United States Patent 7,750,207 (ZEA MAYS RIBULOSE BISPHOSPHATE CARBOXYLASE ACTIVASE PROMOTER) - sequence listing, part 15

SEQ ID NO: 20680 - DNA, 3170 bp, Zea mays
tatttcacgctattttaactatttaaagtctatataatatactatctacatactccagtgctactcaatttgacaatttcaacgacaagaggaccgggaaaaaaaacggaggacgaaagaatgatatgggctactcgacgtctagtggtctgttagggctttggaacgaagctagaggagtgacacatcaaatggcaatggtcttctgctgctcgagaaggagctgaggcatctgttgtgatcaagtgagaacaacatggactctcgtagtatatgcggcctgattctgtcgagcgtcaacaatctggcggaggaagatcatttgccttgactgttctgatcgccagatgggttgacttcggacactgcacggtccagcagttgaaatggtccctttttcaaatgtctgactgtctgagacggtcaaaccaaagcgcgagggcagcagcaaatagatgctcgttcgtgaaacttgaccgcacaccttcttttgaacgatctcactcactcacaccctcggacgcgttttgaggtgctcgcattcgcctccttgtcgacgagccgaccgcactccatgactcgcgagatccccaatccaactgcacgagtttgatgcccaccaacaacctccctcccagcaccgtaacgcgcagggacttttgggccgcggtcccgtcggctacaaacgagagcagcgtcgggttcccacgggtgctgggccgcagattgggcctggcaagtcggcacatcaaatccttttttttaaaaaaaagttgacacgtcgaagagagcagccgcaggaacagcacgcacgacttacactggcactcgaagcccacttctggttccggtggacccgcgtacatcgcaaaggaacgcagcagctcccccgacaaccaccagataaagctgcaagctgcttatcttctcccgtcccataggttgctaggctcggccgtgtagagcagcaagagcacgccgcgccaagcaacaaagagggaccccgcttccatggaggtggtgggcggcgtgtcgctgaggccgtcgccagcgccggcgcgtatccggactaccctgccacccgtcgacgtaggcggacgcttccttctccgccgggtcgcggggcgccagccggcgaggcgcgcgctggtcgtggaggcccggggcggcaggggctggtcggagcggcagatgcagcagcagcgccgcgcgccgctgctgccgaaaatcgaggacgacggcaacccgcgattcgtcatcttcatccgcaccgccaatgtccgtcactagctctagacttctagctgctgctcgtagctcggttggatcggattgggatcttgctacccatccatattggttccgttctgcaaattcgatggcgcaccaccaagatttgtggattttttttgtttagcgcaggtctacttctggtacccgctcaacatcatcacgggcggtacgacggcgaagatcatgctcgccgccaaggacaacttcctcggcaagtacatctacaaggacacgctcgccaggaacctcgccgccgtcatttacaaagtaatcgacgattagcagcagctcttttttggcttcatcatagttcccacattcttaacggccatctaattttactactagtatttgcatagaccagaccatatgtaggctaggctgcctagctaggcatccactcgttcttgaagttggagaaagctttaatgatcaacagctgaccgtgtttgctgtgtgtgtatgtatggaaaggacgaggacgtgatcatagacacagcgaaagagcagtaccgtgtgctcaagaccgaaaatcagtttcggtatggctacaaagttgtggtagttacccaaaactcaatcgcagaagcctcagttgtttgagcaattagttttgtattggccaacaattagatttacttggttctttttttttacatgaacaggagaaagggaacataaggtctgctctgacgacaagcaatgtgatcgaagtacgttgtttccttaatctttctcgagttcttttacaatttcatagccaattatcctagctgaagccccatcattgaacagaacttaaaacgacctatcacctatatatgcttttcaagctgaggtggtacgagatgtttgcattttcggtgagcatgttttgagcgtcctgggtagcctttaatagtaagattactcgtctcagcttccaaagaaggacgagctcaaaaccgtggttgacaaggtgaaggacttctttggcgacgtgactgccggcgccaaagaatcctttgcgcagataacagggtctgctgtcagcaaggaggaagaggaagcagagagcaaagagaagttccgctccaagagacgaaagaagcagcggaagtcgaaggagggcctcagtaagtacgctgggactgcttcactgatgcagtgtcacttgtttaaaccctactatcttcatccttcctgttgcttagtctaatcacgagttttttttttcgtttacatctttcagagacggagaaatgattcagtcagtcacacaagtaaagcaccggctgtagtttcgctatcgatgtccgagaactgttctgtaatttctccagcttccttttttttgtttgttttgtaaaaagacgtcgtgtaacttcattgcgactaacgtgtgctatgccttctcagtaaatctcacaaaatgtgaaggtactccctacgttctgaatcatgagtcgtttttgcggctcgcgaacgggccgtttggatcccttcattttagtggaattagaattcacccaataaaataatttatttagtttggaatttgacattccgtcacttttcaaagttcagaaataaggctatcttaaattcatgtggtgaaagatgagaaataattttatacattagtaaaatttgtttctactctgtaacttacatgacactcttcgtctcacttctttatagtaaaaatgtagcacataaatatttcatacattttgccaataatagtatacaaatatattttacataaaaaccaaattaacttaattgatatatgtcaaaattactattattaaaatggaattcaattccaatgatccaaacggggcgtaaataaaatggatggagtaaagtgtacaaccgtgtattgatttggtttc

SEQ ID NO: 20681 - DNA, 1113 bp, Zea mays
acaaccaccagataaagctgcaagctgcttatcttctcccgtcccataggttgctaggctcggccgtgtagagcagcaagagcacgccgcgccaagcaacaaagagggaccccgcttccatggaggtggtgggcggcgtgtcgctgaggccgtcgccagcgccggcgcgtatccggactaccctgccacccgtcgacgtaggcggacgcttccttctccgccgggtcgcggggcgccagccggcgaggcgcgcgctggtcgtggaggcccggggcggcaggggctggtcggagcggcagatgcagcagcagcgccgcgcgccgctgctgccgaaaatcgaggacgacggcaacccgcgattcgtcatcttcatccgcaccgccaatgtctacttctggtacccgctcaacatcatcacgggcggtacgacggcgaagatcatgctcgccgccaaggacaacttcctcggcaagtacatctacaaggacacgctcgccaggaacctcgccgccgtcatttacaaagacgaggacgtgatcatagacacagcgaaagagcagtaccgtgtgctcaagaccgaaaatcagtttcggtatggctacaaagttgtggagaaagggaacataaggtctgctctgacgacaagcaatgtgatcgaacttccaaagaaggacgagctcaaaaccgtggttgacaaggtgaaggacttctttggcgacgtgactgccggcgccaaagaatcctttgcgcagataacagggtctgctgtcagcaaggaggaagaggaagcagagagcaaagagaagttccgctccaagagacgaaagaagcagcggaagtcgaaggagggcctcaagacggagaaatgattcagtcagtcacacaagtaaagcaccggctgtagtttcgctatcgatgtccgagaactgttctgtaatttctccagcttccttttttttgtttgttttgtaaaaagacgtcgtgtaacttcattgcgactaacgtgtgctatgccttctcagtaaatctcacaaaatgtgaaggtactccctacgttctcaatcaaaaaaaaaaaaaaaggcacgagcacgcaaatggatggagtccaagtgt

SEQ ID NO: 20682 - DNA, 1440 bp, Zea mays
tttcttactcaacccggcataccatgcacgagaagattgtttgcttgtttcagtgcctgtctagcttatagacataatcaagacatgattgatattcaacttctagaccttttcatggataaaagtattctgcacatctgtaagctttggcgatgaatttgcaaaatccagtccaaattcatcgttcccttcccgtgtacgtcgagcacagcattgtcatctgtcagtactatctgtagatcacaccctcacaacagcgactgaaacacgaccagaggccgcttttttttttttttttttgggaacagaacgcacggcctagtgcatggtgttaaatatattattatatgtacaatggacagaatgccaaacactctgcaactcagatacgaaaaagaagattgccataataaatggctatatttttatggtacaaaactacaaacaaagcgtgtggatatgttttgttaggctccagccagtgatcacatcttcctgaggttatcgagccgcgcctgcaggtcatcatctatgccgccatctggcccacctgcggcttcagcctgagcaggaactttccccgctgcgacgggcttcgcaactgcagttgcaggagccttgacaagctctgagttgatatcgatgccaatttcgtcaaggacttgactaaccagctcctctgtctcttcctcctcctcatcgccctccaaggcatcatcgatggcgtcgttcatcacttcactaaccatctccatcttctcgttttgcatctcaaactcccgcatgatcttctgcagggcaggcagattcatctgtcggttcatctgccccatggcttttgtcacacccttcatggcttcacccatggcttgtgttgatttcagagtctgaatacgtagagatacaccttgtagctgggacttgagtgcatagaattttgtgatttggtgtcttgtgcggataagatcctttgccataatttttacagctcccatctgaccctgcttggccaccttcttgatctcgttgatgagcttcttctcctgggcctgcaggccctgcctctccctctcaatctcccggatggacttgtccagcatccgcttattctcccgcagcagctcagcaggagtcttcttcttgccgaagatgaagctcatggcggcgggcggacggtggagcaagacgacgacttgtttcctcggatccgggcggcgactgcgattcggggccggcaagcgagacgctgaagaatcctccttcctttgagggattgggaatttaggattgggctctcttttggagacggagggtttgtttcgatgcgaaggaagggggcagaacgagctttttctgaagttgcggtccgttggcgtgaaccgtgaacgcggtttcgccagcgacagccgagacgcgttcccggccggcctcgaggtaccc

SEQ ID NO: 20683 - DNA, 4882 bp, Zea mays
  misc_feature (3090)..(3090): n is a, c, g, or t
tattagtctaaatggttatgttgatcattaaacatcaaaacttaactataaaatgagttttgatccattttccttatagattcaatacaaccaattctagtacttattggctttgaagacgttagaattcaatcattgatgtcattgcattctaagacatcaaacattgttgacatatttgtaggcgtgtgtagcaccaacctaaccaagtaataatgagcaatgacccaacatagatgcttatatttgtttttcttgagttattaaaaagttacataacacgttatggtgcatccaatgatcagcatgtgctttgtgtggtgtatgtacacccgacattttactttaagaaaagggaccgtttagatgtcttatgatggatttttgttgggaaaaatatgttgattgtttaaccgttggatattaaatttacgatcctgatctccttctccaacattgattctttttccctttttcttccttagccacaaagtcatcccatccactattgctagttcttcctctatttgttgggtgcctcagcctccttcgtcttcgtccctcgcggcgcccggccgccgaagcccctaccccacaaccactctcaaacaaatccatagagaggtagttgtttcatgctacactccaccacctcctctacctccttgttcgccctagaaacaccgttgttttcttcaccaccacaaaccctaaccactcaagaacaacgacaacctaggcgtcggcttcacccaactatcttccaccacatccttggtggtaggcgggcgcatcaccatccctttcgtgaaccgccacaccagcgttgggctgatagcctccccttggttacactctagtcaggaatccactaaattccccaacctctagttatatctcaaaaccctaacacccctaaccggaaccaagtccgccggagttggccctcggtcgaggagaaggatagctcatatcgcacgaaggaatgatgcaacaatctactattgttgaattctttggtaaggaatttgtgagatttctccccataaatttatttcagcggatatttagcatttttccgattctagataagtaacagttttcaattcgatttcctagaatgcgagccatcaggaccgatatagtagtcataatctaataactaaaatgtgctaaaatggaaccaccgaaccatgatactgtcaaatccccgtaattaaatgttgcagcatggaaattttttatacgctttgggcactctccctaactaaattaggtgttttataccatttctgctcccttgatcacgatgacacctattgttgttgtagcggctcttgtatagtattgttcactgtatagcgaatgcgtaataggagttcgagatataaactatgttcttgatttattgatgaagctcgcagttgcaacaagatcatcattggacttggacctcaatctgtgtgacaatctcaatcttctgtgcggtcgtttcctctgcctctgtctgatcaattgatggccagaatgccctttttggctgctgttgcggttgcggcaggaggacgccggcatctcgtcgacctgtcggcgatcgcgccctcagcgggcaactggcctcaggaacaggactccaacatcccaccatggtcgtcatggtcgcgtgagaccaaaaaccaggtgatgttcgtcgcctctgtcctggtattcctcttcgtttgctggtgtgtctaccgcctcttctgccgcgacgacgaggacgaggcgcgggataccagcaggtttgttcgtggaccgtggatcaacgacgacaccgccgaaggtatcagtactccgccgtcgccgccaccgccaccgcagacggacgtggacttggcggcgatgccagcagccgacgtggagctggcgctggccgccatggagctggcgctggcaggcgtggagctggcgccagctccagacgtggagatgacgccaccagtgccagagccggcgccgacgctgaagtgcacgttcagcacgacggatgggtgggcagaggggacgtgctcggtgtgcctgtcggagctggtcgacggcgagaaggtcagggtgctgacggcgtgcatgcactgcttccacgccaggtgcgtcgagaagtggctgcgcgagaacgccacctgtccgctctgtcgcgcccccgccattgccaccgcggccagaggtcgacgtcgccggcggcggagggtggacccaaacctcagctcagcctagctaggaataattaggtggctcttggatttttttttttttttcgcatagttttttttgaacatacagattactttggttaagattataccggcccgtgcgactgaggttttagtaattcgacagtctatctaattaataacaaaaaaagaaatgcatgaaccttgataactataattgtgccattgtgagatctgcatcgatcgaggaggaggaggaggagaccttcgaacatatgtttgtatttgtgtgattttgcaaaatgttgttggaatgctgcaaagtttcatctcttatctcctttattattgaaatggcactacaccggctgatgcttctcatccgtgttttatccttgttcttcaagaatcatcgtcttataattacgtacgtagataagtatttattcgtactcgatggatgcaagttcgtctcaatatgagtggccgtttcctgttctaccgatgcccgtaatgtccgcggcaggaggacgccggccacccggcgaccccgccctcagcgggcacgccgcaggccctcacaggggcaggactccggcggcctctcaccgttggacgtctcgacaacgaacgtggcgtttctcgtcgtctccttgatcgccatctttcgctacatacatccgcctcaaattctgccgcgacggggagacgtggaaggggaccggtcaccggcggcaggaataatggcgaccgtgcaaggcggagcaaccgcggcgggccgacgtggcggcggcaccgcctgcgcgcagtggacaacgtggattttcgacaaataattgtagagagatagagaacagtgaacattctatagaatccttcnatgagaagaagtcttgttaagatcctacaacaacgttgtggtagtcatgttttaaacatctatgattatatcgtaaacatatactagaataaacatagatatatcattcttatcgcaataaaataaaaagatatccaatgaaatcaagagcataaagtttcttactcaacccggcataccatgcacgagaagattgtttgcttgtttcagtgcctgtctagcttatagacataatcaagacatgattgatattcaacttctagaccttttcatggataaaagtattctgcacatctgtaagctttggcgatgaatttgcaaaatccagtccaaattcatcgctccctccccgtgtacgtcgagcacagcattgtcatctgtcagtactatctgtagatcacaccctcacaacagcgactgaaacacgaccagaatgcactccatggcatcggaacttgggaacagaacgcacggcctagtgcatggggttaaatatattattatatgtacaatggacagaatgccaaacactctgcaactcagatacgaaaaagaagattgccataataaatggctatatttttatggtacaaaactacaaacaaagcgtgtggatatgttttgttaggctccagccagtgatcacatcttcctgaggttatcgagccgcgcctgcaggtcatcatctatgccgccatctggcccacctgcggcttcagcctgagcaggaactttccccgctgcgacgggcttcgcaactgcagttgcaggagccttgacaagctgtgtaattgagaagatcaatcaacattgcacatcagtatcatccatctataaggcagcgcattctacatcaggatcaaaatgcgacgatatttttacctctgagttgatatcgatgccaatttcgtcaaggacttgactaaccagctcctctgtctcttcctcctcctcatcgccctccaaggcatcatcgatggcgtcgttcatcacttcactaaccatctccatcttctcgttttgcatctcaaactcccgcatgctcgcctgcagggcaggcagattcatctagtcggttcatctgccccatggcttttgtcacacccttcatggcttcacccatggcttgtgttgatttcagagtctacaaaattggacaccagccaatacaagattttaaagagggctctcatgaatagcagtaacatcagggtctttttgcagtctatggaagattgagtcaactaagtctgtagtcatcaatgtcatcacaaattgcacaaagttaccccaactgagtgtctcaaaataaatacaattcttcaagttgtgtagttacctgaatacgtagagatacaccttgtagctgggacttgagtgcatagaattttgtgatttggtgtctcgtgcggataagatcctttgccataatttttacagctccctgtgaacaatttacggcatatcaaaatatattccatgagcatggaaggaaagcaattgctgccaaaaaaacagtgttcttttcaccatgtaaagcaaaatatattatacgtgttcgaatctgaactaagggcaattgcagccaaaaagacagagcataccataggtccattggacaaaaagaacacaaaaaattgaacaaactaaatcagccagcctatcctgtcaggaggtataaccagctccatttacactgaactaaacagttcgaacatgattgaattcatggcaacaatcgggtgttaagacaaataaccaccgaacacaccgaccattaaaagacaaatgc

SEQ ID NO: 20684 - DNA, 1524 bp, Zea mays
aagcgacacgttatcgacaagcacgtctccttccttccccacccactgctccacctccatcctccatcctccatggctcctccgccgcggcgaaacccgccgcaccagaaccccacccggaggaagggcgaggagccgtggctcgccgcgagcctccgcccggcgaacttcctcccgggcctcgccatcgggttcctcctaggcctcctcctcgacttgtcctcgtcgtggaggcccaagtccagcccggcgccggctccggccgccgcacccgcgcgggcctccagctccaagcgggcgtcggggacctcgtttgcctcgggcggcgaggagcttaagatggttttagtggtgcgtcaggacctcaagatgggggctggtaaaatagcttcccaatgtgcccatgcagcgactggcttgtacgcagaattgttgtcaagcaatcggggtttgcttagacaatgggagcaacttggacaagctaagattgttttgacatgcaagaatcaacaggaaatgaacaggctaaaggaaactgcagaacatagaggtatcctacataagttcatctccaaggggaagcttgctgttggttcggtgcacccccctcttttcctttgaatcatccataggcttctttttttttacttagctaaaaattgtataacctgtgtgatttcctaatctgcaaccaccaaatcttagccagatcggcactgaacttttgctatatgtactgaacttttgagccaactaacgcctcattcattgctaatctcttgcagatgcagcgactggcttgtacgcagaattgttgtcaaggtgttaatgcggtttgcactgtttcttcattaggtagttttagttgaaggatggctgatgtatattttctctttatagagatactgtaccctatgtaggctcaatttgcgtagatacagagatgctggtactcattgattgattttgaataaatgctgttatactaatcaaaataatatcgagtgtatttctgcatgggtactgggacctgtctttattggattgaaggctcacaaaccattttatcttgtctgagtagctgctgagttttaaccactgaagagtgcactatttgtgttgtccgtacggccttaagtccttaactatcttatcaccaatctgtggagtcctcggactcccagagctatggccttaactattccatcacccatctccagagctaaggccttaacactatcgcaccatccatatgtgatcttaaatacagtattgactccttttttttttcattatgttgtagtccttcatacaaaaaggtaacttttcaaacaactagtgagtggtggatgtagactgtattgagattaaatggatggaaagtgcaggtttcagtaatcttatttttccacccttattttttttcctgtgaagcttgtgtcaatgagctatttagctaccttgtgttatcagtagtttgtgaaaaccgaggcaccccagactcatttggcatatcttctgcag

SEQ ID NO: 20685 - DNA, 1868 bp, Zea mays
tctccgcgccctgccacggcgcctcgagctctggctgccgtgccttgcggcggtcgagagtaacccggccccgccacccttagctccgccaccgccggacgaggcgagcgccggctcaggcctcgatgcgagggccgggggaggtggcggtggtggtgacggaggtggcggcactgatcttgggtggttgagggctttcccgcatgtgttcactgcgtcaatggcaaacttcctattcggttaccacattggggttatgaacggtccaatagaagatattgcaacccagcttggttttcaaggaaatccgttcctccaaggtcttgtggtgagcatattcattgttggtgccttttttgggagcttaggctcatctgcattagtagataagttcggctgcaagaggacccttcagatcgacagtattccattgattattggagctctcctgagtgcgcaggctgattctttggatgagatgcttttgggaagattccttgttggcatcgggatcggcgtaaacactgttcttgttccaatatacatctctgaggttgctccaacaaaatataggggcactttggggactctgtgtcaaattggaacatgtctaggcataattgctgcactttccttggggataccttctgagagtgatccacattggtggcgaacaatgctttatgctgcatgtgtacctgggattcttattgttgctgggatgcaatttgctgttgagagtccacggtggcttgccaaggttggaaggttcgatgatgctagaaaggttgtagagagcctttgggaaccttctgaagttgagaagtccatggaagagatcaaagctgttgtgctaaatgatgattcacggggcagctggtcagaccttctggtggaaccacataatagagttgcattgattggaggatcccttttctttctgcaacagtttgctggaataaatggtgttctttatttttcatcattgacattccgtgatgttggtatcactagtggtgctttagcaagcttatatgttggaataaccaattttggaggggcactagttgcttcaaatttgatggacaagcaagggcgaaagaagcttttgataggaagctaccttggaatggcttttgcaatgttccttatagtatatggtattagcttcccgcttgatgaaggagttgcccacagcttatcaatcgctggaactcttttgtacatttttacttttgcaattggtgctggaccagttaccggtatcattataccagagctcagcagtgctcggacacgctcaaaagttatgggcttcagtttcactgtgcattggatatgtaactttctggtgggactatttttcctggagcttgtgaacaagtttggggttggagcagtctatgcaggttttggtggggtctccctgctgacagcactcttcgcctacaatttcatagttgaaacaaaaggacgttcgcttgaggaaattgagatgtccttgagcagtgctacccctggcaagcaagagtagaacatctcaattgtatggacaaactgaacaactgacgggaggaatttaataagagcagagggggcctaatcccatgaatcttcagcagcagcagtttgttgcaaacaacatcaactcctatagataatgagcacaatcaaattcagcttttctttggtagcatgagaatcgttgtacaatattaaaaagggtgaagaaaatgcccctttaaatttgttttttttgtacatctgatgtatatattttagtattttacgccttctgtagtacgtaaaataaagggaacagatctttctgatattactcgattgatgaatttggaatattcgcttcc

SEQ ID NO: 20686 - DNA, 1583 bp, Zea mays
gaatgaagatcggcatgagctatttatttaagaaacaatttttggactcgaatccaaaaaaggcttcctagatagaatctctttacatgataataaaggtcttcaacaaacattattcaggaattgatacaacctgtatatgcataaaaacagataaagtaggaactacaaactagtcagcctatagcccctccaggtaacttgttttattgccaagcgttgatcgtaccataccaactgaagctgaaggcctctcattcagcttattctggttttcactgaatattctatatatccccagcagaaatggaagggaaaggaaagtgtataactaatcacatggtatgagaaggacatcaacttctttcagcaaggctttcatagaagagtatgtagccattatcagtattaccactgaactcctgcggtgagccaaagaatgcctgtaccatggactcatcagtcatctcaacgttctcgtcatcaaagaataaccaatgattgtggctcttaaccaaactgatatagtggccatggtttggcccacttccaacatgaactaccacagcgaaaagggagtattccaagtccgaattatcaactgtattaagaagtttaagctccagtgggaaaaccactctgtatgatagttttttgtagcgctgaagctgctcaatatacttgaaccgcttgagatgaattactagaatgtttggtggtttttttattttcatccttttttgtgcttcctgcaaactgcagcatttgtcacagaagaacttgtcctctgcattcaaagtctctgttgagctgaagttcttaagacagctggtgagtgaactattctgttcgatgtccaggctcaggtcaaaaaatgtttcatctctatcagtcacagtttcacatctcagacaccttgtttcattagtcaatattccctggaagcatttatgaacccatgtgacagctaattctttgtgactaccattgggttggccatcaatagggccatttgaattcttttggagtgagagattttgaagagactctcttgcagcattatgttctttctctagaatgtcaactagctcattcagtaaaaaattcagaaactcatgagcatcctgatgcatatagctgcggaaaatctcattttgtttcttcaatcgttgtataaaacgcttaggagcaataacccctgttttcttcttctggctactgatctgagagaacagatcagccaggcaggttagcatgttctcttcaacatctccggtgtttttattgtttgcatagtactccagcaattgatcacggaaaggaacacaaaaataaagtgcctgcagcacgctgttgcagtagcaggtgtttccgaagttctcgaggccgaagtagcgctcgccctcggggaactgctcgcccagcgccttctccaacctggagcccgccgcgcccatcaccgcccccgcccagctcccattgcccggcgatcggcgcgaggggcctgtcgctgttctggccggctggggcggtgcgagacaggatttgtactgtggcgcagtgaaactgttgcgattgggcga

SEQ ID NO: 20687 - DNA, 1452 bp, Zea mays
  misc_feature (35)..(35): n is a, c, g, or t
  misc_feature (44)..(44): n is a, c, g, or t
tattattttttaaaatttaattttttatttttttnttttttttntttttcaaatcccctctctcactcctccgcacgtctatttggatcaacatcatgtggttcagattagaagtttacatggttgcattttttttttttttttcgccggatacgttccccacatcaaagcttgtatgagactcgtactacgacaagtgccaaactcatgatgcatgagctaatctcaagagacggtccattttggatttacttttacaacacatttacatgattatcaatgttctcgatgaacatcccacaaatagatgttttacctgccccgtgctatttacagttctcatgcgatgcagctgcggagactgaccacacgtggttcccaaatccctcttgtgtgattggtcatatgttattacgctccggactgcaacagataatcatgtacctacacaaacaaacctaggtttcccttggctcggatctcggcaaagagtcttgcctcgttagctcatagtttgactctggactgctgttccttgtgctgacacgcattgagcacaggaagaagaatgaagaagtataaatggttatgtgccatatgctgtgccaaatccagtagttgttatttgattccagcttccagctgatagccgcaaaagacagtgtcatgaaacccaaaagtaagaatatccaacggaagcgtttgttcaccatctccagagtaatctggaacaaagttctgaggtttggccaactttgaggcatattaaggttaattcgtgagggccagcatataaaccttcgtgctgtagagaactccaatagccaccccataagcaggccaacagaaccaatggcaataacaattccaatatttgcagatcttgttgcaccagttgcggctaaaagagccgtgaggataaatacagcagtatgcattgctctctttgaaacttcatcaattgtagccatatatatgaacgtacccacgacagccatgaaggaaagccagaagtccaaaaactgcaatacacgaaaagacagaatgcaccaagtgccaacatcacatgaatggtataatgcactggaaattccactagatgtgtaaagaatccattctgcaaatgccttttgtcggagggcccagaaggcaggtaaaatagctgcaccatttgatgcgattagaaaaacagactgccaaatgtgcccattaggggaaactagctcatcgctgcaatcaaagccaccatgatcgcgatcacatgtgcagaagctgtagaaagtcagcccactttcatcaactgaggaatgacacacacctttctgattgcagttcctatggcatccctgaagagatatagacatgtatgtttgagaatttgccgtatcacttggatgcttcaccccaaagcaccaagttccctctttagcataaaaaatcgatagatccatg

SEQ ID NO: 20688 - DNA, 1723 bp, Zea mays
cctcgaggcctgccccggggccgccggtacaatcagatgcagatgctaatgatacagtccgtccagaccccacccgccgccgcccacctccgcgctgctgcgcccgccagcacgccaccgctcctcgcgcgtaggctggccggttctcgtccagctcccgcctccgccggaacaatcagatgcagccgatgctaacgctacagtccgtccagcccccacccgccgctgcccacctccgcgccgctgcgtccgccaagacgccactgctcctcccgcgcagagcggccggtcctcctccagcttccgcctccgcctccgcctcggctgagttcccaggatccgttccagacagcgctcagatggcgccccgacggcggcggcgccggagcgtggccggcatcgaccaggacgaactcctcgatcccgaggccctcgcggaccccgacagcggcttctacgagatcaacggcgtgaggctgcaccacaaggtctgcagccacgaggatgaggactcgtccagcgaccagtccaccggtagtaccattgcctcagactcagacgctgtcctgaaaagccagattggcctgcccatactgctgctgcacggcttcggcgcgtcagtcttctcctggagcagtgtgatgcggcctctcgcccgcattgtccgtgccaaggttcttgcgttcgaccggccggcgtttgggctgacatcccgggccagtcgctctgccgatgacgccaagcctctcaatccttactccatggcgttctcggtcttggccacgttggcgttcatcgactaccttggcgctgagaaggccatacttgttgggcactcagctggttggccttgtagcagtggatgcatactttgaggcaccggaacgggtggctgctctcgtgctagttgcgccggctatatttgcaccaaggaaggcggtgaaagagggccagtcaggggaagaagaaggagggcagcaagcacagagggttcccaacgatgaaaattcgcctccaaatttgttcgctaggatttcgggaggatttcttgagctatggaagcacgttgcggggcttgttctcaagatgatcacagcgatacgagatgtggtccgatctttgtgtcttaaagctgtcgttgcttttcttcggtcatcgttgggtgtggtgctggtaagatgggtgatggataaatttggtatactgggcgtccggaatgcatggtatgacccgagcaaagtaactgatcatgtcatacaaggctacacaaagcctctaaaatccaagggttgggagacagctctgctggaacacaccgtatccatgatcatagattctgtgtctgcatcaagagtaccagtttcaaagaggctttctgagatctcatgcccagtgctagtggtgacaggtgacaccgatcgcattgttcctgcttggaatgccgagcgtgtggcacgcgctatacctggagcaacttttgaggcgatcaagagttgtggtcacttgccccacgaagaaaggcctgaggaattcctgtccgtcgttgaaaattttctacggacaacgtttgcaaatccaaatgaacaagtatttcaagcagctgtatcatgaattatgtgttgagtacgatctatttgctttataataaatcttaaagacccactcgtgtacaatgagagtggaatttggagtttaagcacatgagaagtaaaagaagttgaag

SEQ ID NO: 20689 - DNA, 3873 bp, Zea mays
acatagaatcacatacagaaaatcaggatcgccaaacacttagattcgctagtcaacagattctcctcacaaccaacttttctaggaattcagcttctcagggaaaaaaaactgtcctaaacaggcccgtgagctctcagcgtaaatctgaagattgtcggttgtatctggtggaagtaatgcactaagcacagttttttgtgattaaatgagctctagactcatgtactatctccgttctcgaatagttatcatccgctagtttattttaaaactaaactgcaataaataaagaagaatggatggagtattttgtaaaccttaagatgactgcatgcgccgccccactcaagatagaagagcagaagctttctggagacattgacatgcggagactgtcttaaagttaaatttatcaattctaaataaaagatcttcttgagacattgacatgccgagactaccttaaagataaatttatcaattctaaacaaaaggttcttgttgtatcaaaagctggatgtgtagcaaaatagttccatagtagattcactagtatatctagattcaattttttattcgtggagttatttcagatatcccctcaatcttatggtctgatactctgattgtgttgtgcagtcaaaagaatcatagacaccatagatctctggcgattgttgcggttggcgacacaaaattggaacttaatgtgttccaaatagcgacaatgcctcactcgaaacaggtgtggcaattgcagcttcatttgcttccaagcaaagaggaccaatgtttcagtaaggttgtttcactcactattttaaactctataatataatttacaatttaaaataatgttttatatgactatatatatgctcagtcgattacagtctaataacgggacttctaataacaggacttttgattgtctttgtctacaatggtttatcaatttcacccttcctacacatgaaactcgcactaggtacaacagctatgacagagaacaaaaaggtagtcttttgttgactaaggccttgttcgtttctgccggattggtaggtcggaacgattcctgaccggattgtttctctaatttatataaactttgattagctggaacgattccagttataatccgacggaaacgaacaaaggactaagacgtctccaaccgtctcctctcccctcaccgtatttgctattgtggtctccaaccgtctcctctctcctcaccatgtttgccattgcattgcatgtacaacgtcacaatatactctttcaacaactcaccccgctctatgaatgagggagttttaagggcatgtttggttcgtatctaactgtattacactttgcataaggttagtcgttcgaattgaagaactaaccttcggcacaaaaaaagttaggcaaagtgtagcaaattaagcagtgaaccaaacatgtccttaatctccctgcttccattatcttaatttaattacctgataataatgtgttgtcttgttcttgattcatagcggttgaaaataagtgaccaacaatattcgttccaaatttttaactacccgtatccgttcatgtatcctggagaaatatattacgttaggatacagaataactttgtatctagttcctgttttcatccctaagcagacagcactgtcgcaagccataatctgcaataacaacatataattgtgccatccaaaaaacgtaattattgtttgttcgagataatgcgctaataacgtgtggctagttctagcaactggatgtgggtgcctgcagtgtgggcccgagcaaatccatctcttgcgctcgcagacaacggccttcccgccgccggtacaatcagatgcagatgctaatgatacagtccgtccagaccccacccgccgccgcccacctccgcgctgctgcgcccgccagcacgccaccgctcctcgcgcgtaggctggccggttctcgtccagctcccgcctccgccggaacaatcagatgcagccgatcctaacgcgccagcccgacagtccgtccagcccccacccgccgctgcccacctccgcgccgctgcgtccgccaagacgccactgctcctcccgcgcagagcggccggtcctcctccagcttccgcctccgcctccgcctcggctgagttcccaggtatcattctctattgctttgagaaagaatttatttatctctggaatgcatacatagacccctttcggtgtagtcttcttggatagttggatcaataatctctcacatttctactattctacttccctccgtctgaccaggcagcgaatttgtcgctgccggcccccgaatggcggcaccccccccagggcccggccgggacgagcccccagcatgacacagtactgaaccccgggggcaaatgcaggatccgttccagacagcgctcagatggcgccccgacggcggcggcgccggagcgtggccggcatcgaccaggacgaactcctcgatcccgaggccctcgcggaccccgacagcggcttctacgagatcaacggcgtgaggctgcaccacaaggtctgcagccacgaggatgaggactcgtccagcgaccagtccaccggtagtaccattgcctcagactcagacgctgtcctgaaaagccagattggcctgcccatactgctgctgcacggcttcggcgcgtcagtcttctcctggagcagtgtgatgcggcctctcgcccgcattgtccgtgccaaggttcttgcgttcgaccggccggcgtttgggctgacatcccgggccagtcgctctgccgatgacgccaagcctctcaatccttactccatggcgttctcggtcttggccacgttggcgttcatcgactaccttggcgctgagaaggccatacttgttgggcactcagctggttgccttgtagcagtggatgcatactttgaggcaccggaacgggtggctgctcttgtgctagttgcgccggctatatttgcaccaaggaaggcggtgaaagagggccagtcaggggaagaagaagaaggagggcagcaagcacagagcgttcccaacgatgaaaattcgcctccaaatttgttcgctaggatttcgggaggatttcttgagctatggaagcacgttgcggggcttgttctcaagatgatcacagcaatacgagacgtggttcggtctttgtgtcttaaagctgtcgttgcttttcttcggtcatcgttgggtgtggtgctggtaagatgggtgatggataaatttggtatactgggcgtccggaatgcatggtatgacccgagcaaagtaactgatcatgtcatacaaggctacacaaagcctctaaaatccaagggttgggagacagctctgctggaacacaccgtatccatgatcatagattctgtgtctgcatcaagagtaccagtttcaaagaggctttctgagatctcatgcccagtgctagtggtgacaggtgacaccgatcgcattgttcctgcttggaatgccgagcgtgtggcacgcgctatacctggagcaacttttgaggcgatcaagagttgtggtcacttgccccacgaagaaaggcctgaggaattcctgtccgtcgttgaaaattttctacggacaacgtttgcaaatccaaatgaacaagtatttcaagcagctgtatcatgaattatgtgttgagtacgatctatttgctttataataaatcttaaagacccactcgtgtacaatgagagtggaatttggagtttaagcacatgagaagtaaaagaagttgaagaaaacttatatagtttgtctcctgcttttttttaaacgaaaaaaaaaaaaaaaaaagcggcc

SEQ ID NO: 20690 - DNA, 3493 bp, Zea mays
  misc_feature (2800)..(2800): n is a, c, g, or t
tgaaaagaggtgtttggcacaacttttgcatgagccagagccgaagctgataaataagccctaccaaaggggccctaaatatcttcggtaagggtaactgaatgcccaggaaaaaccggtagaacaataagcgaagcgccagtcatccacggccgaaatggatccagtccagtaaaacacggaaacggttagggcataaaatcaaaaccacccacgcacccgatcaaaaactacagggtactatatatataaaacgaaacgagcagatgaaaaatatcccccacccaaacagaccacgcgagagagggggaagagagagccgcgccgcgtagctgcgtagagttgcctgcctccgctgccggccgcactacctaatcgctgcgcctgttttttcccaccgccagatggccgccgtcacgccgccgccgcagtcggacctgtcgccgcagacggggcgccctgcctcgtccgccgccaccgcggccaagccaggaaggggcgcagcgggtgccaccgggaggctggtggggaagtacaagctggggcgcctcctggggcacggcaccttcgcaaaggtgtaccaggcgcggcacgtcgacacgggggaaagtgttgccatcaaagtgcttgacaaggagaaggccgtggagagagggctcgtctcgcacatcaagcgcgagatcgccgtgctacgccgcgtgcgccaccccaacatcgtgcacctgttcgagatgatggcgacgaagacgaagatctacttcgttatggagctcgtccgcggcggcgcgctcttctcccgcgtctctaagggccgactccgagaggacaccgcgcgccgctacttccagcagctcgtctccgccgtcgggttttgccacgtccgcggtgttttccaccgggacctcaaacccgagaaccttctcgtcgatgagcacgggaatctcaaggtgtcggactttggactctccgccgtcgccgatcagttccatcccgacggcctgctccacaccttatgcggcacgccggcctatcgggcccccgaagtgctcggccgccgcgggtacgacggcgccaaggcagacgtgtggtcgtgcggtgtcatcctctttgtgctcatggccggatatctccctttccatgacaaaaacatcatggccatgtacaagaagatttacaagggcgagttccgctgtgcgaggtggttctccaaagaccttaccagcttgctgatgcgcattcttcacactaatcccaacactcggatcactttgccggagatcatggagtcccgctggttcaagaaaggattcaagcctgtcaagttctatatcgaggatgaccagctgcataacgttatagatgacgaagatggcctgttagatatgggacctgctggtcctgttcctccaccattgccacctccaccgccacctctacctccaccaaaggttgatggtgatgaatcagggtctgactcagactcgtcgatctcatcctgccctgcttcaatgttatctgatgagagccaaaggccccgtggctctctaccacgtccagcaagtcttaatgcctttgatatcatatcattttcaaggggatttaacttatcagggttatttgaggagaaaggggatgaagtgaggttcatctcggctgagcccatgtcagatatcataaccaaattggaggacatagcgaagctgaagagcttcaagttgcggaggaaggactggcgcatctgcctggagggtacaagggaaggagttaaggggccattaacaattggcgcggagatatttgaactcacacctccccttgtaatggtggaggtaaaaaagaaggcaggggataatgaagagtacgagaacttctgtgacaaggaattgaagccagggatgcagcaccttgtccaccatatggtccgagctccaagtatgctgcttactgatgccaagtagatcgaaaggctttgtaacttttactcacattttattatgatatgtttgttgcattgataattccatcatgaattttctggtccagatattctcttgctaatatttgaacgtactgattttactaattacatgttggaaacaagcgaggtataaaattgtctgaagaacgattacttgaaatgcaccgccactttatcaaaattaaaattttacaccattgttctagtggctctgaagttgctttacgaatgatttctccatttctaggtgtagatcacacgttggcttcgccaagtgtcacgtgcacaagttatctccggcatcccacttgattactttttcctcgtagtttgactagataactaacttctgtagttattagttagaccaagacatttttctctatcacatcttcacttttgaaagcttctgctgctattatccacattctgttgaaacttgccttatgagctcgcaaataaaaatacagattgaatcaatgaacgacttagtctctggtttatttacctttatgttcttacaccagcattaattactttcatactattgttgcatctagctctgagtaatctacaccccttgttattgaatgatttattaaaattttacacctttttattgaatggtataaagtgaagaaagaatgaagctttcattctttttattccatgaggaaacttttctcagaagctttcttgcatactagttcaaactgggaactttactctctgcctctggtgtatcgtttttatccatccgtcataaattatagtaatgttatgacttcttcctgcattagggttattcaggtttacttttgngatgatggcagtaggttgtattcactatttgttgtatgtcaggtgttgatttgtggggtttgtatgctggtggctttatgttaaattttctgtgtagtaacgtaatgttccatacatgatttttgcattcttgatccataatcgtcatttgtatgcagtttaatgataacgcccacttattggatccatgttgagcacttaatttgacagacattcataattataatgaaaaacgtggagcgcattaacacatccaaatcttgctcatgtctgcaggcacaatcagggttagttgaatgaaaatttaagcacgattaatcctgtcagacacacacacacacaagtgtcattttgggcttctttttctctattaactgccttctcttaagatcatccactaggatcatattagttgttagttgctgacacttagaagtattcattccccatcggccacaaagaaatggtttgtaatgtgatgtactctttctcttcttttttatttgtcgtgttttagtttaaaaataaattaacgagttacaaatattcgagaacggagataatattgactgttttatctgacaatttcctttgctcattgcagggctttgaacttaacatgcacggaactattgataacaggaatgacattccgacaggattgacattcggactttcggagccgcatgaggc

SEQ ID NO: 20691 - DNA, 2111 bp, Zea mays
  misc_feature (2050)..(2050): n is a, c, g, or t
  misc_feature (2056)..(2057): n is a, c, g, or t
  misc_feature (2064)..(2064): n is a, c, g, or t
  misc_feature (2075)..(2075): n is a, c, g, or t
  misc_feature (2089)..(2089): n is a, c, g, or t
  misc_feature (2096)..(2111): n is a, c, g, or t
attcggcacgagagcagcgcagctgcacagaattgttatcgcagggggcattaagctgcctgcctccgctgccggccgtgctacctaatcgccgcgcttgtttcccaccgcccgatggccgccatcacgccgccgacgcagtcggagccgtcgccgcagacggggcgcccggcctcgtctgccgccgccgcggccaagcgtggagggggcggggctggtgccgccggcgggccgctgatggggaagtacgagctggggcgcctcctggggcacggcaccttcgcgaaggtgtaccacgcgcggcacgtcgacacgggggacaacgttgccatcaaggtgctcgacaaggagaaggccgtgaagagcgggctcgtcccgcacatcaagcgcgagatcgctgtgctacgccgcgtgcgccacccgaacatcgtgcacctgttcgaggttatggccacaaagactaagatctacttcgtcatggagctcgtccgcggcggcgagctcttctcccgcgtctccaagggccgactcagggaggacaccgcgcgccgctacttccagcagctcgtctccgccgtggggttctgccacgcccgcggcgtcttccaccgcgacctgaagcccgagaatctactcgtcgacgagcaggggaacctcaaggtatcggattttgggctctccgccgtcgccgagcagttccgtcccgacggcctgctccacaccttctgcggcacgccggcctatgtggcccccgaagtgctcggccgccgcgggtacgacggcgccaaggcagacgtgtggtcgtgcggtgtcatcctctttgtgctcatggccggatatctccctttccatgacaaaaacatcatggccatgtacaagaagatttacaagggcgagttccgctgtgcgaggtggttctccaaagaccttaccagcttgctgatgcgcattcttcacactaatcccaacactcggatcactttgccggagatcatggagtcccgctggttcaagaaaggattcaagcctgtcaagttctatatcgaggatgaccagctgcataacgttatagatgacgaagatggcctgttagatatgggacctgctggtcctgttcctccaccattgccacctccaccgccacctctacctccaccaaaggttgatggtgatgaatcagggtctgactcagactcgtcgatctcatcctgccctgcttcaatgttatctgatgagagccaaaggccccgtggctctctaccacgtccagcaagtcttaatgcctttgatatcatatcattttcaaggggatttaacttatcagggttatttgaggagaaaggggatgaagtgaggttcatctcggctgagcccatgtcagatatcataaccaaattggaggacatagcgaagctgaagagcttcaagttgcggaggaaggactggcgcatctgcctggagggtacaagggaaggagttaaggggccattaacaattggcgcggagatatttgaactcacacctccccttgtaatggtggaggtaaaaaaagaaggcaggggataatgaagagtacgagaacttctgtgacaaggaattgaagccagggatgcagcaccttgtccaccatatggtccgagctccaagtatgctgcttactgatgccaagtagatcgaaaggctttgaacttaacaacagcacttcgcacggagctactggtaacaggcgtgacattctgagcggcatgaggctagaggagacagttgagcacagcacagttgaccagaagagatagtcgccggaacaaaaaccttgaccagttccacagcgctgtagtttcgcagatgatgagcagctcggcatctcatgactgaataaacgcaatgcccgccatggagggagactccggtgtctttcttgtacctgaggtggttaagttgttactcgaatgctgtatcacgagtggtgtagtcctgctattcgtaatatttcgattaaccatcatgctattctgtcaaaaaaaaaaaaaaaaaaaaaagtgggttattntgtttnntcctttnctgtttggggncctctcttcctttnttttttnnnnnnnnnnnnnnnn

SEQ ID NO: 20692 - DNA, 2028 bp, Zea mays
cctcgaggccccccccgttatcgcagggggcattaagctgcctgcctccgctgccggccgtgctacctaatcgccgcgcttgttttcccaccgcccgatggccgccatcacgccgccgacgcagtcggagccgtcgccgcagacggggcgcccggcctcgtctgccgccgccgcggccaagcgtggagggggcggggctggtgccgccggcgggccgctgatggggaagtacgagctggggcgcctcctggggcacggcaccttcgcgaaggtgtaccacgcgcggcacgtcgacacgggggacaacgttgccatcaaggtgctcgacaaggagaaggccgtgaagagcgggctcgtcccgcacatcaagcgcgagatcgctgtgctacgccgcgtgcgccacccgaacatcgtgcacctgttcgaggttatggccacgaagactaagatctacttcgtcatggagctcgtccgcggcggcgagctcttctcccgcgtctccaagggccgactcagggaggacaccgcgcgccgctacttccagcagctcgtctccgccgtggggttctgccacgcccgcggcgtcttccaccgcgacctgaagcccgagaatctactcgtcgacgagcaggggaacctcaaggtatcggattttgggctctccgccgtcgccgagcagttccgtcccgacggcctgctccacaccttctgcggcacgccggcctatgtggcccccgaagtgctcggccgccgcgggtacgacggcgccaaggcagatgtgtggtcgtgcggtgtcatcctctttgtgctcatggccggatatctccctttccatgacaaaaacatcatggccatgtacaagaagatttacaagggcgagttccgctgtgcgaggtggttctccaaagaccttaccagcttgctgatgcgcattcttcacactaatcccaacactcggatcactttgccggagatcatggagtcccgctggttcaagaaaggattcaagcctgtcaagttctatatcgaggatgaccagctgcataacgttatagatgacgaagatggcctgttagatatgggacctgctggtcctgttcctccaccattgccacctccaccgccacctctacctccaccaaaggttgatggtgatgaatcagggtcggactcagactcgtcgatctcatcctgccctgcttcaatgttatctgatgagagccaaaggccccgtggctctctaccacgtccagcaagtcttaatgcctttgatatcatatcattttcaaggggatttaacttatcagggttatttgaggagaaaggggatgaagtgaggttcatctcggctgagcccatgtcagatatcataaccaaattggaggacatagcgaagctgaagagcttcaagttgcggaggaaggactggcgcatctgcctggagggtacaagggaaggagttaaggggccattaacaattggcgcggagatatttgaactcccccccccccttgcaacgggggaggtaaaaaacgaaggcaggggataatgaagagtacgagaacttctgtgacaaggaattgaagccagggatgcagccccttgtcccccatatggtccgagctccaagtatgctgcttactgatgccaagtagatcgaaaggctttgaacttaacaacagcacttcgcacggagctactggtaacaggcgtgacattctgagcggcatgaggctagaggagacagttgagcccagcacagttgcccagaagagatagtcgccggaacaaaaaccttgaccagttccacagcgctgtagtttcgcagatgatgagcagctcggcatctcatgactgaatccccgcaactgccccccatggagggagactccggtgtctttcttgtacctgaggtggttaagttgttactcgaatgctgtatcacgagtggtgtagtcctgctattcgtaatattccgattacccatcaaaaaaaaaaaaaaaaaaaagggcggccgcaaccccccac

SEQ ID NO: 20693 - DNA, 1872 bp, Zea mays
atccccctgcactaccattggattaaggctaggaactattcgtgactaatccatgttaatacaaataaacaaaacaattctgcgggaacgaactcaacaaaaccgtttcataataaatgaacaaaaatggtagattgaactgtttacaaagtggaatttgaaataatgattgggatagaggatgagatagagagtgttggagatagtattaagtacttgtgacgcaccagtatatatatgtatgcatatataataattaatatatacaattaataaaaaaaagttaaagaaaatcagtgccggattagattgcaacggcaaatcgcatcacatgtccaacaaaaatatctggaactgtacgacattccatgatgacccgctgcgtgccgcccggccggggcctccctgtttcctttcctttttgcattcccacccacccatcccctcaaaattcgcagcgtgtctcttcctccatcgcagcgtgtctcgtgctccccccaggctcctcttcctcgctttccctccaccccgggcgcaaaccctaaccctaccgtcgctcgccccgcggcgtctgccaatggcgcgccccgtgtgagtgtgcgcgagagaggggtagaccttgaggccgctacccggggaggagagcgagagatgtataaacaggggggagcggggggaggggctgggctggaccggaagcggatcaacgacgcgctggataagcatctcgagaaggcggtcgcgtcgccgtccacgtcgagggggtcggcgggcggcgggcgcgaccaccaccgcctcgtcgtgccgtcctccgtgtcgtccatccccaagggccgctgctccgaaggggagtctgattctgatagtgaagcatcggatgttagcggctctgatggagaagacacctcatggatttcatggtattgcaacttaagagggaatgagttcttctgtgaagtcgacgatgattatattcaagacgacttcaacctttgtggtctcagcagccaagttccttattatgattatgctctcgatctcattttagatatcgagtcatctcatggtgatatgttcactgaggaacaaaatgagctcgtagaatcagctgcagagatgctttatggtctgatacatgcacgatacattctgaccagtaaaggactggctgcaatgctggagaagtataagaactatgactttgggcggtgcccgcgtgtttactgctgtggtcaaccatgcctgccagttggacaatcagacatccatcgatctagtaccgtgaagatatactgccccaagtgtgaagacatctactacccacggtccaagtaccaaggcaacatcgacggcgcatactttgggacaacgttccctcatctgttcctgatgacatacgagcacctcaagccacagaagctctcgcagcgctatgttcctcgtgtctttggcttcaagctccacaagccatgaacctcatgtatttgtcttttaaactcctcaagacgtggcactgggggcatgcgggagttttgcaatccttgaagacttgcatataagagcgccattggcaggtcagtggattggtaaaattctatcatgctgcagcgtgcttgtaccttagctggctggcacctatccaacatttgaatgtagctctaaggatatcaatgttgtaacctaactgctattgttctttgattagtaaaccaggagccccccctacaatgtagaatatggcaattatttatggctttgcagaaaataacaacccttcatctgcttggttctcgtaagatggccctttaattttgtagtttgcgaacttctattttgaaatgtgatttgcaaaggtgcgtcatctcaaaaaaa

SEQ ID NO: 20694 - DNA, 1534 bp, Zea mays
ttgggtacctcgaggccggccgccattcatcatcatcagctagctgcttggattccgaccgctgtttcctatcctttttcattcccacccgcccatcccttcaaaattcgctgcgtgtccctctctctccctgcgctcgtgctccgcccaggcccctttcctccaccgcgggcgcaaaccctaaccctacagccgctcgccccgcggcgcctgccaatggcgccccccgtgtgagtgtgtgtgagaggcagagacctagaggccgctacccggggaggagagggagggagagggagaggctgatagatgtataagcaggggggagcgggggtaggggctggtctggaccggaaacggatcagcgacgcgctagacaagcaccttgagaaggcggtcgcatcgccgtccacatcgagggggtcagcgggcggcggcggtgtgcgcgaccaccaccgcctcatcgtgccgtcctccgtgtcgtccatccccaagggccgctgctccgaaggggagtctgattctgatagtgaagcatcagatgttagtggctctgatggagaagacacctcgtggatttcatggtattgcaacttaagagggaatgagttcttctgtgaagtcgatgatgactacattcaagacgacttcaacctttgtggcctcagcagccaagttccttattatgattatgctcttgatctcattttagatattgaatcatctcatggtgatatgttcactgaggaacaaaatgagctcgtagaatcagctgcagagatgctttatgggctgatccatgcacgatacattctgaccagtaaagggctggctgcaatgctggagaagtataggaactatgacttcgggcggtgcccgcgtgtttactgctgtggtcaaccatgcctgccggttggacaatcagatattcatcgatctagtaccgtgaaaatatactgccccaagtgtgaagacatctactacccacggtccaagtaccaaggcaacatcgacggcgcatattttgggacaacgttccctcacctgttcctgatgacatacgagcacctcaagctacagaagcccttgcagcgctatgttcctcgtgtctttggcttcaagctccataagccatgagcctcatgtatttggcttcaagctccataacccagagttttgcgagatcaaggtccttgaagactacatataagagcgccattggctacatataaaagcgctattgacagatcagtggattgataaaactccaccatgcagcggagcgcttttaccttacctggctggcacctaccaacatttgaatgtagctctaaggataccgatgttgttgtaacctaactgtaattgtttttttgattagtaaaccaggaccccgtacgatgtagagtatgggcattatttatggcttatgcaaaaaaaatcgttatgctgtcccaggctcccagcaaccctttacctgttttttttagatcctttacctgcttggttctcgtaagatggccttaaaaaactcgag

SEQ ID NO: 20695 - DNA, 3914 bp, Zea mays
tgttatccacgggctactttgggggaattggtgccccatttgctcatatttctggccgtatctaggacaagttccaaagaagagggaacgcaaaaggcctgtgagagtgtacatggatggatgctttgatctcatgcactacggccatgcaaatgcattgcggcaggccaagttgctgggcgatcagcttgtagttggagtggttagtgatgaggagattgtggcaaacaaaggtccacctgtcctttctatggaagagaggttgactcttgttagtggtctcaagtgggtcgatgaggtcgttcccaatgcaccctatgagataacagaagaattcatgaatactctcttcaacaagtacagcattgattacattattcatggagatgatccttgtcttctacctgatggcactgatgcatatgcgctagcgaagaaggtcgggcgttacaagcaaatcaagcgaacagaaggtgtctcgagcactgacatagttgggaggatattgctaacattcaggcagaaagatgctgacactgatttaagtgttgtcgttgctgagaagtctggagagaaatcaaatgatgaagtgaaaagtcagctatctcatttccttccaacttctcgccggatcatgcagttttcaaatgggcaggctccttcgccaggtgctcgtgttgtctatgtagatggcacatttgatcttttccacgctggccatgttgagttcctcaggagtgccagacaacttggtgactttcttcttgtgggtatctatgacgacgagtcgatcagggatagaagaggctgtcgtcctataatgcatctccatgagcgtactcttggtgttcttgcctgccgttatgttgatgaagtcattattggtgcaccatgggaagtttctaaggacatgatcactacgtttaacatttcattggttgtccatgggactgtagctgagggcaattcagctggtgaaattgatccttatgctgttccaaagagcatggggattttccagacaatcaggagcccaaaatctataacaacattgtcagtggcgacaagaatagttgacaatcatgaagcttacaagaagaggaacctgaaaaagaaggctagcgaagaccggtactacacacaaaagaaattcgtttctggagactagtgctgcacaaggagtgtatatttctgccagcagtccgaggaaatgcatgtgccaccctgtattgatgttattctacagcagagactggaacagataatcagcaatagaaaggtcacaatgatagtttgagcaatggtgtggatggaccaagctagggaagagagagagagagagagagggagaaaactgtcacattcttctgctgtcgcccttttaggaacgctcacatgacatgaggagttcacataaacgattctttttctttctgactttgttatccccgtatggggatttatatatatctgtagctgaaggccttcagcaaaccgttgttgtatacttgtgtgttgttacttaacagcgtgtgtagtgattagcactgcacactccctgattgtaccatggtatattgaatgtttatactgctggaagaaaaaaagggggaccttgtgatggtcagatgtttaatttatctggtgacagtcttgttccatgcaaaatcatgtacataacaactttagaaggtcctgtctcagctaaaactattgaaaccatcacatgctcaggctgtctctagtatacagtgtataccggtgtgcaaaacactgtaggctacactgtttacggagtgaagtttgaagttagataataaatcttgttcgttttgaaaaggattaaaatgattggaggagattaaatctatttctagtcaaaactgaataggaagagatttaattccctccaatcctggtgcaactgaataagccttaaggctgctagagacaaccttagactgtcttcagatatagtaaaaataaggaacgcaaaaatatagatgatactatttaatagagtgtaatttaacagtggatctattcagtactctgtctccgaaagctacatgttccaaggaccgaagactactgcaacaccaccaattgcaggaagctagacattactgcgacggcacattcaatccagcgtgtacggagctagcaggtgacaaaggctgcctggaacagtggcgcgccactttttggttgttgcacgcttgcacaaacaggagctcccgccatcagaacagacctgcaggtcgtccagataggataacatcacttaccatagccttccacctgacaaaccatgtccaatggctttactaacctgaccaaaagcgaggatgcaggccaggctgcggctgcggctgccggaaatcctcctcgacgtccatcggcgccgcctgttgcaggccaggctgcggctcacggaggacagcagcctcctcgtggccctgagctggctgcagcggtgacggtgagggcatcgacaccgacacggctggctgcgcctgcacaacgaccggtgctgctgcaccggcgtctgcgtccacgtctgcaagtggttcctcttcttccatcggctccgggatctctgcctcgtcctggtcacagcaagggtcgcaaacgtgaggccgcgagcaactggtctgagtgcttaaggtgcacaagcacaatggcgacctttttttcttttaaaaaaaaatgttttgcgacaaacagttcaattccccaaggacaagataataaaaaatcacatctttaactgttccatacgaatgcgattcagatcaggagagccatcagtcgccagttgccgtacctctagtttgatcctcttgggaccaaggaggatggggaatccatggctgcccacttcggcgtccctcctctttatgcccacggccacaagatcagccatcgtcctcacaacaagtccaaacactagcaacccaaactgacactgtccaaaatccccctttggtttcaagctgccattcccgtaaccaagatttgggtatataaaggaggcgtttaaacgaccagtcttaaccgcgaccgagcaagagttgaccagcaaacccaggcgacttggatctggattagtgctagttgctttgcaaattcggatgtagtttaatgaacgattttaccatgttgaccggctgcagttctctctctctttggcctggtgtgaagctgtgatacttgcggcctttgcttggtcgtaccttcattgctctttgtttttattttttctcctctgccaaaaaaaaactagatgaagcagttatatgtggagttgtagattggatggagaagcacatgtcaatagcaacagatggtgccctgtgtttgaccccccttgagcctgaattttgggtgtaatctgactctgaaaaacctgttttatgtacccaacctccctctccctctcgccccaaaaagatccgatgcagtctttgttacttcttcacgattcactaggtatatgcatgtgcgttgctacgaaatcaatatgataaaatacattgatatgtaaaaacgataattattattatatatttttgttaatgtcaataaaattggatgtttacgtgccttaaaagatacagtaaggtgtccgcatgttaataggatctagatttctttgtgactgcgacataagcaatgcttactggtttctatgatttttttcttatcagtgagtatattggtagcttcttgttttttttgcttcctatgtatggcatctttattgtctttaaatttttggggtggataaatataactgggaaactttctatgttatctttatctgattgtgccagctatattaatcatgcgaattctaaaatgggtatatcatataatgtcgattccttttgaataatttagtttacgaaata

SEQ ID NO: 20696 - DNA, 1345 bp, Zea mays
ttgattacattattcatggagatgatccttgtcttctacctgatggcactgatgcatatgcgctagcgaagaaggtcgggcgttacaagcaaatcaagcgaacagaaggtgtctcgagcactgacatagttgggaggatattgctaacattcaggcagaaagatgctggcactgatttaagtgttgtcgttgctgagaagtctggagagaaatcaaatgatgaagtgaaaagtcagctatctcatttccttccaacttctcgccggatcatgcagttttcaaatgggcaggctccttcgccaggtgctcgtgttgtctatgtagatggcacatttgatcttttccacgctggccatgttgagttcctcaggagtgccagacaacttggtgactttcttcttgtcggtatctatgacgacgagtctatcagggatagaagaggctgccgtcctataatgcatctccatgagcgtactcttagtgttcttgcctgccgttatgtcgatgaagtcattattggtgcaccatggaaaatttctaaggacatgatcactacgtttaacatttcatcggttgtccatgggactgtagctgagggcaattcagctggtgaaattgatccttatgctgttccaaagagcatgggcatctttcagacaatcaggagcccaaaatctataacaacattgtcagtggcgacaagaatagttgacaatcatgaagcttacaagaagaggaacctgaaaaagaaggctagcgaagaccggtactacacacaaaagaaattcgtttctggcgactagtgctgcacaaggagtgtatatttctgccagcagtccgaggaaatgcatgtgccaccctgtattgatgttattctacagcagagactggaacagataatcagcaatagaaaggtcacaatgatagttcgacaggcaagcaatggtgtggatggaaccaagctagggaagagagagagagagagacggagaaaactgtcacattcttctgctgtcgcccttttaggaacgctcacatgacatgaggagttcacataaacgattctttttcaaaaaaaaattgttatccccgtatggggatttatatatatctgtagctgaaggccttcagcaaaccgttgttgtatacttgtgtgttgttacttaacagcgtgtgtagtgattagcactgcacactccctgattgtaccatggtatattgaatgtttatactgctggaagaaaaaaaagggggaccttgtgatggtcggatgaaaaaaaaaaaaaaaaagcggcctttaaagctcgaactggatccggagcttgcagcctgcgtacgcgtgcgg

SEQ ID NO: 20697 - DNA, 885 bp, Zea mays
  misc_feature (19)..(20): n is a, c, g, or t
  misc_feature (24)..(24): n is a, c, g, or t
  misc_feature (59)..(59): n is a, c, g, or t
aggggcctttttttttttnntttnactattaccattaccatttgcgttacattttgaanccaaacagcaccataaattcaattttgtcattaaacacctgacgaaccccattgcactatagaccatgcaacagtggcacacggaacgacaaaggccaggatatctaatcaccataagctcaatgtgacagtgaaaattcaaacacagtgctaataaatgcataaaccaccaagtaattcgaccctgaagtcccagcaccaaggaaaatttcatcctagggatggggtttagggttaggggagtattagaaaccgtgaaaaggcgtgtatgccaaacttccttaccctgtgaatctcctaactaataactcaatttgtaactgagtgttattggttggcgtcatcatttgcatcatcatcagagtctgagtcacttgcattgtatcctggacgtttcatgccaaccttcaaagctgaagacctgaaccttgatgctctatccatccattgttttcccttgtactcgttcttgggggtcccataacccgagaagaacatctgcgctacaagcacctggttggcgatgtctcctttgcgcgcctccttgtacgcgtcctggaaccagcgctggacgcagtcgccgaccacctctgacagcggcttccgctcggactccgacccaccgactccattggctccctccatcgcttcgtccctgcctatgtacggttcgttgctggctgcggcagctgcggcggcaagggcttggggcttcctcccttcaggagtgccgcagccgacgatggtttggagaaaaaagaaaagagcgaaggagagaagcgcggaaaatacaatttggcggcgtgctcggggcgggtccgcgagg

SEQ ID NO: 20698 - DNA, 820 bp, Zea mays
  misc_feature (50)..(50): n is a, c, g, or t
  misc_feature (96)..(96): n is a, c, g, or t
  misc_feature (107)..(107): n is a, c, g, or t
acttgattgctggctcgcacaagcgaatcaaaaatcgagagcagcagtcncagcataatcagggttgcgttgctgggactgacactagaggtttancccaaccttgnggggttaccttaaaacataaattcaattttgtcattaaacacctggcgaaccccattgcactatagaccatgcaacagtggcacacggaacgacaaaggccaggatatctaatcaccataagctcaatgtgacagtcacaattcaaacacagtgctaataaatgcataaaccaccaagtaattcgaccctgaagtcccagcaccaaggaaaattccctgtgaatctcctaactaataactcaatttgtaattgagtgttattggttggcgtcatcatttgcatcgtcatcagagtctgagtcacttgcattgtatcctggacgtttcatgccaaccttcaaagcggaagacctgaaccttgatgctctatccatccattgttttcccttgtactcgttcttgggggtcccataacccgagaagaacatctgcgctacaagcacctggttggcgatgtctcctttgcgcgcctccttgtacgcgtcctggaaccagcgctggacgcagtcgccgaccacctctgacagcggcttccgctcggactccgacccaccgactccattggctccctccatcgcttcgtccctgcctatgtacggttcgttgctggctgcggcagctgcggcggcaagggcttggggcttcctcccttcaggagtgccgcagccgacgatggtttggagaaaaaagaaaagagcgtgccccaacacaat

SEQ ID NO: 20699 - DNA, 828 bp, Zea mays
ctaaaaatgaattaataaatataaccgccgccctcgtggccgcgtctgtctcttttgttgccacaaccttgtaatttacctcaaaatataaattcagtcctgtcattaaacacctgaggaattccattgcgccatagagcaagcaacagtgacacacggaacaacaaaggtcaggacacctaatctggctaatcaccacaagctcagtgtgacagtgattcaacgtagagataaatgcataaaccaccaagtaattcaatcctgaagtcccgaaaccaaggttaggggaatattagaaataatgaaaaggtgagcaaaagcttataccaaactttcttaccctgtgaatctcctaactaataataactcaatttgtaactgactgtcattggttggcatcatcatttgcatcatcggagtccgagtcacttgcattgtatcctggacgtttcatgccaaccttcaaagctgaagacctgaaccttgacgccctatccatccattgttttcccttatactcgttcttgggggtcccataacccgagaagaacatctgcgctacaagcacctggttggcgacgtcgcctttgcgcgcctccttgtacgcgtcctggaaccagcgctgaacgcagtcgccgaccacctccgccagaggcttccgctcgcactccggcccgcccacttcattggcgcccaccatcgtttcggttcgtctccggcggcaagggcttggggccttcctcccagagcgccgcagccggcagccgacgacgggttggggaaaaaaaaaaaggataaggagcaagcccggccccggccggcctcgag

SEQ ID NO: 20700 - DNA, 2182 bp, Zea mays
tgcagtgcccggcgcctggtcaggggttgtgccggcctggccgtggctcgccatggccgcattcgccgcaaatattggtgtccctagtcgtcggcgtcgtgttaccgacccaggatatcctgtccaccccatggtcccactgcacgtggtggcgcactggcgccgtagaagagcggctctgcgcgcctgaccgaggctgcgctcacgcccgcgccgcatgaggcagacttcggcgatgagcacctcgtagtgctccctggcctcccgcgacgcgcgcccggggaggtgcaccgcgatgcagcagcctgccatggcggcggctggagggtcctcctcgaagccatgagccaccgctctctccacactctagactctagaggaggtcgttggtcgccgacacagtcagcgggcggccagcgaggaggaagaaaccgcttggtggagagtcttcgactgggcacccgttggcatcgtcgaggaaggctacgccagttacgtccgcgtctgcgctgcgttattactaactagaccaattgtacttttatttttttaataaaaaaacttatcaaaaaataataaaacgcaactggttttaaagttgagaaagtaaagtagaccatgctctaaaaatcagtgggttatgtagacttattctttgtaaaataaatcaaaaatctagatgctcatcacctagaaaccatccccgatgttgatgaaatgtagctagtttcttcaactacttagatttggtatatataaccctggaaactccccgcacaaactttgataatgcacacaatgggcgctctgagagcagcatgccagcatcagagcataaaacataccacaggcacacttgtatgccaaaattagacatacaattcagttaaccagttaaccaggttgtcttgagctcttggcaacagttctgaacaacgcaacgaacacatacaacgcacaagaaatgcattatcaaattgtcacatgcaacgacacaaactggatattgttgcagccaaagtacggatgactacaatcttcactcgtcagagtcaccgtccgcatcaaagtccgaatcatcaatcaactccacttcatcctcagggtcgctatcgctaatatagataggcttcttggtagccctggctgtccttctaggttgtgcagcaccaactggctctgcagagctgccagagggtggtgaagcttcaacagttgttccagagcttgcagaagcggtcgagcctctctgtaagattgagccgctcttcttgttgaagggagaggacctcatcttccggaccttcttctcaggggaagatgcactggtgttgttatcctcagtggccttgagcatctcatctattttcttctgtgttaccttgccctgagccggcgcccttttcctggcggcggcaggagccttgggcttcacaacggcagcaggcttccttcctctacctttcttctgagcttggacctctaggacttcctcatcaacatcagatggtatcgtcgccaaggatgatgacgccttctttcgtccgcctcttttgcttgctccctctgtcgctttgttttcattctgctgttctgtcaattctgttacttcagtttccatggcagaatgatccggagaggagtcgctgatattaaaagcagccagacggtcttttaacgaaggcatgtcaacttcttcgtccacatgggcacttgctttcttggattgtttcttttgattttcagcagccacataatctccatcttcagacgcagaatcatttgccttgctggatgttttcttcggttgagctccacgctttgcaaccgctggttcaaaatcatcatcttctgtatcgctatccagctttttagatgcagcctttttacgtggtttcttgggtgcagcttttgatcctccttttttgccagcatttatcctcttttccctttgcagttcctctgctagatccatttgatcaagcacatccagttctttctcaaaagcatcaagatctttcaaccatagtgattttggtgacatattctccaattcctcaacatcatccccgacgctttgtcgccccgcgttaagctcctgtatcttttccaaagtcaacgtaccaattgacattgagaggagatactcatagtcaataggttccgctccagcagcttcagg

SEQ ID NO: 20701 - DNA, 1371 bp, Zea mays
  misc_feature (7)..(39): n is a, c, g, or t
  misc_feature (927)..(931): n is a, c, g, or t
  misc_feature (1122)..(1123): n is a, c, g, or t
acccacnnnnnnnnnnnnnnnnnnnnnnnnnnnnnnnnnagtttttttttttttttttttttttctttttgtgcagcctcacgacctggttgtaaattaatataaccgaaccatacaatgcaacaacgggcacacaaacagtgaagtgcagtgcagcagtatgacgtatgaacaacaaacaggcgatactcgcagtaatcctcgacggatactggcttcttctatcacatgatgatatgcatcagcggcgcaccaaatccatccacaccacacaccacagcgcttttcacgatccaaggaaggtgaaagttacaaagccaagttaaaaagggaagcaaaagaagaactgaagtgacaaaaaacaggagatcagtctcaaatgacaaactacgaggtaaatgccccccctcacgctttgaggattagcatagtagcccatatgcccacttctatggctgcgggccgccgtcttgttgcagtttttcatggtcagaactcagaaaagctcacacaaggcggatgcttggatggcgcactacaattgagccgagatcatcccgcaggttgccgaaaccgtcgtaggcgccgtggttctcagccctagggctgctccctgtactgctggagaccgacccgaaggcggtcgtcttctgcagaacgcccacaggggaggactccatcccgtggcttgaatcccagtagtcggtgagaaggttcagaggcgccgacaggtaatttctcgcttccacgttgccgttcttggccagaacctcccccaacggaccgcccatcgaagagtcacggaacatcgtcgcccaggttgcttctagctggctaacctcgtctcttttcgccgcaatgccgagaccagtcggactgtactcgcggctcagcttcagaggcgacagcatcagcttctcgtggatnnnnnatgtggaggccgacgatagctccgaggatgccatcggagcagatatcgagagctgtgacctctgagcctgcatgtcttctgcctcgggccatgaaaggcctccctgggcaggtggcgtcctgggccagtccacgaagtgttgcagggaggctgggttctggtgttcgttcatactctgtgagccgagcagnngttgacgttctccaaggaactgtgaggggaactcatcagtgaatccgatgaaacgaggccgaactctagccttgagctggtcacttcaaaaggattggtgttgtgtttcgagaatgggagcacgctgcctgtgtttcctgtgttcatggaagtcagcatcgagtcgtgcccggagtcctgcatgttttcgatatcattctgtttgttctagagccgaaatccgagactccgcatgagagcactggtcc

SEQ ID NO: 20702 - DNA, 3055 bp, Zea mays
ctgcagtgcaggctgggcgagcgaataggggatggctcttttgcaggcaggtcggccggccggccggtggcagctgctgctgcggccaaagggtggggggaaaaaaggctggtgccgcctcctgggaacgtatgattgtatttctgccgccgctagctgttgccgtcgtgatgagcgctggaatactacgccgggagtagagaaacgatcaatgattcttggagcagggacagggtacgtacaggtacagccatggcggtaagtaccagtacgttacgtaccttttcctttcatgtatatacagagaagttccttgttgcaacttgctaaaacttgttcagtacaagtttcttcttcttaaagctaccacagcgtgaagtaatttcagctttgttcttctcaatctcgatgtgaatgcacgtttctgaagatgctttcgacaaatgcaatgcagagcacagattctagcgcagctttaccacaggctagaacctgggccaacgatggcgaatgttcaaattcaattattcgcagactggaaacagcattctgtaagattgcagacacagatttcgaatctaaatgtgcagcctcacgacctgtttgtaaattaatataaccgaaccatacaatgcaacaacgggcacacaaacagtgaagtgcagtgcagcagtatgacgtatgaacaacaaacaggcgatactcgcagtaatcctcgacggatactggcttcttctatcacatgatgatatgcatcagcggcgcaccaaatccatccacacagtcacacaccacagcgcttttcacgatccaaggaaggtgaaaggtacaaagccaagttaaaagggaagcaaaagaagaactgaagtgacaaaaacaggagatcagtctcaaatgacaaactaggaggtaaatgcccccctcacgctttgaggattagcatagtagcccatatgcccacttctatggctgcgggccgccgtcttgttgcagttttccatggtcagaaactcagaaagctcacacgaggcggatgcttggatggcgcactacaattgagccgagatcatcccgcaggttgccgaaaccgtcgtaggcgccgtggttctcaaccctagggctgctccctgtactgctggagaccgatccgaaggcggtcgtcttctgcagaacgcccacaggggaggactccatcccgtggcttgaatcccagtagtcggtgagaaggttcagaggcgccgacaggtaatttctcgcttccacgttgccgttcttggccagaacctcccccaacggaccgcccatcgaagagtcacggaacatcgtcgcccaggttgcttctagctggctagcctcgtctctgttcgccgcaatgccgagaccagtcgggctgtactcgcggctcagcttcagaggcgacagcatcagcttctcgtggatgggggatgtggaggccgacgatagctcggaggatgccatgggagcagatatggagagctgtgacctctgagcctgcatgtcttcagcttcgggccatgaaaggcctccctgggcaggcgtcctgggccagtccacgaagtgttgcagggaggctgggttctggtgttcgttcatactctgtgagccgagcaggttgacgttctccaaggaactgtgaggggaactcatcagtgaatccgatgaaacgaggccgaactctagccttgagctggtcacttcaaaaggattggtgttttgtttcgagaatgggaacacgctgcctgtgtttcctgtgttcatggaagtcagcatggagaggttgtcggagtcctgcatgttttcgctctcattctgtttgttcaccagttccctgttatattgcagagagcaagggtcagtcgcacccgtagcgtagctcttcgccggcagctggtgctgattgacagtgaggccagcagcaggagctccggcgccggccagagcagcaggctgggcagcagcagcagccgccgccgccaccgcggacatggctttcgcggcatggccaggctggccttccacatgctttcttgaacgatggcgtccccggttcatgtgtcgctcgcagtacttctggtcggcgaccgcgtccctggagcaccgccatttcttgccgtccgtccggcggcaccgcccaggctccagatccgcattgccggagtagcccagctggaaagagccccaccccaatgtgctcgtgccgaagtatgaaggcgggtagggagacgctgcgaggctcctcctgatggggatgaggaggctgtgaggtatggggctgttcgcggccaggtacttgtagatcagggcctggtgttccagctcgatccactgggacggcgtgaatggggccctcaccctggccattgccccctgcatgctggtgctcaagctcaccgagctcaatcctgagcaagaggccggggtcccgtagtacagcggcatggccccgccgccatcagccgcagcggtggaggaggcgcacgaggccgcggcggcggcggcggcggacgagaagctgagcatctgctccccgccgtggccgggactgcacgagcccagcaggaacggcgccgccgccgccttggtggcagccgccacgtccccggcgacgacgggcgctgtccctgtcctgggctgcttggccctgccgccgccccacacgtcgtcgtctccccccgccgcattgggcccccgcccgtgcttgagcagcctgctagatccgccgccgagcaggcccagctccgaggcgcccgcgtccatcaccaccgacccgcccaggtccatcgtcgcgcccccgcccgctcgccgtgctgtgtgcccccgcgctagtgctgctcgcgtccatgcggcgcgggatgggaagcgtgggagtggggcggaggaggaggaggcggcggcattgctttgagttgtgctctggttctagtggtatagcttggctagctgctgctgcctgctggtgagtgtgtatgggcgcgcgcgtgcggtgcatggtggtgcccttgggttttacttacgcgggccgtgggcaggggtg

SEQ ID NO: 20703 - DNA, 4312 bp, Zea mays
caattttgtttgcatcattctttgtcaatattaaataatgtttaaattgttatttcacgatcgccacatatgttataaaaacattgatacttatatttatcttagcataatacatgctttattcaaaaaaataatatatgtggcaattttgagccgagttatttgtccaagcaatctattgctatttttaaaggcttgctctttcccatatggttttttttatcttcatcaaagttataaataatttgaagacccacaagatttttctctctctatgttgtgcttggacggcatgacattgcgccaccgtgtatatgtgtgcgcgtgtttgtgaatattgcttattatccaataggtatagattagatttgagaggatgaaaaataaacattgacgtacagtatagttttagccatgaacaagcatggatttgtcgtgtgcagtcccagtggcaggtatacttcaagcaaacgaaactagcaatcacccagcacagttttcctgaatcctgaacaacctaaagaacagagcatcaaatcgatggacggatgaaggtcgatcgacagctctctccacctccactccgatctcggaggacgaacatctcgtcccaatctcaaaccccactggggctacacgcatttcccggtgccgatgaccaaaaagcaggcggcagcaccaccagcagcccctgcggccctgcgctgcgcctcaggcctcatcacgctagtgcacatcactcgctctacagtgcgtctacagcatccagcagggtctcctgtactgtgcaccgaatcatcaaaagggcaagggcacgcagtggtgcttaccggctggtcgcccgtcatggatgctggatggaggaggcaccaggcaggcagccattcagccagccagcctgggcagctggacaggcatggatggatgcaatgaacaatggctcgctgcagtgcaggctgggcgagcgaataggggatggctcttttgcaggcaggtcggccggccggccggtggcagctgctgctgcggccaaagggtgggggggaaaaaggctggtgccgcctcctgggaacgtatgattgtatttctgccgccgctagctgttgccgtcgtgatgagcgctggaatactacgccgggagtagagaaacgatcaatgattcttggagcagggacagggtacgtacaggtacagccatggcggtaagtaccagtacgttacgtaccttttcctttcatgtatatacagagaagttccttgttgcaacttgctaaaacttgttcagtacaagtttcttcttcttaaagctaccacagcgtgaagtaatttcagctttgttcttctcaatctcgatgtgaatgcacgtttctgaagatgctttcgacaaatgcaatgcagagcacagattctagcgcagctttaccacaggctagaacctgggccaacgatggcgaatgttcaaattcaattattcgcagactggaaacagcattctgtaagattgcagacacagatttcgaatctaaatgtgcagcctcacgacctgtttgtaaattaatatacccgaaccatacaatgcaacaacgggcacacaaacagtgaagtgcagtgcagcagtatgacgtatgaacaacaaacaggcgatactcgcagtaatcctcgacggatactggcttcttctatcacatgatgatatgcatcagcggtttttttttttttgccaccccacacaccacatcgcttttcacgatccaaggaaggtgaaagttacaaagccaagttaaaaagggaagcaaaagaagaactgaagtgacaaaaaacaggagatcagtctcaaatgacaaactacgaggtaaatgccccccctcacgctttgaggattagcatagtagcccatatgcccacttctatggctgcgggccgccgtcttgttgcagttttccatggtcagaactcagaaaggctcacacaaggcggatgcttggatggcgcactacaattgagccgagatcatcccgcaggttgccgaaaccgtcgtaggcgccgtggttctcagccctagggctgctccctgtactgctggagaccgatccgaaggcggtcgtcttctgcagaacgcccacaggggaggactccatcccgtggcttgaatcccagtagtcggtgagaaggttcagaggcgccgacaggtaatttctcgcttccacgttgccgttcttggccagaacctcccccaacggaccgcccatcgaagagtcacggaacatcgtcgcccaggttgcttctagctggctaacctcgtctctgttcgccgcaatgccgagaccagtcggactgtactcgcggctcagcttcagaggcgacagcatcagcttctcgtggatgggggatgtggaggccgacgatagctcggaggatgccatcggagcagatatggagagctgtgacctctgagcctgcatgtcttctgcctcgggccatgaaaggcctccctgggcaggcgtcctgggccagtccacgaagtgttgcagggaggctgggttctggtgttcgttcatactctgtgagccgagcaggttgacgttctccaaggaactgtgaggggaactcatcagtgaatccgatgaaacgaggccgaactctagccttgagctggtcacttcaaaaggattggtgttttgtttcgagaatgggaacacgctgcctgtgtttcctgtgttcatggaagtcagcatcgagaggttgtcggagtcctgcatgttttcgctctcattctgtttgttcaccagttccctgttgttacccactgccaaggggccccgccggcatgtacatcaaagagcgactgaaatttgagggcccatgaacatgttcatgtttgcaaattcatggaaacacttgtatatagattgaagactttgggatggaactcgatactgtaaacacaacacctacagccctacactacactaccagcacctggacaagtatcacaatatcacatcagagaagtccagtgtcacactagggcagctggaagaatgtaggagaaagcaaataaacattcaatctagcgccagtttgacgaaagcagatagtttggctagcaagaccaagactagacgacatattccttacgtgttacagcatttcgagcacaagcagagcagaagaaaatacctgttatattgcagagagcaagggtcagtcgcacccgtggcgtagctcttcgccggcagctggtgctgattgacagtgaggccagcagcaggagctccggcgccggccagagcagcaggctgggcagcagcagcagccgccgccgccaccgcggacatggctttcgcggcatggccaggctggccttccacatgctttcttgaacgatggcgtccccggttcatgtgtcgctcgcagtacttctggtcggcgaccgcgtccctggagcaccgccatttcttgccgtccgtccggcggcaccgcccaggctccagatccgcattgccagagtagcccagctggaaagagccccaccccactgcgcccaacacgcaacagcgccaaatcaagatccggaaaagaaacaatcgacacggcttttagcatatcgatgtgcatgatggaactgaagctagcccaaaaagcacactctcggtcgctttgcttttgcgctcggttccccactctttcttggcttacatgtgctcgtgccgaagtatgaaggcgggtagggagacgctgcgaggctcctcctgatggggatgaggaggctgtgaggtatggggctgttcgcggccaggtacttgtagatcagggcctggtgttcgagctcgatccactgggacggcgtgaatggggccctcaccctggccattgccccctgcatgctggtgctcaagctcaccgagctcaatcctgcggggagcaaacaggcaggcatagttaggagagatgagcagcaaaacggtggaagccaacaaggcgcagccaaaaacatgtgtactgcttcatagagatgaccgccgagatgcaagcgtttcctaaacacgatcctagggcaggataaaaggcaagcaaaaaaagacacaaaaacctggaacggagcgcctgcatgcaaggatcagaaacctgataagcagcacagatttataggtgatgtccatagcaagccgaccaaggaccacactgttgggtcccgacagtgaacttgaatcgcgaggctccattgtattcttgagactttcttgcgtgcattcatgctcttttagctgtttcttggtttttaggtttctgagtgagaaaggggtgaagg

SEQ ID NO: 20704 - DNA, 5253 bp, Zea mays
  misc_feature (56)..(56): n is a, c, g, or t
  misc_feature (2542)..(2542): n is a, c, g, or t
  misc_feature (3271)..(3271): n is a, c, g, or t
gcagccttttcacgcaatagcaaagtcagctcaaacttgatttctgaatgcaatantcatgaagatggcagcatagagacccaaagagtgacattctagccccttctatagccaacatgttggtgaccttctctgcttcatcctcatctgcaaaacttttggctcttaagtgtccttcgagcagataggtgactgggaacaaagctaccaagaaagagaacacccatggcaaaacccttgtgcttgattcagaaggaagatgtgtgaatacgacaaagactgctgcagagacaattgttgcaacaagaagaggatacagaacaactgcctggaagaagtactgaacagagatgtagatgcctagtgtaatccccacagccactgcatatgaagtccttaactcaacgacatacttcactgggatgatggatgtaactgctgctagtgtaagtaccacagttgcaatgagcagccatgacggccatgagggcttagatgctacaaacccatatattgaaatgtcatcatcagataaatgtgccgctgtgataaaatccgaccggtatacccatgatagcttaataggaggctgcataacaacgaagagaaggcctgttgccacaataaggaccaggaatctcttcgctgactgagcatgagggaaatggagagcgactattggaatgcatgcaactcctgtcaaaagaatatatgaacccagtaacagaccatctgaaggaggtcttccattccaccactgtaaagcttcaaaaattgtttcccggcagagccaggcagaaaatgctatgacagatgcatgaaaataagcttgccagaccttcatcttagaagctcctttggacttgtctctgtaaagaagtaaaggtggggtaacagcaagtagcaaaacagctgagaaccatataactgatcttgatgtcataaacagcattgctaactttgatgaatatagacaagttaagatccaagcagctttgggccctagtctctgatcaacatataatctccttacaagagccaagcccaaaaaggttgtaataaaaaccatataattaggatagatgatatcctcttcaaatccataataatacatggaggcatagttaaacaatcggttctcaatgtagcatagcaacaatgtatgaccaataagaccaagttccagaagaaaccgaagttttgttggaagaagtgccaaaccaggaacagccattgccatgatgacagctgcaacaacatactttgtgaaggacttcaatggcatgccagcaatccaaatattcagatcccaataattgtgcaccacaaaccaaaggaccatcaagcttgcaagtgccacaaaggtaaagtatgatgacaagcttttcttagtaaagaaccttgcaacataatagccagaaatcatcggcagtggcaggaactgcaaaagtattaacaaaaaggcattaagtatgaccctacacaactatctgttgatgtgcaaacaaaataactggtcataaaatgttgcaagactcaggatagggttggtagtgacagggcactaggtaaaaattggtagcaacaagacatgcgcattataccactgccaggagcctagatgatgctatatctttatacgtccaatgagaccattctatcctactcaccatgtaaaggaacatctctctgctgaacaaaagtctgctattccacaactctacgtgattagatactcatgttgtccttgaacttttttaatatgaaatttgagtacctaaagagtttgacaagaaacaatagagtgccccccccaacagaaacccatcttaaaaagcacagtagcatctattcatatgtgccatttggaattcctgcacagggacaaatatcaacaggcacatagctatctaattttacagcatagttttgcaatacttacacaatgtggatatttaatacaatctaaataaggtttaaaaaaattggcagcactgcagcattcaaaaaccctgacctctgccaaggaactcactagcttcgcacagcgccacagccataattcaagtactaagcaacatcattgagatattgtggtgaggatgacatgaaaagtagagggattataagggtgtaagtattcaggtacccagctacaacatttcaaacaaaaatgcatgagtcaagtcaaagcaaacaagaaccacaacaatagttaaaacatgtaatacataattgatgagcatctactaacagcaatggtcaagtactattaagtatgagtatgttgtatgtatggcagcacaatatcacaatttattctcattcaaatatgagtaacggtattgatagtttctttactgcagttaacccacaaagcaacacaatgattggaaaatcatcgcaaaaactacacttcttagaaagtagaaacagttttataaaacaacacttttattaaaataggtacaaaaacaaaactacacctctaggaaccaattacacaaaattatgcttttaaaggcttaaaactgaaacttgnaatgtagttttatatggattggcaatcaaagtgtattttgtgaagttaatcttacaaactgtagttttgcaatattagtttgaatatatgtgtaattatatgaagctagcttttgacagtgtagttttgtgataatttttttaacaaacttagtgcagtttgtgaaatttactttatttatccatgtcaaaattggcataaatcaagcaaaagattattaaaagaactgttttgcttcagtttgctggtcagaacttttgaagattatccaaataataatgatctcactgtataaagaactgcctgatccatccaagacacggttcttataaagcggtaaggtgagacaaggtgttggaccaccgcctggacgcctaggcgaagcctaaggcgagcaaggcgacgccttatctatctaagaaccagcaagacagtagcatggagaggaagaaaaagaaggaaaggggtagcaggcccagcccaccatctagcccatatatcttcccctgctgccccccttccacagccgatggaaccgccgccgcccccaatttggtgtcgctgcccctgattcaggcgacgccgccgccgccccgattcgagccgtcaccgccctgatttggccatcgtcgtgctgatttgggccgccgcgccgccaccccgatttgagcgccaccactccaattcaacgctccccttcctcgtctccctccctcttgctggttcttnactgagcgacacggacgcctagctacttttgggcgcctggtcgcctacgccttaaaaactatgatccaagaaaaaactattataatctaacaatactaaaatttaaaagttattgctgctaaagaaccaactgaacataagaatttagatcctcaacaatacaaagagacaagaaaaatagcaaacacagaattggtgtaaagtctcatagaactgtttaaccatactgtatctatagtgtaacaatgtgacataaaatggacagacatcaatggcagtactaacttaatgataagaacaataactccttgaccaattcatctaagagctactactagtacctgatgtataaccagtctaaaatatgtggattttttttttttttttgaaactcaaatgttccatacacgaccagaagcagtgattatcattagtaagtccaaagctttatatcgactttacaatacaagatgtacttcatagaattacatttgttggttcaacgtagcatgcaacatgaattactttaaacaaatcaaagaagatatcaattgcacaaaggaggccacaacataccaccatggggaatccaatgactacagctcctgctccactgactagcactgccaatcctgtaaaagccacagaactagcagcatccccaaccttgcccgcagcatgtgctgcaagacccaaagcgccaccaagcattgtgacagttacaagcaggtaattcagcggtggtggagcatgaatgtaccttccaaacgagtggaacacaactctcacctcaaggcaaagcaccaccacgaccagtgcgacgaacccattcacaattcttatctggtccatggtgcgtgcatccctggtgatccaccacagtgcaccacgagtggatgcatacagctggaacaagaacggtatgaagaacagcaacaacaattcacacacactggccaacgatgtgaagagtgttgcacgatgggacacggcatggaacaacaccggcacgaacagcacatacagagaatgcacacagctctccaagggaccaagaatgccatcactgtccagcattggagcatcctgcttccggctattgaagctggaccgacggggtatagagaacagccagtagaacaccatgcagaacgtggcaaaatagtaggatgcattggccatgccgaccgcagacacgagagcccacgtgaagagggcgggggcggcaatgggcacacaggcaaagagcagccgctccagggcagcaacaatagtcgggttctcgagctggatccatcggaactgcagcgacgcccagacgccaatgaggaaggaggtctcagcgcagagaagcagcgcgaggacggtcagcggcagcgaggcagcggccgcggacgatagggaggcggagaagaaaaaagcgacatcggccgcgagcagcgccgcccagacggtgaagaaggagccctggcgcagctggagcgcgtcgagaaggtatgccgccgctaggccgatggcgaggacggcgaagacggggagcccgccaaggtcgagaaggaaggccgcggcagggaccagggccgccgcaaggcgcgcgttgtgggcgaacgccggacccgaggccgaggccgctgcggtggcagcgcgcggtccagcgccgacgtaggaggatcggggcctgttggcggaagagggtgaggggaaagatacgaggggcttcggagaggatgtggagttgcggtgcggcgcgggggacgcggccgatgagggggacggggagtgggtggagaaggtcggggtggatagcgacggcgagatgaggagacgcccgtggcgggacgtggatccggatgagggatccatgcaggcgggggcgggatctagggttttgcgccggagggctagggtttgggatgcatcggccggcgggaggggagagaggaagacgacggcgacggagtggacgaggagatctgaagttt

SEQ ID NO: 20705 - DNA, 844 bp, Zea mays
  misc_feature (3)..(37): n is a, c, g, or t
gannnnnnnnnnnnnnnnnnnnnnnnnnnnnnnnnnnctagaagtacacatcaaagtcttctgctcaggcttatcgaatgcaaaactttgcgtcgtcaaaagttcgacataaacgacccaaggtgatggcatcatctgtgctgttaaaatacatctatatatgcgacaacacctttagcctacactcagtatgcaatcattcagtacaaaaaaagcaaagttgttcgacacttgtttctctctgctacatagcacaattttgctgcgagaggatcaggcaatgaagtatctgttcctgagctttgaaagaacttgatgtatagtgacagcctcagaaagttacatgacctatttcaaatgtatctcatcccagcaattcttatgcgccttgatatcatgtactgggcaagagagtacatagctcctagcaatcctaacacccgaatagtaagtatgtctgtcattataatcgaaggcaagttgagaggtagcgtcagcagtagcttggcatctgtctgtctgacataatcccacatgaagcggttgaagagtatgtgattcggcaaagtgagcacaagaagagcaaagttcttcacagcaaacagccagcccgggcccccgatatcaagagcccatcctccattgccaggccaagtctcctcccatatcctatacaacgctgtcaacaataaatagccagaaatagaaactgttactgggaaatagcgctgcctatcaccaaaccctgcgaagatatctgaatcctggttcagaagcgcagcctggcccgccaggaagaaaatagcacggttcgagcccccggccggcctcgaggtacccaatg

SEQ ID NO: 20706 - DNA, 2970 bp, Zea mays
gcgaatcgcctttatttaaacaggaatataataaacgtgcatcatgctaggtctttaaattatgcatttaaacttgagactccaactcagaattgaatttgaaattttcaaactagaatagagaagaaagaaaatacaaatgaaaataacaaaaaaaaggatgaaaccttacctctgctgtgcctctcggctcgagccaatgcaggcatgcagcagcccacatgtccccttttcttctttttctcttttatttattttatagccggacacctgcatcattcttcttttctcttttatttattttatggccgaacactggcattgcatcattaggatacatgcaagacgccaagttgttgcacgtttcaccaccatatggacgccttaccgttctgcgtcgccagattcttcctcaagctcagtttgttacggacctccccaatttccggcaacaacttgatccagccgttacgaccatttaatgatgtacaattctcctgagctttcaagagaaaaaagaggtaacatgaaaaaagccaatactttcatgctttggccaaatctagacaccacacacctagaaatgatctgacctccctactagcgctttagtgacctaaaattgctcagcttctccaacaatagctcccatagatcctaatagttataagccatccgtcaccgaggtacttcaatgtcccagtgcacgagaaagtacaacaaatcagaagagaagactcaactctcagaaccatctgacgagccaccacctacctacctgcttcctctccgatcaggagggagaactcaactctcagaaccatctacgactccatctaccactacaaagcctccacctgtctaccttcctctcccttcgctctctcactggctgaggaagaaccgagacactggctatgagaaagaaccaaaacaagcccacgagctggaacaaaaaaaaaaaacgaaatcaacagttacatcaaagtcttctgctcaggtttttcgaatgcaaaactttgcgccgtcaaaagttcgacataaacgacccaaggtgatggcatcatctgtgctgttaaaatacatctatatatgagacaacacctttagcctacactcagtatgcaatcattcagtacaaaaaagcaaagttgttcgacacttgtttctctctgctacatagcacaattttgctgcgagaggatcaggcaatgaagtatctgttcctgagctttgaaagaacttgatgtatagtgacagcctgcaagcaatgcattgaaagatggcttcaggaaatcatactctactggcagcgacttggtaaggtgtaacagatttacctcagaaagttacatgacctatttcaaatgtatctcatcccagcaattcttatgcgccttgatatcatgtactgggcaagagagtacatagctcctagcaatcctaacacccgaatagtaagtatgtctgtcattataatcgaaggcaagttgagaggtagcgtcagcagtagcttggcatctgtctgtctgacataatcccacatgaagcggttgaagagtatgtgattcggcaaagtgagcacaagaagagcaaagttcttcacagcaaacagccagcccgggcccccgatatcaagagcccatcctccattgccaggccaagtctcctcccatatcctatacaacgctgtcaacaataaatagccagaaatagaaactgttactgggaaatagcgctgcctatcaccaaaccctgcgaagatatctgaatcctggttcagaagcagaaggattggcgccaggaagaaaatagcacggttcgagccaccagtgagtgttagatttagaaccaggcagatgccaaaacacagcacagtagaaacattgcctatagcaggcatccatgctgcctctgctgccaaccgcttgatggtgaatgttggtgcagcatgagctcttcgttgctggagcagccttgctttgggtgggaaggcagcactccgactagatggaccatgcatacctctgtctgcagccttttcacgcaatagcaaagtcagctcaaacttgatttctaatgcaataatcatgaagatggcagcatagagacccaaaagtgacattctagccccttctatagccaacatgttggtgaacttctctgcttcatcctcatctgcaaaacttttggctcttaagtgtccttcgagcagataggtgactgggaacaaagctaccaagaaagagaacacccatggcaaaacccttgtgcttgattcagaaggaagatgtgtgaatacgacaaagactgctgcagagacaattgttgcaacaagaagaggatacagaacaactgcctggaagaagtactgaacagagatgtagatgcctagtgtaatccccacagccactgcatatgaagtccttaactcaacgacatacttcactgggatgatggatgtaactgctgctagtgtaagtaccacagttgcaatgagcagccatgacggccatgagggcttagatgctacaaacccatatattgaaatgtcatcatcagataaatgtgccgctgtgataaaatccgaccggtatacccatgatagcttaataggaggctgcataacaacgaagagaaggcctgttgccacaataaggaccaggaatctcttcgctgactgcaaggaaacattaaaatataatcaattggtgcagcaacaaagcatttgccatatgtagagcaaatagtagcataagagggtgaacagaagtactagaaaacaagggttatagttcaatctttaacttgaagatgcttttcagtaaaaggaatcacattcaaacacagaaacaaaaggcaaaaaaatattccttttcattgacaggaaatcagaaatgtgtgggccatactccctgcaatcaaatttaagggtgtgtttggcatggctctgctccactttagagcagt

SEQ ID NO: 20707 - DNA, 4106 bp, Zea mays
  misc_feature (3435)..(3435): n is a, c, g, or t
ctgcagagggtgaataaatttggagtccttgtatgactacgcaattgttgaaaagaagtggagacaatgatccagttatatttgcagccaaaacttggttttcagcaatatttgtagaatctgaatagagtatgtggtcttagtcatgcctggtctcagattttggagcatgcatataggttattgatcagaaaacaaatacacaaaagtattgataactgatcaacaaataaaaaaactaatctggtctaaagcaggcattttattaaacagctcaactgcaagcaatggttggctagcagtgcagagttactggaagcgactgctcccctgcaaatataccatcaaccagcaacaacgtcttgcagatatgaacacattatgactcgcttagaaaaccaacgctatcagcagtctttggaaacaagaataaactagagctcttaaatatcagcacatatttcgccgtcctaacagaatcaaaactaacttccgctcttaaatctaaactcagtgatgtacatgttgtctaagcacaattctagtctaaacaccaaacataaaatacggttgttgagaatatatgtgattagctaactgaaatttgaaatgaatttcgcaaattgagcacaacagttaagagaaaaaagcgaaccatagcataggcaccgtgacaaaatgccttgatgataccagttcctggtatttactaccagacctctatttataattaatgtatctgcacaagatatttactaccatagcataggaacagttcgctgtcctgatccatactggaagcaacatctaaaaaactggaggacatttgcgtcatgtgaaaagatgagctcacactaagagagattgtctgctggatactgttgtcaggactagttacattgtaaaatgtccattccacatactatgacagatctcatcgttaaaccctggcaagtgcatctccatctcagactaacagccaccaattgttgaactcaattcaaattgcctccaatgccctgagctttccatgtcaaaatctgcataagagcaacaaattgagataagatcagttcaatgaatatagatgagaatctaaaagaaagatgactaggaaaatagaaaagcacacaaagagccaaagatatgagtaccacaaacaagaagttcagtttacaactctatcaagagggcctccagcaattaagagtgtgcatatcagacctggctggtagcatctgagaaatatggcctgtcaaaagtaaaattgaaaaggcttgagaaaaccataggaaatatatagatcatccaacacatctgtttttcccctataattgaaggggactgattatctttaaaaaccccccatttaagacaattcacatgaaagcacagcccccaagaacacaaccataaacttttcaaaaatcaaagacctggtagtggtgctccagatggcaaatgattcagaacagtatgttgatgattcataggattcattgaagatctgtcaatgtttgatcttgaatatcctacatccgaattttactattagtgtcagtccaaaagttgatgaaaaacaactcttagataacttatggaagaacacataccatcatgcacaaatggcccttctgagcaaggtaatgatctgccacttgctatccaattatgctggtcatctggactgaagttaccagatgccatccgccaatgttcttcagatggataatggctctgactgtttggaaaggactgtgcagcataaggattgtgtgaaggtgcaacagcttgttggcccatgggattcatgtgtgccatacgagaatggggatgaactggaggtgtttgtgcagatggaaaggcactgaaattcccttgctgaaaaggtacaccagttggccgaaactggtaattaccattagaagcttgcgccataaatacgctagtatttccaaattctgccggcattgaagtaacaaaattaactgcagcttgtccattaactggtccaccaggaatgaaggttgttgtatttccaatagcttgaattgatgtgtttactgtcatctgggccaattgattaccattgggcgtcatgaagtactctggcgctggaggctgataacccaatgacaacggagatgaagaaacaggcagcggaatagaaggaagaggtgggtcctgggttggcagaggtggtggtgcaggctgaggaggtggtccagatggtagtgggggaggtggtggcggaagtggtgaagctggagagagtggaggtggtggtggcggcggcggtgtagcgggtggtggtcccggaggcaaaggaggtggaggtggtggtgaatctgatggaagtggtggagggccatcaggtagagggggaagctcattctgggcgatcaatgcctgctctgaacctggaccttgactagagtcatgttcaataatgacagctccatgagtctgttggttgttgccaagtaactctaaagcatcttccatagcagcatcagtagctacatgttctactctaataatgtgttcctcaacagatgctggagcaatattatcttcagtttcatgtatgacaccacctgcaacaggccgtgaaacaaatgatgatgacccattggtttgagggaagtcttcatcatctcccgacccgtttcggctcgagattccagaaagctcaaaagttgcattgctgagaacagaaaaaacacagcatatgtcaataatgtctggtaagttggataaagataagacaacacatactcacatagacacactaaagtactgggaacactgatttataagcaaaacaaaattccaaaagattatcaggaaagcagaaaacatccaatgtgtagagttacttcattaatttgaagcatgtccttcctaatagcaagttcactgagcttcatactaaaatccacaacctttgcaacataagcaccctggtcatgtaagactctcttagcataaaccgtattttgaagatcctaatagcagggattagtgtggtcagagcatttgacattactgtatcctattttagattccacaataccacaacataacaactgtattctaaaatattgatacaaataaaacaagcatatgtgtggtaggtactggcactgctgtgtttctttgagttctttaaattgatgatagagagagcatcaacttagtgtcatgtgaatctgcaccatacgtgccaattccaatatgggactggcatgatcattactacccagcatattctaaacaagagaatctgaaatgcaattttaagctatttttccggtcatgatgtactaatctcataaacggacttattaaaagtttaaattattgagcagatagatccaccagaacctacatgtcaagctaaaaaataaaaacagaaatgatttattgacctantaaatggtatatcaagtcccaaaataccttccatattcatcaacaagcatgtcatccatctccctaataggatcatctacagaacgttcagaacgggatggtcgctttaacattaaactagtgctagtatcatcatttggcacctcaatgtcacccatgtactttcggagtatgtcttctggcataatctttctctcaagccacaatcttaaaacctacaaagccaggcagccaagtgacccactgtttagaaaaagagaagtcggaatcagtaataatgtccaatactttaaggcactggcgccggttttcacgagcaccagctccaggtggagcagcagcaccgaaaagacgaggcaatgccgcttgaacagtgggaacatatgaagccccggcaactcctgaacatttcagaattcaaaggataactttttgggcaaatatagctctaaagcaggattggtataaaacttaaaaaaaataaatttacctctatgagaatgggaacattgtgttatggaatccacaagaaaaaggaggtcaattctgcgatgcaaattatgcttgttctccaatttctgtatgagaagctcgacaatctggaagagaaacaataaggatagtgaaataacaatgaaacagtgatgcagatggcgtatgtgagagaaagg

SEQ ID NO: 20708 - DNA, 5718 bp, Zea mays
  misc_feature (236)..(240): n is a, c, g, or t
  misc_feature (242)..(243): n is a, c, g, or t
  misc_feature (3655)..(3655): n is a, c, g, or t
  misc_feature (4013)..(4013): n is a, c, g, or t
acccaatcaactgggggtctcgggttttcagtggacaaaagggcaaacaaagttacccccctaaaattaggtcattgaaaccttaggcgttacacggtttctacatcaactccttttgctccccattttttgtcccgttgtgattttgcccccttttttggggggaaatagcgtgggacccagtttcccacagttttcttttattgctttatttatttttttttattttgtttttnnnnntnntttttttttttttttttttttttttttttttttttttttttttttttttttttttttttttttttttttttttttttttttttttttttttttttaagagaaaaaagcgaaccatagcataggcaccgtgacaaaatgccttgatgataccagttcctggtatttactaccagacctctatttataattaatgtatctgcacaagatatttactaccatagcataggaacagttcgctgtcctgatccatactggaagcaacatctaaaaaactggaggacatttgcgtcatgtgaaaagatgagctcacactaagagagattgtctgctggatactgttgtcaggactagttacattgtaaaatgtccattccacatactatgacagatctcatcgttaaaccctggcaagtgcatctccatctcagactaacagccaccaattgttgaactcaattcaaattgcctccaatgccctgagctttccatgtcaaaatcacaaacaagaagttcagtttacaactctatcaagagggcctccagcaattaagagtgtgcatatcagacctggctggtagcatctgagaaatatggcctggtagtggtgctccagatggcaaatgattcagaacagtatgttgatgattcataggattcattgaagatctgtcaatgtttgatcttgaatatccatcatgcacaaatggcccttctgagcaaggtaatgatctgccacttgctatccaattatgctggtcatctggactgaagttaccagatgccatccgccaatgttcttcagatggataatggctctgactgtttggaaaggactgtgcagcataaggattgtgtggaggtgcaacagcttgttggcccatgggattcatgtgtgccatacgagaatggggatgaactggaggtgtttgtgcagatggaaaggcactgaaattcccttgctgaaaaggtacaccagtgggccgaaactggtaattaccattagaagcttgtggtgccataaatatgttattgtttccatattctgcctgcatcgaagtaacaaaattaaccgcagcttgtccattaactggtccactaggaatgaaggttgttgcatttccaatagcttgaatcaatatatttcctgtcatctgggttaattgatcaccattggccgtcacaaagtactcaggagctggaggctgataactcaatgatggtggagatgaaggaacaggcggaggaatagaaggaagaggtgtgacctgggttgccagaggtggtggagcaggctgaggaggtggtccagatggcagtgggggaggtggtggcggaggtggtgaagctggagaaagtggaggtggtggcggaggcggcggtgtaacaggtggtggtgaaggaggcaaaggaggtggaggtggtggtgaatctgacggaagcggtggagggccatcgggtagagagggaaagtcattctggtcaattgcctgctctgaacctggatcttgaatagagtcgtgttcaataaggacagctccatcagtctgttgtttgttgcctggtaactctaaagcatcttccatagcagcatcagtagttacattctctactataataatgtgttcctcaacatatactggagcaatagtatcttcagtttttcgtatgacatcattttcaacaggccgtgcctgtgaaacaaatggtgatgacccattatttttagggaagtcttcatcatcttcaaacacttttgatgataaaattccagaaagctcaaaagttgcattgcttccatattcatcaacaagcatgtcatccatctccctaataggatcgtctacagaacgttcagcacgggatggtcgcttcaacattaaagtagtgctagtatcatcatttggcacctcaatcccgcccatgtacttccggagtatgtcttctggcataatctttctctcaagccacaatcttaaaacctacaaagccaggcagccaagtgacccactgttttttttggggaggggggggagccagaatcagtaacaatgtccaatactttaaggcactggcgccggttttcacgagcaccagctccaggtggagcagcagcaccgagaagacgaggcaatgccgcttgaacagtgggaacatatgaagccctggcaactcctgagcatttcagaattcaaagaataactcttgggcaaaagatagctctaagagcaggattaacataatacttataaataaatttacctctctgagaatgagaacactgtgttatggaatctacaagaaaaaggaggtcaattctgcgatgaaaattaggctcgctctgcaatttctgtatgagaagctcgacaatctggaagagaaataataaggatagtgaaaaaacgatgaaacagtgatgcaaatggcatgtgtgtgtgtagagagagagagagagaaacctctccagcaatgccatatttagagcactcaattgcatggcgtgttgcacgtcctatactatcctttgtcctcgataaagtctctatcattccctccaaagcatcacgagcaatagctgcatcagtaccaccactaggtgaaccgctggcctgcctagatttgggactctttccatgaccattgtcaaactctattgggcttttcagaatacgttgaccaggactcccgggaaaagcaattctgggtggggatggaatgcggaaaacaggactagggcttagtcccggcaaaccatatggtgtggacgtaatatcagcattatcagtcgaagacccatcaaattttgcatgaacagaagccataaggttcctccttgcttgggcagctgcaataagatgttttattgacttggccgagccagggttaggttcagaagaaactgctttatcaacataactggatctgcataagagaaaaccacaaactataaacgtgtgcagctaaaactggtttgaacacaaagagataagtatcagaaagaaatttgttaagtccaaaactcaaagcagtatacctttcctctttcaagtgatcccgcttcccactctgttcagttgacaaagtggtgcccaccttatgctcaacagacgtagctagcttagatttagcctttgtttcttctggttggggcagcaaggggatcttttctggggcaggatagtttcgggaatgggagttcccagatgttaggtgtgatggtttagaagaactactacgaagtttcttcacctcagaggatgccggcatttttacttgagcagaggatttgccatcaaccaggctcattttgttaccaatgacagcaggagtctcaaccaaccctgtgatcagtcttttctcgactacctggtgtctagcatgcactttatcctgactcggtgaagaaaaaattggntcatgcttcacaggtgacatcctaacactccttgatttctcttctcttgcagggcctaacttttttccaaaaacattgccaacatgagaagaaaattttccccgaatacctgctttctcagttgggactatatgtgtagagagagatttagcagaagttctatgaagtggtgttcgctgtccttcatcctcatcttcatcaaaacgacatgctcttctcttaggtttcaccaattgcctatcaacacgtgaggcatcctccttcatgctggaaccctttttaacagaatcagcaacagttgacagtgtcacagaaccacatgctggttccatgacctcagaatgaagccttgatatgngtgatacaacaccacctgatctcagtgccctatcatcgctggtactggtcttaagaatcgtgtttttacacgtttccatagaggtaggccgctcatgtttcacagcataatgctttccataatcaatgtttgacttcatctcactcttgtcaactgtcttatctgtttcaccagccctgtccataagccttggcttttttcccggacgtgtatcagcactactgtccatcttgtgctgcccactatctggcagcgatttcttattggaaggcatccctgcagatgattttccagtcaattgctcgtcaggcccgccatgcacaattttattataatccattttctctgaatcagtagttagtgattgttttgtcatgatttttgacttcttaaattctctgctctctttgtcagcactcatgtttaatacaacatcagatgcagcctcagcaacaatcctttcaatagggctaccaataccagcacgtttgttttccttcctttcagcattcctcaacggcttgttggatttagatttctttggcacttcaagggcacaaactacctccaagttaggttccaaaataaaaccatctaggggacagctctctttttcaattttcacctcttcagcctccctttcagcacggacagatgttggtgaatgctcctgttccatgtaaatgtcaagagaagacttggatgcagcagacttctttgtcatgggatgcttaggatcctctagtaaagatgttttcttttgataaactgctaaagaatgatcacatatttcatgaccatcatctttgacatcctcctcggtccctggccttttcgctgaagtatgcgagtaatcagtagggctatcaccttccatttgtcccaatcctggaatctcaccaacatcctgtgacctcacaaggtgctctgaaggcttttcactctgatcaggcaatgctccatttgcagcttcagatgtttttggcaactcattgtaggccttgcagatctgctccacagcatcattaaatacttgaacatattttcttttaactttcatatttggagctcggtctaacagatcattctttgtcttctcagtaaattcctcaagatctgccagcggtacaaaagcactcccggcgggcccatagaagtagacaaagaacttttttggcgttggctcatgattaaattcctcgggcctgctgatcttagctggccaacgcgggtaccccttgatcttggcgaggacgaggtcacctagctggggttccctggtccagttgggccgctgcttggcgccgcgcctaccgccgggaggcattggcggcgacggcgagggaggaggacgcccctccccccagcgccgaacactaacctaactctagcagcagagaagagagcagcgggggcggggcgagaagaaggaccggccctggacctgcccctagggtgggaagcagaggcaccctcaagacaaccctagaggagggaaaggacggcggggcgggggcgaattgcgtgaggtgcggtcaccttctccgtttctcggtagctgatacctgaaatcacttggatggacgggactgccggggatgggacggagcttctgctttgtttgcctgcttcttcctcctcgcgtctccctcctctcaacagcgcggcgcggatacgggcagccggccggcctcgaggtacccaa

SEQ ID NO: 20709 - DNA, 7263 bp, Zea mays
  misc_feature (6460)..(6460): n is a, c, g, or t
ctcgagtaaatgttgcaaggagctttttatttcatgcatgctcaagcatgcttgcgttgcaagtttactctgtgctcgcctctgaaaagaactagtacccggcccgctgtcgtcttcctttccctccttttctggttccacgaaggagagggaacactaggaaaccaagccagcatctgatctttattagctgcttctctgttcctagctcctcccatatgggagtacttcgccaaggcaacacacggggcaaacaggcattgcgaggtaagaagtccagcatcgattggtcttatatgcactccgtctgggtggatttaatttctgtttgtatatccgattcggttgcgccgctgttcttgttttctcgccaatttataactttgatctaccaagaggcactcgtcatattttactagtttacccccatatccagactctgggtcaagctcgccgcattttgtctatgtatcagatctaccctaccgccaacccatgcgttgcaatcgcaagtagtagacgtgagacaggacttgatcgtccaaagacctaccctttcttcttgcttgggattgcactggactagactccattgtttgaccgcggacgatgcagatgtttctgatggagatggacagacaggatttggaccatggatgccctgtcggcccaactcccttttcagcattcaatctgtcaacccacagcggagctagggacagttggtctgcgcaaaccaaagtagacttgaaccaaggacctactttgatgatgatttattagagttttctaaacagaaggtcgtatatctctggttcctgtgattttgatagttgctaataaaataaatacgtaatcaataaataaaacatgatgtgattttgacttgtgtgaactgtgaactgattgtcagaactcagaagctgctctgctataatggctctgctataaggtggagaagagaagccgatggccgcagccgaggtcctgacggccgcatgggaggaatggggcctgcgggcgctggtgctgctcagcctaacggtgcaggtgacgctccacatcctggcggagttccggcgccacgtcgactccggcgcgctgagggccgtggtatggtcggcgtacatggcggccgacgcgacggcgatctacgtgctgggccacctgtccgtggccagccggtcgccggagcgcgagctgacggcgctgtgggcgccgttcctgctgctgcacctgggcgggcaggacaagatgacggcctacgccatcgaggacaaccagctgtggctgcgccacctgcagacgctcgtcgtccaggtggccgccgccgcctacgtggtctacgggtcctccgccatcgtcggcgcgcgccggctccccttgctcctcgcggccaccgtcaccatgtccgccgtcggcgtcgtcaagtacggggagcgagtgtgggcgctccggcgcgccggcactagcccgaccgggaactacagcagcgacatcgggaagaggaggttcaacctggcggtgcccgattctttcatcagccgcttggatcccgcggagacctacctgctgcacgctcacctgctgctggacatagccaaggacaggttcaagggtccgctaccgcgtctgtttctgtgcggccccggcagccaggaaacgcagctgcacggcgaggaggagctgtacaaggtggccgagctgcagctgtcgctcctgcacgacgtcttctacaccaaggccgaggccacgcacacctggtacggcctctgcgcccgcgtgctgtcgtcgctggccaccgccgccgcgttcctgctgttcaacgcgctgctcctgggcgcccatcgccgcaagctggagggctacagcagaggcgacgtggcggtcacctacgtcctcttcgtcggcgccgtcgtgctggaggccgcgtcgctcgtgagggccgtgttgtcgagctggacatgcgcgctgcttgtcaagcacggctccgaaggcagcgcggtgtgcaactccctagcccccgcggccgtgtacctccgccggctggtccgcgcggcggagtggaggtggtggcgctgctggtcgcgctccatggggcagctcgacctggtccagctgtgcgtgcgcagcagggccagccggtacagcagggtcgctagatggatgggcgtggaggactggtggaacacgatggcctattccggcccgtccgtccccgtgtcgccggacgtcaggaagctgctgctcaagagcctgaaggcgaggccgtgggatcgagagcagttcgagagcagagggctgtacggccgggagctgggccttgactgggtcgcagagtcgaagctggaggcgaggatcctcgtctggcacgtcgccaccgagctctacctgtactggtttaacaaggatcagctgccgctgccgctgccggccgccggtgctggtgttgcggacctcgtcgaggtcgctcagtcgctgtccagctacatgctcttcctgctggcatcgcgcccacacatgctgcctcccgacgccagccgcaacgactacctcgtggtgtgctacgctctcaccacccacgagaggtacagcacagccgacgatctgctctcctcgctacagcgctttgcggacgcgctgtgggccaacaactctgcgccggagtacgaactgcgttgcaagaatactaatcggcgtgggtacaaggtgttgaggggaggatgctcgcttgctgcgttcctcatccaccaccaacaccaagaagactcctcctcctcctcctcctcctcgcctgccggtggcaccggcaccctggaaatgatctgcagggtgtgggcgcagatgctgtgctgcgttgccgacgagtgcagcgccaattctcatgcaaagcaactcagcggcggcggcgagttccttactgtcgttgctcttgtagccaaattcatgaggtccaagaggttgtcctggcacttgcacatagaatctcagcgtacagacgaatggtaaattatacgtactagctaggtagggcgactgcttctacaagtatggccatgcctgttctgtgtgtgcactggtcgtttgtttggtttactggtcatctgcaagctggccacaagtagtaggtggtgtttttagttggctgttttacaccatgcattgcattaagcaatacgccgtagccactctctggcccacaaaaaaaaagtctaaaatcaagaacaccttagccaattgagatcgatgccttcaacaagttcctcctgagaagagtaccaacctagcaaaacaattggaacacaaaatggacattggaaagtccgtgaagaagcaaatcaagaacttctctagataaagatgcaatgtgtctcctctgtccgatagtgctaggagcggtactgttactcactctacgcggcagcgccactcgatcaaaacctcacacaccgaggcgaaactttgtgggcagcagggtagagaaaagttaagattgttatagaagcttgagcatcaaaagatcaccccttcaaaaatatattcgaaatttcaaactcgaattgtggttttcagaagaagaaaaacttgaaactactcaaaacttgtattcgagatgaatcaacccataccaacgggtggcaatgattctagaaatgtatcctatgcctcaaacaagccaaaacttcctcacagactcagattcaagaattcactttgaaaatgaaacataagagctcaagtgaaagaaatcaaaccaaaaaccaaaacaatcagatttggacagggatttaccataaaggataggtgtgcttaaggccacacttcccaaaatcataagtacatagatccaacacaatcaaagcacctaaggatctcctaacaaaatgaaaatagagttaaaacaaaagctagagagatggttggttggtgcagcccttccttcttatttatagatggtattttcaaatttccaacatacctcctaaatacatagaacttatccacacatgcagtgataaaatggaccaactctaattttgatgatttgacaaacatgcttctttcatgaagttgcttcgctttgatacatcctccacgatggctccacatggcacctctgatttcctccgaaaccacacaaccaggttttgagactaaacccatagaaatcgtcgttgggtggttttgatgctcaactaccaaacctccacaggtagcgtcatccatacgtgtcccctatatcctagacacgtgtgccaccaaacttgaaccatgttgacaacacgatatgcatcgccatgtcctcgtgactgctgatgtccccaaatgtcaatcaccgcacctggttacctagctttctagtcccttagtcaagacccaacactcgtcattcaccgtttcctatcaccagcacgaatccgtatggcattcaccttcatcgttgaccactgtctccgatctctacacctacgcatcacaagccaagagtccaagacacatgtacaaactcacgcctcggttagtccatactactcaacccaatacgctactacgttgacaatcactctttacaaacgcgaaccacaaggacacatataaacgagttattttccacaaggacaaatataaacgagttattttcagtggccacatatctgccattgaaaattaacttagcggccaaaagttgatcgatttcttacggtgattgtagcccatgtcctagtagagttatatttgtgatataaagtagtagttaatagtcctttgtcagtaagtagatattatgcaaaaaaattatagacactaaaatgcttttttttttttttttcttgcaatatatcttctatagctttttggggatcagacaccagaccatgccactaagccatgaaaacacggtttaaaagctagcttgcatataaggcttgaaacaaattgttcataagatctctaaactcatattacatcaaaatatggcattctgattcgacaccgatggtcaacctaaacggttttgttttatgtacaatcgattggtaacagggaattagttcttcctttgtccagccttttgttgttctactctatcagaagcagacctcattgttaggtaatgcttgcttgagtggaccacttgacgtgcagcgtgttctcaatggcaatttggcttaagtcggtggaaagaatctgttgaggttgaaaggcaaagtgtagaactcttcattcctgctgtcgccacggaatgtcctgaaccgcgcccaccatggcattcctcggtcccttgctgcatctctcacatcaagtgtgttgtcaaggagtactgctacaatgagggcgacggcgggtggtgatgagaagctagtgttgatgtagtcattgaaccatccagcttttgtgtgcgctgggccttgttgagaacttgtggaatacctagagaagtactctggtatagataaacccaggaagagtgagacaccgatgatgaagagattgcgcatcgagttcatgttggtgaactgcataaaggagagccccacagcagcgacaattccaaacataacgcagtaaatggcagcgaatattgtgaaaggaatggaggcaaaaagtgctccaaattttccaagaatggagaagaagatcatgaaaccagcagaaatttgtatcactcttctgctaccaaccctcgttgatcctaggagaccaacgttctcaacagaaacagtagaaccagtcccagtgccaaacaggccatctagtagggtgccaatgccctgccacccaatgcctctgctcaggacatatgctggtgggggtgtcgcactagccaatcgtgcagcagctttgaatgctcccgtggtctctattaaagaaaccatcaccgctgccatcataccaaatgcatggtctgcactgaatgttggtgcaccccattgtaaagggtatggaatgcttatccattgtgatgaagatatgagattggcacggtctgtccgacagttgatctgggtgacaagtgctgtgtgcttgtatgcaccacttgctgtgaggatgtgggcatataaccatacaagagtgatgcacatcagcagtgagaacctctcgaaaacaggaacatgacgaatatgcacatgcttgagatactgggaaagcgcaacaaataggataagcatcggaagaccaatctccacgcatttcccaaccactgggaatcctctctcgaaaagtccaagccccaccagtgcaaccacgggaaccatcccaagtgggctgaagaacctagaacatatagcccacaactggctatatccaaggattatttggatgcttgaggatacaatcagtgaaccttgtacggccctcatagtctgcaggaatctagtgtggccatcagctatacgcgcgaacgaggggtcacggactatggagaggattggaaccacgtacgcgtatgaacctncccatgattgtgggaagacgagtgccgaatagcgtctggagcagcgtcttgatcccagtaacgaacagcagcgtttgaaccaccttggccttgtcatcatcatttccacccataagaggaaccagcagcgtggggatcatgacagcagtgcccaaggacagtatgtagtgttggaagcccaaagcgatcccttcgccccatgaaggattggagtcgatgcagtactccagtccctggagctggtccattggcagatgatgcaccatgtcctcaggcttcacctcggccatctctgaatctgctggaacaagcgcgggtcgggttctggaactctgagtatccgacgaaagggtccaagtccaagatctgagcctcgagagcaatcaatctgggcagaggaagcgaccctgagagcagagcagaggagaggaagagcgaggggacgtagcaacagccagcagcgctgcgaaagcccaagccaagacaagccaagcaggctccagttttgattaggatgttctaggtaatggtctcgtgcggaacgagatcctctgacgtggggcaacggtaagtaatgcgggggaagataaacgcgaatccagcaacgtaaacgttcgcctcttcggcgaccggggagacaaatgtcagcgggcgcagcggcggtggtcagggcctcagggtcaggggtcggcgggcgaggaagaagacggagaatggatgtggtggcgactgactgcggaacagtaaaaagcgcgcacgcaagcgaacaaacaacccccccacgcgtccgcccacgcgtccgc

SEQ ID NO: 20710 - DNA, 2179 bp, Zea mays
tatatttccatattttgtgaaatatgttagtcaacacaaaaaacgttgtattatccgtgcgcttgccctctgtctttttttttttttttttttttcttgttaagtctactgtttcacagcagcttaagccaaacgatttttaacttttcacagcatacagcttgcggcagttttttcacaacaaacaacccacacaagacagctgaaccaaccgctttttttcaacgcaaacaactcacagaagacagctgaaccaactgcaccggactcgatgaacaaacatttttctgaactaaagctttcctgcaactttgtcaggcacttagcctagggcgccagaattagtcctgtactgggctcgtaccgggtacaagttcaacgatacctcctaaaactcgaggatatacttactaccttcaatcaccggtacattttacgaacacacgcaggttaaaaactgactcagaacccacctgtcaacatgctcatggacctaaatcacgctgcccagacctcctaatttgcagtgttcaacagaaaccagaaacctccacaataacagttgcaggcaatcttccacctgacagcctgagcttaaaaaaaacaagccagttactagacaaaacaagctgctgatcaaaaacctcatctatccgaaatgtcagatgatgtgggaagtagtgatcgttcagcttgcatatctgcatgtgcttgagcttgaaccaggatctgaggctgcgcttgtgcttgtgcttgtgcgtgtgcttgtgcttgtgcatgagcctgtgccatggcctctgcttcggcttcggcttgactctgctgctttaggaaccgattcattcgttcgagcagctgcacagctttcctctttcctctgtccgtgccactttctgctagctcctccagcaaagacacgatgccctgctcctgtgcttcagcaagatgctgttgctgctgctcaccactgcatagatgcaccataacagcagcagcattttccttgttccttggagatccatttctgataactccaacaagtacaggtattgcagaagcagcgccgatagctgtcttcccctcaggatggcctgagaggattgccaatattgcaagggcctcatctaccatcccactttcagtctccatgagcagttctagtagtataggtaccaatccagctcttacagctttccccttgttgccctggtaaatacacaagttaaatagtgctgttgccgcatcctttttaccccgttggcttccattactcaatagctgcacaagtgcaggaattgcccctgaacacccaatagtcaccttgttctcatctacaatagataggctgaaaagtgtggcagctgaattctcccgagcctccatgctgcccctctttaacacatgcacaattccaggaacagctccagaagatattattcttgccttgttctcttcgtagatggaaagattcaagagagcagtaaccacatgttcctgggtgctaacatcagtggttgatagcagactaacaagaataggaatagcaccagcatctccaatacaagcacgattttcagcactgcgcttggcaagttgacgaagcataccagcagagccaccttggtcttcacccgcgcggccgcccactcgcccgagaagctcaagaacattgctatgctcagcagcactacatgacagtggtgcatccctaagttgagcagggcgttttggaggctcaataccatttgcctcgcaccattgagttatgagactacgtaagacataatttggggtcagggatttattggcaagcttctgttgtgtcttcggacaggtatcatggccagcctccagccacatctctatgtacccccgctcataagtctgcagaggcatatgcaaggaattataatgagctgaaatgcaaaaggtatgtatattgaatggaaacatttcaattggatattggacaaaagtatgacctgcccagtggcaacaataactggatctttcattaaatccagtgatattgggcaacggaaatcatcgggaataacaggacatgctgaattgtcttttgtagaaatggttgctgtacttgcttgggcacccatctcagggtcttctgtctgcacaaaatccttaatccttttgaggagcattgacatcttttcaacaa

SEQ ID NO: 20711 - DNA, 4050 bp, Zea mays
tgggtaccgggccttttttttttttttttatttttttttccaatccaaaagtctcaaataatactcatactggctaagaataatacatgaggcgagcacagattagtatcctcttcgagccccaggagacacaaaagaaaaagaagtatagatatgtttgacagcatcacaactcaagtctaagcacataaatagctctaccagatataccagcccctattacccaatgcaaaaggcataaaagtagttttagaagctggcatccatgtcgtctgttgagatagcttcctacagctcaaatcattatcaaccaccgacagcatccgctcactaatcaacatcaacttcctcatcatcgcccgtgtacctatccgcaaaaatattgcttgaagagacaatgtttcctacatcatcgttgtcaccctcccttaacttcttcactgtaaatgattctggtagatcagttcccttgctatcttggagatgttctagggcatcttcaggtctatagttctctgatgttgggatcatatcatcaccattctctctctgtctctttccagtttttgcttcttcacttgttgggagggaaataagtctttttctcgatgctgaaacatggttttgtctttggtcacttgggctcatttcattagcattatatggatcttcattggcagtaatccctatggaaccctgctccttggtacaaggcttcaaaatatctgaagcaagcaaatctgctagcctctcaaagcgagcctgagacctctttaaatcctcctgtgcttttatataacgcccatgtgctttgattagctttttggttttggaggacatcctttggcaatcttctttctctttgttcaattgcaattcaagatcttctactctgctacaaagtttgtgctcttcatcagtcttcttctctaatatcatctccagctttgatttgtcttcacgcaatgcttccatgtccagatgcatttgtttcagttgatcttcatgaccatttttctcatcactgcttaagtacctttcatcttttcctctgtcttcgttatcaggacttcgaacacttacggatgaatcggtttctccaccatcaggacttttactatgttttctctcactctgccatagagcataagcataaagataggcaatttcacaagcaagccataaacttgcaaaaaaaagcatgtatacagatcacatgcctaacataagatcaaaaaccctccttggtgataccaacattcatgaccctacacggctacaacccccccccaaagttataaatggatggtaatgagactccatggtagatcatggttgaacaatagaataaaaggtctcataaaccacaaacttaacattgcagctcgcacatataaaaaattaggaaaccaataaattagcagggattaagtcatgatggtacatgaagataaactagcccgatgtaataaacaaatttaagtacttctaatgactagatcttgaatccctaataattgttattcgttcctacatacctcttcctaataggtgatcttgaatgactagatcctgcaaatcaaatctcagggagtagttagaagatacaatggacagtggcaaatatttttattggcacaaatgtgcacagaaaaagtgattacccctatcttcagaacttggtctcttatcatgaaatgaacgacgcctgatatctctttcaggggaatacctcccatggggtgagtgtcttctatcaggcctgagtctaaactcatgatctctgtaatcccttctccctacaaatcaggaaggtggaagatttacccaaaaaaacattatgccatcaaagaacaagagttagatggggctgcatagatacaaggcaacacagaaacccattaaccttaccacaaccttgagccatatggttattcaattagctcaaaaattagagggcccacaataacaccaatacaccatagaccacaaacacagacgagccaatacaactaatgaaagagtagatgccaatacatgattatcatgattaaccacttagaattgatccagtacttctaatacgaatcacctgaagtaaatttggatggaatcaccaaaattaattagatgtcatgttccaatcaccatgacgtaaaatcttccaaaactcgaatagcaccaaataaatttaatttcatttgatcagatgttatccatatgactgccaaaaatcttgttccaagatgatacttgaagtgcaggtaacaataaagccacagatatagcttgatgcagtgtattcaaacggcatgtttcaattagttgcaaaagcttctaatagcattgttaaagctcactgaccatagcatgaattccatcgagaagataaaatgtataatatcttccatgttcagttcttctgaggcaggttaagcattcaagtatcataaatgaccgattgccatccggaacaaaggccaggatggaaataagatgtgccatcctctggtagcagtcaatctcaacaaatctgtccatgagatatctattgtaaaatcaaaataataaccagcaatgccaagattatctgcaatgaaatcaggcttgttgatgatttttgtgttctgcggcagcaagcactcagttcaagtaccactacacaggaatcatggtgtatatgcaccataagatgagaagatataacacaaactgagaaaagattcaggtgccaaaccatcatactgttatgcaattgaagggtagagtcttctcagcaacgggtagaaactataaaacctcccagaattgtcagccattaacatctgcaaccccatttgtacatcctcaaaggatgcacttgcaaattgttaacattatataattcttgcagttgcaactatcttccctgttcgctaactctcctcctgagatcatatgattcagatcacattgctatctgtcagtgtttgctgcaccactagcattcaaacattgggctgtgtctccagtcatcaaccaatcatcccaataactcgatgaataaacaggccgaatatgcatctctttgaagaagagcgcactggtgtctcttgctcgggaaaccatccaaataacctaatccgacaaattggcatggaatcgacaacattttgggtacggtaaaacccagaagaagatgataaggtgatgcaaagccctaaaacgacaaactaagcgcggatccataatgagagcgggagggagggacggaaggaggtgcgcgtggtgcaccccagctcgcggccgaggctggaaggaggcgcgagggggcggccttcggagctcagcctcgccgtgggcgaaaccgcagttggggcgggggcagccgcccctgcccctccaaagcgcgcacagcttcgtcttgtacgccgggccgcggaagggcggaggacctgacgcatccgggctcccgcctctgtccctctccctcatcccctcacgcatggctcctgaatgcggcggacagcagccccgcttgctacagtcgagacggcgggcgagaggatgaagccaagacgacgaataccatccccgaagggaaaggggacgggagaggaatttgttaaattatgtcgctcttcaaaacaggtggttaattgatactaggtaggtgcccgtaccctacgacgatgcacaaattattcgataaaactgtatattagttcagactccaatcatgtgttatacttcagcaaaacacataaaaattaaaaacccaccaaatatattctttggacactctgaaagaagtaatatatgtgtaccttggaataacaaattaagggcatgtttggtttgatgactaacttgccccactttgccacacttttctgcctaaggttagttcttcaattcgaacgactaaccttaggcaaagtgtgacacgtttagccacaaaccacacagcccttaaaaatgtcaggacaaagaagaatatacattcaagtgagccgtgaccttatcatggtcaatgaaaacatcaatagactctataatgttatcggcacc

SEQ ID NO: 20712 - DNA, 3718 bp, Zea mays
aattgcgactatctgtaatttttaagttctattattaatgcattactcagtcgactttggtccttaagagatcttgttggaatttaacaaatcatgattcaaaagtcaaaacactgatccatatttggttaaataagatgatcaacgaccccaagtatttataagtttccatgggaagtggtgaagtacctcgatcaagtactcatttggtagtttggatatgaatgaatgaacattagttgttcttgctgcttcagttatctccttgtcacttgcatccattttaccaatcttcaaattgtcctttatgttactagaaaatagtgatggttcctgagagactgaagctatgtttctgcgcagcgaattcagatcaattttcttgagactgtggccatcaatgaatatgtcccctgcagtattaggccttcttacatgactgaagcattttaatactacttaagcttacagttactaatgcttcacaaaagtacgagtattaaacaatatatgaccctttttgttcaggttttagttgaaaaatagtgaagtagatcatgtatatagttgcactgataagattatagaagcatacctaaagttggatcataaaacctttgaagtagtgaaatgacattgctctttccacagccactgcttcctaccaatgtgatgactttacctgcggggatggacaatgagaatccttgaataattggcttatcctagcgggaaggatatgcaaagtgccccctacagtgcctattaattttgtattagcaaaatggccagtaagtagcaagaagaacaataaaaataatttaaaaacttatgacaattagtaattaatatggcaggtctggttaatgagtggctatcaattgttgaatcattcattggcacatggatttatctcaagaagttactctacattgtactccagttcccactgttcagtttctgtcactttttgtcaaatcatagtttatcaaggacagctctcatgatgctcaagtccccagtgagctaacctgactgcagtccaacgctgatttagagcagctaaccaaatgaaaaacttgcattggacgtgcagcccaaagcttccatatttctttccatgtgtcaaaaccaacaaccctgagcccccaacaaagaaaatacaataagcagcatttcgtgtattgcaaaagtatgcctggtcttgcaagtttttaagcctaaaatctatccaatgacactgatgagcgctatgtattgtgtactcatgtggttacaatatacagttcacctgttgctggttattgatgatttgcctcataggaattttatttttcaagtgcagcctgactgcatcatattgatttgattctttctgcctaagactgaccttatggtacaaagcattttccttacatcatagtttcagaattttatggcaactttagacacaatgaatatgcagaataaaattcacctacaacgtatatgtgttgtgaaattaaaacaaaattggctcttgtgctactataaaccctattctatgatttatattggcatagacatacgtgtaatatatttgtgcattttttactccacttgtagtttctggaattttctccttatctgatctatcattgctgtcaacgtgcatattaaatacacgataactgtttaagagactacttgtgtttatttggtacatgtggtggaggatctggttagtcagtgatgctggtgtgctgtgttatataggtgtctggacaagtagcagcatttcatgtgacggttgacaggtgtgccttttactgctgcagattcctcggctggcaggtactttcctttcttttaccctattggctgtatgagttcattgttttttgttatttctctttttattagttcatttccatgctagctgtagatcaagttaatccagatgcattaactcagtgaattaaccagatgcattatggaactaacatatctgcaggcctgcttgatccatacttttgtatggtttccctttcagattaatcttaaataaattgtgcttatttttttgcttgttatttttgcttaacaataataaaaaactgccaagagtttatttattttgtaatgaaactgtcatgtgtcaactaaactcatctttctcatctgtagtctcttatctcccatcccaaacaaccaattccacgttgccgtccgcgggtttaagcattcaattgaacataaatgaccaattgtcaactgaaaagaaggccaggatagaaataggatgtgtcatcctctggaagcagtcaatctcaaattctcagtctcaataaatctgcccatgagacactatagtaaaatcaaaataataagcagcaatgccaagattatctgcaatgaaatcaggcttgttgatgtttttttgtgttctgcaacagcaagcactcagtttaagtaccaccacacaggaatcgtggtgtatatgcaccagaagacaaaaaaaatgagataacacgaactgagaaaaagattcaggtgtcaaaccatcatattgctatgcaattgaagtgtagattcttctcaaccacgagtacaaactatacagcctcccagaactgtcagctattaacatttgcatcccccatttgtacatcctccaaggatgcacttgcaagttgttatcattatataattcttgcagttgcaactatcttccctgtctgctagctcttctcctgagaacatatgattcggatcacattgccggtttgctgcaccactttggagcctctactcatcagccaatcatcccaataccaagatggacaagcaggcagaagatgcatctctttgaagaagagcgcgctggtttctcttgctcggatgaaacgtccaaataacttaatccgacagattggcatggaatcgacaacaatttgggtacggcaaaacccagaagcatacggtaaggcgatgcaaaaccctaaaacgacaaactacgcgcagatcgagaatgggagcgagagggagagacggatggaggtgcgcgtggtgcataccaggccgagggcgaggctggaaggaggcgcgagggggcggcctccggagctcagcctcgccgtgggcgaacccgcagttggggcgggggcagccgcccctgcctctccataaagcgcacagcttcgtcttgtacgccgggccgcggaagggaggagggcccgaggcatctgggctcccacctctgtccctctccttcatcccctcccgcatggctccggagcgcggcggacagcagcaccgcttgctacagtccagacggcggccgagaggatgaaccgaagacaacgaatgacacagggaaaatgggagggcaacagggaaggccggaagggcctataggcggcccatccgtccatggaagtcccattctacccattagggttcgtgattcaaaatattgttctaaaaattaaaaaattatatcatttaaaatgtttaaacaactacgtattttaaaaaagtagattacattattaagaaaaaaatgttgagaataatgtagaaacaaaaataagacacttgtacgtgtagtatgtttaggttacttcattatgtgtcatatattttttataaaaacgtaaaatatgtttgttggagctgtgttttttttaattgaatcctacatttcaagatacgacactaatttaagtcactgttaaag

SEQ ID NO: 20713 - DNA, 1673 bp, Zea mays
aggtaaatgaatcatggatgcatggtctttctattttttttttttttttaacaccagtccaaaaatctcatactcaaactggctaagaataatacatgaggcgaatacagattaatatcctcttcgagtctcaggaaacacagaaaagaagaaaattctagcatcgcatgtaatcatgtttgacagcatcacaactcagtctaagcacataaatagctaccaaatataccaggccctattacccgatgcaaaaggcatacaagtagttttagaagctgacatcgatgtcgtctgctgaaattgcttcgtacagctcaaatcgttatcagcgaccgacggcatcgggtcactaatcaacatcaacttcctcatcatcgcccttgtacctatccgcaaaaatattgcttgaagaaacaatgtttccttcatcatcgtagtcacccactcttaacttcttcactgtaaatgattctagtcgatcagttcccttgctatcttggacatgttctagagcatcttcaggtctatagttctctggtgttggaatcatatcatcaccattctctctctgtctcttcccagtttttgcttcttcacttcttgggagggaaataggtctctttctcgatgctgaaacatggttttgtctttggtcgcttgggctcatttcattaccattatatggatcgtcattggcagtaataccgatggaaccctgctccttggtataaggcttcaaaatatctgaagcaagcaaatctgctagcctctcaaagcgagcctgagacctctttaaatcctcctgtgcttttatataacgcccatgtgctttgattagctttttggttttggaggtcatcctttggaaatcatctttctctttgttcaattgcaattcaagatcttctactctgctacaaagtttgcgctcttcatcagtcttcttctccaatatcgcctccagctttgatttatcttcacgcaatgcttccatgtccagatgcatttgtttcaattgttcttcacggccatttttctcatcactgcttaagtacctttcatcttttcctttgtcttcgttatctgaacttctaaaacttacggatgaatcggtttttccaccatcaggacttttgctatgttttctctcactcttcctaataggtgatcttgaatgactagatcccctatcttcagaacttgctctctgtctcttatcacgaaatgaacgacgcctgatatctctttcaggggaaaacctcccatagggtgagtgtcttctctcaggcctaactctaaagtcattatctctgtaatcccttctcccaggccgagggcgaggctggaaggaggcgcgagggggcggcctccggagctcagcctcgccgtgggcgaacccgcagttggggcgggggcagccgcccctgcctctccataaagcgcacagcttcgtcttgtacgccgggccgcggaagggaggagggcccgaggcatctgggctcccacctctgtccctctccttcatcccctcccgcatggctccggagcgcggcggacagcagcaccgcttgctacagtccagacggcggccgagaggatgaaccgaagacaacgaatgacacagggaaaatgggagggcaacagggaaggccggaagggcctatcctcgtgcc

SEQ ID NO: 20714 - DNA, 717 bp, Zea mays
  misc_feature (48)..(48): n is a, c, g, or t
tctcagccacccccatcctcgtgcaaatctgtcgccaccaccacccgntacgcccgctatcaacaacctccgcctccatcgccgtgcgtctcggccatccctcgactctgagatttacgccgctctcaagaacccccgctctcaaaaaccatgctcccaaggaggtactgcagactgctcgcaagtcctggtagcgcagaaccgcgcgtcctcaatccgctactccggcaagcccgctccccgactgttcaactaatccgccgtcacctcgcgtccgccctcgtcacattggttttcgccgaggtgtctggacaagtagcagcatttcatgtgacggttgacaggtgtgcattttactgctgcagattcctcggctggcagggccatgtgggggagtgctagacgaatggaatttgatagggatgcaaagattcttcgaaggaactttgtaattgatctgttaagttacgaggacaattcatgccgctatgctatccttgcaaacatacaataaagacttatcaatatcgcttaaaaggattagattaatgtacggttgtcgacatatttgcttattattaaaaattgtaagacatcacattttttaattgaggttgcatcaataaacaggttgatgtagaccaatatggtttgtgtgtggtttacatgttttaaatataaatatatggggcagcaagcgaaaaaaaaaaaaaaaaa

SEQ ID NO: 20715 - DNA, 1132 bp, Zea mays
atcggttggtttatgcaccagcgctcagctgtgtttcgacctgcgtgcgtgcttgagagagaggcgacttcccggagtttagcatcttcttctctctcagtctcaccctgtccctcgcgaaagatctccatacttccctcctctcttcccgcactgttctcggaatcgctcttctcctccgcgctgttcttggaatcgaaaggtgggaagcgcaatgagcaacgagttcgattacctgttcaagcttctcctgatcggcgactcctcggtgggcaagtcctgcttcctcctccgcttcgctgacgactcctacgtggacagctacatcagcacgatcggcgtcgactttaaaatccgcacggtcgaggtggagggcaagaccgtaaagctgcagatttgggacacagcagggcaggagcggttcaggaccatcacgagcagctactacagaggagctcacgggataattattgtttatgacatcacggacatggagagcttcaacaacgtgaagcagtggcttgacgagatcgaccgatacgccaacgacagcgtatgcaagcttcttgttggtaacaaatgtgatctggccgagaacagggctgtcgacacttcagtagcacaggcttacgctgaagaggtaggcatcccgttcctcgaaacgagcgctaaggagtcgatcaacgtcgaggaggcgttcttggcaatgtctgctgcaattaagaaaagtaaagcagggagtcaggcagccctggagaggaagccctccaatgtagttcagatgaaagggcggccgatccagcaagagcagcagaagagtagtagatgctgttcaacatgaggcacagcaatgtctgtctttggagaatcagtaaaatgattatctgctagactagatgtgtttctctgtcttcgtttgttttgagacacatatatatagttgcgaaaatgcggtggtgagaaactcgaaatgaatctgagccagaactcggaccgccaaatttcatcatttttactcacaaatttctaccatattgaacagcgagataatccaaccttgaaaaggtagtttatttacaaaaaaaaaagaacgaagggcggccgccgactagtgagcccgtcgatccgggca

SEQ ID NO: 20716 - DNA, 993 bp, Zea mays
tttctatagtgtttcttatttattaggtcattcaacctgaaatgtgtcatatgccatcacaacattgatttactccatgatacatacagagtgctggaggagatagtacctattaattgatgttaatttgattcccacgttattgttttagtaatcactaatttccctaccttgtttcttgattgctaggctctctgtagtttactaagtgactttttgttagctactgtggtatcaggaactgataacaaccatcatctttataatagttattacctattaggatatgcaacatcttgaactttttggtacagacagatataagagtgagcccctctcaacttgagcggattatcttgtttctatgtttttgtttatcacatagacgaagttaatgcttaatcttcagagatgcatataaccaagtgacgcttacttggatctgagaacctctggtgcttgtttatctcaagtaagccttttgagtctgaatgtttcgttgaagaacatcaattcttaattgcaagtcaatgttgtaattcttgagaagaagtcagggaagcttataagaagaaaggatgggctctaacaaatcctttacctaatttaccaggatgggagagtgtcgaatgctttttcagatactatttcttggttcgtcaaatctatttgacctaaatgcaagtttttgctcaaatgtggcaaaaaatgattgtctcaccaattgtcagcacaactgcctccaacaaagttagaatgaaaagatggaatagaactttggtggccgcacatgtgtgaagacttgagttcatatatacttatttaggtcaacgttaacgcaaacagttgatgaccaaaattttcaattagtactttagtttgaatttagattacacttttgtatgagttatttgacaatgcttatttatgagatattgaatggtatttatctatattatattaattataatgtgggtttaaaaaaaaaaaaaa

SEQ ID NO: 20717 - DNA, 1057 bp, Zea mays
gccggccgggtctcgatcggatcggttggtttatgcaccagcgcccagcggtttctcgaggtgcgtgcgtgcgtgcgtgagagagaggcgacttcccggaggtttagcatcttcttctctctctctcagtctcaccctgtccctcgcgaaagcatctccatccttcgctcctctcttcccgcactgttctcggaatcgctcttctcctccgcgctgttcttggaatcgaaaggtgggaagcgcaatgagcaacgagttcgattacctgttcaagcttctcctgatcggcgactcctcggtgggcaagtcctgcttcctcctccgcttcgctgacgactcctacgtggacagctacatcagcacgatcggcgtcgactttaaaatccgcacggtcgaggtggagggcaagaccgtaaagctgcagatttgggacacagcagggcaggagcggttcaggaccatcacgagcagctactacagaggagctcacgggataattattgtttatgacatcacggacatggagagcttcaacaacgtgaagcagtggcttgacgagatcgaccgatacgccaacgacagcgtatgcaagcttctcgttggtaacaaatgtgatctggccgagaacagggctgtcgacacttcagtagcacaggcttacgctgaagaggtaggcatcccgttcctcgaaacgagcgctaaggagtcgatcaacgtcgaggaggcgttcttggcaatgtctgctgcaattaagaaaagtaaagcagggagtcaggcagccctggagaggaagccctccaatgtagttcagatgaaagggcggccgatccagcaagagcagcagaagagtagatgctgttcaacatgaggcacagcaatgtctgtctttcgagaatcagtaaaatgattatctgctagatgtgtttctgtcttgtttgttttgagacacatatatagttgcgaaaatgcggtggtgagaaactcgaaatgaatctgagccagaactcggaccgccaaatttcatcattttcactcacaaatttctaccatattgaac

SEQ ID NO: 20718 - DNA, 1960 bp, Zea mays
  misc_feature (1922)..(1924): n is a, c, g, or t
  misc_feature (1926)..(1927): n is a, c, g, or t
aaaaagaagctagaacacgctaacaagacaacaaggtgagtagtttcttgctccaaccgccttacctgccgttgactcgcttgctgcctcggctcatggggcgctactacctgtaggatcatggggcgcgggcgcggccacctcctgctgccggcagcagccgcctgcctgtgggcgctgtcgtgcgcgctgctgctgcgcgcgtcccctcaccgcgctggcgccggcgccggcgggctgctgagggtcgggctcagcaggcgcggcggcgggctcgaccagcgcgcgctggcggcggccaaggccgcgaggcagcaggaggcaagccgtctcggggcctccggcggcggcgacgtccctctcgtcgactacctcaacacccagtactatggggtcgtcggcatcggcacaccgccgcagaacttcaccgtcatcttcgacaccggcagctccaacctctgggtcccctcctccagatgctacttctcgattgcctgctacctgcaccacagatacaagtcggccaagtctagcacgtacaaggcggacggcgagacctgcaagatcacctacggctccggctcgatcgccgggttcttcagcgacgacgacgtgctggtcggggacctgaccgtcaaaaaccagaagttcatcgagacaacgcgcgaaagcagcgtaacgttcataatcggcaagttcgacggcatcctcggtctcggataccccgagatctccgtcggcaaggctcctccgatctggcagagcatgcaggagcaggagctgctggcggaggacgtcttctccttctggctgaaccggagcccggacgcggcggcggccggcggcgagctcgtcttcggcggcgtcgaccctgcgcacttcagcgggaaccacacctacgtccccgtctcccgcaagggatactggcagttcgacatgggggaccttctcatcgacggccactccaccggtttctgcgccaaggggtgcgctgccatcgtcgactccgggacttccttgctcgctggcccaacggccataattgcccaggtgaacgaagcgatcggggcagacgggatcatcagcacggagtgcaaggaagttgtgagccagtacggagagatgatcctcgacatgctcatcgcacagacggatccacagagggtgtgcagccaggttggtctgtgcgtgttcgatggcgctcgatctgtcagcgaggggattgaatctgtcgtcgggaaagaaaacctgggctcagatgtcatgtgctcggcctgtcagatggctgtcgtgtggatagagaaccagctccgcgaaaacaagaccaaggagctcatactgcagtacgctaaccagctgtgtgagcgtctgccgagccccaacggagagtcaacagtcagctgccaggagatctccaagatgcccagccttgcgttcaccatcgcaaacaagaccttcaccctaacaccccagcagtacattgtgaagctggagcaaggaggccaaaccgtctgcatcagtgggttcatggcgtatgacgtgccaccgccgcgtggtcctctctggattcttggggacgtcttcatgggagcttaccacacggtgttcgacttcggcaacgacaggattggcttcgcggaatctgcatgagtgtggagagcactctcatctttataaagacgataccctatgtattagggatgtgtagtttactgtctatccactacatgccaacagtacgctgcaaataaatcggtggccaaaattgctgaaaccagaaacgtgaacagtactgctttctttgtttctggagaagagcaaatggatgcttcaagacatgcatgtccgatgtgtattgagaaatagagcgacgagtgctgctcgatcgtcttgaaatttaaaaaaaaaaaaaaaaaaaaaannnannaaaaaggaaaaaaaaaaaaaaaaaaaaaaaaag

SEQ ID NO: 20719 - DNA, 896 bp, Zea mays
gcgttcgcccccgccgctcccgcacttagccactcttcttcctcctgatcaatccgctctccagcacttgttcggaagaaaaagaaggtagaacacgctaacgagacaacaaggatcatggggcgcgggcgcggccacctcctgctgcgcgcgtcccctcaccgcgctggcgccggcgccggcgggctgctgagggtcgggctcagcaggcgcggcggcgggctcgaccagcgcgcgctggcggcggccaaggccgcgaggcagcaggaggcaagccgtctcggggcctccggcggcggcgacgtccctctcgtcgactacctcaacacccagtactacggggtcgtcggcatcggcacgccgccgcagaacttcaccgtcatcttcgacaccggcagctccaacctctgggtcccctcctccagatgctacttctcgattgcctgctacctgcaccacagatacaagtcggccaagtctagcacgtacaaggcggacggcgagacctgcaagatcacctacggctccggctcgatcgccgggttcttcagcgacgacgacgtgctggtcggggacctgaccgtcaaaaaccagaagttcatcgagacaacgcgcgaaagcagcgtaacgttcataatcggcaagttcgacggcatcctcggtctcggataccccgagatctccgtcggcaaggctcctccgatctggcagagcatgcaggagcaggagctgctggcggaggacgtcttctccttctggctgaaccggagcccggacgcggacgcagcgtccggcggcgagctcgtcttcggcggcgtcgaccctgcgcacttcagcgggaacaacacttacgtccccgtctcccgcaagattactggcagttcgacatgggggac

SEQ ID NO: 20720 - DNA, 5008 bp, Zea mays
  misc_feature (2338)..(2338): n is a, c, g, or t
  misc_feature (2479)..(2479): n is a, c, g, or t
  misc_feature (2682)..(2682): n is a, c, g, or t
ccgtccgggagggggactggatggagtagtacgtggacgatgccaatcccagcgtttgtgtttgtcgcccagacgccttctcctctttccccctctccgccttgactcactcacttgaccactcttcttcctcctcatcaatccgctctccagcacttgttcggaagaaaaagaaggtagaacacgctaacaagacaacaaggatcatggggcgcgggcgcggccacctcctgctgccggcagcagccgcctgcctgtgggcgctgtcgtgcgcgctgctgctgcacgcgtcccctcacggcgccggcgccggcggcctgctgagggtcgggctcagcaggcgccgcggcgggctcgaccagcgcgcgctggcggcggccaaggccgcgaggcagcaggaggcaagccgtctcggggcctccggcggcggcgacgtccctctcgtcgactacctcaacacccagtactatggggtcgtcggcatcggcacgccgccgcagaacttcaccgtcatcttcgacaccggcagctccaacctctgggtcccctcctccagatgctacttctcgattgcctgctacctgcaccacagatacaagtcggccaagtctagcacgtacaaggcggacggcgagacctgcaagatcacctacggctccggctcgatcgccgggttcttcagcgacgacgacgtgctgggtcggggacctgaccgtcaaaaaccagaagttcatcgagacaacgcgcgaagccggcttaacgttcataatcggcaagttcgacggcatcctcggtctcggataccccgagatctccgtcggcaaggctcctccgatctggtaggtatctatctcattgctcttgcacccgccggcgggcggcggccggcccatcacatgtaggttgccaggcagagcatgcaggagcaggagctgctggcggaggacgtcttctccttctggctgaaccggagcccggacgcggcggcggccggcggcgagctcgtcttcggcggcgtcgaccctgcgcacttcagcgggaaccacacctacgtccccgtctcccgcaagggatactggcagttcgacatgggggaccttctcatcgacggccactccaccggtttctgcgccaaggggtgcgctgccatcgtcgactccgggacttccttgctcgctggcccaacggccataattgcccaggtgaacgaagcgatcggggcagacgggatcatcagcacggagtgcaaggaagttgtgagccagtacggagagatgatcctcgactagtgctcgatcgcacagacggatccacagagggtgtgcagccaggttggtctgtgcgtgttcgatggcgctcgatctgtcagcgaggggattgaatctgtcgtcgggaaagaaaacctgggctcagatgtcatgtgctcggcctgtcagatggctgtcgtgtggatagagaaccagctccgcgaaaacaagaccaaggagctcatactgcagtacgctaaccagctgtgtgagcgtctgccgagccccaacggagagtcaacagtcagctgccaggagatctccaagatgcccagccttgcgttcaccatcgcaaacaagaccttcaccctaacaccccagcagtacattgtgaagctggagcaaggaggccaaaccgtctgcatcagtgggttcatggcgtatgacgtgccaccgccgcgtggtcctctctggattcttggggacgtcttcatgggagcttaccacacggtgttcgacttcggcaacgacaggattggcttcgcggaatctgcatgagtgtggagagcactctcatctttataaagacgataccctatgtattagggatgtgtagtttactgtctatccactacatgccaacagtacgctgcaaataaatcggtggccaaaattgctgaaaccagaaacgtgaacagtactgctttctttgtttctggagaagagcaaatggatgcttcaagacatgcatgtccgatgtgtattgagaaatagagcgacgagtgctgctcgatcgtcttgaaatttgtttgttcatggtagcacagcttatcacttataaaataatttgtggatcgccttttataggaccaaattagatcatgagaggagggtgaatgagagtcaatattttttaatcgaaaacgatcttgggttcaatcctaactaacatcgagaactctctaagaacaaaaaaaaaaagaccaacactaggcctattttgggaaccccaattttctatggaattttcatttttctaagggaaattagttcattttcccttgggaaaatagaaatcccttggaaaaatntagttcccaaattagtgtggcagctgtggatctcatcagcagtaaaatgatgcaatatatgcttaaaatgatgcaataaacacagcggaataattaaaccccacaacgaaaaacacaccagcactttagtgtggcagctgncagctgtggatctgatcagcagattagagagcgcaaaacctaacaaaaataaataaagcccaaatagagcacacttgggtgtctagaactactatagcacccaaatagtgatgtggatcctcaaacatcaaaattttactattaataggtcttcgaccattttccttacaacttgtacatgatgtagccttgacaatgggcantccatcactctgtactccaacacagtcttgttactctcagcgcatgcactaggaggaaagcatgtcattagtcactcatgaaccccatgtgaggccgtggacctagacctagacggagacaccatctagctattttatacttattttgattaactagtataggcaaaccatatatatatacacacactagcaagtaaacgccttaatctaaaatgacgaataaaataaaaaatccaccattattaccaatctaaaaaataaaaaaatctatttttaaaccatgaaataagctatactaacaatgaaaggtggatacttattttgatcaactactatatgagctttcttcttctatatgtgtaaactatcaagtaaaactaaggttaaatgacgtataagtcaaaataaaatcactattattccaaataaaaatcacaaatttctctatttctaaaccatgaagtgaattatacaaaagcaataaaacatgataggataaagttcctaacctttataatcctacaatgggtaaaagaatggactctttacaattcgtccacaaatgaactccttccattagtaagaacacagagcttcaaatagctcgattggtctaaggggatatataggtggacatagtcctgattggtcgcttaatctgagactaaatgccaccttttagtctcagttggagccatcaaacatggctaaaggtctcttctaggctagctttgcggcactagacttggacccatgaccaaatgagtggtctcggttctcaattaggccttgttcgtttgtgtcggattgcacacagaatcgttttagctaatcaaagtttatataaattagagaagcaatctggttaggaatcgttccgacccgccaatccgtaagaaccgaacggagccttactgggtgggtaatttggaccaaaatgtaagggttcaagttattttttataatggtggcattttggcagtttagattcaaactttagaggttgtttaaaaactatcctttataataatgaccaaggtggataatttagatgtgaatttattatatggggttaccttatctagttttggtaatgtagatgtaggtaactttttatatagagaaatatacgactattatcagagatgatggctagtctatatatcaaattagagattagttgttttttattattgtaaaattttctattatttatgtttttatctagttactgatgatgattattagagtgatataaaaaatactgattgttctaattaagatacattagtttgtcttatgaggattattggaatatctaattaataaataatattaagattattttgcttatggatatactagcatatatattgtgaaacgtgtcgagagtgccgattccccgactaactgcagaagaaattaaagtacagatatggcgtacatgaaaattcaaattgcctttataaaaaactcaattataatccatttacaactctctacaacgtagtaagtatataagagggctctatggtatacattaagcgtacaacttaaagccgatgtgtgtatacggatttatgcaccgatggcggtgcatgagagctttggttccaatgtcattgcctgttgtcattaagcctttgcaaaagcgcatgcaatgcagtctcacgtgctccggcagccgcagccgtggcgggcccagtgccggcgctaccgttaccaccatctccggaggcgtcagcggcgccgcttaggtgaggagcttgtggctcagcgcctccggctccggccatgatcgtcgagagcgcggccgccagcgccgtggtaaagttggggtcgctggcgatcgcggccgtcatggtgtccagtgccgaccggttccttccgtccaaacccagcagcgtcgcgccggccggtgggtgtggggctggcaccggcgccgccgccagcctgtgcccaccagcaccagggaagccgtacggcatcgggaacggcatggccgggacgggcggcgtgggcagacggtgctggagcaggcccgcggccggcggcggcggcgagtgcgtgaggtcgagggtgatcgtcgggaacggcgcggaggcggagagcgtggcggccgacgcgtaggggtggtactgggcgaagagcggcgccgcgacgtggtggccggcgaagagcgcgcccgcgtcgcggctgacggccgggccggagaggagcatggcggccgcggctgaggtggtcttggccatcgcggcggcctgcggcggcagctggtggctgtgggtgccctcgtacgtggtgatcagcaccgccttgtcctccg

SEQ ID NO: 20721 - DNA, 2165 bp, Zea mays
cccacgcctccgcgcacgtcccggccggccgatggacgacggagtagtacgtggacgatgccaatcccagcgtttgtgtttgtcgcccatacgcctgcccctctttccccctctccgccttgactcactcacttagccactcttcttcctcctgatcaatccgctctccagcacttgttcggaagaaaaagaaggtagaacacgctaacgagacaacaaggatcatggggcgcgggcgcggccacctcctgctgccggcagcagccgcctgcctgtgggcgctgtcgtgcgcgctgctgctgcgcgcgtcccctcaccgcgctggcgccggcgccggcgggctgctgagggtcgggctcagcaggcgcggcggcgggctcgaccagcgcgcgctggcggcggccaaggccgcgaggcagcaggaggcaagccgtctcggggcctccggcggcggcgacgtccctctcgtcgactacctcaacacccagtactatggggtcgtcggcatcggcacaccgccgcagaacttcaccgtcatcttcgacaccggcagctccaacctctgggtcccctcctccagatgctacttctcgattgcctgctacctgcaccacagatacaagtcggccaagtctagcacgtacaaggcggacggcgagacctgcaagatcacctacggctccggctcgatcgccgggttcttcagcgacgacgacgtgctggtcggggacctgaccgtcaaaaaccagaagttcatcgagacaacgcgcgaaagcagcgtaacgttcataatcggcaagttcgacggcatcctcggtctcggataccccgagatctccgtcggcaaggctcctccgatctggcagagcatgcaggagcaggagctgctggcggaggacgtcttctccttctggctgaaccggagcccggacgcggacgcagcgtccggcggcgagctcgtcttcggcggcgtcgaccctgcgcacttcagcgggaaccacacctacgtccccgtctcccgcaagggatactggcagttcgacatgggggaccttctcatcgacggccactccaccggtttctgcgccaaggggtgcgctgccatcgtcgactccgggacttccttgctcgctggcccaacggccataattgcccaggtgaacgaagcgatcggggcagacgggatcatcagcacggagtgcaaggaagttgtgagccagtacggagagatgatcctcgacatgctcatcgcacagacggatccacagagggtgtgcagccaggttggtctgtgcgtgttcgatggcgctcgatctgtcagcgaggggattgaatctgttgtcgggaaagaaaacctgggctcagatgtcatgtgctcggcctgtcagatggctgtcgtgtggatagagaaccagctccgcgaaaacaagaccaaggagctcatactgcagtacgctaaccagctgtgtgagcgtctgccgagccccaacggagagtcaacagtcagctgccaggagatctccaagatgcccagccttgcgttcaccatcgcaaacaagaccttcaccctaacacccgagcagtacattgtgaagctggagcaaggaggccaaaccgtctgcatcagtgggttcatggcgtatgacgtgccaccgccgcgtggtcctctctggattcttggggacgtcttcatgggagcttaccacacggtgttcgacttcggcaacgacaggattggcttcgcggaatctgcatgagtgtggagagcactctcatctttataaagacgataccctatgtattagggatgtgtagtttattgtctatccactacatgccaacagtacgctgcaaataaatcggtggccaaaattgctgaaaccagaaacgtgaacagtactgctttctttgtttctggagaagagcaaatggatgcttcaagacatgcatgtccgatgtgtattgagaaatagagcgatgagtgctgctcgatcgtcttgaaaattgtttgttcatggtagcacagcttatcacttataaaatagtttgtggatcgccttttataggaccaaaaaaaaaaaaaaaaaaaaaaaaaaaaaaaaaaaaaaaaaaaaaaaaaaaaaaaaaaaaaaaaaaaaaggaaaaaaaaaaaaaaaaaggcggcc

SEQ ID NO: 20722 - DNA, 884 bp, Zea mays
acgagtctttcttctttccgttccttccctcctgaattctccgctcacgccaatcgaggcacgcaaatggctgagagccccagctgagcaaccagccaaagcgagaaatccacttggagaagcttctgcgcctccctcccgaacggaggcgggccggggcggggaggggagcacgcctgcgctctgcgcctgcgggtagggtttctcccggcccgacgatggcgtccgccaagtcgtcgaggtcgcggcccgccggccactccggagtgttcccggtgaacgctgcggccggcgcgggaggcagcgacggcggggtgcagctcgcggacaagctcaagatattcaagaccgacaacttcgaccccgacgcctacgtgcagtccaagtgccgcgccatggacgagaaggaaataaggcacctgtgttcctacttgcaagatctaaagaaggcttctgctgaagagatgcgcagaagtgtttatgcaaattatgctgcattcatcaaaacatcaaaggagatatcggaccttgaaggggagctactatcagttagaaatttgctaagtacacagtcagctttaattcatggtctgtccgaaggggttcagatagattcgttgaccacagggcctgaaggctctgctgaacaagacatatccagtgttgaggatcaggagccatcagaaatatggaaatggtccacagatttccctgacatgcttgatgttctgctagccgaaagaagagtggatgaagcactggatgccttggatgaggcagaacggatcgctgctgatgccaaacaaaagggaactctatccacgactgacattctggctttaaagagggtatatctgaaaaccgtcagaagttggctgatcagc

SEQ ID NO: 20723 - DNA, 2242 bp, Zea mays
cattgggtacctcgaggccgccccgcaccgccacaagtgaagtcaccgacggacgcacggctgcagcgcgctcctactctcccgcgatcgccaccggggaaggggcaatagaataaagtgagggcagccaatgcaggccgccgtcaacaccaccactgtcggcgctcacccgcacccaacaaagtcctcgttcctccgtccgtcccctccttgccgcgtctacttccacgcttctccacgcccgaaccttagggcgatcgccatggccagcaagtcgcagctgcaggaccaactgatcatcactcgccccgacgactggcacctccatcttcgcgaaggcggtgtcctcgaggctgtagtgccacacagcgcgaggcattttgggagggccatcatcatgcccaacctgaagccgccggtgaccacaacggcacgggccgtggagtacagggaggagataatgagggcgctgccgccagggagtagcttcgagccgctcatgacactatacctcacagacaacacaagcccagaggagatcaagctcgcaagaaagagtggtataatttttgctgtgaagttgtatcctgctggagcaactaccaattcccaagatggtgtcactgatatatttgggaagtgcttgccggtcctcgaggagatggtcaggcaggaaatgccgttgcttgttcatggagaagtcacagatccacatgttgacacatttgaccgcgagaaggttttcattgacaaaatattagcaccacttgtacaaaaacttccgcagctgaaaattgtcatggaacatatcacaactatggatgcagtgaacttcatagaatcatgtgaagaaggtcatgttgctgcaacagtgactccccagcatctcctcctcaataggaatgctttatttcagggtggcttgcagccacacaattattgcttgccagtactgaaaagagagactcatagacaagctattgtgtctgctgtaacaaatgggagtagacggtacttccttggtactgacagcgctccccatgataaacggaacaaagagtgttcctgtggatgtgctggaatatatagcgctcctgttgccttgtctctttatgtgaaggtatttgaagaggctggtgcccttgataaactagaagcatttacaagcttcaatggccctgatttttatggcctcccaaggaacacttcaaagattatcttgagaaagaatgcctggaaagttcctgctacttataaacacagttcaggggagattgtgcctatgtttaatggcagcacccttgaatggcttccatctgatcagcctaaagagtaaacagtatacattattggacccagcacttgggggaatcaataggtggagttttctagttctttttcccgtttccactagaatcagcatagcgaaactattctgcttgttgaaagcaacggtggaggatctgcttgttgagttgttatatccatttgcattgcagtgcaattctggaagtagctaaaaggccatattgtatgtttatcaaggctagtctactgatctagacaccatagcatctgtggtttctaaggtgacaaggcgaccaggcaagagctgggtgtgtctggacgcctagatggcacaaggtgctacttttccccaaggcgagctgggtatgcttggacacctagcctctgaaacatgctaccacatccataataatgtaatgaataaatatcagcatttcagttacatagccgtataaccttctagtccggacataatatttctatgtttttgttactctgtgtctgaataaatagatttctactttaaaattgtctttaaataaatcaatctctaggaggctaaacggtccatcagcctatctatttttcttgaagtctcctcgtgtttactgcacctcccatctcctaatctaatattgaggttctgcaggtcgatgtgtgtagtatatgctataattagtgtgcaattggaacgtttttcaatcaatgtgcactctagtcaatgaaggttagtatgattttttctctatcatactaatctcttctaaacttattagaaatctactctctccgtccaaaaataaattttgttttttacatttttagttgattcatacaataattaatgtatttgttttatatatgtctatatttattatgatctatttgaacgacataaaaaccaagagttaaaacgattaatattattttggga

SEQ ID NO: 20724 - DNA, 2133 bp, Zea mays
acccaaactcgccgtccgcctccgccaccacccccgcccgcgcccatagcaagctcgccttccacgcgcgcggccgcgccagcgcaccacgcctcgcttcgttttcccgttgcttgacgctgaatccattccaccaccacccaggcacggccaggccagcgccagcgcgtcgtccccggcccccgctccgcctctccggtcgcgcccgcctcggggcgaccaccaccaaaatagaaacttccgtgtgtaggtgacccccggctttacccccgcccgaccgcccccaccccaccccgcccacgcctccctccctcccgccgggacaaaaccgccgctcctcctcctccgcccctccccgctctttctgtgaggcgggaagcgaggcggatgccgaggcgacggggctcgcgcaccgcacgcgtgtgcccgccgcccgggggccaggcgaggtggtgaggtgaggccgagcgcggttttaaattgttcacccggccgcccttctcgccgtagttttcagtggtacaagcaagggaggaacgaacgtgagggctgcctgcctgcctgcggacatgggctccagcctcaagtaccgatctggcctgtgcctcatcgtcgccgtcgtgctgatctgggtcatctctgccgaggtcacgcaggggatattcacaaagtacagacatccatttgcagttacttacttgggggcctcccttatggtcatatacctccctttgtcatttctaaaagattttatatacaattcgttgagaaggcattctagaaacactagtgcttccaaaattgcaagcaaatcttcctttggtggtagtgcccctttgaagaatggtgaatttcagaagatgttggaaatggaatcacagaaaactatagtggtaaattgccctgatgtgagcatccctgtagtggaagagacaaaaccactcatatgcggaatcactgaaatggatgatggccttttcaaggacaagcaactttccactaaggagattgcaacgtatggattgtatctttgccccttatggtttgtgacagagtatttatcgaatgcagcgcttgcaagaactagtgttgccagtaccacagtgctgtcttcaacttcaggactcttcactcttttcattggtgttttacttggccaagactccataaatgctgcgaaaattattgctgttttcattagcatggctggcgttgtaatgacaactgtgggccagacttgggcatctgatgaatcagaagcaggcaaatctggttttacacagaggactcttctaggtgatatgtttggtcttatgtcagcaatcgcctatggtctatttactgtgctgcttaaaaaattttgtggagaggaaggagaaaaggttgatgtccaaaaactgtttggttatcttgggctttttacccttgttgctctatggtggattgtctggccattaaccgcactaggcgttgagccaaagttttcaatgccccactcagctaaagtggatgaagtggtggtggcaaatagcctaatcggaagtgtattatcagactacttctgggctctttctgttgtttggactactcccttggtggccactctaggcatgtctctcacaattccaatagcaatggttgctgatatgatcattcacggccgtcactattcagcagtatatattcttggttctgtccaggtattttcaggctttgttatcgcgaaccttgcagatcgcttttctcgttctctagggctatcatagtctcataaaacagaacaggcccttattagagcgtgcatcaggaagctccaaggtcgggttggttaggccaatacttcagaaaacctggatcgggagatgccaggaattattttccctttgcttctttaaacatagtggaggtgaattttgccgtggtgaatagtgaaaggcagcagatgaagaagaaaacatatgttatagcaaccctttgcaactgtaaattctcttactacaaattgcgcgacagtgtagactgcggccgttctcggcccatgtcaacaggcttgctcgatttcaaatttgcaatgtccttttatccgtgttcatggcaattgcaccaagttctaccgcaaaaaaaaaaaaaaaa

SEQ ID NO: 20725 - DNA, 1756 bp, Zea mays
aaaggtcaattgtgaacatatcagtcatacatactcaagagctactattactgtcccaagatcatgaaatatataatccacaagtagccaagaagatgaattctgtgtcaatgtgcatgtcaaaagaactcaatccaccactgattatttctaaatcaattgaatattgatatggtactagatattagattaaattgcaagcagcgtcgcttaccatccaatagtattgttgtcaacattaacttcccgtcaaacacctcatcatctcaagctgataattggcaccatctgcatctgcttcatcatcctcttccctcatcttcagtaaaaaatagtaagatagccattagcctataaaatgtgaaagaacagctactaccctggaagaccttagcagaaaaatacataatcagtacagagctgcttagaatgttaaggagcaagggctcacagggaatggaaaacagttggtcacttccagaacactaccgacatccaaaccaagcaattgacctgtaactaaagcaggcgcaaactcctcacagtgcttaatgatcttcagtacagcctgcaaaaatagcattattgtgaaaacaaataacacagtgcttgtggaattaagatacaaagaatgcttcctgctacagggaaatttatcccctaaaaggaaagggtttactttcccctgatttcgatccccaatacatctgactctatgcgaacagattcgtcctctgagcacgcctaagtttctcaaatctcgaatgccaaaacgcaagcacaaacagcagactgggtggggttcggaagtaattaccaggccctccatctggacgacacggagcggcgtccgcgtctcctcggtgaccgtagacacggcctgcaggcacgccctcactcctcccggtgccgctgctgcaagccagccaaccagatccaaggttagcgcacgagatgacgagagagaggctaaggaaaggcttcggaaaatcggaagtcccttacagttagccatggcagctcgtagatcgttgggcggcggtgcgctggcgtgaggatgcgtgcgcgcttggaggaacggatcgagggaaaggagagcggcggctgggaattctagggttttttgtctgcggggagagcagagagcaggacgttcgagtccagttgatatatataaggtggggcgcggatctgctcggttcgttaaaaaagatttaaatctcttatattgaaaccggatagggattcacgcggagtccgcactccacgaattcggcaacgcgcgtgccgacgcgttctgtgcctggatttgcttggatccaaaatcgtcgtctccaaccgttctcccacatttcttcatctatctcaccacgggtcatgtccccgcgcgcaacaacctccgccacatttgtcgccaacaacctcccgccgcgcccgccgcatggtgccggccatccgcccctgccatcctcattttatacagatttactctgttagtaaaaatatggttgatactattgatccttctatcatattggctaattttgttcttttttcctcatgtaatgcaatgtaacgcagagggagataaaaatcccagtccttgttgggattacagtactatttattgttcacgttattggtgctacgagaatgggtaccttataatacctcaccggccggccaaacaaatgtaatatggtgagtggtgactacaaacaacgttgaatgtcccaatcttgtatttgacttttgg

SEQ ID NO: 20726 - DNA, 1999 bp, Zea mays
atccttgtgtcttccttaactttgactttgtctaacaggtaacgggttcggttggtgttgcactatccagcgacaaataaaaagaaacggagagagtttctatctatacgttggcacgagtgcatggccagaaaggatagcaggttttagtaaaagagatgcaccataagactcttagaataggagcgaacactaattattttatttaatatgttaataagaaattaaaatgaagaccttatcatattaaggctctatttaacacaacttagtttacatcttcacatttaactctgatatcatattagggctttatttaacacaacttagtttacagcttcttagaagatttaaaagattgtaccaaacaagacctttcttttctatagcatcttatcgttatcgacgcttctcgtaataaactaaaagcagacaataagctgtttttcattaaacatggcctaagtcgcatgcactacctgttaaacctaaaacctttaaactgataagacgagatagacaattccaacagtacctaccatttgacaacagcccatttcgagaacgaaaacaagctacactatggacttcaaactgagcgtcacaaaaatactaatgggagaaaattggtttatacggcaacgcatacatatgcaagtacattaagtatcacgagctaaccatctggtccatggaaacattaagtagaggacaggcacgcccatgtaaaggtacatcacaaaattacgattttgagcagtatcacaagctaattctaacagcattcatcacagcccagtcttctaatcctcatgcaaggccttcatcaggtatagcctgtcgaaattctgaccagcaaccccgttgatatggttgcagtaactgcagatctgattagttactagatagccctccaatcgtgagggctcaggaataggcttaaatataggattggatggatcttcttctggtagtggctcctcaccagctgctttcctcgccatgttctcctgccttctcttttgaagccatgcctgctgctgtgactgttgtcttgagagattgcggttataatattggaacttgttctgctctgatgaaagatcatccatgcacccaatcagaaattccaagttcctttccataaagggggcggttgacaatttaagtcggtccaggtcacactgggtaacaggtgactcaggttccagctccttcataaaggcactgacaagcgctgagttggaaacttttattggtatctcctcaaaaatatcaacccaggacaatttcttctcccttaacttctccccagttaaaccattgttacggtaaagatccataaacgagtctgtaagctttaaggctttgagagctagcacgccttgactagatctagatgggtcatagacaatgcacacacatctcctgatgctctcctgatagttcataaatgtttcaatcagttccacagtttgaaaagatccaagcaagcaagactgataccatccaatagtattgttgtcaacattaacttccctcaaacacctcatcatctcaagctgataattggcaccatctgcatctgcttcatcatcctcttccctgatagggaacggaaaacagttggtcacttccagaacactaccaacatccaaaccaagcaattgacctgtaactaaagctggcgcaaactcctcacagtgcttgatgatcttcagtacagccaggccctccatctggacgacgcggagtggcgtcggcgcctcctcggtgaccgtagacacggcctgcaggaacgacctcattcctcccggtgccgctgagttagccatggcagctcgtagatcgttgggcggcagtgcgtaggcgggacgatgggtgcgcacttgcaggaacggcgcgagctgtggatcgagggaaaggaaagcggcggccgggaagttagggttttctggctgcgggaatagcacaaagcgggagacgtgcagttccaatg

SEQ ID NO: 20727 - DNA, 5345 bp, Zea mays
  misc_feature (656)..(656): n is a, c, g, or t
cctgcagcttatgttgatcctgtgtggtccttttgcagctactaacttgactattttctttgtgcaggttacaatttgaactgctggcaatggggcctcattgttccttcatcttgatcctactgctatgcttcacccccagctctgctttgactggacataatgatataaatacattgttcaaactgagggacatggtcactgaagggaagggatttctccgtgactggtttgattcagaaaaagccccttgcagttggtcaggtataacttgtgtggaacatgctgtagtggatatagacttgtcatctgtgccaatttatgccccgttcccgttatgtgtcgggtcattccaatcactggctcgtctcaacttcagtggttgtgggttttctggcgagcttccggatgccttggggagcttgcacaatcttgagtaccttgatttgagccataaccagcttacaggggcccttcctgtttcattgtatggactgaagtcattgaaagaagtagtgcttgacaataatttcttttctggtcaattgagccctgctattgcacagcttgagtacctcaagaagttttctgtatcctcaaattctatctctggtgccattcctccagagttgggcagtttgcagaatctggagttnctggaccttcacatgaacgcacttaacgggtcgataccatcagctttgggtaatctgtctcagctcttgcaccttgatgctagccagaataatatctgcggctcgatatttccaggaataactgcaatggcaaacctagttacagttgatctctcttcaaatgctttggtggggccactacctagggagattggtcagctacggaatgctcaactgataatattgggacataatggtttcaatggaagcattccagaagagatcggtgaactaaagctgctggaagagctcgatgtccctggatgcaagctcacaggcatcccttggacagttggtgatcttagaagtttgagaaagcttgatatttcagggaatgatttcaatactgaacttccggcatctattggcaagctgggaaatctgactcgtctatatgcaaggagtgctgggcttactgggaatattccgagagaacttggtaactgcaagaagcttgtctttgttgatctcaatggcaactccttttctggccctatacctggagaacttgcaggtttagaagccattgtcacattagatgtgcaagggaacaatctatctggtcccattccagagtggatccggaattggacgaaccttcgttcaatatatctggcgcagaacatgttcgatggacccctgccagtactgccattgcagcatctagttattttttctgcaggtcccctcaggcgatcaggttctattcctgatgagatctgtcaggccaaatcactgcagtcactcttgttgcacaacaacaatctgactgggaatatcatggaggcatttaaagggtgcaagaaccttacggaacttaacctgcaaggaaaccatcttcatggtgagataccacattacttgtctgagctaccactagtaacagtggaattggcccaaaacaacttcacaggaaagctgccagagaaattgtgggaatcatcaactattctggagatcacactcagctacaatcagcttactggccctatacctgaaagcatcggtagactctccagtttgcagaggctacagatcgacagtaactacttagaagggcctattccgcggtcaatcggctctctaaggaatctgacaaatctctctctatggggcaataggctgtctgggaacattccacttgagctcttcaactgcagaaaccttgtcaccttggatctaagttctaacaatttgtctggccacatcccgagtgccatatcacacttgacatttctcaacagcttgaacttgtccaataaccagctgtccagtgctatacctgctgagatctgtgttggatttgggagtgcagctcaccctgactcagagtttatccagcatcatggtttgcttgatctttcatacaacagattgactggtcatataccagcagcgatcaagaattgtgttatggttacagtcctcaacctccaaggaaatatgctaagtggtgccattccaccagagctttcagaactgcctaatgttacatccatctatctttctcataacacattagttggccccatacttccttggtctgtaccgtcggttcaactgcagggcctttttctctctaataaccacttaagtggctccattcctgctgagataggtcaaatacttcccaaaatcgaaaagctagacttatccagtaatgcacttactggaacactacccgactctttactctgcatcaattacttaacctatctggatatcagcaataacagcctctctggacaaatcccattgtcttgtcctaaagaaaaagaggcatcgagctccctgatattgttcaatgggagcagtaaccatttctcagggaacctagatgagtctatttcaaacttcacacaactgtcttttcttgatatccacaacaacagcctcactggaagtttgcccttctcactttctgatctcagttatttaaactatcttgacctctcaagcaatgacttcaatggccccgccccttgtggtatctgcaatatagttggcctcacatttgccgacttctctggtaatcacattggcatgagcggcttagtggattgtgctgcagaaggcttttgtactggaaagggttttgatcggaaggcacttaattcatctgatagagttcgaagagcagcaatcatttgtgttagtatactcactgttgtcattgtcttagtttttctggtggtttatctgaaacggaggctattgagaagcagacccttggctcttgtacctgtcagcaaggccaaggctaccattgaaccaacctcaagtgatgagctcctagggaagaagtttcgagaacccttgagtatcaatcttgcaacatttgagcatgcacttctgagggtcaccgcagatgatattcagaaagccacggagaatttcagtaaggtgcacattattggggatggtgggtttggcactgtctacagggcagcacttcctgaaggtcggagagtagcgatcaagaggcttcatggtggccatcagttccaaggtgatcgtgaattcctggccgaaatggagacaattggaaaggtgaaacatcctaaccttgttcctctacttggctactgtgtatgtggtgatgaaaggttcctgatatacgagtacatggagaatgggagtcttgagatgtggctcaggaaccgggctgatgccatcgaaacacttggatggccagaccgcctgaagatatgtattggttctgcccgcggtctttcgttcctgcatcacggttttgtgccccatatcatccaccgtgacatgaagtcgagcaacattctattggacgagaactttgagccaagggtctctgattttggccttgcaaggataatcagtgcatgcgagactcatgtcagcactgacattgctggtacatttggctacatacctccagagtatgccctgacaatgaagtcctctacaaaaggcgacgtctacagctttggcgttgtcatgcttgagctgctcactggacggccacctacagggcaagaggaaggggaagggggtggaaaccttgttggctgggtgcgatggatgatggcacatggcaaggaaggtgagctgtttgatccttgtttgcctgtctcaagcgtgtggcgggtacagatggcccatgtgctcgccattgcccgagactgcactgtggacgagccatggaagaggccaactatgctggaggtggtgaagggcctcaagatggccgaaacgatagaatgtggacctctggttgtgacagtcaccaaggacatgtaatgctgacggcatcaacgctgatgtatggaactgggtgttcagggaatgttgttcttgtgtcgatataataatgtaggctccttgttgctgtagctgtactggtgactgtaatgagaaactaacgctgctcatgttcaggctgtagttattgatgtaaccttttcatctggacccaagcaagcacttatgatatggcagggatcgtttaagcacaaaagatgcagtgactaggccccgcgcgccagattttgcattctactacattttctactttgttgttctactgctcatggtcctccccagattcaacccatgccagtttggcctgattactcagctatccttgctgtcttaatggggctataccgctatactgctgctgtgtacgaatttgtctgcattgatgctgtctctaaccttacacgcctcctttattaacgcctcgtcaaccctttgtaggtgagccctaaacctaagctagtgtgtcagcttaaaaagaacatgcaaataagttatcatgcggattttgccaaaaactaaatcatctctagttatctagatagcccagtaaatcgctgcaacacctgtaataataaaatatttagtctttgacggaacaccaagaaggcaattgccaaagatgtggttaatagaccttggagtgcgtaatccaaaacaatagtgtataaatctccaaatgaactgcgcaaaatggcaatttataaacaaatgttgtatagattcatctgagtcatagaacacacattttttattaccttaccaattacgcttaattaagttagctttcgttagaaccactcctttgattaaataccacataaagatctttatcttgagagacacttttagtttccatagtagtttatgataaaaacacatttgcattatttagaaagagctctatacattgacttaacagagaattgaccggatgtagttaagttccatttaaacacatccttctcatcacaaagttttatatgagcaattctagcgaccaatctatgccaaagcactagattttccctaactagagttctacggaaagagatatttaatggaatcctataaaaacatctgctactgtagaacttttttgcgcactatattataaagagaagggtactgaagcatgaaaggttggttcacaagcgaagtatcttgctaaaatttgatttgattaccatcctttaggataaaagaacctagacttaggaaggattctttgactttcattagcgccccgacaaaaaatgtgaattccttggtttccttgcaactttggacaaagtatcttttcttaaatatttttgtagaaagtaatctttggcaaaggccatttcctcgttaagg

SEQ ID NO: 20728 - DNA, 1792 bp, Zea mays
gtagcacctgaccgtggcccagacttcggagttgagagaacaaacgaactggtgggtgggttggggggtcgtcgccgccggccggtggagttgctcgctcctgcctcttggatctgccgcccggtggtggctcgccgccaaggatggcgcgggcggagaagatacgctccggtagcacggcgttggcgacggcttcgacggagacgccaggcaggtcgacggaccaccggagggcgctctacttcgccgccttcctggtgctggccgacgccgcgctcgtcgccctcatcgtcgccttcgtcccgtataccaagatcgactgggacgcctacatgtcccaggtggacgcttttctggagggggagagggactacaccaagatcgagggagacacagggccattggtctacccggccggattcctctacgtctactccgccgttaagttccttacgggaggccgcgtcttccctgctcagattttgtttggcgtcttgtacattgtcaacttgagcctcactcttctgctttacgtcaagactgaagtgcttccatggtgggctttaggtttgctttgtttgtccaagagggttcactccatctttgttctccgtcttttcaatgactgcttcgccatgacattgctccacgctgctatggttttgatcatttatcgcaagtggtaccttggtctagtagttttcagtggagctgtctcaattaagatgaatgtccttctttttgctccttctttgcttctacttatggtcaaggccatgagcatcaaaggagtcttctttgccttattgggagctgctgtcgtacaggttttgttgggtatgccattcttgctgtcacatccagttgagtacatctcaagagcattcaatctcggtcgcgtgtttatccatttctggtctgtgaactttaaattcgtcccagagaaggtgtttgtatcgaaagagcttgccattgcattgttgattcttcacctcaccacacttatgatatttgctcactacaagtggttaaagcatgaaggaggcctattcggtttcctgcattccagatttaaaaatgctaaatcaatcaagcagcttgtttccagccagcccagaccatccagtctcagcgcagaacatattgtaactgttatgtttgttggcaacttcattggcgttgtgtgtgcccgatcattgcactaccaattctattcctggtacttctattccttgccttttctattgtggaaaacacgttaccagacacctttgaggattattctatttctcgttgtggagtgctgctggaatgtttacccttccactgcctattcatcactccttttgctatttgtgcacttgtgcattttgtttggtatatggttttcacctgctgaatacccctatatcatcagtaaagggacaaaacggacataccaagaagttgcaaagctagacttccctgcaaaatagtgtaatctttgaaggtagcagtgaggatacaagtgtcaaaggcttctggaaattgtgaggtactttggtatgccaatactcttgggactagttggcccaaatttctcgagtagcatctagacatataccaaatatgtatgtccatgtgtaacttcttaacatagatgatagcgactctaactataagagtaactatggctgcggacttccccaggatcttgttttatcatcctttagacatgtctcagcagtcagcagccaaaagagatccatgcctcaccttataaggccttgtttgcaaaaaaaaaaaaaaaagc

SEQ ID NO: 20729 - DNA, 1115 bp, Zea mays
gctcacgtgaggctcgagaatatatattcattcgtgaatcttgcagtcggctgtgcccccccgcgagtacaagtgtgttgctctcccctggctcgagaatatatattcattcatgaatcttgcagtcggctgtgccctgtggtacaagtgtacaactaggcggaaactatgtttagttcattatgctcattgatatctctcgatctaatctctatacctcaaaaacctgtaatctgttttatccttgcttatgcatcctttggcttcttggttcttgtcaacctcgagtaaaggaaaacacctgctaatgcagcaccagttcctagtgcattgacaggcgaaataggtgtgctgaagaacagaacggaggagacgatcacaaccacacgctttacgcagttggcgacggagtgtgtcactggcgacactctcgacaagatcaagtacgagagcttctgatagccatggaagcacagacctgcgagcgctgctctcacgcacagctcttggaggttcaggcccgtgctctggaggtatcctggggtgaacttgatgccttcggcaaagatcatcagagggcaggacagcagaaacgacagcacagtgatcaccgagaagagatttatgtcatccataacatccttgtcaccggcaaggagtttcttgctgaggacgttcctcgattggttggtcagattggacgccatggcgctccaaaacccggtccagttgaaagaaacttcggtgaatgacgccaaggcgacgccgccaacgatcggcacgagcgagcccagcaccggaagggaaggaacctcgccgaggaagagggcggagaggacgacggtgaagaagggctcggaggccttgatggtgtgcgtgaaggagacggcgaccttgcccaggctcatgttggtgaacaccgtgcccagcatgtgccccacggccagcggcgcgatcttgcccagctgcgcagcggagagcctgggcgccgggtggagcctggtggcccacatgaggaagatgagcagggagccgaacgcgagctggaaggctgtgatggtgtacggcagcggcaacggcagcgcgccgagaacctgcttgttgtgatgtgaccc

SEQ ID NO: 20730 - DNA, 2381 bp, Zea mays
agcttgtgaaattttttacattagcagcaacggaggaaagcacaatttgtcgaggcaatcctactcaactgtatacgcagtgcgatacaagctttgtctacgttgcacaggttgaagagtgcaccgccaaagaatgaatacacatatctgcatgcactgccatgtatgtacacgatgaaatgcagcatcaccgtacctgcacgagcctacgagttcctaacaaaattgtcaatctaaggtaatttctttgtcaggtttcaagcaggcgactccgcgagcaccaaggtgtgccaccagccacaggacacgtttagcgggtggtaagcgtccacacgtacactgcaaggcacgttcctgtccattgagtcgccaaggccaagctggccgtacttgttccatccccagcagaatacctcgccttcatctgttataatagcactatggcgagctccacaagaaacagatctggcattcttattctctaggctggtagcatctaccaattttggaacagtctcagcctgatcagaaccagtgccaagctgcccaaactggtttcctccaaaggaataaacatcaccatctacggatgtacatacagtgtgccacagacccgcggcaacgtcttgcatcttggatcccaggatagacgatacacacgttggacttaaaacatcatctgtattcccttgtccacactgtccatacagcccccacccaaatgtaagaagagctcctgaatctgttactgcagcactgtgacgacctccacaagcaatggccctcacacaatttcccaagactttactgacatgtccttcagcagccttgttacctttcatagctgatgggcgatccttgctgtatagtgctgattcaatgcacggtacaggatggggagaagaaacagttcggattctagagcccagacctagttgcccttctcctccatatccccaaccccatacctgacctaaatctgacagtgctaatgtatgacgaccaccagcggctacagccactattttcactcctgtactaaatgtcacaacacaagggggtgctgaaagactttcatcactggatgtcgaactctcaggtccatgttttgctaaagacaactttcgtcgctttgtgctgtcatcagtgcctctgctttcagaggaaccagctgccgctccgctgcttgtcctagacacctgtgacctagggctcacttggtcagtggccattgccatttgcctttcatccttttccatggttccaactgaagactggtctccaataacccttccagttggaacacattctttccaaccccatgtataaacatcatattcatcagttattgcaacacagtgagcccatccagcatcagcgcgcactatcacgacactgctaggaagtggaaaagcttctggagtctcctcgtgcttcccagcagtcacataactttggcccatgtcatcagctgaaccccaagtgaggagttttccagactcagagatggccatcgcgaagccgcaaccgccgccgcacacgtctctccacccatcaccggcggcagtcgccgccgtcgggggcaaccttacggggaccggcccgagcagcggcgagcgctgcggggacacgccgggcaagtacccccacatcagcaccacccgctccttattccccgcgccctccccctgcgcgcagctggggccgctgtcctcctccatctcatcctcccctccccctcctccgccggtgccgcggccgttcatctcctccgggagcctgggcctccgaatccaccgctgatttcgatcgctggccgacgggagcggacagcggagcaagcgagcaaagcgttggtgttggttgcgggcttgcggcggccacttactcttccgagcgtgaggctgagacgcgagggttggggccgtatcagtttcttcgggggcgggagcgccacatcggacgccgacgtggccgatctctgacacgtggcgcgcgctgggacgctggatcgggacggccattcgtggccaggaagcggcaggaaggttctggaagtccgagcctccgaggccggggggttcgcctgcagacgtgtcgacccgagaagcgtccacatcgcaaggatcgcggccaggagggggtgggggtgggagtgggagtgggaccgcggcccgtgggacggccagtggaggagagacgtggccgaccgcgatttgaccaacggcgctcgccgcatccaccaactaggagccgtctggtctctggtatggtcgtatggattcaagatgctgaagaaaacaacatgtgatcaattttaggaaaaaaatttggtgcagcgggccgcggcccaaaatatttacagccccttacaaaaaaag

SEQ ID NO: 20731 - DNA, 1152 bp, Zea mays
cattgggtacctcgaggccggccggggccaccgccaacaggtgtcccagccgcgcgccgcacgccctgttgccttctctcgacttcgagagcaccgccgcacggcataacgctcgcacggccgagccccgacattctaccgcactccctccgctgcacccctttccattctaccgccggcgacgccaaagttcttgggcctcctcatcggcgacttttccgccggcgacaggaaacaacgaaccaaaccacttctctgtcgagaggcgtcgcgctcctctcttcgccctctgctgttatttttcttaacccggctttctctcgattgctgcgtaaagttgaagatgaggaagctcaagttccatgagcagaagctcctcaagaggcacaatttcttggagtacaagagggagggcggccaccgcgaggcgctcgtcacacagcgctaccgcctcgtggagagggacgactacaagaagtacaatgggatatgcttaatggtgcaaaagctcgttaacatcataaagcagatggacccaagagaccctttcagaatccagatgacagacttgattctcgataagctgtataatatgggtgtaatttcaacaaaagagagcttgttaaagtgtgagaaactttcagtgagcgccttctgcaggcggagacttgcaacagttatggtgaagctcaagtttgcagagcaccttaaggaggctgtgacgtacatcgaacaggggcatgtgcgtgtcggtccagatgcagtcacggacccagcctttcttgtgaccagaaacatggaggacttcatcacctgggtggattcctcaaagatcaagaggaaggtcatggagtacaatgatgcattagatgattatgatgccatgttctgagaaaatcattctgcagaaatttatgtgcccgtcagtagtgtaatcttaagcctgccacatatgggtcttttctgaagaaatctgtgggagttgtcttctgcagggctacttgcatttgtattgcacctgcagatgtgatgcaattttgtggttggttgaaggcacattataaattcatatctgatgtagttgtgcaattgtctttgttaaagagcgggtttgcccggatttcccctagtctgcaaaaaaaaaaaaaaact

SEQ ID NO: 20732 - DNA, 1248 bp, Zea mays
tgcaggcttgcagcggagagggaggcacggagcagcgttgggcgagtcggcgtcatggcgaggcggcggtctggcactccggctacgggctgacgacgacatggtgccctagcgtctggagatttggcgagtagcggcagggcttcgagggcttcgggcgcggactggagtctgggggaaaagttcaaattataaaaatacctaaatattcaaattataaaaatatttagatataagccattgttcagaagttatatgcctaatcattaagatcatattttggcttcattgtccatattgttggaactggatgtgaagcaatgcaatccaatgaacatctttacttttgtttttctgtaataagtgagttacattcgaggatattctgcttttcatgcaccaaataaatttacccttagcagtttggcctatatgccttaaaggtttgctttagcaaccctgaggatgcttctgtttgtcaaacagacacttgatttttttgagcatgttgtgatcctgagttgtcaagctgcaggtctcttcctccctctccctcttcctctcctccctagcaatctggcacgtttgttttcctttataggatgttgtgttctagccatctcacttcagctcaagtgttctttcttggctaaggtctgcaactctttggtagagtatatcatattattcactttgctagccgcttttatggtaaggtagaacaagtaggaaacaatgacatgtgcagttccatttaccttgtttactcaattcttgcaggcggagacttgcaacagttatggtgaagctcaagtttgcagagcaccttaaggaggctgtgacgtacatcgaacaggggcacgtgcgtgtcggtccagatgcagtcacggacccagcctttcttgtgaccagaaacatggaggacttcatcacctgggtggattcctcaaagatcaagaggaaggtcatggagtacaatgatgcattagatgattatgatgccatgttctgagaaaatcattctgcagaaatttatgtgcccgtcagtagtgtaatcttaagcctgccacatatgggtcttttctgaagaaatctgtgggagttgtcttctgcagggctacttgcatttgtattgcacctgcagatgtgatgcaattttgtggttggttgaaggcacattataaattcatatctgatgtagttgtgcaattgtctttgttaaaaaacacgagggggggcccggtaccc

SEQ ID NO: 20733 - DNA, 1658 bp, Zea mays
gggaccctcgggccggccaacaggcaacaggtgtcccagccgcgcgccgcacgccctgttgccttctctcgacttcgagagcaccgccgcacggcataacgctcgcacggccgagccccgacattctaccgcactccctccgctgcacccctttccattctaccgccggcgacgccaaagttcttgggcctcctcatcggcgacttttccgccggcgacaggaaacaacgaaccaaaccacttctctgtcgagaggcgtcgcgctcctctcttcgccctctgctgttgaagatgaggaagctcaagttccatgagcagaagctcctcaagaggcacaatttcttggagtacaagagggagggcggccaccgcgaggcgctcgtcacacagcgctaccgcctcgtggagagggacgactacaagaagtacaatgggatatgcttaatggtgcaaaagctcgttaacatcataaagcagatggacccaagagaccctttcagaatccagatgacagacttgattctcgataagctgtataatatgggtgtaatttcaacaaaagagagcttgttaaagtgtgagaaactttcagtgagcgccttctgcaggcggagacttgcaacagttatggtgaagctcaagtttgcagagcaccttaaggaggctgtgacgtacatcgaacaggggcacgtgcgtgtcggtccagatgcagtcacggacccagcctttcttgtgaccagaaacatggaggacttcatcacctgggtggattcctcaaagatcaagaggaaggtcatggagtacaatgatgcattagatgattatgatgccatgttctgagaaaataattctgcagaaatttatgtgcccgtcagtagtgtaatcttaagcctgccacatatgggtcttttctgaacaaatctgtgggagttgtcttctgcatggctacttgcatttgtattgcacctgcagatgtgatgcaattttgtggttggttgaaggcacattataaattcatatctgatgtagttgtgcaattgtctttgttaaagagcgggtttgcctcggatttccccgcgtctgaaattcctgcaccatgtttcgttttgcagttcgtttgtgcttgccggcattattacgtctagagattaatttagcgccacaatttcaataggtcattaataatggcagcagcggagtcggctgttactgccagacgctttcagcctaggctcctagccagtgtttggctaacaaataaaaggtaaacgatagactgatttcaattcacacttccacttcaactcacactttcacgggcatttccaaagaaaaaaaaaaggtaaacatcgctgcgtatgcacgacacacgttcgcttcaattcactttcacgagcattgccaaagaaaaacaaagaaagcgaaaataatcccagagaagcactgtaacaaaacatgccttgcgcaaactgataatgaaaagctttgtcaattgacatgaacttacaacagtgttatatacgccttttgacggtacaacactacttgtaaacttctattttaagcttaggttatttacaattataaaatactcatttcattccaaactacaggtcattttattttttgttcagaggccacacatcttaaatttaata

SEQ ID NO: 20734 - DNA, 1058 bp, Zea mays
ctcgaggcccggcaacaggtgtcccagccgcgcgccgcacgccctgttgccttctctcgacttcgagagcaccgccgcacggcatagcgcggctcgcacggccgagccccgacattctaccgcactccttccgctgcacccctttccattctaccgccggcgacgccaaagttcttgggcctcctcatcggctacttttccgccggcgacaggaaacaacgaaccaaaccacttctctgtcgagaggcttcgcgctcctctcttcgccctctgctgttatttttcttaacccggctttccctcgattgctgcgtaatgaggaagctcaagttccatgagcagaagctcctcaagaggcacaatttcttggagtacaagagggagggcggccaccgcgaggcgctcgtcacacagcgctaccgcctcgtggagagggacgactacaagaagtacaatgggatatgcttaatggtgcaaaagctcgttaacatcataaagcagatggacccaagagaccctttcagaatccagatgacagacttgattctcgataagctgtataatatgggtgtaatttcaacaaaagagagcttgttaaagtgtgagaaactttcagtgagcgccttctgcaggcggagacttgcaacagttatggtgaagctcaagtttgcagagcaccttaaggaggctgtgacgtacatcgaacaggggcatgtgcgtgtcggtccagatgcagtcacggacccagcctttcttgtgaccagaaacatggaggacttcatcacctgggtggattcctcaaagatcaagaggaaggtcatggagtacaatgatgcattagatgattatgatgccatgttctgagaaatcattctgcagaaatttatgtgcccgtcagtagtgtaattttaagcctgccacatatggctcttttttgaacaaacccctcggagttgttttttgcatggctacttgcatttgtattgcccctgcaaatgtgatgcaattttgtggttggttgaaggcccattataaattcatatctgatgtagttgtgc

SEQ ID NO: 20735 - DNA, 3963 bp, Zea mays
aacttcggcacgagggttgccttactttttttcatccttttcaatgtcttctaaccttagatttctggattctacgcacaaagcgtttattagtgtcaacatttctacacttccatttaaccttgaaatgttcacccgtggatcctaagacgcaatactaattggaagagaggcaggagaaagccgaagttgacatgtgaagagacagtaaaaggagatttgaaaggatggaatgcatccaaagatttagccttggataggagcaaatgaaaacaactatccacatgctgaactttgattagtggcttctgttgggtttcaattgtagcctacccgacttgcttgggactaaaatgctttgctgttgttgttttgttgaaatgttcacccgtcgggattggagaactctaaaggaatgcatggatatggtcaatctatcttttatcttcgtagaggtggttgttggaatccaatgaatttaacacatccacactgcccctgttggtattctatcactcgaggctaaaacatagcacttaccaatactatggcttacatgttgctatgagatgccagctagtgtctgtttccgattcattccttaatatttagatatattccacttgcagacctgcttcttgggacattttttgtctgtctctgctactactaacataatggaacctattttctacccctgtgcttgttgaaagtggcaagttcctcctatgtgcgaaacggacctcccgcccaacctgtacagaatatacaatatttatgaattctgaaaatttatctaggtcaagcaaaatgtacattggaaagctgaggtactaactcatgcattggccattcttttaggaattacataattctctagtatttgtgtatcactaacaaaggcctggtgcagtggtgagaactatctcactgagtcaccaggtcgtgagttcgaagcaacctcttcgcatttgcggggagagggcttgccttggtttattccttccccagactccactcatgtgggagcttccggcactgggtctgcccctttttatgtatcactaatatatctatggcattgaacatctaaagctgaggtcgaatctcctcggcacaaagtttgcaatatatgatacccagcccccatgcaatgcagcagaacccgggaaaacaagccgtcggttctactcccggaaggtgtcgccaaaggtctcctccagcacctacaacatagcgcaggtttcatatgagctgaatgtcttgggtactcggggccctaggcggatgaactgtgttatgcactccatccctacctcgtgccttgaggctggtggcactgttcccagccagctggacagcatccttgctcgctctactgatgagtcatttggcagcatttccttctccaagtcatctgttgtggaccggtctatgcgtttcagcagctcaagattctccgacatctcaatgagcagcagccgcaggattggagacacggcatcgggagacaatgatgagtgcaaggagaggccattgattctccggaacaaggccccaaggtggcacgagcagctgcagtgctggtgcctcaatttcaggggcagggtgacagtcgcatctgtgaagaacttccagctcgttgctgccacgcagcccgctgctggagcaccaaccccatcacaggctaccccagtgccgccgccggagcacgagaaggtgatcctgcaatttgggaaggtggctaaggacatgttcaccatggactaccgttacccactgtcagccttccaggccttcgcgatctgcctgagcagcttcgacaccaagctggcctgcgaatgaagccaccagtcatggctcaaagtcaaggacgatctgtctgtttcacgaagacggtggccccaaattttgctgggccaccattctgttgtatgttgttgatgccttcttaacttacctaggaagctgcgtttagacattttgcacctgatctacagctgctgctgtgtttctgtcctgatcgcattgttttccatagctttgctctgtggagcggcaacttgatctgccctgcccttaactagccggcaggtttattaatttggttttccatactatggttgtattaactgagaagagactccgacactttcgttgtgcctacctaagtctctgtctgcctttgccctctgggatatgcaaatgtgcatcttgtaaaatttctgaattgcttttgtggcaagtcatagtaataaaagaactagcttccattcaaaaaaaaaaaaaaaaaagcggccctccaagtgaccactggccactgcaagcggcaacgccggcgaggtttttttcttgtttaaagtgcatgttttttttttgaattattatgtgcatgcttgtgctcgtaaaggcaagtgcttgcgaccttgcgtgtttgtgttctacaaaagaaaaaaaaatcaacattttaaaggtcagtccactttacacccttaaactataccggaattatgaatttccacaatcaatcagatattttacgtctctgcgttggcctttggagcgcgacaggaatgcatgggagccagatataacaaagcatcctgacctggcggatcatgtacccgtcaaccgcaagatatctgtagtgatttcattaatttcagcaatttatcggtctagtttttggagatgctcgtaacaaacagtgttcacgagtgtgtatcactttctatcttattctcaattttaaacttcactctataaacagtctataatataaaaacattatgtttcatatccgtttacatggtctgttagaatgaattagcgttagagatgagtgttcgtgcgttgtgagttttcatccctttcgtctaatattcgggccagcaatataatactgcaataagttaataatcatggatgctgttcggcctgcgattattttatatataataacattggatattgtagcctggtaaccaaaaatcatataatgcatatatgcatatgcatcgcaggcttcagcccgtcagggtcaccaggaaaggcttcagcccccgtccatggccatgaccgtgagtggactggtctactccccgtccccggtcgccatcagtgacacctcggcgcgggcaggcggccaatgagcggcgtcgacgtggacccgggaccccgattggcgtgcggcctgtgctactgctccgttgactggccggacgaaggaaaactaggttgggaatgatgagagtgatactctctagcaaggaaaagaaaaaaggtatttgttcaccttatcttttgcactttaacctgactactctgattgctgatggcatcgatcaaccagcagtttcgtgattggttttgtttgttaacggacgctttgcaaccaaatccaatccaactgtacatatagatgatgtatgtgacacttgcgcagtacagttttctaatccatattactgttgtcacatacttacaagtatagaaaacaggtacgtagcaaacaagaggccagtacgacatggacgttcagagataaattatatatccgttctcgaatatttatcattttacagtttaattttaatcaaaacacgactaataaaaaaaacggaaagagtagataccatcgaacgcgttgttctggatctctcaacattttctaaccgcattcgatcattacgtttctttcagacgctgaggctctgtatgttgttcgcgcgtgctttccatgagaaattgtgtcatctcggttagtagttaaaaggtagatcatgatatttgaaattatgttttatcggcaccaacaatcaaacacctttcagcttcaattaccataaatcgagtaagtcaatttctaagcattaggtcacagtagggatgataacgaggaattccccatcaggttttagctccctatcttgatccacgtgatgaaaaaaaaaattcctgcag

SEQ ID NO: 20736 - DNA, 1980 bp, Zea mays
ggtaccctcggggccggccgggttcccttccttcgcctccgcttcctcctcctcctcctcctgcccctcccccacccccacccgtcgggacgcctccccactttcccctcccccggatccgcatggcgcctctgcagcccgcgccgctcggcctcccgtagccgacgcccggccccgtcccaccgcccgctgcgccgagcgctgcccgtcccaggctcatatttgcacagagtcattggaggaagtttgatgtttcagcagtactgtgacctttattagatgtctttccgcagcattgtgcgtgatgtaagagatggctttgggagcttgtctcgaagagggtttgaggtgaagtttctgggccaccgccgaggcagatctcacggtgctgtccatgagctgcgtgatccagccccagtgatccagagcagttgctgggctaatttgccccctgaattgcttcgagatgtgattgagaggttggaggccagtgaagccacatggcctaacaggaagagtgtagtctcttgtgcagctgtttgtcggacctggagagaaatctgcaaagagatcgttaagaatccagagttctctggaaaaatcacttttcctgtgtccttaaagcagcctgggcctcgagatgtaaccatccagtgcttcatcaaaagggataaatctactcaaacctactacttgtatctgtgccttagcacagctgtgcttgttgaaagtggcaagttcctcctatgtgcgaaacggacctcccgcccaacctgtacagaatatacaatatttatgaattctgaaaatttatctaggtcaagcaaaatgtacattggaaagctgaggtcgaatctcctcggcacaaagtttgcaatatatgatacccagcccccatgcaatgcagcagaacccgggaaaacaagccgtcggttctactcccggaaggtgtcgccaaaggtctcctccagcacctacaacatagcgcaggtttcacatgagctgaatgtcttgggtactcggggccctaggcggatgaactgtgttatgcactccatccctacctcgtgccttgaggctggtggcagtgttcccagccagctggacagcatccttgctcgctccactgatgagtcatttggcagcatttccttctccaaatcatctgttgtggaccggtctatgcgtttcagcagctcaagattctccgacatctcaatgagcagcagccgcaggattggagacacggcatcgggagacaatgatgagtgcaaggagaggccattgattctccggaacaaggccccaaggtggcacgagcagctgcagtgctggtgcctcaatttcaggggcagagtgacagtcgcatctgtcaagaacttccagctcgttgctgccacgcagcccgctgctggagcaccaaccccatcacaggctaccccagtgccgccgccggagcacgaaaaggtgatcctgcaatttgggaaggtggctaaggacatgttcaccatggactaccgttacccactgtcagccttccaggccttcgcgatctgcctgagcagcttcgacaccaagctggcctgcgaatgaagccaccagtcatggctcaaagtcaaggacgatctgtctgtttcacgaagacggtggccccaaattttgctgggccaccattctgttgtatgttgttgatgccttcttaacttacctaggaagctgcgtttagacattttgcacctgatctacagctgctgctgtgtttctgtcctgatcgcattgttttccatagctttgctctgtggagcggcaacttgatctgccctgcccttaactagccggcaggtttattaatttggttttccatactatggttgtattaactgagaagagactccgacactttcgttgtgcctacctaagagctctgtctgcctttgccctctgggataaaaaaaaaaaaaaaaaagcggccctcgagct

SEQ ID NO: 20737 - DNA, 2101 bp, Zea mays
  misc_feature (2087)..(2087): n is a, c, g, or t
cccgcccggaaaaaaaaaaaaaaaaaaaaaaaaaaaaaaaacttgtccagccccaccccccctgccgctcgcccttcccttccttcgcctccgcttcctcctcctcctcctcctgcccctcccccacccccacccgtcgggacgcctccccactttcccctcccccggatccgcatggcgcctctgcagcccgcgccgctcggcctcccgtagccgacgcccggccccgtcccaggctcatctttgcacagagtcattggaggaagtttgatgtttcagcagtactgtgacctttattagatgtctttccgcagcattgtgcgtgatgtaagagatggctttgggagcttgtctcgaagagggtttgaggtgaagtttctgggccaccgccgaggcagatctcacggtgctgtccatgagctgcgtgatccagccccagtgatccagagcagttgctgggctaatttgccccctgaattgcttcgagatgtgattgagaggttggaggccagtgaagccacatggcctaacaggaagagtgtagtctcttgtgcagctgtttgtcggacctggagagaaatctgcaaagagatcgttaagaatccagagttctctggaaaaatcacttttcctgtgtccttaaagcagcctgggcctcgagatgtaaccatccaatgcttcatcaaaagggataaatctactcaaacctactacttgtatctgtgccttagcacagctgtgcttgttgaaagtggcaagttcctcctatgtgcgaaacggacctcccgcccaacctgtacagaatatacaatatttatgaattctgaaaatttatctaggtcaagcaaaatgtacattggaaagctgaggtcgaatctcctcggcacaaagtttgcaatatatgatacccagcccccatgcaatgcagcagaacccgggaaaacaagccgtcggttctactcccggaaggtgtcgccaaaggtctcctccagcacctacaacatagcgcaggtttcatatgagctgaatgtcttgggtactcggggccctaggcggatgaactgtgttatgcactccatccctacctcgtgccttgaggctggtggcactgttcccagccagctggacagcatccttgctcgctctactgatgagtcatttggcagcatttccttctccaagtcatctgttgtggaccggtctatgcgtttcagcagctcaagattctccgacatctcaatgagcagcagccgcaggattggagacacggcatcgggagacaatgatgagtgcaaggagaggccattgattctccggaacaaggccccaaggtggcacgagcagctgcagtgctggtgcctcaatttcaggggcagggtgacagtcgcatctgtgaagaacttccagctcgttgctgccacgcagcccgctgctggagcaccaaccccatcacaggctaccccagtgccgccgccggagcacgagaaggtgatcctgcaatttgggaaggtggctaaggacatgttcaccatggactaccgttacccactgtcagccttccaggccttcgcgatctgcctgagcagcttcgacaccaagctggcctgcgaatgaagccaccagtcatggctcaaagtcaaggacgatctgtctgtttcacgaagacggtggccccaaattttgctgggccaccattctgttgtatgttgttgatgccttcttaacttacctaggaagctgcgtttagacattttgcacctgatctacagctgctgctgtgtttctgtcctgatcgcattgttttccatagctttgctctgtggagcggcaacttgatctgccctgcccttaactagccggcaggtttattaatttggttttccatactatggttgtattaactgagaagagactccgacactttcgttgtgcctacctaagttctgtctgcctttgccctctgggatatgcaaatgtgcatcttgtaaaatttctgaattgcttttgtggcaagtcatagtaataaaagaactagcttccattcacaaaaaaaaaaaaaaaaaaaaaaaaaaaaggaataaaaaaanctcgagagaggggg

SEQ ID NO: 20738 - DNA, 1746 bp, Zea mays
  misc_feature (47)..(48): n is a, c, g, or t
ttgggtacctcgaggccggccgggaatggatgcgaactaatgaatannaaaaaaaaaaaaaaaaaaacattgggttccccgcgggccggccgggcctttctccgggcacaccatactgttcttgctacttctagatagaggaacaagagagagaaggccaccgacatcgcctcttaacccgacaagccccattgcccaggagaaccccgtgccggggagcgagccgcgcgcattccccgtcccgtgccaccggaccaggggaaggaggacacacatgtcgtcgtctctctctccagcggcggcagccgcgcccctggatctggacggcaactccgtcgcgcccctcaccatctgcatgattggtgccggcggcttcatcggctcccacctctgcgagaagctcatggccgagacgcgccatgtcgtcctcgccgtcgacgtatactgcgataagatccgccacctcgtcgaccccgcgccgccgcacctcgcggggcgcatctccttccaccgcctcaacatcaagaatgactccaggctcgagggcctcatcaagatggccgatctgaccatcaacctggcggctatctgcacgccggcggactacaacacgcgccccctcgacaccatctacagcaacttcatcgatgcactcccagtggtcaagtactgctccgagaacagcaagcgtctcatccacttctccacgtgcgaggtctatggcaagaccatcggcagcttcctccccaaagaccacccgctccgcaaggaacctgaattttatgttctgaaagaagatgagtcaccctgtatttttggtccaatcgtgaaacaacgatggtcctatgcttgcgcgaagcaacttattgagagacttatatttgctgagggtgcagaaaatggccttgaattcacaatcgtgagaccttttaattggattgggccaaggatggatttcattcctggtgtcgatggtcctagtgagggtgtaccccgggtgctggcttgcttcagtaacaatctgctccgccgagagcctttgaagcttgtcgatgggggccagtctcagagaacctttgtatacatcaaggatgccatcgaagctgttgtgctgatgattgaaaatcctgctcgagccaatggtcacatcttcaatgttgggaatcctgacaatgaggttacggttagggagttggcccaaatgatgacagaggtctatgcaaacgtctcaggagaggcgccgctggatgagcctatgatcgacgtgagttcgagtcagttctacggtgaaggatacgatgacagtgataagagaattcctgacatgactataatcaacaagcagctaggttggaacccaaagacgcctctcaaggatctgctggagacaacattgacgtaccagcacaagacatacaaagaagctgtgaagaggcaaatgtcgcaggcttcagcaacaagttaagttggcgttggctggggacggctcctcgtttagagccctagtcgcagcaactgtttcgcaagtcagaatacatatacgccggtaatcgatctgtttgaggccctagacgcgcccatgttttgtctgctaccaagggatgttatcctattgtgatataactactacctgtgtctggttgctcctaggtttttttcttgcaattatatgtatttatattgaaaaactagatattatttaaaatacaattaaaaacaaacaagcaataaaaaaaaagaaaaaaa

SEQ ID NO: 20739 - DNA, 1726 bp, Zea mays
gcacgagtccattgcctggcacatccgaagcgagagagggagcacccttccgaagccacgccaccgacatcgcctcgtgacccgacgcacgggatagaatcccattccccccgaaccctgcgccggggacccagccagctagctacatccactgatccacgcgcattccccgtaccaccgccaccgcgccgcgtcacggaaggaggaggatgtcgtcgtctccctcgccggcggccacccgcctggatctggatggcaaccccatcgcgcccctcaccatctgcatgatcggcgccggcggcttcatcggctcccacctctgcgagaagctaatggccgagacgcaccacaccgtcctcgctgttgacgtctactgcgacaagatccgccacctcgtcgaccccgcgccgccgcacctcgccgggcgcatctcattccaccgccttaacatcaaaaacgactccaggctagaggggctcatcaagatggccgatctgaccataaacctggccgcgatctgcacgccggccgactacaacactcgcccactcgacaccatctacagcaacttcatcgacgcactcccagtggtcaagtactgctccgagaacagcaagcgtctcatccacttctccacctgcgaggtctacggcaagaccatcggcagcttcctccccaaagaccacccgctccgcaaggagcctgaattttatgttcttaaagaagatgagtcgccctgtatttttggtccaatcgtgaaacaaagatggtcctatgcatgcgcaaaacaacttattgagaggcttgtatttgctgaaggtgcagaaaatggccttgatttcacaatcgtgagacctttcaattggattggaccaaggatggacttcattcctggtgttgatggtcctagtgaaggtgtgcctcgggttttggcttgcttcagtaacaatctgctccggagagagcccttgaagcttgttgatgggggtcagtctcagagaacctttgtctacatcaaggatgccatcgaagctgtagtgctgatgattgaaaatcctgctcgagccaatggccacatcttcaatgttgggaatccgaacaatgaagttaccgttagggagttggcccaaatgatgacagaggtctacgcaaatgtctcaggagaggcaccgctggatgagcccatgattgacgtgagctcgagtcagttctacggcgaaggatacgatgatagcgacaagaggatccccgacatgactataatcaacaagcagctaggttggaacccaaagacgcctctcaaggatctgctggagacaacgctgacgtatcagcacaagacatacaaagaagctgtgaaaaggcaaatgtcgcaggcttcagcgtcgacttagatagcgtgcccctggctctcgtctagagcctagtcgcagctgttaagttgtttcggaagcgcaggtcacacatacgctagtgatctttttttttgaggccctagatgtccgtgttgttagataatcaagggatgctgtatcagtatgatatatttgtggcagagttgatgtattccatcgttcgtcgtactagttgggttggttgccgagagctgttatatattgctgtttgagtgtagaactagttgctcagttatatgttattggttcatgagattagcgcccacatcaatctgttgatagcacatacatacacaaaaaaaaaaaaaaaa

SEQ ID NO: 20740 - DNA, 2052 bp, Zea mays
cggcagcggaagatgcataattgcaatagctagtaagctagagattaaataattgataatataatatttatacatgcataagtcaggaacaactgaataaataattgtaacaacaaaatcgaaaggctgggaaggccacaattttgagatcgagttgaggaagggagacgaaaataaaaggaaaaattgacttgtccagcaaaaactagtgacatgataagttttaatatatttagaaaataatatatagataattattggagaagatgattttttgtgctttctatatcatttaaagatttgctaaatctagaatttaggtagtgaaattatactccacgccggccgggttggactgaagggtgctccctgtctatcgaatttttacaccctcactccgtcccaccgtaaataggcagacacatcagaagagagagggagcacccttccgaagccacgccaccgacatcgcctcgtgacccgacgcactgcgccagggacccagccagctagctacatccactgatccacgcgcattccccgtaccaccgccaccgcgccgcgtcacggaaggaggaggatgtcgtcgtctccctcgccggcggccacccgcctggatctggatggcaaccccatcgctcccctcaccatctgcatgatcggcgccggcggcttcatcggctcccacctctgcgagaagctaatggccgagacgcaccacaccgtcctcgctgttgacgtctactgcgacaagatccgccaccttgtcgaccccgcgccgccgcacctcgccgggcgcatctcattccaccgccttaacataaaaaacgactccaggctagaggggctcatcaagatggccgatctgaccataaacctggccgcgatctgcacgccggccgactacaacactcgcccacttgacaccatctacagcaacttcatcgacgcactcccagtggtcaagtactgctccgagaacagcaagcgtctcatccacttctccacctgcgaggtctacggcaagaccatcggcagcttcctccccaaagaccacccgctccgcaaggagcctgaattttatgttcttaaagaagatgagtcgccctgtatttttggtccaatcgtgaaacaaagatggtcctatgcatgcgcaaagcaacttattgagaggcttgtatttgctgaaggtgcagaaaatggccttgatttcacaatcgtgagacctttcaattggattggaccaaggatggacttcattcctggtgttgatggtcctagtgaaggtgtgcctcgggttttggcttgcttcagtaacaatctgctccggagagagcccttgaagcttgttgatgggggtcagtctcagagaacctttgtctacatcaaggatgctatcgaagctgtagtgctgatgattgaaaatcctgctcgagccaatggccacatcttcaatgttgggaatccgaacaatgaagttaccgttagggagttggcccaaatgatgacagaggtctacgcaaatgtctcaggagaggcaccgctggatgagcccatgattgacgtgagctcgagtcagttctacggcgaaggatacgatgatagcgacaagaggatccccgacatgactataatcaacaagcagctaggttggaacccaaagacgcctctcaaggatctgctggagacaacgctgacgtatcagcacaagacatacaaagaagctgtgaaaaggcaaatgtcgcaggcttcagcgtcgacttagatagcgtgcccctggctctcgtctagagcctagtcgcagctgttaagttgtttcggaagcgcaggtcacacatacgctagtgatctttttttttgaggccctagatgtccgtgttgttagataaccaagggatgctgtatcagtatgatatatttgtggcagagttgatgtattccatcgttcgtcgtactagttgggttgattgccgagagctgttatatattgctgtttgagtgtagaactagttgctcagttatatgttattggttcatgagattagcgccctc

SEQ ID NO: 20741 - DNA, 2387 bp, Zea mays
cctttaattttttttggggtcgcaagatactggagggcattattatttccgatgttccaagaaaactcgtgtatagagcaggtgatacaaaataaaaggtactacaaaatgttgtcagtttaagtcttgccgtgcgcaaaaaaacaggtgggcttgtattacaaggactagcaacgggccaacaacacattgctaactaaaaacctatgaatactggtcaacaaaaatcgtaagatgtgcattctcacaaattacagtcatatgtaaaatgaaactgctccagataaactatcaggcaaataacagatttttgtactctaaaaatcaagctattattggcctgtagcttctgtttgtagagctcacgacgatctgcattggtgtcagattaggccatatgggcccaccacgtaatgatctgcacacttatgaacgatcttcgtcatgtgtatgatttgggacctctccttgattgtcaagtggcatatactgcgccatgatagctctaatctcagagtccatgtatgaccttagtctgtatttgtacacaacataacttcccgctgccacaacagcaacaactatcaagataccccacactgcagcccatgctgctttagcctgaactgctgtcttgcttatgcaggtgtcatgctctctgatgtacaaaaggtcaccactgcaagtgcagtcatagccaccccatgtatctttgcagttgcattcaggacactgacaagcttttttctccttgcactcatcaatgtcttcacattttttaacgccgtcccctcggaaaccagctgggcacaggcatttcccatctccagattcctggcaagcagagaatgtttttccgttgcgagtttcatgccaacatcctccatggtttatcaagcattttcctggtccagcaggttcacaattgctgtagccatcgcctttaaattgtacgccattgaaagtggggcattcacacactctaccacggaaggtgtccctacaggctgttacattagcagatttgtcttgccagcagcccccgttgtcattcagacactcatttgtctctatatcatcactcaggcaaacatttggttctgtagtttcctcaaaaccagcacaaatagctttgaggacagctttcctctcaagcttccctcgatattgccggttgttcacaacaagtgtaggcaatatagtaacatctcctcttgaacctttcccaatctgagcatcttgttccattttaagtaacgggtggtcagaatcagcatttgggtctcccatgcatttatcgaccttcttcacatccagacctagtgatttgatgacagtttctgcacattttttattgtacttcttctccttcattggacaccttatgtgaaaatcagtcacataatcccaccagacccatggtttcttattttcgtttgcaactttaaacacacataactgtctgaggttctctaccaccacatcctttccttcgtagcctgtgctaaaatcttgctctggatcaggtgcacagtaccttccatggtttatgcattgagacttgcattgtttactgatcacaaatgcttgaggacagtaccaagtaatgtaatggggcgtgaattggctatagccacctttctcaagtagttgggcagctcctttaaattccttaagaaaattcatcagcatatcacatttaggcccgcattcatcattgctgtttgtccataactcatactcaacacggtcatctggatgtggaacagcctccctccaatcaagattaacattaaccatttccccatctttaacagccttcttcaactggtcaccaaatttttcatctattaatgcagaaggaatggttatgttttgtatatactttgaagcctcgtcatcttcacgaggtaaatccattgttatcaatggttcatccttgtcatcaactacaagtactgcagaggcaccagcattttgtgcattccaaaccttcttcgcaaataagcactcaccgcggtcgatgaggaggaacgtgggcatcgcgccaggcttggcacggaaggggtgcctgccgtcgaaatcgtcgcaagccttggcgttgtccttagggtagacgacggcgcccgccatgctcccgccgtactgtgggattccgaagttccctatagcgctgtcgtgtcgtccccgcaacgaagtcggcgacgtcaccatcaggctgttcttctccacaacgaagcgcgcctccgccgccgccgccgcgagcagcagaagcagcagcagccgaaacgcttgcgctcccatcgcgtgcgagctccggcgcatcggaagcgaggcccaacggaaaatagtcggatgcagttttttccggccggcccgcccgtacc

SEQ ID NO: 20742 - DNA, 2362 bp, Zea mays
tttcaattctgcgggcaatgcgttgatttctcccgcctctctgcgcggattcatgcagcatccagctgcatccagttatttggcttagcctcgtcgtttatattagagtagttcgtgggcgatgattattattacggtggctaaattcgagttatgcacatattcatcacggagaccccgagagttggtgcatgatgcactgaatcccagctgcacatgtttaaaacagcgacacagttatatcccagtaggaggtattattttctattgatcttttgagtgcagcatcgtcgcgtcagcagcggcgaagctctatactggtcagacccattaggtgtattccattcccacctacagtcggtgaatcactcgtctgcatctcatcgaagctggtgatgcaagctttgcatgcatccttagcttattaactggtgaagtggtttctttcgccctgtaactctttgggtgtaacttatggagagcgattagcaaattattaccgttttagatagttctgcgtcaagattttaaaccatttttttctgtaagttttttgctgtctctgtcaccctttgcgtgaagagagctaggtgggccgtagaaaaggcttcagttcagatctcatttcagatagcacaggaccaatctggtctgcagtgttcaactggaatataagatttcgctgcataggtcaaaggtttgtacgagtgaaaaaggtatttatttttaagttcatttagtattattttggctggctgaattgtatatttctatgttattttactatactattgaaaaaatgagtaaattgtatgttgtgataatctgaacttttacatgacagactagcagatactgtcatggctcaggatgaagctgtggctacccaaaagactggaaatacaacatctccttctaaggattacccaactccttctccatatcctgattggtcaaccatgcaggcatattatggccctggtgtcttgccaccaacatattttactcctgcaatagctccaggtcatccaccgccatatatgtggggtcctcagcctataatgccaccccctttcgggacaccatatgctgcagtatacccacatggtggagcttacccacacccccttgtgcccatgatgtcaactccaatgagcgtggagccagccaaatctgcgaatagcaaggagaaaaattccaataagaaacttaaggaaatagatcggactgcagtgtctgctggcagtggtaacagtaaaagaacagtgtcatccattgaagattacagtgcagaaggctcaagcgatgtaaacgatcagaatgtgaacgaaacgtccaggaagcggagctcagatggtggacctggcgcagaaaccaccacaggtggaaacacggaatgtgttttagctcctaaccatacgctggggaatgctaccattttgccacaacactgcttttcagctccagtaattaagcccagtgctacaaatgtcgcgaactcgagggcgataggcacggcattatctccaccacctggtgtgatggttccagttcataatgcagtaccatctgacttatcagttaaggatgagagggaattgaagcgcgaaaagaggaagcagtcaaatagggagtctgctagacgatcaaggctgagaaaacaggctgagacagaggagttggctacacaagtggagtctcttgcagcagagaacacgtcccttagatctgaaatcggccggctaacagagagctcagagaagctcagactagagaactcagctctaatggtgaagctgaaggacaccgcagaaccgtctcccagcaaagcagccgcatccccatcctctccccgtgcctcggcggagaacttcctttccatgatcgacagcgccaacgcgccgagcgtcagcaggcacacggagcacggcggtcccaggctccggcagctcctggactccagtccggcgacagacgtcgccgccgtaagctgatgatgaagccggtccggcaaatacgccacagcacatgcatgtggcctggggattccgcaggctcatgcggctcgagtgctcgccgtaaacgtcagcgttacggactcggactctgtactccagtttaggcactgattccaccgagggtaccggtaattttatctgctctcgcgccagagtgccgggctgcctgcgaccactcctgtgtacccagagttgtaacgtagtagggtgttgtgctgcatgccgaccttttgaaacttttcgagaccgtcatttggaccatttttttcgtcgcaataacacaatacagatcggagtttgtaccggaggtatgtaaaaaaaaaaaaaaaaaaaaagggcggccg

SEQ ID NO: 20743 - DNA, 1851 bp, Zea mays
cattgggtacctcgaggccggcccctcgcggcccccacgcgctcccgggctcccctgcctcgccgcctctctccctgtcgtacccacctgccccctcgcggtctctctctccttcctgattggatcaatctggcctcgcggctccgactgatccgtggcgcctcgctcccgagcggaaccaccacctgatttgacgagactagcagatactgtcatggctcaggatgaagctgtggctacccaaaagactggaaatacaacatctccttctaaggattacccaactccttctccatatcctgattggtcaaccatgcaggcatattatggccctggtgtcttgccaccaacatattttactcctgcaatagctccaggtcatccaccgccatatatgtggggtcctcagcctataatgccaccccctttcgggacaccatatgctgcagtatacccacatggtggagcttacccacacccccttgtgcccatgatgtcaactccaatgagcgtggagccagccaaatctacaaatagcaaggagaaaaattccaataagaaacttaaggaaatagatcggactgcagtgtctgctggcagtggtaacagtaaaagaacagtgtcatccattgaagattacagcgcagaaggctcaagcgatgtaaacgatcagaatgtgaacgaaacgtccaggaagcggagctcagatggtggacctggcgcagaaaccaccacaggtggaaacacggaatgcgttttagctcctaaccatacgctggggaatgctaccattttgccacaacactgctttccagctccagtaattaagcccagtgctacaaatgtcgcgaactcgagggcgataggcacggcattatctccaccacctggtgtgatggttccagttcataatgcagtaccatctgacttatcagttaaggatgagagggaattgaagcgcgaaaagaggaagcagtcaaatagggagtccgctagacgatcaaggctgagaaaacaggtgtgctgtgtgatacagttgtacaatgaagcagcatcctgaaacatgggagtggagtctggcttggattatttgtcctaacaacatatcttcaatcttatacttatgccctcccttggtgtaggctgagacagaggagttggctacacaagtggagtctcttgcagcagagaacacgtcccttagatctgaaatcggccggctaacagagagctcagagaagctcagactggagaattcagctctaatggtgaagctgaaggacaccgcagaaccgtctccgagcaaagcagccgcatccccgtcctctccccgtgcctccgcggagaacttcctttccatgatcgacagcgccaacgcgccgagcgtcagcaggcacacggagcacggcggtcccaggctccggcagctcctggactccagtccggcgacagacgtcgccgccgtaagctgacgatgaagctggtccggcaaatacgccacagcacatgcatgtggcctggggattccgcaggctcatgcggctcgagtgctcgccgtaaacgtcagcgttacggactcggactctgtactccagtttaggcactgattccagtgaagtaaccgagggtactcgtaattttatctgctctcgcgccagagtgccgggctgcctgcgaccactcctgtgtacccagagttgtaacgtagtagggtgttgtgctgcatgccgaccttttgaaactttggagaccgtcatttggaccatttttttcgtcgcaataacacaatacagatcggagtttgtacaaaaaaaaaaaaaaaaaaaaaaactagagggggggcccggtacc

SEQ ID NO: 20744 - DNA, 2403 bp, Zea mays
  misc_feature (2163)..(2163): n is a, c, g, or t
  misc_feature (2175)..(2175): n is a, c, g, or t
  misc_feature (2232)..(2232): n is a, c, g, or t
  misc_feature (2241)..(2241): n is a, c, g, or t
  misc_feature (2375)..(2375): n is a, c, g, or t
atttctatgttattttactatactattgaaaaaatgagtaaattgtatgttgtgataatctgaacttttacatgacagactagcagatactgtcatggctcaggatgaagctgtggctacccaaaagactggaaatacaacatctccttctaaggattacccaactccttctccatatcctgattggtcaaccatgcaggcatattatggccctggtgtcttgccaccaacatattttactcctgcaatagctccaggtcatccaccgccatatatgtggggtcctcagcctataatgccaccccctttcgggacaccatatgctgcagtatacccacatggtggagcttacccacacccccttgtgcccatgatgtcaactccaatgagcgtggagccagccaaatctacaaatagcaaggagaaaaattccaataagaaacttaaggaaatagatcggactgcagtgtctgctggcagtggtaacagtaaaagaacagtgtcatccattgaagattacagtgcagaaggctcaagcgatgtaaacgatcagaatgtgaacgaaacgtccaggaagcggagctcagatggtggacctggcgcagaaaccaccacaggtggaaacacggaatgtgttttagctcctaaccatacgctggggaatgctaccattttgccacaacactgcttttcagctccagtaattaagcccagtgctacaaatgtcgcgaactcgagggcgataggcacagcattatctccaccacctggtgtgatggttccagttcataatgcagtaccatctgacttatcagttaaggatgagagggaattgaagcgcgaaaagaggaagcagtcaaatagggagtctgctagacgatcaaggctgagaaaacaggctgagacagaggagttggctacacaagtggagtctcttgcagcagagaacacgtcccttagatctgaaatcggccagctaacagagagctcagagaagctcagactagagaattcagctctaatggtgaagctgaaggacaccgcagaaccgtctccgattaaagcatccgcatccccgtcctctccccgtgcctccgcggagaacttcctttccatgatcgacagcgccaacgcgccgagcgtcagcaggcacacggagcacggcggtcccaggctccggcagctcctggactccagtccggcgacagacgtcgccgccgtaagctgatgatgaagccggtccggcaaatacgccacagcacatgcatgtgtcctggggattccgcaggctcatgctgctcgagtgctcgtcagcgttacggactcggactctgtactccagtttaggcactgattccagtgaagtaaccgagggtaccggtaattttatctgctctcgcgccagagtgccgggctgccttgcctgcgaccactcctgtcctgtgtacccagagttgtaacgtagtagggtgttgtgctgcatgccgaccttttgaaactttcgagaccgtcatttggaccatttttttcgtcgcagtaacacaatacagatcggagtttgtacaaaaaaaaaaaaaaacccccaggcgggcgccccacccccctagctgtttttccccataccaaacaggaactattacccaatcacctcaacctcaattgcccccccccccgtctttttcctagaaaaaacacattccccactattatcccgatccgcactatttccccccctcattagtcatcgcacatccatcctcctcgccatgaaccttccagttttattccccccgccactacagttatctcccccacccccaaccttttccacctatttctttttattttcctccctatccaccacacaccccgctacctatccacccttgaccttttttcccccattttatgccatttttcccccaccccactttttactgcccaccctatattttaccccccattctcctttcacctcccaccaccatctcaatattacttatactagttctcccaaatgttgacccggcctatataccaccattcttctccccacttccacgccgccgttctttcacccatttattctcctccccttcttcttccacctctgttatcacccagctgtatcgctctctgcatggagacacgcaactcgttctnattcacgttcgnatagttcaccacacgcgcccgctcagctctatccagtgtcatacttcccgccgatantctattcanccaatatgtatgatgcctcctcttacgtgttagtacataactcgatctagtcgtactttgagtcagaccgcccttgggtcacaggtttatgtcgatgttttaagtacattactctaagatgcgtgttgatctgntgtacttctcatcccgtatattacatat

SEQ ID NO: 20745 - DNA, 2736 bp, Zea mays
  misc_feature (215)..(219): n is a, c, g, or t
ccacgcgtccgctgccaataagctgtccaggcttaaggagcaagccgaagagtatgccgccctgattatggaggagcttgatcctgaaggacttggctacattgagttgtggcagttggagacccttctgttgcagaaggatacctacatgaactacagtcaggcgctaagttacacaagccaagcactaagtcagaacctagcaggcttaaggnnnnngagtccaattcgcaagataagtaccacattgagttactatttggaggataattggaaacgcctatgggtgcttgcattatggattggaataatggctggactgttcacttggaagttcatgcagtatcgcaacaggtatgtctttaatgtgatgggctactgtgtgaccactgcaaaaggcgctgctgaaaccctgaagctgaacatggcaattatcctcctcccagtatgccgtaacaccattacttggttgagaaatacaagggctgcacgggcattgccatttgatgataatattaacttccacaagactattgcagcagcaatcgttgttggtataatcctccatgcagggaaccatcttgtgtgtgattttccacggcttataaattcatcaaatgagaaatatgctcctctgggccagtacttcggtgaaacaaagccaacatactttacattggtcaaaggagtggaaggcatcactggtgtaattatggttatctgtatgattattgctttcactttagctacacggtggttccgtcgtagcctggtgaagcttccaaaaccatttgacaaactgactggcttcaatgccttctggtactctcatcatttattcataattgtgtatttggctctcattgttcatggccagttcctttacctcattcatgtctggtaccgaaaaacgacatggatgtatctggcagtgcctgtttgcctgtatgtaggggagagggtgctgaggttcttcaggtctggcagttattctgtcaggctattgaaggtggccatatatcctggtaatgtgttgacactgcaaatgtccaagcctccggctttccgatacaagagtgggcaatatatgtttgttcaatgtccagcagtgtcaccctttgaatggcatccgttctcaattacttcagcgcctggggatgattatctaagcattcatgttcgacaacttggtgactggacacgagagctcaagagggtttttgcagcagcttgtgaacccccagtgggcggtaaaagtggccttcttagagcagacgagacaaccaagaaagccttaccaaaacttctgattgatggaccttatggttctcctgctcaggattacagcaagtatgatgttcttctacttgttggattagggattggtgcaactccttttatcagcatactgaaagatcttcttaacaatatcataaggatggaggaagaggaggatgcttccactgatctttatcctccagttggtccgaacaagccgcacattgatctcagcacacttatgacggtcacatcaagaccaaagagggttctaaggaccacaaacgcttacttctattgggttacacgtgagcaaggttcttttgattggttcaagggagtcatgaatgaaattgctgaactggaccaaaggaatattattgagatgcacaactaccttacgagtgtttatgaggaaggagatgctcggtcagcgctcatcaccatgcttcaagctttgaaccatgcaaagaatggcgttgacattgtctctggaactaaagtccggacacactttgcaagaccaaattggaaaaaagtcctatctaaaattgcctcgaagctgccctgggcccacgcaggtgtattctactgtggagctccagttcttgcacaagaactaaacaaactgtgccatgaattcaatgggaaaagcacaacgaaatttgagttccacaaggaacatttctgaattccagtaatacttggtgcgcagaaatgatatattatgtgtgtgtacagcatttttgtcttggtatgttcatctggagttctggacgaacatgagagcaaagtggagaagctaccatcaaatgcttaacagctgacggcctgcactctttgttaactgctcctaaatgaaccagaccaccaagaagtgggatttttgtgtacatatacatgtgatgtccaaacgtccatctgcagattggacccctcaactgtgaagagattcctcccaggtggtcaccaatgtacagagcacacatgaagataaagagtagttgggattgtcggtagcatgctattcgtataggacaggagggataccactagtcacaacacacaaggctatttaattgtatattttcatgcagctgatgccctgcactttctgctgctggccaatgcggcaaggacagaagcattttttctcatttgtaccgcatacagaaaaggcataacaaaaaagaggtgaaagggagaatagcattttagcacacttatgggtccctcgatttatttgaccctgcggtgctacgagcctacgaggaggagatgaagtagaataaaattgtcatttcattaaataaagcaaatgtttagaatattttaataaaagtgttggggcttgtttttatctacgcccgccattctcgaatgatatttattgttactagttcatttttgaactaaaacgtgacaaataaaaaaaacgaatgtagtaatatttagaca

SEQ ID NO: 20746 - DNA, 859 bp, Zea mays
cattgggtacctcccggccgcccgcgggtccgatccgatggcccgcgccgccgctcgcctcctccccatcttcctcccatggcggcgtcctcccccgccctgcctcctccgccggggcttcctaaaccctagcagccccagaacctccgcgcgcgtcgacaccctcgttctccctggagacgagcgcttgcccttcccctcgcccccacgcctcccgaaccagctgcgtcctgactacgggagtggcggcggaggcggcgctccctcgaccatcgcggccatcgtcacctcactcggcggaggccctgcagcggtggggatcgtgcggatctccggccccgatgccgtcgccgtcgccgaccgcgttttccgcccagccgggaccaggagggcgtcgacgccgtggcaaccgcgcagccactttgttgagtacggactcgcgctcgacgcggacggcagcgttattgacgaggttttggtggtgccaatgctctccccgaggtcctacacgcgagaggatgttgtggagcttcagtgccatggcaacgatctctgcttgcgccgcgtgctcagggcttgcttggaagctggagccagacttgctgatcctggtgagttcacccttcgtgcattcctgaaatgggaggttggacttggcccaagcggagaatgtgtctaggcttatttcagcaaagtcagcagctgcagcggactcagctttggctggcatccagggaggcttttctaccctagtaaagtcattgagatcagggtgcattgagttgctaacagaaatttgaggctcgtttagattttgaagatgagatgcctccctttggacccagtgatgcttgtcagc

SEQ ID NO: 20747 - DNA, 2285 bp, Zea mays
aatccccaatcgaaacggctcgcagctcatctcaatccgatccgatggcccgcgccgccgctcgcctcctccccatcttcctcccatggcggcgtcctcccccgccctgcctcctccgccggggcttcctaaaccctagcagccccagaacctccgcgcgcgtcgacaccctcgttctccctggagacgagcgcttgcccttcccctcgcccccacgcctcccgaaccagctgcgtcctgactacgggagtggcggcggaggcggcgctccctcgaccatcgcggccatcgtcacctcactcggcggaggccctgcagcggtggggatcgtgcggatctccggccccgatgccgtcgccgtcgccgaccgcgttttccgcccagccgggaccaggagggcgtcgacgccgtggcaaccgcgcagccactttgttgagtacggactcgcgctcgacgcggacggcagcgttattgacgaggtcgttattgacgaggttttggtggtgccaatgctctccccgaggtcctacacgcgagaggatgttgtggagcttcagtgccatggcaacgacctctgcttgcgccgcttgctcagggcttgcttggaagctggagccagacttgctgatcctggtgagttcacccttcgtgcattcctgaatgggaggttggacttggcccaagctgagaatgtgtctaggcttatttcagcaaagtcagcagctgcagcggactcagctttggctggcatccagggaggcttttctaccctagtaaagtcattgagatcaaggtgcattgagttgctaacagaaattgaggctcgtttagattttgaagatgagatgcctcctttggacccagtgatgcttgtcagcaaaattaattgtatgaggaaggaggttcaggatgctttggacacttccaattatgataaattgttacaatctggtctacagatagcaataattggccgtccaaatgttggaaagtccagcctccttaatgcttggagtaagagtgaaagggctattgttactgaaatagccggaactacacgggatgtagtagaagcaaatgtctcaattcatggtgtacctgttactcttttggacactgctggtataagagaaactgatgatgttgtggaaaaaattggcgtgaaaagatccgaggctgctgcaatgggagctgatcttattgtaatggcaataagtgcagttgatggatggactgatgatgacactaaacttatggagcatgtttcggtaaataggaagtcctcaggttctgcagttccgatggttcttgtaatcaacaaggtagattgtgcaccatttgttcccggagaacagttcaaacaattcagtggcctcttcagaaaacacgtacagacatgtgcagtcaccggtaaaggcatttccgatttggagagcgctgtaatagaggtcaggggtattgagcatgtgccttctgagggacgaaggtggaccgtaaatcagaggcaatttgaacagctgttgaggactaaagaagctttcgcacgtctagagtcatcaatcaacgagcagttaccaatggacttttggactgtggacttgagggaagctgcgcttgcccttgcaacaatcagcggggaggacatctccgaagaagttttgagtagcatattcagcaaattctgcatcgggaaatgatctcgcaggatgctgcatccagtagtttggagcagaagctttttccttgactgagaacaggaaccaacatgctgactggcacttgggttcgcggcatcagaatggtgaacaggcgtgcttgttctctgaggtgccacaaagaacacaagggaggtgaagccctgtccatcctagtgcacaccgtatagatgctaaggatggaaccatcgagttcctgtcttcgacgtcggatacgaatcctgtatactcgtggttgatatgagaaaattttattagacctaattgagaacgcaaacagtttcattcatccgtcttgctgtacgggacgcaacatacccgaattgtgaccaggagacattaaggtgccgtctggttcagacgttgtaacaggaatcgtaatgagatcccttaccggcggtaatgtaatggttattggctgatcccttaccggcggtaatgtaatggttattggctgtaattagattggatagtaccagatactacttgaaagagctcagtcaaataaaggtatcggtctaatccgtttgcgttgaaaaaaaaaaaaaaaaaaactcgagggggggcccg

SEQ ID NO: 20748 - DNA, 2864 bp, Zea mays
  misc_feature (1482)..(1482): n is a, c, g, or t
gagctccgcgtccgttgctgtcgccgttgctgtcgcagcttcgactcgcgcctccagatcttctttgacatggtggataagaatgcagatggccatatcacggaggccgaggtgaaagagatcattatgctgagtgcttctgctaataaattgtcgaggcttaaggagcaagctgaggagtatgcagccttgatcatggaggaacttgatcctgaagggcttggctacattgagctttggcaactggagacattgctactgcaaaaggatacctatgtcaactacagccaggccttgagctacacaagccaagcactaagccagaaccttgctggtctaaggaaaagaagtccaatccgaaaaattagcagcacattgaactactatctggaggacaactggaaacgtgtttgggtgcttgcagtatggattggaataatggctggattgtttatttggaagttcattcagtaccgtaaccgttatgtctttgatgtgatgggctactgtgtcacaactgcgaaaggtgctgcagagactctcaaactgaacatggcacttattctcttgcctgtatgccgcaacactatcacctggctgcggaatacgaaagctgcacgggcattgccgtttgatgacaacattaacttccacaagactattgcagcagcaattgtggttggtgttgtccttcatgcagggaaccaccttgtatgtgattttccacggctcattagttcatcagaggtgaagtatgctccactgcgcaaatactttggggaaaataaaccaacatatctggatctggtaaaaggagtggagggcataacagggataatcatggttgtgtgcatgcttatcgcttttactctagcaacaaggtggttccgccgtagcctggtgaagcttccaaggccatttgacaaactaactggcttcaatgcattctggtactctcatcatttgttcatcattgtgtacatatcacttgttattcatggagagtgtctataccttatccacgactggtacaaaaggacgacatggatgtaccttgctgttcctgttggtctgtatgtaggggagaggactctgaggtttttcagatcgggcagttattctgtccggttattgaaggtggctatatatcctggtaatgttttgacattgcagatgtctaaacctcccacattccgttacaagagtgggcagtatatgtttgttcaatgccctgcagtttcaccttttgaatggcatcctttctcaattacttcagcacctggggatgactatctaagcattcatgttcgacaacttggtgactggacacgggagctcaaacgggtattctcagcagcttgtgagccacctgtgggtgggaaaagtggccttcttcgagcagacgaaacaaccaagaaagcgttaccaaaacttttgattgacggaccatatggttctcctgcacaagactacagcaagtantgacgttttactacttgtcggattaggttatcggtgccacaccttttattagcatactgaaagacctgctcaataacatcatcaaaatggaggaagaggaagaagcttcaagcgatctttacccaccaattggtcgcagcaaggcacatgttgatcttgacacccttatgaggattagcgcaaaaccaaagagggtactgaagacaacaaatgcttacttttattgggtgacacgtgaacaagggtcttttgattggtttaaaggggtcatgaatgaaatcgctgaactagatcagaggaatatcattgagatgcacaattatctcacaagtgtttacgaggaaggggatgctcggtcagcactcattacgatgctacaagctctcaaccatgccaagaatggtgttgatatagtttctggaactaaagtgcggacacattttgcaaggccaaattttaaaaaggtcttatctaagatagctaccaaacatccatatgctaagataggagtgttctactgcggggctccagttctggcacaggaactaagcaagctctgttatgaattcaatggcaagtctacaacaaaattcgaattccacaaggagcatttctgacatacagcaaggttaatgcagaatattggaacaagggggagaagatgtgatgtatgtaagtcacttgtgctttaacatgttgctttcttggcgatgagtttgaaagagcaagggattctgcacaaggtgttgtatcaccacagcttactccgcacttgtgatactactgtcccccagttacaactgcattatctattgcttgagatactaaaatacaataagatcgcatagaaaggaaaatgggggtcagcagcacatcacacaaggtttccatcgaaggttcaagagcacataccccaggtggagtagcaagggaatctctcccatggagtccacaaccataaattgtgattatataagtagcgtgatgtaggacacatacaatgaaggccaggatgtcacaaggctacctaactgtatatttgcatgcagctgagtggctgactgaggccacaagtttgatctaactttgtacttgtacacagggttgaaaaacaggaagaaggtacattttgtttttgtaagtagcgtaggttggtagtgactgggctcagattgggggccctcaagtttcattaaagcttgttccgttgcctcgttgagtggtaggttgcattttttttaggacagatctggctgattcatgtatatctttactgaaggccatgtttttttttaaaaatttatgatgctgtctacatgttgatatggaaaggattaaatgtggaaaatgatatgtatacctgtgctaatttggcgccagat

SEQ ID NO: 20749 - DNA, 2091 bp, Zea mays
cagggtaggtttgttattcttttgttcttttgtgggaattggactatttattttacaaggaacctgatttggatgtagcagcaaacagttgcaatggagagatcaaattcaggatagccatgaagcaacagttagccgagctcactcatccggtcatcccctgttctcaaatcaagatcatataaacatgattcttgcttcctatcatctttgatccgatctagattacagtttcgagctatttccagtttccatgctaacaagcttgtgaggaaacttctgatcgttggtcgctgtccgccattgtctggacctgggcagcatattgcaggttccagagaacttcttccatggaaggtcgagccgagcattcgatggacaggcattttatcataattgaaaccacgatggataacgaatcctgtgaacaagtgccaatgatgacaggatccacaacttgatcgcgctcttccaaagtagacattgacacaaccagatctttcaaaatgaaagggccacctttctcatgtaattttgggcccataagtacttgcccgggcgtataaccaaaagagcatacatcatcctccaaattttccatttctgtagcatcattttgcaagtatttttccttttgtcctattacctcatctctgtatctctcctctgtatatctcctctgtgattatagataatccatagtcactcaactttgccgtatggtgttcatcaaccaaaatactggaagattttagccgaattggatacaggataccaggcaattattcctgtatgtaggaaatgaacagccttagcaatggcaatcagcacttgcagcctatcacaccatttcagagtcttgtctggactacaggcagaaagataagaagaaagagttccaccaggcacatattcatacacaaggaaaaccctcttcacagttgattcatcaaccgcactatcaatgcagtgccccaataagcaaaccaaatttggatgacgaagctttgcaaggagatctaaacgaagctttagattcctaattgaatatcgctggtgcaatggcaaacatcttatggcaatcagggttgcattctctaaccttcccttgtacagctttccaattgctccctcgcctaaaaatgctgacctttcaaagctctttgttgcttccttgagttcttctaaagaaaatatgtgatatgacggttgtatttgtgttcctaacttgacagcttgagatatgcaccttgcattcaccagcagttcagacgacattcctgacaacaaattatcttgtgcccacgcgtccgcccacgcgtctgcggccagaactttctgacagcttcttttgttggaagccattaacaacagagaaagcacaagaataacaaacaatatgccaacaacagtgactacaagtccaacatccttttttgatcctctcccattatgagattgttggcaatatttatcttcatgctggtgggcagggtcaactctaaagcaattcccatcaaacttaacgaccttgttattcaaattaccgttcagacagctgggcagatcgcctgtgagtcggttagtggacaaatccacaaatcccagggtgctgctgcatgttaaactacttaacaatgaaccactaagcatatttgccgccaaattcagataactgatgttagggagagcaaacagctctgcgggaggactccccacaaggaagttgaacgagacatcaaggtgctgaagccggttcaactgaccaaactgctcaggaatttcaccctttagtgaatttttactaagtaagattgttaccactgatgtaggcatctcaggaagctctccatccaacttgttgtcccttaaatccagcatctcaagcttatttaggttgactccatttggaacatcccccgagatgctattgccggcaagcgcgagctccgtaagcatggcagctttgccaatcgatgctggtatggaccccttcagctggttactctgcaaccgaagaacaatgaggttcgagaatgagtcaagccagtctggcacacttccattgaagtagttaccatccagtgtcac

SEQ ID NO: 20750 - DNA, 1511 bp, Zea mays
atgcattgctatcataacatctgtgtgatccagttctgtggatcacccctttctacatacgatttttatggcgacaagtcagcaaaatggctacaactacctgctggtgcagcttggtaaaaaaaaaaatcccatccatggtgagtttttaaaaaataatcatagttatggccaaaaggagccgatctcaaaaacagaacagtgtccgcatttcaaactgggctccataaagttctgtcgcctcgcctgtgacctgtagggtagcagcaggcagcggagggggagagagagagaggggatggattctcaagcgccgcttcgtcctcctctagctttcgcctgcttcatcttcctttgctcatccttctgcgcagaaatgggatgtacgacagggttggtgcggcggcgtcagatggggagagcaggaggatgcggctgcacaccgacgggagccgcggcgacgcgcacgcgtggcctgggtacctctacacccgagcagttgggagatgcacaccccaattctggagcagcggagccgagccctggcccaacatcgtcccacaggaagcggcggtggcgaaggtgttcgggtctaggtccgtggagcgctacgggccgcgcctcaccctgctggaagctaccatgaggaccgacgatgccggtggcagcgccttcgtgaagctcgtgaagcaagggagcgccgccctcctcaacgcctacgcgaggagagggttccctttcgactcctgggaggtgaaggccctgctgctggaggcgctggtgtccgaggatgccgctgtggtccaggcggagcggtttgagcaggccaacgagtcctgcgtttgatcttcgatggatgaagatgcaacgatggtgccgctgtagtatcgtgttcctggttggtcaccacttctgtgactttggcgttgaggtttctgaagccgcaactctgtccaagtcggcatgtttctctagatgccgggctttgtgtaatgctgtgtgcactgatgtgtagtaggttgtaatctacggaccgtgattttttttttactatttcaatggtaatggaagttctatgttgtcgcaaaaaaaaaaaaaaaaatcatgcttgccaccgtgccctgattggagtctgcgtggcgccgagaacacaggccccaaccccaagccggccaccccagtggtgccgtctgccatggcgcccgcgcgccagttcgtcgtgttcgcccaatcccacgaagctaccgagcgagtggtgaactggagccgtggggcgtgggctggctgtggtggcctggccccacttttgcgggcggctgggctcatcgcggattttccgttgcggaccccaacgggccggcatggggatgtgggcttgcgcgtctctcgtcggcgtccgagtggagaaacgaggtcgtgagatggggtggggcgttggacctcatattttatttgggctacgcaaaagatagagcgaaatttgccgccgaaggcacaaaagatgtttgact

SEQ ID NO: 20751 - DNA, 2447 bp, Zea mays
  misc_feature (563)..(563): n is a, c, g, or t
ttcatcccaaatatctgggacgccttccagttcaccggagccacggcttccgtctgcgtcgcctacattttccctgctgcgatcacactaaggtgactgtaatatgtaactttgtttattactaaaatcgagcagcacaaatttctccatcatggctttggatgtttgaagctacttcgtttgttccggtctaatttaccagggatcctcatggcatagcgaagaagagagacaaggtcctggcagtgttcatgattgttcttgctgtggtggcaaacaccgtggcagtgtacagcgacgcttgctcgtgatcttaaatggcagccatggctacgtcaagcgcacgcgtatctaaaaattagtcagggctcaaagtgccgtaactatgtatatagggcgtctgatccaccatagtcctaaggcgggatccataattgatgtgaacaaaagtgattaacataatgaatattcttagatccgggtttgttaatggttctgaattttaaagccctttctttgattaagtaaggaagaactacttagaacccttggaagtctatgangaagctggcctttagttgatcctagaattggattaattttggttgtaacaaggagtaacattgttgagatggtcccttgactgccatgataagtgattttgtcaaagttgcttcatctcctcctcctaatattactgttgctagttaactttaatgtagctgtttttagcgctttcatttaggccgaatctgcctgtccgaactccgaagcgtggcagccatagcccatatgtgcctatctggctatccctcaagctgctcgcgtctcgagtaggttgtattttgctgaaaacagttcataacccttcttaatgaaactatattggatatgtatttttatcatatttttctgattttacagaaatttcaaaaaaaaatacaaaattgaacgaaataggtttgaaaaccatttcctgatcagtaccagaaatagtaaattttaccgaatttcgccaaatctcaggcgagaaattttaccgtggtccaatgagaccccattatttcaggtaatcaggtgtaaaaacgtacgtcaggctggaaaaagcgcaccatataccaaatctattatcttcacacacgggtgcatcatgtgaattacagtctcgagcagtcggagttcaatttcgtagagacagttcacagaacacttctaataagaaaagagtaacaccatccatagataggtgtcagtttagtaaaaaaatcgaaaattgtaataacaagtgcttagcattccttcattgggagataacaaatgaacatatggcatgcgatcaactaatatacaatatcatcatggaatcctgaagttcgatatcattggcgtcatctctcgaatcgtgaaaccatagtctactactacacaccttctgccttccctgttgctgcctttttgtcatcgtcatcactctccaatcccgaggtcgcatcaatcttatcaaagtcatcatctagcccatcatcaccaccaacagaagcctcatcatcgctacccagatcccccagcagaaatacatccaggtcatgttcaggatttgtcgaagaggtcttgcttggcacttttgtgtctttcggttctgcagttgtagatgcttgggatgcttccttctgggaatcctttttctcttcctctgctttcactttcagctcctcgaagtatttcttctcaaacggagctatatagctgtttactagcaaaaaatatacccgccagaatttgcgctctttcatgtatcttgggcatagctcatatctgaactttgatatttccttgactgccgagaggacaagtgtgccgtgtctggcctgccactcgttcagatcctgacgcacattcgacacagttggcacatcagacacctcaggctcatcttgcagtgggaagtcgcggaaggtgtttatggtcatgcccttgacgaactcgcggaggtcgtcggtgatgccgtagcactcaagctcggccgcgtcgggcaccgacgaggcagcggcggggataggcgggatcgcggggatgggcgggatcgaaggcacagggaggtcggaggcgaggtgcttgatctggccggcgaggaggtcggcctgcttggtggcctcagcggcgatctcccgcgacttggaggcggtttcggagaagatctccttggacttcttcgccgtctccgagaccagcgccgacgagcgcttggccgcctccgcggagagttcctgcgaccgcttcgccgcctcgccggcgaaggcccgggccctctcccagagatccattgaggcagcggaaaaaaatctagaaggttatgggtcttctcaccgccgccgttgacacgtctccgttgacgtcggcgcgggacggcctgactggaggggtgttctttaaagaacgggatgttt

SEQ ID NO: 20752 - DNA, 1253 bp, Zea mays
  misc_feature (1173)..(1173): n is a, c, g, or t
gaaaaacgcaccatataccaaatctattatcttcacacacgggtgcatcatgtgaattacagtctcgagcagtcggagttcaatttcgtagagacagttcacagaacacttctaataagaaaagagtaacaccatccatagataggtgtctcagtttagtaaaaaaaatcgaaaattgtaataacaagtgcttagcattccttcattgggagataacaaatgaacatacggcatgcgatcaactaatatacaatatcatcatggaatcctgaagttcgctatcattggcgtcatctctcaaaaccatagtctactactacacaccttctgccttccctgttgctgcctttttgtcatcgtcatcactttccaatcccgaggtcgcatcaatcttatcaaagtcatcatctagcccatcatcaccaccaacagaagcctcatcatcgctacccagatcccccagcagaaatacatccaggtcatgttctggatttgtcgaagaggtcttgcttggcacttttgtgtctttcggttctgcagttgtagatgcttgggatgcttccttctgggaatcctttttctcttcctctgctttcactttcagctcctcgaagtatttcttctcaaacggagctatatagctgtttactagcaaaaaatatacccgccagaatttgcgctctttcatgtatcttgggcatagctcatatctgaactttgatatttccttgactgccgagaggacaagtgtgccgtgtctggcctgccactcgttcagatcctgacgcacattcgacacagttggcacatcagacacctcaggctcatcttgcagtgggaagtcgcggaaggtgtttatggtcatgcccttgacgaactcgcggaggtcgtcggtgatgccgtagcactcaagctcggccgcgtcgggcaccgacgaggcagcggcggggataggcgggatcgcggggatgggcgggatcgaaggcacagggaggtcggaggcgaggtgcttgatctgagccggcctcgaggtccccctgcttggtggcctcaacggcgatctaccgcgacttgaagacggtttcgaagaagatcaccttggacatattcgccgtctccgagaacagtgcagatgagtgtttgcccgcccccgcaaagagttcctgcgcccgnttggccgcctggtaagaaaaagaaaggctcgagccaaattccaagcatgcgtgcgcgcgcagtcgtagctcttgtttagt

SEQ ID NO: 20753 - DNA, 1132 bp, Zea mays
ttttttttaaatgtattatcttctattcttttacaccggtatttcaagcaaattgtagcctcgagtagtcgtactgaagttcaattcaatagatagactagtacatatgcagaaaactcctaataagaaaagaggagtcacaacatcgataagatgtgtgagtttagttaaaaatcgaaagttgtaaaaaaaacaagtgtttaacatccttttctgggtgataacaaatgaattgatgacatgcgatcaactaatatacaataccatcttggaatactaaagttcgctatcattgtggtcatctgtcgaatcgtaaaaccataggctactacttcgcatcttctgctttccctgttgctatttttttgtcatcgtcatcactttccaatcccgtggtcacatcaatcttatcgaagtcctcatctaggtcatcatcatcatcaacaggtccctcatcgtcgctacccagatctcccagaagaaatacatccagatcatgttctggatttgttgaagaggtcttgattggcgcttttgtgtctttgggttcgaaagttgtagatgcctgggatgcttgcttctgggaatcccttttctcttcctctgctttcactttcagctcctccaaggatttcttctcgaacggggctatatagctgtttactagcaaaaaatatacccgccagaatttgcgctctttcatgtatcttgggcatagctcatatctgaacttcgatatttccttgactgccgagaggacaagtgtggcgtgcctggcctgccattcgctcagatcctgacgcacattcgacaccgttggcacatcagacatttcaggctcatcttgcagtgggaagtcgcggaaggtgcttatggtcatgtccttgacgaactcgcggaggtcgtcggtgatgccgtagcgctcaagctcggccgcgtcgggctccgacgaggcagtggcggcgataggtgggatcgcggggatgggtgggatcgagggtacggggatgtcggaggcgaggtgcttgatctggccggcctcgaggtacccaatcgcccttgcctcggcggcgatctccaaaaaaatggaggaggtaacggaaaagatctccttcgtccgtacgcctcggtc

SEQ ID NO: 20754 - DNA, 1680 bp, Zea mays
gactaattctctctttttttttttttttttggggctgtttttcaattcaatgggtagactagcccatatgttttttttttttttttggaaaagaggagtcacaacatcgataagatgtgtgagtttagttaaaaatcgaaagttgtaaaaaaacaagtgtttaacatcccttttctgggagataacaaatgaattgatgacatgcgatcaactaatatacaataccatcttggaatactaaagttcgctatcattgtggtcatctgtcgaatcgtaaaaccataggctactacttcgcatcttctgctttccctgttgctatttttttgtcatcgtcatcactttccaatcccgtggtcacatcaatcttatcgaagtcctcatctaggccatcatcatcatcaacaggtccctcatcgtcgctacccagatctcccagaagaaatacatccagatcatgttctggatttgttgaagaggtcttgattggcgcttttgtgtctttgggttcgaaagttgtatatgcctgggatgcttgcttctgggaatcccttttctcttcctctgctttcactttcagctcctccaaggatttcttctcgaacctattagaattttactgaagtcagcaaaaatgtaaatgcgcaaaaactatgccagaaaactaacatcatgatataataagcagtggttggaaatcaactatttatgtgaaatatgaaaagatcaaatgtgataataaatatattcaaggtaagctccattgcatctatggaggcagccgaggcaggaggcccaagtaaataggaccgcagattatgccatcaataataattgcagacaatggataaaatcagcatactacaatgccacaaataaaagtaatggctacaccaattcaaataaatttctataaattccttttgacaagtgtgacatgataaataaatggcaaaccgtcgacattctagtaaaagtttgtgcatcacgaacaggagtggctacatagctgtttactagcaaaaaatatacccgccagaatttgcgctctttcatgtatcttgggcatagctcatatctgaacttcgatatttccttgactgccgagaggacaagtgtggcgtgcctggcctgccattcgctcagatcctgacgcacattcgacaccgttggcacatcagacatctcaggctcatcttgcagtgggaactcgcggaaggtgcttatggtcatgtccttgacgaactcgcggaggtcgtcggtgatgccgtagcgctcaagctcggccgcgtcgggctccgacgaggcagtggcggcgataggtgggatcgcggggatgggtgggatcgagggtacggggatgtcggaggcgaggtgcttgatctggccggccaggaggtcggcctgcttggttgcctcggcggcgatctccagcgacttggaggcggtctcggaaaagatctccttcgacttcttcgccgtctccgagaccagcgcagacgagcgcttggtcgcctccgcggagagctcctgcgaccaattcgccgcctcgccggcgaaggcccgggccctctcccagagatccattgcggccgggaaaaaatctagaaggtctgaagtcttctgtcttctcaacgccgccagtgacacgtctccgtcgacgtcggtgcgggacgggag

SEQ ID NO: 20755 - DNA, 1030 bp, Zea mays
actcactcactcgcatcactgactgactggactgctgctcactccttccttcccctggcagagaatctgcagtgcttgccggccggccctgcagagcgcggggatctgcaggcatcatggtgcaatcaaagaagaagttccgcggcgtcaggcagcgccactggggctcctgggtctccgagatcaggcacccgctgcttaagaggagggtgtggctggctcaccttcgagacggcagaggaggcggcgcgggcgtacgacgaggccgccgtcctcatgagcggccgcaacgccaagaccaacttccccgtgccaaggagcggcaccggggagctgctggcccctgcagtgccggccgcacgggaggcgcgtggtggcggtggcggcggcaccagcctgtcgcagatcctcagcgccaagctccgcaggtgctgcaagacgccgtcgccgtcgctcacctgcctccgcctcgacccggagaagtcccacattggcgtctggcagaagcgcgccggcgcgcgcgccgactccagctgggtcatgaccgtcgagctcaacaaggacgcgccgccgccaccgtcctccggcgaggagccggcgcccagctacggcggcgcggccaccacgtccacgtccacgcccacgtcgtccactatcacggccggctcgcctccacctgagatgatggacgacgaggagagtgttgcgctgcagatgatcgaggagctgctgggatcacatgggatgatgctccaggtccagggtgcagcaggcagcctcgtcatctgaaggaaaccgcatggttcaacaagctattatgatatgatcaggacatcatcatcaggtcactgtcccagatcagaccaagcagttaagattgcatcatatatataatataggtacacctctattactacatcaagcttaggaaaaaaccatatagtaagatgaatcactactgtgtgaagctctgtaattatatatattaaaggcttttacttgtaaaaaaaaaaaaaaaaaacggcacgag

SEQ ID NO: 20756 - DNA, 1084 bp, Zea mays
tcggcctaaactgggtaaactagtaccacccgtattaatactgtgaagactatatgagagggtatgaaatgtataacctaaacttcccacttaattccagacatcacgacactaccagctctctgccatatctttctgtttctcaatatattctcttccctcgagccccgccgtcagtaatctgttaaccctctcctgatgcccatcatcggcctcgccctcaccggagcaccgaactggtactccttgctcgcgggggaaaagttctcatctttctccccgagctcacctcggcatccccgacggtctgggtcgccacagccaacttctccactagctggccgacctccaccccttccttcgccttggccagcgtgaggcgcacgaagctgccaagggtcgtaggggatgtgagcggcacggcgttgacccagttgacagcggtgatgtcgagcgcgttggggaggacgtgcccctgcacggcggccacgtgcgtcgggtgcgctgcgtaggacgccaggctctccctggtggcatggcgggtgtggaggaggtgcgtggggctggtgaggtggtgcgaggccattgcggcaacgcacgcacggtgttcggtggattgccaccacggatggcggcgctacggagcagaggaggtgacggggacgggggctggacccctaagcggagccccactacagccgtcccaccgacccgggagtccgggacccaatggcgtcgtcatcgatggcatcgttgtcgcgtcgttccgtcttgcacgcctcctacacccgctcgcagttttccgcgaccgacatctgcagccacttcattcctctcgtctcgaagtacgtactttagaaccctagatgcagcgacctggatggtttcccatcgctgccgacggcctcgtgcgcgctcctcctgtcgaagtcctggccgacaacgatcttgtttctaatgttttaaaactttttacaagaacttgcatatttctatattggatgtcaggtgctcaagtatggaagaacttgtttcgaattaatgttttaaaaccttttactaaaaaaaaaaaaaaaaggggccg

SEQ ID NO: 20757 - DNA, 1444 bp, Zea mays
ttttttttttttttttaatcgagggaagcaattcttattcattgcactgtcattcccaatttcacaaatcacaagttgaaaagctgcaggaccaggaccagggagtccatctatccattattccgacatcaacaacacactcagaatcccgaaagtgagaccctgcagcctgtaatcagaggctcgcgggcgttggagcatctccgacgacgaagtccaggaccatcacctcgtccagcagcggcctgaccaaggccttggcctcctccaccttgccgtccccttccacggcgtccagctcctccacgctgtcgaacaccgccaccatcccgaactggtaccccttggcccgcgccggggaaaagttctccccgaagctcaccttggcgtccccggcggcctgggtggccgcggccaccttctccacgagctgcgcgacctccaccccttccttcaccttcgccagcgtgaggcgcacggcgctgccgggggccacgggggacgggagcggcgcggcgttgacccagtcgacggcggtgatgtcgagcgcgttggggaggacgtgcccctgcacggcggccacgtgcgccgggtgcgccgcgtaggacgccaggtcctccttggtggcgtagcgggtgtggaggaggtgcgtggggctggtgaggtggtgccaggccattgcggcaacgcacgcacggtgttcggtggattgccaccacggatggcggcgctaccgagcagaggaggtgacggggacgggggctggacccctaagcggagccccactacagccgtcccaccgacccgggagtccgggacccaatggcgtcgtcatcgatggcatcgttgtcgcgtcgttccgtcttgcacgcctcctacacccgctcgcagttttccgcgaccgacatctgcagccacttcattcctctcgtctcgaagtatgcctcttgactccaaatcgcaggcacaggccacattcccgtccatctctctctacctttcgtcaggtcccaacttttttctgtttaacagtgagtagtgattctctctgcgtgcgcaggtacgtactttagaaccctagatgcagcgacctggatggtgtcccatcgctgccgacggcctcgtgcgcgctcctccggtcgaagtcctggccgacaacgatcttgtttctaatgttttaaaactttttacaagaacttgcatatttctatattggatgtcaggtgctcaagtatggaagaacttgtttctaattaatgttttaaaaccttttacaagaagacatgttcataacttaattgtcaccggtgtgttatgagttatgactcttggtaaacttgttgttgtattgttatttggtgacttcccttcaatccttctacaataataaacaaattaaaagcaagatgggctatggattctgtgctactggaacaatgatctt

SEQ ID NO: 20758 - DNA, 4511 bp, Zea mays
ctgctagcgcccctgcgggctgcggctgacgccctcgcacggtgacagacacgactctggactcagaaaacagataggagcctgttagggttttttatgggccaaaatgtctactacctatataaaattgtttttggcctacgactcggaccatggcctaggtggcccaggcccaatatccgcccctggcggtgactccacatctccggcatatgagagagagctgaacggactagtcaaagcagtctgcaattggcggccatatttgtgggggcgagcgttcacagtaaggactgatcacttcagtttgaagtacatattggaccagcgcttatccaccataccacaacacgcatgggtcatcaagctatttgggtatgacatagaggtggagtataggccagggaagatgaacggcgcggctgacgccttatcaagaagggatgaagaaccagcggtagcactgtccactccaactctggaagtttttgatacactccgggaagagacattgatagatccgtaagtccaggaactgaagacacaattggcggcaggaactgcaggagaagaatgggctgaaaaggatggattgttagtatgccggggcagagtcttcgttccaaataattcaagtgtgtgggatcagttactgatggttgcgcatgtggcaggtcatgtgggagtagagaatttgcatagatggaggagctcgttccacaacgcccatattaggaaacgggtacatgaatttgtttggggctgtacgattttccaaagaaataagtctaaacatcttcaccctgtcgacatgttacaaccattctctccatcggtacaggtcacggacgaactgtttctctaggagcggagaaatgttgcggatgcattcatggggaaggcttatgctaggaagaggcacgtggagggcatgatcacccttggtgccagcagcttggcgtccaccagcacaacaacaggtaagtcttagaagtgttagctgattaataacttgttgttagctaattaatagtcggttggttagctatataataggagggagttgttatctagataagggcaggataatacctcatgtttatctctgagcagataacagccgaccctgatctataaaaggaaagcagtaactaggtatcgaaggaaaacaatctctctgtggggcggttacttcgatcactctggcctacggtgatccggctccatcttcttccttgcattcttctccaccatatcttctcagatctcttccgtggtctgtgatgctcttgcactcttcgttgcgcactcctcgaaggcccaaacgtatcagatacacttattttatatgtagttttttatatatatttagccatgtcaaaagataagatacatgcttctacgtttcctaaataaacatcgttcttatttctcaaaaaatcaaaaatattaattttgatcaaataattataaaatatatcagtttagattacataattagtattataaggtagacagataagtatatatttatatttaatataaatgttattagtatttttttacaatatataccggtagcgaccgttgttttagaattgagggagtgttgcaggtgggtacactacactacgacgacgtggtagattgattgaagtcgaaggcgccatcaactacacccaatcttgaatactaccttctttgtttatatatttgtcgtcgcttagttcaattttgaactgcacagcgtcaagtcaagtaaaaaaaaagatacataagaaatattataagaactgattcagattgtcccatcattcaatattcctggacaggactagcagctgcaactggaaccattacaactgttatccgaagctaaggattccaataggcgatttactttttcatggaaccaggcacgatgtatgctacacagtcaaatgaaatgacatgttaagacttaagacatcacttataaataatcaaaagagcactgatcttttacactagtaagggagcaagtactctcttcacaagaatgtgcagtgccacacataggcacaatcctggcaagaaacatcctacctgtacccttaacccataatcaagcgaagcaattattgtccatcatcctgtcatctccagtatcacaaaaaatgacaactacaaggaacccaatattctaaagatcaacgacatgcctagaaccgagactgaaccaggaacctcctagaggctcgggcactgctggaacctctcgggcaggtggccagatgatcaagtccagcaccatatatatatatagcagacactcatatgacatggcttggttagacatctttatttgggaacgagatgacctggttaacattacttattatgctatcagctgagtgtatacttgtacagttgtactacaatttatgggtgcaggtgcagctatgaattttcagcagggtcactgtatcagtcagtgtatgatgttctgggtttctgcgaaagaattcagcgaactgcagtacgatcatcccattacccatggcgattgcgaatgcttcgaggtttacaatggttgtttaattttcacgtaaccatatatacaaatacaatcaaatgaaatggcatggcagaacatcgtttatagttggatgagtgcacttgtgctagtcaagtgaaagattgacgaatgtgccatgcgtcttgactaggctaacctaagattaaagagacggagatgtgccgaactgatccttaatcgagggaagcaattcttattcattgcactgtcattcccaatttcacaaatcacaagttgaaaagctgcaggaccaggaccagggagtccatctatccattattccgacatcaacaacacactcagaatcccgaaagtgagaccctgcagcctgtaatcagaggctcgcgggcgttggagcatctccgacgacgaagtccaggaccatcacctcgtccagcagcggcctgaccaaggccttggcctcctccaccttgccgtccccttccacggcgtccagctcctccacgctgtcgaacaccgccaccatcccgaactggtaccccttggcccgcgccggggaaaagttctccccgaagctcaccttggcgtccccggcggcctgggtggccgcggccaccttctccacgagctgcgcgacctccaccccttccttcaccttcgccagcgtgaggcgcacggcgctgccgggggccacgggggacgggagcggcgcggcgttgacccagtcgacggcggtgatgtcgagcgcgttggggaggacgtgcccctgcacggcggccacgtgcgccgggtgcgccgcgtaggacgccaggtcctccttggtggcgtagcgggtgtggaggaggtgcgtggggcccagcgcctccgcggccggggatcggaggcggagcaccggtcctgcgtggatgtaggccaggcccgggacgagcgtggccagcgcctgcagcgaggagaccatcgccgccgcggcgcccgaggccaccgcctccgggcgggccttgaagagcacgaagtgctcgatcggggcggcgaccgcggacgaggaggaggacatggcggcggcggcgcggagggaggaggtgggggtgaggcggcggaaggtcgggaggtggagaggggatgagatggctttgaggcaaatcatggttaggtcagcgtgacgacggggagggttaaagatgcagagggctttggtggtttcagtgagaaagacagtgagtgacctgagacctgagtacctgacgaagctgggagggttaaagattcagggatgcgagttgttgttctctgctctatatataaaataaaataaaacatagtgagctggactggcacggggcggtggcggcagatgtactcccacactggcttcaacggcgcacgctccggtatctgtggcggctacagtttaccgccggaacgttcatcggttcacgctaagtccgctacactgcaagcggatgacagaggacaccgccagatcaaggggtggtgcagccggccctcttcccttgatgtgcgtgcacggtggtgtttggtagtggatgaaaaattggtaatggatgataaataggtatgaaaaatgatattttatggaggtagttggatatagggagagaatttaggaggaaccgctgcagagagtgaaaacataggaggagaccggttgctgacgtggcgggatagtgggatatagggggtgaaatatagatggaaccattgaacacagtctgatagctcgtcgcctagttggtctcatagctcggagctatgtactgtggttacagtgacacagggagttcataggaggagcctgctggctggtcaatggacggcaatggccccccaacaaccgtgtgcagaatgcaaagacgtcttgcacaaaccggcgccttcccttttataagcttaaatatactcccacgattattcgatcaacgtagtcagccaccctcggttggtgaaacagaag

SEQ ID NO: 20759 - DNA, 1188 bp, Zea mays
  misc_feature (1151)..(1151): n is a, c, g, or t
ttttttttttttttttcaatggtggtttaattttcacgtaaccatatatacaaatacaatcaaatgaaatggcatggcagaacatcgtttataattggatgagtgcacttgtgctagcgagcactacaagtgaaagattgactaatctgccatacgtcttgactcgtgttaggctaaacctagattaaagagacggagatgtgccgaacagatccttaatcgagggaagcaattcttattcattgcactgtcattcccaatttcacaaatcacaagttgaaaagctgcaggaccagggagtccatctatccattattccgacatcaacaacacactcagaatcccgaaagtgagaccctgcagcctgtaatcagaggctcgcgggcgttggagcatctccgacgacgaagtccaggaccatcacctcgtccagcagcggcctgaccgaggccttggcctcctccaccttgccgtccccttccacggcgtccagctcctccacgctgtcgaacaccgccaccatcccgaactggtaccccttggcccgcgccggggaaaagttctccccgaagctcaccttggcgtccccggcggcctgggtggccgcggccaccttctccacgagctgcgcgacctccaccccttccttcaccttcgccagcgtgaggcgcacggcgctgccgggggccacgggggacgggagcggcgcggcgttgacccagtcgacggcggtgatgtcgagcgcgttggggaggacgtgcccctgcacggcggccacgtgcgccgggtgcgccgcgtaggacgccaggtcctccttggtggcgtagcgggtgtggaggaggtgcgtggggcccagcgcctccgcggccggggatcggaggcggagcaccggtcctgcgtggatgtaggccaggcccgggacgagcgtggccagcgcctgcagcgaggagaccatcgccgccgcggcgcccgaggccaccgcctccgggcgggccttgaagagcacgaagtgctcgatcggggcggcgaccgcggacgaggaggaggacatggcggcggcggcgcggagggaggaggtgggggtgaggcggcggaaggtcgggaggtggagaggggatgagatggctttgaggcaaatcatggttaggtcnagcgtgacgacggggagggttaaagatttttcgatta

SEQ ID NO: 20760 - DNA, 1318 bp, Zea mays
atagagaatgctagatgtttgacgccattcatccacactactttttttttttttgataatgaaaactgaaaaacagaaaacctacttgaagccaagtatgatagggtgacaaacggcctagtcgcactacaaaagtttacaccaccatttaaaaagtcgcagctatgatgggcgctatgtccgcaacagtttttctaagcagtttacatcactaaaagtcgcagctatgatgggcgggctcgcttggtgccgctgttgctgacgccaccgccgccggtgcaggacgggcacttgtactgcttgatgtgctcggccttggccgccgtgatcttgacgcacttgccgtggaaccacttctcgcagaggtcgcagcagatccaaaactcgtcggggccgtagctttccttgcacgcgccgcacagcgtctccccgtgctcgccctcgcttgcactgccatcttcctcctcgccttcctctgcaggggcacgcggctttggctgcttcaccttaggctccggtggtttctttttgttgttggacttcggtttgatattgctgtggttactactgcttggtggtgctggtgccttggtttcactcttcccactaacaatttcaaaagccatgggaagatcatcaatcaaactgtagaggcgcttcctgtcatttttattgaaaccgaatcgagcaccgaagtaaaatgcaacagaaagtaaccatgcatcactgtgtgcagcaaccatggacaaccactctttttcctgcattccatctcttgcaaagtttatgcctaatgctggttctgggaggtcaggtggcacctcttcagcaggcaaatttacttcccagctctcattaggaaacccatacaggcacaagttttctttttccgggtcgcattgcttgaagaaatcctccgcatcagtggtgagcgcgcggattatcccggcacgacggcccttgaagtcccggaacacctcctccaccgtccggggattgtaacctgagtccattcggagcagcggattgccggatttgggcgctgccggtgccggagaagatttgctgcggtttattctgacgtatattttcgtgtggtgtcgtcgagcggaggagggtttaagtgaggagagagaaggcaggcccccgccggcctcctggcccccattcgccgttgcagagaaaagagtgatcaagtgaccttgagcaaagcgctcaaagccatccatcacacactcatgtgctcgtacaattaactgaagatcattgttgttgcagaactccataacccgatcaggctggtaacaacgtcgtgccg

SEQ ID NO: 20761 - DNA, 1434 bp, Zea mays
ggccgcttttttttttttttttttaggaaacccaatcaggtaaattcatatccatttgttgagataaggaaatgtgagtatgtgagtggcatatgactcacacgatacactagcatatggtacaagtacaacaacttttccgcacatcgagattgtgcaaaactaatattaagattcaaacaggaaatgtcataacaaatattgcaactgctccatgaacacagcagcctactgttcctccttcatagcctcttgaaccgcctttagaactagtggcattaaatgcttgtttgttgcaataattcctctgtcacgatcaagatatctacctttgcaaaaatccaaatcgtttcctgcggcatcttttaccatgccaccagcttctgtgacaataattgatccagctgcatgatcccaaactgtttctatgtaacttttgtgcgggatgcgcagaaaaatggcaccatcaccacgtgctagggcaccatattttgcttggctatccattctaacaggaggagctcggacaccaagtttctctgcaatggagctagttaaatcacgcttggagtgtgatgcttcaaaggattcaaagaatgaggcgtcaactggattattggtggagcaaacactaatcttttgtggctcagatccttctaaggcctcaacttgcgctccacaaccaattgtagcaaaaaagagggaacctattcgatccccaaaagagctgctattgttcttgtttgttgattttaatggaagatttggacatcccaacacacccagaacaactttgccctcatcaagtagtccaagtgcaactgcatactgatctccccttatgaaacctttagtgccatctattgggtctaatatccaatgtcgcccagatggacctccctcagatttaccaccatcaattgcagaaagcacatcttccttagataacgacatgttgtatgaaccatcatttacgatggtttcattaatgagggtggtaatgtgttctataatttcttgggcaccatcttctctcaagtcttttgaatcctcttcagctatgattgagaaagagtgagaaggcaattccttcttcaggaccagacataccagtacctgtgatccataatccgcaactgtaacaggagtcttgtctgccttcgattgaatgtcagagtgcaaaatgctccgctgcactctctggcagaggcgggccgctagggcgacggccttcttggctgcagcgagctcggcggcgtacgggtttccgacgacctccgtagcctgcgacatggtggcgccgtggcgggcgtcgggcggggcgcgtgacaaaacaaatctggggaacaactattgtgacgtgcatatcatttttgctttttcgaatatggaacaactatccgcagcgactgtctctaaatttttccttctatt

SEQ ID NO: 20762 - DNA, 928 bp, Zea mays
gagggccgcttttttttttttttttttgggtccacacaataatatataacttatattatcatataaaggaacatattagcttttacttccatacaagctttaagagtttcttcaacagatccatttcatgggtgaacctgcattctggtctcaaaggaatggacctttgatttggccagtttggggctgtaatttacaaagagcaatcctaaagaaaacatataaacatgaggggtcagacatcggtataatcagtttgctactgtagttaaaaaaaatacaggctgctagttgctacaccgcaaaggttgctagaccggaacacgttttcctctgtagcggtcaaggaacgatgtcacaaatggttgttggaaaatccagccgatgataggaatcctctgcaagaacacagaaagtgttggccagaacccactgaagagtacaataaagccatatgcctctaagagcatgccaaaaaacggccacccaatgagaaccagaaaaaaaccagcaccaaatgagatagtacccttgtaattctttggcttggtgaagaactgcatagttgatttcagaccaattgtcaaacccaaacctgacaggaaaagaatattgcccattgcgatgagccccttgtcaaagaagaaaacaattcccagaaatgagaagaatattccaaagcctgtcaggccaagcccaatcttcttgaggtcattcatctcgaaggaaaccatcttgtcttgcaatgacaccgtggatactggcgggtgtcgtcgccggcgaagagaccaaagaaagcctcagcagtcagcacctggcttagggcggcggcggcggcgcacccgtcgtctgagagcgacagaggggctagactagagaagtagagagacaaacaacgcacgaggaggttatgccccgccggcgtcag

SEQ ID NO: 20763 - DNA, 873 bp, Zea mays
  misc_feature (817)..(842): n is a, c, g, or t
attcggcccgcgcaataatatataacttatattatcatataaaggaacatattagcttttacttccatacaagcttaagagtttcttcaacagatccatttcatgggtgaacctgcatcctggtctcaaaggaatggacctttgatttggccagtttggggctgtattgctgtaatttacaaagagcaatcctaaagaaaacatataaacatgagggatcagacatcggtataatcggtttctactgtagtaaaaaaatacaggctgctagttgctacaccgcaagcatatattgtgcaaaaggttgctagaccggaacacgttttcctctgtagcggtcaaggaacgatgtcacaaatggttgttggaaaatccagccgatgataggaatcctctgcaagaacacagaaagtgttggccagaacccactgaagagtacaataaagccatatgcctctaagagcatgccaaaaaacggccacccaatgagaaccagaaaaaaaccagcaccaaatgagatagtacccttgtaattctttggcttggtgaagaactgcatagttgatttcagaccaattgtcaaacccaaacctgacaggaaaagaatattgcccattgcgatgagccccttgtcaaagaagaaaacaattcccagaaatgagaagaatattccaaagcctgtcaggccaagcccaatcttcttgaggtcattcatctcgaaggaaaccatcttgtcttgcaatgacaccgtggatactggcgggtgtcgtcgccggcgaagagaccaaagaaagcctcagcagtcagcacctggctnnnnnnnnnnnnnnnnnnnnnnnnnncgtctgagagcctcgtgccgaattcctgcag

SEQ ID NO: 20764 - DNA, 2041 bp, Zea mays
cttaagacgggccaccctcttgtttttaattttggattttttagattctgttctccctttttttttttttttttttttttttttttttttttttttttttttttttttttttttttttttttgaaatcagacaccactgtaatcgcagtggttcaatctttatttggagatggaaataggatctaattatagacggtgggaatggtttgcaatggtaacgcatagtagtagttggttacgttacattttagccaaccaaacggctagtaggatctcatctcatggaacctactccactagccggacctgaatggattggaacaccgaggtggcagcacaaggttggtttagatcagaatctgataccaccaagaccgtgtctccgggtttcactgaacccttcgacctcatcaggctgatggttttgttgaagttatcctccatgctatttgacaatggtagatgaagtggaatcactccccagtagaggttcatgctctttcttgaattggcattatcagtgaacgcgaatatgggagggttgggtcggttgcgcgatagaagtgatgccatgtgaccatgctttgtgtagacaaatatggcatccacagcaaggttgtttgccatttctacagcacagctgcaaatctgctctgagatccggtcaggcaatgcaattgcaagctgatgccgtggaagaagtttctgcatgttttcctcacggctccatgattccatcctttcactggctgcacgaagtacagatagcgctttttggggatatgcacctatagctgactctgctgatagcatcacagcgtctgcatattgccgcactgcttccgaaacatcggccacctctgctcgagttggtgttgggtattcaaccattgattcgagaagctgagaagcaactatcacaggcttgttcaggtgtctacatagtttaacaattgattcttgaatggctgggatctgttcaagaggaatctgaactccaagatcccctcgtgctaccataactccatcagatgcctctatgatgtctttcaggttcttgagagattctagactctcaatctttgcaaatactttgatgtgctctaacgatcttctagagaggtaagctttcaactgctttatatcattagcatcatttacaaatgatagagcaatgcaatcaactccttcagctatcccaaattcgatgtcagcccaatcctgggtccgtgcacttacagcgcaaatcatttcctattttctcagtaacttcaaatgttgccattccaccatctattacaagctcatcaccaaccaaaatgccttcagaaaacttatcaaaattcacatgcattgtgaactgatgggcttcatcagcttttttgtttgtaaatatccactctgacccatcctcggccttgactgaggtggcgcctccgtggtccgcgacgaggagctgggaaccctcggtgtcgaccataagcgtcacgcagaatcctccctcctcgttgagcctccgcacagagcgcatggcggcacgatgccactcccggccaccgtggcagaggttgatccgcgccacgcccatcccgccgcgcgccagcgccggcagcgcctcgacgcaggcgggccccaccgtgcacaccagtttcgttttccgcatccccaagaaccctttctcccgcagctccgcctccgacaccacgtccattgtcgcctcccccaccgaggcgcggatcgggtggctggccccgtggcggtgagccgcgggggaggagacggcgactaggtagggcaacgagctggtagtcctggcggaggcagccattgggattagggtttgcggagaatgagggaagaaacggaggccgcggagggagaggagtcagaggtggtgtgccggcggacgctgcgaggtggggagccgggagggaggcttgtgcttttgtgcagttgtgttgtgcgagtagttgagctgccccgcccgcccgggcggcccctcgcaggatatacatcccggccggcctcgaggtacccaatg

SEQ ID NO: 20765 - DNA, 2808 bp, Zea mays
tgcatgcctgcagcatccagaattcatgcggccaaaaacaacacaatgtcctgaccaaacacacatagcgcatatagcatatccaagcacaatccaatacaacaaaggtgtaaccataatatgatacgaacatgatacagtgtcacagtttggtttgcaaatgacacaacatattactttcaagtaccaacaagacatacaatggttagggcttcaacaagagagcacaaacttcaaatatgttttgctctgttctttcaaccaccggtatcacccagggtagttcccaacagtggtagctcagcaaaaaagaatgagcaaccacctaggaaatgaatggaagggtatctaacataaacctatactaatgtatctctgaagagtctgtcttggttaattctccgttggtagtacacattgtgcatcaacagtataaaaaacaacataagcttcacagtttcacgcagcatgtgacttggccgctcgccgtgagcaccttgtcctcttcttggacaggcagcaagcacagccttcgagcagctcaaggtcctcatcacaggtcagaatagaagccagctctgggttctccagcaacatttttgaggtcagaaaaccagcaatagtccatgtctgataagatcgggattgcttcccaatgaacctcccagatcgagtgtcgtagtatcccggccacttgtcatctgacagtctctcctcggccacagtaatggccctccgggccaattctggtctacccatttttatgcacgccagtatgaactatgatcagcaaaaaggggaattcagcaatgatctacaagtatgaaaatcaacaagaaatttggaagtattggttttgatatttacctgccataatagggtgggccaagatccaccattatgatatgaccatgggctgcacatgcacaaagtggtcacacgtcaacaattgatgcgatggttacaaaagagaaaattaatctacaaaggaaatagacagagaaccacaaaaaaaagatatgacaaactgaaagacaaggacagaacgaaagattgattctacaagcaaggatgcttacgtattcttaggatcactgccagtaataatgcgccattcatcatcttccattgcagggtagcatatcttgaggggcatgtttgctataagatcatcccacttttcttcgataaggctaaggattccctcagcttgttttggagtagttagagacgaagctatagcccaaaggttaccaagagagaagaacctaaaatccatgtgagctggctgcagattccctataaggtaacctcctttctcaggaatccagtcaacaagccaggaagggatttgctcagggtaaatgttgaatttgttagtggcatcatgtgagtattcttctgtcttgtatctgtatatctcatttattttcttcatgtcaacccagtaatattctctgatgtgaaaggacaatgcactgagcctgttattaatggcacggatgaggtttttcgatccatcattcacgacaagcatttctcgtgagcatcgtaaagcagagtagaataaagcctgggtaacagaaagaacttgtaagtacaaatcttcagctgatatatcgaatagatctaggtttataaaataagtattttctttttgttataaactaaattagtcccacacaagagaaaaaaaaagaattggtctctaaggaagcatctctttcttattgctcaataacattccagattattattccaggatctaatgaattgaagccataagcaattaaactcaacttacttggatttcaagaggatgcccatgtattcccatcctcctgtctatcatgcatgatccatctgtaactagtaatgttgggaacatgtcaaacccatcagccaaacacaaactcagtatcaattgaattcctgtctgcacatcaactctttctagcaaagcactgtccccagtaatcttgctgtaagctctcaacaaaataatccaccacagtcctgcaaaaagacagataggtttaaagtagcagaacgaaggtgtatgacaacagtaacatcaaaacaaattcttatatgcagcgtatgttggaagaagatatgtaccagaatccacaggagctacacggccaatggctgcctcaccaaagtcagggtccaaaacctcctcaaatccttcattgttctcatcaagtggtagggttctaatcttgaagctagcaggcatcaatccttgcccagggctgtaacaatcaacagttttctcccagctctaatcataaaagaaaggagcggttagtgactacctcaagaaaagtaaaaaaacataaacaagcaaccagagaggagttaagcaaacacatttttttcactttaagagaaaatattagtggtgcctctgagtggtatagatcaagtcatggtcttagtctgttcgaaaccagctttcagaattttcagaggaaaaaacgtttcacgtccctttcatcatttttgtagaaatctatctagctcaaaagaagtacaattgcaaaagtatgtgacagaattagcatattgcttgtcagtacaattcctagaggataattatgatttagttgttgttcctctcagacttaccatcaaatcttaactgcacttactatctaattttaattgttcaattgggtcgtctgctactgcattttactggcaaaacagaacgagatcctctggtgaaatcggttgtttctttcaagtgaaacaagcttacattagattgtctccgtcagcatcatctatatctatctatat

SEQ ID NO: 20766 - DNA, 2432 bp, Zea mays
cgcctttcgttcggacgcggatcgtccggcctccgggccggaccgtccgccgactccactttggttccaaacaatatcataaacctagtttgaagccaaaagttttaacttttaagtagtagtgaaccctatctagagcttttagttaaggacttttatgacgtggggcaggctgaatatcataaacctagtttggaacttttggtgatactccttctgtaccaaaatataattcattttatactaattatacatttattaaatatgaatgtagtttacatacatatctatatttattatcatttaatgatagaaaaaagtaggctaaaaagaactatattttagaacagagggagtacattgtagtagctgcagaaagattaacaatactgttgtgttcattcaatcaagttgtctttggctatttggattctatcaagttgtctttggctatttggtggctaaggtatcaaaacaaacagcacctcagtttcaggtactggttaccgaaaacaatggctacgtcaagtttagtagggacgaatggatgattcaacaagcttgggttaaagacatctcccgctgggttttggtttacaagaactaccaagatggtctggttgaaacagtttaacaacaatagtgccagattcatcagctgctgcagcattgagaatcatcagccaaaaaaacaacacaatgtcctgaccaaacacacatagcgcatatggcaaatccaagcccgcttttttttttttttttttaatccaatacaacaaaggtgtaaccataatatgaaaagaacatgatagtgtcagagtttggtttgcacgaagtacgaacaagacatacaatggttagggctgcaacagcgctcccaaacagctcaaataatagcaggtacttttttctgtgtacatgagagcacaaacttcgaatatgtttttgctctcttctttcaaccaccggtatcacccagggtagttcccatcagtggtagctcagcaaaaaaaaccaatgagcagacaccgaggaaatgaatggatgggtatctaatataaacctatactaatgtacagctgaggagtctgtgccttagttaattctccatctgtagtatccattgtgcgtctgcagtagaaagaacaacatgagcttcacagcttcaccccagcatgtggcttggccacccggcgtgagcacctggtcctcttcttggacaggcagcaagcacagccttggagaagctcaaggtcctcatcgcaggtaagaatagaagccagctcggggttctccagcaacatttttgaggtcaggaaaccagcaatagtccatgtctgataagatcgggattgcttccctacgaacctcccagaccgggtgtcatagtattctggccacttgtcatctgagagtctctcctcggccacagcaatggctctccgggccaattctggtctgcccatttttatgcaggccaatgtgaactatgtgaacagcaacaaggaagtcaggaatgatctacaagcacgaaaatggacaagaaatttcaaatcattggtgttgatatttacctgccacaataaggttggccaagatccaccattatgatatgaccatgggctgcacatgcacaaagtggacacatgtcaactattgatgtaatgtttacaaaagcgaagtttaaccttaaaaaaagaaatagatagaaaaccacagaagggagatatgaaaaaccgaaagatatgaaataacaaaacgaaagattgactcttcaagcaaggatgcttacgtatttttaggatcactgccagtaataatgcgccattcatcatcttccattgcagggaagcatatcctcaggggcatgtttgctacaagatcatcccatttttcttcaataaggctaagattcccctcagcttgttttggagtagttagagacgaagctatggcccaaaggttgccaagagagaagaacctataatccatgtgagctggctgcagattccctataaggtaacctcctttctcaggaatccagtcaacaagccaggaagggatttgctcagggtaaatgttgaatttgttagtggcatcatgtgagtattcttctgtcttgtatctgtatatctcatttatcttcttcatgtcaacccagtaatattctctgatgtgaaaggacaatgcactgagcctgttattaatggcacggatgaggtttttcgatccatcattcacgacaagcatttctcgtgagcatcgtaaagcagagtagaataaagcttggatttcaagaggatgcccatgtattcccatcctcctgtctatcatgcatgatccatctgtaactagtaatgttgggaacatgtcaaacccatcagccaaacacaaactcagtatcaattgaattcctgcggacgcgtgggaga

SEQ ID NO: 20767 - DNA, 1149 bp, Zea mays
  misc_feature (63)..(63): n is a, c, g, or t
cttgggcaaacacacatagcgcatatgcaaatccaagcataatccaattcaacaagggtgtanccataatatgaaaggacatgatagtgtcagagtttggtttgcgaataacacgaagtacgctcttgtcttcgtttggtcagggctggcatcagcgctcccattccgctcaaataatagcaggtacttttttctgtgtacatgagagcacaaacttcgaatatgtttttgctctcttctttcaaccaccggtatcacccagggtagttcccatcagtggtagctcagcaaaaaaaccaatgagcagacaccgaggaaatgaatggatgggtatctaatataaacctatactaatgtacagctgaggattctgtcttagttaattctccatctgtggtatccattgtgcgtctgcagtagaaagaacaacatgagcttcacagcttcaccccagcatgtggcttggccacccggcgtgagcacctggtcctcttcttggacaggcagcaagcacagccttggagaagctcaaggtcctcatcgcaggtaagaatagaagccagctcggggttctccagcaacatttttgaggtcaggaaaccagcaatagtccatgtctgataagatcgggattgcttccctacgaacctcccagaccgggtgtcatagtattctggccacttgtcatctgagagtctctcctcggccacagcaatggctctccgggccaattctggtctgcccatttttatgcaggccaatgtgaactgccacaataaggttggccaagatccaccattatgatatgaccatggggtattcttaggatcactgccagtaataatgcgccattcatcatcttccattgcagggaagcatatcttgaggggcatgtttgctccaagatcatcccatttttcttccccaccgcctaagaattccctcagcttgttttggagaagatacccccgaagctatggcccaaaggttgccaagagagaagaacctaaaatccatgtgagctggctgcagattccctataaggtaccctcctttctcaggaatccagtcaccaagccaggaagggatttgctcaccgtcaatgttgaatttgttagtggcgtcatgggagtattcttcctcgggccg

SEQ ID NO: 20768 - DNA, 1076 bp, Zea mays
ggttaggggcttcaccaagagagcacaaacttcaaatatgttttgctctgttctttcaaccaccggtatcaccaggggtagttcccaacagtggtagctcagcaaaaaagaatgagcaaccacctaggaaatgaatggaagggtatctaacataaacctatactaatgtatctctgaagagtctgtcttggttaattctccgttggtagtacacattgtgcatcaacagtataaaaaacaacataagcttcacagtttcacgcagcatgtgacttggccgctcgccgtgagcaccttgtcctcttcttggacaggcagcaagcacagccttcgagcagctcaaggtcctcatcacaggtcagaatagaagccagctctgggttctccagcaacatttttgaggtcagaaaaccagcaatagtccatgtctgataagatcgggattgcttcccaatgaacctcccagatcgagtgtcgtagtattccggccacttgtcatctgacagtctctcctcggccacagtaatggccctccgggccaattctggtctacccatttttatgcacgccagtgtgaactgccacaataaggttggccaagatccaccattatgatatgaccatggggtattcttaggatcactgccagtaataatgcgccattcatcatcttccattgcagggaagcatatcttcaggggcatgtttgctacaagatcatcccatttttcttcaataaggctaagaattccctcagcttgttttggagtagttagagacgaagctatggcccaaaggttgccaagagagaagaacctaaaatccatgtgagctggctgcagattccctataaggtaacctcctttctcaggaatccagtcaacaagccaggaagggatttgctcagggtaaatgttgaatttgttagtggcgtcatgggagtattcttctgtcttgtatctgtatatctcatttatcttcttcaggtcaaccctggaggcttctctcgtcccacgggacaacgcactgagcctgttgttaatggcacggatgagatttttcgatccattgttcac

SEQ ID NO: 20769 - DNA, 2600 bp, Zea mays
taagctcttttttttttttttttggttttttttttttttttttttttttttttttttttttttggttgataaactttcaggtcttgagagaaataacaaagaacatctgtcaaatatccttaatgcacaacaatctttttggcaagaaatactgaaataggaactcattaccatgaatccagagtgataaagaaaacaatactcacccctgatcaagcagacagttttacacataaagaaaacagtacacacaccaatctaccacataacacggcagttttacaccttgcgtatcagtagaaagagtatctgatcaagcttgaagcgagcagcagtggaagggtcatccctaagcagctacaggagcccgcagaatgatgcataaatctcccttgaatgccgtactgttcaacatgtttgaaggaagtcagatcaactaagcttgaatatttgggtattcatataaccaatccttacagcatacaaagcattcaagtgtttctggtgtcattgtgcttcgattatcatcaagaatacgaccaccagcgctgaacgcaaactccgaaggaacagtgctcaaaggtattgctaaaatatcacgcgccatagctgaaagcaccgggtatttgtttgcatttgtcctccaccaatttagaatttcaaatctttcatctattctcacaagttcttcctctaagtatgtgtcaagctcagactttggaaaacgtcttcctcttatttgggaccattgagaaaattcttcatccaaccttctttttccaagaactgttgagcctaaattactagtccttatatcaataaaaggtgaacttttattatctatttgaacaagtgttgcatatttttcaaataatttggtgagacattgtttaaccaagaccacgtttatctggatgtcaacaaaatattgagacatcttctcataaaagaagtccaaaaaatccatcttctttgatggatcaagtatggtggctaagacaagtgtcatgttatacttgcccttctcccagtatttatcgaacttagcatccatcgcccgtgccgaatccttaagcacacaattgatttgccaatttgtatttctcagagttcgatggatacatagcacattatgtaaaaacaaatgagatgttggacttctatgtgtcgagaatgcttttgtagctttctcaaatgcctcaagaaactctccaattgcctcagaatttgtccactcttcatcatttggtgaaggctcaagttgttcttcagcatatcttttcaagacaaccttgtactcaatggcctccataatcatgtcgtgtgtcgaattccaacggtttggaacgtcaagaattaatctatcctttgaaggcaatccagacctctcagcaatcccattaaaagcttgtatgcgggagggtgaggaattgatatgtctgaccagctcacgaatcttatagattgctccatgagcaattgccattccatcttgaactaagagaatcaatatgtgtgcacaacattggacaatacgaagatcgcctccaaatagcccactttctcgaaggtcacgcactgacagattgttagaaacattatctaatgtgatagtaaacatcttctcttttatcccccactctttgagacactctgtaattccttctttgattgctaggcctgtatgtggatatttcaaatatttgaacgcaataatcttttttttcaagataaagtctgcattaatgtagtgggctgtcaagcaaagataacccaacttctgatttgaggtccaaagattagttgtcaagcaaatccgagagttaagactttgtagctcatttcttagctcttgcctcatcatcttgaatctggtaatacaatcattttgcattgtttgacgcccaacaccgctgaatgatggctgcattgactccatccactgagcaaagaaaggatcgtcaaacttgttgaatgcgacctcggcactgatgcaccacttaaccatacactcacgagccttttgagagtcaaacacaaatgaagcttccgctggtcctttttccattgtagcaatgaattgcttgcggtcctcaactgaaattttaggacatgtatccgcaacgtggtttctaaggctatttgtgcttgaactcctcaacatcgccccgcaatatttgcaaatagccttcatcacgccattgacctcaactaactccggttgaaaatactccaaaagctttgcccttctaggcagcgtttgcaccgattggtcatccgaggtggcattagtacctgaaccctcggatacctctaaatccatcttgaccacggagactggaaatgggaccgtcttcgcttcgagccgtctactaggtcgtgctggcgtgcgggaggagcggcgacggactaccagacggagggcgggggcggagcgggaggagatgggggagcgccgaggggcggccggcgagcgcatgggcggcgagcggggacggactgcgggcggacgggggcagcgccgagcgcactagcgcacgggagtacaggactagtgctggaatatgggcaagcttttcgcaaaggctaagacgatggtt

SEQ ID NO: 20770 - DNA, 1864 bp, Zea mays
gtacttagctaaatggcccgggatccattttccttacggcctcaacagtcaataccacagatggaaaaggtcaatattcgaaccagatccggcttagaatagttccttccaaaaaattgggtgaaacatgacatactagactcataacttatataacggtttcaaacaaaattttgaacagcccacattttacattgaccttttcacaataatgttcaaggagtcatcaaagagatcacatctacagtacgactggtatttcctaatgattggttgtgggcttattaagtctccatgtagttcaagagttgtcttgtgacggcagtgaactctgaacatattcgattgccttctgttgcacaagctgaattctttcgttgtctttacccagtgacttctcgaaattaagatacttcttgaacaagaactgcatcttttttggaggtagggtcagacaagtcaccctctcaaacaatgcccgtataacttctacgtcaccaaggcggatttcttggtctagataaacactccaaaggtctgttctttttgggtactcccgcaatattagttcaaatctggatcttccttcttcaggcaccccacatttgaattctagaatagcagtttgtgagaggaattttatgcgctttctgtgtggcaaacttagaagtgcacggtttacaatggctttgatgtactcaacatccttgccttgcttgagagcaaactgaatgcggcataaccatatcttgcaggaagttttgaaccttttggtcattctgtctagaagttcatctgcaagctcatactgttcggtcctctcgtacatcgcaagaagagccaagtgcagctttttgggatcacaatattgcaaggctctttggaatacctttttcacagcatcctcccttggactaccgtattcattttccagattgaaatatgctacccaaacatttagtttctcttcttcttctctggggattattgtttttaaagccctctcagctactgcacgtgctttctcaacatctgcaagatctaacaaagttgccatatactttatccagataaaactactatttggggagctcctaactaacttctcaaaatcatctggagtttgtggtatatcttcctgcaaagccctttcctccatagcactgatttctagttccctttgttttcttgcttccttctttaactgtttatcatctttttagctttgttcagttccattagcaatttcaagacatgtattactaatattatcctctaggtcagaacccggctctccgttgccatccccctgctcagctgctgcatcctccttgtggtgccttttgaactgcttacggtcggggacgcaggtcggtcttgccgccggcgccctttcccttcttcctggtgacgtgaggcggcgccatagcagccaatgctctaacctcctcggaagcgcgtcgtactgtgcggtgaccggaggcgcggacggtgaatggactgctgtcagctgtgcgaactgcggaagccgaaggcgcggacggcgaacgtgcgaagctcggcctggcgggggcgcagagccgcgaacgcgcggggcggagctgggcagggcggccgcgggggcatggggcgaggaggagctcgggccctcggcgcggcagtgccggcagggagacggtgggccggagctggagcttcgtcctgggcggtagggcgcagtggcggaagacggcgccgcgccggcgagtcggcgcctcggcggccgcggacaggggcgacggggcatcgctctcgggaggacgaggatattgctcaacgcaaggggctggcggcggcgcaggcagtcgtagtcggagaaatctgt

SEQ ID NO: 20771 - DNA, 1132 bp, Zea mays
gcctcaacagtcaataccacagatagaaaaggtcaatattcgaaccagatccagcttagaatagttccttccaaaaaattgggtgaaacatgacatactagactcataacttatataacggtttcaaacaaaattttgaacagcccacattttacattgaccttttcacaataatgttcaaggagtcatcaaagagatcacatctacagtagtacagtactactggtatttcctaatgattgtttgtgggcttattaagtctccatgtagttcaagagttgtcttgtgacggcagtgaactctgaacatattcgattgccttctgttgcacaagctgaattctttcgttgtctttacccagtgacttctcgaaattaagatatttcttgaacaagaactgcatcttttttggaggtagggtcaggcaagtcaccctctcaaacaatgcccgtataacttctacgtcaccaaggcggatttcttggtctagataaacactccaaaggtctgttctttttgggtactcccgcaatattatttcaaatctggatcttccttcttcaggcaccccacatttgaattctagaatagcagtttgtgagaggaattttatgcgctttctgtgtggcaaacttagaagtgcacggtttacaatggctttgatgtactcaacatccttgccttgcttgagagcaaactgaatgcggcataaccatatcttgcaggaagttttgaaccttttggtcattctgtctagaagttcatctgcaagctcatactgttcggtcctctcgtacatcgcgtcgacgcggccgcgaattcggatcacaatattgcaaggctctttggaatacctttttcacagcatcctctcagctactgcacgtgctttcttaacatctgcaagatctaacaaagttgccatatactttatccagataaaactactatttggggagctcctaaccaacttctcaaaatcatctggagtttgtggtatatcttcctgcaaagccctttcctccatagcactgatttctagttccctttgttttcttgcttccttctttaactgtttatcactctttttagcatttgcttcagttccattagcaatttcaagacatgtatt

SEQ ID NO: 20772 - DNA, 3068 bp, Zea mays
  misc_feature (2520)..(2557): n is a, c, g, or t
  misc_feature (2688)..(2725): n is a, c, g, or t
  misc_feature (2934)..(2937): n is a, c, g, or t
  misc_feature (2987)..(3050): n is a, c, g, or t
tattcggcacgaggcccaccccggtcggtctcaagctctcagcccacacgccgccatcaggcacgtatgcgacctgacctcgtgttacatgctactacggccgtgtatataacttcgctccgtctaccgcggccccggccatcctctctaacccacggaagcaaggcaaaagctcgtgctggacgacatctcccctgtcgatccacgaccatgatgcagcagctccgtcacagccagccgagcccgtgcctctgcggcctgcgggcggcacggcctatgctcgcgctcggcgcagcagcatcccgttcgcggcccgccggaaaactgcaaccgagcgcctgcctcggcctcggccatgtagccccagccgcggcgagaggacagccccgtccccgtgccgttgccgactcggcgctgggagcatcgcctacgagcgtgcatgtcggaggcaagctgctgctgcagaacttcgccgccgacagccagcagcggctcaagctctccatccagcttgtcagcgccaccgtggccgatcccgacgggcgcggggtgaaggcggaggcgtcggtgctggacgccgtcgtgggcagcggggacagcgagctcgacgtggacctgatctgggacgaggcgctgggcgcgcccggcgcggtggtggtgaagaaccactccgacttccccgtgtacctgaggctgctgagcgtgccggccggccgtcggcggcgccgacgacgaggccgccgccgtccacttcgcctgcaacggatgggtgtaccccgtcgacaagcacccgtaccgcctcttcttcaccaacgacgcgtgtgtcaaggaagaaacgccgagcgccctgctcaagtaccgggaggacgagctcggcgcgctccggggagacggcgagacgacggagcggccgttccagccgtggggaccgcgtgtacgactacgcgctgtacaacgacctggggaacccagacctgcgccaggacctggcgcgccccgggccggcgcgctcccggcgggtcccgtaccctcggcgtaccaagaccggccgaccagccgccaaaacagatcctcggtcggagagcagagcgccgctggacgaagagatctacgtcccctgcgacgagcgcgtcggcttcgccagcatccccgcgccgacgcttccgccgctgggcgggcacttcaggtccctcgccgatgtctaccgcctcttcggcctcgacgacctcggccggctcccggaggccaaggcggtcatcaacagcggcgcgccgttccccgtcgtgcctcaggtcatttcagtgaacccgacacattggcggaaggacgaagagttcgcgcggcagatgatcgccggggcgaacccggtgtgcatcaagcgcgtcaccaagttcccgctggcgagcgagcttgaccgcggggtgttcggcgaccaggacagcaagataaccaaggaccatgtcgagaagaacatgggcggcatgacggtgcagcaggccgtagaggaggggaggctgtacgtcgtggaccaccacgactgggtgatgccatacctgaagcgcatcaacgagctccctgcgagcgaggagaaggcggaggtgtcgcagaggaaggtgtacgccgccagaacgctcctgttcctggacggcgaggactcgtcgatgctcagaccgctggcgatcgagctcagctcgccgcacccggagaaggagcagctcggcgcggtcagcacggtgtacactccaccggacagcggggacgacggcatcacggccgggaggttctcaacctgggaactggcaaaggtttacgcctctgccaacgacgcagccgagaacaacttcgtcactcactggctcaacacgcacgcatccatggagccgatcgtgatcgcggcgaaccggcagctgagcgtgctgcacccaatccacaggctcctcaagccgcacttccggaagacgctccacatcaacgccgtcgcacgccagatcatcgtcggctcgggtgaccagaggaaggacggcagcgtcttccgtggcatagacgaggtcacgtacttccccagcaagtacaacatggagatgtcctccaaggcgtacaaagcctggaacttcacggaccttgctcttcccaacgatctcatcaagagaggtctggcgaaaggagatccaaagaagccagagacgctggagctggcgataaaggactacccgtacgcggtggacgggctcgacatgtgggcggcgatcaagaagtgggtggctgactactgcgccatctactacgccgacgacggcgcggtggcgagggacagcgagctgcaggggtggtggagcgaggtcaggaacgtggggcacggcgacctggcggacgcgccgtggtggccggcgatggactgcgtcgccgacctcgtggagacctgcgccaccgtcgtctggctgagctcggcgtaccacgcgtccatcagcttcgggcagtacgactacctgggcttcgtcccgaacgggccctccatcaccnnnnnnnnnnnnnnnnnnnnnnnnnnnnnnnnnnnnnncacggagtcggacttcctggcgagcgtcacgccggtcaccgaggcgctcggcttcatgtccatcgcctcggggccgatggggctcaagggcacggaggtgtacctggggcagcgcccggacacggagcagnnnnnnnnnnnnnnnnnnnnnnnnnnnnnnnnnnnnnngttccgggcgaggttggaggaggtcgcgggcaacatcgacaggcggaacgcggaccctgcgctgaagaaccggacggggcaggtggaggtgccctatacgctgctcaagccgacggcacagcccggactggtgctccgtggcatacccaacagcatcaccgtttgagcagcagagcgccgtcggcagctgtcagcagtgtacagtaatnnnncagaataataaggtggtcgtgtacggcgctatctccacctcctaaacgtnnnnnnnnnnnnnnnnnnnnnnnnnnnnnnnnnnnnnnnnnnnnnnnnnnnnnnnnnnnnnnnnaaacaagtcaaacctctt

SEQ ID NO: 20773 - DNA, 3725 bp, Zea mays
  misc_feature (152)..(153): n is a, c, g, or t
aacccacggccgcgcggccaaagctcgtgctggacgacatctcccctgtcgatccacgaccatgatgcagcagctccgtcacagccagccgagcccgtgcctctgcggcctgcgggcggcacggcctatgctcgccctcggcgcagcagcanntcccgttcgcggcccccgccggaaaactgcaaccgagcgtctgcctcggcctcggccatgtagccccagccgcggcgagaggacagccccgtccccgtgccgttgccgactcggcgctgggagcatcgcctacgagcgtgcatgtcggaggcaagctgctgctgcagaacttcgccgccgacagccagcagcggctcaagctctccatccagcttgtcagcgccaccgtggccgatcccgacgggcgcggggtgaaggcggaggcgtcggtgctggacgccgtcgtgggcagcggggacagcgagctcgacgtggacctgatctgggacgaggcgctgggcgcgcccggcgcggtggtggtgaagaaccactccgacttccccgtgtacctgaggctgctgagcgtgccggccggcgtcggcggcgccgacgacgaggccgccgccgtccacttcgcctgcaacggatgggtgtaccccgtcgacaagcacccgtaccgcctcttcttcaccaacgacgtgcgtgcgtgcgcagctagctaaccactgcacgctgaccgacgaccctagcacaccacaaggctcgaaacttgcatcacgtccgtacgctgttcccctcccctgcaggcgtgtgtcaaggaagaaacgccgagcgccctgctcaagtaccgggaggacgagctcggcgcgctccggggagacggcgagacgacggagcgaccgttccagccgtgggaccgcgtgtacgactacgcgctgtacaacgacctggggaacccagacctgcgccaggacctggcgcgccccgtgctgggaggatcccaggagtacccgtaccctcggcgtaccaagaccggccgaccagccgccaaaacaggcccgtgcccgttcacgatctccgtttcccaaaaacgttccgttccagcgagccgccacagcaggggaggatctcgctcgctcgctcgctagctctctcacttgctgcctcgtcgtgcgtcatcagatcctcggtcggagagcagagcgccgctggacgaagagatctacgtcccctgcgacgagcgcgtcggcttcgccagcatccccgcgccgacgcttccgccgctgggcgggcacttcaggtccctcgccgatgtctaccgcctcttcggcctcgacgacctcggccggctcccggaggccaaggcggtcatcaacagcggcgcgccgttccccgtcgtgcctcaggtcatttcaggtgcgacagcaataatgcatggtgtgatgtgctcaagggaaaggaaagggaaaaaaaaagaactgtatgtctctatctttctgtctgtctggggcagtgaacccgacacattggcggaaggacgaagagttcgcgcggcagatgatcgccggggcgaacccggtgtgcatcaagcgcgtcaccaagttcccgctggcgagcgagcttgaccgcggggtgttcggcgaccaggacagcaagataaccaaggaccatgtcgagaagaacatgggcggcatgacggtgcagcaggtgtgccgtacgacgggcactttttttaagcttctagtccctaggcgatctttcaggcaaaatgacgcttgttgggaaatatgcagttctttctcttttttctgtctgaactcgactcgaccatggatcgatgcacgcaggccgtagaggaggggaggctgtacgtcgtggaccaccacgactgggtgatgccatacctgaagcgcatcaacgagctccctgcgagcgaggagaaggcggaggtgtcgcagaggaaggtgtacgccgccagaacgctcctgttcctggacggcgaggactcgtcgatgctcagaccgctggcgatcgagctcagctcgccgcacccggagaaggagcagctcggcgcggtcagcacggtgtacactccaccggacagcggggacgacggcatcacggccgggaggttctcaacctgggaactggcaaaggtttacgcctctgccaacgacgcagccgagaacaacttcgtcactcactggtatgtacgtacactcgttcgtacgtagagacaagacgaggtcaatgtgtgtctctgtgtgtgtaggctcaacacgcacgcatccatggagccgatcgtgatcgcggcgaaccggcagctgagcgtgctgcacccaatccacaggctcctcaagccgcacttccggaagacgctccacatcaacgccgtcgcacgccagatcatcgtcggctcgggtgaccagaggaaggacggcagcgtcttccgtggcatagacgaggtcacgtacttccccagcaagtacaacatggagatgtcctccaaggcgtacaaagcctggaacttcacggaccttgctcttcccaacgatctcatcaagaggtaataccagtactagatacgaaacgaaatgacatgtattcgttcacataccatagcaacagcatgctatacatgacgaacagaggtctggcaaaaggagatccaaagaagccagagacggtggagctggcgataaaggactacccgtacgcggtggacgggctcgacatgtgggcggcgatcaagaagtgggtggctgactactgcgccatctactacgccgacgacggcgcggtggcgagggacagcgagctgcaggggtggtggagcgaggtcaggaacgtggggcacggcgacctggcggacgcgccgtggtggccggcgatggactgcgtcgccgacctcgtggagacctgcgccaccgtcgtctggctgagctcggcgtaccacgcgtccatcagcttcgggcagtacgactacctgggcttcgtcccgaacgggccctccatcaccacgcggccggtgccgggcccggacgccggggcggaggtcacggagtcggacttcctggcgagcgtcacgccggtcaccgaggcgctcggcttcatgtccatcgcctcggggccgatggggctcaagggcacggaggtgtacctggggcagcgcccggacacggagcagtggacgcgcgagcggagggcggccgaggcgctggcggagttccgggcgaggttggaggaggtcgcgggcaacatcgacaggcggaacgcggaccctgcgctgaagaaccggacggggcaggtggaggtgccctatacgctgctcaagccgacggcacagcccggactggtgctccgtggcatacccaacagcatcaccgtttgagcagcagagcgccgtcggcagctgtcagctgtgtacagtacagaataataaggtggtcgtgtttggcgctatctccaccacataaacgtgaaaatgtttttttttgaattatatggacatgcagggccgcagcccgtaagcctggccccagtttcggttttctgttttttttttttttgcctcgatctggtgatcagcaagccacgtcggtccgggtgatctcgctaccggagatagaatgtgtacacgaaacctaataggtttttactccattaggatacgaggttgagtcaattttcatacctatagatttgttaatgagcataaatttatacccgaaaaaaaaaaaaaaaaactcgag

SEQ ID NO: 20774 - DNA, 1297 bp, Zea mays
gagatcatggaattttttttttttttttggccacatgtaagttgtaggctatatattgacacgatgcaaatagattggttacactttccttccgttggtccaactgtccatggcaattgaacaaacactgaagtatatggtcagtatatgtgcgcatgatctatttttttggagggcacatgacacctgagcctttcgatttctacactatattgtctctgatccatttggtggcgacccatttctcgcctttgatgacggggcagctaccatgaagtgaagtccggtcaatggtcccatttaccataagggagtaaaacaagagtccgtcacccttccttggttttacctttaggccaatgcacttctcatagtcatagcctatatccatattctcactgttctcgtatgggaacatagtttctcccccttcttcgacatccgtgagataaagcaagaaagatgccaccctttgatttttttgtggaccatactgagctgggtcaaatgcgtcataatgtgaagcatacctttgtccaatattataccgcaggacattaaatggctccccatgatttctgggtaacatggtagcccttgcaatcttcttctcgatttccgcaagggtttcagttgggtcttcattagcactaaggaatgttcccgaacttgtcctgattccttttgtactctctgcggtttctcctttcctcagggctaatgttgatggcttaagtctctcctttgccgtttttactatattttcacactgttctgatgtcgcaaattgtggaaagtacaaagcacgaggctgccagctcaaaatctggtatgggatcaaggacggcgcagcctcgccggactcgccgtaaggcatctccggccacgccgcctccaacagccgctctctcggcaccggcatatccgcctcctccggatcctgggtgaagaggagcgagccgaagaagccggcgaggaagaagagggagcaggagaggagcaccacgggaagccgcagtcgcgttcgcaacagacccgcaccgccggcacctccgccggcggccctgatgacgccacctcccttcattccacgagctaggagacgaggacgatccggcgtcgcgtcacggcctcacgggagaggcgggtcttctctgaatctctgaatggagcgagttcttttgttattagtcaggtgtccgagcactgacgaatgggaccgaatactcgatagacgggcccggtgcgcgacgtcacgtgtctgtaaagaacacccagtcagttacggtgggcccag

SEQ ID NO: 20775 - DNA, 2853 bp, Zea mays
ctattagtagtagtgccgctgcccgctggtgctgggagctcatcatcattcgtcggtagcaggaaggaggcggcgtggaaggggaggcagatgcgggaggcccaccgcagggtcgtcgcaccagatggacacgccggataggccccgcgccgccgccgccgccgggttcgaggattctcctgtcttcaatttcatcaacaatctctcgcctataccaccacctaaacctttagactcagcacataatgtgcagctattcaagtcatcagacttggcacctgtttcttcgatctttgcctcaccacatgttaatccagtgaaggaaactaaagttttgatcagggatgaatctgttcaccttcctcaagaattgcactcgcctagcagtgtcaggactcgaatagacacctcaggctcttttagaatgatcagatgcaaagacattgtgtcggacaattgcaatatcacttgtcaactaaacgaggcatctattgattcttctgatcatacatcaaactctacaggccaattgactcaatccatacaggatgctgctggcagtatggaaagcgataaggatcaatgcgatgccaataaaacagaccttaccatatcccaggagtgcacaggcctagaaggtatgaaccttgatgagagtggcccagacaaaatggattcgtcacattctgggattgttgttcatgaaaaccagctatctgaacaaaacaatgacgaacctgcagcatataatgagggttacattattacacaccaatcaactagtgatatgctcactttagccataccatctggaacagaaacacaaccagtgaatgatacacaaatggctgataacccctactcttgtgaatccttgttggatgatcagtcaagtggatattgcacccagaattctgtgcatgaaccccatttgtactggactggggcagttgaagggtctgcagtatcctatactccccaaacactccctggtgctttgcaaagtcagctgatgccatgtaacaagctcagtgaaccaaaagattacgtgcctactgagcaaaatgccttgtcacagcacttacgtggcatgcgtaggcgcagccttttcaatgaaaaggctggaattagtaataaaggtgtagacaaaacttcggatcatcatcctgtaaattcaactacccccaaatgcaaaactatttctggtgacaactcaaagcctctaagaacccctccatgcgcattacctggtattggcttgcacttgaatgcccttgctacaatacctaaagagaaaatagtccctcgagagattcagtctactataaatgaatcaagtaacttgataggccctgctggatcttctccagcaccttttgagcaaaacattataaatgatgatttcactcaaacaactgatgttgcaactgccgaagcttctagtcagggtagtcccaagaagaaaaggcataagtttgacaatggtgatggcacttcatgcaagcgttgtagttgtaagaagtcaaaatgcctgaaactttactgtgagtgttttgctgctggagtctattgttctgagccttgttcgtgtatcggctgtcagaacaaccagagtcatatggaaacagttctgtctacacggcaacagattgaatctcgcaatccattagcatttgctcctaaagtcattcatacatctgagcctggtatggacttaggggacttttccaataaaactcctgcttcagctcgtcacaaaaggggatgcaattgcaagaagtcgtcgtgtctaaaaaaatactgtgaatgttttcagggcggcgtgggatgctccgtaagttgcagatgcgagggctgtaagaatgcttttggaaaacgggagggggcttctgtgttaggcataggggaacctaaacagggattggaagaaaagtatgtttgtgtgaaagaagaaaaaagtgaaatcgataaacagcttgttgtctaccagactactgacgctgctcctgctgaaaatgtactgaccacaccttccatggtggagtgcagacccttggcttgtcttccacccgcaagctccaagaaaagctccaaaaaaccacggtcttcaacaaagctcacaggacatccttctcggccgtgcaacttacaagctcctccaaagaccgacgttgtgctctccccattcgaaaactacgcggaaatggtcctcggtgatagcacatcagatatcctgaagggaaattcatctcctcatacttctgttaaagttgtgtcaccgaataagaagcgaatctctcccccacggatgggtatcgggctatctccaatctgtaggagtggcaggaagctgattctcaagtccatcccttctttcccttcccttggtggtgatgtaaacaacgaggatccgaaggccaagctcccagcgccttgaatttatcatgttttgtgtcactcgtggcccttcccgttggttctcgaaatcgcccacgcgctgactgcaccagactgtttctaccaccataccatcagatagtggatggacaaccaagcgtgcaccgtttcatcatttgtgtaattgtgtttgcttcgattaataattattcacgtactgctataataacccactgtgatggcagaattctacctacctcccagaaccaccagtggcatttggtttgctggtaagttatgtctcggctcaaggacgttgctgtgttgcctgtgcctgtatgtctgtataatttatgttcattatccgggatcaagatgtggaacctctatgtacctgatggcagaactgttaagacatattttattttatttttatctgaggttaaactgtgaact

SEQ ID NO: 20776 - DNA, 2946 bp, Zea mays
gcacgagaccattacctagaacatcctaatcgaaccattaggacaagcattagtgttcgctcgtcactcgtcagtactcagtggaggaggcggcggcggggagggagacagatgcgggaggcccaccgcggggtcgccggaccagatggacacgccggataggccccgcgccggcgccggcgccgggttcgaggattctcctgtgttcaatttcatcaacaatctctcgcctataccaccacctaaacctttagactcagcacataatgtgcagctattcaagtcatcagatttggcacctgtttcttcgatctttgcctcaccacatgttaatccaacaaagggaactaaagttctgatcagggacgaatctgttcagcttcctcatgaattgcactcacctagcagtgtcagaactcggataggcacctcaggctcttttagaatgatcagatgcaaagacattgtgccagagaattgtaatatcacttgtcaactaaacgaggcatctattgattcttcagatcatacatcaagctctacaggccaattgactcaatccataaaagatgctgctggcagtatggaaagcgataaggatcaatgcgctggtggtaaaatagaccttaccatgtcccaggagtgcacaggcctagaaggtatgaaccttgatgagagtagcccagacagaatggattcatcacattctgggatagttgttcatgaaaaccagctatctgaacaaaacaatgatgaacctgcggcatataatggggtttacatgattacacaccaatcaagtagtgatatgctgactttagccgtaccatctggaacagaagcacaaccaatgaatgatacacaaaaggctgataatccctacccttgtgaatccttgttggatgttcagtcaagtggaaattgcacccaaaattctgtgcatgaaccccatctgtactggaacggggcagttgaaggggctgcagtagcttatactccccaagcacttcctggtgctttgcaaagtcagttgatgccatgtaacaagctcaatgagccaaaagattacatgcctactgagcaaaatgctttgtcacagcatttacgtggcatgcgtaggcgcagccttttcaatgaaaaggctgggcttagtaataaaggtgtagacaaagcttcagatcatcatcctgtaaattcaactacccccaaatgcaaaaccatttctggtgacaactcaaagactctaagaacccccccatgtgcattgcctggtattggcttgcacttgaatgcccttgccgcaactgcaacacctaaagagaaaatagtccctcaagacattcagtctactataaatgaatcaagtaacttgataggccctgctggatcttctccggcaccttctgagcaaaacattataaatgatgatttcactcaaacaactgatgttgcaaccgctgaagcttctagtcagggtagtcccaagaagaaaaggcataagtttgatagtggtgatggcacttcatgcaagcgttgtagttgtaagaagtccaaatgcctgaaactttactgtgagtgttttgctgctggagtctattgttctgagccttgttcgtgtatcggctgtatgaacaaccagagtcatacggaaactgttctatctacgcggcaacagattgaatctcgcaatccattagcatttgctcctaaagtaattcatacatctgagcctggtctggaactaagggacttctccaataaaactcctgcttcagctcgtcacaaaaggggatgcaattgcaagaagtcgtcatgtctaaaaaaatactgtgaatgttttcagggtggtgtgggatgctccataagttgcagatgcgagggctgtaagaatgcttttggaaaacgggagggggctgccgtgttaagcatagaggaacctaagcagggattggaagaaaaggatgtttgtgtgaaagaagagaaaagtgaaatcgagaaacagcttgttgtctaccaaactcctgatgatgctcctgctgaaaatgtactgaccacaccttccatggtgcagtgcagacccttggcttgtcgtccacccccaagctccaagaaaagctccaaaaaaccacgatcttcaacaaaactcactggacatccttcgcggttgtgcaacttacaagctcctccgaagaccgacactatgctctccccattcgaaaactacgcggaaatggtccttggtgatagcacatcggatatcctcaagggaaattcatctcctcaaacttctgttaaagtggtgtcaccaaacaagaagcgaatctctcccctgcgaatgggtaccgggctatctccaatctgtaggagtggcaggaagctgattttaaagtccattccttctttcccttcccttggcggtgatgtaaacaatgaggatccagaaaccaagttgccagccccttgaatttaccatattttgtcactggtttatttctaccataccatctgatagtggacagccaagcgactttcctttcatcatttctatctctctcgatcaatgattatttatgtactgctataataatctgccgcgtgctggcaaaattctgcctccctagaacaaccaatggcatttggtttgctggtaaattatctcttggctccgtgtgttccctgtggctgtctgtctataatttatgttcattattttgttccggagaccgaagaatctgaggacttgtatgtatctgggatcaagatgtgaatctcgcatgtaccagatgacagaactgttaagacttatatttgtctgaggttaaactgcaagacttttatttaagctaaaaaaaaaaaaacaaaagaaaaaaaaaaaatatagcagggctcttgagatgcattctcttgtgcgtgcttggtaactgtagtcgtgcaactgttgacggc

SEQ ID NO: 20777 - DNA, 1462 bp, Zea mays
cttttttttttttttttttttttttttaggaagtcaaaaaaattgaaatttgtcacatgcataatgcatagaaacatctagacacatccctaacttggccaggaggtttatatacacattttttgccctaggttattattaaaataccaattaacaaaggttcagaataaaaaaacaacagttgtacatcgattaaaaccagttcagctactccagcttcttaacaaatggagaggcgcagaagtatgaacatcagggagattccatcatagctacccgaatctcaaagaaaagggatgggaaaccattccagctaacagcacttacatggtccacggaaaagctgtttgaaccgattcctaatttcagatatccaagtcatcatcgtacatgcctccatctgagactgtatcatcgaaatcatccatgtcatcgaaatcagcatcatcatcttcagtgaccacatccagcagatcatcatacatatcaacctcaaaatcagagcccgagttggctatgctgctgacgatgtaagcccgatacttgaagtcggagatggagtcgtgaggaagcttcagatctcgtatcctagcgcatttcgatctcagcgcgtcgtccatctgtatgttgtagcattggcgaatgtcaagggattcaaggcgagggcaacggtcaaggattgccacgagtccgtcattggtcaggttgttaccgatcaactgaagttcttggagcccaggcatggtgctagcgatccctaatgcttccgtgtcatcatccatgccctcgtagggtgcaaactcgctttgaagaatagaccagcgctcattcaacctgaagcatttaagctgcgggcaggctctcccagcagtctcacacacgatgccatacaatgagcagaatgtaatgtctagctccttgagctgagggaagcaattaactgcctctgcaaaaccttgattagtgacgtaatggcacaggcagagatggaggctcttcaatgagggggccctctgagagatgtagcggagcaggtcgtcgttgacgaaggtctcggcacagaacgcctccatggtgcccgcagagcggtcgaccgcggcgcgcgccatggcctcgacctcctcggtctgcagctggtccccctggtagcacatgtcgacgcggcgccacagcgtagggtccgaggccgcgagacggtgccacgcgcggcagaccagcccggcgccggacaggatctcggccacgtccagcttcgcgaacacggccgcgagcgcgtccgacggcatctccgcccagtcgcaggcctcattctcggcggccatgggcgaagccggcggcggcgaggacattgggtagggttagggatcgcggtctgggtgggaagggaattggatagctccggcctccggtaccgggagtagagtaggcagcccggccggcctcgaggcgccccggtaatctt

SEQ ID NO: 20778 - DNA, 831 bp, Zea mays
ggccgggccgggcgccgacactgtctcccctccctaccttcgcaagtttgcgcctaaaccctagctcgcttcccaatggcgccgaagaagcgcaaggccgatcccgccgagtccgccgacgctgcggaggcagccgccggcaaccaccgccaggagccagcgccctcggagcccaagccccgcgccaccatctacttccccatcaccgacgacccgccggagcccgccgccgaggaggacgaggaggatggcgctggcgaagacgaggacgacgtggaggacatcggcaagctgctcgagccactgtcgcgggagcagctcgtcgcgctgctccgcacggcggcggagacgagccccgctacgatggcggccgtgcgccgcgccgtggagtcggaccccgccagcaggaagctctttgtccacggcctcggctggggcgccagcgccgaggacctccgctccgccttctcatgcttcggcgagctcgaggactgccgcgtcatctctgacaagcagtccggcagatccaagggctatgggttcgtcctcttccgctcccgccgctctgcactccgcgccctcagccgcccccagctccaaatcgggggccgtcttgctttctgccacctcgccgcctcaggccccgcgcccccagcttctcagtctcagaaccctagctccaacccaaacaccaatgccaactctaactccaataccaccaccaatgcttctggctcatcatcgtcgcaacctgacaatatgccgcgcaagatatttgttggtaatgtgcatgctgatgtggacgtggaccgcctatataactattttgca

SEQ ID NO: 20779 - DNA, 1607 bp, Zea mays
  misc_feature (1594)..(1594): n is a, c, g, or t
cctcgaggccggccgggaccttcgcaagtttgcgcctaaaccctagctcgcttccaatggcgccgaagaagcgcaaggccgatcccgccgagtccgccgacgctgcggaggcagccgccggcaaccaccgccaggagccagcgccctcggagcccaagccccgcgccaccatctacttccccatcaccgacgacccgccggagcccgccgccgaggaggacgaggaggatggcgctggcgaagacgaggacgacgtggaggccggccgccggcgccgcgtcccactgtcgcgggagcagctcgtcgcgctgctccgcacggcggcggagacgagccccgctacgatggcggccgtgcgccgcgccgtggagtcggaccccgccagcaggaagctctttgtccacggcctcggctggggcgccagcgccgaggacctccgctccgccttctcatgcttcggcgagctcgaggactgccgcgtcatctctgacaagcagtccggcagatccaagggctatgggttcgtcctcttccgctcccgccgctctgcactccgcgccctcagccgcccccagctccaaatcgggggccgtcttgctttctgccacctcgccgcctcaggccccgcgcccccagcttctcagtctcagaaccctagctccaacccaaacaccaatgccaactctaactccaataccaccaccaatgcttctggctcatcatcgtcgcaacctgacaatatgccgcgcaagatatttgttggtaatgtgcatgctgatgtggacgtggaccgcctatataactattttgcacaattcggtgagattgaagagggtccgtttggctttgacaagaacactggcaaaccaaaaggattcgcattgtttgtttacaagtctgtggagagtgctcgccgtgctttggaggagccaatgaagaattttgatggcaagacgctaaatgtgcagaaagccatagatgggaggaccaagggctcatctggaacgaatacaaatgctaactccaatcccactactgcatctgtggctgctgctgcagctgctgcgcagatgactgctcctgccactgccgccattagcccatatgatgcatcggcatatggtgccactgcggttcctgacatgagttttgcacaacaagccgctatgctgggatttggtgcacagcaacaggcattcgctcaacccaatgcaatgcttgccatgatagcggcaatgcagaacccagctgcactagggatgacaccagccatgtttgctgctatgaacccagccttcgccgctgctgctttaggtgcaggcgggcagcaggcacagacagctggtcttacgggctttggagctcagggttttgggacgcaggcatttggagctggaggtgcagctttcccaaatgcagcaggtgttcaagcagcaacagctgcatatcaaggaggtggggctcctcctggttttcaagggccacctggatttcaggttggccaagcaactacccagacaagcactgcagtggcagcagctggttatcaggctggggcagctgggcagggccaggtgcctggggctcaaatggnaggcactggtttt

SEQ ID NO: 20780 - DNA, 981 bp, Zea mays
ccccccattgaattgacacactctgctcggtaccccagaagctcttcgtccacggtctcggatggggtgccggcgccgaggacctccgctccgccttctcacgcttcggcgagctcgaggactgccgcgtcatctctgacaagcaatctggtagatccaagggctacgggttcgtcctcttccgctcccgccgctctgcgctccgcgccctcaaccgccctcagctccaaatcggtggtcgtcttgctttctgtcacctcgccgcctcaggccccgcacccccagctcagtctcagaaccctatctccaacgccaaccccaatgctaactctaactccacgagcaacgcttctggatcctcatcatcacaaactgacaatatacaacgcaagatatttgttggtaatgtgcatgctgatgtggacgtggaccgcctatatgagtattttgcacaatttggtgagattgaagagggcccgttgggctttgacaagaacactggcagaccaaagggatttgcattatttgtttacaagtctgtggagagtgctcgccgtgctttggaggagccaataaagaattttgatggaaagacactcaatgtgcagaaagccatagatgggaggaccaagggctcatctggaatgaatacaaatactaactccaatcccactactgcatctgtggtcgccgcccagatgactgctccttccagtgttgccatcagcccatatgatgcatcagcatatagtgctactgtggttcctgacatgagttttgcacagcaagctgctatgctgggattaggtgcacagcaacaggcattcactcaacccaatgcaatgcttgccatgatagcagcaatgcagaacccagctgcgctagggatgagtccagccatgcttgctgctatgaacccagccttcgccgctgctgcattgggtgcaggggggcagcaggcacacacagttggtcttacag

SEQ ID NO: 20781 - DNA, 1995 bp, Zea mays
tgcatgatctgagaagaattagttctgcagatcgggcgattaatactcagtatggaattggcacagatggtcgatgtacaggtacatgcattttgttaagctatatgctaggctcagtgttaagatctgggccttttgggtgacttgacagcttgtgcagttgcgcctgagacatctattactacactgttcagtttttacttgtcggataccattataaatcatgttagtctgctgcattaacagtatatgtcataaatatgtactatgcttgagatagcttgtttcaaacatgaaatctgtgtgagctcttttattattctgaggggtgtccctcagatatccttatatgttctgacgatgtaattttatttcaagagacgaagctgattttggtgtcggattgctacctaggttttgacttttgacttggagtattatcttgagcatctcgccaagggttgagtgctttgttcaaagatcaaagcagtttgtgctgttacattttgtatgggctgagcaaccagctcagcttcagttaccttaacacactgacacagctggagacactagccaatttgcatgaaacaaaatataacctcaggaatattggcactttaaatttacaagagcccgttagcgctttaaacatcacgggtacacaagttacaagaatttccaagcactttacccgccacttgttccatgaatgctttcagcactacataaaactagtaattaactgctgcctaacaagggtggtcagttagactggacacactagccaatttgcatcccatcctaaaggaaccaaagaacccagagaaaggctcacattattatctccactctagcctgccaacactccatcatcagggatttcttagagactgacaaatagcgaagaaactcgctagatgtactaagctagtatgcatcgacttctctaaaaaaatctgaagttaattactcttcatcagagaaaaatgatgggagatccacagttttttccttgactttccacaatatacatggacctatacttgatataagggacaacaaccacagccagcacagacttgatcggctggaacacgtcccctggcctgccctcatcgtggtattgtgacgcttccggttctctagttacctcttgataatatgactcttctgtttggccatgctttgcatggataaggagcactgggaatcacggggcgcaacctgagatcatctgagtggctagagagtaattgaagatcattccactagagtgataaacagtgtactccttcaggaagatttccagggactgcaaaagacatgacatgtctttcaggaaaaattctccggggagtcatttctgaagcagatgaactctcgactgctgctgcatggttccggccatgaaatcttcccaaacgatttacgatagaaattctctccagatcttggcactccagttgcacatccaacatcgaggccctcttgttcaaactgtaacaagaggcaaattgtgtttcaaccgaaaaggaggcaaattgtgttgataaaaaatcgtgtttcatttgagcttaatatagatgtatcagcacaaaactaatttaggaatcctcctaggatacagggcgggatagttattagttatccaaatacaggaaggaaatggtttcgatggctcatgcgaaaacaaatatcatgacaaacgtagctatagatgaaaatattagtcaacactgcggcttgcacttgtaccaacactttaaaattcacttccaactacaggtggaaatgtggggagaaaattagaaagaagaaagcatagctacaatttcaaaattattcattcagtcatccccagagtacactagcaaatatatgaagtgcaaactcttgaggtgcaaacaatttcattaagcttcagcattgggtgctaaactaacaagaacattctggaggaaaatagtcttttaaagtatgagttgctgcagcatc

SEQ ID NO: 20782 - DNA, 1011 bp, Zea mays
tgggttccgggcccctttttttttttttttttttaacctcaggaatattggcacttcaaatttacaagaacccgttagcgtttaaacatcacgggtacacaagttacaagaattcccaagcactttacccgccaattgttccatgaatgctttcagcactacataaaactagtaataattaactgctgactaacaggggtggtcagttagactggaggacacactagccaatttgcatcccatcctaaaggaaccaaagaacccagagaaaggctcacattattatttccactctagcctgccaacactccatcatcacggatttcttagagatcgacaaatacccaagaaacccaccagatgcactaagctagtaagcatcgacttctctaaaaaaattctgaggctaattactcttcatcgagaaaaatgatgggagatccacagtttttttccttcactttccacaatatacatggacctatacttgatataaggtgcatcaacaacagccagcactgacttgatcggctggaacatgtccccggcctgcctcatcgtggtactgtgatgcttccagttctcaagttaccccttgacaatatgatccttctgtttggccatgctttgcatgggacaaggagcactgggaatcacagggcgcgacccgggatcatcattgcggctagaaaataactgaagatcattccactagagtgacaaacagcacactccttcaggaagatttccaggcacggcaaaagacatgacatgtctttcaggaaaaattctccgaggagtcatttctggagctgatgaactctcaactgccgctgcatggctccggccatgaaatcttcccagacgatttacaatagaaattctctccagatcttggcactccagttgcacatctagcatcgaggccctcttgttcaaacttataaagtcattttccatcttccggaaaagtccaacgaagacttccacaacctttgacactctgatagg

SEQ ID NO: 20783 - DNA, 1102 bp, Zea mays
  misc_feature (9)..(9): n is a, c, g, or t
  misc_feature (29)..(29): n is a, c, g, or t
  misc_feature (42)..(43): n is a, c, g, or t
  misc_feature (161)..(162): n is a, c, g, or t
gcatgaaancaaaatataacctcaggaantattggcactttnntaaatttacaagaaacccgttagcggctttaaacattcacgggtaccacaagttacaaagaatttccaagcactttttacccgccactttgttccatgaatggctttcagcactacanntaaaactagtaattaactgctgcctaacaaggggtggtcagttagactggacacactagccaatttgcatcccatcctaaaggaaccaaagaacccagagaaaggctcacattattatctccactctagcctgccaacactccatcatcagggatttcttagagactgacaaatagcgaagaaactcgctagatgtactaagctagtatgcatcgacttctctaaaaaaatctgaagttaattactcttcatcagagaaaaatgatgggaggtccacagttttttccttgactttccacaatatacatggacctatacttgatataagggacaacaaccacagccagcacagacttgatcggctggaacacgtcccctggcctgccctcatcgtggtattgtgacgcttccggttctctagttacctcttgataatatgactcttctgtttggccatgctttgcatggataaggagcactgggaatcacggggcgcaacctgagatcatccgagtggctagagagtaattgaagatcattccactagagtgacaaacagtgtactccttcaggaagatttccagggactgcaaaagacatgacatgtctttcaggaaaaattctccggggagtcatttctgaagcagatgaaccctcgactgctgctgcatggttccggccatgaaatcttcccaaacgatttacgatagaaattctctccagatcttggcactccagttgcacatccaacatcgaggccctcttgttcaaacttataaagtcattttccatcttccggattcttccaacaaagacttccacgaccttagacactttgtcttccattttcttagcacttcttgtttgttcagatgggttattttcatcctccacaggggagcaagagttatataatgatgatgatgccatgctgcatgca

SEQ ID NO: 20784 - DNA, 1638 bp, Zea mays
ccggccgggagaccagcctgctccggtcctcttggagttgggcctgcccacctcccggccggtccgccgcgcggttccagtttcgcctctcgtcgccggtcctggcgagccccgcctccttgatctccgaccagcagcttccccactgcccactccccagccccggacgtgcccttcgccggtgctgtcatggcgttcggccgacggagccccggatcctcgcggcaccctcccgcgctcaccatcgtcacggcgctactcctcgcctccctctacttcgccgccgcggcggcggctctatcgcccaccgacgcgatgcacaacaacaactgggccgtgctcgtgtgtacctcccgcttctggtttaattatcgacacatggcgaatacattgtccctatacaggactgttaagagattaggaatacctgatgagcgaatcatacttatgttggcggacgatatggcctgtaacccaaggaacagctatcctgcccaagttttcaataatgagaaccaccagctaaatctctatggtgacaatgttgaggtcgattatcgagggtatgaggtgacagttgaaaatttcttgagagttttgactggccgacatgaaagtgctgtaccaagatcgaagcgtcttcttagtgatgaaggaagtcatatacttttgtacatgactggacatggtggtgatgaatttttgaagttccaagattctgaagagcttcagagccatgacttagcagatgctgtgaagcaaatgaaggagaagcatagatttaaagagctgctgataatggtagatacctgccaagctgctactctcttttcacagcttcagtcacctggtgttttggcgattggtagtagcatgaagggtgaaaactcttattctcaccatcttgattcagatgtaggtgtttctgttgtggataggtttacctattatacacttgctttctttgagaaactgaacatgtatagcaatgcctcactgaacagccttttcacctcatacaatccttccatgctgttgtctactgcatattatcgaatggatctttatgaacgtcccttaaatgaggtgcctgtgacaaatttttttggatcagtcatgaagactctccacactgattcagcctacacaggtttcttggctgcgcatgacaatgaaactccaatgtccacgggagataaccttgatgatcatttcatgttaaagggcagggctatcgcacgaagatcaaccatagaaaaggaggcacaattaacaccgcatggatggactgaagttctggctgaacagctggagggaaagaatactgatactgttgtgatgtatggtctgggagctatgggtatactgttggcactttcaacctggttatcaatgtaggcaccaaaaaagtgtggttcgtagtctcttacgctatccatctctggtccgcgtgcgagagagagaaaagagataatatgtttgggaggtcttttagattttttctcttggtttttaaattcattaacgatgattagagttctttagaaaatgctgtatgtagttctttagggattactgtgttatcgttttatttatttaacatgatcttttgggaaagacttgtgcatatgggcggcc

SEQ ID NO: 20785 - DNA, 1735 bp, Zea mays
  misc_feature (1142)..(1143): n is a, c, g, or t
  misc_feature (1706)..(1731): n is a, c, g, or t
tacctcgaggccggccgggctagcgctgggccccggtcgcccgaccagcctgctccggtcctcttggagttgggcctgcccacctcccggccggtccgccgcgcggttccagtttcgcctctcgtcgccggtcctggcgagccccgcctccttgatctccgaccagcagcttccccactgcccactccccagccccggacgtgcccttcgccggtgctgtcatggcgttcggccgacggagccccggatcctcgcggcaccctcccgcgctcaccatcgtcacggcgctactcctcgcctccctctacttcgccgccgcggcggcggctctatcgcccaccgacgcgatgcacaacaacaactgggccgtgctcgtgtgtacctcccgcttctggtttaattatcgacacatggcgaatacattgtccctatacaggactgttaagagattaggaatacctgatgagcgaatcatacttatgttggcggacgatatggcctgtaacccaaggaacagctatcctgcccaagttttcaataatgagaaccaccagctaaatctctatggtgacaatgttgaggtcgattatcgagggtatgaggtgacagttgaaaatttcttgagagttttgactggccgacatgaaagtgctgtaccaagatcgaagcgtcttcttagtgatgaaggaagtcatatacttttgtacatgactggacatggtggtgatgaatttttgaagttccaagattctgaagagcttcagagccatgacttagcagatgctgtgaagcaaatgaaggagaagcatagatttaaagagctgctgataatggtagatacctgccaagctgctactctcttttcacagcttcagtcacctggtgttttggcgattggtagtagcatgaagggtgaaaactcttattctcaccatcttgattcagatgtaggtgtttctgttgtggataggtttacctattatacacttgctttctttgagaaactgaacatgtatagcaatgcctcactgaacagccttttcacctcatacaatccttccatgctgttgtctactgcatattatcgaatggatctttatgaacgccccttaaatgaggggttaattctgccggccccgccnntttttggatcagtcatgaagactctccacactgattcagcctacacaggtttcttggctgcgcatgacaatgaaactccaatgtccacgggagataaccttgatgatcatttcatgttaaagggcagggctatcgcacgaagatcaaccatagaaaaggaggcacaattaacaccgcatggatggactgaagttctggctgaacagctggagggaaagaatactgatactgttgtgatgtatggtctgggagctatgggtatactgttggcactttcaacctggttatcaatgtaggcaccaaaaaagtgtggttcgtagtctcttacgctatccatctctggtccgcgtgcgagagagagaaaagagataatatgtttgggaggtcttttagattttttctcttggtttttaaattcattaacgatgattagagttctttagaaaatgctgtatgtagttctttagggattactgtgttatcgttttatttatttaacatgatcttttgggaaagacttgtgcatatggaagtttggttatcttgatagccatttgagtagnnnnnnnnnnnnnnnnnnnnnnnnnngtgc

SEQ ID NO: 20786 - DNA, 1359 bp, Zea mays
  misc_feature (543)..(543): n is a, c, g, or t
  misc_feature (1156)..(1156): n is a, c, g, or t
accgagttcttgcattaagtgtgccatcagcaacatgttcttccagcattttacgaaacccatcacggtttttcctctcttgtcttctcacttgatccttttgtacccgcttctgctcttcctcttctttctctaggtgtcgaatgtactcttgaaaaatatccaaccgatcaaacttctcaagtcgggaataacgttcatcgtcctccagacgttcctgaacttttctccactgagtacttgccttgatgaagtcacatgattctagaaaagctctgtattctgctacatatcttttgtgttcttcagcagccttggctttttccttcttaagcagttccacaagatagttctcaaataaatcttcacgctcccttggacgctcaactgctttgaatctttcatcatcttcaaacataaaggaatgctttgctccatcttgttgattaagtaagctccctgcgttcttccaaccaatgccaagggaaatcatccacggtgctttcctctgtttgatacgtttttcttcggcttcaaactttntgcgctggttcaagtactcattgaaagcttgctttctctctccaagagttttcaaagcaccatatcttttgtcatttatgatgactctcatagtctgatcccatgtccaatcagactccacatttaccgactcaagcagggacttgaacgcattttttgcttccatcttagtggcatagactacaggttcttcttcacttgttttctcctccactggagtgacattaatcttccctgcaactggcatggtctttttggcctcctccaaatcttcagccgatgtaccatcctctgcgtcagccccagtggtcagagatgaattttcatcgttgtttctgctggaccctgcatctgttgcaactaatggaacttctgtgcttgctgcaacaggaacaacagcagtactcgaaccaccattttgcatgccaacaatagaactggaagtattctccacattgtgcggcaggggagcaccagaaagaacagagtttgatgacccatcatgtgcgctggaagcaattataccaacagcagatgacgactgattagcaggtgcagtagaaggttcaaaggcagcagatctgacaagagcactagtagctattcctgattnctcgatcaggttggtgatttgatgtgttctctgccaattcacgtgcaacctttaactagtcagagatagtacattttcattgcttggttactttgttgagctaggacgtcggtcattaggtggcacgaaaaacaatacgtcttgcctcgaccatggcgatgggtgctgcgcttcttgcaacggaagctatgttcgagcgagcg

SEQ ID NO: 20787 - DNA, 3481 bp, Zea mays
tttttactcttcttttttttttttttatttttgttttttttttttttttttctaaataaacgacaattgggtattggaagaaatgtagatatttaagaaaatatttcagaatgtatggaactaaataactataacactagtgattgttacgccaaagcactaataacaagtcaaaagtaagaaaaataggagcaatggagaacatgacaaggggaagtaattactgacaatctcggtagcaaacagaaagactaatagatctccccatcctctccaagttcaccatcttccagctcatgtgctccatttcttctactactatctcggtcctttttatgtcttttgtgccggttttcactatctgaatctgagccatgtgcatgcttcctagatttcttgcgatcactgctatgcctccgagacttcttagcatcgtctttatcatccctctcagagcttacatcatctgtgtcatggtgacgtctcttatgtttcttttctttatctttatctcttttcttatcttttgcaccatgggtgttcaaatcagcaccatcaaactccatttcatctctccttgatcgatccttccctttctccttttctctctcctcccggtggtctctttctttttctttgcgttctttctccttcctttctttctctttctctttcttcttctctttctcctcacgctctttctctctttttgccttttcttcctccctcaaacgttctttctcttttaacctttctttcaggtggacaacgcactcttcaaaaagctctctagcataagtctcactgtccaaggccctgaactcttggctatcctcgaaaagctgtttagaatcatcccatgttgaagaagctgatatttccttgatggaatacaaaagatctgaaaaattttcacccaagcgctggcgcttcttagcctccttttgctctttttccttgagcctttcaagctgatcgtcatatacaagcttgatgttgatggttgatattcctttaagagcatcatcctccagagtagcagtttggaattcctctaatgtccatgaagttgtcataggaatctttccagatttcaccacttctttaatttggatcttgtcttcttgatactgtttgccaagttcctcgatcacgtcatcaaataactctttcggtgtagagccagatgtgtttgatgctacagccaagtaggactgtgaatcttttatctgtgcacagtaatcacgccaccgagttcttgcattaagtgtgccatcagcaacatgttcttccaacattttacgaaacccatcacggtttttcctctcttgtcttctcacttgatccttttgtacccgcttctgctcttcctcttctttctctaggtgtcgaatgtactcttgaaaaatatccaaccgatcaaacttctcaagtcgggaataacgttcatcgtcctccaggcgttcctgaacttttctccactgagtgcttgccttgatgaagtcacatgattctagaaaagctctgtattctgctacatatcttttgtgttcttcagcagccttggctttttccttcttatgcagttccacaagatagttctcaaataaatcttcacgctcccttggacgctcaactgctttgaatctttcatcatcttcaaacataagtattgctttgctccatcttgttgatgatgtaagctccttgctttcttccaacattgcaaggaaatcatcacgtgctttcctctgtttgatacgtttttcttcggcttcaaactttttgcgctggttcaagtactcattgaaagcttgctttctctctccaagagttttcaaagcaccatatcttttgtcatttatgatgactctcatagtctgatcccatgtccaatcagactccacatttaccgactcaagcagggacttgaacgcattttttgcttccatcttagtggcatagactacaggttcttcttcacttgttttctcctccactggagtgacattaatcttccctgcaactggcatggtctttttggcctccaccaaatctttttcgattaggatgttctaggtatcggccccgggcgtcagagatgaattttcatcgttgtttctgctggaccctgcatctgttgcaactaatggaacttctgtgcttgctgcaacaggaacaacagcagtactcgaaccaccattttgcatgccaacaatagaactggaagtattctccacattgtgcggcaggggagcaccagaaagaacagagtttgatgacccatcatgtgtgctggaagcaattataccaacagcagatgacgactgattagcaggtgcagtagaaggttcaaaggcagcagatctgacaagagcactagtagctattcctgattctcgatcaggttgttgatttgatgcgttctctgccaattcacgtgcaacctttaactcgtcaggaatagtccattttgattgcttggtcactttgttgaaatagtacttccgtccttctggtgtagtaaattctttccattcagttgaggcatcagccctctccaaaggtgtcatcaactcaactggtttctcccaacttgattgccttgtcttcttattatagtagtacttttttccctcggctgcagtgtgctcctgccaatctgaagagctaggttcagacaagttgacaggagacaaagtcgttggagctgacacctgctggtgcccagactgcactagaggaggcacatgagttacactctgtcctgggcctgtactccagggttgcactacaggagggatcgatgttggttgatatgtataggtcaggggttgcataggagcacccatggtgagcaaatggcccccagcatacgcagcttgttgctgtggttgcataggtgctgatgacattggtctagctggctgatataccatgggaaccccttgtgatacaggtggaacttgatttgagtgaggcatgtgctgcccaggttgtggaaaatgtggcatttgccctggcatgccaacgttagcccccggcataggctcgggggggggggggaactgctgtgctgctggtggcatgaactgaggaggatgctgcgaaggcatcactggcctaaactgcataggcattggtggtccaagattttgtggctgagcgctagaacccatcatgggaggtcttggaggctgaggcagcccagaagactgcatattactggccatcaagccaccatcaaaataccagaaagagtaggaagagcacctccagagatcacagctcgctcgcttgttgttgatcttgttgccggaagcaaaccggatggagcagtaggacctatcgccggggctacagggggtgcacgcagccacaactacacgaggcgcgtgcggtggagagaccgcgagtttcactggtgggggaggggcgacgccggcgacaggcacggctggtcggcgggggagaagcgaca

SEQ ID NO: 20788 - DNA, 4583 bp, Zea mays
actgatgcagattgggctggagatattgatgacaggcgctctacagggggatttgctgtttttctgggcagtaatttggcatcctggagcgcccgcaaacaaccaaccgtgtcaagatctagtactgaggctgaatacaaagctattgcaaatgccactgctgagttgatgtggattcagtctctaatgaaggaactgaaaatttcttgtccccctacagcaagaatctggtgtgacaatattggagctacctatctcacagccaatccagtctttcatggtcgtgttaagcatgttgaaattgacttccattttgtgcgtgaaagagtggcaaggaagcttctggatgtgagagtgatttctacaaatgaccagatagcagatggttttacaaaagctctgacgaagaagaagatggatctgttcagagacaatcttaacttatgcaagttatgattgaggggggatgttagataatattaagaatgtatctgtaaagtaaggaaagggtgatgcgcctgtgtaaagataggaaaggatctgttcagttaggaaaagatctgttcagttatagatataatctgaggcaatcaatcagatctgttatagatagaatccaatcaatcataatctgttttgattgatttgattgattgctggcgccagcccctttgtaatctgatgatggtattccatctcctataaatacatacaggcggcctactacggtaggtaacaaacgcttcccaacctggtgttctttcaatactatcatccatcaggccagactgagagccggaggctcccgcatgagtggggtctaaggaaaggataacctgaggcaagcctttctcccgcaaatgcggagaggctgctttgaccccgtagtgctaaaaggctgtaaaaaaacaggcaccacaagaatgttgacaaggatattcacatacaagatgagaaatggagcaaaaactgaaaagtttataacaaaaaggcaaccagagacagctttttagaatgtgggggtcactagcttggacaagatttagcaaaggattataaatgcatcaattatgaagcacttgcaaaccttatgaaacaaaacaacacgagaaaatcaaacatacctccaaatcttcagccgatgtaccatcctctgcgtcagccccagtggtcagagatgaattttcatcgttgtttctgcaatgttcaacaaataagcgtattaacagacatttaaacgtcaggtagcatatactacaggataaaaaatggtgagcgcatgtgaaaaacctgctggaccctgcatctgttgcaactaatggaacttctgtgcttgctgcaacaggaacaacagcagtactcgaaccaccattttgcatgccaacaatagaactggaagtattctccacattgtgcggcaggggagcaccagaaagaacagagtttgatgacccatcatgtgcgctggaagcaattataccaacagcagatgacgactgattagcaggtgcagtagaaggttcaaaggcagcagatctgacaagagcactagtagctattcctgattctcgatcagggttgttgatttgatgcgttctctgccaattcacgtgcaacctgagagagagaaaaatcaatgcagcaataatgtattttcaattaaacggagaaaagaagaccaagaaaaaaacctttaactcgtcaggaatagtccattttgattgcttggtcactttgttgaaatagtacctgcaatgatagaacaatcaaaatacagaaagaaaatggaggattcattgacatattgacatattgacatataaataaatagatctcaattggcactcagttccagtgtaaacttacttccgtccttctggtgtagtaaattctttccattcagttgaggcatcagccctctgttaaatcaacaaaccccattggaatacatattaatacagcaagaaggcattaagtacattacctatattagagaatgaactgccctcaagcaaaaagaaacaagaatgatttcttggtcctttgcaagtgctcctcaaccaaatttaaagaaccaatttaaagagatagaaagcacaaaatccgcaaaagggcaaagagtgtgcatgtgcatgaaagcacattgggaattgaacctcatgaactttagtagtggaacatgatattgggcacgaaatgtaaatttacataggactagctgaacagatcaaaatcatatggctaagctgcatgaatataagcaaacagcacaactaacctccaaaggtgtcatcaactcaactggtttctcccaacttgattgccttgtcttcttattatagtagtacctagaaattgaaagagaaaattaaaccaacccaaataaagagaaaaccaaaacatgaaatacttaaattacaagagcttgtcatgaagaagtcaataacaggaaggatttaaaagaacactaacttttttccctcggctgcagtgtgctcctgccagtctgaagagctaggttcagacaagttgaccttgtcatttgcaaactcagttattccaaagtcgacgatataaaatattatatagtagacaaaaacaattgatgcagcagatattacaaaattaaacaaatatcaggtgatgatgaagcagaggtctggcactacttacaggaggcaaagtcgttggagctgacaccggctggtgcccagacggcactagaggaggcacatgaggtacactctgtcctgggcctgtactccagggttgcgctacaggagggatcgatgttggttgatactgaaatgtcggagttagcaagttagtagcttagtctaagtctagtaacacagaaatcatatggaaataactaactcaaagagtgactaatagggctaactgtataggtcaggggttgcataggagcacccatggtgggcaaatggcccccagcatacgcagcttgttgctgtggttgcataggtgctgatgacattggtctagctggctgatataccatgggaaccccttgtgatacaggtggaacttgatttgagtgaggcatgtgctgcccaggttgtggaaaatgtggcatttgccctggcatgccaacgttagcccccggcataggctcaccaacagaacggaactgttgtgctgctggtggcacgaactgaggaggaggctgcgaaggaatcactggcctaaactgaaagggcagcatgaggagcaacattagaaacgtagcctagaattctggaagcaacaaatgtgtaaagaaacaaaaatctggaattcagtttacctgcataggcattggtggtccaagattttgtggctgagcgctagaacccatcatgggaggtcttggaggctgcttgtaagataataaagatgattagcactatgtacactacaggtgacatgacaaaatgatattgacagcatgtgacagcagttacctgaggcagcccagaagactgcatattactggccatcaagccaccatcaaaataccagaaagagtaggaagagcacctccagagatcacagctgtaaacaatccagtgtaaaccatccaaagtatggacaaaaaaaaattgactgctgagaaaagccacttatcaaaagaagctgaaaaaagccatttgaggtgtttggtaattggtacctgcagcttttcactacctcgctcgcttgttgttgatcttgttgccggaagcaaaccggatggagcagtaggacctatcgccggggctacagggggtgcacgcagccacaactacacgaggcgcgtgcggtggagagaccgcgagtttcactagtgggggaggggcgacgccggcgacaggcacggcttggtcggcgggggagaagcgacaccggcggtggagggaagctatgagcttcaccgtcgaggggaggggtgacgccggcaacggggcaaacttggcatcgatggcgggggagtcacagatctagcaaagaggagacacgcagtcttagggtttctcggcattccttagtaaatcaattcctctgcattaaaacatccaacttatgtagcaacagttttctcaagcaacattttgggggcaaccgtcccctcaacggaggggaatgtaagcatcagagcagacttaccggctaacaagacaagacccaagcgaacaagaaggcccaacccgcgtgtcgttggacctggttgtaacctagattgatatagggatggcaatggatccaattcgggtcaggtataataaatacgttgtcatctctaattttgtcggttcggataagtataggaatacgttgtgaggagagggttatcatcatacttgtaaacacttgaacccattaaacgtttctcgtcgccttcctcatttcttgatgtccactctaatactgttcttttgtcccattcctattgttgttgttaataaagttatcggtcgtgaaattagggatatccgaattataccctaaacttcggatgccttcactggaaggcagcttctgcgaaggcatcactggcctaaactggaagtgttctgcgatggttcttagggagccttcgggca

SEQ ID NO: 20789 - DNA, 2187 bp, Zea mays
  misc_feature (2058)..(2058): n is a, c, g, or t
ttcagctcggtaccctgctgctgtagtccagcgcaagcttcttagtttccgtggggcgagtcagcggccatccacgaacgtaactgcaatgatccggtcccgtttccctggcatgcgccgatgtggagggcccataagcggtcactcccctcacggaagcaacgaaatgcggaaaatgtactggacgggaacatctcaagcattgcatcagaaaattaacaatccgtcaagtacaacttcaaggacaaagtgttgggtgagaacaactcgcgagtctggtcgctagattgctaataagatgatgatacgctgccaactctccccaacagtaagcctgcgtctgaaagcagccagtacttttctgggtacaaagccctacgggtttaagagtagacctggataagctagtaaatgaaaaccataatacaaacacgctgaatcttcaagcccagcaatcctcgacaaatttccatagataactaaatcctagtataatgaacaagccttaacatgacatgagcgacaaatcaaacactccatactctcccaaaagcacatcactcacaaagaaactcgttgcaaactgagcaatctgttacctcatcacagacagcaccatggactttgaaggaaatgaaaatttagcctggtcagctgccagaaggaccaaagaaaggtgtcaagcatgggctggtgttattgctacatccattgccccccagcagtagctggtgttattgctatatccattgccccccagcagtagcatcacaggtgcggcagagcaaaaatccagctggtaggcttcagcccaagtgcgcaactcaacaggcaagagatggcaataaatccatgtgtaacaagactggagatgagtgctacaagtagctgctcggtcgctcacaggtcggctattagctccatcaggacataaatagcttatatagttggaaaaatataaataaatcaacggttttgtttatttatttttctgagaataggacaaggcagcttgcggttatggctatctaaagttgcatgtccagccaaagttctaaaggataattaaggcacactaacttttcaccacccatgtactgatgtgccaaaataacaaacctacacagtgaagtacaaaggaaaaaaagagaaggcaaagataaagtgtctaggaaggcaagaaaatattttcataatgtacatggctacaattccaacacccagataaaagttttactactcacaagtcacacctacccaaaccaggacatccacatgaagcaaaccacatggttaaagtgttgcaccgtttccagagaataataactcgaccggggagggaatgaccacccttccggtataacattaagaagagaccgaaacaatagtcctagccgagaaaatccccgaaccctggcctcaaattactaacggaccggcgtcaaccgaaaccatggcgcacaggacatcgtaacccgagagcgaatgaggcacatcgaggggatttttcaaccaagcccaaaaatccgcccccgaggggaatcaaacccgggacttggtggtgctactccgaagccttaaccactaggctagaggccctttcgctttccagagaataatatgtgcaactaccctagaacccacacattgattatgcaaaaagaaaagaaacgacaattggtattgaagaaatgtagatatttaagaaaatatttcagaatgtatggaactaaataactataacactagtgattgttaagccaaagcactaataacaagtcaaaagtaagaaaaataggagcaatggagaacatgacaaggggaagtaattactgacaatctcggtagcaaacagaaagactaatagatctccccatcctctccaagttcaccatcttccagctcatgtgctccatttcttctactactatctcggtcctttttatgtcttttgtgccggttttcactatctgaatctgagccatgtgcatgctgcatgatcaacagtaatcatcttattacacaatttaatcataagcgaataaccatgacaatatntcaggcgattgaagaatagttcagaaattaagcagaacaaaacaattacatcataattgcagctattgtcggcgtttcggttatttctgatggattacaaagattagttgattatgatgttgtcgtcct

SEQ ID NO: 20790 - DNA, 2084 bp, Zea mays
  misc_feature (2063)..(2063): n is a, c, g, or t
  misc_feature (2084)..(2084): n is a, c, g, or t
agtagctcgcactccccgctagctccctctggttcccttcaagcggagaaagaagagagaggagggagaagaagcaacaagagcgaacgcaaaagtacagtacagctcctgagatggcggcgccggcgccgaagcaggaggagctgcagccgcacgccgtcagggaccagctgccctccgtctcctactgcctcaccagcccgcccccatggccggaggccgtcctcctgggcttccagcactacctcgtcatgctcggcaccaccgtcatcatccccaccgcgctcgtcccccagatgggtggcggcaatgaggagaaggcgcgggtggtgcagacgctgctgttcgtggccgggatcaacacgctcatccagagcttcctcggcacgcgcctccccgccgtcatgggtggctcctacaccttcgtcgcgcccaccatctccatcatcctcgccggccgctacagcggcattgccgatccccacgagaaattcgtgcgcatcatgcggggcacgcaaggcgcgctcattgtggcctccaccctccaaatcatcattggcttcagtggcctttggcgcattgtcgtcaggcttctgagcccgctgtctgctgctcccttggtcgccctcgtcggattcggcctctatgaactggggtttccaagtgttgccaaatgtgtagagatcggtcttccacagattttactgctggtggcactttctcagtacgtaccacatctggtccccttgctgagtactgcctttgagcggtttgctgtcataatgtccgtcgtcctcatctggctttacgccttcttcctgacggtcggcggtgcctataagaatgctgctcccaagacccaattccactgccgcactgatcgatctgggcttgttgggggcgctccatggataagtgtaccctatccgtttcagtggggagctccaacctttgatgctggtgaagcctttgctatgatggcagcttcttttgttgctcttgtggagtccaccggtgcatttatcgccgtttcacggtatgccagcgcaacaccatgccctccttccgtcatgagccgtggcatcgggtggcagggagttggcattttgctgggtggattatttggaactgccaatggaacctctgtatctgtcgaaaatgctgggctgctcgctttgacacgcgttggcagtagacgtgttgtgcagatttctgctggatttatgatattcttctcaatccttggtaaattcggggctgttttcgcatcaattcccggcccagttatcgcagctgtatactgtcttctcttcgcatatgttggtatggcaggtgttgggttcctacagttctgcaacctgaacagcttccgaacaaagttcatcctgggattctctttgtttatgggtctgtcggtgccacagtatttcaacgaatacacttccgtcgcgggctttggtccagtgcacacgcgtgcaagatggttcaacgatatgatcaatgtggtgttctcctcgaaggcgcttgttggcggggcggtggcgtattttctggacaacaccctgcacaggcgcgatggcgtcgtgaggaaggaccggggccaccatttctgggacaggttcaggtccttcaagaccgacccgcgtagcgaggagttctactccctcccgttcaacctcaacaaattcttcccgtccttctgatccttgctggtgctggtaactgagagaagaaaaatggttgtggttaggttggttgtggactgtgattttggcaatgccacgccgcccaagaggctgtttctcctacttctgttgtggtgagctttgaatcttgcagagctcagcgtaaactatttcgaaaggagtggagaaattgcttggtattgctggatgtaaattgggtcgggatagattgataaaatgaaaacagaactgcgccagtaatctttctgtagattgtaaactattgaactccagtgctattttagagtaaactccaattggttgatgtgcaaaaaaaaaaaaaaaaaaaaaaaaaaaaaaaaaaaaaaaaaaaaattnaaaaaaaaaaaaaaaattttn

SEQ ID NO: 20791 - DNA, 1657 bp, Zea mays
gtacagcttagcttcaccggtcaagctgttttcttgcattttttttcgcaccttttcacgggagaggttttttttccctttgctcatcatcttccatggaaccgcgcatccctggggcatcctcgcggcatcatccgcagccccgcgcggcagtaggccgtgctcggctgctcgccccgtgccccggcggccgtggcagctcgcaccccggcagcggcatgatgtactaactactaaggaacagtgagatagtaacatgaatttactctaccctgctgcaggttgccaaatgtgtagagatcggtcttccacagattttactgctggtggcactttctcagtacgtaccacatctggtccccttgctgagtactgcctttgagcggtttgctgtcataatgtccgtcgtcctcatctggctttacgccttcttcctgacggtcggcggtgcctataagaatgctgctcccaagacccaattccactgccgcactgatcgatctgggcttgttgggggcgctccatggataagtgtaccctatccgtttcagtggggagctccaacctttgatgctggtgaagcctttgctatgatggcagcttcttttgttgctcttgtggagtccaccggtgcatttatcgctgtttcacggtatgccagcgcaacaccatgccctccttccgtcatgagccgtggcatcgggtggcagggagttggcattttgctgggtggattatttggaactgccaatggaaccactgtatctgtcgaaaatgctgggctgctcgctttgacacgcgttggtagtagacgtgttgtgcagtcgtctccgcgacgtatgcccttcttctcaatccttggtaaattcggggctgttttcgcatcaattcccggcccagttatcgcagctgtatactgtcttctcttcgcatatgttggtatggcaggtgttgggttcctacagttctgcaacctgaacagcttccgaacaaagttcatcctgggattctccttgtttatgggtctgtcggtgccacagtatttcaacgaatacacttccgtcgcgggctttggtccagtgcacacgcgtgcaagatggttcaacgatatgatcaacgtggtgttctcctcgaaggcgcttgttggcggggcggtggcgtattttctggacaacaccctgcacaggcgcgatggcgtcgcgaggaaggaccggggccaccatttctgggacaggttcaggtccttcaagaccgacccgcgcagcgaggagttctactccctcccgttcaacctcaacaaattcttcccgtccttctgatccttgctggtgctggtaactgagagcagaaaaaatggctttggactgtgattttgttggcaatgccacgccgcccaagagggctgtttctcctacttctgttgtggtgagctttgaatcttgcagagctcagcgtaaactatttcgaaaggagtggagaaattgcttggtattgctggatgtaaattgggtcgggaaccgggatagattgataaaatgaaaacagaactgcgccagtactctttctgtagattataaactattgagctccagtgctattttagagtaaactaatgctggttgatgtacaaaaaaaaaaaaaaaaacagtgagatact

SEQ ID NO: 20792 - DNA, 2050 bp, Zea mays
tcgaggccggccgggccgggaaatcgaaaaagtactttcgctagctcccttccgttcccttcccacgaaaaccggagagggagtgagaagaagcaacaagaagcggagagccaacgcgcaacgcaacgccctgagatggcggcgccggcgccggcgccgaagcaggaggagctgcagccgcacgccgtcagggaccagctgccctccgtctcctactgcctgacaagcccgcccccatggccggaggccgtcctcctcggcttccagcactacctcgtcatgctcggcaccaccgtcatcatccccaccgcgctcgtgccccagatgggcggcggcaatgaggagaaggcgcgggtggtgcagacgctgctgttcgtggccgggatcaacacgctggtccagagcttcctcggcacgcgcctccccgccgtcatgggggcctcctacaccttcgtcgcgcccaccatctccatcgtcctcgccggccgctacagcggcattgccgacccccacgagaaattcgtgcgcatcatgcgggggacgcaaggcgcgttcattgtggcctccacactccaaatcatcatgggcttcagtggcctttggcgcattgtcgtcaggctgctcagtccgctgtctgctgctcccttggtcgctctcgtcggatttggactctatgagctagggtttccaagtgttgccaaatgtgtggagattggtcttcctcagattttactgctggtggcgctttctcagtacataccacatgcggcccccttgctgagtactgcctttgagcggtttgctgtcataatgtccattgccctcatctggctttacgccttcttcctgacggttggtggtgcctacaagaatgctgctcccaaaacccaattccactgccgtactgatcgatctggacttgttgggggcgctccatggataagtgtaccctatccgtttcagtggggagcaccaacctttgatactggtgaagcttttgctatgatggcagcttcttttgttgcccttgtggagtccactggtgcgtttatcgccgtctcacggtacgccagtgcaacaccatgccctccttccgtcatgagccgtggcattgggtggcagggagttggcattttgctaggtggcatatttggaacagctaatggcacctctgtgtctgtcgaaaatgctgggttgctcggtttgacacgcgttggtagtagacgcgttgtgcagatttctgccgggtttatgatattcttctccatccttggaaaattcggagccgttttcgcatcaattcctggcccgattatcgcggctatatactgtcttctcttcgcttatgttggtacggcgggtgttggtttcctgcagttctgcaacctgaacagcttccgaacaaaattcatcctggggttctctttgtttatgggtttgtcggtgccacagtatttcaacgagtacacttccgtcgcaggctttggcccggtacacacgcgtgcaagatggttcaacgatatggtcaacgtggtattctcctcgaaggcgttcgtcggcggggctgtggcgtatttcctggacaatacgctgcagcggcgagatggcgccgtgaggaaggaccgggggcaccatttctgggacaggttcaggtccttcaagacagacccgcgcagcgaggagttctactccctcccattcaacctcaacaagttcttcccgtccttctgatcctgatggctggtaactgggcgacggaaaatgctgttcggtcaggtggttgtgaattatgattttggcaaaatgccacgcccaaacggctgtttcctctcctgcttctattgtaaccactcgttgagttctgaatcttgtagagctcagcctgaactatccagaagtagtggaggagaaattggcaggtatttttggatgtaaattgggtctgtgttctcccatagatcgataagatggaaagagaactttctgtagattacacactccagtgctataattttttattttattttttttgccaaaaaaaaaaaaaaaa

SEQ ID NO: 20793 - DNA, 1827 bp, Zea mays
cattgggtacctatcggtcccctgcccctccccgacgcttccggctttccgtgcgaccgtgcccttttcctcctctcgcagctcgcaggcgcaacagattccacccgttccttcgggtggccggacggaacgaggaaggaggcaggatggcctccgatggccacccgccggagccggggaagaaggaggatgtcgccaccacggccgccgggcctggagcaaacgatctggacgacccgcaattcatgtgctgcgtatgtctggatcttctgtacaaaccagttgttatatcatgtggtcatatgtcatgtttctggtgtgtccacaaagctatgcatattttccgggaatcgcattgtgctgtgtgtaggcagccctatatacacttcccgagtatttgtcagctcttgcatcatttgcttctaaagcttgaaactaatgattacaaaagaagggaaaaagaagtactagaggaagagaagcgcatgcaaacatactctccccaaatcattgagttcttaaactacaagactaacgttggaagctataaggagaacagaaatgaagacagtaaagctagacctccacaagaagttccattgaatgacagcgttccagatgagcatttgaagaaaattaaattggaggatgtttcatgccctctctgtatggagatgctgtatcaacctgctgttcttaattgtggtcatgtgtattgtgtatcctgtttgtcatccttgaatgaggaaacgctgaagtgccatgtttgtggaagtcttcaccctggagatttccctaatgtttgcctggaccttgatcatttccttgaagaatattttccagcagaatatgaattgagagggcagaaagttcaatttaagaaggatcagtgcaatcgtgaaacatcatcttcaggtacttcaggcagaaaaggaagcactagggcactgcatgctgaagacccgtcaaatattcacattggagtaggatgcgactcatgtggggtatatccgatacgtggtaagagatacaaatgccaggactgcactgagttaataggctttgacctttgcgaagcctgctacaactccagttcaaagctcccaggacgctttaaccagcggcacacccctaatcacagaatggaagttgacaattcagcactcgtgcataggatactgagacaccatggcatacccgaggaaggccctgagggactgatgatggaagtggttggtcctgatgcaatggtgcagatactcattgataatcaaggaatggaggagggcaatgacgagggcccaggagaggcggccattgaagaaccagttggttctcttggctcaatgtcgcgtctgtcgcatctattcatgtataatccagaaatggaggatggcaatgacgaggactcaggagaggaggcggccattgaagaaccagttggttctcttggcgcaatggcgcctctattcatgtatgatcaagaaatggaggacaacgaggaggatcaggcacactagatgcagattgcaccagctgcagcgaagcctttgttttgtgttgctggggcggctctacttatgtaatgtggaatggagggattgcgcaagcttaaaagtatggctggatcggccttgttttttaactggttctctagttactgccatctaatagccaacatttttcccgcttttgtaaatccgtgcagttgtttgtttcaaaggaaaatgcaataaggatatgcagaactatattccttattttaaactctattacgtaaacaatgtaatctgtaataaaatagtgttttgcaaaaaaaaaaaaaaa

SEQ ID NO: 20794 - DNA, 5788 bp, Zea mays
  misc_feature (747)..(747): n is a, c, g, or t
  misc_feature (2785)..(2785): n is a, c, g, or t
tgcccgtctgtagtactttctttatttctcctacttaatttccatttatctaactttaatccctgcatattcatacttagcaatcatgttagtccacattattgtgttggtcattaataactaaaatatttatagaaatggtcctaagcacatttccctttcagcaggtacaatcttgaccatctggatcaggttttcaattacataatacaaataagagaccattacaaagatattttaaaatctagtcacatcataatatagctaagaaccaatatttttagagagtcctctaagacatactctttataaagagactgagtcttttatttttcatctaacatcttacaacatgcacaatctttagggtttttgaagtatatgagatgactaagggactttatttcacaagactaagatcctagatcataaatgtactttagagacaatatgtatacaaaaccgtctagagacatctaaagaggctatatattaaatgggattgtacatgtttgtcggatactcaggaacgaggtacccaaggcaaggcccataattctctctttggcccatttactgaccaattcctcaccgagtaagtctgcatggtgggacgaacgaccaagtcctcgccaagcaagtctgcgagacggggcgaacgaccatgtccccgtcgagcaagtctgtgaggcaaggtgaacgaccaagtacccgccaagctgatccatatgaagaaaacacaggccnaagctggcaagccacgtccgaaccgtacatacaatatcaaaagggctctggctgacgcgatagaacacccccgcatgtgcccacagatatacccctcactgactcatgggccagtcaacccagtcatgagggcctcaacactggagtctctattgtgacccgcatacccgaaagaacgtaacaagtatgcatatcgggggttatgtccacacacgccaggggtgacataggcccatgacgataggtggaaccgcgccacgcacaaccgctccatgtgactcgccctagggacctcgcgcactactatggaggtgttaggaatggactagctataggaggtcgtgtgacaaacgagcaagacgatacaccataccaagagtacgactatgcatgaccctacggaggacccaccacgacaaacctgggggtccaacctctctctctagtagaaaacaaatctcctctgtaaggtcctacctctgagatataaaagggcagaccccctcctccttcacacacaagcacaactactataacgcgcctcgaagcaatactacgatcaacactacactggactagtatgagagcctgaataagtataactccagtatctcagctccttgctcgtatccccgtgatccaccattaagagtgagtccgcactagtatccccaaccgaacacaaatttattgtcttccggttttcaaaaccacgacaatgtccttagaggcctcttaaggacatttttattaagcattttatgagttttgttcttattaaatgatatgtcatataaggaagcatgatgtcatgatatgcaatataataaagagagagtttatgggagataagattgttttatcaagatgaaattttagagatgttaattttttgacaaatgttgacatgaaagtctagagacctctaatgcagtgggttaaatagatccttcatgaaaagatcatctttatactttttactagttagttgcccgtgctttgctacgttttttatatatcgtacaaataagtactgagatatttattcaaatataatcattgtttatttctaaacattaatatacacgtgtcttggtggttagcccaaatttatagaggaggaggacgtgatttcgagtgcttgctctgcactatttttaatatatttattgtttaattctaaatgataaggcgcgtgggcgcggatctagagtatgagcgtggagaatgaagctgtgctaggatgtccaccttgcattccctcatgcagttgaaacgggcaaccaataaaacaaattatgtttttaataaattagtatagatatagatttaaaccttttaaaatgagatattaaatggactctacgtgctcaaccgttcagtttcgatcgtcgccgcgcaccgtttccatacttccgtttccaccagctcatcacgagcaggcgggtccaacctcgcagtcgcagccccgagatttgactgctgtccttggctccgctgcgggcccactatcaccattgccccgctcctggagctcaccaaccccgcatccaatccacctctgcggcccactcgagcccgacgcgtccgctccctcccctagaccgcgctcaccgtactccggtccacggccacgtttgtcacattcgtgcgcatctgagagcggttcacagacccaagtccatactacgccaccgacgacctctccgcgcgccgacctctcggtaccgaggctttcggcgccgaatctcccgtcccccacctgcccgaacggtccctagccgtccgtatggccaggcgacggccggatgggcctccagcggggcacgtggcgggcgagcaggggcagccacccccggaccccactgcgacgcgagcggcctgcaccgcgcaccggcacggcacccggctgtttgaatcccgtgggccccactcgcagtaaattcacctgcataaatccttcagcagtccggccccatacgcttcttaacccatttgcatgacaagcggccctacggaactccatgacccacatgtnggtgggtgtttcaagacagcggaaccgacgaagcagaacgtggtgcccaaggaataagacagttaactccacgtctccacctcaccactgccagtaaacagcgagtcctcccttgctccgtcctcctcgtccctgccgttccccaaacccaaagcagagcagcctcggcttctcttatccggagaggagggcggccgccggcgtcgaccttcgcgaggaaggagaggaggccgttggatctcgctggattcgattgggctaggacgggatctccgcgggcaggtaaatactgctcattaattgatttccttactcgcgtcgatccggcctttgaatcgagagattgctcccggttctggctggattgaataaccgatttcatttcaaggaaaggtacttcgattcttggagctatttttcgctctcctttccattttcaccatttccttgtttgatgatttcttgatctcgttttggatttatcatgtatctccgcccgcctcttgctgaattgagtcctcgccgccgttgcagatgcgctgagctcttggcgtgtgcagtgcacgatggtcgatcttgctgatctcgagggtgcgggcgaggcggcgcgctcgcatcccgccgcttccggccagcgggacaggctggcggcgctgctggagctcgctgcggcggacgacgccgcggggttccgcgaggcgctcgcgggaggaggcggccagggcgacgcagcggagctggcggacggggtcgggctgtggtacggccgaagcaaggcgtacgagccgcgcacgccgctgatggttgcggcgacgtacggcagcgtcgaagtggtgtcgttgctgctcggcctcggatgcgtcgacgtcaaccggcgccccggcgtcgacggcgccaccccgctgcactgcgccgcttccggcggctcgcgaaacgccgtggccgtggtcaagctgctcctgggtgccggcgccgacccggtaactcccgactccgccggtcgcttgcctgccgacgtcatcttgtctccacctgcttcgcccgacgccttgggcgatctggagatgctccttggccgccgccgagggctcgctgtcgcgacctcggtgccatcgctctcgtcgtccccgccgctctcgtcctcgccggatgagagcaacaggtcgccgtcctcgcggtcgtcttcgttgtctccgattaccgtcgaccgtgccaagaaggagtacccggtggatccgacgctgcccgacatcaagagccgcgtgtatgcctccgacgagttccgcatgttcgcgttcaaggtgcggccatgctccagagcctactcgcatgactggacagagtgtccgttcgtgcaccctggcgagaacgcccgccgccgggatcctcgcaagcacccatacacggcggtgccctgccccaacttccgccgccctggtggctgccccagcggtgatagctgcgagttctcccatggtgttttcgagagctggctccacccgtcgcagtaccgcacaaggctctgcaaggagggcgcagcttgtgcccgccgcatctgcttcttcgcccacgatgaagatgagctccgccatgtgcctcacaatagtggtgcaggtctgctgtctccccgtgcctcttcatccattgacatgaccgctgctgctgctgctctagggcttctacctggatctcctaccaggcactttgtgccaccacctctgtcaccatctgctgccaacaatggtggaggtgctgctgctcattggctccaaggtagcaggctgcgctcttctttcaatgcaagagatgcacaggctgatgaccttggctcgctcctggaatgggaatctcaataccttggagcgctcagcctcccacaaagcagccgatcccagccccgtctttctactggtctgactattcgtccaacagcagttgctccatcctacctcgaagagatgtatgcttcagacatggctatgtcgccaaggttcaccaatgaccaaggtcactcagtcttctcaccagcacacaaatcagctcttctaaacaagtttcatcatcaacagaagggccttttgtcgcctgtcaataccaacaggatgtactcaccaaggggccttgatccatcaattatccattctccatttggtggcatgtctcctcggtcccctcggactatggagctaacatctcccctaagtgtccgtgttggtgttggagctgctgttactccgcgtgatatgttggatcagttttcttccctgaacaagcaccaggtgccatctgtgggatcgccacggaatcttaatgcctcatggggcaacattggtaccccaaagagtaaggtcgactggggtgtggacgacgacgaactagtgcgcttgaggcaccctgtgcaacatggaaatacagaagaggaaccagatgtgtcttgggtgcagtcactggtaaaccatgctgagctgaatggcaagaggggtgaaatggcaagcatggcttctccatcgattaacaagcctgacctgagcttttagggtgactcgctagatcagtgttattgcttcttggcttgagcagcaagatgcgcttggagccgaagtaactgtcaaagaggccttttgctctcaaggtggatgaaaccatatttttgccgcgttagtttccgagaagaatagttatttgtcctagtaaataataatattctttttttatttcttgaaattttttgttcgcaaagtcggagatggtgtggtcttcaggaaagcatttgctcacaaattggtagctgaaagaagctgtcgagtattggtaaacagcctcgttaccttggaggtcctaactagtattcttttgattagttcagatgaggtgaaaattcatatggtcgaccgtgagagtcgatagtaattgtgttgatctctgtaacaagagaggttatagatttttttacccccatttgtcaatgaacaatttcataaatacattgatatttccagttta

SEQ ID NO: 20795 - DNA, 1112 bp, Zea mays
ctgagtattcgtccaaccgcaattgctccatccaaccttgaagagatgtatgcttcagacatggctatgtcgccaagattctccaatgatcaagttcactcagtctactcaccagcacacaaatcagcacttctaaacaagtttcatcatcagcaaaagggcctactgtcgcctgtcaatactaacaggatatactcgcctaggggtcttgatccatcagttctccattctccatttggtggtatgtgtcctcggtcccctcggactatggagccagcatctcccttaactgtctgtgtcggggctactgctacgcagcgtgatatgttggatcagttctcttccctgaacaagcatcaggtgccatctgcgggatcgccacggaatcttaatgtctcatggggcaacattggtaccccaaagagtaaggtggattggggtgttgacaaagatgaactagtccgcttgaggcaccctgtgcaacctggaaatacagaagaggagccagatgtgtcttgggtgcagtcactggtgaaccatgctgagctgagtggcaagaggggtgaaatggcaggcatggcttctcgaccaactaataggcctgaactgagcagtcaggatgactcactggatgagagtgttattgcttcttggcttgagcagcagatgcacttggagccgaagtaactgtgaaagaggtcttttgctctcaaggtggatgaaaccatctttttgccgggttagtttcctagaagaatatttgtcctagtaaataataatattccttttgtattcttgaatttttttgttcgcgaagtcagagatggtggttttcaggaaagcagtcgctcacagattggtagctgaaagcagctgtcaagaattggtaaacagcctcgttaccttggaggtcctaactagtattcttttgattagttcagatgaggtaaaattcatatattccaccgtgagagtcaatagtatctgtgttggtctctgtaacaagagaggttatagatatttttttttccatttatcattgaacgatttcatgaatacattgataattcccatttaaaaaaaaaaaaaaaaaaaaaaaaaaaaaaaaaaaa

SEQ ID NO: 20796 - DNA, 735 bp, Zea mays
cccacgcgtccgctcgtgcagaccaggttcctgcgaagataaatcaagaaccaaaccaaactgcacctatcaggagaatcggcctgctttctaggggacttggatggcttgacaagggcaagggaaggcagaattccaatgaaacatctggaggctaaactcatctaaagtccaggatgaagtcatagctcccaacaagatctggattgttcattaacgcttggattgcttgatcaccgtaagagtgttgaaatcagcatcgatacatgttttctcgggaagattcagctggtatattccatgaagttttgcaggaagtgtatcttgtatcatattgagttcaattgtcagataaagttttgttggtaggtcagaaaggcttctgcaagtcatcggtgtaaattttcttttattagttccattaagattgtcaatagttagtgttccaaataggagaaagaaaagaacacgacttactacacacaagaaaaatttctgttagattagttacagtatcatggagttgttactggagaagagcatgttttttttatctcttcagaaatgtcaaaaccaccgaagagattctctctctgtatttttgtctgatacgtgtggctcagacattcttcagtcacagttgacatgtttgatgtaaggcaattattgtcacgaggattctgattacgaatacaacagcagaaactccactatagggaggcgttttggaaagcc

SEQ ID NO: 20797 - DNA, 939 bp, Zea mays
cctgctcaaccgagtctcttcttaaagaatgatggtcatctttatgccacgtttgtatggacatcatataaaaaaatgaatggcctcattgatctagaaagattatacaaagttgaggtgcagtgggttcaccatatttgatgaattgtttttagcagggaaggcaaaattccactgaaacatctggaggctaaactcatctagagttcaggatgaagtcatagctcccaacaagatctggattgttcattgatgcttggattgcctgatcacgataagaatgtgttgaaatcagcagctatgttttctcggggagattcagctggcattttccatgaagttttgcaggaagtgtatcttgtaccatattgagttcagttgtcggataaagttttgttggtaggtcagaaaggctgctgcaagtcatcggtgtaaattttcttttattagtttcattaaggtcgtcaatagtcagtgtttccaagtaggagaaagaaaagaacccaacttcatatacacatggaaagaggaaaaattgtgttagattagttacagtatcatggggttgttttgttgaagagcgtatatctcttccgaaatgtctgaaccactgaagagattatctctgtttttttttcttttgagacatgtggctctaacatattcttcagttactgttgacatgcctgatgtacgaaaattattgtcaaaaggatctgattacgaatccaacatcgaaaaatccagtatagcgagacgttttgggaagttaattattgtctgttcctcacaatgttattcgaaaataattttggtaaaagcatgccgtgttccctcttttgatctgcgaggagtcgtgcggcatgcccgtgcagtgaacaccttgtttctgtcaacagaatacgacgaatgccttgccacattggtgaagtagatcag

SEQ ID NO: 20798 - DNA, 1878 bp, Zea mays
ggccgcttttttttttggcccttggggcctttggcacaaactatatgctagtatatcaaaatacactacaagattgtggcacaaatttaaacaaacaatctcactccaactggggtgaattttactaagatacatctgaattgcatatatagttacctaaatcagcttacaggcagcccatcgcacacaccacgccttgtcaggatataacagcaactaaacaagcaagatgcaccagaaatagacgacgcagacacgcagtacatactaacacagacacctggtgaagaaaagttcatctaggattgcatcgcgtcctctccatctgcttccccgggcacttcgttgaacatgtactggctctggtactccatcaggtactgcgtcgaccgcttcacgtccaggaacaactggtacacccggctaatgtcctccatgtcgaccaccttccccttgcgcctctggcaggctaatgcggcagatgtgataaggttgatggcgtaccgcagcgaggtctccacgccgattttggtgagcaggaccttggcgtccgcggacatctccacatcctcctcatcgcaccggatgtccaggatcttcctgatctcatcctccgtgtagggctgcgtcgtgatgatcagtaaccggtcaaggaagtctggcgggatcccgtgtggcgagcggtagtttgtcccacgaatggatgtgatccctctgtttgttgcgattactaggatcggagccatgtcattttccaatgctcggttgaggaaggagaagcactcaatgtctagcatgtgaacttcatcgatgaacagaacaccagggacaatatcagcttttccttcctctctccactctgcgacttttgtgtcgatctgttcccgaacctctgcacgaatttcaccggtgtcaccagtgaacagtgcaagaaaaccctgtgtcctgctattaatgacatcaatctcatgtaaggtaacacagtgcacgatctccttgcgcttctggagctcgccatcaggacacttgacaaacttggtgtgcgggccaacggcatcataatcccgcgacctcccaatggagcgtccaagcttggtgaccttcccggaggccttgtcaagtgcaatcacatccccgctctgcaccttctccttcccaagagcctcaatcatctttcccccgagctcgtacaccgtttccatgtccgtggtcttcagcgtgagccgccccgacttaccagccgcagtagcacctgtaggggcagccgagctgccgccagcggcagaggccgacaaagggcggtcgatcaagatctccacgacctcgccctcgatgatttccgtctcctccttgatgcgcacgccgatggcgcggcggaaggcctgcgtgagcgcctccgtcttggagaggtcgagcgagaagagctccgaggctgcgacggaggcgaagggcgtctccgcgccgagcgacttggcgatgcccatggcgagcgcggtcttgccggtaccgggctggcccgcgaggagaacggcgcggccggcgatcttgccctggcggatgagctggagtatgagccccgcggcgcggcgcgcgggcagctgcccgaccatgccctccgaggcgtcgcgcgcctccatggaggagtccagccctagcccccggatgtgggagtgcgcgccgatgcgctcgatccgcgtcaggtcccggctctctgacagccgctttagctccgccatggccgccgcttcggtgcgtcgacttttggccgccggggttgagggggctgactggcggaggcgaggcgagacgaggtttaggttgaagcctcgaaggagagacccagggtttttgtcaatggaccaaactagaatgcggtac

SEQ ID NO: 20799 - DNA, 1879 bp, Zea mays
ggccgcttttttttttttttttttggcacaaactatatgcccgtattcccgagcgccccgcggcttttttttttttttttaaacaaacaatgtcactccaactggggtgaattttactaagatacatctgaattgcatatatagttacctaaatcagcttacaggcagtccatcgcacacaccacgccttgtcaggatataacagcaactaaacaagcaagatgcaccagaaatagacgacgcagacacgcagtacatactaacacagacacctggtgaagaaaagttcatctaggattgcatcgcgtcctctccatctgcttccccgggcacttcgttgaacatgtactggctctggtactccatcaggtactgcgtcgaccgcttcacgtccaggaacaactggtacacccggctaatgtcctccatgtcgaccaccttccccttgcgcctctggcaggctagtgcggcagatgtgataaggttgatggcgtaccgcagcgaggtctccacgccgattttggtgagcaggaccttggcgtccgcggacatctccacatcctcctcatcgcaccggatgtccaggatcttcctgatctcgtcctccgtgtagggctgcgtcgtgatgatcagtaaccggtcaaggaagtctggcgggatcccgtgtggcgagcggtagtttgtcccacgaatggatgtgatccctctgtttgttgcgattactaggatcggagccatgtcattttccaatgctcggttgaggaaggagaagcactcaatgtctagcatgtgaacttcatcgatgaacagaacaccagggacaatatcagcttttccttcctctctccactctgcgacttttgtgtcaatctgctcccgaacctctgcacgaatttcaccggtgtcaccagtgaacagtgcaagaaaaccctgtgtcctgctattaatgacatcaatctcatgtaaggtaacacagtgcacgatctccttgcgcttctggagctcgccatcaggacacttgacaaacttggtgtgcgggccaacggcatcataatcccgcgacctcccaatggagcgtccaagcttggtgaccttcccggaggccttgtcaagcgcaatcacatccccgctctgcaccttctccttcccaagagcctcaatcatctttcccccgagctcgtacaccgtttccatgtccgtggtcttcagcgtgagccgacccgacttaccagccgcagtagcacctgtaggggcagccgagctgccgccagcggcagaggccgacaaagggcggtcgatcaagatctccacgacctcgccctcgatgatttccgtctcctccttgatgcgcacgccgatggcgcggcggaaggcctgcgtgagcgcctccgtcttggagaggtcgagcgagaagagctccgaggcggcgacggaggcgaagggcgtctccgcgccgagcgacttggcgatgcccatggcgagcgcggtcttgccggtgccgggctggcccgcgaggagaacggcgcggccggcgatcttgccctggcggatgagctggagtatgagccccgcggcgcggcgcgcgggcagctgcccgaccatgccctccgaggcgtcgcgcgcctccatggaggagtccagccctagcccccggatgtgggagtgcgcgccgatgcgctcgatccgcgtcaggtcccggctctctgacagccgctttagctccgccatggccaccgcttgccgccggcccgccgcttcggtgcgccggcttttggccgccggggttgaggggatggactgaaggaggcgagacgaggtttaggttcccggccggcctcgaggtaccagggttttgtcaatggaccaagctagaagaagt

SEQ ID NO: 20800 - DNA, 1855 bp, Zea mays
tgggtaccgggccccccctcgttttttttttttttttctttttttttttttaaacaaaccacggtttccaaccggggtgaatttaataagatagattgagttgcatagtcacctacatcaagctaacaaacagtccaccgcacacaccgcgccttgggtcagggtaacagcaacctgaacaagaaagacgcatcataaatatacgccacgcggtacatactataacccacacacaccatgtaaaggaaagttcatctacgattgcatggcgtcctctccatctgcttgccccggcacttcgttgaacatgtactggctctggtactccatcaggtactgcgtcgatcgcttcacgtccaggaacagctggtacacccggctaatgtcctccatctcgaccaccttccccttgcgcctctggcaggctagcgcggcagatgtgataaggttgatggcataccgcagagaggtctccacaccgatcttggtgagcagaaccttggcgtccgcggacatctccacgtcttcctcgtcgcaccggatatccaggatcttccggatctcatcctccgtgtagggatgcgtcgtgataatcagtagccggtcaaggaagtctggcgggatcccatgcggcgagcggtagtttgtcccgcggatagacgtgatccctcggttcgttgcgattactaagatcggcgccatgtcgttttccaacgcgcggttcaggaaggagaagcactcgatgtctagcatgtggacttcatcgatgaacagaacaccagggacaatatcagcttttccttcctctctccactctgcaacctttgtgtcaatctgctcccgaacctctgcacgaatttcaccagtgtcaccagtgaacagtgcaagaaaaccctgtgtcctgctattgatgacatcaatctcatgtaaggtgacacagtgcacgacctccttgcgcttctggagctcaccatcaggacacttgacaaacttggtgtgtggacctacggcatcataatcccgcgacctcccaatggagcggccaagcttggtgaccttcccggaggccttgtcaagcgcaattacatctccactctgcaccttctccttcacaagagcctcaatcatctttcccccgagctcgtacacagtctccatgtccgtggtcttcagcgtgagccgccctgacttaccagcggcagttgcaccagaaggagcaactgagctgccgccaacgccagaggccgacaaagggcggtcgattgagatctccacgacctcgccctcaatgatctcggcctcctccttgatgcggacgcctatggcgcggcggaaggcctgcgtcagcgcctccgtcttggagaggtcgagcgagaagagctccgaggcagcgacggaggcgaagggcgtctccgcaccaagcgacttggcgatacccatggcgagcgcggtcttgccagtgccgggctggcccgcaaggagcacagcgcggccggcgatcttgccctggcggatgagctggagtatgagccccgaggcgcggcgcgcgtggagctgcccgaccatgccctccgaggtatcgcgcgcctccatggacgagtccaaccctagcccccggatgtgggagtgcgcgccgatgcgctcaatccgcgtcaggtcacggctctccgacaaccgctttagctccgccatggtcaacacttgccgcaccgccgccgccgcagccgctggttcggtgcttcgatttttggccgccggcgaggtgaggtttaggcctgtagagcggggaacgagccagggttttgtcagtggcccgcccggccgcctagctggaaggctcccggccggcctcgag

SEQ ID NO: 20801 - DNA, 1971 bp, Zea mays
gcctgaaagtttctagtaacaagaagaaacataaaatgcagcaagcattagacttgcatgtttgaataatcatgtaagtagatatatttctgtcaaatctgatctgtaactaaagtgtataggtatatatctgataaaaaatgaagcatgaataggttatagagaattatatttcatgtaaatcttttgaatagccttgtggattttgatgccaccttatttttctagttggcccatgcaaccacatgaaagtatgaaacaggctgtgccgctttttactaactagagatccatgttcttgcatgtgtaggttattggcctttatgttggggttgcaacagtgggaatcttcatcatctggtacacgcatgacagtttcctgggaattgacctggctagtgatggtcatacacttgtatcgtactcccagctctcaaactgggacaagtgctcctcatgggagggcttcaaggtgtcaccattcaccgcaggagcgaggacattcagcttcgatgcaaatccatgcgattacttccagggtggcaagattaaagcaacgaccctctccctgtcagtcttggtggccattgagatgttcaactcactgaatgccctgtcagaggacggcagccttgtgagcatgccaccatgggttaatccgtggcttcttctggccatgtcggtttctttcgggctgcatttcttgatcctctacgtgcctttcctcgctcaagtgtttgggatcgtgcccctcagtttgaacgaatggctcttggtggtggcagtggccttccccgttgtgctgatcgacgaggttctcaaatttgtggggcggtgcctgacagcgcgtgcccggaaacaatcagggaagaggaaggcagagtagatgctagtgatcatcggtatttagaatctgtagtgccacggggaatcgatattcaatgtgacacccccattgtttttgagctgctaagggctctcgatcctttcagagtgttttaggttgggaatatgaccgtgcatgacaggctaggatactctatagaattggtaagcatatcgcgttgaacaacactgccttttgtttttcgttgtaacaaatgctggtactgtgaacatgctggagatacaacaatggttacctgacgtttttttctctctgaagaaaagcaaacatacccccctctggcgaaccttctgtcttctgacatgttgctcagtaatacgtttttttgcacttgtatgtgcggttatgttctcttgtgagagattcctcttgtacagatgatgatccgcatcattgtgatgtacattggtgcttctacatatgctatatgcattgttgaaggagtagacatcggacttgtccgtcagcatctgccgccggaagtagtcctggtcgaggtacccgaagctgcccggcggtgctgacgtgcgtcttgtccagctccggtccggtcttggacagcccgaagtcggcggagaacctatcatgtggtattgtgctcacatgtccaatttaaatttagggtttaggtttaggttttgcagtttgatacctgaaaggcggaagagttcttgccaaatatggctggtgaagatacggtctctatctgataccagagcgtgaggtccacgaagtttgtatacgtttgccatgaagtcttgaggcactttaacggcgtgtttggtttgcaggttggactgctttcggagtcatctggacctacgtccgagcctacattatcgtttggtttgaattgcggaacgatgtcgtccgtcactgcgttgttctaataatatactaacacttggaatcagctcactccgcaagaaagtgcaagaccgctccatccggagccaggccacgatggatgagccaaaccatcaaaccaaacatgctataagtgtagtgaatggatgaagcaagccgatgaaatgggcatacttactgaacgtatcaaccaccac

SEQ ID NO: 20802 - DNA, 1941 bp, Zea mays
  misc_feature (1798)..(1798): n is a, c, g, or t
  misc_feature (1822)..(1822): n is a, c, g, or t
aagcgtggtcgcggccgaggtacccacattcagttgctcgatggatctgttgtgctattggatgatggtgccaaggcactcatattatctacactccgaattggcagaatttgcaacatatgatggtgaagatcatgcagctcacaagtatctgctcgatccatcatactactcttccatagagagtaatatgatcttttgtggttttgtgggtctaagggatcctccaagagaagaagtccacacagcaattgaagattgcagagctgctggaagacgcggcacggcgataacaggagataacaaagaaacagccgaggccatctgccatgagattggggtttttggccctcatgaagacatcagttcaaaaagcttcacagggaaggaattcatggcactttctgataaaaagaagctcttaagacaacagggcggccttctcttctccagggcagaaccaaaacataagcaggagatagttagactgctcaaagaagatggtgaagtggttgcaatgactggcgatggggtgaatgatgcaccagctcttaaactggccgatattggagttgcaatgggcattacagggactgaggttgctaaagaagcttcagatatggtacttgcagatgataacttcagtactatagtcgcagcagttggtgaagggaggtctatttacaacaacatgaaggcttttattagatatatgatctcctcaaacatcggagaagtcgcgtccatattcttgacatcggctttgggtattccagaaggtctcatcccagtgcaacttctatgggtcaatcttgttacggatggccctccagcgacagctttagggttcaacccacctgataaagacatcatgaagaaacctcctcggagaagtgatgactcgttgatcacgccttggatcctgtttcgctatatggttattggcctttatgttggggttgcgacagtgggaatcttcatcatctggtacacgcatggcagtttcctgggaattgacctggctagtgatggccatacccttgtgtcgtactcccagctctcaaactgggggcagtgctcctcatgggagggcttcaaggtgtcgccattcactgcaggagcgaggacattcagctttgatgcaaatccatgcgattacttccagggtggcaagattaaagcaacgaccctctctttgtctgtcttggtggcaattgagatgttcaactcactgaatgccctgtcagaggatggcagcctcctgagcatgccgccatgggttaatccatggcttctcctggccatgtccgtttcttttgggctgcatttcttgatcctctacgtgcctttcctggctcaagtgtttgggattgtgcccctcagtttgaacgaatggctcttggtgatagcagtggccttaccagtggtgctgatcgatgaggttctcaaatttgttgggcggtgcctgacagctcgtgcccgaaaacaatcagggaagaggaaggcagagtagatgctagtgatcatcggtattagaatctgtagcgccacgggaatcgatattggatgtgacaccccattgtttttgagttgctaaggtctctcgatcctttctgagtctttttagactgggaatgacagtccaggacaggcaaggatattctataggactcataatcagatcgcattgaacacactgcattcttttcgttgtaacaaatgctggtgctgtgaacatgctggagatacatcaatggctacctgacgctttttcgctataatggttgcgtcttatatnactgctactaactgttctggttgncgcaatcttaacaacaataaacaaacaaaacacacctcggaggctcctggccccggccgcggcccagaaccacgtcgaagctgcgcaaactcggggctcctgtgcaaagcagctaagcc

SEQ ID NO: 20803 - DNA, 7741 bp, Zea mays
  misc_feature (1640)..(1640): n is a, c, g, or t
ttttttgtttgcagattgatgtcttataactgcttcagcaacatcttctagagatctctggatactagatgggatctgatagtgatgagcaggagggtcaatattcttcttttcgttagtcgaaatggaactgcgacctgactcaatcgacctcctggttctgaaaacttacattagcagatatgtttccatggatatcgtcaagacctttttgatctcttttgactgcatgctccagctcatcagctcaacccttcgtgtcgagcagggatctctcaccggcgagaccgcttcggttaacaagaccagccacaagttcgagttggaggacactaacatttaacaagaccagccacaagattgagttgttttagttaaattgtttttctactgcgaaattatcttgcatgtagctttggagcaggtaatgcatatccgcaaaaggttaataacaatttattcaacaaaagaaaaaaatgataaaagaactagtagctacttgcctactttcagtgacctctctataattaaaaagattgactgttctacttctgacaactctttcatcaaggtacctgaaattgttgaatttacattctcgtgtgactgttctacttctggcaggttttggttgagaaaatggtggcaggttctgtaataattagtattttttatttatatttttagggtgctgtcagtggaggaacaatgctgccaagagagtagcaactctggaatttgatcgcacccgaaagtcaatgggagttattgtgaaagtggactctgggaagaacttgctgcttgtcaaggtatgcattgtgctggagtttgcattccttgtggttttaggtcgtcagtttcaagtgcacagcaatgacctgcttcttgctgctcatctgtttaagctgtgatgttgtccagcctgtcgcccgccgtgctacccacattcagttgctcgatggatctgttgtgctattggatgatggtgccaaggcactcatattatctacactccgtgagatgtctaccagtgctttgcgctgtttgggttttgcctacaaggatgaattggcagaatttgcaacatatgatggtgaagatcatgcagctcacaagtatctgctcgatccatcatactactcttccatagagagtaatatgatcttttgtggttttgtgggtctaagggatcctccaagagaagaagtccacacagcaattgaagattgcagagctgctggaatacgtgttatggtgataacaggagataacaaagaaacagccgaggccatctgccatgagattggggtttttggccctcatgaagacatcagttcaaaaagcttcacagggaaggaattcatggcactttctgataaaaagaagctcttaagacaacagtgcggccttctcttctccagggcagaaccaaaacataagcaggagatagttagactgctcaaagaagatggtgaagtggttgcaatgactggcgatggggtgaatgatgcaccagctcttaaactggccgatattggagttgcaatgggcattacagggactgaggttgctaaagaagcttcagatatggtacgttttgttagaagtgcctgacgccatgtcctatgaacttgtgtcangttgctaaagaagcttcagatatggtacttgcagatgataacttcagtactatagtcgcagcagttggtgaagggaggtctatttacaacaacatgaaggcttttattaggtctgtttttggataagctatggccaaacttttttgtgcataattgttggttaaattaaaatatgctgagtcatgtgctatatgaactgcagatatatgatctcctcaaacatcggagaagtcgcgtccatattcttgacatcggctttgggtattccagaaggtctcatcccagtgcaacttctatgggtcaatcttgttacggatggccctccagcgacagctttagggttcaacccacctgataaagacatcatgaagaaacctcctcggagaagtgatgactcgttgatcacgccttggatcctgtttcgctatatggtatgttttcaatcacgccttggatcctgtttcgctatatggtatgttttccagttgatcatttgattagttgatgggtttgagattaatatgatacggtggactcttgtttttccagttcaatgaagctgtgtagcaatgtacatgcttttgatcaagtatgtctattaaattgttttacggtgaatagtttgtagtgtaaacctgcaagggttttcatagtgtaactaagttccatggagatcttgagcccccagtagatgaaaacggccacgaatttaccaaagtattcttggatgtgctactaattcagggttgagcttgacttctgataaattaatgatgtgaacaacattggggtttaaacatccaccacttagatatgatttatctgtcgttgttgcctgaaagtgactagtaacaagaagagacataaaatgcagcatcagacttgcatgttcgaataaatatgtcaaattatatgtggagtagatgtatttgctctgatcttgctgatctgcagctgaagtgaaaaggtgtatagctgataagaaatgaagcatgaatgggttatagaaaattatattttatgtaaatctattacatagccttgtggatattggtaccaccttatttttcttgttggcctgttcaaccacatgaaacacgctttgctactttttttttactaaccagagatccatgtccatgcatgtgtaggttattggcctttatgttggggttgcgacagtgggaatcttcatcatctggtacacgcatggcagtttcctgggaattgacctggctagtgatggccatacccttgtgtcgtactcccagctctcaaactgggggcagtgctcctcatgggagggcttcaaggtgtcgccattcactgcaggagcgaggacattcagctttgatgcaaatccatgcgattacttccagggtggcaagattaaagcaacgaccctctctttgtctgtcttggtggcaattgagatgttcaactcactgaatgccctgtcagaggatggcagcctcctgagcatgccgccatgggttaatccatggcttcttctggccatgtccgtttcttttgggctgcatttcttgatcctctacgtgcctttcctggctcaagtgtttgggattgtgcccctcagtttgaacgaatggctcttggtgatagcagtggccttaccagtggtgctgatcgatgaggttctcaaatttgtggggcggtgcctgacagctcgtgcccgaaaacaatcagggaagaggaaggcagagtagatgctagtgatcatcggtattagaatctgtagcgccacgggaatcgatattggatgtgacaccccattgtttttgagttgctaaggtctttcgatcctttctgagtctttttagactgggaatatgacagtccaggacaggcaaggatattctataggactcataatcagatcgcattgaacacactgcattcttttcgttgtaacaaatgctggtgctgtgaacatgctggagatacagcaatggctatctgacgctttttagctatgatggtgcgctatatatgctactactgttctgttgcgaatcttctgacatgttgctcactgctcagtaatatatttgttagagtcgtatgttcagttatgtttgcttgtgagattcctcttgtgcagatgaaatccgcagcatggctattgatcatatactgctgtacacggaggatgcaacattattttagcttcacctgccctcctcgctgttgaccatctttgaaaaaactctcctcatggacataccatcgaggtcccccaagttcgctgccacggtggcctctgtcccgtcgctgacggtagactggttgcgatggaatttggacgtactcctgggaactagctgcgtgttgtctgtgccagagctgtccggcgacgcctcctgcaactgcagcgcgaactcgaggcaccagagcacgtcccctatggcgggccgctccacgccgtactccgcgaggcacttctccgcggtgtcgacgaacttcttgagcgactccggccgtatcgacccagcgatccgctggtcgacgatgctgtcgagctcgccgtttttgagccgctgcgtggcccactctgccaggttgaccatctcccggggcagcgtcgggtcgatgaccggacgggcgcagagcacctccagcaggacgacgccgaaggagtagacgtcggacttgttcgtcagcatctgccgccggaagtactccgggtcgaggtacccgaagctgcccttgacggcggtgctgacgtgcgtcttgtccagctccggcccggtcttggacagcccaaagtcggcgaccttggccatgaagctgtcgtcgaggaggatgttggcggacttgacgtcacggtggatgatcgccttggccgagccggtgtggaggtagtgcaggcccctggcggcgccgatgcacacgtcgagcctctgcttccacgagaggggaggcagctcggagtcgtagaggtggctccggagcgtgcccctggccatgtactcgtacaccaggatcatctcgccgcgctcgtcgcagtagccgatgagcgacaccaggtggcggtgccgcagccgggagagcagctcgatctccgtgcggaactcgttcagcccctgctgcgaccgccggttgccgcgcttcacggccacctgcgtctcgtccctcagcgtgcccttgtacaccttcccgaacccgcccacgccgatcaccatgccctcgtcgaacccgcacgtcgcctcctgcagcgccgcctgggggggcccctacccggcaccggcgctctgcccgagcgtgaccgtgttgttcctggcgcctgcgctgctgctcttgccgaagctgcgcgagtgcgaccgggatcccagcgcgctctccgagaacgcgacccaggtgctcgacggcttcttctctggcttcttccttcgtcgtcgcaacatgaggacaatgagcgcgacagccatcaccacggtgatgacccccgcgatggccgaaccagcgatgattgcggtgacggtcttcttctttgaaccgctctgcgacgagtccgcgccgccgccggtgctcccgaccattctcatgatctcgaggccgttgaggacgccgtctgggtacgcgttgcccagcgtggacgtcccgatgctcacggtgatgttgcccttggcgtccttggcgctgagcacgaagtccttgtataacggcacggccgggacgctgaaagtgtctctggagatctcgtagtccggcagcacattccacccgcctacgtagacgttgaagaccaacccgttcgccgccttgctgacgatgtcgcagaagtgtagccggagcaggtacgccgaccccggcgcggcctggagcttccacgtcatgttaaactgcacgcttatggtgctggcggacaccaggttggtgttgatctccgtcgctgtagcgtagaccatgcctggcgccgtctcgggcgtcgccaagcctggcgtccaccggagcttcgacggcgccacatccctgtgcaccgtgaccgaactgtcgaccaggaaggcttcgtcgggaagccacgtccttcccagcgtgtcgttcctgggcgtgatcttgggagagcccatgttgaccctgttaaccgtctcgagcgcctgcgtggacagccccgcgtagcggcccatggggctcaccgtctgcgccgtgtccgcgaacaggtcgtcggggtgcgacacgacctcgatggcgttgacgaacgccaccttccccgccgccgccggcgcgaacgcgaccgccagcgtgccgccggcgacgttgacggagaactcccggaccgcgggcgtgccgttggcgggcgcgtacccgtcgatgagcagcaggccctgcgcggacacgctgaactcggcgtccgcggcgaggtcgccggacccgtaccggaaggggaagaagtggaggcgcacgaagtggcgcccgggactcttgatcgcgaacgtgtacgaggacggcgccgcgaagacgcgcgcggaccggtacagcgccgcgtcgtcggagccgctggccgccgacgcgctggcctcggagccccggggcgccggcagcacggccgccgcggggaggccgtcgtccccgaggaacgtcctgccgtcgacggtggcgttcgccgccgtgccgcagagcacgaggtagtcgtccgccggggtgaacgcggcggccaccagcgcgggcagcagcagcagcacgacggcgacccgcaggagcgtgtcgaggacggcgcgagccatggacgtggcggaagggagtggctctagaagcagctcatggacctgtccctggaagtggaacagagacgtcgagggttgcagttgcaggcagcatgaatcaaggccccatgggagtcatggtggatggttggttacttagcacaggacaggagctgctgctgtttggcggcgtgctgagagtgaatctgcgaactggcaggacaggggcagcagctagtaggtaccctaagagctgcctacccacaggaacgcggaaccggtgctcggtgattggagatttggttagccatggaggtaatattggggagggaggtggtggagcttttggttagtggggaaagcatatcactgtcattttccgaggatctgagctagaggatggctttagatattttaccaggaccaggagcctttttttttaattctgccattttttcgtggtttacaggtccctcggccgcttgtgcgcttgctcacgtcgacctcagcgaatttcaattcagcagctacaaaatggcaggtgaaaacgaggcatcgagaagagcatacatacacatgccttttcagggaccaaggaattctcgtttctgcggcagaacgacggcaaattattatttctatctctaggcctggctggtggctggtggctggtggtggactggtggtggtgctctgctttcgcagctcgcgaggtggtggtgggaaggaccgcggaagcctccagcggcccgcgtcgtccgccccgcgcaacccgaccagtcgtcaccagagtgcagtgggcatggcaggcggtcgtcgttgtcgtgcgccccaccaccagacgagatcatacgctagctgccggtgcagggtgcacacgtttcaggttcgttagatccgtactagtagatggcaccgatggaattggggattgattggcacactggatcggactcggaaccgtatatccattaaaatttgagggaaatagctagtggctgcaccgcgatactttctctgtccctcacagacacaagtctgtctgatgactgatgtagcatacgcgggcggatggcagacgaggctgctggcgtgtttcgcgtgcgcgcgggggggaggagaaacagaaaccggcgtgtggactggacacacgacgacacaagggccgggaaacatggaggataaagcgcggcggaaggaggcgtgaacgccgccagccaccagtacgcgtcgcgtcgcgtcggtgccgcgagagggacacggcacggggcaccgtctcgccctaggaggccctacgcccacgcgagttgaccggcgatgcatggatggcgaagactgtcggggtgtgcagctggatgcaggggcgcgagcggaacg

SEQ ID NO: 20804 - DNA, 2775 bp, Zea mays
  misc_feature (2599)..(2603): n is a, c, g, or t
  misc_feature (2637)..(2641): n is a, c, g, or t
ccggggtctgcgtgtcgcgcacgctagtacgctacgctaccggctgcggtggctctcccgagtcgaagtggcagctcccagcctcccacgcgtgaccgtgagagggaagggggtatttaacagacggcgggccccgcccggcccggctcgcggcagcagcaactgcagtggcggcgcctacccccacgcgcctccgcctcccgctcctctcccgcaccctgcgctctggtcactgtagaagctcttattcctccaggctcctacggttctcgtgcagtgccaccaccatgggagatgagacctcaacctcggttgctccccaggagcaggaatccactgtggctgggagtgtcaagcaacagctctccgggctggtccttatgtccctccgggctactgtgcctgaggtggaggtagaaccgatggttgaagtttcagcaaagtttgctgactaccaatgcaacaatgctatgggattatggtcaaaggttaaaggatctggaaccagtttcaaaaaccctaatgccattggacaggccattgccaagaacttgccttcttctgatattattgaatccacatctgttgctggacctggttttgtgaatattgtcttatcaaaccgctgggttgcacagagaatacaagacatgctcgttaacggtatcaagacttgggcaccaattcttccagtaaagagggcagtgattgatttttcatcacctaatattgcaaaggaaatgcatgtgggacatttaaggtctacaattattggagatacattagcacgcatgtttgagttctcgaatgttgatgttctgcgaagaaaccatgtaggagattggggtacacagttcgggatgctaatagaatatctttttgagaaatttccaaattggcaagagattggtagccaggccattggagaccttcagattttctataaagcatccaagcatagatttgacaatgatccagaatttaaagcaagggctcaacaaggagttgttcggctacagggaggagaagagagatatcgagaagcatggaaaaagatttgtgacattagcaggagtgaatttgacttggtctacaaacgcctaaatgtggtgcttgaagaaaagggggagagtttctataatccttatattcctcaagtgttggaggaattgagtagcaaaggcttgatcaaggagagtgagggtgccagagttatatttattcaaggtcatcagatccccttgatagtggttaagagtgatggtggcttcaactatgcctcgactgacttggctgccctttggtatcggctcaatgttgagcaggcagagtggatcatatacgtgacagatgttggtcagcagcagcactttgacatgtttttcagtgctgcaaagatggctggttggctgccaggtccaaacgaaaagaagtttccgaaaacaagccatgttggatttggtctagttcttggttcagatggcaagcggttccgaacgcgcagtactgaggttgttcgattggtagagctacttgatgaggctaaatctcggagcaaatcagaactactacaacggctcactgaaaatggcaaaattgttgactggacggatgaggaattagagcaaacttcagaggcagttggatatggtgctgtgaagtatgctgatctcaagaataatcgtctgactaattacacatttagttttgaacaaatgctgagcgataagggaaatactgctgtgtaccttcagtatgcacatgctcgtatttgttccattattcggaaatccaacaaggatgtggaagatctgaagatgactggagccatttctcttgaccatccagatgagcgtgtgttggggctgtatcttatccgatttgctgaggtggttgaagaggcatgcacgaatctgcttccaaatgttgtgtgtgaatacttgtacaatctatctgaaatgttcacaaaattctataccaactgtcaggtggtcgggtcaccggaggagacgagccgactgttgctttgccaagcgactgctgttgtcatgcgacagtgcttcaatctgctagggatcaccccagtctacaagctgtgatcggctgcatgtttgaagtttgatttatacattcaacatcgctttacgtagaaacccattcatcatggttgcagttttggccttgtaacctagttgaggcagttaacagactataatccatctccctgtttgaaaatagaagcaactcaaaagtttgtaacaaaatatgctctgcagagtttctattgatccattacattacgtaaaaaaaaaaaaaaaaaactccgtttcttttgggctgcatttcttgatcctctacgtgcctttcctggctcaagtgtttgggattggccccctcagtttgaacgaatggctcttggtgatagcagtggccttaccagtggtgctgatcgatgaggttctcaaatttgtggggcggtgcctgacagctcgtgcccgaaaacaatcagggaagaggaaggcagagtagatgctagtgatcatcggtattagaatctgtagcgccacgggaatcgatattggatgtgacaccccattgnnnnngagttgctaaggtctttcgatcctttctgagtcnnnnnagactgggaatatgacagtccaggacaggcaaggatattctataggactcataatcagatcgcattgaacacactgcattcttttcgttgtaacaaatgctggtgctgtgaacatgctggagatacagcaatgg

SEQ ID NO: 20805 - DNA, 4886 bp, Zea mays
  misc_feature (2162)..(2162): n is a, c, g, or t
  misc_feature (2181)..(2181): n is a, c, g, or t
  misc_feature (2241)..(2241): n is a, c, g, or t
  misc_feature (2272)..(2272): n is a, c, g, or t
  misc_feature (2339)..(2339): n is a, c, g, or t
  misc_feature (2347)..(2347): n is a, c, g, or t
  misc_feature (2423)..(2423): n is a, c, g, or t
  misc_feature (4069)..(4069): n is a, c, g, or t
  misc_feature (4073)..(4073): n is a, c, g, or t
ctgcagacagagctactgtttatgctatatgtgagcagtttctaactgaaagtttcatattcgcacttgcaagaaacaataatgtgagaagtttcatattccttgagtttttttttattctcagaaacatctaatcatggcatgacgttcgggagggtttatgttagtttttgactttacacgtctgaaaccgagtaaaaaacagtcagggaagcaagtttaagcattctttaatttcagcaaaagggaagcagtcgtagttgaaatggccgctaagtgacgtgctttggaaaagggttctctgaatagcgagggcttgggcgctgatatatttctcgtagtttatggggttcaccatgactgttcctgctgccctctgaattcttatggttgcaaattacaggcacatgaccacctcataattttgccctcctcagcagttccttttcttctcctttccttttccttaggaactgggcagtttcttagacattgccttcttccctgatctccaagcccaggcaacgaacgaacccgttacccatacgtgtccccgttttgggtttatctgagtttgggagaagcgtcattgctgaccaatctgggcgccttctcactgaccactttgcccctttatacgtggcgtcttttttcctcgtgcgcttctaaacacggtccaagaatcgatttttttttcttctctctcacttgccttcttccgtcgtgctctcattatcccataattaattacttgccacaggccttgatctccctcgcgtacacagagcgagcgatggtggagcacgagatggagcagaaggggtgtctctgccggatcaggctgcgctgtcgagctcttctcggcgatggaggaggacctggacacggacgacgagggctcgtgggaccttgttgggagggacatccggctaaaggccgccttcctgtgcattgacctcggccgtgtgatcgccttgtgcgggggcgaagagcgcaagaaggcgctcactgctcttgccaacaagctcttctactccatggatgagctgaggaccctttccccctcctctctctttttttcttcttcttcataaaaaagcgtatcttggtccactgcaagttcagggtagcatgcatgtgttgagtttaggtgtcatgatgatactgtgataaggcagcaaattcagggtatcatgtgttcattccgtttgatgatgtcttcctgattaacaagacgcgcttgcacaaatggcatgcagcggggccgcgcagtggagagcaggagcctccctctgacgcaggcgcgctacagcgacaccgctgacgcgctccgcgaggtcgtcgccgtcctcgcgctgtccctggacctggagttcggcccggatgatcccgtgtgccgtgtgcgagatcaccttcacgcggcttcacatgctgtgtggccgtgtgggtgtggctgtgtatacattattggctcatatttgggttggcgtcttcccccgtttgcgttgccgatgctccgctgctctctgattctgtaaccctctatgcgaaatgctgctgcatgcagtgctccccagacatcctgatttgatggccgcgcgttaggctagcgccgccctgataattttgacgcatgggtggatgcagtttaatagcattaaaataatttattttgtatctactcataaagtctgtgactctcatatacaatcaaccaaatataatctaaaactaggtgggtgcccgtgcgatgccacggaacataaattgcgagcttttaacggacttagagccctggcagagctctaggtacgtgatcgtgcgttgccacgagacaagaaaaatgcccgtgcatcgtgatataatacccgtgtattgtgacgacgacataattactcacttcaagtggcatagaggagcatctagggctaatggatccaaacaagttgttatccaagcaaacattatgcaaacataggcagccattccccaaactcacgccaggcagagaatcaactaacatgctcacataatttttacagtcaccaaaagcaaaatcatttcaaaaaaaatacattcaacatgaacccaacaaaatcgcaaaatcattgccacgagagttaaaaattagtataaaccatagatacggaacgacaaatatnactatgatatacaaaatcngtgtgataaaatattactgtaccactaatatcactatgatatataaaatccgtgtgatanggaacgacatctttaattttacgctctcaanttccaaattattttttcgaaaggacggcaagaggattgctgaatatattaatagaaggagaaaaacnaaatacanggactactggccagcaagggaccaactacagcctattcaagaaaaaattagatatatgatctcctcaaacatcggngaggtcgcgtccatattcctgacatcggctttgggtattccagaaggtctcatcccagtgcaactcctatgggtcaatctagttacagatggccctccagcgactgctttggggttcaacccgcctgataaagacatcatgaagaaacctcctcggagaagtgatgactcgttgatcacgccttggatcctgtttcgctatatggttattggcctttatgttggggttgcgacagtgggaatcttcatcatctggtacacgcatggcagtttcctgggaattgacctggctagtgatggccatacccttgtgtcgtactcccagctctcaaactgggggcagtgctcctcatgggagggcttcaaggtgtcgccattcactgcaggagcgaggacattcagctttgatgcaaatccatgcgattacttccagggtggcaagattaaagcaacgaccctctctctgtctgtcttggtggccattgagatgttcaacttccacatgatcaaagtgcactttctgtcaaagcaacaatcttcaagatcacgggctctgtaaacattactatatgtaccctgaccaatatgaataaaccaaagaataattcttgaaaacaatttccaaggcaataaaatttacatgtggcaatcctcacagtgagttatttccatcggaagtacccctcaggccctcacaacactcgtgaacacatctgagcacataatctcaataattcagtccaaaccaaattctagaaatggtttgaagtatatcagccaaataacagttctcgtctttcacagttcaatgtctagactttaagtatgaatccagaacagagcaaacagaacaatactatttgttatattgtcgccttatttccagaaattcagcaaaatcgagccgtctttgccgctcttagcagaaaggaatccttttgtatctcgaacttcaagtgcttctagaatgccaaatctcctggaaacaatatttcaaggtcaaatagatcgccaccaggaagttatgtttgcccatattgcaaaacgcttatgtttcatactaaattactaactcacattgtcctctgaaaaattgttcgaactgattccaagctcttccaggcgcggtggtgctgctgtgagcctatgtggccagggaagtaattcgctgcctttagccttattaacttagtccattcttatgagaattaatttagtcaatatgaatacaaaattgagtgaatcgatagtaggaaaccatcattttctacgccataaactctatgaacctttttatcttcttccgcgtaatttttatgatactcagattttctatagccaattctctctatagtcagattcttcctacatttagattcttagaaaagctactcggagaaaagctgaacccaacagtcagctagattctcgaaaaacttcacatcctaccgaccaaaaagtgaataacgcaagagttttgcgaaaaaatattattcacagaacaaagtggagaatcggatttataaaaaagtaaagaaagagaactatactgactatgtaatatgtatatcaaaagggctgaagcctgtgtctgaagctgatattaaatctactgttgacatttcaccacatgagaaaacagaaggngtcnaatactacattacatttgaggattaggacaacgccggtgcagagttattagctacagttaggatcaaaacaagagaaacggctgctacgacagatcttgcaccgagtgattccagagctttttcctcacgatcaagactctttcgtcacctgtcgtgagcgcatctttcttaggcctcatctcaaacgtccagtcgtcccaccttagcgctggtaaaagtttcttgatgtaggtaacgacatcaactttgtctctgatgatggcgtaaccataagtccttaggatgcggtccatctcgatcagaagatcctccaggctacatccctgcttctctatctcagaaaacaggagccaggcgtgaaggaggtcgtaggtgcccgggtatgtcgagaatgattcacaccttcagttaaacaggtcataaataaggaaaattagcatcagccagccctgtgtaacgggaagtaaggcagacacagacacacaggacaatgcacaagaaatttcttcagtagtgaagaggttagaaatgaaaagaatggtcttaaaaactggaaagaagcaacagaatgggggcacctatatcagatatgttgacaggactcattttttttgcgagggcccatgtttctcggttttgtttaattataataacaataacaacgcaggtaatcttataatgggcagaagtattggcctcaaggctcaaacactacatccatattccaaaatatgacagccaaaatacatcaatttctgaaaaccatgtttacacgcggttgcatcttagaaatcaaacaagataatatcacc

SEQ ID NO: 20806 - DNA, 2626 bp, Zea mays
  misc_feature (2390)..(2390): n is a, c, g, or t
  misc_feature (2415)..(2415): n is a, c, g, or t
  misc_feature (2444)..(2444): n is a, c, g, or t
  misc_feature (2522)..(2522): n is a, c, g, or t
  misc_feature (2568)..(2568): n is a, c, g, or t
  misc_feature (2573)..(2573): n is a, c, g, or t
  misc_feature (2579)..(2579): n is a, c, g, or t
  misc_feature (2606)..(2606): n is a, c, g, or t
cctcgaggcccggccgggctcgcggcagcagcaactgcagtggcggcgcctacccccgcgtgcctccgtctcccgctcctcttccgcgccccgcgctccgtcaggtcactgtagacccgcttcttcctccaggcttctgcggatctcgtgcagtgccaccactatgggagacgagacctcgacctccgttgctcctcaggagcaggaatccactgtgcaggctgggagtgtcaagcaacagctctccaggctggtcctttcatccctccagactacattgcccgatgtggaggtagaaccgatggttgaagtttcagcaaagtttgctgactaccagtgcaacaatgctatgggattatggtcaaaggttaaaggatctggaacaattttcaaaaaccctaattccattgggcaggccattgccaagaatctgccgtcttctgatattattgaatctgcatctgttgctggacctggttttgtgaacattaccttatcaaaccgctgggttgcacagagaatacaagatatgcttgttaacggcatcaagacttgggcaccagttctgccagtaaataggacagtggttgatttttcatcacctaatattgcaaaggaaatgcatgtgggacatttaaggtctacaattattggagatacattagcacgcatgtttgagttctcgaatgttgttgttctgcgcagaaaccatgtgggagattggggtacacagtttgggatgctaatagaatatctttttgagaaatttccaaattggcaggagataggttgccaggccattggggaccttcagattttctataaagcatccaagcataggtttgacagtgatccagactttaaagcaagggctcaacaaggagttgttcggctacacggaggggaggataaatatcgagaagcatggaaaaaaatttgtgacattagcaggagcgaatttgacttggtctacaagcgcctaaatgtggtgcttgaagaaaagggggagagtttctataatccttatattcctcaagtgctggaggaattgagtaacaaaggcttgatcaaggagagtgagggtgcccgagttatatttattcaaggtcatcaaatccctttgattgttgttaagagtgatggtggcttcaactatgcctcaacagacttaactgctctttggtatcggctcaatgttgagcaggcagagtggatcatatatgttacagatgttggtcagcagcagcactttgacatggttttcagtgctgcaaagatggccggttggctcccagatccaagtgaaaagaagtttccgaaaacaagccatgttggatttggtcttgttcttggttcagatggcaagcggttccgaacccgcagtactgaggttgttcgattggtagagctacttgatgaggctaaatctcggagcaaatcagaactactacaacggctcactgaaaatggcaaaattgttgactggacggatgaggaattagagcaaacttcagaggctgttggatatggtgctgtgaagtacgctgatctaaaaaataacaggctcactaattacacatttagttttgaacaaatgctgagcgataagggaaatactgctgtgtaccttcagtatgcacatgctcgtatttgttccattattcggaaatccaacaagaacgtggaagagctgaagatgagtggagccatttctctcgaccatccggatgagcgcgtgttggggctgtatcttatccgatttgcagaggttgttgaagaggcatgcacgaatctacttccaaatgttgtgtgtgaatacttgtacaatctatctgaaatgttcacaaaattctataccaactgccaggtggttgggtcgccggaggagacgagccggttgttgctttgccaggcgactgctgttgtcatgcgacagtgcttcaacctgctcgggatcacgccagtatacaagctgtgattggctgcatgttcgattaatacattcaacatgtagaaaccccaattcatcatggttgcagttttggtcttgtaacctagttgaggcagttaacataatctactgtcctgtttgaaaacagaaggaactcaaaaggttgtatcaaaatgtgcttgcagagtttctgttactgttaggctagttttgcaaaaaaaaaaaaaaaaaagcttctcgtgccgttttttttttttttttttcatatatggcaagcatagaattgcttgcctgtgcaaacttaattataagatgaagtaatttctttatacaataactggatgaaccagctagagagcagataatcgatcaccggaaattaacactggactgaaatctcagtgatcaggacaaagcactaatgaaagccacactggtntcctggccatagctagttacacgtnctgatgaaggaggatcctgcaggtcctanactcctagctagctagctacacgtactgaaaaagctagtcctggccgccgggctgactaggcatcgccatcgtcgaanttctgcgagtagctatgcaggtcatacccgaacctgaccgcgccgngcctnggccgngccgggcgtttcctccaggagcacctnaacctcgacagcagctgctt

SEQ ID NO: 20807 - DNA, 2230 bp, Zea mays
ggccgcttttttttttttttttctcttttttttttttttttttttttttttttagatgcaacagttctgttttttttaatagctaattcgcttatatgtctcaatgaccgaaaggctgttacacctgaccgaaagatgcactctaaagctttgacaacactcctatgtcaaaaccctcaccatccaagcactgaatcggtgtgcatgtggcagggaaaaatccatatgtaaacctcatacaaggatcgactaatcttcttttttgctgtctgaatcttcaagagcttgcagcctctcgacgagtggtgggtgggagtagtgatatgccgaataccaaggatcggtgttcatcgcagacaagttctcctcctgtagtttaacaagggctgctcggagctgaggggcatatccaaggttcttggcaaaggcatcagcctgaaattcaaatgctctgctgacaaggttcaggcaaaagctcagaaggtgttggatgggtattatggtgtgctggaaaatgatcaatccaattattactggctggtccttgaagccaaaacttccaaatagatctttggagctccttactagagtatatcctccaaattgaagaaacataagcagctggacagctacaaaggaatagacagtatgattgagtttccagtgtccaagttcatgtgctataacagaaactatctcatcctcattgctacactgctgaatcaatgtgtcatagagtactatgcgcttgttcttgaaaaaaccatacatgtaggcattactgtggcttgatctggtagacccatctaccacgaaaagctttttcaaaggaaacttgagggaagctgccagcttctctattttttccctgaggactccttcaggaagaggagtgaacttgttgaacagaggagctatcacaatggggtatattgtcatcatcagtagagctaatacaaacataaaaccccagagatatatagccaggtaaggtcctccaatctgtactatgtagatgatagcagccacgattggtggccccaatatcatggatagtaaaattcctttgatcatatccctaatgaagagccatatagtttgcttgttaaaaccatgtcgagcctctataacaaaagttgaatagagagagaacggcaagtctgtaatctgcgaccaaaccatggaaccagctaagaaagcaagggtgtgtattatctcattctcagcactcagcccaacactggtaactaactctccagatttcttccaaaaccagggaagaactctatagtatagtattgtagtatccattaaaatagtcacagcctcatgaacaaaatggaaatagcttttgtcgaggctataagctctagagcgttcaaacttttcgtcactaattactcccagcaggggttttggcaaagttggcagcttgagggctctatgctgacggatgtcaagatatgtctcaaatatgtacatgaaaatcataaagcaaagcacggcctccaggtagggcaacgccattggagccgagggaggccacgtcggcggtggcgcttcggaaaccgaggggcggagctgagggctgaggcgagggatcgggggagggaatggtatgaagcgggggagctttgacggcttgacgcggcgcaggctcgggtgctttgctcgattccggagctcggagctgcggaaggaacaacgaagttgtgaattggcgtccgaaggtgctgggcacggctgggctgaaggccgaggcaggcttgaggccccaggcttggtagtgaagccaaactgacatgccgcggcctccactgcacggacggagcatccgcagcacgattcctgtcctgaactcctgattcggtgattcacgaatcctgatggcgctgggccgtggcccagatcgatgaattcgggttgggcctgcgtgaccatttgtgccgtggctacgaagcagcccacagtgaaacggtggcataaatgggccatgttgggcgcagacaccacaaaattaccaccttgctccaaaagtagctgaactgaagagcataacgacgtgatgcgttcatcagtgtatgggacttcttcttcttcgataccgtactgcatgggttgggtgttgtcgggcatctggataaagcctgcaaagtgtttgatgaaatgtctagagaaggataaaccccatcgattgcaacttgtaacacgttaattcaggcaacctgta

SEQ ID NO: 20808 - DNA, 2369 bp, Zea mays
actagatccaacccccgtgcatcgcattctctcccgaacctcatcgctcatccaacgctggcttgagatcgaggtcgtcaaggccctgccacgccatgcatcggcaacgccgccgacctaggcgcctcggcctctgcctcgatcgaggccgtcggtctcaccacgtcgtgcatcagccgcgccgccgacctaggcgcctcggcctctgcctcgatcgaggccatcggtctcaccacgtcgtgcatcagccgcgccgccgacctaagggcctaggactcggtctctccctccgactttgacaggtcctcgtcgtgacgacgatgagggggcagcgactgtacgactccctcaaggccctctccgatgtgtccggcccattgaatccattcctcctctgtctcgccatggtggacatgttggtgctcttcgaaaccccaccagattttgccctattcaaggcgctcgacaaggggaagctcgaaaaattcgaggtgagtgactgtcgctgcattttctaaagtctggtattgattgggttccttaaatttgctcgacaaggtttctatggatccagtgcctgacagagttcatccccatttcactggtcgatttgaaccaaaagaatttcactggtagctatatgaggattgtatcaccattctctagctcgtcaatgaatgggttttggaggatctcagtctcagttgtcaaggtgctagacacacataacgccactttggttcaagtcacgagcttggatggataactgtagggagttgtgcttaaggaaatgcgcatgcaatgcttatgcttacacactgccgagagacaccaaatccgtacaaatttgtggtagataaattgttcttgtatcgactttttcctgcttgcattgttattattgccttgcaaagcatgaaagctaaatctggtgacagaaaatatcccaatggcagagataactcagtggcagtagcgtccaatgtcaccatacaggatgtttgttttaaaggtggtactttattgaagctttataatagattgtgccctttttctgaatgtaatattgtagaacatcttatgtgaaatgtatggatgatggttgcaaatcctgatattgaatagaacttcctttttcgaattatcatatacaaattaatggatatatctgcttatgttttcctcccaaacacgcttcagcagtggtaattatcatgcaatctgcatatttatataggataaaaggtctatttacacttattagttcttaacacatgtacatctatggaatatgtttatgagctcctggtcctcgttttggtactgctgctgcctaggtatatggcgcatggtaggaccacccaccgtgccttagctaccaggaaaatgacaggataagtgttcctacactgtcacttgctatggagacagagagatacatttttgtttgtatggtttcttggcagattaagaagcagttggaggcggacacaatcacagttgtggatacctctagagatagccgccatgtctggtgagtaacaagaccccaaccccaaccacttgatattctttttctaattttctaggatgcaaagaaacaaatgtgctacatgctcaaactcacatggacatggtgaatatgtctgtattcagtagtcggtatcaaagaaaacaaggccatttttagatgtatcaatgtgtggtatataattcgcaacttgtttgtttagaaatgttcctatgcgaagcattgttggtgattgatgtggagatgatagcggtttttgcttaaatatttgagaaatatttgttttttggcattgtagtgctactaccacaaaaaaaatagtgatttgccatcttgctttatcttccgtttgtgtgctaaaaatatttacatggattgaagtgtgtatttctattccataagtgtgaggtttttttggcaacacattttatcatgaagtctatgagcagcaccagctcaatgacgaggctcggcatgcaccgcgacatcttctgcagcgcttgttaactcagggagaacaaggatgacaagggagtgtcgatggccgacttcctcagtacttgatgcaggggctaagatctctattgggtgccatactctctctagatgtttttaaatgaatttgcagttatttttttggttccatgttgttgttgccttcaaaagtcccatcaccttcgctccaaaatgtcatgtgttaggttttgatataagtttaggttgctttgccgattcatggattaaaatgccctcaagaacatttatgctgattccttgatataacaccactggatgatattgtgggcatcaacatgctctcccaaaaaaaaaaaaaaaa

SEQ ID NO: 20809 - DNA, 1718 bp, Zea mays
  misc_feature (5)..(5): n is a, c, g, or t
  misc_feature (19)..(19): n is a, c, g, or t
  misc_feature (60)..(60): n is a, c, g, or t
  misc_feature (62)..(62): n is a, c, g, or t
  misc_feature (72)..(72): n is a, c, g, or t
  misc_feature (111)..(111): n is a, c, g, or t
  misc_feature (116)..(116): n is a, c, g, or t
  misc_feature (124)..(124): n is a, c, g, or t
  misc_feature (147)..(147): n is a, c, g, or t
  misc_feature (156)..(156): n is a, c, g, or t
  misc_feature (183)..(183): n is a, c, g, or t
  misc_feature (186)..(186): n is a, c, g, or t
  misc_feature (188)..(188): n is a, c, g, or t
  misc_feature (220)..(220): n is a, c, g, or t
aaccngaaacttttctccntccctccatggcttacactggctggaatccaatggtgtccntnggggtactangccgcttgtttcttggaaaaaaccccttacctgttgggncattnactgtggncttggatctggttggaccccttntacccacgnaaaagctttttccaaaggaaacttganggnanctgcccagcttctctaattttttccctggggnactccttcaggaagaggagtgaacttgttgaacagaggagctatcacaatggggtatattgtcatcatcagtagagctaatacaaacataaaaccccagagatatatagcccaggtagggtcctccaatctgtactatgtagatgatagcagccacgattggtggccccagtatcatggatagtaaaactcctttgatcatatccctgatgaagagccatatagtttgcttgttaaaaccatgtcgagcctctataacaaaagttgaataaatagagaacgacaagtctgtaatctttgaccaaaccatggcaccagctaagaatgcaagggtgtgtattatctcattctcagcattcagcccaacattggtaactaactctccagatttcttccaaaaccagggaacggatctgtagtacagtattgtggtatccattaaaatagtcacaaactcatggacaaaatggaagtagcttttatcaaggctataagctctagagcgttcaaacttttcatcactgattactcccagcaggggtttgggcaaagttggcagcttgagggccctatgctgacggatgtcaagatacgtctcaaatatgaacatgagaatcataaagcaaagcacggcctccaggtaggacagcgccattggagccaagggcggaggcgaggaggatcagagggcaggcggagggagtgggcgcacgcgcggatgcttttgctcgaatccggtgctcggaaggaaggaaggaaggaagttatgaattggcgtcctcaatggtgcagtcacgcagttatcaacttggcagttggcacttggcagtgaagccaaatatgccgcggcctgcggcttggctctgcgctctgtacgaagcgtccgcagcacgaatcctgtcctcactggactggatccgaaccctgatggcgtatgggggcatggggccgtgggtaccattggattagtgttgggcctgcgtgaccattttgccgtggctacaaaactagcccacaacgaaccagtggcgtatatggatcatgttgggccgacaccccacagttatcgtcttgctccgaaagtcgctagctggaccgatgtgtgtgctacaaagcataatgacgtgatgcgttcgtcagtgtcgatgaaatggtgtgttccttgaggaatggtggatagtggctgctgggctggttagctgcacgcctgctttctctactcactgtggcagagatagaagcgccagagagaagaagtgcaaccgatgaaataagggcccccttttatagatggatcggacagtccaatagtcacctccatatatatgtgatgtgatcaatctactattaatcttcctccaatccaaacatttaacgtccattttctatgccaccatggaccgtcctgctattctagttctagatctgaactgctattctagttctacagctgtgggtgcaaagtcaggcagacgccacattcttcctgcaggcatgca

SEQ ID NO: 20810 - DNA, 1759 bp, Zea mays
gagaaggaagaagctcaggcgaagcgaggcagagggatgtcgtgacgacgaaaccgaagccgagaacggaagcgagccttacatatacccggccccgtcccagtgccctcggcttccgccccagataccaaaccctaaccttagtcggccgttccgcaggcccgccggcggcgacgccttgtgtgccgcgtccgtgattctcttgcacagggaagcgtttggaaggggactccctgcctagtgcactggccgcagcgacgcgcggccgaggcgcggatcggggaggggaggacggctgtggcgagatggcgggtgacgtcgcgacctcgccagccccggcgccgctgtccgtgtcctcatcgtcgcagaaccaccaccaccacggccccacgaccgcccgcggtctcctctgccacgccggcgccggtgcctccgctggtgtggtggcggcgacgttcgtgtgcccactcgatgtcatcaagaccaggttccaggtccacggctggcccaagcttgccacaggtagtgtaattattgggagcttgcagcagattgctcaacaagaaggtttccggggaatgtatcgcggcctatccccaactattctggcactcttgcctaactgggcggtttactttactgtgtatgagcagcttaaaagttttctttcttccaacgatggaagccatcaactttctttaggggcaaatgttgttgctgcatcatgtgctggagctgcaacaactattgtaacaaatccactttgggttgtgaagacaagatttcagacccaaggaattagagccgggccaatcccgtataaaggtacacttgctgccttgagaagaatagcacatgaagaaggcatccgagggctatacagtggcctggtccctgccttggctggtatcagtcacgttgctattcagttccctgtgtacgagaagataaaagcttatctggctgagcgagataatactactgtagaagcattgagttttggtgatgtcgctgttgcttcgtctctggctaaagtagctgcgtcaacattgacatatcctcatgaggttgttcgatcaaggctgcaagaccagcgagcaaactctgatgccagatacaaaggtgtaatagactgtgtcagaaaggtttatcataaagagggtgtggctggcttctaccgtggatgtgccacaaatctgttgcggacgacccctgctgcagtgataactttcactagcttcgagatgatccataggtcccttcttgatctattccctgctgaacctgaacctcacatccaacctctaaagcattgaccatacaacatttgtaccctatccatgcggcagattaggaccccagtaaccatccagcaacagcaatgttgtttactgtgccagatggctcttgtaaaagagagaattgtttttttccccagataatagctgccattcaaaagttgaaacaatagtgtaggcagagcattagcatctgtgtacgtaatagatttgttagcatgcatttggggtggaggtatatgagcgatgttgggtattttttatgatgatgacgaaaagaaaaatgttacgacatatgaaggaatgattactatattcttttccacaaaaaaaaaaaaaagatcgtgattcgtgaatccgtgattctcaggcctataatatattgtggcaatttgccggagtctgatacattggctttacttctggttagtgttaagtgtgattatatggaaggactagca

SEQ ID NO: 20811 - DNA, 1504 bp, Zea mays
cgggttccaggacacggatggcccaagcttacccaggcacaattggaggcagtgtaattattgggtgcggcccccggattgctcaacgggaaggttttcggggcatgtaccgtggcctctccccaactgttctagcgctcttgcctaactgggcggtctactttactgtgtatgagcagcttaaaagcttactttcttccaatgatggaagtcatcaactttctttaggggcaaatgttgttgctgcatcatgtgctggtgctgcgcaacaactactgtaacaaatccactttgggttgttaagacaagatttcagactcaaggaataagagccgggccaatggccatataaaggtacacttgctgccttgcgaagaatagcacatgaagaaggcatccgaggactatacagtggtctggtccctgccttggctggtatcagtcatgttgctattcagttccctgcatacgagaagataaaagcttatctggctgagcgagataatactactgtagaagcattgagttttggtgatgttgctgttgcgtcgtctctggctaaagtagctgcatcaacattgacatatcctcatgaggttgttcggtcaaggctgcaagaccagcgagcgcactctgatgctagatacaagggtgtagtagactgcatcagaaaggtttatcataaagagggtgtggctggcttctacagtggatgcgccacaaatctattgcggacgacccctgccgcagtgataacattcactagcttcgagatgatccacaggttccttcttgatctattccctgctgaatctgaaccgcacatccaacctctcaagcattgatcatacaacatttgtaccctatccatgctgccattcgagtttaggaccccagcaaccatccagcaatgttgtttactgtgccagatggctgttgtaaaagagagaattgtttttttcccggatatgcaacagtaattcggaagttcaaacaatagtgttggctgagcattagcaacttgtatgtaatagatttgttagcatgcatttgcgggaggtatattgggtatgttttcttgatgatgatgaaaagaaaacaatcttaccacatatgaaagaatgattgctatatttttttcccacacctatgagctgtgaagccgccattctcatgcctacaatatcttgtggtaatttgctggagtttgtgataatagtgatttcctgggccgttgttgggctgtatcaggcactccagttcctaggcttcttataatcttattggtcggaagagaatttcgtaacttatttttaatcatgttttaaaataaccaacttagaaaaatatttttaaaactaaccttttgatcgtaccaaacgtgctagcgcgatgggaccatatgctgtcgcacggtttgccacgataggttcatcagcgttgcgtcctttgagagaaccgtgcatctctcctatgagcagcacaatgatcaagacagcgatca

SEQ ID NO: 20812 - DNA, 1727 bp, Zea mays
gagcacccagatgcgcacaagccttgagcacgctcgatagcaccacggcgtctggcctgaacccatttcccatcatctggtcgaacatcctcagtgcctcactgaactccccagcacggatgcaagcgtcgatcattgcgctccaggaaaccaggcccctctcgggcattctgacgaatacctcccgcgcggcctctaggtcgccgcacttgccgtaccctgacaccatcgtgttccaggagaaagcgtccagggaggtggcaccgctagtatcaaacaccctgcgcgcgtcggagagcatgccgagcgcgcagtagagcttgaggaggcagttggtgacgacggggtgtgcgagcgcgccgtgcttgagcgcctgcccatgcgcaagccccgccgcagcgagtcgatcgcagacggcagcggagggggtgcgggagcgggaggaggacgcggcgagggaggcgagcaggagggagaaggtgtagggggtcggcaatgtcgcggcacggatgctggaaaagagagcgagcgcggcggccgcgggggcgccgcggcgcgctagcgcggcgtggagtgggcacccgcgtgtaggagccgaggaaaagccagcagcgccggtggagcggagcccaacgagtgcgcggaggaagcagaggtggcggcggggggtgggcatgagaaacgggtggacaatctgctgctggtcgtgccaagatttgtgccaaatactagaggagatcgacttgatcccagtgtacaagctgaagtgcttccttgacaggacagttgtttccatgggaagcgctggttcatgcaaattaagtacagaagctaggacagttgttttctcgacctgtgttgcaggtcgagtttttagattatcttctgtgctgtttgtagagaattttgaaataaagaatgagatacagaatcggatagagcatctactgaatatatcattacagagagttgctgaagacagcctaatatcagtagacttatatttttgttatttatgatctaatgttccatttcagtactgacaagctcatactgtacagtagtttcagatttatgcatgaaacatttacgatctacctccccttttcggtgtaatatcttacattttttctttgatgactttgcctctcaaaaatctcgatcctccagtaccgaacatgattatttggaactgtgttcatcgtcaaacatcaggtaatgtaaatgttacagtttatacccatcaatctgaggtatcattggggccaaggataacaattgtggtatatactacagaactactcaacaactacaaccaccgctatatatataactaatcaacatgaaaatttgttgcctgtccaagtccagaaggaatcagagagaaacgagaaggacaagaatagaaaaacatggctttcagctcggcgccaagcaatgatcatatttcacaaaatgacctgcgttcttggttttagaatcagtgatcgctcaatcaaataaggctctgccatacattttctctgcgctgacccaaaatggggcgatattatcttcacttagtcacactttatgttcctgtagatcctcctcacaaacaatgtcgatccaagatacccgacggcaccgcatagtgttcctaagccgtggcagaccatcgataccatagtttgtctaccacaagatagcagaagagcttaccgcatagtgttcctaagcctaggcag

SEQ ID NO: 20813 - DNA, 1167 bp, Zea mays
accggccgcgtttttttggaactgtgttcatcgtcaaacatcaggtaatgtaaatgttacagtttatacccatcaatctgaggtatcattggggccaaggataacaattgtggtatatactacagaactactcaacaactacaaccaccgctatatatataactaattcaacatgaaaatttgttgcctgtccaagtccagaagaaatcagagagaaacgaggacaagaatagaaaaacatggctttcagctcggcgccaagcaacgatcatatttcacaaaatgacctgcgttcttggttttagaatcagtgatcgctcaatcaaataaggctctgccatacattttctctgcgctgacccaaaatggggcgatattatcttcacttagtcacactttatgttcctgtagatcctcctcacaaacaatgtcgatccaagatacccgacggcaccgcatagtgttcctaagcctaggcagaacattagagtgtagccgaaatagaagctggtctggaagaatccagacatcttggtcttcatgtggtaataatatatggagtagaggtaaacatacaccgcagtggaagcagcagagaagaatgaagtccattgccagtggtagttctccgcatttagcaagaaatatgtaccgacaattgttacacatatggtgacaatgatgagtatcagaaagaccagcaacatgaacccgtaaacatagtagaccttatagttccagaacgatgtgaagacaaagtacatctcaataaagatactaccaaaaggaagcagtcctcccataagcgcaatgacagatggtgtgaggtaccatttcttctcaggaatagggcgaggaatagtcttcaccctacagggattgtttggagcaccactccaatttctaccaacaacagttcccaaaagtgcaagagggaaagagatgaaggcccacaggatgaaaacaaccaccatcgtaccaaatggtatggcagctaacgatccatagaaaatagcaatagtgttaagcaccaggccaattccaaagcacataaatgggaaaagtgatgctgtcatggccattgccttgatccagtttttccctcctcctcctccgtatggatttaaaacaactgagcaccttatagaactataggtatacaattca

SEQ ID NO: 20814 - DNA, 1136 bp, Zea mays
aagcacataaatgggaaaagtgatgctgtcatgcccattgccttgatccagtttttccctccatgtcgtgagtataatgcacccctgacatatccagagatgaatgaagtaagagcatagcaaacaatgaatgttgtgacaatagctcctcgcccaatgtacagcattccaatgattgccaacaaaatcactagtagaatcagtgctgccaactgtgtaccaataccaacaagagctgaaagaagatctagattgcaaggaggccggaaaacatcaccatgtacaagcttccatccagattcttcattgacatctcgttccagagtttcaatatcatcatcatcacgggcatactttgcataatcatttcttagagtccgcatcagtatcattgacactagtccagtgagaaagataaccatcatgaaagaattgaaaattgagaaccaatgaatctggtgttcaaagaaaggatagtccagatacacatcaaaacggtgagcaaatgttatgtttgttggttcccatttgacagaatatgtcatatccaatgccttgttcacatcaataagctttgggctttcttgagtaagattaacatggataatctgattgccattgtatctgatgacaatattcttgtgcgtgaataggaaatatttgttatcattgtttctgtctgcctctccaacaaaaccccacaaaggcaaatcatcaatgaaaaattcaaaccaatatgagttctcaatcgcatccgacaattgcttagccttgacaagatcgaggtctagcgaacaaattgtggccttatcaacattctttccaaactttatgtcgatctggctgtcaatgagctcattcccaccaaggacctcgccgagtcctccccacttatgcacatggttttctgacgcatggcaaaatgggaggctgtagtagttgtatgtctcctgcggattgttgtacggaccaaccttgttcacccagagcgtcacaggctccgctgcttggtacttgtggtcggagtccgaagcggcggtgaggggtacgaggatgaggagggtgatggcggcgaacgcagcaccggcggcggaggccattgccggatggaatggccggcctcgaggtacccaatg

SEQ ID NO: 20815 - DNA, 2321 bp, Zea mays
cctcgaggccggccgggaccgggttggatggagattacatactcgaatagtcagccagccagccggcttgaacgtgcagttttcccctataaaacggcattggtgcccccagccggcgggccatccaatccaatccaaaccgtcccttgtccctctcttcctcgaaacgcagctatggggactcggccgcggggggtcgtcctcgcgccatgggcggtggtgctggtgctggtgctcgcgcttcgtctggcaggcgcgtcgcatgtgatccaccgcagcctggaggccgaggcggcgccgtcggtcccggcctccattgtcagccccctgctcaggacggggtaccatttccagccgccaatgaactggatcaacgaccccaacgctccgctgtactacaaaggatggtatcacctgttctaccagtacaaccccaagggcgcggtatggggcaacatcgtgtgggcgcactcggtgtcgcgcgacctgatcaactgggtggcgctggagcccgccatctaccccagcatcccgtccgacaagtacggctgctggtcgggctcggcgacgatcctggaggacggcacgccggcgatcctgtacacggggatcgaccggccggacatcaactaccaggtgcaggtgctggcgctccccaaggacgcgtccgacccgctgctccgcgagtgggagaagccggaggagtacaacccggtggcgacgccggcggccggcggcatcaacgcgacgcagttccgcgacccgacgacggcgtggcggcacgcgggggcggggcactggcggatgctggtgggcagcgtgcgcggcgcgcgcgggatggcgctggtgtaccggagccgggacttcaggacgtggaccaaggccaagcacccgctgcactcggcggcgctgacggggatgtgggagtgccccgacttcttcccggtgtccgggccggggctgcaggccggcctcgacacctccgcgcccggaaggaagtacgtgctcaagagcagcctcgacctcacccgctacgactactacaccatcgggtcgtacgacggcggcaaggaccggtactaccccgacgaccccgccggcgactaccaccaccgccgccgctacgactacggcaactactacgcgtccaagacgttctacgaccccgtggagcgccgccgcgtgctgctcgggtgggccaacgagtccgacagcgtccccgacgacaaggccaagggctgggccggcatccatgcgatcccaaggaagatctggctggaccccaccgggaagcagctgctgcagtggcccatccacgaggtcgagaagctcagggggaaggccgtcagtgtggacgccaagctggtcaagcccggcgaccattttgaggtcacaggcatcgcaacttatcaggctgacgtggaggtgagcttcgagctggagctggaggcggggacgagcctgctggagaaggcggaggcgttcgacccggcgtacgacgacgacgcgcagaagctgtgcggagtcaagggcgcggacgccaggggcggcgtggggccattcggcctctgggtgctggcctccgccgacctgcaggagcggacggccgtcttcttcagggtgttcagggacggacacggcaagcccaaggtgctcatgtgcaccgaccccaccaagtcgtctcttagtccggatctgtacaagccgaccttcgcgggcttcgtcgacgccgacatctccagcggcaagatcacccttagaagcttgatcgatcggtccgtggtcgagagcttcggcgcgggaggcaagacgtgcatcctgtcacgggtgtacccgtccatcgccgtcgggaaggacgctcacctctacgttttcaacaacggcgaggtggacgtcacggtgtccggcctgaccgcctgggagatgaagaaaccgctgatgaacggcgcctgaaattgaagggaggaaaaaaaaagtctatccggccgccacgtgactttctttattttcgttcttcttcttcttcgtcaacacacgtctctgccgccaaaggagaaattgattgatttcaacgtacgtatgtgtacgtctgctgccgatcgaaagagaattggattattataaaattgtttgaggccggtccttccattttctcgtccttaattcctctggcatgcaggatcagtgaccgacgacttgtagtttgcttgagcatgttgtttacgctgctagcttcttgttgtacgatacacatatacaacaatatgacacgatgaataaaaaaagcgcccccgttttaaaaaaaaaaaaaaaaatgaggc

SEQ ID NO: 20816 - DNA, 2080 bp, Zea mays
  misc_feature (236)..(236): n is a, c, g, or t
  misc_feature (1016)..(1020): n is a, c, g, or t
tacaaataacaccgatcagtacttggttctcttctcctgtgctccacattataatactgtttgatcagtcctaattggtttcagaaaagctatctcgtactagtgagttagggacgacgatgggcatggcggcgctgttgcttgtgtgggctctgctgcactgcgcaggcacggtgacgatggtgcgggcgtcccacgccgtgtatccggagctccagtcactggaggcggagagnggttgatgagacgtcgcgcaccgggtaccatttccagcctcctaagcactggatcaacgatccaaatggaccaatgtactacaaggggctgtaccacctgttctaccagtacaaccccaagggcgcggtgtggggcaacatcgtgtgggcgcactcggtgtcgaccgacctgatcgactggacggcgctggccccggggatctacccgtcgaggcagttcgacgtgaagggctgctggtcgggctccgcgacggtgctgccgagcggcgtgccggtggtgatgtacacgggcatcgacccggacgagcaccaggtgcagaacgtggcgtaccccaagaacctgtcggacccgttcctccgcgagtgggtgaagcccgactacaaccccatcatcgcccccgacagcggcgtgaacgccagcgccttccgcgacccgaccaccgcctggtacgggcccgaccgccactggcgcctgctggtgggcagcaaggtgggcggcaagggcctggccgtgctgtaccggagccgggacttcaggcgctgggtcaaggcgcaccacccgctccactccggcctcacggggatgtgggagtgcccggacttcttccccgtcgcggtgcacggcggcggccgccactaccgccgcggcgtcgacaccgccgagctgcacgacagggccctggccgaggaggtcaagtacgtgctcaaggtcagcctggacctcacgcgctacgagtactacacggtgggcacctacgaccacgccacggaccgctacannnnngacgccggcttccgcgacaacgactacggcctgcgctacgactacggagacttctacgcgtccaagtccttctacgatccggccaagcgccgccgcgtgctgtggggctgggccaacgagtcggacaccgttcctgatgaccgcaggaagggctgggccgggattcaggcgataccgaggaagctgtggctgtccccgcgcggccggcagctgatccagtggccggtggaggaggtcaaggctctgcgcgccaagcacgtgaacgtcagtgagcaaggtcgtcaagagcgggcagtacttcgaggtcaccggcttcaagtccgtgcagtccgacgtggaggtggagttcgcgatcggcgacctaagcaaggcggagcggttcaaccccaggtggctgaccgacccgcaggcgctgtgcaagaagcggggcgcccgggagacgggcgaggtggggccgttcgggctgtgggtgctggccgctggcgacctcacggagaggacggccgtcttcttcagggtgttccgggccaacagcagcagcagcagcaggctcgtcgtcctcatgtgcaacgaccctactaactccaccttcgaggcgcaggtctacaggcccaccttcgccagcttcgtcaacgtcgacatcgccagaaccaagacgatcgcgctgaggacactgatcgacccctccgtggtggagagcttcggcgcgggcggcaggacgtgcatcctgacgagggtgtaccccaagaaggccctgggcgacaacgcgcacctcttcgtcttcaaccacggcgaggtggacgtcaaggtcaccaggctggacgcctgggagatgaggaccccgaagatgaacgtgccggcgcagtagctagtggtggtagtggtagctcgatctagggaaatggtctagttttgttagagaagcggttctggctcgttttcgctcacgtcgcctctcagattgttctcgatctcatccatcactacattgcaacgaattctaccactctctcggcgcctcccactggtttagcaatgaataaaaattacaggtacaggg

SEQ ID NO: 20817 - DNA, 879 bp, Zea mays
cctccgggaccttccgatcgttctcctttcttctccaacacccgtcgctctcttctccaactcgaagatgtcggccgccaccgccctgcttcatcgaggcccaagacccaatctccgtttttgataaagaaaccaaacagcaacctagcagtcttccttcacttctctgctcccgacctcgtagcgaatcagatcggggggctagggttccggtgcgcctctacagccggacgcgaggctaggctgggcatggagggaatcgtcacggcctgaaagaggtcctggccggagacgacgaacggggctgcagccgccgggaagcgctacaaagtttggacgcctctctggccggtggcataatcgacaagggtggggtcaacactaagcagagttacaagcgtcaagctatccatccgcgaccacgagtctaaccacaacctaaagaacatcgagctggaaggcaattttgaccagatcaagcaagccagcgacttgttgcgtgatctcatcgcaaccatcagcgcaagcatgccagcgaaaaatccatcttctgctgtggcgccagcaggaggaggccgaggcagtggtccggggggcacgagcagcaactacaagacgaagctgtgcgagaacttcttgaagctatgcgagaacttccaacacgactatgtatgagatattatctcttattatgactggatgagatgtgtcttatggctatagatgagacttttgtggtgtaattgatgagactatagatttaaatattgttatgtgattgtgtgtgagatgttttatgtgaaaatatgttgtgatatagttgtttatatatttgttatgttgtggaatgtggtgtaaaataaaaataaaaacattttc

SEQ ID NO: 20818 - DNA, 1136 bp, Zea mays
cattgggtacctccggccgggccttcacttctctgcttccgacctcgtagcgaatcggaccggggggctagggttccggtgcgcctctgcaatcggacgcgaggctaggctgggcatggagggaaccgctgcggcccggaagaggtcccggccggagacggcgaacggggctgccgccgccgggaagcgctccaaagtacgattgggtgcccgtttggcgagggatgtcattttctgcactttgtccctggtggttacccggcagttgcaaaaatgctgaatctaagtagctctgctgtatctgcgccatcaagaactcatgtggatcatgccgctcttaccggtgcctctcatccagcttctacggtcaagacacgcatgtgcaccaagtacaacactacagaaggctgcaagttcggtgataagtgccatttcgctcatagcgaaagagagcttgcgaagccagcctacatgtctcaagaaggacctcctatgggtggtcgatatggacgagctgaacctatgcaaccagctgccatgggccctccagcaggaaactttggtgcctcggcgactgccaagatcagtgtggacgcctctctggccggtggcataatcggcaagggtggggtcaacactaagcagataagtagaattacaggcgtcaagctctccatccgcgaccacgagtctaaccccaacctaaagaacatcgagctggaaggcaattttgaccagatcaagcaagccagcgacttggctgcgtgatctcatcgcaaccatcagcgcaagcatgccagcgaaaaatccatctgctgccgcggcaccagcaggaggaggccgaggcggtggtccagggggcaagagcagcaactacaagacgaagctgtgcgagaacttcttgaagggtgcctgtacttttggtggccggtgccgcttcgcccatggcgagacggagcagcggagaggtgctgcatgagagtcgaggtgctctaggcaatgagatgccgtgtgctccctccttttgctactgtgaattttcgcctggcagcgctaggcggttggactgttgtgttgataaaacgacgtcaatggattgaactctagatttcagctttaaaaaaaaaaaaaaaaaa

SEQ ID NO: 20819 - DNA, 3248 bp, Zea mays
gactttactctaggaagtaatatttttatcctaatctacgaatttaacgttatctttccatcgttcatcctttcttctccaacacccgtcgctctcttctccaactcgaagatgtcggccgccaccgccctgcttcatcgaggcccaagacccgatctctgtttttgataaagaaaccaaacaacaacctagcagtcttccttcacttctctgcttccgacctcgtagcgaatcagatcggggggctagggttccggtgcgcctccacaactggacgcgaggctaggctgggcatggagggaatcgtcacggcctgaaagaggtcccggccggagacgacgaacggggttgcagccgccgggaagcgctacaaaggtgaggcatcgctatcccactagtcctgtccgctatccgcctcgattgttttggttctacttgatgttggttgccctcgctccttgcgagaagtgtttcgtcgactggatttacgtgtgtaccatgggagcagagcgagagtgttctggttggtcatttgattatgcttatgcgcgcaatgagatgcacatccggggtgtttgtggtaggggactggtagtggggcctggagggttagagattttcttgcttgcttcaagtgatgcgtggattggtggaatgatagcttactgccaccaaaattgaaccccctctatacttaggatgttagtctgttactctcttaactttgactactcacttggaccttaaaggctagcgttgtatgtggcttgaagatggatcaaaagaatacaatgaaatctgaaggaatgtatcacagttatatctgctacctatgccgaagctatacacatttttttctagctactgataaaaaacttcaccagtgctaacaggtaaggagcacaataacatattcttatttgagaaacttacccctcttaagtaaaaacattagtactaagtaagtacataatggtgacaaagcctgcgtgttcccaaatatagttaggactacgtgcctcataaaatagtaatgtagtaaaaaatagtttagtactcatagtagagttcagatagtgtgatagtatggggctcatctagatgtatgttgttgaaaagaggaaagttatttagagaagaaatggtaatttgaagcatatatggaagtcaaagcaccttttgcctcttgaatcttgatcgatgtaattggacaattcaccagttcaaccaacaaggagaaatctcccaacctgtatgtgcctcacgacaattttggtacactaaaattagttctagaactaaaagtctggaaacatcatttacatgtattttgttaaaaagagacagttgtagatgtattctgttaaaaagagacagttttttacggaagaaatagtaatctgaagcatatatgggaatgaagccaccttgtggatcttgaatattaataaaaattcaatttggcagttcatcagttcaatgaacaagaagaaacatgcagacacatggtatttatctgtgtagaaaccttatcaatcttttttcgactgtataataactattttctgtaggataactacaatgcaaacttctaacgcatgagaaaatgtaattaattttatgctacagacacagagtcatttcaaactggtctatcaagcaaatcaaagccttgcaccaagtttttcaggttatagtcttaacctacccgaaataacatcagaacggtaacctgtatcttttttcactcttcttacaacaaatcaattatctggaagtttcattttatatgccaaagatatatggaatacttgaatagtaacactaaatcgtgatatataagcttctctgtttcaatatatctcactagatcaacttgctttttcccctctggttacttaattaagatgttagatgagtaccatacatatcgatgttcattccactcttgctttggtgcatttagtatagacatgttacaaggtggtgtttgaattaaatggaaattcttttttagtgttcgaagtatttgtaagagtagattcaaatattattttattatatggtattatgctttgtttatattgttactctaatatgcctgaatatacgatttagatgtttgtgtattttattttatctcatatattgaaagatcagtgtggacgcctctctggccggttgcataatcgacaagggtggggtcaacactaagcagagttacaggcgtcaagctatccatccgcgaccacgagtctaaccccaacctaaagaacatcgagctggaaggcaattttgaccagatcaagcaagccagcgacttgttgcgtgatctcatcgcaaccatcagcgcaagcatgccagcgaaaaatccatcttctgctgtggcgccagcaggaggaggccgaggcagtggtccggggggcacgagcagcaactacaagacgaagctgtgcgagaacttcttgaagctatgcgagaacttccaacacgactatgtatgagatattatctcttattatgactggatgagatgtgtcttatggctatagatgagacttttgtggtgtaattgatgagactatagatttaaatattgttatgtgattgtgtgtgagatgttttatgtgaaaatatgttgtgatatagttgtttatatatttgttatgttgtggaatgtggtgtaaaataaaaataaaaacattttcaaaaaaaaaaaaaaaatccaattaacatcctagaggccaactgggccgtaggaagttagctgttaacttcctagggctatagtcagccgtaggaagttagtcagctgacggcgttgacggcgtgaagctactaactttcgagaacctactaacttccgagaggcttctttggctgtaggaagttagctaacttcctagagggttgtaggaagttaagctaacttccgacaaaaaatttctgagagtcaaacttccgacgggatggcttaacttccgagagtttagctaacttcctagagtttatggctaacttcctagggtttaggttgtaggaagtatactattttggtgtagtgataatctagtttatatgtagttgtttgatagtttagattatataaatgtagattattcataaagacaacaatattcttgtttgtttatttgagctcataaaagaaggatgatatatattgtaaattctatttacataaccattggtaatggatcttttgctaaaataatctcaaataagctacc

SEQ ID NO: 20820 - DNA, 1441 bp, Zea mays
cacgactctcggcaacggatatctcggctctcgcatcgatgaagaacgtagcgaaatgcgatacctggtgtgaattgcagaatcccgcgaaccatcgagtctttgaacgcaagttgcgcccgaggccactcggccgagggcacgccttgggtaccctgcggcccgcccggccttcacttctctgcttccgacctcgtagcgaatcggaccggggggctagggttccggtgcgcctctgcaatcggacgcgaggctaggctgggcatggagggaaccgctgcggcccggaagaggtcccggccggagacggcgaacggggctgccgccgccgggaagcgctccaaagacacggagtcatttcaaactggtctatcaagcaaatcgaagccttgcaccaagtttttcagtacgattgggtgcccgtttggcgagggatgtcattttctgcactttgtccctggtggttacccggcagttgcaaaaatgctgaatctaagtagctctgctgtatctgcgccatcaagaactcatgtggatcatgccgctcttaccggtgcctctcatccagcttctacggtcaagacacgcatgtgcaccaagtacaacactacagaaggctgcaagttcggtgataagtgccatttcgctcatagcgaaagagagcttgcgaagccagcctacatgtctcaagaaggacctcctatgggtggtcgatatggacgagctgaacctatgcaaccagctgccatgggccctccagcaggaaactttggtgcctcggcgactgccaagatcagtgtggacgcctctctggccggtggcataatcggcaagggtggggtcaacactaagcagataagtagaattacaggcgtcaagctctccatccgcgaccacgagtctaaccccaacctaaagaacatcgagctggaaggcaattttgaccagatcaagcaagccagcgacttggtgcgtgatctcatcgcaaccatcagcgcaagcatgccagcgaaaaatccatctgctgccgcggcaccagcaggaggaggccgaggcggtggtccagggggcaagagcagcaactacaagacgaagctgtgcgagaacttcttgaagggtgcctgtacttttggtgaccggtgccacttcgcccatggcgagacggagcagcggagaggtgctgcatgagagtcgaggtgctctaggcaatgagatgccatgtgctccctccttttgctactgtgaattttcgccttgcagcgctaggcggttggactgttgtgttgtgttgcgacgtcaatggattaaactctagatttcagctttctttttttaacatataagttcgagaaaacgttaaactgtcgtgcagcttgcattttgttggtcggtaagctagcagctggcctcccctggacaaacctgtgtgacaaaaaaaaaa

SEQ ID NO: 20821 - DNA, 537 bp, Zea mays
  misc_feature (1)..(1): n is a, c, g, or t
nccccgtggtgctcatgtgcaccgaccccaccaagtcatctctggacgcgaacctgtaccagccgacgttcgcaggttttgtcgacacagacatttcgaacgggaagatatctctcagaaccctgatcgaccggtcggtggtggagagctttggagccgggggcaggacctgcatcctgtcgagggtgtacccgtcgctcgccatcggcagcaaggctcgcctctacgtgttcaacaacgggagggcggacgtcagggtgtcccgtctcaccgcgtgggagatgaagaagccactcatgaacggcgcttgaaatgtttttattgcgtgatatggaatggtgctcgcctttgtacaatatggtatggctagatacatatatatgagagcttccacgctcggtcgtcgtgtggaaaaaacctatgatgagtgtgtacgatcttagggatgttcgattcagatgccactacacgggcaataactatatcctaattcatggtttcacgaaaaaaaaaaaaaaaaatggacactctgtttcc

SEQ ID NO: 20822 - DNA, 2052 bp, Zea mays
ctcgcggcccggccgggatccttctagcttcgatctctatatacctctgtatgtgagtgaggccaatgagagccctcgtagtcgtaagtttcgcttcggcgtgcttgctgctgctgttgcagctcgcaggagcgtcgcatgtcgtctacaactacaaggacctcgaagccgaggctgctgcggcgacggaccaggtgccgccgtccatcgtcaaccccctgctcaggacggggtaccacttccagccccccaagaactggatcaatgatcccaacgcgcccatgtactacaaggggtggtaccatttcttctaccaatacaatcccaagggcgccgtatggggcaacatcgtgtgggcgcactcggtgtcgcgagacctcatcaactgggtggcgctagagccggcgctcagaccaagcatcccgggcgacaggtacggctgctggtccgggtcggcgacggtgctgcccgacggcggcggcccggtgatcatgtacacgggcgtggaccacccggacatcaactaccaggtccagaacgtggcgtacccgaagaacgtgtcggacccgctgctccgggagtgggtgaagccctcgcacaaccccgtcatcgtccccgagggcggcatcaacgcgacgcagttccgcgacccgaccacggcctggcgcggccccggccccgagcagtggcggctgctcgtcggcagcgcggcggggtcgtcgccccgcggcgtggcgtacgtgtaccgcagccgcgacttccggcggtggaggcgggtgcggcggccgctgcactcggcgcccacggggatgtgggagtgccccgacttctacccggtgagcaagggcggcgcgccgcgcgcggggctcgagacgtccgtgccgcccggcccaagggtgaagcacgtgctcaagaacagcctcgacctccggcggtacgactactacaccgtgggcacgtaccacccgtgggccgagcggtacgtgccggacgaccccgccggcgacgagcaccgcctgcgctacgactacggcaacttctacgcgtccaagacgttctacgacccggccaagcggcgccgcatcctgtggggctgggctaacgagtccgacaccgccgccgacgatgtggctaaaggctgggctggaatccaggcgattccaaggacggtgtggctggaccccagcgggaagcagctgctgcagtggcctatcgaggaggtggaggcgctgagagcaaagtcggtcactctcaagaacaggttaatcaaggcaggacatcacgtcgaggtgaccgggatacaaacggcacaggctgacgtggaggtgagcttcgaggtgtcgccggcggccctggccggtgccgagacgctggacccggcgctggcctacgacgcggagaagctgtgcggcgtgaagcgcgcggacgtgaggggcggcgtggggccgttcgggctgtgggtgctggcctccgccaaccgcaaggagagaaccgccgtgttcttcagggtgttcaagcccgccgccggcagcgacaagcccgtggtgctcatgtgcaccgaccctaccaagtcgtccctgaacccgaacctgtaccgcccgacatttgcaggatttgtcgacacggacatctcgaacggcaagatatccctgagaagcctgatcgaccggtcggtcgttgagagcttcggagccgggggcaagacctgcatcctctccagggtctacccgtcgctggccatcggcaaggacgctcgcctctacgtgttcaacaacgggagggcgcacgtcaaggtgtcccgtctcaccgcgtgggagatgaagaagccggtcatgaacggggcctgaagatcttgaataaatatatcacccatgcatgacatagtggcgcctgaggaatctttcctttttttatatatatattttagatatatcgtttaagaattcattttctacactaaaagggcgccccgttatgttacaatggtaccagctgcacttctagtaacaaagacaattgactatttgttgttcaaaaaaaaaaaaaaaaaaa

SEQ ID NO: 20823 - DNA, 2064 bp, Zea mays
atccttctagctggcaccagtatatacctctgtatgtgagtgaggccaatgagagccctcgtagtcgtaagtttcgcttcggcgtgcttgctgctgctgttgcagctcgcaggagcgtcgcatgtcgtctacaactacaaggacctcgaagccgaggctgctgcggcgacggaccaggtgccgccgtccatcgtcaaccccctgctcaggacggggtaccacttccagccccccaagaactggatcaatgatcccaacgcgcccatgtactacaaggggtggtaccatttcttctaccaatacaatcccaagggcgccgtatggggcaacatcgtgtgggcgcactcggtgtcgcgagacctcatcaactgggtggcgctagagccggcgctcagaccaagcatcccgggcgacaggtacggctgctggtccgggtcggcgacggtgctgcccgacggcggcggcccggtgatcatgtacacgggcgtggaccacccggacatcaactaccaggtccagaacgtggcgtacccgaagaacgtgtcggacccgctgctccgggagtgggtgaagccctcgcacaaccccgtcatcgtccccgagggcggcatcaacgcgacgcagttccgcgacccgaccacggcctggcgcggccccggccccgagcagtggcggctgctcgtcggcagcgcggcggggtcgtcgccgccccgcggcgtggcgtacgtgtaccgcagccgcgacttccggcggtggaggcgggtgcggcggccgctgcactcggcgcccacggggatgtgggagtgccccgacttctacccggtgagcaagggcggcgcgccgcgcgcggggctcgagacgtccgtgccgcccggcccaagggtgaagcacgtgctcaagaacagcctcgacctccggcggtacgactactacaccgtgggcacgtaccacccgagggccgagcggtacgtgccggacgaccccgccggcgacgagcaccgcctgcgctacgactacggcaacttctacgcgtccaagacgttctacgacccggccaagcggcgccgcatcctgtggggctgggctaacgagtccgacaccgccgccgacgatgtggccaaaggctgggctggaatccaggccattccaaggacggtgtggctggaccccagcgggaagcagctgttgcagtggcctatcgaggaggtggaggcgctgagagcaaagtcggtcactctcaagaacagggtaatcaaggcaggacatcacgtcgaggtgaccgggatacagacggcacaggctgacgtggaggtgagcttcgaggtgtcgccgtcggccctggccggtgccgagacgctggacccggcgctggcctacgacgcggagaggctgtgcggcgtgaagcgcgcggacgtgaggggcggcgtggggccgttcgggctgtgggtgctggcctccgccaaccgcaaggagagaaccgcggtgttcttcagggtgttcaagcccgccgccggcgacaagcccgtggtgctcatgtgcaccgaccctaccaagtcgtcccagaacccgaacctgtaccgcccgacatttgcaggatttgtcgacacggacatctcgaacggcaagatatccctgagaagcctgatcgaccgatcggtcgttgagagcttcggagccgggggcaagacctgcatcctctccagggtctacccgtcgctggccatcggcaaggacgctcgcctctacgtgttcaacaacgggagggcgcacgtcaaggtgtcccgtctcaccgcgtgggagatgaagaagccggtcatgaacggggcctgaagatcttgaataaaaaatatatcacccatgcatgacatatagtggcgcctgaggaatctttcctttttttttaaacatattttagatgtcgtttattaagagttgattctccatactaaagggcgccccgttatatgttacaatggtaccagctgcacttctagtaacaaagacaaattgactatttgttgttcaaaaaaaaaaaaaaaaaactagagggggggcccggtaccc

SEQ ID NO: 20824 - DNA, 1392 bp, Zea mays
tcattcaatgacactccatcagccatattctggacggattacgtggccactagatggtatcgagctccagaattatgtggctcctttttttcaaagtacactcctgccattgatatttggagcgtagggtgtatatttgctgaattgctcacagggaagccactctttccagggaagaatgttgtgcatcagttggatcttatgactgatctacttggtacaccttcagcagagtctatctccaagataaggaatgagaaagctcgacgatacatgaacaatatgaggaaaaagcctcgggttccctttactaaaaagtttccagggatagatcctatggctctccatttgcttgaacgtcttcttgcttttgatcctaaggaacgaccaagtgctgctgaggccctggcagatccatactttaatggattagcaaataatgaacgtgaacccatagcacaacctatctcaaaacttgaatttgagtttgagaagcggaaactggccaaagatgatgtccgagaattgatttaccgagagattttggagtaccatcctcaaatgctacaagaatacctacaaggagcagaccacaatcagatgaccttcatgtatccaagtggggtggatcgcttcaggcgccaatttgctcatttggaagaaggtactgcaaagggtgaaaaacacagtccacagctgcgacagaatgtttctttgccaagggaaagagtaattggcaataaacatggagatggcaatacaggtgataagctagcgcatgcctcagtgacggatggcatcagccaaccgagcttgagtgagagaagctttctgaagagtgaaagcatcagtgcttccaagtgtataggtgaaaaaccgaagcatgtcaaagatggagaatctgttttagagagcgtggatgaaacagtcgatgatttgtcgaagaaaattcctcaactgaaaacctgatttttctcaagttcactggagcaatgaatagctcgtagtatggcacgttaggttctcaagacgatggacctacggcaaaggtctatagccaatgagaccacaagttctaatgccagtaattctgttgtgatgtaaatttcctcccatttgtgtttgtacttcgcgactgcaaacaacctgtttctgactaaatggctcgtgttttcctccgtggagccatcaccatattctgtaaattttcagttggaagtgaatcttcagctgcagaggcatatttgattttcccccagcaagtaggcctaggcattcagttaattctgtaaagttggttatggaaattttcagttttgacaaaatgttaactgaatttgctaccaaatactccattctaaatcacaagacattttgatttaaaaaaaacca

SEQ ID NO: 20825 - DNA, 3573 bp, Zea mays
aaaaaaaaggaattgttatcattaacagttcaatctgcacagcggatgcaactgagccatccttcttactgttcaactttcatattcagcaaagccaacggaatcatttacatcctttacctcgttgacttcttaacaaatgaattatatctgagatgactgcctcccacttaacaaattgggcaaacagccacccctgttctagcaccaattttgctgtacatgctaaagggatgcaatataaaataaaaaacaaaagaaacaatctccacctttcaccattctgattaaaatgacatgctatgaaatttacagctgctttcactaccacatgcatcaacaagaccatcttcagccaatccaaggcaaacctaaggacaagctcttcttttctcaacccacagaaaggtggttccaaaaaagaaggtaactggagtatttacatcatgcaggaacaccttcaaactgatagctggtaccaaggagctgttacttcagtcgaaaatcacgtctaaatgctgtcaggttttgagtgaatctgtcacgattcttaggttccaagttcctattgacatccgtcatcagcttatcgaagcactgtgaaaggcgttgttgctggtccacagtctgtgatgctaatatgtgcgctctgagttcactgaacatctgttcactggtcattatcaggctcagtattggtcgactcagactccactgattaccagcatcctcaaagagcatgatctcaaaaagagtcttcagtatctgaggaaacaaattgggacactctccaatatgtcgtgcgagatttactgaagctggtgatggaggtgagtcaccagatgtaatgttattaaagtaaaaggctgccaggttgtcgatggcagaagcgcactgtgatgatatccctgcatctagaccttttaagccagattcgagtgagctgacaatatgtatgaatgtgtttgtgtccaaattgagaacaaacttgatatggttgttgaacagaacttccatatacccaaagtacgctttcgacagctttttgaatgccaatatatcagataatggaactgagagggtcatcttcagagatatatcaagggcatcagcaagtgctctgtcaccatagagctcaaatacgccaaaattgacataattcccacacaaagcccttgaaagaacagtcagtgagatccatatgcctttgtatttacttccataaatgtctgtgccattaggaagcaatagaattcgtgacccgtaagccacgattatcttgctaacctctcggaataaaaggatcccatttggtgatgatgaatcaaatgtcagtctttgagctttgttcaaaacaaattcatacgtgaacttgagcaagggtgtggtgacctctggttcatcagtgcaaagtgagatggctctcagcagaagtggcatgcgagatggatacaaccagtcaaataggaggccatatgtcttgcggctgttggttgccatagctatgccacgtagatctctcatccaaccaacaaatgcacgcttagcgacatcagtccgaaaagcagcatcaggagttgcctccaggtttaatgcaacctgttgaagtggttccatgaaagtcctgaatttcacagggctatcttccatgaagactaaggagccaaggatgtaatagaacgtagttctactacgtgaacatttgtattctgcaagaaatgggaaattctctggagaatgatttgcaatgatgaattttacactctccagcttaagcagcagctttccagtcatatagccagttgccaagtcaaggaacagggacagagtatgatcaataacatcctcactctcagcatagcacttcatatttgtagcaattttgccaacaatcacattgagtagaattaaatggtcattaagtcctagaagctcagacaatcttccatacaactttgaagaatgcatagcttggtctcctacatatgaccttctgaaactttgtacaaaaatgagaatagctcggtcaagcctttgcttacttaattcttgatatctctgtgtgtgcgctcctgtatcagtcacacttatcaactgtagtacacgggcagagagttctgcgtcaatcaactcttgtgtttcttgactaacacctgttacctgcctaactttgacaatggccgcaattatgtgaaccatccatgcaatttggccttcaatgacagacagctcatcagcatcaccaggagcgggtaatctggacctttccgtataagcttgcagaagaggttccatgatgtttatgatgtacagactactactttggtactggaatctgcaaaggaaaggaagaaactccagctggtcctggagaacttccaccactatcacaaaggattttccagtgagttgtcagcaaggatggcctgaacagaattaattctggaagtgataaaaccttctgtgatcttgggaacagtttcatcaagaagacttggtgtttcacctttcaagtaaggcacggatgtcaccagccttgaccaaagacttagaaggtagtagacactgttgctggcccactgccatgacaacaaggatctagttgtaaattcagctactagaccaatccactcaccataaaactcaacattcaaaagctctgccagctggtaattcactttgaaacgtcccaaagacggcagaactcatggtaattgtcatgatcagcaagtccttggccagttagaagtatctccttggtgcctagcatcagatgagaaagaaactgggaccttgcaggatcctccacaaaaatactgcgcctgacagaagcaagtcgaaccagacactccaaggcctcttttgaaacccgtatgtcattgactttgtagtaatcaaaaaagatttggagtgtggaaggatcttgaagaagaggcctccaagatgcaggaagctgcactgttccaaattcttcagagctttcgtccaccggagaaccaacaaagtcaaaagataagcacttcaaggcaaggtcaagaggaatatgtccaaagtcatccggagcttcactcttcagttggtttagtgaggttaacgaaatttggaagatctgcagaagaaactgatccttgaatgaacccgcaattttcctatgaagcgtcaaaggcatcgcggggtttggctgattcatttctgtaacgagattgtttagtatcttcaagcctatgaaataatgatcctgggaagcaagacctaaaaaatcagtcgcttccttgacagtctctctgaatctgtcatcatcaaaccatccaaattttgtaattcgacagaccagctgaattaaggacacaatgacaaagttctgcaatttaggcccccttgtgccaagatagtttatgacataattccgtatatcgagacggagcatcaaagaaagactgcggtcagaaacttgcttcagcaagcttgaactcgccagcatcagggcatatggagttgaggcattgtccaatatgtattggcactgcgaaatgtactcgctgttctctgagaagcacttgagggtgctttctg

SEQ ID NO: 20826 - DNA, 1662 bp, Zea mays
atagatgtttaatgtatataggaaaaaaatgagatattgaaaaaaatattttacgcgaggacggataggacattcggcgttcctagtcgtaccccgcagcttccgtgctcacctcgcctgcagggcagcagccgctggaagaacacgaagacgacgggagtgcggggtggcgtcgccgccggagcaccagttgtagccggcggctaggcctccgcgccgctctccgtggccaacgtgccgtcatgcttgcggcgtcggcgcggcggctgtccgccgccgcctcgttttcctcttcttccatgcgctccagccagctcgccgccgtactgaaccaacagaggtggatgcacgacaggaacaagaaggcgatggagctggtggccaagggatggagtgcgctccaggaggtcgaccgcgtcatcgactacgccgatctcaacgacaagcgcctcatcccgcttctaaggggcgctaaggaaaactttgagctggctttggagattgacaatggtaatacacatgcgaggtattggctgggaaaaatgcatttcaagtatcatgttcctggtgcttgcaaggcagttggtgctgctttgttggttgaagctgcaaatatgggtgatccagatgcacagtatgaacttggatgtcgactaagaattgagaatgactatgttcagtcggatcaacaggctttccattacattgagcaagctgttgatcagctgcaccctggtgctttatatcttctcggtgctgtatatctaactggggactgtgttaagagagatatggcttccgcgttgtggtgttttcatagagcttcagaaaagggacatgctggtgcagctatcgcatatggatccttgcttcttaaaggtgctgaaatacctgaagttattacaaggttcaactcaggcaagagtccatcaactgggaaaatgcggaaaaggacccaacagcaggatccagtaaagctagcgaaagaacagtttcaaattgcagctgaggcaggctgtgatctcggtctgcggtggttgaagaggcttgaagcttatgaaaaccaagaagaaaagctaaagcaggttcagcaatgatatccactgaaagaatcccattgcatttgtcgcatacaagtatggtatatggcagcatggttgctgcacataggtataccaataatttcctttcctgccttcattatgttggaggctattcgatcctcggatgttcgggtcaactttgcaggaagatatactgaaatttggatatttagactaacttcttggattataggcgattggatgttcactttgtacgatgtattagcgttgacattactggaagccctaattgtgagaagtagaaacatatcatgtgtgttgctacgggcattatggatgatttagaataaaattagactatataactacttatacgaaggaataaattgtggcatatgatgatgtggataacaaaaaaaaaaaaaaaaaaaaaaaaaaaaaaaaaaataaaaataaaaaaaaaaaaaaaaaaatttaaaaaaaaaaaaaaaaaaaaaaaaatatatattaggggggcccccccccatttgtggtttctccccccgaatattaatccgggcccgggccccggggggttcccatttttttttatgggggg

SEQ ID NO: 20827 - DNA, 1986 bp, Zea mays
  misc_feature (1952)..(1952): n is a, c, g, or t
aatattattcaagattacgtccgctgactcctcaggcctcccactgcgtgtggggccgagccagcttgctccatcaagccgagagcccactcttctttctcacctcgcatcgcactccctcaatctctcgtctctatcgccgcatcgcttctctgccggagctccaacaacctcgcctcgcgcagcactccgctgaccctccctgactccctccctgccgctgggatggccgggaaacgagttacgggccgcgatgggcaagacgagggcggcgccaaggtcgggctcccggcgatggacctctccctcgcgttcccgcaggccacacctgcctccattttcccgccgtccgcttcggattattaccagtctgatgatttgctgaccagtgaagagcgctctatcaggatgaaggtcaggggtattatggaaaaagaaattgctcccattatgtcagcgtactgggaaaaggcagagtttccatttaatgccattcctaaacttgcaagccttggtgttgctggtggtacaataaagggttatgggtgcccaggactttccattacagccagtgctgttactatgtcagaaattgcacgggtagatgcaagctgttccacatttatactggtgcactcctctcttgcgatggtgacaatagctctttgcggatccgaggctcagaagcagaagtacttgccatcccttgctcaacttactactgttggctgttgggcattgacagagccaaattatggaagtgatgcgagctctttgagaaccctagcgaccaaggcacctggtgggtggcacatagatggtcaaaaacgctggatcggtaacagtactttcgccgatgtcctcgtcgtgttagccaggaatgcagacacgcaacagctaaatgggttcattgtgcggaaaggagctcctggcctgaaagctacaaagatcgagaacaaaattggcctcaggatggttcagaacggtgacatagttttgaacaaggtgttcgtccctgacgaagaccggttgccaggcatcaactcgtttcaggacatcagcaaggtgctcgccatttcacgcattatggtggcatggcaaccggttggcatatcaatgggggtcttcgacatgtgccaccggtatctgaaagaaaggaagcagttcggagtccctctggcggcgtttcagctgaaccaagagaagctcgcccggatgctcggtaacgtccagtcgatggtcctcgtcggctggcgtctctgcaagctctacgagtcggggaaaatgacgccgggccacgctagcctagggaaggcttggaactccaggacggcccgcgaggtggtctcccttggccgagagctgctgggtgggaacgggattttggccgacttccttgtagccaaggcgttctgcgacctggagcccatctactcgtacgagggcacgtacgacatcaacagcctggtgaccggcagggaggtcaccgggatcgcgagcttcaggcccgccgcgccagcgaaagcccggctgtgacgtgataacctgtgtccccgtgttgcagggaactggaggcgaataaatcatgatcaggtcgtcgtcgtcgtcgccatcgaacaaactgagcacgttcctggaacccgcccggtcaacgttggctgctcacatggtgtaccgtagccgagtgcggatgggaacggattcctagatatatgtagtactatacgaagatatctgttgcgggtggattactgtaaaccgggtctaatctctgttgcggtgtttgccgtctttggtcagaaggtaaggggggaacgccaggcagatctggtgggtttggttgttgttgttgtcgtgttgggtgggtagcatgcgagtgtggaggcctcgaccaatgaataaaacatggtgccgtttgggcggtagtacgtaagatattccttctccctctncctctctgacgggtggtgctccctcctgtcttga

SEQ ID NO: 20828 - DNA, 1030 bp, Zea mays
ccgccgggccggagtcgtcaccaaacagcgccgcgctccgcattgcgctagggttttagaactcttcctccggtcctccccgttatccctccaaaaggcagcgcccgctagggttttagccgccgcctccttccctctcctcctccacgtctcctcaacagccgctgccacccggagccttcccgcagcgacgccatgtgggctcttcgccgagctggcaaccccctcaggttccgtgcccaaaaagttgcaagtgcccatgtctgtgcgagtcttgaggtgctgctagctgctgatgcaaagaatgtagaagagcaccatgaggcagactgccagaaaatgtgctgctgtcataaaccaaggtcaccagcctttcaattgtcattttcatctggccagtttgcttgcagtaggggtttctcctctcagccaggtgcaaattctggtgacaaagctgatgagttagaggacggattttctgatctcgaggttccaccagcagctgttcaaaacgatgacgggttggcatctgaagatagttctgatgaggatgctgctgacgaatttggcttgcctgatgtggatgctgatgcaaaacctgagaaggagcacactagaagattatctgattctattctcctcaagacattatctgattctattctcctcaagactgtgttggaagctccgaggcatcaagtcacttcagcacttgagaaatgggcaaaggatggcaatgcatttgataggggtgaactctattatgttcttcttaatcttcgaaagcggcattggtactccaaagccttggagcttgttgagtgggttcaaaaatcacagctattcgaatttgtagagcgtgattatgctgcacatcttgatttaacagctaaggtctatggtcttcataaagcagaacagactattgagaaaattcctgcatcttttaggggtgagattgcttatagaacacttttggccaattgtgtttctgcatccaatataaaaaaatcggagcaagtttttaata

SEQ ID NO: 20829 - DNA, 2928 bp, Zea mays
tttttttttttttttttttctgatcagagaacgagatgatagttgccttgttgcagtaaactcggacaatagcaagagaacaaaattctgataacaattttttaaaaaaaaaatctacaactagcaatactgctacaaatctggaccagtttagacctcggaccacaagttacggctaagtgctacagttatcttcggaaccttgtctgttcaaggaagtggcgggttggagccttatagaagcatcaccgcagatggccgtcaagacatcaaactctcctcacgttgtctccatggataaccaccgcgccttcagtcatcagggtgccaagagcaccgcggagttcgtgcatatgaatttccattgagctctgcttcctcagttcctccagcaactcaatcatgcgcatcgaggggcctccaagctgcattttctccgcaatcaggttacgggttgcggcaacgaggttctcccgcctctgcctttcgcttgcggatatccccgtcatgatcagatccatatcaatcgtaccagttgcatgatccgtcgcagactgctgcatggcgacttcaagaagcctgaatgcctccacaacatcccgcacctcgaccacttcagagaaccgcattcgggctaatgcttcgctgagacggatcaaactctctatttgtctagcggttgctgttatgaccttctttctgctcccagggctattccctctttttctcatctcgacatagccacgagttaactcttctgcagcttcatcagataactgtggctgaatatacttccttgcatagcttatgtaggaaactagtgtctgcaagtccaagacctcgagctcctctaaatttggattctcaaaatgcaacgaaacaatatgctttgccaggcgcctatcagtttgctcatccgccttgtccaagataagataaatcaggtcgaatcttgaaagtagcgttggcgctaagtggatgttgtcaattacagagagccttggattgtaacgtgattcagtaggattggcacatgccaggacagatgtcctagcgtttaaagatgcaattattccagccttcgcaatggatactgtctgctgttccatcacctcgtgtaacatgcttcgggcattatcagacatcttatcaaactcatctatgcaacaaacacctttgtcactcaaaacaagtgctccactttctagaacagtttcgccagtctcagggtctttggtgacatatgcagtaagaccaacagcagaacttcctctgccactcgtatagataccacgaggagacagtttatgcatgtactggagaagctgggatttacttgttccagggtcccccacaagtaaaatattgatgtcaccccggaaactagctccagaaggaagcttcaagggattgccgccgaaaagctggcaaaggagacctcttttgacatcatccaactcccatatgtttggagctaatgatctagtcaatctttcatagatatcaggcaactttgaaagctcttttagtttctcaaccttatcactaagaaaatcctcttcagtagatttgctagcgttagaattatcaatatccatggtgtcctccacatgaagcctagacttgtctgtcttctttatgtgaaggcaatcaatatatgtcttgaatatagacttcactgtcctttgagttggtccaattcgaatactcatagctctgtatattccagttatctcaaccctatctccaggctttccagcatcaacaagcttatcatgcatcaagacactaactgtatgtggagtgccaccttctggtatctcgtctggtgtttcctgcaactttatgatctgcttgtctgaaaatctgcatctgttgtgcactagggtcatagaatttgtggctttacattgttctttctgacaaatgtgtggttcagttactcttcctctatcaaccatgacgggctctgagtagaaaccacaaaccaggcagcggaacacagcctccttgagctccggtatgaccgagctgcatctaattatcatacccttgatggataccatcttctcaatatcagatgggttgagattcctcaagcaaatggacgacttgaggttgtagatcctggtctggatgtgcttctcgaagagcggctcgatgcgcgcgacgaggtccatgagcacgatgtcgaagatggcgagcacctcgagcggatagcgaaccatcttgctgtagaggtctgggtcgtggtcaaacacgtcgtgcgcatcgacgtcgagcgactccccgccctcgagctcgaggatgcggtggatggcgcgcatgtacttgccctcgtccatgaccgggtcgacgcggccagcgtcgcgcgggtcccggaagtggcgcaagaaccggagaatggcggcgttgacgtcctgcacgcttatgttggtgccccagacgaagaccggggtggcgtcgacgccgccgccgccgtcggtctcgtcgtccccagcttcggaggatggagggacgtcatcggtggacattggagtggagggcgtcggcgggaaccggccagtcgagttctgacgcggctgccgaggggcgccagccccagctccggacggcgtgcggcggccagggtgcggcggcgtctcgaaccccccgagagaaggggacgaagcataaggactagcggaaccacggcgacggcgaccgccggagcggcgtgtgggctgagatggggaggagttagtaaccgcgagtgggcttgacggccgaccatagggcgacgatgcgggaggaggggagctgccgccgccgtcagaagccatgtcttggtcgcacagacaatcactcgggatggcagataggtagtgagagaggaggtggtggtgggatatgggaagggtgggatgggatccggccggccgcgagggt

SEQ ID NO: 20830 - DNA, 1998 bp, Zea mays
  misc_feature (20)..(21): n is a, c, g, or t
ttttttttttttttttgtgnnaatgctgccggtgctcgcacatatagatgatagaacacggcatgatactgatcacagaacgagatgatagttgcattgttgcagtaaactcggacaatagcaagagaacaaaattctgatatcaattttttttaaaaaaaaatctacaactagcaatacttagaaagttacacaaatctggaccagtttagacctcggaccacaagttagggctaagtgctacagttgaccaaatcttcggaaccttgtctgttcgagggtttgagcttatagaagcatcaccgcagatggccgtcaagacatcaaactctcctcacgttgtctccatggataaccaccgcgccttcagtcatcagggtgccaagagcaccgcggagttcgtgcatatgaatttccattgagctctgcttcctcagttcctccagcaactcaatcatgcgcatcgaggggcctccaagctgcattttctccgcaatcaggttacgggttgcggcaacgaggttctcccgcctctgcctttcgcttgcggatatccccgtcatgatcagatccatatcaatcgtcccagttgcatgatccgtcgcagactgctgcatggcgacttcaagaagcctgaatgcctccacaacatcccgcacctcgaccacttcagagaaccgcattcgggctaatgcttcgctgagacggatcaaactctctatttgtctagcggttgctgttatgaccttctttctgctcccagggctattccctctttttctcatctcgacatagccacgagttaactcttctgcagcttcatcagataactgtggctgaatatacttccttgcatagcttatgtaggaaactagtgtctgcaagtccaagacctcgagctcctctaaatttggattctcaaaatgcaacgaaacaatatgcttatgccaggcgcctatcagtttgctcatccgccttgtccaagataagataaatcaggtcgaatcttgaaagtagcgttggcgctaagtggatgttgtcaattacagagagccttggattgtaacgtgattcagtaggattggcacatgccaggacagatgtcctagcgtttaaagatgcaattattccagccttcgcaatggatactgtctgctgttccatcacctcgtgtaacatgcttcgggcattatcagacatcttatcaaactcatctacgcaacaaacacctttgtcactcaaaacaagtgctccactttctagaacagtttcgccagtctcagggtctttggtaacataagcagtaagaccaacagcagaacttcctctaccactcgtatagataccacgaggagacagtttatgcatgtactggagaagctgggatttacttgttccagggtcccccacaagtaaaatattgatgtcaccccggaaactagctccagaaggaagcttcaagggattgccgccgaaaagctggcaaaggagacctcttttgacatcatccaactcccatatgtttggagctaatgatctagtcaatctttcatagatatcaggcaacttcgaaagctcttttagtttctcaaccttatcactaagaaaatcctcttcagtagatttgctagcgttagaattatcaatatccatggtgtcctccacatgaagcctagacttgtctgtcttctttatgacttcactgtcctttgagttggtccaattcgaatactcatagctctgtatattccagttatctcaaccctatctccaggctttccagcatcaacaagcttatcatgcatcaagacactaactgtatgtggagtgccaccttctggtatctcgtctggtgtttcctgcaactttatgatctgcttgtctgaaaatctgcatcggttgtgcactagggtcatagaattcgtggctttacattgttctttctgacaaatgtgcggttcagttactcttcctctatcaaccatgacgggctctgag

SEQ ID NO: 20831 - DNA, 1202 bp, Zea mays
  misc_feature (1154)..(1154): n is a, c, g, or t
gtctcaggtagcagtcgcgtgatgaatccgggggcgtgcagataaaaccctccctcgattaaccctaattccttttctcttcggggatactcctttcaccgagtctcttctggttctcggcgtgtgctcgtgtgcagatttgactccatgtcggcggcgctcgcggtgacggacgaggtggccctgccgatccgggcggtgggggatctggcggccgccgccgaggtctcgcgggaggaggtcgccgtcatcacccagtgcgcggcgctcggtgggaagttgccttttgaagatgcatcagttggtgcggttcttgcagtcattaaaaacgtggaaagcttgagggagcaattggttgctgaaatcaggcgggtgctgaaagctggtggaagagtattggtgcagagccctgcaccctcatccagtcagaagccgaacactgatattgagcgcaagttactgatgggtggatttgctgaagtgcaatcttctgctgcaagctcgcaggatagcgtgcaatctgttacagttaaggcaaagaaggctagctggagcatgggctcttcttttccccttaagaaaacaacaaaagcccttcccaagattcaaattgacgacgactctgatctgattgatgaagacagtctcttgactgaggaggacctgaagaaaccacaacttccagttgttggggactgtgaggtgggggcagcaaagaaagcatgcaagaactgtacttgtggcagggctgaggccgaggagaaggttgggaagctggagctcactgcggagcagatcaataaccctcagtcagcttgtggcagttgtgggttgggtgatgccttccgctgtggaacctgtccctacagaggtcttccaccattcaagcctggcgagaaggtttccttgtctggcaacttccttgctgctgacatatgatggcatcgccaacatcggcaaaacaaggagacgggggttacctacgttgttagtcgactgaactgcattccaaatagcttctgttagccaatgcgaatgtgcgtgtgagtgacttgtctttcggatgatatataacgcctctgcccaatcgcgcctctacacaaacacaaagtgtgcatcagtgcatgtgttttcagattgattttgtgagcctnggatgtgaagaatgaatatccctttaccccaaaaaaaaaaaaaaaaaa

SEQ ID NO: 20832 - DNA, 1316 bp, Zea mays
  misc_feature (952)..(956): n is a, c, g, or t
tcccgaatacggaaccgaacgccaacacctactggcgtcttgtgaagcttcgagaggagaggaggccaggcaaaacccaaatcaaatttcgccttcgtcgtcgtcttctcgtctcagatttgactccatgtcggcggcgctcgcggtgacggacgaggtggccctgccgatccgggcggtgggggatctggcggccgccgccgaggtctcgcgggaggaggtcgccgtcatcacccagtgcgcggcgctcggtgggaagttgccttttgaagatgcatcagttggtgcggttcttgcagtcattaaaaacgtggaaagcttgagggagcaattggttgctgaaatcaggcgggtgctgaaagctggtggaagagtattggtgcagagccctgcaccctcatccagtcagaagccgaacactgatattgagcgcaagttactgatgggtggatttgctgaagtgcaatcttctgctgcaaactcgcaggatagcgtgcaatctgttacagttaaggcaaagaaggctagctggagcatgggctcttcttttccccttaagaaaacaacaaaagcccttcccaagattcaaattgacgacgactctgatctgattgatgaagacagtctcttgactgaggaggacctgaagaaaccacaacttccagttgttggggactgtgaggtgggggcagcaaagaaagcatgcaagaactgtacttgtggcagggctgaggccgaggagaaggttgggaagctggagctcactgcggagcagatcaataaccctcagtcagcttgtggcagttgtgggttgggtgatgccttccgctgtggaacctgtccctacagaggtcttccaccattcaagcctggcgagaaggtttccttgtctggcaacttccttgctgctgacatatgatggcgatgcaaacatcggcaaaacaaggagacnnnnnttacctacgttgttagtcgagtgaactgcattccaaatagcagccaatgcgaatgtgcgtgagtgacttgtctttcggatgatatatataagctggccaatagcgcctctacacaaacacaagtgtgcatcagtgcatgtgttttcagattgattttgtgagcctggatgtgaaggatatcgctcaaccacattgtaaagctttacatgctgcagagctagtcgcctctggcagcggggtctacactctggagagagatcgatcgaggcctaaggggatggatgttaccaatgcaaagacactgtaacactcaaacactcgaaaatactattctgaataaattaggaaaactcatttcat

SEQ ID NO: 20833 - DNA, 1219 bp, Zea mays
ttggtgcggttcttgcagtcattaaaaacgtggaaagcttgagggagcaattggttgctgaaatcagtcgggtgctgaaagctggtggaagagtattggtgcagagccctgcaccctcatccagtcagaaggtattaacttatcagaatctgtttttgtcgttacatttctcttgcactgttgatgtaaagttcttaatttttttatgattgtctccattagccgaacactgaaattgagcgcaagttactgatgggtggatttgctgaagtgcaatcttctgctgcaaactcgcaagatagcgtgcaatctgttacagtgagtggtctaagttcatgtgttatagtatgttagtttttctgtgcaggctttagctcgcgtgctagcgtgcaccccgtgtcggttaaggcaaagaaggctagctggagcatgggctcttcttttccccttaagaaaacaacgaaagcccttcccaagattcaaattgacgacgactctgatctgattgatgaagacagtctcttgactgaggaggacctgaagaaaccacaacttccagttggtagagcaacaaaacccgtcaacttagttcaactccataagcaatagccagtttaggtttggattctaaacagttaagtgatgttttcactgatgttttcaccagttggggactgtgaggtgggggcagcaaagaaagcatgcaagaactgtacttgtggcagggctgaggccgaggagaaggttgggaagctggagctcactgcggagcagatcaataaccctcagtcagcttgtggcagttgtgggttgggtgatgccttccgctgtggaacctgtccctacagaggtcttccaccattcaagcctggcgagaaggtttccttgtctggcaacttccttgctgctgacatatgatggcgatgcaatcggcaaaacaaggagacgggggttacctacgttgttagtcgagtgcactgcattccaaatagcttctgttagccaatgcgaatgtgcgtgtgagtgacttgtctttcggatgctatataagctggccaatcgcgcctctacacaaacacaagtgtgcatcagtgcatgtgttttcagattgactttgtgagcctggatgtgaagaatatcgctcaaccacattgtaaagctttacatacagactgcagagctactcgccgctgaatttctaagcttaagaatcaattct

SEQ ID NO: 20834 - DNA, 1339 bp, Zea mays
atcttatcccacacggcggctcgacgactagggttttctggtaaaagaagggaacacgatcctctccgctgtcgccgccgtcgacatcggcagccgcattccaagccccgtcgcgggcatcaacagtgcctctcttcagcgtctgcggtggcaaacgacacggggcgagcagggtgcgcgaacctgaggttcgtaggcgtcgccttccgcccctcactgaagtcgtcgtcagcagctccctccagtctctgccacgattggactccatgtcggcggcgctcgcggtgacggacgaggtggccctgccgatccgggcggtgggggatctggcggccgcgccgaggtctcgcgggaggaggtcgccgtcatcacccagtgcgcggcgctcggtgggaagttgccttttgaagatgcatcagttggtgcggttcttgcagtcattaaaaacgtggaaagcttgagggagcaattggttgctgaaatcagtcgggtgctgaaagctggtggaagagtattggtgcagagccctgcaccctcatccagtcagaagccgaacactgatattgagcgcaagttactgatgggtggatttgctgaagtgcaatcttctgctgcaaactcgcaggatagcgtgcaatctgttacagttaaggcaaagaaggctagctggagcatgggctcttcttttccccttaagaaaacaacgaaagcccttcccaagattcaaattgacgacgactctgatctgattgatgaagacagtctcttgactgaggaggacctgaagaaaccacaacttccagttgttggggactgtgaggtgggggcagcaaagaaagcatgcaagaactgtacttgtggcagggctgaggccgaggagaaggttgggaagctggagctcactgcggagcagatcaataaccctcagtcagcttgtggcagttgtgggttgggtgatgccttccgctgtggaacctgtccctacagaggtcttccaccattcaagcctggcgagaaggtttccttgtctggcaacttccttgctgctgacatatgatggtgatgcaactatgcaagtgaacatcggcaaaacaaggagacgggggttacctacgttgttagtcgactgaactgcattccaaatagcttctgttagccaatgcgaatgtgcgtgtgagtgacttgtctttcggatgatatataagcgcctctacacaaacacaagtgtgcatcagtgcatatgttttcaaataatagattataatcttttaggtgaactatccattgtgttaaacatttattctctaaaaaaagaattaagttaaaaaaaaaaagaaaa

SEQ ID NO: 20835 - DNA, 1272 bp, Zea mays
gaggataacagaatttcgacggaaccgaacgccaacacctactggcgtcttgtgaagcttcgagaggagaggaggccaggcaaaacccaaatcaaatttcgccttcgtcgtcgtcttctcgtctcagatttgactccatgtcggcggcgctcgcggtgacggacgaggtggccctgccgatccgggcggtgggggatctggcggccgcgccgaggtctcgcgggaggaggtcgccgtcatcacccagtgcgcggcgctcggtgggaagttgccttttgaagatgcatcagttggtgcggttcttgcagtcattaaaaacgtggaaagcttgagggagcaattggttgctgaaatcaggcgggtgctgaaagctggtggaagagtattggtgcagagccctgcacctcatccagtcagaagccgaacactgatattgagcgcaagttactgatgggtggatttgctgaagtgcaatcttctgctgcaaactcgcaggatagcgtgcaatctgttacagttaaggcaaagaaggctagctggagcatgggctcttcttttccccttaagaaaacaacgaaagcccttcccaagattcaaattgacgacgactctgatctgattgatgaagacagtctcttgactgaggaggacctgaagaaaccacaacttccagttgttggggactgtgaggtgggggcagcaaagaaagcatgcaagaactgtacttgtggcagggctgaggccgaggagaaggttgggaagctggagctcactgcggagcagatcaataaccctcagtcagcttgtggcagttgtgggttgggtgatgccttccgctgtggaacctgtccctacagaggtcttccaccattcaagcctggcgagaaggtttccttgtctggcaacttccttgctgctgacatatgatggcgatgcaatcggcaaaacaaggagacgggggttacctacgttgttagtcgagtgcactgcattccaaatagcttctgttagccaatgcgaatgtgcgtgtgagtgacttgtctttcggatgctatataagctggccaatcgcgcctctacacaaacacaagtgtgcatcagtgcatgtgttttcagattgactttgtgagcctggatgtgaagaatatcgctcaaccacattgtaaagctttacatacagactgcagagctactcgccgctgaatttctaagcttaagaatcaattctaaaaacaaaaagtcatccatttggagttgaaaaactcgagagta

SEQ ID NO: 20836 - DNA, 1061 bp, Zea mays
acagaaaacagccccgagagcttttctttgtttcggcgaaaatgtgcagcacaaaccacacacgacaagcctttacattacgtatttataaagtttactgcgcaaccgaagcttaaatggctccatacttggatccatccatccccacggctgcgtttgcaacaaacaagaggcaccagggggggcgagggaacaaaagcttacacatatttacaaagggcgcaaaacaagccaggcagctaattatggcgtgtggccgtgtgtacctttttgtactttagggtcacttgtctacgttcaccagactgatccggagaaggaataccgtgtgaacagctccacggttaaggatggcgaaaaactctgctccctcagccacggtgagctcacctagagagattcggtggcactcgtattcgtcgggcaaccggaaaccatagaaccacctaatgaccaggttcacacaaactaccctttctgctactcggtgagcttggagtgctttactgacttcagttggcagcacatgcaaagatgcgatcgagtagtgcagtccaataaggttgattatcgcactatgattccttgagaacaagaaaaactggacatcgaggaatcctatatcaggtatcaaggccaaatcagcaatagctttcagatagtattcggattcaagtgactcattatttaagctgctgcccacaaattcaaccacattagatattgcaacagccattcttctgtgctggctgatgtagagagctttccatccctgcacaggggacgccgacgccacggcagatggccagcggcagcggaagaggcgctcccagatgcagtcagcgtcgcaggctctgcgccaggagcgcgagcagccgccgagcgcgcagacgtcggcctcctggaggcaggaggcgacggctacggcgatgtcctcggggaggtcggcccacctccccaccggcgagagctccatctcgcctcgcgcgatccccctttcgctgcagcgactgtactgtacgtctgtaccagactaccagcgcgaggcttgtggtccatat

SEQ ID NO: 20837 - DNA, 1070 bp, Zea mays
  misc_feature (1044)..(1044): n is a, c, g, or t
agaaacggtgaaaatgtgtagcactaattacacatggcaagcctttattatttgtttatagaagactatgatgacacagttacaatgggtccatacttcgatccatccccacaattgcacttacaacaaagaagaaccccgagagcagcagatgacagagacagaaagactttttttttttttttttgacaaaacaagccaagtacatattgtgtgtgtactttttttgtactccagatcacttatctacgttcaccaaactgatgcggagacgaaacacctcgtggacagctccacggttaagaatggcaagaatctctgctccctcagccgtggtgagctcacctagcgagattttgcgggactcgtactcatcaggcaaccggaaaccatagaaccacctaccaagcttgagcaagttcacacaaaccatcctttctgatacactgtgagcttggagtgctttactgacttcagctggcagcacatgcaaagatgcgatcgagtagtgcagtccaattaggtttattatcgcactatggttccttgaaaacaagaaaaactggacatcgagaaatcctatatcaagtatcatggccaaatcagcaatagctttcagatagtattcggattcaagtgacccattatttaagctgcctcccacaaattcaaccacattagatattgcagcagccattcttctgtgttggctgatgtagagagctttccagccctgcatacgggacgacgacgccgacgcctccgccacggcagctggccaccggcagcgaaagaggcgctcccagatgcagtcggcgtcgcaggctctgcgccaggtgcgcgagcagccgccgagcgcgcacacatcagcctcctggaggcgggaggcgacgtctagggcgatgtcctcggggaggtcagtccacctccccgccggtgagagctccatttcgcgcgattcccctttcgccgctgcgactgtacagtaccagactaccagagcatcttcaaggtgtgagaaatttcactatttgtgtggtgtcncccggccggcctcgaggtacccaatg

SEQ ID NO: 20838 - DNA, 3274 bp, Zea mays
  misc_feature (778)..(778): n is a, c, g, or t
cttgtaccgaggtcacgacccatggatgggcacgagcacgacccgatttaagatagacacaaaatgactcttatatttgttaaaacgaaacttcattttgtacttccatgtatttaaaaatgcaaagctagagtttgtactagttatatgtttttcttttgtagctttgaattagaggatgtgatataattttacttttcctataaacattagacaataattgaacttaaaaactctatcttgagttggttgtactctttttcccttctgccaaaggggttttaacgaggcaatcattgcacaactatggtaacttaatagagacattaatttatcttttgattaaatttgtttgtcttatgttttattattattcattaattttggttttaattttggactattgtgtgaattttgggctctgatgtaaattttgagctataaatggaatttcgggctttttataaattcgatgcacccaaaataatgatgcacctaaaataaaacccgacacatttaaacaattacgtgtcgggacgtgggctgatggctaaggctatgggccggcacgacctaacccataataattacgagtcgacctaactcgaaattcaaacacgtcgtaccttttcaggcttgagccgagccggactgagacgacccgaatatacacctatagcgagaatggacgaacgagtttgaaagggtagggaatcttttacaaagttttaactggttttaggtgggtgtagttagctaatgtactaattattaaatntgaggttagttaacaattagctgaaggtgttcggaattccatagctaattttagatgctaactcttagttccaggcatttcgaataggaactatgttaaaaagaatcttaattatacttttgatcaaacttaaaataacttaatctatagtatctcaatttgtttttatttgacgttagatagttcaaattcacatacaaacggtaaataaaaaaaatcagagggagtactattctagactatatttttttagtgcagaagagtatggaataaatttggaccccagaaatctggacagggcattgggtgccggacccactgaaaaacatccttccctaaatttcttatccagacaatttattcgtataataatttaaaagaaaagctacagaaaagctcggtgatagactgatagtggtaggcggtgtactactcaaccataccctgggcccactacacaggtagtgctagtgttgtaagctcccttcggacaatttcacgggtccacgacagtgccggatagaatcggtccaccactccccgtaccccgaactacctgacctgagagagagaccgtgcctccctcgccgccgccgccgcagcatccctagtcggagaagatggctgagaagccggcaggtcccaccccgaggacgaggatccgaggcggtctcgcggcctcagctccctcctccaggtctcccttcccttgatctgcatttgcaccgccgtttcgtttgaatctttttgaactcgctccagctgttcgtttcgcattctctgatgcaggaggctgtcttccgtatctttcaccgcggccccgagcatgatcaagaaggtgcggttccactcatgcctttcgaaatacctgcaactttgctctggtctttttagcttttgggatcagttgtttgttttgttgggtagtaagtggggttcctgtgatcgatgtttaaatctttttttgtttgtttcgtctttcgtgtaccagtagtgtcatagaagctggtgtgactgggcacgggacactgcattaatgaagtagagcggggaatatcttttaatagtgaacattggcggttaccagaaatgcaccatgctactgtggagtactaaacatctctatgtgcaggttcctgaccctccaaaggccgtgaggccatcaagagccacacctgccaagaagcggccacaagtggatcaagctcagaagcggagagaagaggtcgctgctctgcaggagcagcttaatggcctgcaaagtaagttgcatgaaaaagatgaagctctaagatccgcagagaacttgatcggacgagttactgcggcgaatgaagcagttgatgggttgaggagccagctctccgagaaggaattgctgattgaatctactggttcagagctgcacggtgcaaaggtgaattaagatgtggtcaataccttttgtagtggattacattcattgaatacactttttctttgtaattccacgcgagaaagatcacattattgttagagaaaattgatatcttgctgtacaggtgtagttttttttgttttagggtaatattaatcaattgtgattttcttttggtatcattcactgttgttgataatactttgcagcccaattaagggctaattcaaatggttatatagaaaatagcgtcattagatatgcatcactttttataaacctgggatgatcccactagttagtccatctttgtattatcatttcatgattgatgttgaactgtactggacaaaggaactccaggtgctatactttgaggctttaactatacttttttcttcttctcgaaagcgcaggagaactgcgccccattatatattaagcagaaaaaaggggtggtcttaagaagaccaatacaagaggcctccctatggagcccagtagtaagcatacataaaaatatccatcaaaataggacagctaccaaaggaaaccaaaaggccctccttaattctcagctaatggtgctgccaaatggaaaaggcctttggcaccgacaatctcccatttttttctttcctcatcagcagctctaagactcatgataacattagggctgcaaccatcaaagacacatttatttctatggttccacaaaatccaggctcccaggatgataagggagtcaagtccttttttggtgagtccgttaacaacaacccccacctcttcccaccaacccagatatgagccaatatccggttgtggagcaagagaatgcagaccaaatttccttagtagcagataccataattccctcgagaaagaacaggtaacaaggagatggtctaaagtttcatcctcttgatcacaaagggggcacttctcaggaagctctacctatactgttgcatggcattcactgttgttattccatggttcatcgaatccatattcaagcacgaaaggggggccaacttcataattctacacttcctgcaggtcgactgctagaggat

SEQ ID NO: 20839 - DNA, 1263 bp, Zea mays
gggtaccctcgggttcggccggtagtgctagtgttgtaagctcccttcggacaatttcacgggtccacgacagtgccggatagaatcggtccaccactccccgtaccccgaactacctgacctgagagagagaccgtgcctccctcgccgccgccgccgcagcatccctagtcggagaagatggccgagaagccggcaggtcccaccccgaggacgaggatccgaggcggtctcgcggcctcagctccctcctccaggaggctgtcttccgtatctttcaccgcggccccgagcaagatcaagaaggttcctgaccctccaaaggccgtgaggccatcaagagccacacctgccaagaagcggccacaagtggatcaagctcagaagcggagagaagaggtcgctgctctgcaggagcagcttaatggcctgcaaagtaagttgcatgaaaaagatgaagctctaagatccgcagagaacttgatcggacgagttactgcggcgaatgaagcagttgatgggttgaggagccagctctccgagaaggaattgctgattgaatctactggttcagagctgcacggtgcaaagatcatgctagcagagaagcaggcggcactggagaagttagagtgggaggcaaatgtgtcgagtacaaaggtggaagagctccaagctgatgtagcttctatggatactgaagtttctgctctgatgaagctgttcaggaaaataacagagagtgacagagcccctccacccagggatagaaatgacgatttgtctttggaatgcgagccagttcaccttgatgacacggtagacgacattgaccttgagaagatggagaaggagatgtcagcctacgtttcggctttgtctgccgcgaaggagaaccctaccgacgagttcatgagagcagtcgcagatgcaagattaagacttcaagccgttgtactctgaccaagactagagcgttgcgttgtactgtgtaaccaacaggagcaagcaagtcgatagtacgtttgctaatcgctgtgttttgccggtggcccccctcagggccttttctgtgttctttctcctaccttgcatctgatcggcggccgctagtgacagtgagctagcttgatgtaacctgtaacgctatgaaccgtggtgtacgtgactgaacctccgtaatagtagatggtatcgtgtacggtgtaccttttttagcaacaagatggttcggcctgtcttgacggccgaaagttcttgttt

SEQ ID NO: 20840 - DNA, 1355 bp, Zea mays
ttttttttttttttttgtgctttatttccaccaacattcatttatatcatccagtttacacactcaccacacaactacatgcgtcaaagtcgcgaacatacaaacacgtaaagtactagtactagtctacagcctgtaccgtgcagcagggacacggacaactttaccccccgtgctgctcagcgcacggtcgctacacgcccatgcgctacgcgaggagccccctggcgatgcggccgtcggcgccctggggaaagaacccaccgtgctgagcggggttgccggtgccgtagacgatgccgaggatctcctcgggcgtgcggtcgtaggcgagcgagaggtggtcaccggcgatgacattccccacggtgagcccctcgggccccagctcggccgccaccaccagtccctcgtccttgacgcccctcctccccagcgagttcctgaggtccgagatgtgcgccgtgacctccgccaccccgacggcgtagcccgccacacgcgccatcccgcgctcgtacagcagcgtccggatcaccgcgtcctgcgctgactccaccgccagcagccccgccagcagctttctggcctgaggggtgaagagcctggggttggcgccgacgtagccggtgaggccgacgtaggggatgatgtaggaggcgacgaggaagttgacgctgttctcgtaggggttgaagggcgggtccagcgtcgcgttcagcgcctgctcgatgatcttgccgaagttggccgcgctgatgtccagcaacggccgcgggaagcccctcaccgtctgcttgatcgccctgaggtgcccgacttcttggtagcagaactgggtggcgacgtcgcggatgaacggggtgagggaaggcggactggccgccgatggagggcggcccgccgccggtgaggttggcatcgatggcgtcgaggccgtaccccagagcggcccagcagaagaactccgtctccaggtactccaggttcagcgggaactccagcaggtccacgtccgactgcggcagcagcgacccggggccgccgaagaagccgcggtacggcggccgcgcccactcgttgtccatgtcctgcgcgcgcgcaaaggcgccgcacaggcaaaccaccaccgcggcgaccacggcgacggacggcgccggtgcacccatcgatcgacggcgggcggctagctacgacgatcgctcaagagctagcggggactagtagctagaatcgggcaatgaacacgtcaagataccgatgcgatcgattcctcagctgcaagtttgacttttgcgtttgtgcagttagttatattgctcccttttcgattaggatgttctaggtaatggtct

SEQ ID NO: 20841 - DNA, 1002 bp, Zea mays
ggtaccgggccccccctcgtgttttttttttttttttttttagggcagcaacccattatttactttatttgtttccacctacattcatgtatatcatccaaagtttacacaaggcactcaaggccacaccataccaactcacaaacaagtatagtactgctagctagtctacagtctgcgccgggcacggataacttcataccgatcagcgcacggtcacaactcacccatgcgctacgcgaggagccccctggcgatgcggccgtctgcgccctgaggaaagaagccgccgtgctgggcggagttaccggggccgtacacgatgccgaggatctcctccggcgtccggtcgtaggcgagcgacaggtggtcgccggcgatgatgttccccacggtcagcccctcgggccccagctcgggcgccaccaccaggccctcgtccttcacgcccctcctccccagcgagttccggaggtccgagatgcgcgccgtgatctccgccaccccgccggcgtagctcggcacacgcgccatcccgcgctcgtacagcagcgtccggatcaccgcgtcctgcgccgactccgccgccagcagccccgccagcagctttctggcctgaggggtgaggagcctggggttggcgccgacgtagccggtgaggccgacgtaggggatgatgtaggaggcgccgaggaagttgagcctgttctcgtaggggtcgaagggcgggtccagcgtcgcgttcagcgcttgctcgatgatcttgccgctcgttggccgcgcttatgtccaacaacggcctcgggaagcccctcaccgtctgcttgatcgccctgaggtgcccgacttcttggtatcagaactgggtggccacgtcgcggatgaacggggtgagggacgcggactggccaccgatggaggccgcgcccgccgcccgcgtgaggttggcgtcgaaaacgtcgagaaagtaccccagagcggaccagcgcatgagctcccccg

SEQ ID NO: 20842 - DNA, 2181 bp, Zea mays
ttttttttttttttttggcgtatagtgcagcaacccattatttactttatttgtttccacctacattcatgtatatcacccagtttacacaaggcactcaaggccacaccataccaactcacaaacaagtatagtactgctagctagtctacagtctgcgccgtgcacggattcatactgctcagcgcacggtcacaactcacccatgcgctacgcgaggagacccctggcgatgcggccgtctgcgccctggggaaagaagccgccgtgctgggcggagttaccggtgccgtacacgatgccgaggatctcctccggcgtgcggtcgtaggcgagcgacaggtggtcgccggcgatgatgttccccacggtcagcccctcgggccccagctcgggcgccaccaccaggccctcgtccttcacgcccctcctccccagcgagttccggaggtccgagatgcgtgccgtgatctccgccaccccgccggcatagctcggcacacgcgccatcccgcgctcgtacagcagcgtacggatcaccgcgtcctgcgccgactccaccgccagcagccccgccagcagctgcgcacacagatagtgcatatcaacagcacgtcaacagggcaggcacagccacaggtacacagcatgactggtaggagagggatggcaacgatcgagtagaatgttcatgcgatgcacgcgcgtacgtatgcactttaattacctttctggcctgaggggtgaggagcctggggttggcgccgacgtagccggtgaggccgacgtaggggatgatgtaggaggcgacgaggaagttgaggctgttctcgtaggggtcgaagggcgggtccagcgtcgcgttcagcgcttgctcgatgatcttgccgaagttggccgcgctgatgtccagcaacggcctcgggaagcccctcaccgtctgcttgatcgccctgcatggccggtcaggggcggtcacaacattgactaccatctgcaattccgttctcaggctgttgctgtgtcggctgttcagttgttacctgaggtgcccgacttcttggtaacagaactgggtggccacgtcgcggatgaacggggtgagggacgcggactggccgccgatggagggcggcccgccgccggtgaggttggcgtcgatggcgtcgaggccgtaccccagagcggaccagcagaagaactccgtctccaggtactccaggttcagcgggaactccagcaggtccacgtccgactgcggcagcagcgacccggccggggcgccgaagaacccgcggtaggccggccgcgcccactcgctgtccatgtcctgcgcctgcgcaaaggccccgcacaggcaaaccactgccgccgtggccaccacgacgacggacgacagcgccggcgcacccatctccggccggcgggcggctgcgacggcaatcgagcggtgactagtatagtagctttatttggcaacgcgcacacgtcactgccgttgcgattcctcagctgcacgtttggcttgtgcgtgtgtgtgcggatcggtgcaagaatttataggcgatgcgggcgtgcgcggtggcgggctggcggcgcgacggtgtccgatgacgggacgggtagccgtggcgcgccaagagcgtggcgcgcggaggagtacgtacgtacatatcgaagccagccagcgacgacgctagctcgtttgtcgtggcgccgtcgtgcatatgggacagatttgtttcttttcgcgagttcacaattgcgaggcataaagatggtggtccattggaaggaagcaaagatttcctcttgttggtacggtagcatgcgtggatatatgcaaaatgacgagaacggagcaagttaatcatgcgtcgtgcactcgtgcgctcaaaaagaagggtaggaagagtgtggagaaacaaaagtatgatctattcgtacttgcaagaaaacatatatccttcaaaacatatctccagagactagactgataacaaagatacgaatttcgctcatgaaaacaacggattctaagctaaccacgctcatcccatgttttgctaggtaatttgccatcttgttgcaatttcttggacactactaaacattaactaccaaagtgctcgtacgttgctacgatttccatttatgcttaagtaatactagaatatctgt

SEQ ID NO: 20843 - DNA, 2733 bp, Zea mays
  misc_feature (1212)..(1212): n is a, c, g, or t
atttctttggggtcgtaaaagaatttcaaacaaaactgttgtcagctacaaagttgaatatctttttatgttctacaacttttattttagtagtttttccattcgaggtggttttgcaaaatttgcattctagtttcgacaaatttaaatgcaattttgagagtccaaactatttcaaataaaaaaagttatcatctacaaagtttcataacttttagagatctacaacttttattttggtggttttttatacgaggtcatttgaaaaactcaaaaaatcaatttcaaatgatttatactagcgattccttaagaaaaccgccagtacaaatataatttatactgtcagttttcttaagaaaaccactagtggaaatgcatgatttgcactgacggttgcaaaagtgtttccactcacaattcttaagttgcaccggccattttattttcacttacgttccataacaaaaccgcttgtataaattagatctcaccatagtcatagagctcttttgtactagtgtacctttgcttacagtgcatcaactctttatttagtgctttatttccaccaacattcatttatatcatccagtttacacactcaccacaactacatgcgtcaaagtcgccaacatacaaacacgtaaagtactagtactagtctacagcctgtgccgtgcagctgggacaactttaccccccgtgctgctcagcgcacggtcgctacacgcccatgcgctacgcgaggagccccctggcgatgcggccgtcggcgccctggggaaagaacccgccgtgctgagcggggttgccggtgccgtagacgatgccgaggatctcctcgggcgtgcggtcgtaggcgagcgaaagatggtcaccggcgatgacgttccccacggtgagcccctcgggccccagctcggccgccaccaccaggccctcgtccttgacgcccctcctccccagcgagttcctgaggtccgagatgtgcgccgtgacctccgccaccccgacggcgtagcccgccacacgcgccatcccgcgctcgtacagcagcgtccggatcaccgcgtcctgcgctgactccaccgccagcagccccgccagcccctgcgcacgcacatattacatatcattaggcaacacaccagcaccgtcagccggggacatgcacaggacatgacttgtacgcatgacgcacgcacatgnccgttccgtgcgttggccgatggctaggtggtggcgagtagagtgttcatgcgatgcacgcgcgtatgcacttcaactacctttctggcctgaggggtgaagagcctggggttggcgccgacgtagccggtgaggccgacgtaggggatgatgtaggaggcgacgaggaagttgacgctgttctcgtaggggttgaagggcgggtccagcgtcgcgttcagcgcctgctcgatgatcttgccgaagttggccgcgctgatgtccagcaacggccgcgggaagcccctcaccgtctgcttgattgccctgcaagcaagcacgccggcgccggccgggtcacattattgataatttgtagtgtccagctatgtgttcgcgtctgcttgtttgccctgaggtgcccgacttcttggtagcagaactgggtggcgacgtcgcggatgaacggggtgagggaggcggactggccgccgatggagggcggcccgccgccggtgaggttggcgtcgatggcgtcgaggccgtaccccagagcggcccagcagaagaactccgtctccaggtactccaggttcagcgggaactccagcaggtccacgtccgactgcggcagcagcgacccggggccgccgaagaagccgcggtacggcggccgcgcccactcgttgtccatgtcctgcgcgcgcgcaaaggcgccgcacaggcaaaccaccaccgcggcgaccacggcgacggacggcgccggtgcacccatcgatcgacggcgggcggctagctacgacgatcgctcaagagctagcggggactagtagctagaatcgggcaatgaacacgtcaagataccgatgcgatcgattcctcagctgcaagtttgacttttgcgtttgtgcagttagttatattgctcccgggacgggaggatcggtgcaaggatttataggcggcgcgagcgtgcgtgttggcgcgcgggctggcggcgcgacagtggccgatgacggggacgggtagacgtggtgcgccaagggcgtggcgcgcggaggagcaagagtacgtctagtgttgtttaaacgctgacggtcgattcgttttcttgcctgagttcgaatggttgcttcacctctacatcgaagccagccagcgacgacgctagctcggccgtcgtgcatatgagactgattaagtgatgcttttttagtgagttcacaattacgacttgcgagacagacagacagtgatcgttggctcgttgcctcgttggaaggcagcaaagattatccttgttggtacggtggcatgtgtggatatatgcaaatgacgagaactcagcaagttaatcatgcgtcatgcgctcatcaaaaagaagggtagggagagtgtatagaaacaaaagtatgatttactccttgtatgaaaaaaaatcggttgtggggcctaatcacatattttttatattttatattctataccaatcataatatagatatttataatatagatatttatatggaaaaatagaaaacg

SEQ ID NO: 20844 - DNA, 1390 bp, Zea mays
ggcgtatagtgcagcaacccattatttactttatttgtttccacctacattcatgtatatcacccagtttacacaaggcactcaaggccacaccataccaactcacaaacaagtatagtactgctagctagtctacagtctgcgccgtgcacggattcatactgctcagcgcacggtcacaactcacccatgcgctacgcgaggagacccctggcgatgcggccgtctgcgccctggggaaagaagccgccgtgctgggcggagttaccggtgccgtacacgatgccgaggatctcctccggcgtgcggtcgtaggcgagcgacaggtggtcgccggcgatgatgttccccacggtcagcccctcgggccccagctcgggcgccaccaccaggccctcgtccttcacgcccctcctccccagcgagttccggaggtccgagatgcgtgccgtgatctccgccaccccgccggcatagctcggcacacgcgccatcccgcgctcgtacagcagcgtacggatcaccgcgtcctgcgccgactccaccgccagcagccccgccagcagctttctggcctgaggggtgaggagcctggggttggcgccgacgtagccggtgaggccgacgtaggggatgatgtaggaggcgacgaggaagttgaggctgttctcgtaggggtcgaagggcgggtccagcgtcgcgttcagcgcttgctcgatgatcttgccgaagttggccgcgctgatgtccagcaacggcctcgggaagcccctcaccgtctgcttgatcgccctgaggtgcccgacttcttggtaacagaactgggtggccacgtcgcggatgaacggggtgagggacgcggactggccgccgatggagggcggcccgccgccggtgaggttggcgtcgatggcgtcgaggccgtaccccagagcggaccagcagaagaactccgtctccaggtactccaggttcagcgggaactccagcaggtccacgtccgactgcggcagcagcgacccggccggggcgccgaagaacccgcggtaggccggccgcgcccactcgctgtccatgtcctgcgcctgcgcaaaggccccgcacaggcaaaccactgccgccgtggccaccacgacgacggacgacagcgccggcgcacccatctccggccggcgggcggctgcgacggcaatcgagcggtgactagtatagtagctttatttggcaacgcgcacacgtcactgccgttgcgattcctcagctgcacgtttggcttgtgcgtgtgtgtgcggatcggtgcaagaatttataggcgatgcgggcgtgcgcggtggcgggctggcggcgcgacggtgtccgatgacgggacgggtagccgtggcgcgccaag

SEQ ID NO: 20845 - DNA, 1299 bp, Zea mays
ttttttttttttttttgagtgcagcaacccattatttactttatttgtttccacctacattcatgtatatcatccagtttacacaaggcactcaaggccacaccataccaactcacaaacaagtatagtactgctagctagtctacagtctgcgccgtgcacggataatttcatagttcatactgctcagcgcacgctcacaactcacccatgcgctacgcgaggagccccctggcgatgcggccgtctgcgccctggggaaagaagccgccgtgctgggcggagttaccggtgccgtacacgatgccgaggatctcctccggcgtccggtcgtaggcgagcgacaggtggtcgccggcgatgatgttccccacggtcagcccctcgggccccagctcgggcgccaccaccaggccctcgtccttcacgcccctcctccccagcgagttccggaggtccgagatgcgcgccgtgatctccgccaccccgccggcgtagctcggcacacgcgccatcccgcgctcgtacagcagcgtcctgatcaccgcgtcctgcgccgactccaccgccagcagccccgccagcagctttctggcctgaggggtgacgagcctggggttggcgccgacgtagccggtgaggccgacgtaggggatgatgtaggaggcgacgaggaagttgacgctgttctcgtaggggtcgaagggcgggtccagcgtcgcgttcagcgcctgctcgatgatcttgccgaagttggccgcgctgatgtccagcaacggccgcgggaagcccctcaccgtctgcttgatcgccctgaggtgcccgacttcctggtaacagaactgggtggccacgtcgcggatgaacggggtgagggacgcggactggccgccgatggagggcggcccgccgccggtgaggttggcgtcgatggcgtcgaggccgtaccccagagcggaccagcagaagaactccgtctccaggtactccaggttcagcgggaactccagcaggtccacgtccgactgcggccagcagcgacccggccggggcgccgaagaacccgcggtagggcggccgcgcccactcgctgtccatgtcctgcgcccgcgcaaaggccccgcacaggcaaaccactgccgccgtggccaccacgacgacggacgacagcgccggcgcacccatctccggcgggagggcggctgcgacgacaatcgagcggtgactagtagtagctttatttggcaacgcacacgtcactgccggtgcggttccctcagctgcacgtttggcttgtgc

SEQ ID NO: 20846 - DNA, 2723 bp, Zea mays
gcacgaggccttccccacctacgtggcacccattgctctcactcgctcccgccggttgctcgtccccggacccgccgcactactgctataggcgcatccccggcgccttcgcacactctctccccggccacttcccaaatccgcccgccattcatgcacccttctgtgcactgtcagcgccaccattagctcgcagctcaagctcgccactaccattttggtcggttcttgaggaaatcgatcgaaccgttggagtgccaccactggcagaggctgttgcattcttgagttgagcaggaagaggagaggaagcaatggctctgtcgacgttctctgtcccaaggggattcctcggtgtgccggctcaggactcccatttcgcttcggcggtcgagctccatgtcaacaagctgctccaggccaggcctatcaatctcaagcctcggcggaggccggcatgcgtgtcggcgtcgctgtcgtcggagcgcgaggcggagtactactcgcagaggccgcccacgccgctgctggacaccatcaactaccccgtccacatgaagaacctgtctgtgaaggagctgcggcagctggccgacgagctccggtccgacgtcatcttccacgtctccaagaccggcggccacctcgggtccagcctcggcgtggtggagctcaccgtcgcgctgcactacgtcttcaacgcgccgcaggaccgcatcctctgggacgtcggccaccagtcgtacccgcacaagatcctgacggggcggcgcgacaagatgccgacgatgcggcagaccaacggcctggcgggcttcaccaagcgcgccgagagcgagtacgacagcttcggcacgggccacagctccaccaccatctccgcggcgctcgggatggcggtgggccgggacctcaagggcggcaagaacaacgtggtcgcggtgatcggcgacggcgccatgacggccgggcaggcgtacgaggccatgaacaacgccgggtacctggactccgacatgatcgtcatcctcaacgacaacaagcaggtgtccttgcccacggcgacgctcgacgggccggtgccgcccgtgggcgcgctcagcagcgccctcagcaagctgcagtcaagcaggccgctcagggagctcagggaggtggccaagggagtgacgaagcagatcggtggctcagtgcacgagctggcggcgaaggtggacgagtacgcccgcggcatgatcagcgggcccggctcctcgctcttcgaggagctcggtctctactacatcggccccgtcgacggccacaacatcgacgacctcatcaccatcctcaacgacgtcaagagcaccaagaccaccggccccgtcctcatccacgtcgtcaccgagaagggccgcggctacccctacgccgagcgagccgccgacaagtaccacggtgtcgccaagtttgatccggcgaccgggaagcagttcaagtcccccgccaagacgctgtcctacaccaactacttcgccgaggcgctcatcgccgaggcggagcaggacagcaagatcgtggccatccacgcggccatgggcggcggcacggggctcaactacttcctccgccgcttcccgagccggtgcttcgacgtcgggatcgcggagcagcacgccgtcacgttcgcggccggcctggcctgcgagggcctcaagcccttctgcgccatctactcgtctttcctgcagcgcggctacgaccaggtcgtgcacgacgtcgatctgcagaagctaccggtgcggttcgccatggacagggccgggctggtcggcgcggacgggccgacccactgcggtgcgttcgacgtcgcgtacatggcctgcctgcccaacatggtcgtcatggccccgtccgacgaggccgagctctgccacatggtcgccaccgccgcggccatcgacgaccgcccgtcctgcttccgctacccgagaggcaacggcgttggcgtcccgttgccgcccaactacaaaggcactcccctcgaggtcggcaaaggcaggatcctgcttgagggcgaccgggtggcgctgctggggtacgggtcggcagtgcagtactgcctgactgccgcgtccctggtgcagcgccacggcctcaaggtcaccgtcgccgacgcgaggttctgcaagccgctggaccacgccctgatcaggagcctggccaagtcccacgaggtgctcatcaccgtggaggaaggctccatcggcgggttcggctcgcacgtcgcccagttcatggccctggacggccttctcgacggcaaactcaagtggcgaccgctggtgcttcctgacaggtacatcgaccatggatcgccggccgatcagctggccgaggctgggctgacgccgtcacacatcgccgcgtcggtgttcaacatcctggggcagaacagggaggctcttgccatcatggcagtgccaaacgcgtagaacttgtgctgatctgggcctatagagatgattgtacattttgtcgttaactagagtgtctgaacttgggagattagtcttctttggatgaaagtgtcgccggaacaacagttaccgtttctttttttgaaagagaaaggcaaaagatttgccattcccatatattagaagaggtaaaaataaaactttataaaaaaaaaaaaaaaaaaaaaaaaaaaaaaaagtaaaaaaaaaaaaaaaaaagcggcc

SEQ ID NO: 20847 - DNA, 4439 bp, Zea mays
  misc_feature (382)..(382): n is a, c, g, or t
  misc_feature (1054)..(1054): n is a, c, g, or t
ctcgaggctcgcgagccgactcggactccctcagactcagagaggctcatgagcctaaatgaatttgagccatccgagctgaaacagcgagctaagcctaaacaagtctgatccagtctaatgacacggtgctatattgttacattattacgttattatgttattgatttatttttatagacacaatgctatgtatagtttagaatatgttgtcagattatatataataaaaatatataataaaatatacaatttatgttaatgagacttagtgtggtgactcgctagtccgagccaagtctaatctccgaaatcacaatcggtgtgattggttgcctgcgtttacttatccagactctctagatgcatcgaccaaagtacnacttttgtttgcttacctgtgcacgcaaggccaagccctacagctacagcggaggacaaaatgatcacccccggttgcatgcgtaggtacgcagcgagcgtccgcttccaacgagccaagctcgtacgaggtaggccacactcgtctacctaaccaatcacaccgaatgtaaatgagtcgaaccgaacttgacttgttgggtcaccgagcttggctcttttccaaccctatggtgatagctctcccatatatggagtgagctctaatctctctatttttaattatttcatttcttttgcccctccataatgcctctatagctactccatatatggagtgagctctaatctccctctattctttaatatttcatttctttgcaatattaacctttttaagctctgtaacatgataataatatacattactgtagtatgaatagattatgattttttagagtcgaaaaactaatgaaaaaaatgttagataaccgagttatagtgtatagagaaactggatagggaaaatggttggagacattgtgtgtgtggagagatgagagagtttttttttacttaaatataatagaaagtctaaagtacagaccacatcatgtaacaaaacagcacttttgggatacatgtggccatgtgggtacactgaagtatatanatcatccaaaattccaaatagtttgctggctcggctgaagtagtgcaatggtaagttgcttacctgtactggacgtctggatctgtcattcacagacaaattcagtatatttattatttatgtaagcttacaagcgccagatgtccaggtaaagaatttcacaaaaacttcagctaactcatccgcgggtgtacatatagactacaagagaatcaatatgtacagatatgctgatatgcatagcataggtcctgcgagatattttccggctaacacacccagctaatatcaggtttcagtcaatgcgtgagcataaagacaacgtacctgtattggctccacctgcatatattttggaagggcggttcagatcaggaattttacacaaatttctggttaacagatttgccaatccagcaaatctgaacatacaaaacccagtcggggaggaaaaagtccatcctcccggtattccatataagaagagaccgaaacaatggtcccgaccgaaaaaatctctaaaccctgaccctccatcactaacgggtcgacgtcaactgtccactctacaacagcccaaccgaaggatggcacacaagacatcgcaacccgagagcggatagggcacaacgagggaatttttttaaccaagcctgaaaattcgatcccaataggaatcaaactcaagtcttgggggggctactcagaagtccttaaccgctaggctacaagcataaacagatttaatttgaatatcagggaacatttttttacaaaagtttgcagcttggacatgtaagctaaaagtcataaatattcactcatcaacctgcaagcaagtaaaccaaccaccagtgtattactatacatgcattgtagctcttgctggtgagaaagaagcaaagcaatagcttttttgtgacttgaacgattgcaagaccaacgcgcatatcctcatcaccaaagatgtgaaatcagaaaatcatcaactaaagaatcaaaagaactctggctccacccagcattaacaaaaaaaaaaccaatccgatgcaaacttcccaactgacagctatttatttacattgtacagctgctgctgctgcttcttttcggcaggttttactttgttctcatgagggttttctggatccgtgggcacttatccaagagtaggagcaaaccaacattattacttgataagccaaaagtatacctgctttgagatagcttctttttcttgccaaataaagtgaggacccacttaaacaaggcaaccacggaatatgtcttgaggagtgccaccctcttgtcctccgtgaatctcctttctacaatcccaactgctcgttttctaggggaacggtgtacacctggccccaccccagctggaactccatccttggcaagatgctgcgcaatctcacaaagaagaacaagttgtgccttctctgtgcgcattgccacaagggcctgcctcatcgactccctatcagcctccagtgcctccagcctcatgtaaagcttcttaatgtctggctccaccgcctcaccctggtacttatccatgacccttgcaataggcgcagactcaccttgatgcaccttgtcaatggtgtataccctatcactgccactgtcaacaccatcagcctcgcttgcttccaccctatcaccacggccagcagtaggagactctggcagctcttcatcgtcattgtggaggtcgctcagttcttccacaccgtccacagataacatgtcatcagcatagaggccaccctgctcatgcccagacaagtccggcaacgcctcttctgtgtagaggtgggtgccttcctcttcgtcttcctgaaggggtggctcaagcaggggagtttcctgatcgtgctcgaggcggcagatccggcgctccagatcgagggcaaccgcatcctcttcctcctcgtcctcgtagtagtactccccgtcgttgcagcggagctgagggtagtaccctccatcaccatcgccatcggcatcggcgtagccgtcctcgccctcgaggaggagtaggtcctcttcctcctcggcggcggtctgggcgaacaggaggtcctcgccctcggggagcgggatgccgaggtggaggaactggcgcctgtactcgcggagcctggcgcggaggcgcaccaggcggcgcgcgcgctgggcgaggagcgcgcgcagctggtcgatgtccgcggcgtcgagcgccatcttctcgtcggcgaagcggcggaactggcggagctccatctggacctcggccttgtcgcgctgcaggcggagcatcatggccatggcctcgctggcggcgctggccgcggcgaggcgctcctcctcgacctcggcccgcagcgccgacgccgtggactgggccgccgccaccgcctcccgcagcgccgcgcactcgtcctccgcctcgacccgcgccgtgggccccgcctccccgccctcctcccccttctccgcgcccagcttccgcttcacggaccgccgccacggcacggccggcgacgaggagggggaggagcagcacgggcaccgctctccggcggccggcgacgacgcgccggggtcgtggtcgtggtcttcgttcatgacggcggcgggtggcgagaggattcggaaggggcgcgagcgcaatcaaaccgcagacgcggagctttttctcgtctggatttgggagcgagttggaatgcaaggaacttggaaggaattggtgcggggagttgggtttgatgtgttgagccgccttctcttcttcttttcggcttttccccttcgcgaggtgggccccaagtaggctcctccggctgcaagtggggtctgtgagaaaggtatgtgcagttgcagtcttgaacggtgtggcgccctacatacagatacagtatgtcgtcgactgtggaacttgtccattgcaatgtcgcccaattttctcagtgaacaccgcctagtacacggagcgtccacactttttgcccatccccagagcgcgacgctcttgagatatttatgagcaaaggttgatgcatgcttgtgtattggatcgtagacgtggacgcgttccaaggatctggagccagtcaagaaaacggcagttgcatgtggacagcacagcacaacaggctagctagctagcttggttgtactgttcgtcgcgaacaggtgaaaaacgattgcaaatggccgtccgatacggtatgtgtttcgaacgaacgaacggacgggcggatggatggatagaattattaagcaacccataatgcattcccttcgatactctttgttaattttctgtacgcagatttttcctaatgatgggctgcatggccgtatcgatcccccgcagggttttttatctgca

SEQ ID NO: 20848 - DNA, 1999 bp, Zea mays
  misc_feature (20)..(21): n is a, c, g, or t
  misc_feature (51)..(51): n is a, c, g, or t
ggccgctttttttttttttnnttccacaaatttctgattaccagtccaaanaaactgagcatacaagcataaacagacttagtttgaatacaaggacattttttcacaaaagtttagagtttgcactaacattcataaatatttactcaacctggaagcaaggcagcaagcaaaccaaccaccagtgtatttacaagcgcactatacatgcattgtagttcttcctggtgagaaagaagcgaaagcgattttgtgacttaacaattgcaagaccaacgcataaaatcctcatcaccaaaagatgggaaatcggaaaatcatcaactaaagaatcaaaagaactttcgctccacccaacattaacaaaagaaatgcaatattcccaactgaaagctatctatttacattgtacagctgctgctgctgctgctgctgcttctttcggcaaggtttaactttgttcttgtgagggttttctggatccgtgggcacttatccaagagtatgagcaaaccaacattattatttgttaagccaaaagtatacctgctttgagatagcttctttttcttgcccaataaagcgaggatccacttaaacaaggcagccatggaaaatgtcttcacaagtatcgccttcttgtcctctgtgaatctcctttctacaatcccaactgtgtgttttctaggcaaatggtgtacacctggccccgccccagctcccggcccaactggaactccatctttggcaagctgctgcgcaatctcacgaagaagcacaagttgtgccttctctgtgcgcattgccacaagggcctgcctcatcgactccctatctgcctccagtgcctccagcctcatgtaaagcttcttaatgtccggctccactgcctccccttggtacttatccacgacccttgcaataggcattgctgcaccttgatgcaccttatcaatagtgtataccctatcactgccactgccactgccacttacactgtcagcaccgtcagcattgcttgcttcctccccgtcatcatgtccagcagtaggagactctggcagttcttcatcatcattgtggaggttgttccttgcttccacatcctccttagataacatctcgtcggcatagaggccacccagttcatgttcagacatgtccggcaacacttcatctgtgtaaaggtgggtaccttcctctttctcatgcggtggctcaagcaggcgaggttcctgatcgtgctcgaggaggcagatccggcgctccagatcgagggcaaccgcgtcctcttcctcccgcccgtcctcgtagtagtactccccgtcgttgcagcggagctcagggtagtagtaccctccatcgccaacgacgtagccctcctcgccctcgagcaggaggaggtcctcctcctcctcctcctcggcggcgttctgggcgacgaggtcctcgccctcgggaagcgggatgccgaggtggaggcactgcagcctgtactcgcggagcctggagcgcaggcgcagcaggcgtcgcgcgcgctgggcgaggagcgcgcggagctggtcgatttcggcggcgtcgagcgccatcttctcgtcggcgaaacggcggaactggcggagctccatctggacctcggccttgtcgcgctgcaggcggagcatcatggccatggcctcgctggcggcgctggccgcggcgagtcgctcctcctcgacctcggcccgcagcgccgacgccgtggactgggccgccgccgccgcctcccgcagcgccgcgcgctcgtcctccgcctcgacccgcgccgcggggcccgcctcgtcccccgcctccgcgcccagcttccgcttcacggaccgccgccacggcgcggccggcgacgacgcatcggggtcctggtcgtggtcgcggtcgtcgtccatgacggcggcgggagggggaggcgagggttcggggggccgcggcctcgatcaaaccgcagcgaggagcattttgtcgt

SEQ ID NO: 20849 - DNA, 1208 bp, Zea mays
  misc_feature (1192)..(1192): n is a, c, g, or t
accccccctcgagttttttttttttttttttttttttttttttttgatctaaacacaacgttcttcacattgccctgatagaattatgtaatgtaatgaacagtatcaacatgacaaccttacctttacatacattttattagattttttttctcaacaaccaagaacaacagctattgtcgtttcctcagcacaaagaaacatggcagctgccgcctagggcttgggagggtaaaacccgttcacagtcatacctccgtcgaccgcaatcgtctggccgctaatataagtggaacccggcatgcaaagaaaagcaacaagtgccgatacttctccaggttctccgacacgtccaagcggagttcgactcacaacttgttcctcaaagttcttatttgccaaaattccttccgtaagtgaagtggtgatgtaccacggagcgacagagttggctcttatgttgtccttagcccattcacaagctaaattcttggttagctggttaatggcacctttagtcatagcatatatagttccactaaagattcctatcgctccagcaacagatgatatgaatataatgctgcctgacccagataatttcaaaagaggatgtgcaatttggcacaagtgatatgcagattcaagattagtagccatcagaaacgagtattcctctgcagtaaactcagtagttggtttccttatgtttgttcctacattgtttacgaggatgttgagcttgccgccgaagcggtcggcaacctcgcggagcaaccgctcccgctggtccctctcggagaggtcgcagacggacccggtaacgctgaatcccctggcctcccactccttgatgcgctcgccgagctcctccgccttccgggagcatgtgtgcacggccgcccccagcgccgccagctcctccactaccgcacgcccgatgccgcgggtgccgccggtgacgagggctgtcttgccgtgtagtgcccatctcccggaggaccctatcgccgtgcccgaggtctccaccgtggccatctcgcagttgttgttcccggtcacgatagcggccgaggcaagtggattgtggaactgattgatgaatcaacgtggacatgcgccgataatgctttttttttttttttttttttgttatttttttttttttttttctcccttttttgtaattttncccggccggcctcgag

SEQ ID NO: 20850 - DNA, 5072 bp, Zea mays
ccaaagtgtaaaaatttcagcacaatttgacgcttaaaccataggagtgcgatccctttgactccctgggcatggcccgcagccccgcacaccacacgagtttacacaattcagggaaaaaaactattgctcagtcaaaactcagcatcaaaattagcaccgcttgtctaacaaatcttcagagcagacgtgcacgccgacgaatccacagagacagtacagttgctttagtttactaccccgtatggccgtatcttcctccacatgcagcatttgacgatggcgtcccacgttctcctgcactgttcactcccacagtcccacatgcgcacctagctcgctcgtcgtcgtcgtcgccgccgatgcgtgcagtacatgctgcaccggcctgcttatatatatcgcatcgtctccgaagctactaacccattgcgctctgcaggtttacccggacatggcatccatgtcgcatttaattgctaagccagctccagctgccacctttcctctatcccttccgagaacgagctccggcttcaggcctcgccgcgttaccgtccagcgcgtatcgtgcgcatctcccagaggcgaacgctacgagctagacgcccgaaagcacgaccgccgcgacgtcctcctcggcctcggagcgctcggtgccagtgccaccgctaccctggcgtccgcgcgccgcgccggcgccgaccccgtcgccacgcccgacatctcttcctgcggccaagcgaaccttccggtgagcgccaacgtgctgacgtgctgcccgccgccctcgagcgcgctgcccgtggacttcatcctccccgacgccacgtccttgccgctccggacgcgccccgccgcgcactcggtcaccacggactacgtcgccaagttcaacgccgggatcgctgcgatgaaggcgctcccggcggacgacccgcgcagcttcgcggcgcaggcgagcgtgcactgcgcctactgcgacgggtcgtacagccccgaggggttccccggtgtggagctccaggtgcacaactcgtggctctttttccccttccaccgctgctacctatacttcttcgagcgcatcctgggcagcctgatcggcgaccccggcttcgccgtaccgttctggaactgggacgcgccggacgggatgcgcatgccggccatgtacgcggaccggtcatcccagctgttcgatccgcggcgtgacagccggcacgcgccgccgaagctcatcaatctcgactacaacgccaacgttagggagccgaggttcacttacaaacaacaggttgatcacaacctcagggtcatgtaccgtcaggtaattaacagcgtgtgtttacatgctatgaagtatgaactgccgaaaccaagtacatggtcttggaatcttgccaaaactgatcataactttggacgtgcatggcaaaaacgatgttcgatgatcagatggtatcgctgagcccgacgccgtcgctcttcttcggcagcgcgtaccgcgccggcgacgacccgaaccaagggccagggccggtggagagcatcccgcatggcccggtgcacatctggtgcggcgacccgaaccagccggacggcgaggacatgggcaacttctactcggccgggttcgacccgctcttctacgcgcaccacgccaacatcgaccgcatgtggtccgtctggaaggggctcgacgtccggcgccacacggacctcaccgacccggactggctagacgcctccttcctcttgtacgacgagacccccaagctggtgcgcatccgcgtgcgcgacgtgctcgacaccgacaggctgcggtaccggtaccaggacgtacccctgcactggacggccgccaggccaaccgtgaccgccgggacgcggagagcggactcgttcctcgcgcccgcggcgcaggccgctcccgccgccgctaggaaggcgggcgagttccccatcacgctggacgaggcgacgatcgtgacggtgaagaggccggtcgcggggaagaggagcaaggcggagaaggactccaaggaggaggttctcgtcatcgacggcatcgaggtggacagggacgtggccgccaagttcgacgtgttcgtgaacaccgaggaccacggcgcggtgggatcgggcgggcgggagctcgcggggagcttcgtgaacgtgccgcaccggcacgggcacgggcacgggcacgccaagaaggggagagggatcaagaccaagctgcggctcgcgttgaacgagcagctcgaggacctcgaggccgaaggcgacgagagcgtggtggtgaccctcgtgccgcggcaaggcaagggtagggtgaagatcggaggcgtcaagattgagctgatgcattgaagaattcgttgaccatgcaaaaataaagcagtttatttccgcgagagatcgcaataaatggattggcagcagacgttgcttgtgagtttgcatcgcgtgttgcatctgttctaggcgttactagaattttgttccttggtttacacgggactgtccaagtgcatgctgtggttcgaatagattactactgtcgcttcacacctactccgactccgagtgccaggctgccagcaagatcattgtgccttctgttaagactttgatgttataattatgtgaaccaaacaacatcatatatacttcaatcggcagaatcgaagaagatcattgttaatggatcaccgttacaaacgaatggtggtggcgatggccttcaatctcactgcctagctcatgtatatgatcgatggtgtggttgggttactaatctctgttaacccttagtatgttatggagtcttctttcttatagctagcgtgagcgaggagggatcaagcccaagtaatttagtcttgcgtgtccgatcgtcatgcgtgagtgagatgatgtgtctttggcccttaattagaactcaggcattagacttaaggagatcgagatcagctctaacagcaaaaactacaacatcacaaatacccgcttatctctcacctgagtaatctgtgtcatacagttagctcaacttcatgctgcattgctgctaaaaatcagcatcggtcaataactccttgaatgatgttacatcctgcctacgtggtgtaccttttacgaaaggaagattgaagagagcagacagacagctctgcaaatcctccctttgccatgtttcccgttaattagctccccctctacggtcatctatgcttcatgtcgtcgtctgccctgaccatttcggccctaggaggactgctatcattgtctgtcccgctatgcgtgctcttgtgttcagcttccgtgcctccgggagggtagtattgcgggtcggcgaggaaggagagcgccgcgacgacgtcgctgatccccggccggctggcagcgtcctcctgcaggcacatggacgcgacggcgagcgcctggtacagcgccttcactgggtacctgttgcccagcaacgggtcggccagcttcacgaacctcctcttgtctctcagcagaggcgacgcccagttaagtaggcttaattctcgttctcgatcgatcggtgaccgcaaatgagacgagaggagagaaactcacccagttaagtaggacctgctcctcggacggcctggccatgtcgatggcgcggcggccggtgatgagctcgagcagcacgacgccgaagctgtagatgtccgacatcttggtgagcttgccggtcatggcgtactcgggggcgcagtagccgtaggtgcccatcactctggtgctcacgtggctctggtcgcccatggggcccagcttggcgagcccgtagtcggagagcttggcgttgaagtccgcgtcctggaggatgttggaggccttgaggtcgcggtagatcaccggcgggtttgccacctcgtgcaggtactggatgcccttcgccgcgcccaccgcgatccgcatccgcgtgtgccacggcaggggcttccagctcgggggcaagtccaggagatggtcctccagcgagcccctgggcatgtactcgtagaccaggatccgctggttggagtcggtgctgtagcccagcagcttgacgaggttcgggtggtgcaggaggctgagcatcagcacctcgacgaggaactcgccgttgccctggagcccgtccctgtccagctgcttcacggcgatgaccccccccggtgtcctcgaggagccctttgtacacccgtccaaagccgccttctccgagcaggttctgcgaactgaacccgtccgttgcggcgctcagctgactgaacgtcagcgccctgctgggcatgttttggttgctaacccctaggctctcctctgcatgcgatgcattgcattattaattagcctctgcatgcatgcgatgcatttaatttgagtggctggataatcggatctatatacctgacttggccgaaatatcgttgacgaggtccaccagcccgccgatctccttcctggccttcatcttctttctccagaacctcctcttcctccaccttttcttgttgctatccggcgcgaaagctggcgccgacgtcgatgtctcttccttgccgcgcacaccaccaagctgggcggaggcggacggcgaacaacagcacacgcccgcgctgcggagaaaattcttgccgttgctgtatctctttgcggccgatgcgaacatgcccatcgcgggaccgacacgagagtggacggggcaccctcgggtcgttccgcgcgaggagggtggccagatttctgggcgatacttctacgttaacgatggtgtggggtctgtggacgggaaccgtgttcctttttctggacgtgaattccagatttagcaaagtgctgagtgttcttacgctgtcagttacgctgaaaactgtcgtctaaatattgcacaatgttgacggtttttttcgtgcggtgtagaggatccttgctgtttatattatacaaaaaattataaatatatacgtatactaatatattgaaaacaaaaaatataattgtatttgaataaatatactacatccgtttttgaatatttatca

SEQ ID NO: 20851 - DNA, 1772 bp, Zea mays
  misc_feature (525)..(525): n is a, c, g, or t
  misc_feature (560)..(560): n is a, c, g, or t
ttttgttttttttttttttttttttttttttttttttttttttttttttttttttaattagaactcaggcattagacttaaggagacctgcagggggggggggttgagctaactgtatgacacaaatacccgcttatctctcacctgagtaatctgtgtcatacagttagctcaacttcatgctgcattgctgctaaaaatcagcatcggtcaataactccttgaatgatgttacatcctgcctacgtggtgtaccttttacgaaaggaagattgaaagagagcagacagacacgctctgcaaatcctccctttgccatgtttcccgttaattagctccccctctacggtcatctatgcttcatgtcgtcgtctgccctgaccatttcggtcctaggaggactgctatcattgtctgtcccgctatgcgtgctcttgtgttcagcttccgtgcctccgggagggtagtattgcgggtcggcgaggaaggagagcgccgcgacgacgtcgctgatccccggccggnctggcagcgttcctcctgcaggcacatggacgcgnacggcgagcgaagcgcctggtacagcgccttcactgggtacctgttgcccagcaacgggtcggccagcttcacgaacctcctcttgtctctcagcagaggcgaagcccagttaagtaggacctgctcctcggacggcctggccatgtcgatggcgcggcggccggtgatgagctcgagcagcacgacgccgaagctgtagaatgtccgacatcttggtgagcttgccggtcatggcgtactcgggggcgcagtagccgtaggtgcccatgactctggtgctgacgtggctctggtcgcccacccccccccctgcagccaggccgaagtcggagagcttggcgttgaagtccgcgtccaggaggatgttggaggccttgaggtcgcggtagatcaccggcgggtttgccacctcgtgcaggtactggatgcccttcgccgcgcccaccgcgatccgcatccgcgtgtgccacggcaggggcttccagctcgggggcaagtccaggagatggtcctccagcgagcccctgggcatgtactcgtagaccaggatccgctggttggagtcggtgctgtagcccagcagcttgacgaggttcgggtggtgcaggaggctgagcatcagcacctcgacgaggaactcgccgttgccctggagcccgtccctgttcagctgcttcacggcgataacctctccggtgtcctcgaggagccctttgtacacccgtccaaagccgccttctccgagcaggttctgcgaactgaacccgtccgttgcggcgctcagctgactgaacgtcagcgccctgctgggcatgttttggttgctaacccctaggctctcctctgacttggccgaaatatcgttgacgaggtccaccagcccgccgatctccttcctggccttcatcttctttctccagaacctcctcttcctccaccttttcttgttgctatccggcgcgaaagctggcgccgacgtcgatgtctcttccttgccgcgcacaccaccaagctgggcggaggcggacggcgaacaacagcacacgcccgcgctgcggagaaaattcttgccgttgctgtatctctttgcggccgatgcgaacatgcccatcgcgggaccgacacgagagtggacggggcaccctcgggtcgttccgcgcgaggagggtggccagatttctgggcgatctagaactagtcggacgcgtggg

SEQ ID NO: 20852 - DNA, 2680 bp, Zea mays
ccggccgggatttctcgtggccggcccgattaattattattactacaggctccgtggcttttgcctgtcctgtggcagcgaatcggagagcggaggggaggggaaagcgcagcaacgccggcgagcgagcgggccgttcgaggatcgcaatgtgagcacgagcagggacacacaagatgcttcatcctagctgggtcggtgtctcggcacacgtctcggagtattggtctgtgataatcgccactgttgttttcgcatttgttggcgcggtgacaatttactatacagtcaatcagttgaacaagaacatcagcttgagcctgataagggctatcaaggccagggccaagaggtacaagaaatcgaaggacaaggtgcccgctgcatcccacatctggaggaaagaagttgtctcccgcagcaaaggcctgaaatgctgcgtgtgcttgaagtccgtttcacctcctcagtactctggggggaccatccatcagtgcgatatctgcggggccgctgcgcatccgagctgctcggggaatgcacacaaggattgcaagtgtgtatctatggctggtttgggccatgtgcttcaccagtgggctgtacaatggattgacagcgcggatcactctgaagaagactctttctgttgccactgtgatgaatcttgcaatggagctttccttgcaggctcaccagtttggtactgtatgtggtgtcagcgactggtgcatgttgattgtcacagcagcttggccaaggaaactggtgatatctgtgacttgggaccattgaaacgattgatattatcacctctttgtgttaaggagcttcattggacaggtgctgggattttgagttctatcacaaatggggctaatgaattggcttccagtgtccgagagacaattcggattcgtagtaaaaggtacaaaaggggtagcgcttctgctgattcagatagctctggggctattgagctaccatctgatgctgaaggagattcacaagaagtaaacagcaaagcaaaggtgagggatgatcatgccaattgcaaactcaatgaggtacaccaaagctctgaatcagagaaagataagcaacttgtaccagataacgcagcaacaaccaatatgtcagatgtacaacgtgaaaattctcatgtacagaacaatcagaagtacgaaattatcaatgtgccttctgattctaggccacttctagttttcattaacaagagaagtggggcacagagtggtgattcactgagacagcgtctgcaaattcttcttaatcctgtgcaggttttcgagttgagcaaacagcaaggtccagatgttggtttagctttatttcggaaggtaacccatttcagagttcttgtatgtggtggagatggcactgctggttgggttttggatgccattgagaaacagaagtttgaaaccccgcctcctgtagccatccttccagctggtactggtaatgatcttgcgagggttttatgttggggtggtggccttggtgttattgagaagcggggaggtctattctcagttttgcaagatgtagagcatgctgcagtcactgttcttgacagatggaagatcacaataaaggacaaccaagggaaacttatgagaccaccaaaatttatgaacaactactttggggttggctgtgatgcaaaggttgccttagatatacacaacctgagggaagagaaccctgaacggttttatagccagtttatgaacaaggtgctgtatgcaagagagggagcaaagaacataatggataacacatttgattgttttccttgggatgtcaagcttgagatagatggatccaaaattgatattcctcaggactccgaaggtatccttgttgccaatatcaggagttacatgggaggggttgacctttggaagaacgaggatgatgtctctgacacttacctccctcagtccatgcatgacaagaagctggaagttgttagcttcacaggaatgctgcatctcgggaaactgcaggttgggctttctcgtgcaaaaagattagcccaaggccatcatataaaggttgaagtcagtactacaatgccgatccaagttgatggagagccatggtcccaggagccgggaaccatagaggtttctcatcatagccaggccttcatgcttaagagagtctccgaagaaccgctgggtcatgccgcttcggtaatggccgacatcttggaaaacgctgagagcagtggcattatctcagccttgcagaagaggactttgctccaggagatagcgtctaggcttttgtaggacacagttctaacgccagtagttgtgtgtagctcaccctatagctctctcacgtcttcagcagccagaggcttgcttctgggctactagagaattgcgcctggtcgttgtacatacaccatcatggtattttaccctgattcggattgtgttgtgtatgattctgtaaaattttgtacaccctattgggtgagcacacactgacactgttgcggtcggaaaaaaaaaaaaaaaaaaaatggattgctgaaacttagacaacagtctttctgctttgtgagtttggtttttcatctcattatgcccttcgtacagtatgttttgtattcactattaaagccaaaaaaaaaaaaaaaaaa

SEQ ID NO: 20853 - DNA, 2088 bp, Zea mays
ttttttttttttttttgattccttttttttcttaaaagctcatatatggcgtgaggcagctttttacatgatgaatatttctgcgtgtcatggaccagctattgtactttatttacatgatacgtgagcatgtgggcgatgaatttctgagacacgataaataaacccaatcacaccttaaaaaaaattaattgacacatactacgaaccgactgctaacagcaatttttacataaggaagagttgtccaccagtaaagaagtgctagaattttttacacaaggaagagctgcccagcagtcaaaatccagccgatttgcctgttactactatcctcctgagatgctgacggctaccttcgcagagctgcactgcccggtgcttgggaccttgagtcccatgtcgatccgttgttaaactgtccacgaacaggctcgtacctcgctgccgtcgcagaaagcctgttattctgatggtttgatgggtatccctttcgccgctgctgattctggtgcggaccgtcggtttggaaccctgcattatacacctgttgattgtggatctcatatattcctccaggtggcaaccctgctctataagcatggacttgattatggctttggtatggccctgtttgaaacccagtagcgtatacctgctgattatgattctggtagggttcagctgtctgggaccaagtaggatacacctgtcgagcagtatggttctggtaaggcgcggtctgatgcactgcagtatttgttacttgattgcggatggctgtttgccgaactgttgtcggctgcacatggttgtggtattgcactgctgtttcatgtgctgtagtgttcgctagtggattttcatggactgatctggttccagtaaaccctctcgcgctgggtgcttggcctcgatcacgccacatctgtcctctaatcctgctatgcacattattccttggagattttgggtaagagttctctctgactctcacaccaagtttcaagcgaacaacaggggtacacaacagtgccaataattcattccggtcgatatgttccagagacttaaacttgtgacaagcatcattgaatgcaatagcaatgaggtcaaggcctttcatactaactgctctagcggcattatcaggtctctctacaggatcttcaacaaataaatggtaagatttcctcatccaacttgggttgttctggattcgctcaatctggcccgagtaagtagatatgacattatctgttaaggcattgatatgagcaaacttctgaaaaaaagtcccaagtagacgacaagttgaagtttcatttcttcggcccttgttctggagtctaaatctttctatatttgcagcacaaacctcatcaagatgttgctcatcaaaaagtgctgcttctgtaacatctcctgcaatattcccttcataaatctcattcagaggtggtagaattggtggctcagatgtctaaaaatacaagttaataagcaagtcatttatacctcgtttggatgtagaaatagaagcacataattgagaattcgaaacagctttcctaaattatgttgtttggttgcacgtggaattgagatttggaattagaggcccaattccctggaattggactatgactagaaaccccctctcccaatacaaagcctcgccccacggtattgcgtggaattagaccgcacaattccaaactccaattcagtgacatccaaacaatagaattggaattacatctcatttcaataccatgtatgatttggtattcaacccaattcaattccatcctctccaatatcgacgtccaaacgtagcattagtgaaaccataaataagtaggaacacatagagagatacttaggtataagaaacaacacctgaaaatgatagaggacaagtaggcaaagcgaataagagttgagggtcccgctctttggatcgttaatgttttgtgcttttgcccattccttgatcagcaaaaccatatcaccaaaccgctcatctacagtattgacccagtagaagattttggacttaattcgaccagcaaagttgccaattga

SEQ ID NO: 20854 - DNA, 504 bp, Zea mays
agttgcataaataaggttatttaattatacaacaagaaacgaaaacggctttactatatgacagacagacagacaggagcggtggtggtcactgattaattaattaggtatgcgcagcaataggcaccgagacaaagctgctgtggctgtcgtcgggcatttcgtccacgtccccgacccggacaacgctgacggtcaggctcctggtcaccttggtctgcgacggcttgggcttgctggccaggttgttcgcctcgatcctctccaccttcttcaccctcaccacgctctcgactggcagctcgtaactgctcgtggttgctgacccagccctgctactagggtggttgttgttgccgccgcggaacattttcgacatcaatcccggccggccggccggcccctttctaagttctttcttcgctaatcgatgctgatgattttctagctatagattaattgctcgatctgtctcctctcctgggggggggcctacgtagctga

SEQ ID NO: 20855 - DNA, 1442 bp, Zea mays
  misc_feature (17)..(17): n is a, c, g, or t
tttttttttttttttantttttttttttttttttttttttttttttttttttttttttttttttttacacaacagtgccaataattcattccggtcgatatgttccagagacttaaacttgtgacaagcatcattgaatgcaatagcaatgaggtcaaggcctttcatactaactgctctagcggcattatcaggtctctctacaggatcttcaacctaaacaaaagatggcaaagagatgggatgtaagttgtaaaatacataggctaaaattaagataagcaacaacaaccaaatgcataggcattcctacaaataaatggtaagatttcctcatccaacttgggttgttctggattcgctcaatctggcccgagtaagtagatatgacattatctgttaaggcattgatatgagcaaacttctgaaaaaaagtcccaagtagacgacaagttgaagtttcatttcttcggcccttgttctggagtctaaatctttctatatttgcagcacaaacctcatcaagatgttgctcatcaaaaagtgctgcttctgtaacatctcctgcaatattcccttcataaatctcattcagaggtggtagaattggtggctcagatgtttgaaaatgatagaggacaagtaggcaaagcgaataagagttgagggtcccgctctttggatcgttaatgttttgtgcttttgcccattccttgatcagcaaaaccatatcaccaaaccgctcatctacagtattgacccagtagaagattttggacttaattcgaccagcaaagttgccaattgatatatcacaggagatgccaaattgcttgctcacatattgaaggactggaactcttgcatgtgggatgaactgcatctgcatgtatccagtaacacctcgacttagtaaagctttcctaacatctctcaaggcattctgcttctttttcttgtttattgggtggtttgaaccattcccaaactgaactgacaaatctaagtcacctgattttgagtaaagatctgatacaaaagacccaaacggtttgacagcagcacctgacagagatgcaagagaatggatacaattttccagctcctgaattgtggataaccgcttgcttctatcatcctctactggtttgattagtgcaaggatgtccttgatacacttgttcagcacaatattgtcatgaacagaatcaaccatgatgaaatcctggtgtggtgggtgctcgtcgctggcaaagggtcggacgaagacctgggcacctggagtacggcggcggcggcggcggccaagggcctgtactgttcagtcgcctgaccccgttgatgcagatgacggcggaaacgtgactcgagactcgagtcgaggtctagtattgatctcggcctctcgggccaggcgaagttcgcccgcgaggtacccaatg

SEQ ID NO: 20856 - DNA, 4555 bp, Zea mays
tgttaaaaacaagaatacaaatttgtactgtatattctatatactatttattcgcaatcaaagaaaaaactaattaccgaataaataccgtttcccaccgttttcatccctactcacaatgcatgtgctaggaacaaaatcacaagcatagcttcgtcatatagtggaaactacaaaaaccacaatgcttggtaatgattacagaaccaactgtattaatgaaacgagtactttaaatgatgctagtccatgattcttagacaactacaacagaagacaaccatgaattcaataggaacgctagctagttgaccacgtgtctagaactcgtcaaagtcttggaactcctaggtccaatctccaacttctccatctaagtagtagttacatagaatgcaacatagttgttgtagaaatagcaagggcgagtacttttgcactgagcaagtatcttgatttggaaaagtggactaactttatagtggactatctatagcgatcgctattagttggtcaagtttcaatttaattactaaaagcttaaccatatcccaaattatcataagcagtaggtaacctcaaattagtaacagtaatgtaaaaccgcctttgttccatttttggaacactaatctttgaggatctgaatctctcataaccatgatcacgacttatataacactccctgtagagactatacattatacccacaagtcatgatgctcatttgctaggggtcatgaatcccataccaccacttccaaaaaaatagagaaggttcactacgagatctttacaaaaactcctgagagtgtgtggtcatccattacaagttttgtacaaacaatcaagtaccatagttctcccaatgggttactaaaaataccaaataaaccaagttgcactccactaggcaacgagtccagtaccaacttaaaactctcctccttacgccatctttcaggtaagcaagctagaactctagttcatttaattaaccagccaagtatagtggccatataagtctcgtggttttatcattgtcatgggtccttctcagtcatggctccgacgtcttcgtgtgtagcggagctcacactccgcacgcgctcgacgcgcaggaggacagggatgcgcgcatccacgagctcgaggacaggatccgggacctcaacaacgccactagcaagtggtgcttctactcatacatcgacggtagatctccggtggcaatgcaactaaagctagattcatcaaattattagtcatacggtctagaacggcgaaagctagattcatcaaattattaaattttagggccagatctatcatcttggggctcttcaagtgcctaccctacccaagccgcccacacctccccaggtggccgactatggctcgctaagaccaactccagcagattaaccaaagtttatttatatacactgttttgtattgttctgtattgtagattgtaatgtttgcatagtaaagtttaaatatagctataagaataggtaagctgctaaaaatagtttaagacacccggtcacgtcacatcgattttgttttttttttctttttattagagaaacaactctaggagatgatgacacgtaggtctatcccaagagtaaattagttaattcaaaccaaattacggagggtagattagtcaaatcaaaccaaattactaaagaggggtaaatttgtcaatttaaaacaaattaccattacgtggatctagcctagatctagagttgttatataaaagggtgttttttcacccaacggaggtagtttattctatgccacaccaaatatttagatgataactatagatatttaaatattgtctaattataaaactaattagactaaaatacgagataaatttattaaatctaattgaacatatatttaatacacataaatgatattcaaatatttaatgcggcaaactacactttagtgatggaaattaaacacccgttaagtcgaacagtttcataggggattagttgctttttaataaatctcatgagccagattcactatcttagcaaaactgtgtcaaacaggctttaatctatgcgtgtcttgatgaggcgtactccattaacatacctagttttgcctcaagcccttctcgtttctaaacagcttgataagcctcagtacattccatcaatttcttgttttcgtatttaggcctttttaggatagctccggcttcagaaaatttggttgaagttaatgaaacatgtcattagatgctccagacaatcatgaagctaaagttgtaagctttttagtagaaatttagataagctattttgtttactatatagattaaaaatatttttaaaactatttaaattgatattataaactccacactggagctggaatctggagccatcctaaacaatcctaaacccctgtatttctaaattagaagagttcgtcagctggagcagtcatgcctggctgaacggtggattgaaggttacttcttgctaccatctcaaaattcatggtacgcttgaacagtcagcatttttttttttttttttaaaccaggaacaactggcagtatctgcccagttgaaacttataaagctttaaaacaacatacacatatctttgcaacaaagccaaccctgaggtttctctatttgctagcactcctattttacagctaaaccaaaacggacacacttttttgtgcccacttagctgctacttactccataagagcacaccatacaaatccataaggttttcatggatccagggccatcttcataacaagatcattccatgcatcaatggggcctggtacacaccagtgcaagcaatcattttggacgggcgtggatttactgctgccccttgcaaagggatagggtgttctgtaaggcccaacgtggccgtccggtctcaaggacgagaggctgtaggtatccatcagtctcagtctatccatgtccgctgaacccctaagcgcggctacagccttgttgaaggactcaagctcgatctgtctcatgacacgctcgatgttaccctctctgtactctcccttgttgtagggcaatttcctgcgacaagacccaccgctgaaccactctccatcctcgaagtgatcaggtgaccaggtcctgaagaaaattactggcttgtgtttcgctgagacgatgaagttgaaaacgttttgtagagttttccgatacaggtgctcaaaaccaagttcagcgacgttcttgttctgagaattatgaccaccaaccactgcaccgttctcccagtagaccgctgtcctcagaaaccattgtccgccagaaataataatatagtcaaagctctcatactgacttgtccagttagcatcgagtatatcaaggtggagctgtatttcagaggtagacacgccatcctcattctcaaaaataccagatttgatgaggaaaggagcccagacgatggacactgtgaagttgtaggattggaagtgccatctcctgtttttgaattcgttatcatggtaaacctcaacaggttcttcagcctaaacaagcagcaagcatgtgacagtggaagagataataaggttagagcatcagggaatttccatcccaccattatttaaaaaaagacaacggattaaatagcaaaagccaacagcaggaagcaaacacttccagttttggcagcaaccagaaggaagcatgtgacagtggtacacatgaagtttaatgaacactgaacaagagtttcagcggttcttgtaaaaagtatggtaacaggacctttacatttgaatacctgcataatgtctagtatcaaagcacttgttatcaaactaaaacatcctatatattatttaaaagtgaagatttggaaggatgaaaaggggtgaaattttcagtacagttttgtgaaagatcccatcatattcaaatatagaatagggacactgtatagtgcatcgcgggagaacgagaaagtaaagtcggtagcatttaccttagacagaaaggcaaagcaatgactgaacttggttacggaggatggagtcaccaattagtccccaacctttgtttctcatagaatctagaaatcttactgcatcaaatggtggaagatcacatccataaggtttccacttccaatgtagatattccttatcaggtctaccattcatcatgcagttctggtgatcgtcaataaatcgacagcttgcatttgtataggctggaccagaggggtttggtatccattccccattgaaaagactgcattttcctatacaagtaacacctcattttgtgatctgcaacgccggcgccggagaggacggaaaggaccagagcacccggaacaagaggcccgcgagcagcaggaacccgacggccttcaccacgaatggccctaccagcgcccaccatttccctaaaccgcggctccacggccgacggtggtggtcctgaccaccacatcgggctcgaacccatactccagcgcgagcggtgtggcactgtggagcaagtag

SEQ ID NO: 20857 - DNA, 1765 bp, Zea mays
ggctgaacggaggatagaaggttacttcttgctaccatctcaaaaatcatggtacgcttgaacagtcagcatcgagggccaacctgttaaaccaggaacaactggcagtatctgcccagttgaaacttataaagctttaaaacaacatacacatatctttgcaacaaagccaaccctgaggtttctctatttgctagcactcctattttacagctaaaccaaaacggacacacttttttgtgcccacttagctgctacttactccataagagcacaccatacaaatccataaggttttcatggatccagggccatcttcataacaagatcattccatgcatcaatggggcctggtacacaccagtgcaagcaatcattttggacgggcgtggatttactgctgccccttgcaaagggatagggtgttctgtaaggcccaacgtggccgtccggtctcaaggacgagaggctgtaggtatccatcagtctcagtctatccacgtccgctgaacccctaagcgcggctacagccttgttgaaggactcaagctcgatctgtctcatgacacgctcgatgttaccctctctgtactctcccttgttgtagggcaatttcctgcgacaagacccaccgctgaaccactctccatcctcgaagtgatcaggtgaccaggtcctgaagaaaattactggcttgtgtttcgctgagacgatgaagttgaaaacgttttgtagagttttccgatacaggtgctcaaaaccaagttcagcgaggttcttgttctgagaattatgaccaccaaccactgcaccgttctcccagtagaccgctgtcctcagaaaccattgtccgccagaaataataatatagtcaaagctctcatactgacttgtccagttagcatcgagtatatcaaggtggagctgtatttcagaggtagacacgccatcctcattctcaaaaataccagatttgatgaggaaaggagcccagacgatggacactgtgaagttgtaggattggaagtgccatctcctgtttttgaattcgttatcatggtaaacctcaacaggttcttcagccttagacagaaggcaaagcaatgactgaacttggttacggaggatggagtcaccaattagtccccaacctttgtttctcatagaatctagaaatcttactgcatcaaatggtggaagatcacatccataaggtttccacttccaatgtagatattccttatcaggtctaccattcatcatgcagttctggtgatcgtcaataaatcgacagcttgcatttgtataggctggaccagaggggtttggtatccattccccattgaaaagactgcattttccttttgtgatctgcaacgccggcgccggagaggacggaaaggaccagagcacccggaacaagaggcccgcgagcagcaggaacccgacggccttcaccacgaatggccctaccagcgcccaccatttccctaaaccgcggctccacggcgacggtggtggtcctgaccaccacatcgggctcgaacccatactccagcgcgagcggtgtggcactgtggagcaagtagggtactagctcgcaaggagagaccgggagggaaggatggggctcgggagaaaacaagaggcgagtgtgaccgacagcgtccgtgcttagggcagaaacggcgacttgtcggatcagtgctgtcgatgtcggcgtggcgttggtctccgactctacaattttgtttgtggagacagt

SEQ ID NO: 20858 - DNA, 2601 bp, Zea mays
  misc_feature (2564)..(2564): n is a, c, g, or t
aacacatacatcaaccattaattaactaaaacaaaattttgatttgggacggaggtagtatgacgctacacgtagaccacttgaaataataaagctatgcatgcatcagaaacgccagcatgtagttagaacttggcgagcaggtcactgatttcaaataagatggacagacacctagttagaacgttcgaaacaaatacagaaatcgaaagagcaattggctacaaaacagaggcctaaggacataatgttactgctgtgatacaaaatattacagtatgttgctctgatttttgctctcagtttactcggcgcttcagttgttccctgagttgatttgtgcagtgtcatcagacagcttgtctgattcaaacttggcacctgatctagacagacacttccggcgaacctggtatcagtcttcctcgtgcttccttttagaactggagtgatgctccctccgatgcttgtgtgacctcctgtgttcctcatcagagtgttcctcgtcagagtagcggtgatcatctctatgcctatgccttgatttggaactccaacgttcatgctcatgctcatcttccgaagagctacaatggtgtctatgatgtctggattccctgtccttggagtgactcttgttcttatgtttgtgaacatccttgctctggtctcttgaatgctctgggcgatgcttcttccttgagtgcttatagctatcctcagattcatctttttcctcgtcggattcttggtgtttctttctatacttccgcactctgttctgttcatcgtcagagtctttactatgttttgtcaagtttggcccctcatggtcaaacagaacagagctactaccttcacgttccttagccacagattgcagatcaagtccagaggcattcatatcaggaatggccttggcagcttcactagttgggttcgatgctgcagctaaatcattcatcttgttgtctccactcttaatgattgcagcaaacatcttcgcacggcgaagcctatcagctttcagcttctgttcctttgtcatggtagcttccgaagaacctgcctctttggaagctgctgcagcagcagcttttgcaatagtgtttgcaatccaatcatcatcaatgattccaaaaccttccctttgctcgtgccgaatccctgtccccggggccccggcatcactatttgaaatgtgtttggacagtgcatctcggtcctgtaaagatgagaaacttccaaagctggaagaaggatcattactaacatgggtgcgaacattgtccttggttcctttcatggtgttaagtgagtcatttgcagcacccagtcctcgagtagctgccattactatagcagcagcttcatctgcagtgactttccgagtcttgaccccacaaacaggatggaatatacccttcccttgtttgtcatacagctgcttctctgatggcccagatgagcttctatcagaagcactggattccatgctataattgatgtctttgcgctccattgagcaccttctgtcggcgcgttcacgagagcttctgtcagcgcgctcacaggagcttctgtcggcgcgctcaccagggtttctgcccctccggccggaagaacctcttctgtccttgttattaggacttctacccatgtgaattggactgcaaaatcaataaaagaaatagaaacaaaccataattaaatttttccaatggatcgtaggaaaaaaggataacattgactaagtaaagaagctagtgtaatgcttagagcatgaagattctgatcaaacagtgggaattaaagtatttcttgtgaaatcctgcattgaaaaggtgggccaaagtctacaacacaacctttgtattcccagggtataaactaataaaagagaagcatcaacaattataaggttctgtttggatgtagttattgagggggaggaattgatgggctggaataccaaacactctgggtgtgcaggatatttttgatgagttagataacgtacaatatgagaaaatactaattaaaaaatgggcagtataagcttgaaaagcaaagcaaacaagagaagcatcaacaattataaggctctgtttggatgtagatattgagggggaggaattgatgggatggaataccaaacactgggtgtgcaggatattttttatgagttagatcagatacaatatgagaaaatactaattaaaaaacaggcagtataagcttgaaaagcaaagcaaacaagagatgcattcaggaaacaattgaaccaaggaaagtgattcaagttatcaaaacagacattagcaattcatgcccatgaagatgaagaacttttctaaatccaaaaataagaagaaaacattcaccatgtagtacttcaaattagtatagcagaatatcatcaaagtagatattatatttaaaagaaacagaaaagagatgcaaaaagccagtaagcaacaattcaaccaaagaaactgactcatgtgaacacgatacatccaccagaaaatcatgccataaagatgttagaccaaatgttttangttcctagtcccggcccggccggcctcgagggtccca

SEQ ID NO: 20859 - DNA, 1043 bp, Zea mays
  misc_feature (8)..(11): n is a, c, g, or t
ctagaagnnnntcgagtttttttttttttttttttttttatgtcaacctcatgtttcctttgcatcagatattaccagggttccatggtccaagagtcgattcagcctaccagacacaacagcaaaagagtttaaagaaacgaatgttgtcctaggagagtctcactccagtcccatgggccatggcacggcccctatatgaaatggctgagcaggagcattagcaggcactgtgaaatgtacagctgctcatgtattggccccaagacaatggttcacccagagccagagcagagcttttcgagagccatgttctcgtcgccatccacgctcttcagggcacttctcacctgatcctctgggaagcccatctcaaccagcttctgcaccttctcttccatgcccgttgatgcactcttcgcaaaggcctctgtccagtagcgagccgtagcggcaaatgttggatagtcacgcaggtactgttgggcaacaacagcatcctgaggatcatcaggtgcaggagaagaaagcagagcttgaagggaaaggagcgcagtcttcaaggtaagggctgggctccactgatctttcagaatgtccaagcaaattgctccattttggctgctgatgttagggtgccatactttggtgatgaactgcatcttcggaggctcaaagggatatccaccgggcaggcggatatcgatgacgaacgtgccgccctcgtaggggctgtcggcgggcccggcgatggtgccggtgaggtgggagatgttggcgccgtcgtggagcgcgatggagacgcccgatacctcccggtcgcggttgcactcggtgagctccttctgcacgcgcgagacgtccaccatcctcgatcgatccctccttcctcgcggcgccgccgtcacctcctcctggctctcctcgggagcgttgcgattggaggcgagggttgagacttgagatgcggcagttacttccctctcactcgcgcccggcctcgagctgccctgtccttaatcccggccggcttcgaggtaccc

SEQ ID NO: 20860 - DNA, 3365 bp, Zea mays
ccaacaagtggtagtgcaataatattgacaatgacatgttgtccatcgactatgcctttcggtatgatcttaggccctaactcaccttctgtggacgatccttgtataggtctttagatttcagtctagagtatgttctcgttcacttttcaagaaaatggctataaagaacaaattaactcttagtggttagtgacttttttaatcctttggaccttggttctataggggaaaattaaaaagattgagaaataggaccatctgatttgatttgttctcagtagccatgagacttagggtgatttttttttcattggatgctcttattacactcgtagtctttgaagggggggaccactggaaacagttgctaataaccacatgtagaaagcttaattaattcggattgacatgaggacccaactttgttgcatagctagaatttttcccattatttgacttttcataaagtgcaaaaagaaacaggggaggaagaatggaagggtgcaattaggtgtgctctaccactgagctaataccccatagcacgggccttccaaaggaagaactgctaagccaaaagcgagaaaaactccatctaccatgtgatttgttatgtaaatattcatatgttcttttctattatgaatcaggattgtatggccaaccattgcggatagatgcgtctttttctttggcctttttttactttgaactcggaacaaccctgaagtgattaactgagtgaatgctgccaagttatatcagcaagcgcaaggctaggcatccacttgcaagttacaacagcatttagattataacacaagatggtgaaaaaaaatacaacaatggacactctcctaacgaacaacaccaaatctcaggtattcagcagcagcagcagcatcaggcagttgttagctggagtctatacccgaaacattaagcagcagcaacatgaaattgttaacaggagcctatacccacatcttctttgtggcttccatccgctcgagcaagccctggatttcggtctgcatccgcagcttcatcttgtggtagtcgtagtgcgagttctcgagcgtcttcagctcttcaactttcttcctcctcttctcctccgtctcctggaagcacagctttgccaccttcgtggcgtactcctcctctagtttctgggtcttggtgcggacgatctgccggtagctgtctacctccttcctggcatcatcggccagtttctggaacagtttcgcctcagcttccttgcacttcacgatggtctcaaggctggaggagtcgtcgtcctttgagctggagctgaaatggggttctatagggagtggttttgggctggccttgagcacatcgatctgtgaatcaagaatggaggtgctcggcttgaagttaaacggggattttggcggagtgatggttggggtctgaagatgaagcatatctgtagatttactcgtctgagccgccagtattccttttgacttgctaccagtaacagaacagtctgttacaccatatttaaagaattgtagcatggtgttcgtcgcatcagaaggagaaatgagtttctttacaagcatgctgaggacctcttctgccttggcatggagccccttcccctcgaaatcctcactagcagcaaatatcttcctaacaaagtccagctctttaatctgtgtctcagcactccagttctgagcacagcaattgaacacctccttaacaaacccaaacatctcagaagcatggttgcagccgaggcactggaactgcatctcggtcgtgcccatcgcccccttcaatgtcggacctggccttatcaagttcttctctagcgcgcacgcagcatggcaccaatgggagcagacatcacatccaacccagctgcatgtattcgcagcacaatcaaacttctggcacaccgggcacatacacgcactgcagaagcccttcttggtggagcaaatcttgcactcgcagtcgtccacagggacggcactcttgcagttcaggttgcggcaccgtgtcatcagaaacatctccacaagctcgctgctggagactcggcccttaccagtgacaaaagtggccatgccggttttgatggccaccaggatctccagctgcgtcttgtttgcccgccccaacacctcggcagtcaggtccgagcgacgctccagcttccgctgcaggctcgacagctcatccctcttctccggagcatcaaccataccccgcactgtctcccgcagcacctccagggtttcactcggaaaatcctgcagggcctgagccatggctggcacagggtccgacacgatctcccgcaggatcctatgaggccgtgacgagtgcatccctccatggctggcgtcaaagctggcgccagcgctgagcgcggctgccatcctggcggggagctccgtggggaagaaggacgaggtgccctccttgagctgcgccggggcgaaggcgacgctgccgtcccccatggggcggaagttgaaccggctgtggacggagccgttggtgccctccccggcggcgtagatgtcggtggagttgtgcgtgagggagcagctcgggttgtgcgagaacaccgagtaggagtaggacatgtcgtcggagttgatgctccgggtgcgccccgtgttggcgctgtaggtccgcctggggggcggcgcgacaggcgtggcaggcaccgcggcggctgcggccgcggtcgcgccccgcagatcgccatcgaccgggaggagtgacgcgagctgcggcggaggcagggaggaggacggctgctgcgaggccggcggcggcgcgggcgcgtcggtggagagggagagcgagagctggagcgagtctaggcggggcttcttacccccgaccacggaggagtcgtcgcctggcggatccccgcgcttgggcgcggagaggtggaggaaatcccgctcgacgcacagcttggcgctggccgcggcatcgtctgccggggcagccgcctcggggttgggcggcgaggatggccccgccgccgcggctggcggcgccttgtcgcagaggtagctgctgagcgtgagctcccggtttgggaaaggcggctccggcgggttggagttggacccgggcgcggcggcgctggcgtccttggatccgtcggagtcgccgaacatcgtcgctggatccggcctccgggtgagcgcggggcggatttcggtgcttttttttgttgttgttggccggcgggcggggaagggagggggcgggcgctgcgctcggttgacttctgcacgccaaagcacccaccaccaccacgccacgtcgccacgggcggaaatggagtggaaggtgag

SEQ ID NO: 20861 - DNA, 1189 bp, Zea mays
  misc_feature (18)..(67): n is a, c, g, or t
  misc_feature (183)..(183): n is a, c, g, or t
  misc_feature (1162)..(1166): n is a, c, g, or t
aatcgcggccgcgtcgannnnnnnnnnnnnnnnnnnnnnnnnnnnnnnnnnnnnnnnnnnnnnnnnngcagcacaaactggcaaaccaactgagtgaatgctgccaagttatatcagcaagcgcaaggctaggcatccacttgcaagttacaacagcatttagattataacacaagatggtgnagaaacatacaacaatggacactctcctaacgaacaacaccaaatctcaggtatttcagcagccgcggcagcagcagacagttgttagctggagtctatacccgaagaaattaagcagccgcaacatgcaattgttaaccggagcctatacccacatcttctttgtggcttccatccgctcaagcaagccctggatctcggtctgcatccgcagcttcatcttgtggtagtcgtagtgcgagttctcgagcaccttcagctcttcgactttcttcctcctcttctcctccgtctcctggaagcacagcttcgcgaccttcgcggcgtactcctcctccagtttatgggtcttggcgcgcacgatctgccggtagctgtctacttccttccgggcatcattggccagtttctggaacagttttgcctcggcttccttgcacttcacaatggtctcgaggctggatgagtcgtcgtccttcgagctggagctgaaatggggttctatggagagtggttttgggctggccttgagcacatcgatctgtgaatcaagaatggaggtgctgggcttgaagttgaacgaggactttggtggagtgatggttggggtctgaagatggagcatatctgtagatttgcttgtctgagccgccagtattccttttgacttgctgccagtaacagaatagtctgttaccccatatttaaagaattgtagcatggtgttcgtcgcatcagaaggagaaatgagtttctttacaagcatgctgaggacctcttctgccttggcatggagccccttcccctcgaaatcctcactagcagcaaatatcttcctaccaaagtccagctctttaatctgtgtctcagcactccagttctgagcacagcaattgaacacctccttaccaaacccaaacatctcagaagcatggttgcagccgaggcactggaactgcatctcggtcgtgcccatcgnnnnnttcaatgtcggacctggccttat

SEQ ID NO: 20862 - DNA, 3299 bp, Zea mays
gacccaacaactagcaactccaatctgcttataaaaaatactgtatctgcaatgatatagttttttttttttttttgtttttagcagcacaaactggcaaaccactaactgaatgctggcaagttatatcagcaagcgcaaggctaggcatccacttacaagttacaaaagcaggtagattgtaacacaagatggtaagaaacataacaatgggcaaactctcctaatgaacaacaccaaatctcaggtattcagcagccgcggcagcagcagacagttgttagctggagtctatacccgaagaaattaagcagccgcaacatgcaattgttaaccggagcctatacccacatcttctttgtggcttccatccgctcaagcaagccctggatctcggtctgcatccgcagcttcatcttgtggtagtcgtagtgcgagttctcgagcaccttcagctcttcgactttcttcctcctcttctcctccgtctcctggaagcacagcttcgcgaccttcgcggcgtactcctcctccagtttatgggtcttggcgcgcacgatctgccggtagctgtctacttccttccgggcatcattggccagtttctggaacagttttgcctcggcttccttgcacttcacaatggtctcgaggctggatgagtcgtcgtccttcgagctggagctgaaatggggttctatggagagtggttttgggctggccttgagcacatcgatctgtgaatcaaagaatggaggtgctgggcttgaagttgaacgaggacttgggtggagtgatggttggggtctgaagatggagcatatctgtagatttgcttgtctgagccgccagtattccttttgacttgctgccagtaacagaatagtctgttacaccatatttaaagaattgtagcatggtgttcgtagcatcagaaggggaaatggttttctttacaagcatgctgaggacctcttctgccttggcatgaagccccttcccctcgaaatcctcactagcagcaaatatcttcctaacaaagtctagctctttcatctgcgtctcagcactccagttctccgcacagcaattaaacacctccttaacaaacccaaacatctcagaagcatgattgcagccgaggcactggaactgcatctcggttgtgcccatcgctcccttcaatgtcggccctggccttatcaagttcttctctagcgcgcatgcagcatggcaccaatgggagcagacatcacatccaacccagctgcatgtatttgcagcacaatcaaacttctggcacaccgggcacatacatgcactgcagaaccccttcttggtggagcaaatcttacactcacaatcgtccacagggacggcactcttgcagttcatgttgcggcaccgtgtcattagaaacatctccacaagctcgctgcccgaaactcggcccttaccggtgacaaatgtggccatgccggtcttgatggccacccggcccgcctcctgcgtcccgttggcccgccccaatacctccgcagtcaggtccgagcgacgctccagcttccgctgcaggcttgacagctcgtccctcttctccggagcatcaaccatgctccgcactgtctcccgcagcacctccagggtttcgctggggaaatcctgcaggacctgagccacggcaggcacggagtccgacacgatctcccgcaagatcctatcaggccgtgacgagtgcatccctccacggctgccgtcaaagctgccgccagcgctgagcgccgctgccgccctcgcagggagctccgtggggaagaaggacgcggtgccctccttgagctgcgccggggcgaaggcgacgctgccgtcacccatggggcggaagttgaaccggctgtggacggagccgttcgtgccctccccggcggcgtagatgtcggtggagttgtgcgtgagggagcagctcgggttgtgcgagaacaccgagtaggaatacgacatgtcgtcggagttgatgctccgggtgcgccccgtgttggcgctgtaggtccgcctcgggggcggcgcgggcgcggcaggcactgcggcggcggcggcgggcgcggcgctcccgcaccgcagatcgccatcgaccgggaggaatgacgcgagctgcgacggaggcagcagggaggaggacggctgctgggaggctggcggcggcgcgggcgcgtcggtggagagggagagcgagagctggagcgactctaggcggggcttcttaccccctaccacggaggagtcgtcgccgggcgggtccccgcgtttgggcgcggtgaggtggaggaaatcccgctcgacgcacagcttggcgctggccgcggcgtcttcggccgggccagccgccgcctcggggttgggcggcgaggatggccccgccgcggcgggcggcgccttgtcgcagaggtagctgctgagcgtgagctcccggctggggaagggcggctccggcgggttggaccctggcgcggcggcgctggcgtccttggatccgtcggagtcgccgaacatcgtcgctggatccggggcgagcgcggtcggatttcgttgcccttttttttttgttcggccggcggggaagggaccggcggagcggggccgggccggggtggcgggcgctgcgctcggttgacttctgcacgccgcagcacccacgccacgcggaaatggagtggcaaggtgaggactgacgtgaccaggaaatgaattaatgaaatgggatttgctttgattgtatttgtttgtttattttctcgcttggtttttcttgtcatttgattttgtttcgagcggatggggttcaaagcggcgcggcggctagcagccatctctcggcttcgggccggctattttaccgactggtcgacgtgtcgtgtaatcgggcgcaccgcgtttgaacagtgactacgtacgcgcaaggcgctggcgtttgagtttgaccaatacgtacaacgaaggaagaggaacaaaacccccccgtcagtcagtctctctagttctctactgtgcaccgcgggaccaggcgtgaccggtgtgagtagtgaccgcaatccgtccctgtagagtgtagaactatggaacggtgcacgggatgtggtttctttttttaatatacaaatatctcgcatgtgaattcgtaccagaaccaccgggcgtgtggaccacaggactgacagcagtatctcggtacgggcggacctatactttcgtggagccgagagggagcgggcctcattggctgactaacttcctcccacaat

SEQ ID NO: 20863 - DNA, 968 bp, Zea mays
ttttttttttttttttgtgaaatgtgggtgtaaagcttttcttttttaaggaaaccacaattgtatttgtcaaagtgtgcatagattgccaccgtattctgaatctctgagctggaaaacactgcatcacagagccagatatggccaagccttcacatcaaacgacctgcatagcacgctcgaggatactcatgctgcagctgggaccactgcacgaagaactggtcagcgatccgtagcttgtacaacagtaaaccactcaatgacagtttcttcactcttgcgatgctttcaatgtagaaaatggatgaccatcccaagccaagcaccttcagaacgaaagccgagatgcatagaggaaagcacgtccctggaccgttgcagaatatcacttgtggtctgattcttatcaccagccacatagcatgcagcgtggctagcaatgttgttgcgatggatgtaacataagactggcccacttcacgactacgatatatctgcatgaaatgagcgctctcgccagccttcgttccgttgctctgaataagtgattgttcatagacctgtgccttctgaagactcatgttgtctgtaagtgcagccacatagtaccttggtgtgaacctatccttctgaagtgttgttactatgttcatcatttctgcggtatgccctccttgctcggtgtttcttgaatctcagcgctcttgaaggttgcatctgttagaatgaatgtccagacattgtcgcagaccctattggtgtgcagatgaccctgtggtgtgtcagtcgccggcaccggagaggagaggcagacggatgttggcgatctgccgatcttggtgaaactaaagaccttcttttgcactgcacttcacttcgactgtgtcgttgactcgttgggcattctaagctgagagcagctcaagactgaaagagatggaatggaattctgatacaatctgaag

SEQ ID NO: 20864 - DNA, 1170 bp, Zea mays
  misc_feature (12)..(17): n is a, c, g, or t
  misc_feature (19)..(20): n is a, c, g, or t
  misc_feature (25)..(25): n is a, c, g, or t
  misc_feature (33)..(35): n is a, c, g, or t
  misc_feature (37)..(37): n is a, c, g, or t
  misc_feature (40)..(40): n is a, c, g, or t
  misc_feature (48)..(48): n is a, c, g, or t
tttccgcccttnnnnnntnnttttntttttttnnnanaanaggctaancatttgtgtttgctcgagaaacggtgtcgtttcactcaatttgaggcttgaacttacaatgaaccatcccatctagaatggtaaactcccaaaaccaaaacactatatgcgtaactagcatttccatgcccgcatatatgaaatgcgttgtttgttgtaaagcctttctttttaaggcagccacatttgtatttgtcgaagtatacatatattgtcattgtattctgaaccccttagttatggtggaatcttcacatcaaacgacctgcgtagcatgctcgaggatacttatgctgcagctggggccactgcacaaagaactggtcagctatccgtagcttgtacaacagtaaaccgctcaatgacagcttcttcactcttgcaatgctttcaatgtagaaaatggagcaccatcccaaaccaagcaccttcagaaggaacgccgagatgcatagaggaaagcatgtccctggaccattgcaaaatatcacttgtggtctgattcttattactagccacatagcatgcaatgtggctagcaatgttgttgcgatggatgtaacgtaagactggcccacttcacggctacgatatatctgcatgaaatgagcgctctcgccagccttcgtcccgttgctctgaataagtgattgttcatagacctctgcctttctgaagactcatgttgtctgtaagtgcagccacatagtaccttggtgtgaacctatccttctgaagtgttgttactatgttcatcatttctgcggtatgccctccggagccaaggacaatgagacaactcaatctcgtggcgcacaaccttgactctggttggccactgcgccacagtacgtagaagaagcggactgtgagcacagaggcaagtactggaaagacgtagcaggcggccaccaccgcattgagacccatcttgctcggtgtttcttgaatctcagcgctcttgaaggttgcatctgttagaatgaaggtccagacattgtcgcagaccctgttggtgtgcagatgaccctgcggtgtgtcagtcgccggcaccggagaggagaggcagacggatgttggcgatctgccgatcttggtgttaccaaagaccttcttttggac

SEQ ID NO: 20865 - DNA, 1699 bp, Zea mays
  misc_feature (39)..(39): n is a, c, g, or t
  misc_feature (78)..(78): n is a, c, g, or t
  misc_feature (86)..(86): n is a, c, g, or t
  misc_feature (99)..(99): n is a, c, g, or t
  misc_feature (102)..(103): n is a, c, g, or t
  misc_feature (148)..(148): n is a, c, g, or t
  misc_feature (174)..(174): n is a, c, g, or t
  misc_feature (182)..(182): n is a, c, g, or t
  misc_feature (196)..(196): n is a, c, g, or t
  misc_feature (201)..(201): n is a, c, g, or t
agcagtgaccacaagaccaaaagaagcctcagttttggnatccagaagcaactggccatggaaagcagtgggatcggnagagtggncccactggaggcngtnntcttcgacatcgacggcaccatggccatctccgacccgttccacnaccgggccacctcggagatgctcctnaaggtgangctacaacaacggngtgcncatcacgccgagttcggcatggcgaacatggccggccggagcaacgagtagatcggccgcttcctgttcccggactgggaccagcgccgcctcgacgccttcttcgccgagaaggaggcgctcttcgccaggtacgccgccgaggggctccgggagatcgccggcctcacgccgctctgccgctgggccgccggccgcgggctcaggcgcgccgccgtcaccaacgcacccagggccaacgccgagctcatgatctccatcctcggcctctccgactttttttccctcgtcgtcaccgccgaggagtgcggccgatccaagccctaccctgacccgtacctcagggcgctcgatctgctcggcgtctcgccggaccacgcgctcgtgttcgaggactccaccactggcgtgcaggccggcattgcggcagggatgccggtggttgccatcgccgaggaaagcagggaggacaggcttctcgccgtcggcgcaacgctcgtcatcagggactacgaagaccccaagctatgggcggctttggacaaactggacaccaccaggcctcaagctgctgctgctgagaccaatggaaaactcacacaactgtagctgaggaacacaagtgctagtagccaaaaacaatttcttgcaatattccacttccacgcaagattcaataacaactcattcgtgtatcttgatgagatgcatacaaaattgcctgtaggccagtctgttacagacaaatggaaatggaaacaaaagtgatcgcgataacatgcagatttctatttgtatctaaactactctaccacaggctctcacatgaaattataatgtgcttcagaaatgggtaaaagacaccacatttttttcacaaggttgtcctcgtatacacactaacatgtggacagctggtgatggatcagtttgacgagtatctcattgacaacgcctcataattcttgatttgctgttcagatactgatggcttgatcttcgatagagcacgttcgaagtgcggcatctcaatcaagctagacgaactcagtgaggatgtccccttgtcacggaattccagtctctcttccagtgctgccatggctgcttcattgaccagtgatgctaggtcggcaccagtgagattgttgcactcagcacgacgaccaagtgcatccaaatcaacatcagtcgagatgggcttgctacgagcatgtgcctttaatattgaaactctctcgtctgcaccaggtaaaggtacataatgtttctttccaaatctaccgggacgtaaaacagcatcatctatcacatcaatcctgtttgtagctcctatcacatagacaccttgtctttgatcagcaccatcaagttctataagtaactgatttaagagacgttcaacaacccatcctccctctttcccctctttttgttgtcaaagcatcaacctcatcaaaaaacaggatgcattggggagttagtccgcgcacgagtg

SEQ ID NO: 20866 - DNA, 4729 bp, Zea mays
gacgccacttcgttgcggttttagatttaccacccactcgttccgagcctgtgcgtggtcaatatgtgtgtgagatgaattacatactgtttctgctcttcttcttctgaaaccgtcgagttgcgtgactaccatcgagcgatgcacagcctgagatttatcgcgcgcgcacaaacacgcatactcgttccaagttcctgatcacctgatgattcaaatgatgggcaattgcctcttgggcatgcctgcagctccctcgcggcaaccgttccggtccaggcggttctgttcgacatcgacgggaccctgtgcgactcggatcccctccaccacgtcgctttccaagagatgcttctcgaggtacggtggaacgtcgcttttccctgtttcacttttctttttttaaaccaacgagctgcctgcgatgtgatgtggtttgatttacgaaaccaaaatggctggcatggcatacgcagatcgggtacaacaatggcgtgccgatagacgaggagttcttcatcaagaacatcgctgggaggagtgacgtcgaagctgcccagaacctgttcccggactgggagcttgagaaggggctcaaattcctagaggacaaggaagccaaatacaggaggtacgtacaaatgatagctgtggttttcctcagtattagatcaactgaaagattcagagagtaagcgtgttgtccattgttacaagtttacaacagtaaacccctttgcgtaccgtagcacatacataaataacatccatttcagcgctatcacgcaaaaaaaaaacaccaactttttgctactcagagagatcgattactaggttgtggagagttctgtcatttcctacagcgcccattcgctgctgattctgcggaatgtgatcctttcataatcattacaatacattgcattgcattaacagaactgataggttcgttatgacaacgtgcatgagtgactgaatgtttctagttgttggttctttttattcagtctggcaaaagagcgcttggtgcctgtgaaaggcctcgcgaaggtggtccagtgggtgaaagaccacgggtacaagcgcgcggcggtgaccaacgcccccaggatcaacgcggagctgatgatctcgctcctgggcctctcggacttcttccaggccgtcatcgtcggaggcgagtgcgagcagccaaagcccgcgccgtacccttacctcagggccctcaaggagctccaggtgtccgcagagcacagcttcgtcttcgaggtaaaatcaaacgaccttgtgactgggattctgtgatctgatggttgtattacaggagtagtcactgataaaagatgagatttctttttgggttggtgtaggattctcctgctggtatccgggctggcgtcgcggcggggatgcctgtcgtcggtgtggcgacgaggaacccggagaagtccttggtggaagcaggagccgcgttgctcgtcaaggactacgaagatcctaagctctgggcagcgcttgaggagatggacggagaggaagctaagctgaagaaggccagcgaatgatctgatatgacgatgagccattgattagatttattgcagattaaatctgcctccagcatgattctgttcctagttatgcgctgcggagagagctcacctcatcagggtatttatgagattctagcttcgtatattgtttttcttcttcttgattgaactgagatcaaataagacaaagctgctgtgccttgttgtgtgccatctgtgtatgaacttttcggttcagcctccagcagtctttaatctgaaagaaagacgaggtaggaattctctccctcagggaagatgtgtgaagaatgcaccgtgatgcttgttgcttgtcgaatccatggacgtcatcctttttgagcttcagctctgctacgcaaaccgtgttgaaagtggtttcgggggctatgcagcatgtttttttttttttggtcgtcagagagttcaaaaaacagcaaataatttgaacgccgtttggaaaggcagccacaggtcaaaaggaagaaaagggtggagctgctgagatgctgcagggtggtgtggaacatgagaatgtgagagactaccaccaaccgcgccaactgaaccacggaatcctcaccaactctccctgcctcttcagtcttctccttataaaatgtgcaggcagcatcagcactcgagcagtgaccacaagaccaaaagaagcctcagttttggcatccagcagcaactggccatggaaaggtaatcatccagagtattttctgcatgatttcactcagttctattcccccattcccagagagacagaaactgtcaagatttcgtttcaatccgaccaaaactgtcaagatttcatttcaatccgagcaagttctccgcaacagcagtgaccacaagaccaaaagaagcctcagttttggcatccagaagcaactggccatggaaagcagtgggatcggcagagtggcccccctggaggccgtcctcttcgacatcgacggcaccatggccatctccgacccgttccaccaccgggccacctcggagatgctcctcaaggtgggctacaacaacggcgtgcccatcacgcccgagttcggcatggcgaacatggccggccggagcaacgagcagatcggccgcttcctgttcccggactgggaccagcgccgcctcgacgccttcttcgccgagaaggaggcgctcttcgccaggtacgccgccgaggggctccgggagatcgccggcctcacgccgctctgccgctgggccgccggccgcgggctcaggcgcgccgccgtcaccaacgcacccagggccaacgccgagctcatgatctccatcctcggcctctccgactttttttccctcgtcgtcaccgccgaggagtgcggccgatccaagccctaccctgacccgtacctcagggcgctcgacctgctcggcgtctcgccggaccacgcgctcgtgttcgaggactccaccactggcgtgcaggccggcattgcggcagggatgccggtggttgccatcgccgaggaaagcagagaggacaagcttctcgccgtcggcgcaacgctcgtcatcagggactacgaagaccccaagctatgggcggctttggacaaactggacaccaccaggcctcaagctgctgctgctgagaccaatggaaaactcacacaactgtagctgaggaacacaagtgctagtagccaaaaacaatttcttgcaatattccacttccacgcatgattcaataacaactcattcgtgtatgtatgatgtccttgatgagatgcatacaaaattgccggtaggccagtctgttacagacaaatgaaaatggaaacaaaactgatcgcgataacatgcagatttctatttgtatctaaactactctaccacaggctctcacatgagatttataatgtgcttcagaaatgggtaaaagctggtgacggtgcacactccttgcaaacacggtacagaacaccacatttttttcacaaggttgccctcgtatacacactaacatgtggacaactggtgatggatcagtttgacgagtatctcattgacaacgcctcataattcttgatttgctgttcagatactgatggcttgatcttcgatagagcatgttcgaatgggagaaataggctacacggtagcacaatggcgagcaggaaaattagcactagcgtcaggaagtcattttggcgtttgcccatacctgttcagatactgatggcttgatcttcgatagagcacgttcgaagtgcggcatctcaatcaagctagacgaactcagtgaggatgtccccttgtcacggaattccagtctctcttccagtgctgccatggctgcttcattgacctgaccaaataagcccattagcttggtacagatatcttggcgaatgcagctggattgaattcattgtgcaaacgcaagcactagtgctccttttgggcaacataaacaacaactgttcagtggaatatcacaaatattaccagtgatgctaggtcggcaccagtgagattgttgcactcagcacgacgaccaagtgcatccaaatcaacatcagtcgagatgggcttgctacgagcatgtgcctttaatattgaaactctctcgtctgcaccaggtaaaggtacataatgtttctttccaaatctaccgggacgtaaaacagcatcatctatcacatcaatcctacatcagaaagtgctacaggtgtcaatgatatattcaggggtaaacatgtactacataagatggtagaatgtcagctgctgaagattacctgtttgtagctcctatcacatagacaccttgtctttgatcagcaccatcaagttctataagtaactgtggacagaagaatatgagcaacacagaacagaagagcaatgcaaatgagtgaagaggcaggtgcacaatctagtagaatgctcaaacctgatttaagagacgttcaacaacccatcctccctctttccctctttttgttgtcaaagcatcaacctgatacatcatatggaaatagaacttgaacaccataacgagagaaacagctctccaaactgtgttgcttgtattaaaaatgcatcaaacatagcagacttgtttgaagcattcggtacaagttttccttcacataatgtactacagagcaggcgac

SEQ ID NO: 20867 - DNA, 1416 bp, Zea mays
  misc_feature (1371)..(1371): n is a, c, g, or t
  misc_feature (1399)..(1403): n is a, c, g, or t
gaagcaaagcggccggcccacaccaccacacacacacacagcacaggggagggagacgagacgagatccaaaattccctggcggtgggctgtggctggtaataaagctcgcgccacgggagccacgcacgcggacgccggcatattcgccaaacgcatcgcatcggcctcggccaccggcgcggctgccctcctcctcttctccgtcgatccggagaggactttctctcgcctgctcgtcccttccgcccccgccggccggccggtcctcttcccggcccactccgttccgatcgaccatggcggctaccgcccccaacggcaatcccactgtcagctccctcgcggcaaccgttccggtccaggcggttctgttcgacatcgacgggaccctgtgcgactcggatcccctccaccacgtcgctttccaagagatgcttctcgagatcgggtacaacaatggcgtgccgatagacgaggagttcttcatcaagaacatcgctgggaggagtgacgtcgaagctgcccagaacctgttcccggactgggagcttgagaaggggctcaaattcctagaggacaaggaagcaaaatacaggagtctggcaaaagagcgcttggtgcctgtgaaaggcctcgcgaaggtggtccagtgggtgaaagaccacgggtacaagcgcgcggcggtgaccaacgcccccaggatcaacgcggagctgatgatctcgctcctgggcctctcggacttcttccaggccgtcatcgtcggaggcgagtgcgagcagccaaagcccgcgccgtacccttacctcagggccctcaaggagctccaggtgtccgcagagcacagcttcgtcttcgaggattctcctgctggtatccgggctggcgtcgcggcggggatgcctgtcgtcggtgtggcgacgaggaacccggagaagtccttggtggaagcaggagccgcgttgctcgtcaaggactacgaagatcctaagctctgggcagcgcttgaggaggtcgacggagaggaagctaagctgaagaaggccagcgaatgatctgatatgacgatgagccattgattagatttattgcagattaaatctgcctccagcatgattctgttcctagttatgcgctgcggagagagctcatctcatcagggtatttatgagattctagcttcgtatattgtttttcttcttcttgattgaactgagatcaaataagacaaagctgctgtgccttgttgtgtgccatctgtgtatgaacttttcggttcagcctccagcagtctttaatctgaaagaaagacgaggtaggaattctctcccccaaaaaaaaaaaaaaaagaatgcaccgtgatgcttgntgcttgtcgaatccatggacgtcatccnnnnngagcttcagctct

SEQ ID NO: 20868 - DNA, 2228 bp, Zea mays
cagcgcgtcccccccggccgcccgggcgggcgggcccgcactagacccaaatcctcgtagctccagacatccagaacggcagaaccttctagaccaaaccttcgacccatcacctcgagctccagccatgtcgctctcgtcggcgcgccagcgccgggccactgcagcgtcgccaccgacagatgatgggtacgccaaggacgccaaggacaggaggcggcggcccggcggagacggggacagcgaggacgagggtatcaagtggttcctcccgttcctggcgctcgggctcctccgccacatgagcgcgtcctccaacctgatccacgactgcgacgaggtcttcaactactgggagcccctccacttcctcctctaccgctccggcttccagacatgggagtacagttccgactttgctcttcggtcatatttgtaccttttctttcatgctcttgtagctgggcctgcttcattgatctttggtgagcataaggttcgtgtgttctactcagtgagaatctttcttggtctcatttcaactattaccgaaactgttctggtggttgctctttcaagaagatatgggaagcggcttgcttgttatgttcttgcaatgctatgcttatccagcggttgcttctttgctagtaccagtttcttgccaagttcattctccatgtatgcagtaacactttcgtctgcactcttccttcttgagaaatatgctggtgcagtctcagttgcagctgctggagtgatccttggttggcctttctcaattttggtcttcctccctgttaccgtttattctctaattagaggatcttttagaagggtttttctatctggatttgtgacttcactgtgctttcttgttctttcgtttgttgctgattattactgctatggtcgattgacattctcggtgttcaatcttctgaaatataacgttattggtggcggcgaaagtcacttgtatggaaccgaggggttttcattttacttcaggaatggattcaataatttcaattttgccttcatcctggctcttcttttcttgggggttgtaccatttgcaagaaagaaatatgctcctgatctcctgatagttgtctctcctgtctatatctggttggctttcatgtctttgcaggcacacaaagaagaaaggtttctctatccaatttattcattgatatgtgttgcagctgcagctgttattgacagtttacctgattttttccatgacaaatattcatctgatcagtctatttttgaaaagatagcgaagggtctgcgtcctttgatacttggttttattctgtgtgcttcccacagccgaacattttccatgttaaatggatatggtgctcccctgcagatctatcagcatctagaacatcatgatgacactggacccgggtctattctgtgtgttggaagtgagtggcatcgctatccatcatcgttcttcataccctcttatatcagtgaagtccggtggatagatgatggcttccgtgggttacttccatttcccttcaacgagacactgggtgggaccactgcagctccgtcctacttcaataacaagaacaaggcggctgaagggcaatatctgaaagacattggagcatgtaacttactggtggaacttgatctaagacggccttacccctcgcgcgggagtgacttgtcgacatgggaggcattggccgcactgccgttcctggacagagagctttcccctgcattatatcggtccttcttcataccataccgatggcaacaaaacaatgtgttcggcctgtacaagctactgaggaggttgcatcctgaccatgcgtaatcaagggaaatgtggggtttgcttcaatgagcttaatcacgtgatttcttttaacaaacagcttgcagatttttactgccatagattttctgatcccaatgtgtaatggcgtacctatttttgtcccactgatccttccatcatacaaattcatcacgagatgacgaggatgagagtgctcaactgctgatgtagggagggatgttcgaggagaatcatgttgtgaaacggctgcttcgccagttgttacctttttggattgtttgttgaatattagccaatgacagactgatagatctatacctttttatgttgagcattttttgcccccccgtaaaaaagtaaaaaaaaaacacgagggggggcccggtaccca

SEQ ID NO: 20869 - DNA, 1848 bp, Zea mays
  misc_feature (3)..(7): n is a, c, g, or t
atnnnnngggctgttatgaattcggcacgaggccctgcgcgtcgctggactctaatagcgcgacacgcgagaggcaatggctgtgcggtggtgcctcctcctgctcgtgttagtgttggctgcggccgcggcgttgcgcggagaagggggagtgggacccggtgattcggatgcctggggagaaggagcctgcagggtcgcactcgcacagcggcgagggattcgatggggaggtggatgacgccgtcgggacgaggtgggcagtgctcgttgccgggtcctcaggctacggcaactacaggcaccaggctgatatatgtcatgcgtaccagatactgcaaaaaggaggcataaaagaggagaacatcgtggtgtttatgtatgatgacattgccaatagtgcactcaacccaaggcagggggttatcatcaaccacccagagggcgaagatgtttatgctggtgttccaaaggactacactggggaccaagtcactactaagaacttctatgccgcgctcttgggcaacaaaactgcagtcactggaggcagcaggaaggtcatcaatagtaaagcagatgaccatatttttatctattactcagatcacgggggccctggtgttcttggtatgcccaatctaccatatctttatgctggtgacttcatgaaggtgttaagagaaaaacatgcttcaaatagctatgccaaaatggttatatatattgaagcatgtgaaagtggcagtatatttgagggattaatgccagaagaccttaatatttatgtcacgactgcatccaatgcagaagaaagtagctggggtacatactgtccaggaatggaaccaccgcctccttctgagtacattacctgcctaggtgatctatatagtgtctcttggatggaagacagtgagactaacaatctgaaggaggaaacaataaaggaacaatatgaagtggtgaagaagcgtacttcagacttcaatagctatggtgcaggctctcacgtcatggaatatggtgacaagaccttcaagggcgagaagctttacctttatcaaggttttgatcctgcaaatgccaatgtcacaaataagctgctttggtcaggccaagaggctgtggtcaaccaaagggatgcagatattctcttcctatggaagaggtatgagctcttacatgagaagtctgaagagaagcaggaagttctgagggagatcgccggaacagtaaggcataggaagcatctggacaacagcatcgacttcatcggaaagcttctcttcgggactgagaaagggccttccacacttgaggccgtcagacctcccggccagccactcgtcgatgattgggactgcttgaagcaaatggtacggatcttcgaatcccattgcggatcgctcactcagtacggtatgaggcatatgagggcgttcgcaaatatatgcaacagtggcacgcctggcgcttcgatgaagcgagcgagcatgggtgcttgtggcggctacaactcggcgagatggagcccgttggctcagggctacagcgcttgatcttctgaaaggttccggggatatgggtgtgtatagtcttatctgtgaagtactgtatactgtaaaagttggcctttgtgcctctgtaatgtacgtagcagttgtcttgtatatgtctcggtggtgtgtttctgacttggtatgtttcgccaggtcataataatagacgaaagtggcctgcagcttgcaagccaatccggtgtagtagactagtagtagtagttcacaatcaggcctatgggccatttctaggagaacagagacatgacactagttcggacagctt

SEQ ID NO: 20870 - DNA, 1535 bp, Zea mays
tgcagaggagtccagcacaagatgtatcctccctgcaaaatggggaagtccatacaaatggtgttaatgactcaaaaattgaaagaaatgccgctgtcatgcctgttttaactggcaatcgaagcaaatctaggagccagagcatgagtgttaatcactcaatgagcaagagtatgagtatcagtccaagaagaagcccaatgaaaaggtcaagtaccagcccaaagaggtcacttagcaggagccctgttgacaataatcgcagtagaagccctatccgtactcccaaaagaagcgtgagcaggagtccagccaggcggcagagcatgagcaggagcccacccagaaattcaagcagaagccttcacataagcaggagtcctgttaaagcccacagaagaagcattagcaagagctcagctaggtccatgcaacagagaagtccaagcaggagtctggagagaactcatgtacgaaaaagtatcagtccaagcccacctttggagaagggaagaagcattacccgtacctctgtggtatctccattgcgaagtgttagtcggagcccagcaaggatttcaaggagcccacataggccttctaggagaagccctatgagaagtccacgatggaacatacgcagaagcctcagcaggagccctgcaagaatacctagaagaagtgtgagcagaagcccagtaagaggtggtcgacctcgcaggaacattagcagaagtcccagtccacatcgcagggtagtaacaccaccaaacaatggaagaagcccatccagccacgcgtccccccacgcgtcaccaaaacgcataagacgtggacggggttttactcagaggtactcatacgcaagacaatatcgctcgccttctgctgatcgctcacatcgctatggtggaagaaatgaccgtgacagatacatgggttaccggggttcccgccatcgatcacctcctagacggtatagaagcccacccagaggaagagtgtcatcgccaaggtacaggaggaggagccgaagcgcctcacgcagccctgtctacagggaaagaggaaggggaggtggatacagcaaaagccctatacggagcagttcaccccctgccaggaaaccaaggtcacatggtgaccgtgcacggtcagtttcaagaagccacctttctgggtcagtatcaaggtctcctccagtgcatcatccctctccacctgattccccatcagtgaagcatgcaagtgatgagaaatctcagtccgcgtccccagctctgtcactgtctggtagccctaatcgtggaggcaagaaaggtttggtttcctacggggatggctcacctgattcagctgggaagtaggtttccaccggggcattgaaatgtatcttacaccgttagccattggctgttgatcaggttcatcaatactttttggtatatttctactgtaagaagcggtatggtccttgagctgcccagctgttacatatgttgtttgggatgatcggctatgtcctttggttatca

SEQ ID NO: 20871 - DNA, 790 bp, Zea mays
  misc_feature (755)..(755): n is a, c, g, or t
  misc_feature (774)..(778): n is a, c, g, or t
agtccgacagaacagcacgtgaaagcccaggcctccctccctccctctccccacctgctggaatccgcggccgctgcctgcaagggtgaccttgcttgagcccgtcttccttcttcctcagctaggcacccgtgcccatcttcagtccacctagccatgcctacgacgatggcggcggcggcggcagcgtctgctccaagctcgctccgcgtttcgcgccaggggacgatcgggggaggccatgccctctacagcaggtctcagagggctgccactgtctccgccagagcttccatgaacataacgtgctgcgcgaaccagacgcagacggcgcagcgcaagtcgtattcggggacgacctctccgccgtcaggttcagtgaaagagaaggtgaagccgaggctcgacgacgggggcgtcgggtttccgccgttccggttcgggggaggcggaggaggaggcggcggcggcggcagcagctcgtccggcgggttcatcctcttcgtggtcgtcctgctcctggattacctcaaggagttcgagaggaacctgcagaacgggccacggaggagcggcggtggctacgacgacgggctggcgccacagtagattcctctctctttctcggtgtgtggtttgaattttggaagagaacgtgtgctacgactctacacgaccatgtgttgcagagatgcttcggtgttcgttggtgtgaaaaaaaaaaaaaaaattttttttttcctcaaaaagaaaanttttctcgaaaaaaaaaannnnnaaaaaaaaaaaa

SEQ ID NO: 20872 - DNA, 4513 bp, Zea mays
tgcatgcctgcagctcatttggacgcaagcgttttcgatctgccagtctatgatggtccatcacgtcagtaccgcataccgattgcttttcctaaagttctaaacctaagcagcaacagattcacaggtctgattcccccagagattggtcagttgaaaggcctcctttcacttgatatcagctccaacagcttaaccggaccgatccccacatctatctgcaatctcacaaacctgctggtgcttgatttatccagcaatgatctcacgggtaaaatcccagttgcattggagaatctgcacttcctttccacattcaacgtttctaacaatgacctggaggggcctattccaaccggtggccaatttggtacatttcagaactccagctttctagggaatccgaagctgtgcggctttatgatcggtcgtcgatgcggttcagccgatgtgcctctggtatccacaggaggaagaaataagaaggccattctcgcaattgcatttggtgtgttctttgcaatgattgccattcttttgttgctgtggcgtctccttgtctccatcaggataaaccgtttaacggcccaaggtagaagggaggacaacggatatcttgaaacaagcacattcaactccagcttggagcatggagtgatcatggtgccacaaggaaagggaaatgaaaacaagctcacgttctctgacattgtaaaagccacaaataacttcaacaaggaaaacatcattgggtgtggtggttatggtctagtctacaaggctgaactacctgatggctgcaagcttgctatcaagaagctcaatgatgaaatgtgcttgatggaaagggagttcactgcaggggttcaagcactgtccatggcacagcacgaccatcttgtgccactgtgggggtactgcatccaggggaactcgagattcctcatatactcctacatggagaatggcagcctggatgattggcttcacaacagggatgatgatgccagcacatttcttgactggccgacgaggctaaggattgcgcaaggagcaagccgtggcctttcttatatccataatgactgcaaacctcacattgtgcaccgtgacatcaaatgcagcaacatcctgctagacaaagaattaaaagcttacgttgcagactttggactgtcaaggttgatccttcccaacaaaacccatgttacaacagagttggttggcactctaggttacatcccccctgagtatgcgcacggatgggtggccactctgagaggtgatatatacagcttcggagttgtccttcttgagctgctcacaggcttgcgacctgttccggtcctgacaacatcaaaagaacttgtcccatgggtgctggagatgagctctcagggaaagctggttgatgtcctagatccaacactctgcggcacagggcatgaagagcaaatgcttaaggtgcttgggcttgcttgcaaatgtgtgaacaataaccctgccatgagaccacatatcatggaagtggttacatgcctggaaagcatcaacgttggcctgcaggcacaaaagtcagtcaagacaatacagttagcgagttatacatgagaatattgtaattaaatgcatagagcacacgtatctttaacaagaggtactgattttgcgtccaactagtgtttgatttttgtacagtttttttgtgcatattgagactctctagttttttccataccccatccccttctttttcttgaggtgatagtgatatgtaacgtgtatgctgtttagtttctgaagcattgtactgacagtgatgctcttgcctcttagtgttgttacttagatcttgggttccgattcacagagttcacaagcaactggaacgtaagagtaggatatggaatgtcaaaagcaaacaatttgtggttcggattcggaatgagagcaacaatttgtggtttggaaagagagcagtatacgatgtcccggttgtcgtttgggataaaaagttgccacctgctgaagagagtgtataaatgtgtaggatcacaagctaacatgacaatgcatttcgacgatccaaggtccgagtacgaaccatgcaactatgcaagagaatccaatccattgcagcgcgcagtgtcgacctgcggcatagcaggaggcttggagtgtccctcggcctgtccgatttcaacacgcccgccccccgtacgtacgaacctcaggagtcaggacagcctcccttgtcgcccaagggaggatccgattcaacggtggtatttcatcgaacagcctgagtgcgctgcttccgggacggcggctccttgttccgcgcccaagcccaaaggatcgatgctcaggaccggcattgcgttgagggcgtcgacgaaggcgcgaggaaaatgggctcgggatcccacgcaggtcacggcgcgcggttggcggtggtggttgaagcttggagagggaggagctactgcagaattcacttgtggtgcttgtcagtggacggggccgaggtcgcgggcgagtggcgatggctggcggggaagggttagttggaggccgaaactctcacggcaggcaaggcaaggcaagacgacccgagccgagctttaggaggctggactcgcacgagttgggctcgttgaccccttccttccatgggaggctgggcagggctaccaaaccgagtagccccccgatgaatggataagccccttcctcagccgctcgttgcttctcagtccgacagaacagcacgtgaaagcccaggcctccctccctccctctccccacctgctggaatccgcggccgctgcctgcaagggtgaccttgcttgagcccgtcttccttcttcctcagctaggcacccgtgcccatcttcagtccacctagccatgcctacgacgatggcggcggcggcggcagcgtctgctccaagctcgctccgcgtttcgcgccaggggacgatcgggggaggtccgcattgtgctgctcactataaatcccgcatcctttttttttcatttatacctgggattcagggctcacacacagctcatactgtgccatgtaggccatgtcctctacagcaggtctcagagggctgccactgtctccgccagagcttccatggtaagactacgtgctgtgctttagacctttagttggtgcggctgtgagcatgtgtgcgcgccgccatgcgtgcgttctcctctgtttcttttcccccgcgcttgtcttgtaagttgtaacaaaggactgcccgcttgaatctctctgcagaacataacgtgctgcgcgaaccagacgcagacggcgcagcgcaagtcgtattcggggacgacctctccgccgtcaggttcagtgaaaggtaacggaagcagcagccatctgcataacgaaaaagttgggcttcaccaccagccagcgtcacacacagcttgtcgttcccttccctgacgatctctcatcgctcgtcgcagagaaggtgaagccgaggctcgacgacgggggcgtcgggtttccgccgttccggttcgggggaggcggaggaggaggcggcggcggcggcagcagctcgtccggcgggttcatcctcttcgtggtcgtcctgctcctggattacctcaaggagttcgagaggaacctgcagaacgggccacggaggagcggcggtggctacgacgacgggctggcgccacagtagattcctctctctttctcggtgtgtggtttgaattttggaagagaacgtgtgctacgactctacacgaccatgtgttgcagagatgcttcggtgttcgttggtgtgatctctctctcttttttttttttcctacaaaagacagtttttctcgagggctcatgtgaggactagaaattttagccagtcgaacgaatgccttgagatcacacaatgaaactcattggcgcttcgaaagtttgaataaatttcaaagaatctcctcagtccctgtttggataacccaatttatttattttttcaaagagacagagcccctatttcattagaaaataggaataatgtccttacaccaggcatcacagagaaaagctagcctaactgaaactaggcaaaacaccacactacaaggcatccttacaatacccgctaacagcgataagaaagatacctaacacagcgcgatgccaaacctaaacaagttcataagctttgcttattacagcatcattcaacccagctaggaagcgaggtaaacaggaccgttcaatagaagtaaagcacaaacggagacacgacatataacactaacagccacaaaacccactatccaaaaatgtgacgatctctaggtctccaaccatatgcccggcataaaacttcacttgctatctttctgatgagtttgctttcttggaccatcatcctttttttcttctctttttgtcgaatagctcaggaatccaatcagaagcaccaaaaaaaaatgacgttagagggatcaagcaaatttt

SEQ ID NO: 20873 - DNA, 1832 bp, Zea mays
  misc_feature (1740)..(1791): n is a, c, g, or t
aacaaaatccaattatcgtaatgtcgtaattccaaaattctccttgtcaatagcaaatgacaaaacggttggatagagatccgcctcgttgatcagaggccgtccatcgcggaaccaacggtggatgctccttcacgcggttttgaacacttcagcccgacgaattgttcggttcgtcgacgacaacctccatttgttccacaatccacattccccaccccccacggcccccgggcccacccaccctctccctcttcttcctcactcctctctccctctctctctctctctctctctctctcgtcctgcgccacacgccgcggccgtctccgggcaggaaggaagggggcgggaagatgatgatgacgcgggcaccgatggggccgatggagggcgcggcggtggacgagatggtgcgccgcctcgtggagggcggccgaggcgggcgccaggtgcagctgtccgaggcggagatccggcagctctgcgtagagggcaagcgggtgctcctctcccagcccaatctcctccgaatccacgccccagtcaagatctgcggtgatatccatggccagtttgtcgaccttctgagattattcgatttgggtggttatcctccagcttcaacttacgtattcctcggagactatgtcgatagaggcaaacagagcctggagactatatgcttgctgctggcgtacaaaatccggtaccccgaaaatattttcctgttgaggggtaaccacgaggatgcaaagatcaacagagtctatggtttttatgacgaatgtaagaggaggttcaatgttcggctgtggaagatattctctgattgcttcaactgcctgcccatcgcagcgctcatcgatgacaagatactgtgcatgcatggtggcctctcgcccgaattgactagtttggaccagataaaagatattgagcgacctgctgagattcctgattatggtctcctgtgtgatctgctttggtctgatcctagccccgatggagaagggtggggggagagtgacaggggtgtctcgtgtacgtttggtgcagataaacttgtagagtttttggagaagaatgatctcgatcttatatgccgagctcatcaggtggttgaagatggctatgagttctttgcacaacgaagattagtgacaatcttttcagctccaaattattgtggagagtttgataatgttggcgctcttttaagcatagatgagagcctaatgtgttcatttcagatcctgaagccaactgatatgggtccaccgcatgcaagaaaacaaattccaaataagccaacaagagggtgaagccttggaccagcatccaatacttccagttccagtatcatgatgatcgtcagtcagctcaaagggggtgatctgttgtttggatagttggatccaccagggcctgacattagacatccatcagccaattaatccctttagccaccctttactcgtgtcttgggaggcggcttggctgtaaaggatattctgtacagcatttagttggattcaacacatcatctgttttactgttcttcctgccggcaagggacctcattggcagcatgacatacaatagatgttagtagtctcaatttgttttccttagcttctgccttgcgtttttttttttttggtgcgggacttgatgtatggtgattttatatctttgtaatatgtagatgttgcaggaaataggtctgcacaaacccannnnnnnnnnnnnnnnnnnnnnnnnnnnnnnnnnnnnnnnnnnnnnnnnnnnacctggaagatgtgtgaagctggtaatgtcatgcaatgcaa

SEQ ID NO: 20874 - DNA, 1588 bp, Zea mays
  misc_feature (1558)..(1558): n is a, c, g, or t
aacgatttgctccgcgcctccacctccacctcccgcccccccttccgctccctctccctcttcctcctcactccccaccccccctactccctctctcgtcatccgccacacgccgccaccgtctccgggcaggcaggaagcaaagcggtaagatgatgatgacgcgggccccgatgggaccgatggagggcgcggcggtggacgaggtggtgcgccgtctcgtggagggcggccgcggcggccgccaggtgcagctgtcagaggcggagatccggcagctctgcgtagacggaaagcgggtgctcctttcccagcccaacctcctccgaattcacgcccccgtcaagatctgcggtgatatccatggccagtttgttgatcttctgaggttgttcgatttgggtggttatcctccagcttcaacttatgtattccttggagactatgtcgatagaggcaaacagagcttggagactatatgcctgctgctggcatacaaaatcaggtatcccgaaaaaattttcctgttgagggggaaccatgaggatgcgaagatcaacagagtctatggtttctatgacgaatgtaagaggaggttcaatgttcggctgtggaagatattctcagattgcttcaactgcctgcctattgcagcgctcattgatgacaagatactgtgcatgcatggtggtctctcaccagaatggactagtttggatcagataaaggatattgagaggcctgctgagattcctgattatggtctcttgtgtgatctgctttggtctgatcctagtcctgatggagaagggtggggggagagtgacagaggtgtttcgtgtacgtttggtgcagataagctcgtagagtttttggagaagaacgatctcgaccttatatgccgagctcatcaggtagttgaagatggttatgagttttttgcacaacgaagattagtgacaatcttttcagctccaaattactgtggagagttcgataacgccggtgctctgttgagcatagatgagagcctaatgtgttcatttcagattctgaagccaactgatatgggtccaccacatgcaagaaaacaaattccaaataagccagcaagagggtgaagccttcgaccagcatccaatactttcagcatcatgatcgtcagtcagctcaaagggggtgatctgttgtttggatagttggatccaccaggacatggcattagactcagcgtcttggttggcggcttggctgtaaaggatattctgtacagcattaggttggattcagcgcaccatctgttctattgttcttcctgccggcacagtacctcattggcagcttgacatccagtagatgttagtagtctctatttgttttttcttagctgtgtcatgcattgttttttgagcgtaacttgatgtatggtgatttttgtaatctttgtaatatgtaaatgctgcaggaaataggtctgcacaaattctgtccatcagcagtaccattcttttctttttttgacttccagttcttaaaaagacccgagagtcttctagangctgttatctaaagtcttaaaagatgctgg

SEQ ID NO: 20875 - DNA, 887 bp, Zea mays
gccggccgggttccgagtccgacagaacagcacgtgaaagcccaggcctccctccctccctctccccacctgctggaatccgcggccgctgcctgcaagggtgaccttgcttgagcccgtcttccttcttcctcagctaggcacccgtgcccatcttcagtccacctagccatgcctacgacgatggcggcggcggcggcagcgtctgctccaagctcgctccgcgtttcgcgccaggggacgatcgggggaggccatgtcctctacagcaggtctcagagggctgccactgtctccgccagagcttccatgaacataacgtgctgcgcgaaccagacgcagacggcgcagcgcaagtcgtattcggggacgacctctccgccgtcaggttcagtgaaagagaaggtgaagccgaggctcgacgacgggggcgtcgggttcccgccgttccggttcgggggaggcggaggaggaggaggcggcggcggcagcagctcgtccggcgggttcatcctcttcgtggtcgtcctgctcctggattacctcaaggagttcgagaggaacctgcagaacgggccacggaggagcggcagtggctacgacgacgggctggcgccacagtagattcctctctctctctctctcacacacactctcggtatgtggtttggaagagaacgtgtactacgtctctacacgagcatgtgttgcagagatgcttcggtgttcgttggcgtgatctctctttttgctacaaaagacagagtttttctcgagggctcatggtgaggactagaaattttagccagtcgaacgaatgccttgagatcacccaatgaaactcattggcgcttcgaaagtttgaataaatttcaaagaatctcctt

SEQ ID NO: 20876 - DNA, 1038 bp, Zea mays
  misc_feature (35)..(36): n is a, c, g, or t
  misc_feature (58)..(58): n is a, c, g, or t
  misc_feature (82)..(83): n is a, c, g, or t
ttttttttttttttttccctttttttttttttttnntttttttttttttttttttttntttttttttttttttttttttttnngtaggaacaactgttccaaatgttactttcctcttattattactatccaaatggatccggaaccaactttcaaactcctgttgctacgtaatacagacacaagcattttttttaattaaatcaacgcagtttaacatcttccaattccaagctttcgaacaaacataaggaaatgcgcgacaatccgaccataggcatcacagaaagtatcgtctttacagcataaagcattccaaacttaatcttccacaaaatctccagcctctacatctgagtcatcttcctcttgctctctagtttgttcggcgtattcatcaagtgatgcagcaggaaagatatcaccttctcgacttctgtcagcaatctttgggactgacggcccactctccccacctttgcctttgttcataatacgaagaagtgtacgtcgttccctctccctagcacctctgacagcctcttctagtgacttgcgttcactttcctcctcattcgcatcccttccgacaagctcattaacacatgtgcagcacttagcacatatgccgaggtccttggagcaatctctgcatacgttatggtatgcttgccggacgtttcgcttattacacttctggcattttgctggctcaacaatgggcttgtattttccgtatctgcgtttccagtcgatttgatcccggcagcgctgacagacgccggtgatttctgacagaggtcggaacctgcccccgggctcggtttcgttgatcttctgaccaaggttcggcttccacgcgtagcggttctggtgtttcggcggtccctgccgcttcgacatcgccgaactccgatattctcaccctccgcttcgcgccgccgggcgtttctcttctcccagtgacgctccgagggcttttgcccttaaaacctttcacgctacgactggaaaacgtggctgcatcgttcgagggta

SEQ ID NO: 20877 - DNA, 3092 bp, Zea mays
ccttggacagacacatcgagttgagttcttcagtagcttcaacatcgtctgactgatctggaatctgcaatgtttgccataattcctccaccacatgcagttgtactgagtccgcacagcgatggccacgagcataaggaagaccacatttatagcaaaatcctttggccttgcgataagccattagagatgtcaacttgtcatccatggtggagagcttgctcccttgaacggctgcagatccttcaggcttcgacgtctgaggttggcgaataggcaatggtaacggtagtgggcctttgtgaaatgtcttggtcgaataaacaacatccgatgtgcgagcgtccttctgccgaccgcccacctcttcctgcaattgggccaaaacataggcagtatccaaatcccgtggtcgttgaaccataacaactgaacgaatgtcatcccagagaccatccaagaatcgcatgatgtaatacaatggatctgaattgggactgtatgcatgcaactgatctatgagctgggaaaatcgatcgacataatcagacactgtggtggtttgcctgacatggaacaactgcctaataagaacttcatgctggtccttgcgaaatctatccatgaccatgtgaccaaactgttcccaagatattctactcaaatgacattctaccgattggagccatcgtgctgcagaccccgtaaaatgcatgcgagcaatcctaatccacacactagtgtcaacagaatacatggtgaaataatcttgacatcgtgtctgccatagtttaggattttccccatcgaaccccggaaatggaaccttaggtatgttacccagaggtcggtcgaattgagaatgtggatgacttccaaaagcatcatgcaccatatgtggaattgctggaggaatgggttcgatccaggagccataccattggtcgggaggaagttatgggtatgaggatacccgaaacctccctcccgtgctgggtttgcgtcgtggtgcctccaagggccttcgacgttccttgtggcagcaggtggacatcccatcgtcgagccaaacacggcggcctggagtggagttggcgctcgacgctcatgctcccagcgaccggaagaccgctgttgctccgatcgaagcccttcaatgttcgaatggacgacgcccacggactgttcgatgtaaggcctccacgaagtgattgcgtcggtcgttgcttcgagcgcagccacgcgtgtggacaaggctccatcaacagcatcgatgcattcccatgaagttgcttggatttcggcgacatgtgcatcgatctgaagtgagaaggacctggcgaggtccgatcgcaccatcgagacatcgatgttgttcatcttggccgtcaacgcggtgatggactgggcgttggtcgacaccacccgctccaacgtctgccagtggtggtcctgtgcatccaagcgatcgcaaatctgctgcagcaagcgagattgcgtctccagagtcttcgcttgttcctccatgccaggtggcagcagacaaactggactccgctgcgcccgccatcagccgaaggaaacgctcaaccaactctgataccacttgttagctgcccgatgctaactggattaataagcaagctagtactactagttctacaatgacaggaagctaatacgaatttggtagtagtatcttccgtaaccttctacaagcttcagccccctctttatataggctgcacacgcgattgctaagtgtactaagtattggccggatagcgtccattgggccagcgccgacgacggtccagctcggcaattgtttgatcagttcctgtcatcttcctgcggctgaatactgacacagggacgctccacgcgtcagccggccggggaaatcgacgaggaccgtagagtggcgctcttggatggcggatcgggagccctgtgtgtgaatgcttgccgccgccggggaaaggaacggcagcctttgctgtgttgagcgagctgccgagtgaaccggctgaagggctgttggatcggcagcctacggacaagatctggctttacctgcgtaacgctttgctttgcatatcggtaatttgcaacgttgccgtaggaacaactgttccaaatgttactttcctcttattattactatccaaatggatccggaaccaactttcaaactcctgttgctacgtaatacagacacaagcattttttttaattaaatcaacgcagtttaacatcttccaattccaaactttcgaacaaacataaggaaatgcgcgacaatccgaccacaggcatcacagaaagtatcgtctttacagcataaagcattccaaacttaatcttccacaaaatctccagcctctacatctgagtcatcttcctcttgctctctagtttgttcggcgtattcatcaagtgatccagcaggaaagatatcaccttctcgacttctgtcagcaatctttgggactgacggcccactctccccacctttgcctttgttcatctgccatgaaatattaaccatattgagtaccatcggtatcatcattgtagagagttttcactggaataaatacatcaccgctcaacattgtttaaaacaagagtaacaaaggtcataaggtcaagttggctgctagaattgaaactggaacattcaactgcagtttcacttacaataaggaaccaaagtcacattccacttgcatctcaataaccttgagtagaaaatgtcagtatattgcatttacatgtacttgagtattcgtttcaaaagaaaacgtaccagatctcatgctctatggttgttaaatacaaccattgccattattcttttatgtagcttaaaagtttttttatgaagacacttaatatactattcgttaatgttacattaagcagaattcagtatctagcaacgctacatatgagatacagatattagaagagtacagataaaattgcccaaacaatgggatttgaatatttgattgtgcatgagaatacacttgagaaaaattattcaattggcaacagtgagaaaatactgatgtttaaaataagat

SEQ ID NO: 20878 - DNA, 1936 bp, Zea mays
  misc_feature (1905)..(1921): n is a, c, g, or t
ggtcaaattgagagtaaaaaataaagagttttgtacatggtctaagatcttcatccgctagggaatttttggagatggtctaagatcttcatccgccagggaattgcccgctaattggagtctctcccgtagtcccgtgtttgagttgttctcctctcatctccatcttcgcaacgaccacgaattccacggccaaccaatctctggtctatcgctctcttctccgtgcctttaaattggggccctcgtggccgcccggcctccgccctcaaccgtagccacctcgctgcccctgccgccgacacccctgctcgccgttgctgcagccgcacaggcgatggatcatgaagaagtgaccgaattcctgggccaggtgcccctcctgcagtgcctcccgggttcctctatccgcagaatcgcggaggccgtccaggtcaagaactacgaacctggtgactatgtcgctcgcgaaggtgaacctgtcaatggcctttacatcatagtggatggccaggctgaagtttctgcacctgcgaatgcagaagaagcaaatcgcccagactatgtgttaaataagtacgactactttggttatggaactaatagttctgttcatcaagtcaatgttgttgcactatcaaagctgacctgcttcatattgcccaatcaatatggacatttgttacaaccaaaaacaatatggaatgcagaggaaacacctgaacattctttgctggaacaaattttgcacttagaaccactagaggtcgatattttccgtgggtttactttgccggaagctccaacttttaggcaagtttttggaggacaattcattggacaggcactagcagcagcatccaagactgttgattgtctaaaaatggtgcatagtttgcatgcaatttttcttgttgctggagacaataacataccgataatatatcaagttcatcgggcacgtgatgggtccagctttgccacaagaaaagtggaggcaaagcagaagggcctagctgtattcaccttgattgcttctttccagaaggaagaagtgggttttgagcatcaggctgcaatcatgcctgatgttcctccgccagaacagctccttaatctggaggagatacgtgaaagacggcttactgatccacgcttcccatcccaatataggaacttggcagctaaaaaaaagtttattccttggcccatagaaatgagattttgtgaaggttcagcgtctcaacataaaccaagcttaaactactggtttagagctcgaggggaactctcagacgaccaggctctacacagatgtgttgtagcatatgcttcggatctactattttctggggtgagccttaaccctcatcgggagaagggtttgaagacatactgcctcagtcttgaccattccatctggttccacaaacctgtgaaggctgacgaatggatgctgtatgtgatcgagagcccatctgcgcacggtggtcgcggtttcgtcaccggacgcatgttcaacaggcaaggagagcttatcatgtcgctgacccaagaggcattgattcgaagggagaagccgcgaggtccaaatccgaggccgaagctttgaggcacctgacagcctctgcagtcgactgtagaggatcccaaccgagctttgagaggcgcaccatcctttcttctaatttggtttagatatttatgaattcacaaacaaaaatatagaatatcaagcagtataaaagatctcaagtcaaacctaacattttttttccatttctccggatgatttctatttgttttcgtgtgtgtgtggtattgggggggtattggaagcggaggcggaggcggagggtgttactttaggctatttcctgcagcttactttcattatacgaacannnnnnnnnnnnnnnnnaacagtattcatata

SEQ ID NO: 20879 - DNA, 3434 bp, Zea mays
tagatatttattcccaagttttagcttttaattgtcagcacttatctttattatgactcgtgtgtactcatttagcaaaggtacatgctcaccataggtggcgtagtcaattcttcaccactatcactactgttactattatcatcactttgtaccttctgatcaccatttgccataaggcataggtgtgtacaggatgatgacagtggcgatggagcaagagaagccttagaccctgtttgttttagttttttccagcttctagccaccaaaaactgttgtggactaccaaacgctcaccttttcagcctggttctataaaaatcgatttggtaaaaaacatacaaaatcaatatgaacacaaaatcagtcgagtcgttgtaataataggaatctgtcactttttagatcctgaaccatatagataccttcatctttttccgcatgtaatcctcacgatactcagattctccccatagataaattcttataaaaaatggtcagaaaaaagttgaaccaacagacccttagtaaccatcaattttgtcaccgaaatctgccgcctagctcgcgtctcgtacaagaccttgatcgacggcatcgccctggcactccattgtagttgataaaggtgatcgtgaggtgggattgcaaaggtttgaatgatcgtggatgcacaacaccacgtcgtattaggtggtgtttgattacagagtatggtgagatgggtccgctccattcctaatttattgttgtttggattgattccatgtaagttagagtgattctaaaaattatgcttaaatgttgaatcatctagctctctaaaatatcctgaacggaaccgttctatggtatagagccgctttgtcctaattgacttcgaaatcaaacactaatttagtgaatataaataaatgaatcgatggaatactagtatactactacacaaggcctgagcctgagtctctgttattccacatactcgctccgtagttgctattcttgatttctgaaaagccagccatttttatatttaatcaaatatatataaaaattattaatatttatattatataattagtattgtcagatagtttttaatatattttagttataaacttatttaaagatacatatattgttaatatattctataaaaccaattaatttttaaaaatttgacggcacaacactggtcacaagcatcttcaacgttcaacgacataccgggcagaagcgcacagcggcacagtgcaaacacacaggccttgaccgctcttggcttgtacatacggttctgcctattccacccgggctcggcggccgcgtcgcagtctgctcgcttgtcctgtccctgtcctgactggagtagtggagtctgagagattctctagcggaatccctcgatcgagaggaacacaatccctttctcccactgccgctcccacagtaacaagtgactctaccctcgccggcagagaagaagacgatggacggtgacgccggcatgatcccatcctcgccctccgccgagacatcgccgtcctcgtccgactccgatatcgccactgaggtaacatctctttcacaaacaatgtgcttatgcgcgcatgggcagcagaaactttgcaatcctgattttgtttttctgttgccagtccaccacggggtcgttcttccgggaccggagcacgacgctgggcacgctgatgggcgtgtccctcgccgacgaggaggagcgggaggatcaccaccactcagggcaggacgcagtggaggaggggaccgggtcggggacgccgtgtgctccggtgcatgaggaggaaggggaggggcggaggtggcgccgcaggtggaggcgccggcactggcgcggcgccgcggccggctggtggaggctgtgcagggacgacgtccgcgtgcccacgtcgctcggccacttcctgggcatggagaggcagctctccggcgccgggctgctgtgcggcgacgacggccgcgcgggggagcgggacgctgccgcggctgaaacggggaggtggaagctgcggaggccggcgccggcgcatgggacctcgtcgtccttggcgaggctgccggtgctgctcacggcgatctgcagcggtggagccacttgacctgagtcgagcggttcggagatgaaatccgcggttttgtgactacttcacttatttattattcaatttcagttgctcgtcaattcgtcatgttcatggcagttatctgtcatttgtcaccttctttttctgtcatttgtcaccttccgtttctaatccgagtcggtcaacgttgaacactctcgatcccatttttttttttttttttaactgataaatctcattccagtatcacgtttcttgccttctccacagacatcattccaagctgccctacactatcaaacagctcggccagatcctatctccacgaactaccctatgctgaacttgtaggctagacgtttcaatgttctatttcctctaggcaaaaatctaccaaaaaactttggagaaaaaaaaagagagaggatcaactgaagatcacagctgcgacgaccaggatcatggttgcgaggagtcggttgctccatccagcatcgccttgcgccgacgacttgctgttcgactcatgaacctgtggcttttgcctctccttcagtagaccacagtagagggcattgtccgggacgaccatctcggtgatgttgtagcccagtggatcggcaaccttcacatagacctcctgccctctgtaccagtcatccagcctttcggcgcgcagattccagacaccaacgttgtcgagcgagactaggaccgccgtccagcccccggggaagacctgagtcgtgcagcgagagatggcatcccacttgttgtactcactcctcctgtccggtgtccactcgccgtaatccatcccgacaacaaagaaggagtagccatcgagatggtaggtctggacgtcggtgtcgttgttctggaacacgatctccaggaaccccttgtaggacgcgttgagcgcggacgaagctaccctcggcggcgcgtcgtcgtcgctgggcgtcgcggggaagtcggctgcgtagactccggtcaggttgtggaggtcggccagcctcagcggcgtctccggaggcgagtacgacaccctgttgatcgtcctccggcgcttcccgctgatgctcaggggctgctcgttcttgaggacgaaggtctgcgtgacgttgatcgatccgtagtggaatgatccctgcgggtttggacgggcagcgccggcgctcgtgttcattctgatggaccttgcctggttcatggagtggtacttgtcgtagtgatcatctggagcatcagggaggctgccagaagccctacccttggagttggagtactgaaggacggccacaccag

SEQ ID NO: 20880 - DNA, 996 bp, Zea mays
gtacatacggttctgcctattccacccgggctcggcggccgcgtcgcagtctgctcgcttgtcctgtccctgtcctgactggagtagtggagtctgagagattctctagcggaatccctcgatcgagaggaacacaatccctttctcccactgccgctcccacggtaacaagtgactctaccctcgccggcagagaagaagacgatggacggtgacgccggcatgatcccctcctcgccctccgccgagacatcgccgtcctcgtccgatatcgccactgagtccaccacggggtcgttcttccgggaccggagcacgacgctgggcacgctgatgggcgtgtccctcgccgacgaggaggagcgggaggatcaccaccactcagggcaggacgcagtggaggaggggaccgggtcggggacgccgtgtgctccggtgcatgaggaggaaggggaggggcggaggtggcgccgcaggtggaggcgccggcactggcgcggcgccgcggccggctggtggaggctgtgcagggacgacgtccgcgtgcccacgtcgctcggccacttcctgggcatggagaggcagctctccggcgccgggctgctgtgcggcgacgacggccgcgcgggggagcgggacgctggcgcggctgaaacggggaggtggaagctgcggaggccggcgccggcgcatgggacctcgtcgtccttggcgaggctgccggtgctgctcacggcgatctgcagcggtggagccgcttgacctgccaccgcggccgagtcgagcggttcggagctgaaaaatccgcggttttgtgactacttcacttatttattattcaaattcagttgctcgtcaattcgtcatgttcatggcagttatcagtcatttgtcaccttccgtttctaatccgaggcggtcaacgttgaacactctcgattctagtgtgataatcgtggaatgcaatcatgcaattcactaaaaaaaaaaaaaaaa

SEQ ID NO: 20881 - DNA, 2030 bp, Zea mays
actaatgattgtctctttatatacaagctaggttggccccccctccgagcctttttccttcctgtttacagacaaaccataaccatacttcaacattatatgtaatcgccgcagcgaagtagggcgcctgtccagtatcagataatggaagtagcctcacatctatcaacgcacaatgtaggaacaggatacaagcaaagaacaagtatcctccttttctctacgtctgatttattaaattaattcacactacatcgttaacagtcaaatagagatttattttagtggattctactcctggcatgtgcttcagttaaacctagttccacccaaaaataattagtacaattttactctcgtgtcaatgggccttcgacagatggggcaatctgtgacttgcggtccacattctgaacatgtctggtggccacaaccaaatgccatgtcccggggtttggaaaggcaaactgggcacatctggggttctaaaactctactttcggcagctgatggggatgtaactgatgctgtgatagttgaatttacagctggctcctcccttggatgtgaaggcacacttcgataactatttgcccgagatggttctgctcttgaaactgtgctataacttgcaaaaggaggaggaagtggaatccgctcaggtgactctccaattcgacgtcctaaaattccaagctctaatgttgccttgtattgcaatggaatttccattagtgctgaaagggcgaactctgtctcctttttgctttgacttatcttttttgacatgatcgcagtgaagttgacaaactggaaattgtcaaaagacctagctggtatattgtcatcaaattccttcatcatatcccatggaccatctccaactccaacaagaattatagacaatgggaattggcttgcttgtacaatagcatcaactgtcatttgctcctgggtgcttaactgaccaaattcagtatctacacttcttgtgacctgcccgtcagcaataattactaaaacatggtattggccaccactttgctccacaatggttgtggccatgtcaattattggggcgaatgacgtaggacccgaaaggcgaagatgaggtacaatctctctgtatcgagctaaagcttcttgaaaaccattgcatggtctttcatcaggatagaaggcaaatacatcttggtcatgagtagatgcgtctccaaaaccaaagcaaggaattaaattatcctcatcaaaagcagataaggttttcccaatgatggatattgcctgttcataaggatttgggttgtcactgatattatgcaggctgataccattgaagcaattctttcctgtccattcattactctttgtgaaatcaattcctatgatcaaattagaagactcaagaccagcctgtgctaatgcttcaataacctcatccaaggatcggtactggtcaacaatcttggagtacttcctctccagccttggccgcttacccccggctgtcaccagcctagatggcaccgcccgcgtctcgattgccctcagtggtggtgctgacacagagtgtgtatgagccacccccactgttggacgcgagtaagcgctcgatggcaccacaaagtcttcatccgctcggggcagcggcgcactggcacgccgccgtaagctggaggacgaagagctctcatccgcagcgggagcaaaagcaaggtgcggaagtggcggtgggtcccacagctgcgccagcgacgcagacgccggctcgtaaagttcgggatgtggggaggctggcggcgacctgcgccgtgccgccgccgattcctgatggtggtcgtcctgctgctcagctgagctggcaaggaggctgccgacgatcctggtggcggtctgcaagaccaggaacagcgccctcagcagaaaggtgccgaccttgccgaccgccgccaagaagccgctcatcctgatgaggagaaagaggatcgccgtgagctcagatgggatagcagaccgacgggttaggagaa

SEQ ID NO: 20882 - DNA, 1680 bp, Zea mays
  misc_feature (1025)..(1025): n is a, c, g, or t
gatattctacatatgttttaccataacaacacaaggacacttaattagtactttcataaagccaactttctactgtatcattattataaccggtttttatgcaaaatatccacatcagaagtcatatccattaatatgtactccctctattctaatttataatttatttgactttttactctaagtttgaccaccttgttttatttatacaatttcataattattattaatttttacagtgatattgtttaacatataaatatactttaagtacgactttgaattttttattttttgcaaaaaaaaagatgaataagacggaatggtacgaattataaacgggaatagagggagtgtttatagttattcatattagcaaaccacatcatctactaatgattctctttatatacaagctaggttatccatactaacaagccaaataccatccagtttacagacaaaccataaccatacttcaacattatatgtaatcgccgcagcgaagtagggcgcctgtccagtatcagataatggaagtagcctcacatctatcaacgcacaatgtaggaacaggatacaagcaaagaacaagtatcctccttttctctacgtctgatttattaaattaattcacactacatcgttaacagtcaaatagagatttattttagtggattctactcctggcatgtgcttcagttaaacctagttccacccaaaaataattagtacctcggccccctcctcgcaatgggccttcgactgatggggcaatctgtgacttgcggtccacattctgaacatgtctgcatgaaaatagaaacaaaaaggcaattaaatcatgaaaaatgaattgtgtacgaagcagaaaatatacagtgaagtgttgcatgtttgacctggtggccacaaccaaatgccatgtcccggggtttggaaaggcaaactgggcacatctacagagagtaagaccaagaaattgtaattagataatgtattagttaactaataataagtcgacnacgcacctgcattgtaacagaaaatcaacatagttctttattacagctcattatattaacaacatgtgggccctataatgggttagatttcagtggcacgtgataaatttatcgaagaataaaacacaggaagtactgagcggacacttatagcaagtaaaacaaaatatagaataaatccataggacgaatttaccaaggaaccaaatcagactacacatagccacataggaagagtggttcacccaactttggatggtacaactagcaattgccctttacatcctagccctcaaatccattttcaggggacccacttgtccaaaaacatggaccccgcagggcccatcgctaaccgcgcggccaaggaggagctgtctaactcgccagcctcgtcgggcagcacgaacggtggctcgccagtggtcccatggccggagctccacacgcggagatcactgccgacctcaacccccgcatcctgcaaccaacagtactccgaccctattcgagacatgcgttcatggtggcttgatactctgagagtaagagttattatgcagcctaaacatctcttgctcatctccttcctgcgcctctccctgtactcagtccatagcaagagcaccgactgttcctactcatccctcctctc

SEQ ID NO: 20883 - DNA, 3469 bp, Zea mays
ggccgcttttttttttttttttttgtagtggaaatagaacagtgagaaggcaagatctgttccctttttttgacaaaatggcaacattgatttaattcccctttacttttgcaacacaagaaatctagtcatcacaagtctcgttggcagcttccaaaactaaaaagagttggagaagatttaccacaatccacaatacgtagacatatattagctaaaccctgaatctgtatagtatgatcaacatcacatcgaggagaaaatgaatgggagatggctgcattcccatgtcattggacatccacgtggtcgtctagagctcaaactcctcctcacggagcgccatctctgcggcttcctcatcatcctcgtcaagtgcgaagtactggttcctctcagctggcctgaacatgtagaacatgaacatgtagaatgccatggtggccacctcctccgctgcaacgctgacccatctgtacttgtagttagtaattgtcttgagggcatacacaatgatcctggtgaagtagaggtatccaataacggcaacatagaactggcggaagagcatgagcttggcaagggttctggctgccttgccgtctgtcttggatgactcccgcagagcgcgcatcgaccacaccactgggaagagcacagcacagcagcaagcgacatcaacaaacaagaagatctggttccatgtcacccatccctgcaagaaaggaccagtctcgccgaccacagcagcagcgatgttagctgcaacctgcagagggatcaccaccatgagcactttcttctccttgtcctgcaggaatggcttcaggaacgaccacccggtcccaatcagcgcaatgacagcgaacaagatgacacccttcacgagctggaacaggtagaacatgacatcccacccatgcggtgtcccggccgtgcgaatgtagtgctggtcctcggccgccgagatgcaatagagcatccgcgccacgagcagacccgacatgaggtggtggatgcggtgcgcggagaggcggttgcggtggagggtgacgtagagccacccggccaggaacacgacatagcagacggcgaagaaggcgtagatcgttgggacagaggccatgccgacggagaggtagtccctggtgccgtccgggttggtgttgtacatgtcggtgcggacctccatgctgacgctggtctccggcgcgcagttggcgaagaagaggctgtactcgtcggggtgggtgatggggaaagtctggttgtggtagccgttgtcgtcgagctctgcgaaggtgaagagaggcctgacgtaggggctggcgaggacgcacgtgggggaggattccgggttggggttcagatccgtgggcgccggctgatcgtagatggcctcgaagagcgactcgtcagagaggaggaagaagccgagctgcgcggggtcgggcttagcgagcttggaggagtacttggcgccggtgacggagatagacaccatgccgtggaggccgaagccgaacttctcgaagaggatggagccgcgggagtcgtccttgaaggactcctgcttgatctccgccgccgcaggactgaggaggaccccggatacggcgaggaggaggaggaccgcgcgggcggcggcggcggcgaggcccatcgcggcgagatctgtggggagatggggggaggcggagcagaggtgagcgaattagccggaccggacggggcccgggggcgtccatcccgccttggggagccgggtgaggggcccagcaccgtcggatctccttccagattggtgagccccgtggtggcgagactttgaccgggggaaccttagcaggaaagcaacgcgggcggcttcgtaagagcgttggatcctgatcgcacggtgtacgcacgggcctctaagcccactatatagtctaaataataaaatgccggcgaacacgtcttgatccaaatgcaagcgcacttgctacgaagtttggcagcaacctcctgcttccagaggaaaaagggttgttgacgaatggagaggaatcgctgacgctgagacaacggcctgccgggtcaagcaaattgtttcgacgtgccggagacggagagatttatgcacgcaccatctccagggccttcacgcgtcgggcgaccggaagatcgacgtgcttgaccagcaaaaatgaacaccgaagacctgtttgtttgggggttttttagaaccttttatatctttatgaatcaatttttatatatttttaatggtaaaaagatccttgtcagaaggttactatgtgaattttaagatttttgacttataaaaactgtttggtttttgaaaaatcctaaagatattagcctaaagtagggataaaaaacggtcaaaatagatacttgctcggattttctttttattacgaataaataggaatctacaatgcaaatatatattcttgtttaacattgagcttataaagattcataaaagagaagtctcaaatttattatatatcttttcaaatgataaatataaaaagttcggatacaaattcgaatgttttatcatctttttgttgtagggaccaaaaaatgcgtaaaggaattatactaaaaattgttcttatttataataatgtgcttgataatataagaaaatatcagcatcaatttatatatatatatatatattaaactaataattttatcctaacaattcggttacccccacattcatccctatcacaaagtagataaaagctcaaacaggacctgaggcagtaataatcgtacaatgcgggacggtgaaccaaaaataagcatgttttggctactcatctgttgttgtactttatcattgctctactatcgccaactgattaactttttttgttaagatggatcactagtgtgttggtgcccccttatattcccttcatgagtgtgcatttctgaggttgtctccatcagagtactcaaaggatcatgggcatgcaaaataagtaaccaaagtgcactactcacttaccgaacaggtcgcgtgtggttgtgcaaaatgttctacatcgaggatattggcgagtcctcgccgaatacacaaatcattgtgccaaacgttctttccccaccaacattaccgtgcatcagtgatgctgtggagagacgctcgtgaccaccagctctccaccgttttctccaacaacctctaaatctttgggtggtggagccatccaccatcgatgatccgtgggaacacaagcgcgcaagcacaagttcatctcagatctgggtacgccgccggacaactcgtctaccgtggcgagtttggtgcaaaaggattcctcaccaaaggtgcaaaaaaaatctacgttctgcaaactcgacagaagtcagggatgcttgcgaagacgtcgtcggcaagtagactttgtcggactacggcgggagaacaagatgagcgagccga

SEQ ID NO: 20884 - DNA, 2819 bp, Zea mays
  misc_feature (2267)..(2267): n is a, c, g, or t
gttagaaggtgttgtttgtgtcaacaaccatatgaaattcagaacctgcttccagcaatgacaaggcttcacaagacatggcaacgcaatgcttatcaatgacatccccagttcctacaccaataaaatcatctattcataatggaattgaattctcccttgcttttgtaacacaagaaatctattaatcacaaatctcattggcagcttccgaaactaaaaaggaactggagaagatttaccaaaacacataaacaaacattagctaaaccctgaatctgtatagtatgatcaacagcacatcgaggagaaaatgaatgggagatggctgtattcccacgtcattggacatccatgtgtccgtctagagctcaaactcctgctcacggagcaccatctctgcggcttcctcgtcatcctcgtcaagtgcaaagtactggttcctctcagctggcctgaacatgtagaacatgaacatgtagaatgccatggtggagacctcctcggctgcaacgctcacccatctgtacttgtagttagtaattgtcctgagagcatacacaatgatcctggtgaagtacagatatccaatcacgacaacatagaactggcggaagagcatgagcttggcaagggttctggccgccttgccgtctgtcttggatgactcccgcagcgaacgcatcgaccacacaactgggaagagcacggcacagcagcaagcgacatcaacaaacaagaagatctggttccatgtcacccatccctgcaagaatggcccggtctcgccaaccacagcagcagcaatgttagctgcaacctgcagagggatcaccaacatgagcactttcttctccttatcctgcaggaaaggcttcaggaatgaccacccagtcccaatcagcgcaatcacagcgaacaagatgacacccttcacgagctggaacaggtagaacatgatgtcccacccgtgcggtgtcccggcggtgcggatgtagtgctggtcctcggccgccgagatgcagtagagcatccgcgcaacgagcaggcccgacatgaggtggtggatgcgctgcgcggagaggcggttgcggtagagggtgacgtagagccaaccggccaggaatacgacatagcagacggcgaagaaggcgtagatcgccgggacggaggccatgccgacggagaggtagtccttggtgccgtccaggttggtgttgtacatgtcggtgcggacctccatggtgacgctggtctccggcgcgcagttggcgaaaaagaggctgtactcgtcggggtgggtgatggggaaagtctggttgtggaaacccttgtcatcgagctctgcgaaggtgaagagcggcttcacgtaggggctggagaggacgcaggtcggggaggactccgggttggggttcagatccgtgggtgccggctgatcgtagatggcctcgaagagcgactcgtcggagagaaggaagaagccgagctgtgccggatcgggcttagcgagcgcggaggaggccttggcgccggtgacggagattgagaccatgccgtgggggccgaagccgaacttctcgaagagaatggaaccgcgggagtcgtccttgaaggactcctgcttgatctccgccaccgccggacggaagatgaccccggcgacggcgaggaggaagaggaccgcgcgggcggcggcggcgaggcccatcgcggcaagatctaggtgggagatggggggaagcggagcgcaggcgagatctagccggacggacgggatcggggtgccggccggccccgaggctcccaatgcttgggagtcagggcaatgcccgtcggatctgcttcgagattggtgacttcctggtggcgagactttgaccggggattggagtatgattggtgacttcgtggttgcgtcaagattggtgacttcgtgatagcctcatttcttgcttgcaatattagtccctccattttattctattttagtccataaattaataaatatgaaaattaaaatagagattttagtttctgtatttgttaatttaggagataaaatgaaataaaataggaagaataaaaattagtctctagaaactaaacactctctaagtctagagtctggtctagcatgaaaacatgtctcatgtttggttatatgtatgtgcccaatctgactcactagatatattgtttggttgcgacttgtaagatctttaatatggacttgttctgacttaccaggaagagttttggtctanattgctcatactagtgctattggtgcggttatgtatctagcaaatagtgtctagttggatactgtatttctagtgaatttgtttgcaagatacatcgatgctccaactaaatgtcattagatagggtaaagcaaatctttagatgtcttaatggcataagagatcatggtcttttctatggaagaaactgagacccgactttaattggatatacagaagctagctatatttcaaatcccacaataccaaatatcaaacaagattttggtatttacaaagtcgaataactattttttgcagaaaaaaaccaaccaaactttagtagccacttccacaaattattctaaaataacagatttatatgaggcctcaaaaaatgtgtatggcttcgtagaatgattaatcatatactacagaattgtggtatatgttctctaaaatcacgaaccatcggagatattaaaacttgacgtggtttcaagcgctctccgcgctcggcgggcttctgcccattgcatacgcgacacgtggtgtatacagccggaatcgaaa

SEQ ID NO: 20885 - DNA, 3025 bp, Zea mays
  misc_feature (405)..(405): n is a, c, g, or t
atttgagtttccaaactagctcttaatgttgtggtatcctcgtcacaatggtccccacaaaataaattaagtttggacatatatatggttttgataaaaaaacgcatctaaaaactagtgtcagagattggctgccttgatgagattgggatttctatgggcgtttggtgcttgggtagccatcttttaaatggtatctagttttagggcacttgtgcattggtatgacgacatactactgatgaatttatagatacggtttatacttcaacaaaaaaattagtcgtcactggataatttgacccgcctccgaaaataggatcaacaaaaataaatttataacgtttgcaaataatttccgtggaacaccaactttataaataaggggcctacaatttttagatnacatgatcgttccatttgaaatcgtttgctatctcgttttaaaattcacttctttattaattttcaattggcctccgatggaaatacatctttagtgtgaatattaatgtctgagatactttttttaaatggtactatatcttttaccaatatccataaataggagccatagcttggatgtagatttgtgacttaaatctatgtatcctctaacattaatgctgcggtatcctcgtcacaatggtcactacgaaataaatgaagtttggacatatatatggttttgatataaaaaaccgcatttaaaactagtgtcagagattggctgccgtcggataaagtggccagacacaaaaaaaaaaaaacagcgctatctcttgtcgaagaaaatcagagttgatttgtcgccatggatcggagagccttctacatgccaaatttataggcacaagaaatggtggtaagtgggagcagccgtggtcagtggcgtaaacagtgggtggtccgggtgagccacggcatatcctaagccagcccaccggatgaccagtccaccaagatccatataaaaaatactgatatatattatatttgcattctaatataaacatttatagacttaaatgttaaatctatagtgttatatgctatttttatctttatattttgaactatataccaaattattatatattatattaaattatttataaaaaatctaatggcatacctcacgaaaaaattctagctacgccactggccgtggtaggtgagagaaatggtggagatattggtggtagatgagagtaacgatggaggtctttagtgtatgttatataggtggatgatgagagtaaaaccaatatatatactagcgattcacttaagctagccaaccatcagtgtaaattaatagtttacacatatttctttgtatagtgatagttattatatatataggaacatatcatgcatacatgggaccgttgattacatccaatgcaatatagttatatcgtcggcggcgcttcaacgttgccaacaatgaccatggcttgatgttgctgaggacgaaatatgcagcagcacttccaaggcgtttggcatctactgttgactaacattttgtgttcctgagcggccagctgcgcgcacctcaaatggcagaacaatgggatgcatcctgctaagcctatacatatggtctcgtctccctggcaggatgggagtgctgaagacattatcactgccacgatgcaaagtgcagcatgcacgattctcatcatattgctcttcttgacgagttccatggggccaagaactcagagacaattttattgtactatgtttattctttgtttgcttatagttatatagaggctgagatacaccttaggcctatagagatttaaggtagcctcctatattaatgtctagggtaccttttgggatatggttctataacatgtaccagcaatattataaagagggcacaacttggatgcaaaaaaaattttccgtacttaaatcaacatatatcctctaacactaagggctactttgggaacctcaaatccccttcgggattggagaggattaaggtgaaaatgaactaatttcctctctaatccccttcaatcccgaagggtatttgagttgattggaggggactgagggcaactgattttcctccccctcgattccctcccattccaccaaaccagctgtagtgttgtgatatccttattaaatttatgtacccactatcattaatgttggctatcctcatcacaaggatcactgttacataaatagtttttagaggtgtcttgcttttttttcaagccatggtcctctaaaattagtttgagacatacaacatttaaatgtcaataatgtttatatgcagccgatgttttcacacatctctaggaatctgttttttaggaacgatttgtattatggaccactgagatattctagaggtggctggtaatagagactaatctttgagccatgcatggtaaattgacaggtcactaaaattatgcgcagtataaagtatagctttttgtaaaataagtcattggaacatgaacttaacaaacaagttatatagcttgaggagatatagaactttatttgacaactttttattccgagtcattttgtttctgaaaaaagttttaattgcccaaattttaaaattaaatttaaagttctacaaatgacatttgatggatatgtgcgccctatgctgaatttgttgtactcagccggatcaaaaaatattcagttgaaatttctttcatttaaactacataggtattgaaatatctaacacttgatttctactccatccatctcaaaaatcaaggtctcaaaagttcaaagtatgttctaaattatagcgtacattgtattgctcaacaaccacatgcatcttttttttgcattttagactccatccttacatgccatttaaagaccatcttacacccaaaattgactgctaataattggtggctgaactacatgcatgcaaaactcgattttgaatggttttgcatgctgaccaagttaccggacctgttttttttttttctaatttcaaggaccc

SEQ ID NO: 20886 - DNA, 924 bp, Zea mays
aggtagaacatgacatcccacccatgcggtgtcccgcccgtgcgaatgtagtgctggtcctcggccgccgagatgcaatagagcatccgcgccacgagcagacccgacatgaggtggtggatgcggtgcgcggagaggcggttgcggtggagggtgacgtagagccacccggccaggaacacgacatagcagacggcgaagaaggcgtagatcgttgggacagaggccatgccgacggagaggtagtccctggtgccgtccgggttggtgttgtacatgtcggtgcggacctccatgctgacgctggtctccggcgcgcagttggcgaagaagaggctgtactcgtcggggtgggtgatggggaaagtctggttgtggtagccgttgtcgtcgagctctgcgaaggtgaagagaggcctgacgtagggactggcgaggacgcacgtgggggaggattctgggttggggttcagatccgtgggcgccggctgatcgtagatggcctcgaagagcgactcgtcagagaggaggaagaagccgagctgcgcggggtcgggcttagcgagcttggaggagtacttggcgccggtgacggagatagacaccatgccgtggagcccgaagccgaacttctcgaagaggatggagccgcgggagtcgtccttgaaggactcctgcttgatctccgccgccgcaggactgaggaggaccccggatacggcgaggaggaggaggaccgcgcgtgcggcggcggcgaggcccatcgcggcgagatctgtggggagatgggggaggcggagcagaggtgagcgaattagccggacggacgggacgggggtggattcttctgggcttggggagccggcccgccggcccggcgcccccggatctccttccagattggtgagccccgtgtggcgagag

SEQ ID NO: 20887 - DNA, 5201 bp, Zea mays
taaactttatttcgcaaaaaaagtatcatctgcggtacaaatcttctatttcattctaagtctgcgtcttgttgtgctacatgatatgcacttatgctatatcacctaaaacttgtagggacatcaataaaaatttagggaacctttggcttttaaaataaatagttttggctctggcttctctaccaagcagctttttttagaagtcaaagccattaaaaaccatttggcaaaatagcttcgagattgttttgccaaaaataaatcttgcatagttactcttttatatattatcattattgcgtttgcattgcagagtttctctgggcaaatacattgtacatcttgtttacgtcaaattatagcaagttcatagcttccaacgtggaaaatactactaatctattctacaaaagcacgtggagagcttcttttgttcatcagggaaactttacatataatctgaatatacgtgaacgtggagagttctctttgttcatcagggcccgagccaagaaagaaggaaagcaattttctaacagtttgtccgtaacgtcgtagcagagaaaccaccgcgtcggggccatccacggctgcgctgtggcctgtggcctcccccgtcggcgccctcgcctccactccactggccttggcgtgtccacccccgaccatgccgtggcctggccaggccgcgctgaggcctccacccgtcgtgccgtgtcctcaaggccggccctaatgccatgccgccgggggcccagaaataagaggggcccaacgtctaataataaaatagtagtgttattattagttgtcgtcttgcctaatttatataacttatcaagataaacaatttatattttggtcattccttcatatgacaaaataaaagaaaatttatccttaaaaaatatatctctctcgtagtttatgatacatgagaaagaaaaatctaatataaacgcaagtgatatagtggtgtagtgatagaggagattccgagagagaggtttgcgagtttgaatctcaccgggtcacaaaacacgtgaatccagttcaaaaatggttggggttattttccctaattaaaaaatattttgtttttagtttttttgtgattcttaatttgccgagtgttttttgattgtcgagtgcaaaaaagtactcgacaaagaaccatttgtcgataaaatgtttgacgaagtgtttgtgacactcgacaaagaagaccaattcgatagtgcctgcaccgctgcatggagccagtctcgccctcgctgctgttgttgatcgcaggtcgcaagctcacaactcctaggtaattcactattcactaattcttattctttcatactcatacatattttttagtagttcatttctttgtttatctagcatcttagatatctagttgtaaactttcaattccagtaaaacaattacttgcttttttattaggtcatagatgttgtcgaagaaatatattttcttcataaacaataaacaatggatgtgacatagttctattcttcattaatgtaatcatattagctccaagatacaaatacattgttatgttagtggcctttattccttgatagttattagacatgttaaattaaatatatcaatatatttcattttgttttgtaagtaaaactagtgcatattataattatatataccataaaaaatttatgtagtctagaggacctatcaggatgagttcgcctgaggcccacaaaatcataggattggggctgcatgtccttcggcggaaccgtggcatggtctggtcacaccgagtgctcccctcgacagcgttgtggacatgcccgacagcgctgtggcctggcctagccgtgcggaggcctccaccggccgcattgtggtctcgattagtgctggcaattgggcagggtccatcgtgcttcgggccaagaagacctaaaaacttttgggacatgccgtaccagcccaaagtgtagacacaacggctcaatctgacactaagacatgtcatgccttcgttggacctaaaacatgtctagtgaatatgaggcaatcctccatggcctacaaaaactataccggagaactgtaaaggaaacggtacacacggagttgcgcatccagtaaaaaagtcctgcagccgcacaccctatcccgcataccctatctggtactacaaagtcaagagggaggttggaaaccttatttacaaagtcaagagggaagagtgaggtgaaaataaaataatagaatatgtggtagttagtatagagtagatatttaagttgaatatgactatgaaagattgtgaaatagtgtagagaatctcgctgatcagaaggataaaaattagggttgtatgagtgcggatatcctaaaagccgtcagtgtaagatgtacaatcatgttagactcaggtcgtcgtagggcgcatcaaaaagggcttaatggcaaaagaaccagagttggcaaaatatcttgcagccataagaagaatggagacatatttcttgggttttcatcctcaagcacattcgaaggagcgagaacacagaagctaacaagttggtcaaagtatgagcacatgccaagcagtcaagactgtaagagcccggctagcaaccgtaggatctgaagtttgtaggagaaattaaaatggttcataagtgtgtttcatttgaaataacacttaaatctttgtgtttaatccaaaataacaattaacttttttgaaccgaatatagttcaatgtatgcacagctcccccgctgtcttgctagttgctactccatttctgtattgtaaactagcttagatcttgttcagttatttccatttcatacgagttagaaagaatggaggagaaattagaaagtattttaacttgctagagatttaaacttatttaaggctttgttcagttatccagattccgtgtgcattgagaaaaaataggaataattttaacttactagggatcaaaacgcactcaatcctaatggattgagaaggaaacgaacaacccctaattctcctcaatccaggtggattgaaatcaaaacgaacataaccttaacagttggacgtaaacactcatcataaaataggcaaacaaaaagcaacagtggacaacttgtctaaaggctccaaaccggaatactctctctattcagaaattataagtcagtttagcttttctaaaaatatagttactataagtcgatttagcttttctagaaacagagttactattctaaatacataatttttgataggtatctaaacatagcttatgtagctagagatagtgtatagtaagtaaaatctctgtacttaaaacctcaaaacaactaggctgtttctggtgtaaaatagaggacacggaactgtagatgacattgtttgacactgtttataaagcgtaaacaaagcgaaatttaaaatagtagatatagtaggggatctaccggagatagcctaacgctgccagttcattgtctgcgctacttatgtcctctcagacgttcaaattggggcaccaatactacaataaacttaagctcagaaagctgagctaaagaatcgagcaccgcaaccacaactgtttattgtaacgccagggttatcaattagacaattactcgtatcaagaaacaggataaactacataaaactgaaaatcactagcccacactatattaactgaccctgatgatcaccaaatagctttgtacagaaccacacacacgcgtgcgtacacctgttcctcgagcccagatgaattaagctaatacagaacacaccaagaagtatgctgagttattgagaagatgtttattcaggctgattttcacttactagtgactccaacctgtggttacctgtaggtggctgggtggctcgtttggcttccagccactcaagctgccagagagtgacgcaggaacaagaacgccagatttctggaaaggtgtccgcttgcacgtctagatcccaacaaccatctgaaattcagaaaggacacggcaacacgatgcttatcgatgccattcccagtccccacacaaataaaatcatccattcatagtgaaaatataacagtgagaaggaaagaactgaacccaagacttgacaaaatggcaacattgatttaattcccctttacttttgcaacacaagaaatctagtcatcacaagtctcgttggcagcttccaaaactaaaaggagttgagaagatttaccacaatacgtagacatatattagctaaaccctgaatctgtatagtatgatcaacatcacatcgaggagaaaatgaatgggagatggctgcattcccatgtcattggacatccacgtggtcgtctagagctcaaactcctcctcacggagcgccatctctgcggcttcctcatcatcctcgtcaagtgcgaagtactggttcctctcagctggcctgaacatgtagaacatgaacatgtagaatgccatggtggccacctcctccgctgcaacgctgacccatctgtacttgtagttagtaattgtcttgagggcatacacaatgatcctggtgaagtagaggtatccaataacggcaacatagaattggcggaagagcatgagcttggcaagggttctggctgccttgccgtctgtcttggatgactcccgcagagcacgcatcgaccacaccactgggaagagcacagcacagcagcaagcgacatcaacaaacaagaagatctggttccatgtcacccatccctgcaagaaaggtccagtctcgccgaccacagcagcagcgatgttagctgcaacctgcagtgggatcaccaccatgagcactttccttctccttgtcctgcaggaatggcttcaggaacgaccacccggtcccaatcagcgagcttggaggagtacttggcgccggtgacggagatagacaccatgccgtggaggccgaagccgaacttctcgaagaggatggagccgcgggagtcgtccttgaaggactcctgcttgatctccgccgccgcaggactgaggaggaccccggatacggcgaggaggaggagggccgcgcgggcggcggcggcggcggcgaggcccatcgcgacgagatttgtggggagatggggggaggcggagcagaggtgagcgaatcggacgcgtgggtcgacccagggg

SEQ ID NO: 20888 - DNA, 1723 bp, Zea mays
ttttttttttttttttggtttttttttttttttttttttttttttttagacatctcctactagttagcagttaactattagctctaacgcattcaaacatgacctaagttaagagagttcttactgcgtcagtcaaagtcaccaactccagccctactagaaataagactacaagagtacacgtaaagccttcagctagttcctaattcgttcgtatagtacactacgctgaaatgcacctacatattttagaatcagcatttatcctcagtccatatagtagggtgttgtctggactaaaagctcctcgtcgtcttcattgtcatcgtcgttatcatcagcaccgacccagttgctcgggtggtgttgtgatcgaggaataccactgataccttcaggacgttcttccatgtgatccatttgcaaaggctgcattatattgtttgcattatctgcaactggtggcttgcttggagcatttgtaacattgggcagcattgacatgtcgttcagcatattagtgcttgcgtttctcttcttctgggcatgattttctctgttagcttcaatgcttttgggagtactacctgaaagctccgaccatattttagtatggttcgagacattttcaggaactagtgttggtgcagcagcccctggttctcccgcgttttgtgctgatgtagctggttgttgggcatcatcgctgtcagataattgtgatacagtcatagtagccagaactagagtagcttcaaaatcagaagctgctccatcatccaatccgaatctcgggaccaaaagaacaggttcgccagtcttctcaaagaataggaggatgtcaacctcacatccttcacaaaatgttaaaaaagccttcagttcttttaccccaaaggtgacatccaccggatcaccagcatgaacaaactccacgaactcctcggcagggtcgatccacagttgtgtgtgcagtctagtgtcacagtcatcttttgtcgggtcattgtagctccggagctcaacagccttgcccccgacgtcaccgctagcatcaggtaaccctgaagcaggatctgtagcgatgattgtgagctcctgcagcgaggactggaagttggacaacagccgcgccagctcccgcggccgaatggctaggcggctcgggaaccgtccccggtctagcgacagcgactgcacctcgggctctgcgctgcacacgatccagtacgtcttcctcacaccattgaggcagtggagggtgatctggagcttgggtgcgtcgggttctgggagggatacggcgagtcggtcgagcgcggcgtgcggcgtgcggaggacggcgagcagggacttgaggaggacgctgcactgcagcggcgtggaagacggtgccgaagccgcggcgtcgaggtgatactggtcgaagaagtcgcgcgctagggagatcgaagcgtacgccgaccgcgagctgttaagcgtgtgcatctccagcttggcggggtgcgcctggagcacgagctcggaggcaacgcgcgcgaggaaggtcacgcaccggccgaacgttcgcagggagctgccactcatcgacagctccattaccgcaatcggggccgccgcctgctccccttccgctgcggtctagactctcgcctgcttttggtttaggttcggttgcgcgtccggagagaggagggaaacggaacccggccagcctcgaggg

SEQ ID NO: 20889 - DNA, 3389 bp, Zea mays
atgtcaacctcacatccttcacaaaatgttaaaaaagcctagtatggaagaggaaaaagagagggagatgcaaagactccattagtatttcaggatgagaaaaaaaatcatcggcatcaaatgtctcaaataaatctactactgaatatatgaacttctaagcataccagttatcatgaactcatgaagtaagatcctgtgtagcaactgatgagataataataactaacaaacttctatccaagagagataatagttgtggaaatactctgaaaaggtgttttaacttgcaaacatgtttcttgtattcacgatagtagggagctgcaaatgttattatccaattccttgctgctcctacaaagttattatccacttcaaggcatatcatattacaatctgtttcccaccacaagagtaagggatagagaatttatcaccttcagttcttttaccccaaaggtgacatccaccggatcaccagcatgaacaaactccacgaactcctcggcagggtcgatccacagttgtgtgtgcagtctagtgtcacagtcatctgcgacccaccaaaacaccacagtttcacagcccaatcactagcgtgaacacaacgtccacaaccaacccagaaacaacagaagagaagtaccttttgtcgggtcattgtagctccggagctcaacagccttgcccccgacgtcaccgctagcatcaggtaaccctgaagcaggatctgtagcgatgattgtgagctcctgcagcgaggactggaagttggacaacagccgcgccagctcccgcggccgaatggctaggcggctcgggaaccgtccccggtctagcgacagcgactgcacctcgggctctgcgctgcacacgatccagtacgtcttcctcacaccttaacaacgcaacgcaaaaagaattgggagaaccggagaaattagagctactagtggaagaagagcccgccaaaaccgtaaacaagctctagaaaaatggctggcttgcagagaacagcgcgccaaaagcacgaaattcacaagattggggaaatgtttcactatcgcaaaaatttcttagtgaaaaccttagaagctagatggggatagcaaggggcagggtagcgtttatgcgcaccattgaggcagtggagggtgatctggagcttgggtgcgtcgggttctgggagggatacggcgagtcggtcgagcgcggcgtgcggcgtgcggaggacggcgagcagggacttgaggaggacgctgcactgcagccgcgcgcaagacggtgccgaagccgcggcgtcgaggtgatactggtcgaagaagtcgcgcgctagggagatcgaagcgtacgccgaccgcgagctgttaagcgtgtgcatctccagctgatgaaacgtcagagaagagaactcgtaagaaatctaggtgggtgggttggggacccccagtccccacacggcggtcgggaggccaggagaggggctgcgaaccttggcggggtgcgcctggagcacgagctcggaggcaacgcgcgcgaggaaggtcacgcaccggccgaacgttcgcagggagctgccactcatcgacagctccattaccgcaatcggggccgccgcctgctccccttccgctgcggtctagactctcgcctgcttttggtttaggttcggttgggacttcggagagaggagggaaacggaacgagaaccggtagactgtgcgggccgttttatcgtgttgggcttggcccattactgatggactaattggtctgaagaaaggcgcacagcgatacggcccaacacgcgaggaatggaacgtgacgctgtgagtggacccagaaccgaatgctagggtttacgacccgcgcttctcatataaatggcagcaggtgtcccgtactcgaaccatcgagccgccgccgccgccgccgcagttgtcttcggtcttccgtgctcaccttcgagagatcaaggtccgtgtgctctctccttctcgggccatcgccgatctttgcctatgcttgttactcctgtacctcttcgtgcttgcgcgtatgcctgtgcatctccccttgttggtttgcgaattagcataagtaagccgtagactttaccatgtttcgtggcggtttgcgagtaagctgtagttttagctctacctactgtggaattgcattttacgagatctgaggggaagaagaagaagaagaagaagaagagagcaaagtcagctactcgcggcactggttgatggccgagcagccgcgcgtataggggttggctttggcgcccggctggcagttgtagtaggacgcccccggcacggagcacggcaccgagtccggcatcagcgcgctgtagctgatgtactgcgccgtgggcagcaggctggccgcggtgtccacgtcgtagtacagtagcaggcgcatccggccacacggcgcggcgccgccttcggcgtccacgccgtaatagacggggcactcctccggcgaggcgagccccagcacgagtcgtcggaagaagccccggccccggcccccggccacgcccactccgccgccacgcgcgcgtggatggtcgagaccatcagctccgacgccgtggctccgctggagacggcgagcgccgacatcgcggccgcgaggagcagcgcgtgccgtgccgaagccatggtggacgcggggctttgagacgtacgaacgaggttggcggccggcacggtggagctggcagcgtggtttagaatgttgcaatgcaacaccaagaatctaccggatttgagttgagtaagcgccttgagcggtggtggggcgcttttaagctggaggcctggagggagtgttctgtttggtgctgggcgctggcatcgtgtccgggcgaacggcggtgccacgtcatgccaccaacgctgaccttgctccagcaacgctgggcatcgagaacgcgtggtctcgtgccgaggcacgaacatctagcaggctcctgctcccgcgcgcgattcttgctgcagtttgacctgctagaaaatctgatttctaaccatgctaccaagtaataaataaataaataaatagaagcgcctgggattgctatggcctgtgggactcagcacccagcttcaacaaatcaagctatcaccactaacagttcaatcgtatgactaaatagctgcatccttttatgcacaaatcagtgccacacagaaacagctctccaaaagctcatgaaaaaacatttgctttaaaacatccggggcaagcagcggacatttttttacatggtcatgaacatctctgtttgtttcgtcctagatataacaagtacatggtgctgttatttctttttcaatatttgctacccatgtgtctgatttatcctt

SEQ ID NO: 20890 - DNA, 1857 bp, Zea mays
cactgagactgagaccgacaaaagtgtatgaattatgccagaagtgtttcgatcgagtagtggatttagacgacggattacgtggcatgcatgagcatctgatgacaagtgggcccctcggcgccggccgccatcttcttggttggtcggaaatgagctcgacaggttgaggttgtcagccagcgagatatctgatctcctccggctccggtgcggtgaggaccccatcccgccggcggacaaaagttacatggcctgccccccgcccgaacaggaagagggcccacacgtcggccactctgtctgaccacagcacccccaccacctagcctgattcccaaaacgttttcccctggaaagagaaaaagagaaaaacggagattccttgcccccttttcccttccccatcgtcgaaaccctagccccgcctcgccgccggcacgccggatcggtcggcgccatgtccaaggccagggtctacgccgacgtcaacgtgctgcgccccaaggagtactgggattacgaggcgctcaccgttcaatggggtgagcaggatgactatgaagttgtcaggaaggtcgggagaggaaaatacagtgaagtatttgaaggtattaatgttaacaataatgagaaatgcatcatcaagatcctcaagcctgtgaagaaaaagaagatcaaaagagaaattaaaattcttcagaatctttgtggaggccctaacattgtgaagctgctcgatattgttagagatcagcattcgaaaacgcccagcttgatctttgaatatgttaacaacacagatttcaaagtgctgtacccaacattaacagattatgacattcggtattacatctacgagttactcaaggcattagattactgccattcacaaggtattatgcaccgagatgtgaagccccacaatgttatgatagatcatgagcttcggaaactccggctgatagactggggtcttgctgaattctatcatcctggcaaggaatataatgtccgtgttgcatccaggtacttcaaggggcctgagcttcttgttgacttgcaagattatgattactctttggacatgtggagtctgggctgcatgtttgctgggatgatttttcgtaaggaaccatttttctacgggcatgacaaccatgatcaacttgttaagatagccaaggtacttgggacagatgggctgaatgtttatttgaacaagtacagaattgagcttgaccctcagcttgaagccctcgttggaaggcatagcaggaaaccctggttaaagtttatgaacgcagataaccagcacctagtgtctcctgaggccatagatttccttgacaagcttttgcgttatgatcatcaggagaggcttactgcacttgaagctatgacgcacccgtacttccaacaagtgagagccgctgagaacagcaggacgcgagcgtgacaggcaaagagcgaagaccatctgctcttttatcagtcagtcaggttgtatgagatgagtagccgttgggtcacttggcagaaaataaacaatagcggtagagcctgtactgtacgtaacgtaacctcctcgaggagttgtgaggtttgggacgtgattgcgaacatggtatattaatgattgttcatgtaaggtgctgtttggttcaagaaatgtaacacaaatggtaatggtaaaccatttccctcgattactggcggtaacaaatttgaataggctgatatcaatttttagtgtgttatttgattacggttggactaaaacaaacatgatctaacgttatcagttacccattacgttataaatatgtgaaccaaacggcacctaagatatttgtc

SEQ ID NO: 20891 - DNA, 989 bp, Zea mays
cgccccgccctcccgccgcgccggcccccccgcaggtgcgtcgcgcccgggccgcggcggcgcccgcgcgaccgcggcgctcgcgcctgcccgcccggcgcccccccccctcccccccccggaaaagaaactccaaattaattgtttcaatcattaggagatactattccgtccataccaaataataagtcgctttcactttttttacatagattttgctatgtatctagacatacattatatttagatacatagtaaattgatgtaccaaaaagtcaaaagaacttataatttggaacggagggagtaagtaacaaacaaaaatgactgcctattcagaattggctcgatggcgtgttatcagaaataataaatgttgataaccatacaaaaaatatttaactatagcatttaaataataataataatttattttcattggtgttgatactgtctctggcggggctccgacggtgatcgatatcgggaaccctggtaaaccatgtacctgtcacggtgatttcttccaccataatgcaagcgatcaataaaaggtgaatgatattatcttgcaaatgagtatcccggagtaaaatcacgtctacgacttgtgtgttttggtgacctatcaggagaatcactcctagataggctcctttcattgtctggtgttatattaataaagaaatttatacaaccgattgaccaaacttagtgatcgaacttatttaatagagaaacactaataggtagcaactaatgttagtaggtataataggtatgtgtttgttttgaaaatacaaagccaaaacttcggtactgatacaaaacaaaaatgtaattgtgacttcaccaccaaattcgataatgttttctttttataatatatataataacaccaatctaaattattttactccattatctttcaacatgaaagcaagcatatattacaagatagtttatttgagaagaaacatattgagagt

SEQ ID NO: 20892 - DNA, 1916 bp, Zea mays
attggggccccgcgccggcggggaaaggatctcatccccccacctagcacatcaactcggagtcggagattcccctccccagccgtcgaaagtcgaaaccctagccccgcctcaccgccggtggtggtggcagcctcagcaccggcacacagcccgccgtacctctcctcgtacgctccctcccggtgtgccgtcgccccctcgaccggtccatcgttcgtcggctcggtagccgccggatcgggatcggccggcgccatgtccaaggccagggtctacaccgacgtcaacgtgctgcgccccaaggagtactgggactacgaggcgctcaccgttcaatggggtgagcaggataactatgaagttgttaggaaagttgggagagggaaatacagtgaagtctttgagggtattaatgttaacaataatgagaaatgcatcattaagatcctcaagcctgtgaagaaaaagaagatcaaaagagaaattaaaattcttcagaatctttatggaggccctaacattgtgaagctgcttgatattgttagagatcagcattcaaaaacaccaagcttgatctttgagtatgtcaacaacacagatttcaaagtgttgtacccgacactaacagattatgacattcgatattacatctatgagttactcaaggcattagattactgccattcacaaggtattatgcaccgagatgtgaagccccacaatgttatgatagatcatgagcttcggaaactccggctgatagactggggccttgctgaattctatcatcctggcaaggaatataatgtccgtgttgcctccaggtacttcaagggtcctgagcttcttgttgacttgcaagattatgattactctctggacatgtggagtctgggctgcatgtttgctggaatgatttttcgtaaggagccatttttttacggtcatgacaaccatgatcaacttgttaagatagccaaggtacttggaacagatgggctgaatgtctatttgaacaagtacagaattgagcttgaccctcagctcgaagcccttgttggaaggcatagcaggaaaccctggacaaagtttattaatgcagacaaccaacacctagtgtctcatgaggccatagatttcctcgacaagcttttgcgttatgatcatcaggacaggcttactgcacgtgaagctatgacacacccatacttccaacaagtgagggctgcagagaacagcaggacgcgggcatgagaggccaaagaccaaagactggtgctaaccctggatcagatcatctgctcttggtggagccatgctcttaccagtgacttgcttcagtcgtatgtgatgaatagtggtttgggggtttacttggcaaaaacaaacagtagctatggcgcctgttgtgcccttaaccgcgtcgagacgtgactgaattactcaggtcatcggcttgtgggacgtgattgcgaacgagattattcatgtaagatgtttgtcataaaaggttgtcgttggctgattgttctgcttgtattgttgagcttgtaaagaatatccaacatttgtttggacttcatcgagctctccaggtttattttctcggaaaccggaaaccaattgccgcggccagagataaatggcatccttgcaatgtcccaaattctcaccgaagaacacaaggaaaagaaaagaaaatattgagcaagcacagcacaggcagcatgaatccacagaaccagtggtttttagcacagcaggctgaccgccccagctacagtacattgtcgaactgggcaacaagaaagccgtatgatccgcatctctatacccatttattgacacacagcgtatatgtacatgcataactagggttgaagctgaccatagcatatgattctgttgcatac

SEQ ID NO: 20893 - DNA, 852 bp, Zea mays
gggtacctcgaggccggccgggaatgttatgatagatcatgagcttcggaaactccggctgatagactggggtcttgctgaattctatcatcctggcaaggaatataatgtccgtgttgcatccaggtacttcaaggggcctgagcttcttgttgccctgccaagcattatgattactctttggacatgtggagtctgggctgcatgtttgctgggatgatttttcgtaaggaaccatttttctacgggcatgacaaccacgatcaacttgttaagatagccaaggtacttgggacagatgggctgaatgcttatttgaacaagtacagaattgagcttgaccctcagcttgaagccctcgttggaaggcatagcaggaaaccctggttaaagtttatgaacgcagataaccagcacctagtgtctcctgaggccatagatttccttgacaagcttttgcgttatgatcatcaggagaggcttactgcgcttgaagctatgacgcacccgtacttccaacaagtgagagccgctgagaacagcaggacgcgagcctgacaggcaaagagcgaagaccatctgctcttttatcagtcagtcaggttgtatgagatgagtagccgttgggtcacttggcagaaaataaacaacagcggtagagcctgtactgtactgtacgtacgtaacctccctcctcgagaaggggttgtgaggtttgggacgtgattgcgaacatggtatattaatgatgattgttcatgtaagatgtttgtcataaaatgtttgtccgtttgctgttgacctctaaaaaaaaaaaagcccccatctaggtcaagtcaagaaacttgaggc

SEQ ID NO: 20894 - DNA, 1309 bp, Zea mays
  misc_feature (1191)..(1191): n is a, c, g, or t
cacgagctgagacctcccatgcttgctatatctgtgctgtgcagctggtgtgacgcaagtggtgaagtgatgacgatgatatatgctaccgtccggcggccggggtcgtacagtgacgggagtgagcaggatgactatgaagttgtcaggaaggtcgggagaggaaaatacagtgaagtatttgaaggtattaatgttaacaataatgagaaatgcatcatcaagatcctcaagcctgtgaagaaaaagaagatcaaaagagaaattaaaattcttcagaatctttgtggaggccctaacattgtgaagctgctcgatattgttagagatcagcattcgaaaacgcccagcttgatctttgaatatgttaacaacacagatttcaaagtgctgtacccaacattaacagattatgacattcggtattacatctacgagttactcaaggcattagattactgccattcacaaggtattatgcaccgagatgtgaagccccacaatgttatgatagatcatgagcttcggaaactccggctgatagactggggtcttgctgaattctatcatcctggcaaggaatataatgtccgtgttgcatccaggtacttcaaggggcctgagcttcttgttgacttgcaagattatgattactctttggacatgtggagtctgggctgcatgtttgctgggatgatttttcgtaaggaaccatttttctacgggcatgacaaccatgatcaacttgttaagatagccaaggtacttgggacagatgggctgaatgcttatttgaacaagtacagaattgagcttgaccctcagcttgaagccctcgttggaaggcatagcaggaaaccctggttaaagtttatgaacgcagataaccagcacctagtgtctcctgaggccatagatttccttgacaagcttttgcgttatgatcatcaggagaggcttactgcacttgaagctatgacgcacccgtacttccaacaagtgagagccgctgagaacagcaggacgcgagcgtgacaggcaaagagcgaagaccatctgctcttttatcagtcagtcaggttgtatgagatgagtagccgttgggtcacttggcagaaaataaacaatagcggtagagcctgtactgtacggtacgtaacctccccgagcctcccccgtcctcgagaaggngttgtgaggtttgggacgtgattgcgaacatggtatattaatgatgattgttcatgtaagatgtttgtcataaaatggtttgtccgtttgctgttgaaaaaaaaaaaaaaaagcggcc

SEQ ID NO: 20895 - DNA, 1754 bp, Zea mays
  misc_feature (19)..(19): n is a, c, g, or t
ggtaccctcggagcctgtnccgggcttaaaaaaaaaaaaaaaaaaacaactcggagtcgcagattcccctcccagccgtcgaaagtcgaaaccctagccccgcctcaccgccggcggtggtggcagcctcagcaccggcacacagcccgccgtacctctcctcgtacgctcccttccggtgtgccgtcgccccctcgaccggtccatcgttcgtcggctcggtagccgccggatcggatcgggatcggccggcgccatgtccaaggccagggtctacaccgacgtcaacgtgctgcgccccaaggagtactgggactacgaggcgctcaccgttcaatggggtgagcaggataactatgaagttgttaggaaagttgggagagggaaatacagtgaagtctttgagggtattaatgttaacaataatgagaaatgcatcattaagatcctcaagcctgtgaagaaaaagaagatcaaaagagaaattaaaattcttcagaatctttatggaggccctaacattgtgaagctgcttgatattgttagagatcagcattcaaaaacaccaagcttgatctttgagtatgtcaacaacacagatttcaaagtgttgtacccgacactaacagattatgacattcgatattacatctacgagttactcaaggcattagattactgccattcacaaggtattatgcaccgagatgtgaagccccacaatgttatgatagatcacgagcttcggaaactccggctgatagactggggccttgctgaattctatcatcctggcaaggaatataatgtccgtgttgcctccaggtacttcaagggtcctgagcttcttgttgacttgcaagattatgattactctctggacatgtggagtctgggctgcatgtttgctggaatgatttttcgtaaggagccatttttttacggtcatgacaaccatgatcaacttgttaagatagccaaggtacttggaacagatgggctgaatgtctatttgaacaagtacagaattgagcttgaccctcagctcgaagcccttgttggaaggcatagcaggaaaccctggacaaagtttattaatgcagacaaccaacacctagtgtctcatgaggccatagatttcctcgacaagcttttgcgttatgatcatcaggacaggcttactgcacgtgaagctatgacacacccatacttccaacaagtgagggctgcagagaacagcaggacgcgggcatgagaggccaaagaccaaagaggcaaagactggtgctaaccgtggatcagatcatctgctcttggtggagccatgctcttaccagtgatgaatagtggtttgggggtttacttggcaaaaacaaacagtagctatggcgcctgttgtacccttaaccgcgtcgagacgtgactgaattactcaggtcatcggcttgtgggacgtgattgcgaacgagattattcatgtaagatgtttgtcataaaaggtcgtcgttggctgattgtgctgtttgtattgttgagctagtaaagaatatccaaaatttgtttggacttcatcgagctctccaggtttattttctcgtaatctctatggaaattaccgttactagagataaatggcatccttgcaatgtcccaaattctcaccgaagaacacaaggaaaagagaagaaaatattgagcaagcacagcacaggcaggcagcatgaatccacacagaaccaatggtttttagcaca

SEQ ID NO: 20896 - DNA, 1240 bp, Zea mays
gccacgccacgcacttggtccacaccccccgggctggccgggaatgagagagaagagcaagaaagacttcgtcacgtcaggtcgacggcgaaagacgcggaggttggtgaaggagtgaaggaagaaagagaacgaaaggcggcctctcactcgcagtcgcagtagcaggttctagaccaccaaacccagcggctcccgctcatctcagttcggcttcggccttcgcattcctctacagatttcgcagttttgctgggggtaactacggaatggggggcggatccggatctttcctcaaggtcttggtcaacaacatggatgtcctcgcggggcctttggtttcacttgcgtatcctctgtatgcctctgttagagcaattgaaacaaaatctgctgtggatgatcagcaatggctcacgtactgggtgctgtactcatttatcactctattcgagctcacctttgctccggtactcgaatggcttcctttctggtcttatgcaaagctgttcttcaattgctggttagtattgccacagttcaatggagctgcacatgtatatgagcattttgtgaggccaatgattgtaaatcagcaagttgtaaacatctggtatattccaaagaaggatgaatcaagtagacctgatgatgtaatttcagctgcacagaggtacattgagcaaaatggatcaaaagcgtttgagaatcttgttaacaagtttaagagttcgaacccaaggcgctcaattctggaggaggtagaggttgaaaggagggccaggattcaactagaatctgaagcgagggaagtgaaccctttcttcaatccagaatatcagtactaggcaaccattttcccttcacttgccaggaatgtgctaggatcggtttggaggaagatgtctggatattaggattgcgttttgcacctactgaatcgatgatattgtgtagatggacaaccataattgttgtagatatgttgtggcgatggaactcatgtaatggtcatgtcgcgaatgtttcatgctgctggaaattatgtattcacactggactctagttatgtgcctcactagtttcttgaaggtagttgttgaactaggtatttcttcgtctcttgtctgatataggtgtaaaccatgtggcactgccatgggaggttgactgtccgaatgctacgcttttattaaagctgccagaagcactgaccaataaaaatactaggctgattaaa

SEQ ID NO: 20897 - DNA, 1232 bp, Zea mays
  misc_feature (1048)..(1052): n is a, c, g, or t
  misc_feature (1227)..(1231): n is a, c, g, or t
aacccaacatctgcaaattttgccggggacacattgaaacagcgccagctctatttaatactgctgacgacatctgacggggaaattgcctacatagcgcacatcgaattcgcgccacattacatatttaacaggtagggataaaccaaaagaacacaaggcgatggtcaccctgcgtggttctcgtatgggttctcacatgtttttgttacatactgaatgctactagcaattttttatgctgatctgaattcttgcaatgacagcctcatggtcagcatttttttgtactatacttgaacatacaacagctttgaacagtatcaacatgtgtcagttttaacccaaaagttcagaagtcatatttcgtccggccacttctcaagattaggcatagcatatcagacagcttagaggttgagctgtagaaattccatgcctcaagcatcaatcgctttctggaacctttgaaatgaacaaccttaacatccaagggtacaccatgaaactgtccagcaccctcaggcggggtccaattataaacagcacaaggcaagaagagaacagatgttccattaacttcaccagtaaatgcttcattcttagaaaattttccgaaagccgatggtagatgagacttgacaacccatgcaagtgctaattggtcaccaagcatacgagaagccttcatatatcttaaactgtaagttccaaggacttgtttcaagaattccacagcgttagtgatgccatccctggttccccttaccgcaacaaacccagaattcaacggttgccctttgttattacgaaaagtaacagccagatgaaaatgaggatattttttgaatatatgtccaagatcaccaaccactgctatatcggaatcagttaaaacaaaatgattcaacctctccatcctatcaaattccacaagctttgccccccgcggccccatgtatgtctttattctctgaagcatcaaatttcctcgagaatagtttccttcaactggcaatagtgtagcagtcccttgatttactgaaannnnngaaccaggatcagtcaatatgatcaagtcgcttcttggcattgatacctttatgaaactgatgaaagtgttcagaatggccatggatctttctattttgctataagaactgtttccaacagttacagaatcagatggaacattgtctctccagggtgagacagacaaacaacccnnnnnt

SEQ ID NO: 20898 - DNA, 1467 bp, Zea mays
  misc_feature (14)..(14): n is a, c, g, or t
cccacgcgtccganacaagtggattacctttcttttatccttgaacttttaccttgcacttcacaatcttcataggttctcagtttgatgatgagaaatcgctgattatgtctcaaatgagcttggagaagagatttggccagtccagtgtttttgtagcctctactctgatggaatatggcggtgttccacaatctgcaactccagagtctcttctgaaagaagctattcatgtcatcagctgtggctatgaggacaaaactgactggggaactgagattgggtggatctatggttctgttacagaagacattctcaccggattcaagatgcatgctcgaggctggcgatcaatctactgcatgcctaagcgaccagctttcaagggatctgctcctatcaacctttcgggtcgtgggaatcaagtgcttcggtgggctcttggttccattgaaattcttttcagcaggcattgtcccatatggtatggctatggaggtcggcttaaattcctggagagatttgcttatatcaacacaacaatttatccactcacatcaatcccgctcctcctgtactgcatattgccagcagtttgtcttctcactgggagaggcatcatcccaaagattagtaacctagagagtgtttggtttatatcgctctttatctcaatctttgccactggtatccttgagatgaggtggagtggtgttggcattgatgaatggtggaggaacgagcagttctgggtcattggtggtatttctgcgcatttatttgccgtcttccagggtctcctgaaggtgcttgctggtatcgacacgagcttcactgtcacctctaaggccactgacgaaggaggtgattttgccgagctctacatgttcaagtggacaacgcttctgatcccaccaaccactattttgatcatcaacctggtcggcgtggtcgctggcatttcctacgcaatcaatagcgggtaccagtcatggggacctcttttcgggaagctcttctttgcgttctgggtgattgtccacctgtaccccttcctcaagggcctcatggggaagcagaaccgcacgccgaccattgtcgttgtctgggctatcctccttgcgtcgatcttttccctgatgtgggttcgtatcgatccattcaccacccgggtcactggccctgatatcgcgaaatgtggcatcaactgctaggatgagctgaatatagttaaagagtggaactagacgcattgtgcatcgtaagttatcagtgggtggctctttttatagtatggtaggaacttggtcgggagacgttaattacatatgctatatgtacctccgctggtctttatccgtaagttaatatatatactgctttggggaaaaaaaaaaaaaaaaaaaaaaaaaaaaaaaaaaggaaaaaaaaaaaaaaaaccccggggggggccccggtccccaatcg

SEQ ID NO: 20899 - DNA, 4346 bp, Zea mays
ccgggcccgccgcccgcgcgtcggtgccgcgtcccttttcccctctccccctccgtcgccgcctcgagcgagctccaccacttgctcctgcgcgaggtgaacactgggttagggccactgccaccgctgggctgcctctgcttctgcctctcccgccagcgcgcgagcccgggggcgattcggcgccggcacgcgggaggggaagccgaggaatgcggtgagtcggcgggggtccggcgtttgtgaactcgtggagggctcggattggtgcgccatggacggcggcgacgccacgaattcggggaagcatgtggccgggcaggtgtgccagatctgcggcgacggcgtgggcaccgcggcggacggcgacctcttcaccgcctgcgacgtctgcggcttccccgtgtgccgcccatgctacgagtacgagcgcaaggacggcacccaggcgtgcccgcagtgcaagactaagtacaagcgccacaaagggagcccaccagtacacggtgaggaaaatgaggatgtggatgctgacgatgtgagtgactacaactaccaagcatctggcaaccaggatcagaagcaaaagattgctgagagaatgctcacctggcggacaaactcacgtggcagtgatattggcctggctaagtatgacagcggtgaaattgggcatgggaagtatgacagtggtgagatccctcgtggatatatcccgtcactaactcatagccagatctcaggagagattcctggagcttcccctgatcatatgatgtctcctgttgggaacattggcaggcgtggacatcaatttccttatgtaaatcattctccaaacccatcgagggagttctccggtagccttggcaatgttgcatggaaagagagggtggatggatggaaaatgaaggataaaggtgcaattcctatgaccaatggaacaagcattgctccatcagaagggcgtggagttgctgatattgatgcttctactgattataacatggaagatgccttactgaatgatgaaactcggcaacctctatctagaaaagtgccaattccttcatccagaataaatccgtacagaatggtcattgtgctacgtttggctgttctatgcatattcttgcgctaccgtatcacacatcctgtgaacaatgcatatccactgtggcttttatccgtcatatgtgagatctggtttgctttgtcctggattttggatcagttcccaaagtggtccccaatcaaccgtgaaacataccttgatagactggctttaaggtatgaccgagaaggtgaaccatctcaattagctcctgttgatatttttgtcagtactgtggatccaatgaaggagcctcctcttgtcactgcaaatactgtgctttccatccttgctgtcgattatccggttgacaaggtatcttgctatgtttcggatgatggagctgctatgctgacttttgatgctctctctgaaacttcagagtttgctagaaaatgggttccgttctgtaagaagtacaacatagagcctagggctccggaatggtactttgctcagaaaattgattacttgaaagacaaagttcaaacttcatttgtgaaagaacgccgggccatgaagagagaatatgaagaattcaaagttcgtatcaatggtcttgtagccaaggcacaaaaagttcccgaggagggatggatcatgcaagatggtacaccttggcctgggaacaatactagggaccatcctggaatgattcaggttttcctgggtcacagtggagggcttgacgttgaaggcaatgaacttcctcgtttggtttatgtgtctcgtgaaaaacgtcctggattccaacatcacaagaaggctggtgccatgaatgcacttgttcgtgtatcagctgtccttactaatgggcaatacatgttgaatcttgattgtgaccactacatcaataatagcaaggctcttcgagaagctatgtgcttccttatggacccaaacctaggaaggaatgtctgttatgtccaatttcctcagaggtttgatggtattgataggaatgaccgatatgcaaacaggaacactgtgtttttcgatattaacttgagaggtcttgacggcattcaagggccagtttatgtgggaactggttgtgtgtttaacagaacggccttatatggttatgagcctccagtcaagaaaaaaaagccaggcttcttctcttcgctttgtgggggaaggaaaaagacgtcaaaatctaagaagagctcggaaaagaagaagtcacatagacacgcagacagttctgtaccagtatttaatctcgaagatatagaggaagggattgaaggttctcagtttgatgatgagaaatcgctgattatgtctcaaatgagcttggagaagagatttggccagtccagtgtttttgtagcctctactctgatggaatatggcggtgttccacaatctgcaactccagagtctcttctgaaagaagctattcatgtcatcagctgtggctatgaggacaaaactgactggggaactgagattgggtggatctatggttctgttacagaagacattctcaccggattcaagatgcatgctcgaggctggcgatcaatctactgcatgcctaagcgaccagctttcaagggatctgctcctatcaacctttcggatcgtttgaatcaagtgcttcggtgggctcttggttccattgaaattcttttcagcaggcattgtcccatatggtatggctatggaggccggcttaaattcctggagagatttgcttatatcaacacaacaatttatccactcacatcaatcccgctcctcctgtactgcatattgccagcagtttgtcttctcactgggaagttcatcatcccaaagattagtaacctagagagtgtttggtttatatcgctctttatctcaatctttgccactggtatccttgagatgaggtggagtggtgttggcattgatgaatggtggaggaacgagcagttctgggtcattggtggtatttctgcgcatttatttgccgtcttccagggtctcctgaaggtgcttgctggtatcgacacgagcttcactgtcacctctaaggccactgacgaagaaggtgattttgccgagctctacatgttcaagtggacaacgcttctgatcccaccaaccactattttgatcatcaacctggtcggcgtggtcgctggcatttcctacgcaatcaatagcggttaccagtcatggggacctcttttcgggaagctcttctttgcgttctgggtgattgtccacctgtaccccttcctcaagggcctcatggggaagcagaaccgcacgccgaccattgtcgttgtctgggctatcctccttgcgtcgatcttttccctgatgtgggttcgtatcgatccattcaccacccgggtcactggtcctgatatcgcgaaatgtggcatcaactgctaggatgagctgaagataattaaagagtggaactagacgcattgtgcatcgtaagttatcagtgggtggctctttttatagtatggtaggaacttggtcgggagacgttaattacatatgctatatgtacctccgctggtctttatccgtaagttaatatatatactgctttgagaattatgtatgggcaacaggttgtttacttgattttgtgtgtacatatttaaatgtctctgccaatatcaaatgcattaaccatgaagtatcaattgtcgttgcgtttccaaaaaaaaaaaaccgaatgctacaccaaccaattaacaaacacaattatttaacaccattttctataagttttttttggtataccctcgtatgtacaggctataaactgctcaaaaactagcctatcctagctcttatcacttatcagcgcagggctgtgggcgaaccgtcctggattttccccattgtacattctggcatggcatgtgatctgtgtattgcccttaccgccctgtattcttaggtcgttgatttgcaagctatgtcttggcatgttttttttgaatatatttttttttataaataactgcgaatatagacgctgttgttacacgcgcataggccgacaggttacactcgtcccaaatattccccggttacactggaaccaaaaattccactagtaagagatgatcagaccatcaaactgtccctgtcttctttcaattttgagtcttatcttcacaaaaaattccgctccggtttagcgaaagggcaatcaacacacttacacacagatggtcatgttgccaccctttcgtcagggcatttcctgcag

SEQ ID NO: 20900 - DNA, 2411 bp, Zea mays
gcgaccccaggtcagtcgggactacccgctgagtttaagcatataaataagcggaggagaagaaacttacgaggattccccactggcttcctctgccgctcgcagtctcgctccacaactatccactaccgagtactccctccctcctcctgaaaaccccgaccgcgggcaaaccaaaccctagcgagcgaggcgatcagcgtccggcgaccggcgacagagcgcaatggagacgcgcccggcgccttgcgacctcgaggcggccgtgcccgcgggctccggggctgcaacggcggcggcggcgcagcaggaggcacccgcggcgaagaaagtggcggaggaggaggatccgcgcctgcgctgggccttcgtgcggaaggtgtacgccattctctccctccagttcgcgctcaccgcggccgtcgcggccaccgcgtgcctcgtccgcccgatcccgcgcttcttcgcctccggcccccccgccgccgtctggtccacgtacatcgcgatcctcctgtccccgctcatcgtcatgttccccatgctcaagtacagggagaagcaccccaggaacctcgtcctgctcgccgtattcactctctgctgcagtctcagcatcgccgtctccgcctccaccaccctcggcacagtggtcctgcaagctaccatcctcacagctgctgctgtcctggggctcaccctcttcaccttctggggcgtcaagaggggctacgacttcaccttcacgttccccttcctgttcgcctgcctcgtcgtgctgctgggtgtacatcatcatccaggctaattcgcctgcctgcatgacgagggcactgtcttcctcgttttgaaatagatctgtgctagctctcccatgcatgtcacatgtctagctcacggtttaataatgttgatccactgcaggtctgcttcccgctgggaagggtagccatgaccatctacggcgtcctggccaccgtggtgttctcgggcttcatcgtctatgacaccaacaagctgctgaagcgccacgcctacaaccagtacgtggtggcagccatctccctctacctggacgtcatcaacctcttcatggcccagatggccatctccttccagtgatggattgcgggtctcacctgtacggctgtaccccatgcatgacggcgcctcgcccgtctggtacatggtggatcacacatccacatagcttcgcaagtcgagctgtctttcattatccttatcctaatactggtagtaccaatagcattacagtcctacagatctgtaattggctggccacccttcagctgagacagtatatatatcgtatatggcacctcaccataaatgacgttggagaccatgagatggttggtcgtgcttcggcaccgtatagttgtgacggtgacatgctgatttgaggtcaaagtaggatgacgttttctcgattttttaggatcatgccgccaacaaatattgtccaacaaatattgttctggtgtcgtgagatgggagatgcttactatgttggataacactagtagcggtaattttttactctgctataacggttgatggaaaaacggtactttgcggctcctgacggtcaaggctacacgtaggaaatatcctaaaccatggagtacatacggaaatcaaaactgcgtgaaatctgtgtctggagtcccacagcagtgctttcgtttgtcccgcgccctggcagctcgttcaccatgcccctgtttgtttcggtttttcgcagcttctggccaccagaagctgctacggactgccaaacactcagcttttcagacagcatctataaaattcgtttgggtaaaaaccattcaaaatcaacataaacatataatcggttgagtcgtcgtaatagtagtaatccgtcactttgtagatcctgaatctcatggacaactttatcttgctccgcacgtaatcctaatgatattcagattatctacacagccagattctctccacagctagattctcggaaaagctagtcagaaaaaagctgaaccaaacacagcccatatcgcctggagcccgaagaatgcgagcagcgcgaggagcgtgccagccggcgcggcggaagctccggcgccggacttcttgacggtgaaggagaagggtgcaggcggcgacgagctcggcgtggacccgttgatcacgtcgatccccagacccttgcagtccgggcccagcgaacctgcagcagagacttgttcgttagctatgcgcctatgcggctgcgatcagagtcagaggatctagttgcctacactgtcggtagcacgggtaggaggtgtcgttgaggaggttggagtagccgtcgcggcagggggatggtctagggtccatagcagtgtcattcaagggggggggggggg

SEQ ID NO: 20901 - DNA, 1541 bp, Zea mays
aatactagccgtctagccctcgagccgtccagggcgcggcgacgacacccacaggccacagccacaggccacacgacaccaccgctcggtctcggcgtccgcctccacgcacgcttcctcccgcaggccatccacccgatccgatccgatccgagcgtccaccatgtgggtgacgtcgatgccgcaggtttgggacgaggagggcgcggccaagggcggcgcggtgaccccggcgccggccgcggccatgctgggctcgctggcggggtggctgtcccggaccgtgcagccgcagccgccggcgccccgggtgtgcggcaccgcggggggcccgcccgtgacggcgcccaggctcaggctccgcgacggccgccacctcgcctactgcgagagcggcgtgccccgggaccaggccaggttcgccgtcgtcttctcccacggattcaccggctcccgcgaggacagcgtccgcgcctcccaggaagttgcggaggagctgggcgtgtacatggtgggtttcgaccgcgccgggtacgggcagagcgaccccaaccccaaccggtccgtcaagagcgcggcgctggacgtggaggagctcgcggacgcgctggggctcggccccaagttctacgtcatcggcatctccctcggctgccatgccgtctggggcgccctcaaatacatccccgacaggatcgccggcgcggcgatgatggcgccggtggtgaactactggtggccagggttctcgccggagctggcggcggaggtgtacgcgaagcaggaggtgggcgaccagtgggcgctgcgcgtgtcgcaccacgcgccgggcatcctccactggtggatggagcagagctggctgcccacctccacggtggtggccggcaccacgccgctgcccaacgagcgcgacgccgagatccggagcaagatgaaggcggacggcacgttccagcagaagcgggagcaggcgacgcagcaggggatccacgagtcctactaccgcgacatgaccgtcatgttcggcaagtgggagttcgaccccatggcgctgccggagccgccgtgccccgtgcacctctggcagggcgacgaggacggcctcgtccctgtcgtgctgcagaggtacctcgccggcaagatcggatggatcaactaccatgaactccctggcaccggccacttcctgtcgtcggtgcctgggctcggagacaacgtccttaggacccttttcagtgacaagcagtaaacaaacaatcctccctcacgacgtatcgaagctttcgagcatggtggtggtggtggcgcattagttcattttattattgtaaaggcccgtggttgtcgctgattagagatgataaaataatggtgatgtagatgcaagaccttaaagtgaaatactatatcagagatgtaatatacatacatagtgatgacctttctgttttcattataaaacaaattgtctagtgaaaaaaaaaaaaaaaagtcagcgtaaagtatcttttgttgtgggagtctatccgggcctgcag

SEQ ID NO: 20902 - DNA, 1352 bp, Zea mays
gaggagcagtcgcgtcacggacatgcggacacagcgggatccagcaccaacaagagcctaggaaggccaggggcaggggtcctcgccgcaatggagctgctggccaaggcgcccgtgctgggctgcgccgggaagatgcagaggcagcggcaacgggggtccgcgctgggcaggtggatttgccgtgccgtggcgccgccgagggtgcggctcagggacggccgccacctggcgtacgccgagtccggggccagcaaggaggacgcgaggttcaaggtcgtcttctcccacggcttcaccggctcccgcctcgacaccgtccgcccggcgccggaagttgcggaggagctgggcgtgtacatggtgggtttcgaccgcgccgggtacgggcagagcgaccccaaccccaaccggtccgtcaagagcgcggcgctggacgtggaggagctcgcggacgcgctggggctcggccccaagttctacgtcatcggcatctccctcggctgccatgccgtctggggcgccctcaaatacatccccgacaggatcgccggcgcggcgatgatggcgccggtggtgaactactggtggccagggttcccgccggagctggcggcggaggtgtacgcgaagcaggaggtgggcgaccagtgggcgctgcgcgtgtcgcaccacgcgccgggcatcctccactggtggatggagcagagctggctgcccacctccacggtggtggccaccacgccgctgcccaacgagcgcgacgccgagatgccggagcaagatgaaggcggacggcacgttccagcagaagcgggagcaggcgacgcagcaggggatccacgagtcctactaccgcgacatgaccgtcatgttcggcaagtgggagttcgaccccatggcgctgccggagccgccgtgccccgtgcacctctggcagggcgacgaggacggcctcgtccctgtcgtgctgcagaggtacctcgccggcaagatcggatggatcaactaccatgaactccctggcaccggccacttcctgtcgtcggtgcctgggctcggagacaacgtccttaggacccttttcagtgacaagcagtaaacaaacaaacaaacaatcctccctcacgacgtatcgacggcgctaagctttcgagcatggtggtggtggtggcgcattagttcattttattattgtaaaggcccgtggttgtcgctgattagagatgataaaataatggtgatgtagatgcaagaccttatactatatcagagatgtaatatacatacatagtgatgacctttctgttttcattataaaacaaattgtctacttaaaaaaaaaaaaaaaa

SEQ ID NO: 20903 - DNA, 1731 bp, Zea mays
gtccggattcccgggtcgaccacgcgtccgcttttttttttttttttttgcctagaaaacgagcatgacaaataatcacatccagatgctcaaccatacattacttcgacaataactttcatcaaccaataaaaagaaagagggggagggcatttagacagacttcggtcccttttatgtcacagaacaattcttcaaaaaaaaaagtggagaggcatgcagcaggaagccttgcctagcagcgacgcccgcaatctttacatcttccttggtccgcttgtcttctgaatgtaatcatgcttgaggaggttggcacgcagaagcatggacttgacatctctctcaaagtcattgccggtttgaaggacacgctggaaagttgcatttctctggtcagcatgccttgcgtaaaggatcttgttgtgggagtctatccgggcctgtattttgtcctcagtaatcagtgcggccagctccttctgcagcatggagaccgaagtcttaaaggcggctgccatcgtgttgaggtcaacagatataaaaggaagtgtgtactgtatgatcgctttgtggcgaatctccatatacagagtctctacatgctgatgcaaatggatatccaggagcaggttaggctttagcttctcaagatgacccaagcaagatccatagcgacttgcataaaaatcattaaccagctcccttacttcaggcaccagctccagaaagttacggaagttgatattgtcaatgactttgctcttcaggtctgaacggtcaaaagaagcaagtgcacaaagggcaccatagactgccacgtcttgaggagctatgacttcagagaagttgtttcctagttcaattcctgtctcaacaaacttacgagcagcaaatttgtatttctttgtttccaagttggctaatcctgcagctgccttcagctttgcaacaatggtaggatccagagagtcgggggtttgctctgctttgctgacatagtttgaaacatgtgcatattgccccagctcaatgctaaccagaatcacattcatgcacatctgaactatatgtttggaagtggtgcaatagtcccgagtcctgatgtagcttttgaaagcatctgaaagttggccatgggcatagaagaaatcaccaatgtcattgtagcccattctgatgctctctttgattaagttagtcctgtatccattgagctcgctctcgagcttctccttgcgctggtcggcgcggcgggagacgctgaagacccacgcctggtcgaggccgtagcgcggaccgaggcggccgccgatcttggtgacgacgtcgcggtggagctgcacgtcctccccgcgcttgatctcgtcgtaagccatccgcagcgcctcgagctgcatcgcctccaccccgcaccggtcggcgacaaagaggaggcgcacgaggcgggtccgccccgagtactgcgccgcgtacgcctccacgtcgagctgctcagccgagaccggcgccggagaggcctcctccgcgcccgcgccgcccaggccgttcgccaccgccgccgcggcggcggcggggacctcgccctcgacgtccatggcgtgggagattcgggggaggctaggtttgggggcaaaaccctaggcgaggcggagcgggagcagatggagaggggcgtggggcgagaggagaggaaggaatcagaggagacgccgagaagcctcgggccgagtt

SEQ ID NO: 20904 - DNA, 2598 bp, Zea mays
ggatgagatgtttttactacaagagatcaataaaactgaacagtgctgctaaactaagggcacatatttaaaagtttctaataagaaatgtattttgagagatgaccaacgatattcccaaccggagctacagaaaagaaactacattttgggcatattttgatcttcatgaagttgcatacacagctgaattttggtgaacaaaattgtggcaatggtttcacatcatttagaacacatggacagggcatataacttttttgccactattagcatgacttgtctaacccctgtcccttgcaccagtctcagaaagtaggggctggttaaatatagaaatttggttgattaattgcatggactttcttaatagtaggcaagagaatcaatcatgccctgaaaaccttttaagaagccaaataccctcagcacttatcaaatagatattacatcgtttcgttccacaggtgtgcttagtctcttctctacccctacttaatctacattacatgaacagaaccttctactgtaagcataagagaggagctcttgatctgaatcactagacagtttatgaacaacacttctaagttttgaatgaagtcacgtaatcataatgtgcttcttctgtaagcttctagcttgtgttacatacaaagaagggcttactccagcagcagatgcgtgccgctgtgatatgtaaccccgcacaagggtatctctaccaaagaatcatatatatgttgctccgccaaacagctttgaattatagtggctggagttcttgctcgggaaccactgaatcaacaggtctgtaggcagtttgaccactaaatttttttctccaaataagtactactaaaaaggctgacaaagtgaccaaaatagctaataaaatcccaagcaatatagaaactgcatgctcttgaaaccatgacctgctcccctggggctaaaggaaactaaattatctggaagcactggaataccatgcaagcaaataagatggatgggtactgcagaagttttacgcactataataattcataaagttatctcacatggaacttttcttttggtgctggggagagggatgtaaatataacagtgttgagcactaacaagtggctgcaatgtcaggtggacccaaacactcagagaataggtgagagctcaggagcgtaacaaaacaaacaacggagatctatagtttcttgttatgcgcgccccatccagctgcatggcaggagtatttataggcccgtccgggggtaggtggtccaaagtacgaccctacccctggctatcaactatatccagggaatattcctctcaacggagtaattacaatgtcgtgcacaccacaggcaacagagcgtggtcttcgctggcgctgttggagccttcgcgccttaacatagttgtctgcttgtccagactcggcgaagaatgtcgaggactcctagtcatgatcgtggcagggcctcgactgctcggccatcctgaggccttcgcctgacgtagcccctctgttgcattccgttagagcgaaggaggccttcgctgatgccccttcgctcgtggatttgcgaaaattgttagtagtaaaacagagtcatcgaccggttaattgatggtgtgttcggcctccaccatatagtagcccctcgagggagtggttcatcctggtgggccattcccgaagtcttgatttagaggtggacgaacgttgccctcgaccaaccggtgaacctcctcgagggggccgcatgacgtgacggatggaaaaccgaggcgacactgtttgcttgtgccgcttgtataaaatgactgcgcggccgcgctgatgggccaccacttctgctttcgcacccatcggcgctcgcaagaaccgtcagatcaccgccgcttgcaactgtcgttttcgccgctggtgacgagatcgacgacaagctcgctgacgctgcgccatctaaagactgccgctcgccgtcgaccccggtacgctgccatgcccccctctcgcagtggtggtgcaactccgtcgccgcaccacggggcaggaagggcgttggctcttcctctactagggttccatgctccggtgggccaggccgagagaattatgatgtgggcccctcgaagattacatcggagggtaaacgagatggagagttcgcgctacttcctgggtggatacgggcgtgccccttgggtggagactgtgccgaggccagatgtcgaaatgttattttttgaggggttgttcgctgcaggacttcgtctgtcgtgccatggttttctaattgaagtgcttgagaagtttaaggttcaaattcactaattaacgtcgaacgccatggttgcgttgagcaagtttgtgtgggcaatgactacctttggcggaggcccgagcgtcgaggtcttcgccaagcactattgcttgcactggcaggtcttcgggcgacggagttgatcagtttggcagttgtacttttaccgcgaagactgggaagttgttgagttagccccttgtgcgaagaataagtggggggtggacagaaaaattggttttatttcgaggttgaggctttgcca

SEQ ID NO: 20905 - DNA, 2791 bp, Zea mays
tattagttaatgtacatgctacattttattttgcttttaatttaatctgatggtatagaccttttgtgtaatgtgatttgtgttccttgaactcgtaacaggatggatatacatggatgatgagcagttccagttcttatcacgattgtgtggatctactcacacttcttggaatggcatatctgatttgccagtctcttctcatggtggtgaattacagcagaaggatgaggaaacagcgccggttgtccccggtcgtcccccgcgtccggatctttcccctgattatgggaagggtttcctttctccttgtctggaagcctacaacctgaaccctgaggaagttatccaaaggatattagaaggaacacttcaccaagatctgctagctttggatacttcattagaagagatgccacacgaaaaacctgcaccaactgctgtgaaagataaagggaagggtatattggtggaaactgtgcctcaaattacaaagaaaccccataaagttgctgagacacattactttgttcaagatggcctatcttcagcaacttcatcagcatcacaaggtccatcttctgcaatttcaccagcatcccttgggccatcttctgcaatttcctcagcattccagggaccatcttctgctatttcatcagcatctctgggcccatcctcatccatatcatctgtcccaaaaggtagatttacaaggaaggccaatgatgatttgccggacactgcaatcctggactcgaaaaatgctaaaaatgcagctagatctgttatccttgactcgcaatatgagtatgaagatgagtacgatgattcatttgatgatcttggcttcagtgtggtagagtcaagttatgaggaaactgatggtgtcaatgacgctgaggcttcatcacatggcccaagatggagtgcacgagagaaaccacagttttatgtcaaggatgggaagaattatagctacaaggttgctggttcggttgctgtatccagtgctcgagaagcagctgtcatgaggcaaactcaaaaagagacaatctatggtctgggtcgtggtggaaatgttccttttggtgtcccgaacaggcaacatatagatgtggaggcagaggaggttggtgatgctgacaactcaggcagaggttcaaattcccgtggccggggaagaaaaggcggaagggaaggcaaccgtccggaggagaatgagagctccaatggacgaggctctggctttggtggtaaaagaggaggctggaatcagggcaatccggctgaggaaaactggaaccctaatggtcaacaaggttttggccgtggtggcagaagaggggtctggaatcagggtggcccagcgaaggaagacggtaactctagtggcaggcaagaaagttttggccgtggagcaagacggggcagcatgaaccatgaccaatcagccgaggataatgaaggccataataatcccgcacaagactttactcgaggaccagctcctcgtggtggccatggaaggggaggtggccggaaccatcacaggagagatcgggcaatgaagaagcatatgcaaggattgacagggctttagctgctggtagccttatgcttttgatgtgccgtactgtaaatggcatttttggaggcactcctacttgaccatccaaatttttgtgcttgttctgtttttaaatcaaataacgccatgaagtaacccacatatgttctcgtaacatttgtgattgccctaaaaagggtaatagtgtatgtagttctaaacatgcttgtaactcgttaaatacataattaattctctagcgactggaaagaaaaatcatgaaaccaaaccaattttgttagctttttttgtcatgtgctatccagtaaaacagttcttgcttaaaataattgtatatgcccacatgccatacccaattagggttcacccgatgtccccacctctagaaatcttatagggaaaaagtccaactgactatctccattttttatttggtttactctctgtttagaacataggcaatttaaaggtatcagttcaattttatagaaaacttcccttatcagttcaattttagagaaaacttccagtctatttagaacatccgatttttttcaaggatcgtacaagagttttgcaaaaattagttcaattttacataaaagcgtaagaatttgaaaagaaatctatattccaaataggacattccttttcatttgtctatgtataagttgaattttatttttaaaatttgtaagataatagcgtacgccataaattattttaaaaatacattataaaacagttatgtttactataattttgtctttctagtattaattaattaatttatggtctaacctatcaaaaaatgaaataaatttatgttctattttatttataccgctatatattttctataccatcgctatataatctgacagtttgaactttgcaaaatttatccaaccaaatcactcacaactatacctatactaaatctaccaaacaaattacaactaaacttaacacatcatcaaaatcaatgtttcatatcattgaataacttactctaatttactcactaaaatcaatgaacaatattatttgaatcatcaaccattcctcccctcccctgcaaccaagccgacccttacgttacgcccccaccttccccctcccccacattcttgacgccgtcatcaacccctcccctagcgtcatttatgtcgtcgacgactcttcatctcccctctgcgg

SEQ ID NO: 20906 - DNA, 1853 bp, Zea mays
  misc_feature (551)..(551): n is a, c, g, or t
  misc_feature (1769)..(1769): n is a, c, g, or t
ctgaccacatgtgttagctgaatatgagtgccgagcagtagcatgcatataagttccactgcattcaatatttacatttttttcttatttccaggtaactcaagaggtccacttattgactcttatgaccatgtaattggtgttaatacaactacattaacacgtaaaggtgagtcaagattctctcattaaaatatttgtagtcaagattcttttttgtgatgttccaaactgaaagagtgcatccgggctgttgctgtgaaagaaagtgaaagatgatgaggtcaaaaaatgtctttacttggcaaatatacttgaaacataatttgttatattgtatctaaaattgagaaacagatggtggtgagaaaacattgctctcgcatgattggatatttttgatcttctaatgctgaaagaatgcaacataatattctgatacttggaatttatttgagtaattttaactaaacctgtacgtgctaatgagacatgcatataattactgctatatagtttggtagacctgactttgtgatcattgtttcctnggtatgcttatgatttttctgcaatttatctgtgctatactagacttaatcagtagttccactgatttttagtcgttatattaataatctgaatgctcatgaccaaaggccgttagttcgctgatgaacacaattttcgatgttagaagtggattgttgtttgactctagttcttacattttgtctttccttttgcggatcttttttacatggagaatagatatccaggctatcaatgttgtaatcagttttgatttgattttgatgttcaaattgtaaatctttgttgcaatatgcattttgttataatagaaacaatataaagaaaatagtatagagaataaatgtcatctggtacaattgtattagtcttatccctgttatcatagcattttgcttttcttatttccaggtaactcaagaggtccacttattgactcttatgaccatgtaattggtgttaatacaactacattaacatgtaaaggttggtagatctggaaggtcttgatggtctaatacctatctatgagtacggaagaaaaggcgggagaagtcggtctctgcagcatcgcgcgtgaaaaaaaatcagccaattccacgagcattgatgttgtcatgacttcaaaagaggagagaccatgctaagaataatgcattatgacatttgtcaggcttacatatcgactgtttgatatggatagatgtataggtttatgaccaatccagttcaaagcaattggagtatagaagaaataaggagaaacaggaaagctctgtacatcttgcattttgctgttgtttgtcgaagtttcaatgtctgtcgcgtgacaaaatatagttgtaatttatattttggcatgcacgaaacaggtgtatttattcatttttgaacgaaattttatgtcaaaaaaactatagcgttatatacgaaattttaacgcggcatgcacggaaactaacactaaacatgcgtgatttaaacgtcgtaattcgttacgaaacatatcaatgatttatgctaaaattcacatccatttacgctgtttcggatcacattttacgcaaaaaactgcccgaaccagaccccgcgcacgatccgacgtgcgcgatttttacgccgtaatttttgggccacattcgtcgttatgaaacaaagttacgatttatgctaaagtttgtatccatttacgttgttttggttcacgttctacgcanaaaatccgtccgagcccagaccccgcgcaacgatcggacgcacgccgattttttacgcttgtaaatttttgggcccccgtttcg

SEQ ID NO: 20907 - DNA, 1036 bp, Zea mays
attgggacctcgacccggcccctttccacgcgctcgccgcctgcgtctcggttcctctcctccaccgcacctccaagaatccacctccacgactgagttgacggctcggcggtgccatggcagttcaccggctccaaccttccccctccggcctacagtgctccatcgcccggtcgccagtgctcctccatgggccacggctgacgggtgcacgcaccggcaggagaggtggatttggtggacctagattcgatgtgcagagagcgacttggaggtggctgacatcttcaagcactgcaacatgcagttacaactactgttggccatacagggaaatgctgggcctattataccaattgttcaaagcatggaccttgtgtagttacatgtttttatcatagatagattaatttctgaaatgcccatagattggtatatttgtggaaatttgtggtataaaatttttctgttgatgtttgcaggttatttttccagcacttgacattcgagtgaaaaatgtcgcagggacatattctcttgaacataaaggagaaaatgatctcttcacacatcagacaaggcttctactctttcagaagaaagtcatttttaggagaatcgtgaacaaaatgaccagatgtttaggcctggttggaaggacatttttcgaatgaatcagagtgagctcgaggctgagatttgaaaaggtctctcgagattctactcttgatccaaggaggaaggcctatctgatccaaaatctcatgaccagccgttggatagttgctcagcaataatcaccacaaccaagcgtcgaaggacataatggatgtacacgatgacctggatgtgttgctgcaaatgcttactaaatgaagtgtattttattctgtcttcttcttttttctttcttcctctttttttttcttggtcgtccttcctcctttgccgggatatttagtaagtgtagtaatgaagcactaatactaatggatgaatctcgtgtgcaagatgttgatgagcaagagaaaaaaag

SEQ ID NO: 20908 - DNA, 2140 bp, Zea mays
attccccccaaacaaaccctaaccggccgacccaattctcacgcgctcgccgcctgcgtctcggttcctctcctccaccgcacctccaagaatccacctccacgactgagttgacggctcggcggcgccatggcagttcaccggctccaaccttccccctccggcctacagtgctccaccgcccggtcgccagtgctcctccatgggccacggctgacgggtgcacgcaccggcaacgagcacccaccaccggttacgtgcaccctctctccttcggtcattcctccctttcttccgtgctaagccaccgaacacccaagcagtttggcctgatgccacatctctggcaggagaggtggatttggtggacctagattcgatgtgcagagagcgacttggaggtggctgacatcttcaagcactacaacatgcagttacaactactgttggccatacagggaaatgctgggcctattataccaattgttcaaagcatggaccttgtgtagttacatgtttttatcatagatagattaatttctgaaatgcccatagattggtatatttgtggaaatttattggccaactgtaagcccgtcgtgatgcacagaacatttgtggtataagatttttctgttgatgtttgcaggttatttttccagcacttgacattcgagtgaaaaatgtcgcagggacatattctcttgaacataaaggagaaaatgatctcttcacacatcagacaaggcttctactctttcagaagaaagtcattttcaggagaatcttgaacaaaatgaccagatgtttaggtctggttggaaggacatttttcgaatgaatcagagtgagctcgaggctgagattcgaaaaggtctctcgagattctactcttgatccaaggaggaaggcctatctgatccaaaatctcatgaccagccgttggatagctgctcagcagaaatcaccacaaccaagcgtcgaaggacataatggatgtacacgacgacctggatgtgttccttcataccgagacccagggaaacaaatatttggttgtgagcattacaaaagaaactgcaagcttgttgctgcatgctgcaataagctattcacttgcagattctgtcatgataaagttagtgaccatacaatggacaagtatcttcactacaaccattcattttatcgtccacacctttcctgctgagggatgctttcaaggatttcattttaacatcgaaccaatatcaattaagcatggcattttatttggaaatagaagtttgtggtggtgccatggacctgtgcgtcccttgtgaaatgaattgattttctgtcattgaattttctaactgaagctttttcattcgtttgattcacttgagctcccttaagttgtattgtattatttaatcataaatgtcatccttcctcttatagttatataatcaaatattagttttaatcctatctgcatggtttacaatgtattggtttgtgtcattgtgtgaagaatgtttggtggttagtctgaccacatgtgttagttgaatatgagtgccgagcagtagcatgcatataagttccactgcattcaatatttacattttttttcttatttccaggtaactcaagaggtccacttattgactcttatgaccatgtaattggtgttaatacaactacattaacatgtaaaggttggtagatctggaaggtcttgatggtctaatacctatctatgagtacggaagaaaaggcgggagaagtcggtctctgcagcatcgcgcgtgaaaaaaaatcagccaattccacgagcattgatgttgtcatgacttcaaaagaggagagaccatgctaagaataatgcattatgacatttgtcaggcttacatatcgactgtttgatatggatagatgtataggtttatgaccaatccagttcaaagcaattggagtatagaagaaataaggagaaacaggaaagctctgtacatcttgcattttgctgttgtttgtcgaagtttcaatgtctgtcgcgtgacaaaatatagttgtaatttatattttggcatgcacgaaacaggtgtatttattcatttttgaacgaaattttatgtcaaaaaaaaaaaaaaaa

SEQ ID NO: 20909 - DNA, 1956 bp, Zea mays
cccaattctcacgcgctcgccgcctaggagcattcacgttggtggcgggcggtggctcggttcctctcctccaccgcacctccaagaatccacctccacgactgagctgacggctcggcggcgccatggcggttcaccggctccaaccttccctctctggcctacagtgctccaccgcccggtcgccagtgctcctccatgggccacggctgacgggtgcacgcaccgatggttggtgcaggcaggagaggtggatttggtggacctagattcgatgtgcagagagcgacttggaggtggctgacatcttcaagcactgcaacatgcagttacaactactgttggccatacagggaaatgctgggcctattataccaattgttcaaagcatggaccttgtatagctacatgtttttatcatagatatattaatttctgaaatgcccatatattggtatatttgtggaaatttattggccaactgtaagcccgtcgtgatgcacagaacatttgtggtataagatttttctgttgatgtttgcaggttatttttccagcacttgacattcgagtgaaaaatgtcgcagggacatattctcttgaacataaaggagaaaatgtatctcttcgcacatcagacaaggcttctactctttcagaagaaagtcattttcgcgcgcggcttgaacaaaatgaccagatgtttaggcctggttggaaggacattttccgaatgaatcagagtgagctcgaggctgagattcgaaaggtctctcgagattctactcttgatccaaggaggaaggcctatctgatccaaaatctcatgaccagccgttggatagctgctcagcagaaatcaccacaaccaagcgtcgaaggacataatggatgtacacgacgacctggatgtgttgcttcgtaccgagacccagggaaacaaatatttggctgtgagcattacaaaagaaactgcaagcttgttgctgcatgctgcgataagctattcacttgcagattctgtcacgataaagttagtgaccatacaatggacaggaaatcagtgatggagatgatgtgcatgcaatgtctgaatgttcaacctgttggtccaaattgtcaatccccttcttgcaatggactgtccatggccaagtattattgtagcatatgcaagttcttcgatgatgaaaggagtgtctaccattgtcctttttgcaacttgtgtcgccttgggagcggattgggcactgatttttttcattgcatgaagtgcaattgttgccttggcataaagatgatagaacataaatgccgggaaaagatgctagagatgaactgtccaatctgctgcgactttttgtttacatcgagtgcaccagttaaaggccttccttgtggccacttcatgcattcggcttgttttcaggcatatacttgtacccactacacttgtccaatctgctgcaaatccttgggagatatgacggtgtattttggcatgcttgatggtttgctggctgcagaacagcttcctgaggaataccaggaccggtgccaggatatactgtgtaacgactgcgagagaaaaggcaggtcacggtttcattggctctaccacaagtgtggtttctgtggttcttacaacaccagagttatcaagactgatacggcagagtgttctcgccctctataatttcttttatgcaatccatttgtatatatatatcgacggggtagaaaccttgtgaccgtaggtgtgatagtttttttatagagtgaactgggggaggaaccccacctggatgtattatgaggaaaaagtgactgtgcacatgaggagtctgagaattactcgctcccgtcccaaactaactgtatttctacgatttgaaatatattcgctcatataataaaaaaaaaaaaaaaaaaacgaaaaaaaaaaactcgaagagg

SEQ ID NO: 20910 - DNA, 2042 bp, Zea mays
cattgggtacctgggggccgcccgggcggccaattctcacgcgctcgccgcctaggagcattcacgttggtggcgggcggtggctcggttcctctcctccaccgcacctccaagaatccacctccacgactgagctgacggctcggcggcgccatggcggttcaccggctccaaccttccctctctggcctacagtgctccaccgcccggtcgccagtgctcctccatgggccacggctgacgggtgcacgcaccggtatgcatcccttgctgctctaattcccgacgctctagctcgtgtaccagatgtgcagactgtcgcctagccctgctccggcgtgaaggacttctgcttctgcccctgcgcatcccgcccttggtcgcgcacctcggcatgttcctcggcccgacggctactgtcttgaggcatacggtggccgcccacctcgtacccagtcaccagatctcaagttccacctcaaaatccagatcaagtgaatgccatgtttcatccttggtccaatcggttcttactggaatttgttggcaggcaacgagcacccaccaccggttaagtctctccccttcggtccttcctccctttcttctgtgttaagccaccgagcacccaagcggtttggcctgatgccacatctctggtagctacaaacctacaagctttgacaaaagatgctatgattaggccgatacaaagttgtttctgcttctttatctctgtatcatactagcacttattaggttgcaactcgattgtttaggtactagatttgatctgattgtgaattaccagatggttggtgcaggcaggagaggtggatttggtggacctagattcgatgtgcagagagcgacttggaggtggctgacatcttcaagcactgcaacatgcagttacaactactgttggccatatagggaaatgctgggcctattataccaattgttcaaagcatggaccttgtatagctacatgtttttatcatagatatattaatttctgaaatgcccatatattggtatatttgtggaaatttattggccaactgtaagcccgtcgtgatgcacagaacatttgtggtataagatttttctgttgatgtttgcaggttatttttccagcacttgacattcgagtgaaaaatgtcgcagggacatattctcttgaacataaaggagaaaatgatctcttcgcacatcagacaaggcttctactctttcagaagaaagtcattttcaagagaatcttgaacaaaatgaccagatgtttaggcctggttggaaggacatttttcgaatgaatcagagtgagctcgaggctgagattcgaaaaggtctctcgagattctactcttgatccaaggaggaaggcctatctgatccaaaatctcatgaccagccgttggatagctgctcagcagaaatcaccacaaccaagcgtcgaaggacataatggatgtacacgacgacctggatgtgttccttcgtaccgagacccagggaaacaaatatttggctgtgagcattacaaaagaaactgcaagcttgttgctgcatgctgcaataagctattcacttgcagattctgtcacgataaagttagtgaccatacaatggacaggtaactcaagaggtccacttattgactcttatgaccatgtaattggtgttaatacaactacattaacacgtaaaggttggtagatctggaaggtcttgatggtctaatacctgtctatgagtacgaaagaaaaggcgggagaagtcggtctctgcagcatcgcgcgtgaaaaaaaaatcagccaattccatgagcattgatgttgtcatgacttcaaggagagaccatgctaagaataatgcattatgacatttgtcaggcttacatatcgattgtttgatatggatagatgtataggtttatgaccaatccagttcaaagcaatttgagtacaaaagaaataaggagcaggaaagctctgtacatcttgctaaaaaaaaaaaaaaaacgaagttaaaaaaaa

SEQ ID NO: 20911 - DNA, 1555 bp, Zea mays
cctaactgttacctgaaattagaattattattccccccctccaggcccgacgccgccgagccgattctcacgcgctcgccgcctgcgtctcggttcctctcctccaccgcacctccaagaatccacctccacgactgagttgacggctcggcggcgccatggcagttcaccggctccaaccttccccctccggcctacagtgctccaccgcccggtcgccagtgctcctccatgggccacggctgacgggtgcacgcaccggcaggagaggtggatttggtggacctagattcgatgtgcagagagcgacttggaggtggctgacatcttcaagcactacaacatgcagttacaactactgttggccatacagggaaatgctgggcctattataccaattgttcaaagcatggaccttgtgtagttacatgtttttatcatagatagattaatttctgaaatgcccatagattggtatatttgtggaaatttattggccaactgtaagcccgtcgtgatgcacagaacatttgtggtataagatttttctgttgatgtttgcaggttatttttccagcacttgacattcgagtgaaaaatgtcgcagggacatattctcttgaacataaaggagaaaatgatctcttcgcacatcagacaaggcttctactctttcagaagaaagtcattttcaagagaatcttgaacaaaatgaccagatgtttaggcctagttggaaggacatttttcgaatgaatcagagtgagctcgaggctgagattcgaaaaggtctctcgagattctactcttgatccaaggaggaaggcctatctgatccaaaatctcatgaccagccgttggatagctgctcagcagaaatcaccacaaccaagcgtcgaaggacataatggatgtacacgacgacctggatgtgttccttcgtaccgagacccagggaaacaaatatttggctgtgagcattacaaaagaaactgcaagcttgttgctgcatgctgcaataagctattcacttgcatattctgtcacgataaagttagtgaccatacaatggacaggtaactcaagaggtccacttattgactcttatgaccatgtaattggtgttaatacaactacattaacacgtaaaggttggtagatctggaaggtcttgatggtctaatacctgtctatgagtacgaaagaaaaggcgagagaagtcggtctctgcagcatcgcgcgtgaaaaaaaatcagccaattccatgagcattgatgttgtcatgacttcaaggagagaccatgctaagaataatgcattatgacatttgtcaggcttacatatcgattgtttgatatggatagatgtataggtttatgaccaatccagttcaaagcaatttgagtacaaaagaaataaggagcaggaaagctctggtacatcttgcaaaaaaaaaaaaaaaaatcgaagtttcaatgtctgtcgcgtgacaaaatatagttgtaatttatattttggcatgcacgaaacaagtgtatttattcatttttgaacg

SEQ ID NO: 20912 - DNA, 1696 bp, Zea mays
aaaatctaggatatattattccccccaaaacaaaccctaaccggccgggccaatttcctcacgcgctcgccgcctaggagcattcacgttggcggcgggcggcggctcggttcctctcctccaccgcacctccaagaatccacctccacgactgagctgacggctcggtagcgccatggcagttcaccggctccaaccttccccatccggcctacagtgctccaccgcccggtcgccagtgctcctccatgggccacggctgacgggtgcacgcaccgggcgacgagcacccaccaccggttatgtgcaccctctctccttcggtccttcctccctttcttccgtgctaagccaccgagcacccaagcggtttggcctgatgccacatctctggtaggagaggtggatttggtggacctagattcgatgtgcagagagcgacttggaggtggctgacatcttcaagcactgcatcatgcagttacaactactgttggccatacagggaaatgctgggcctattataccaattgttcaaagcatggaccttgtataattacatgtttttatcatagatagattaatttctgaaatgcccatagattggtatatttgtggaaatttattggccaactgtaagcccgtcgtgatgcatagaacatttgtggtataagatttttctgttgatgtttgcaggttatttttccagcacttgacattcgagtgaaaaatgtcgcagggacatattctcttgaacataaaggagaaaatgatctcttcgcacatcagacaaggcttctactctttcagaagaaagtcatttttaggagaatcgtgaacaaaatgaccagatgtttaggcctggttggaaggacatttttcgaatgaatcagagtgagctcgaggctgagatttgaaaaggtctctcgagattctactcttgatccaaggaggaaggcctatctgatccaaaatctcatgaccagccgttggatagttgctcagcaataatcaccacaaccaagcgtcgaaggacataatggatgtacacgatgacctggatgtgttccttcgtaccgagacccagggaaacaaatatttggctgtgagcattacaaaagaaactgcaagcttgttgctgcatgctgcaataagctattcacttgcagattctgtcacgataaagtaactcaagaggtccacttattgactcttatgaccatgtaattggtgttaatacaactacattaacatgtaaaggttggtagatctggaaggtcttgatggtctaatacctatctatgagtacggaagaaaaggcgggagaagtcggtctctgcagcatcgcgcgtgaaaaaaaatcagccaattccacgagcattgatgttgtcatgacttcaaaagaggagagaccatgctaagaataatgcattatgacatttgtcaggcttacatatcgactgtttgatatggatagatgtataggtttatgaccaatccagttcaaagcaattggagtatagaagaaataaggagaaacaggaaagctctgtacatcttgcattttgctgttgtttgtcgaagtttcaatgtctgtcgcgtgacaaaatatagttgtaatttatattttggcatgcacgaaacaggtgtatttattcatttttgaacgaaattttatgtcaaaaaaaaaaaaaaa

SEQ ID NO: 20913 - DNA, 1985 bp, Zea mays
tgcagaacagcttcctgaggaataccgggaccggtgccaggtaaaccttcctcgctcccccgcccgctttctttccgtcatacacctcacgttacgtttatcatcgttgcgtgccggtgccaggatatactgtgtaacgactgcgagagaaaaggcaggtcacggtttcattggctctaccacaagtgtggtttctgtggttcttacaacaccagagttatcaagactgatacggcagagtgttctcgccctctataatttcttttatgcaatccatttgtatatatatcgacggggtagaaaccttgtgaccgtaggtgtgatagttttttatagagtgaactgggggaggaaccccgcctggatgtattatgaggaaaaagtgactgcacatgaggagtctgagaattactcgctcccgtcccaaactaactgtatttctacgatttgaaatatattcgctcatatatttcctgtgttgcccttcagctgtttcctgggaacatctcggtttgtatcagcgatacagttggagaccttctgaacactgtccccaactcaagccgactcagttgagctgaagagcaaataaatactcaggttgcgattgacatggtacattctcgtctgatcttttacttggaatgctcttcttacaagtatgaagtatcctcttcagtcctctgaccacaagtagaatcttccagagacccagagatcctagattgcgagcacctaatatttttttttggtatgccaacgtgtcacatatctcttacgaattgatcggacgcattacgtagtcagcagcagcaccgggcgcactatcaccgctgctgctgctgcatggatactccaaatacgcgtgtctccaagaggcggcgattcctggactgcaggccaggtttcagaaacttgactgctgcttcgatcagccgagccttgttcctgctggacactgaccttgggctcttaacaggcgatgccaccttgtgtgcgtgccttcgtgcccacaatggccgtgtatatgtaagtatgtaacgttgagctgacctgcattgccgtggcggcggtcgtatcgttttgagatttcgaatatgtttaaacgtaaaaatgaaaaaaggatacaggtttgatgaccttgacctagccccggccatgtaatagcattagagagtgggtcgtggtttgggcctgcgcgcctttaaactgtattgggcttggcccatgtacaggaaccaaacacatggtacaaaatctaggtattgtgaaatacttctgccactgccactactgccagcctgccagggatctatttgtaaaaagacaatgacaaaattgacatcaaagcgaaaaagaaagaaaaaacaccctgtcctcaccagttcaacgcctcttctccgttcacccggcgtgtgctctgcctctctctctctctcgtgcagcgaccgccgacgcgcttcgccagaccttcgccggcgacgagcactcaccaggtatgcgcaccctctctcttccgctccttctgcgcggaaccgataaaactggaaccctagccttaactatttggctttctgtatttggatctgatctacttacaactgtacgcattcgtactacctggttcctttgcaaggaatactgtgtgtgcaagtgtacgccgatgacccatgtccctttctgggtctggcctgtgtaatggtagtggttttttaccacttcgctgtggctgtgggctgattgaatccagttcattctcctgcacattctgttacttctagatagatttatgtgctgcgtggttcggttaggttctacgtttccacctgtggcactgttgctgataagttaccaaacctttgtgggtactgcttgagtgtgccggtcactgtaggctaagtcgtcctggccttaagcctcgatgagatctattacttgtagaatttaacgtggtgagatctcgtcggtgattagattatcatttg

SEQ ID NO: 20914 - DNA, 244 bp, Zea mays
tcgagcggccgcccgggcaggtcaagctttttttttttttttttttttttttttttctagaataagcaataataaatacatttaattattatcatccacgactacgagtgtatgttctgaacatttccacctgggacgttggaacccaaggacaccccgagatcacacaaataatcccatctattcacacgcagacgagggcattcagacaacattttcaatgcaagtttttttttcctactcg

SEQ ID NO: 20915 - DNA, 885 bp, Zea mays
ggtggcattgcaaatgtaacataccaacaccacaaactttttggcaggtgcaactgtagccaacaattggaaaaacaaccacgccggggttaaacgatgttagaatatggaataataaatacatttaattattatcatccacgactacgagtgtatgttctgaacatttccaccccgagatcacacaaataatcccctctattcacacgcagacgagggcattcagacaacattttcaatgcaagtttttttttcttcagcccaacatgtcttagcctcgtctaaaggatctgccactcttctgcttcaccagagccatcaaggtcgtcgtcattggccatgctactgccagaacaacccagtccatcatcctgtttatacatttgtttcgatggctcgattgactgcacaacagtaaagagtggcgcgccattggccttctccgccaactcagaggcccgagaacagaaatcatcaaagtcgtctttgtcacgacagtaaaaaccaatagccagggagggatctatttgttccagagccaaggctcggacaacgctgcagtggtatgaggaagtgtctgcctccaagttatccagtgcaatgtcaaccgtcatctgaacttcatggggatctaggtagagagccctatcatcctgtaccccagcaatgtatgttgatgtaccaggttttccacctaaaatgcccaagctttgtgggaacataaatgtctcctttagaatgggatgtaccttgggttaattttgtcaaggccaagaaccagaggaactaacaaaagaataggtgaccatgtagatggtcctttgttgaaatcagagcaaagctgagcagcaacatcaatgcaaacaactggagctccacgctttc

SEQ ID NO: 20916 - DNA, 1977 bp, Zea mays
agcaacaccacaaactttttggcaggtgcaactgtagccaacaattgattttttttttttttttggtgaaacgatgttagaatatgcaataataaatacatttaattattatcatccacgactacgagtgtatgttctgaacatttccacctgggacgttggaacccaaggacaccccgagatcacacaaataatcccatctattcacacgcagacgagggcattcagacaacattttcaatgcaagtttttttttttcttcagcccaacatgtcttagcctcgtctaaaggatctgccactcttctgcttcaccagagccatcaaggtcgtcgtcattggccatgctactgccagaacaacccagtccatcatcctgtttatacatttgtttcgatggctcgattgactgcacaacagtaaagagtggcgcgccattggccttctccgccaactcagaggcccgagaacagaaatcatcaaagtcgtctttgtcacgacagtaaaaaccaatagccagggagggatctatttgttccagagccaaggctcggacaacgctgcagtggtatgaggaagtgtctgcctccaagttatccagtgcaatgtcaaccgtcatctgaacttcatggggatctaggtagagagccctatcatcctgtaccccagcaatgtatgttgatgtaccaggttttccacctaaaatgcccaagctttgtgggaacataaatgtctcctttagtaatgggatgtaccttgggttaattttgtcaaggccaagaaccagaggaactaacaaaagaataggtgaccatgtagatggtcctttgttgaaatcagagcaaagctgagcagcaacatcaatgcaaacaactggagctccacctctttcgccatcttcatcacccgaaaccacatacagcgccatagggaaattttccttcccatctacagcatcagcttgctctctatttgtgcgaataagggtctgccatgcccggcacatagcatatggacccaaccatgatccagcagccagaccataattccttccagcttgaagtaaattgtgaatagagaaagcacaagcttcagaatcaccgaataggtgtaagacccctatataatctgggttgtatggcttctctgggggctttctccaagatcttccaaggtggtgaaaaatcagcgcctgagcaaccagcatttgactgcttctaaccatgcatccccagttcacatcactagttagcttggaatcagatattgcatcaaagcctttccggtaagtgatccatatcctggaagagaaatcttccagaaacgcagcatgcccgctgtcggactccgagtcgccagactcctcttcttcaggcgacaccttatagcatttaccaaggaaccacacgtcactggaggtcaagaccctgccgcaccccagaagtcgccacatggagccgctgcccacgaacctcctcaggatcctggataaaccataggaccctgaggacgactttgtcgacctggcgtcgcacgccggcgacgaggagccctgctgctgcccctcgaatatggcaaaagggggagagaagacgccggacaggatggaggccttgggctgcctggagccgctgtcttccttgcgatcggagccagcggaggaagaggcaacggcggcagccgctaggacggtcacggcagagtcctggcgcagagaatcgagtggcggcacaggtgattctcccctctcaggcaagctcgtcatcacctaacgccgcatgtgtgtgaaggacacccaggatgtccccccggcgatccagtcctcggcgagatgaggccggcgtggggcggcgagggatcggggcgcacggcgggaggggaggggaggtggcgtggcggaggcggaggggaaggaaaagccggagaggaacaagagagagacgtacgggcggatcgcctccagctgggccatggcgtt

SEQ ID NO: 20917 - DNA, 1949 bp, Zea mays
aattgatttgttttctttttttggtgaaatggtgttagcaaatggaatgttaaatacatttatctatgatcattcacaagtgtatgttttgaacatttccacctgtcacgttttgaacattttcctcctaagagacgttggcacccaacgacactcagagacaacaaatcatcccctgtattcacacgcaaacgagggcattcaggcaacatgttccatgagtttttcaacccaacatgtcatcggtgttcccctggtttagaggatctgccactcttctcctgcctcgccagaggcgtcaaggtcgtagtcctcgttggccatgctactgccagaacaacagcacagcccatcatcctgtttatacatttgcttcgatggctggactgactgcatgacagtaaagagtggcgctccattggctttctctgccaactcagatgcccgagaacagaaatcatcgaaatcgtctttgtcgcgacagtaaaaaccaatggctagggatgggtctatttgttctagagccaaatctcggacaacactgcagtggtacgaggaagtgtccgcctccaagttatccggtgcaatatcaaccgccatctgaacgtcatggggatctaggtagagagccctatcttcttgtaccccagcaatgtatgttgacgtcccaggttttccacctaaaatgcccaagctttgtgggaacttaaacgtctcctttagtaatgggatgtaccttggattaattttgtcaaggccaagaaccagaggaatcaacaaaagaataggtgaccatgtacattgtcctttattgaaattggagcaaagctgagcagcaacatcaatacaaaaaactggagctccacctctttcaccatcttcatcacccgaaacgacatatagcgccatagggaaattttccttcccatcgacagcatcagcttgctctctatttgtgcggataagggtctgccatgcccggcacatagcatatggacccacccatgatccagcagccagaccataattccttccagcttgaagtaaattgtgaatagagaaagcacaagcttcagagtcaccaaataggtgtaagacccgtatataatctgggtcgtatggcttctctgatggctttctccaagatcttccaagatggtgaaaaatcagtgcctgagcaaccagcatctgactacttctaaccatgcatccccagttcacatcactagtgagcttggaaccaggtattgcatcaaaccctttccggtaagtgatccatatcctggaagagaaatcttccagaaacgcagcatggccgctgtcagaatccgagccgccagactcctcttcctcgggcgacaccctgtagcatttaccaaggaaccacacgtcaccggaggtcaggaccctggcgcagcccagaagacgccacatggagccgctgcccacgaacctcctcagaatcctggaccaagcataggaccccgagggcggctttgtcgagctggcgtcgcacggcgtcgaggagacctgctgctgcccctcgaatatggcgagagggggcgcgaagacgccggacaggacagatgccttgggctgcctggagccgccgtcttcctcgcgctcggagccagaggaggaagaggcaacgacggcggcagctggggcggcgtcctcgcacggtgaatcgcgtggcggcgcaggtggtgcttctcccctctcaggcgaggtcgtcatcagctaacgccgcatgggtgcgaaggacacacccacccacccacgatgtccctccggcgatccagtcctcggcgagatgaggtcgcggcgagggatcggggcgcacggcgggaggtgagggggaggtggcgtaggccgcgtggaggcggcggaagagccgaagaaaagaagaggggggagggagggagggagggatggagacgtacgggttg

SEQ ID NO: 20918 - DNA, 2269 bp, Zea mays
  misc_feature (29)..(59): n is a, c, g, or t
  misc_feature (78)..(104): n is a, c, g, or t
  misc_feature (125)..(133): n is a, c, g, or t
  misc_feature (2027)..(2027): n is a, c, g, or t
atgatccctgccgttgctgatccgacgannnnnnnnnnnnnnnnnnnnnnnnnnnnnnngctcccggagacggacccnnnnnnnnnnnnnnnnnnnnnnnnnnngcagaagcggccgccggctannnnnnnnnttctcaccgccgtcgtctccgccgtgctcgtcctcgtcctcgtggcggtcacagtcctcgcgtcgcagcacgtcgacgggcagggtgggggcgttcccgcgggcgaagatgccgtcgtcgtcgaggtggccgcctcccgtggcgtggctgagggcgtgtcggagaagtccacggccccgctcctcggcgccggcgcgctccaggacttctcctggaccaacgcgatgctggcgtggcagcgcacggcgttccactcccagccccccaagaactggatgaacgatccgaacggtccgctgtatcacaagggctggtaccacctcttctaccagtggaacccggactccgcggtatggggcaacatcacctggggccacgccgtctagcgcgacctcctccactggctgcacctaccgctggccatggtgcccgatcacccgtacgacgccaacggcgtctggtccgggtcggcgacgcgcctgcccgacggccggatcgtcatgctctacacgggctccacggcggagtcgtcggcgcaggtgcagaacctcgcggagccggccgacgcgtccgacccgctgctgcgggagtgggtcaagtcggacgccaacccggtgctggtgccgccgccgggcatcgggccgacggacttctgcgacccgacgacggtgtggcggacgccggtcggcaacgacacggcgtggcgggtcgccatcgggtccaaggaccgggaccacgcggggctggcgctggtgtaccggacggaggacttcgtgcggtacgacccggcgccggcgctgatgcacgccgtgccgggcaccggcatgtgggagtgcgtggacttctacccggtggccgcgggatcaggcgccgcggcggatagcggggacgacgggctgagacgtccacggcgccggggcccggggtgaagcacgtgctcaaggccagcctcgacgacgacaagcacgactactacgcgatcggcacctacgacccggcgacggacacctggacccccgacagcgcggaggacgacgtcggcatcggcctccggtacgactacggaaagtactacgcgtccaagaccttctacgaccccgtccttcggccgcgggtgctctgggggtgggtcggcgagaccgacagcgaggcgcggacatcctcaagggctgggcatccgtgcagtcaatccccaggacggtcctcctggacacgaagacgggcagcaacctgctccagtggccggtggtggaggtggagaacctccggatgagcggcaagagcttcgacggcgtcgcgctggaccgcggatccgtcgtgcccctcgacgtcggcaaggcgacgcagttggacatcgaggctgtgttcgaggtggacgcgtcggacgcggcggccgtgacggaggccgacgtgacgttcaactgcagcaccagcgctggcgcggcgggccagggcctgctcggcccgttcggccttctcgtgctggcggacgacgacttgtccgagcagacagccgtgtacttctacctgctcaagggcacggacggcagcctccaaactttcttctgccaagacgagctcagggcatccaaggcgaacgatctggttaagagagtatacgggagcttggtccctgtgcttgatggggagaatctctcggtcagaatactggttgaccactccatcgtggagagctttgctcaaggcgggaggacgtgcatcacgtcgcgagtgtaccccacacgagccatctacgactccgcccgcgtcttcctctccaacaacgccacacatgctcacgtcaaagcaaaatccgtcaagatctggcagctcaactccgcctacatccggccatatccggcaacgacgacttctctatgactaaattaagtgncggacagataggcgatattgcatacttgcatcatgaactcatttgtacaacagtgattgtttaatttatttgctgccttccttatccttcttgtgaaactatatggtacacacatgtatcattaggtctagtagtgttgttgcaaagacgcttagacaccagaggttccaggagtatcagagataaggtgataagaggagcagggagcaggtatcgtaaagtatgtctataaagtagtgcca

SEQ ID NO: 20919 - DNA, 1583 bp, Zea mays
aacaatttggacaccgatccatccatccatccagccccgtacgtgtctcgctggccgtccgtatatatagagagaggcatcggagattggccgccacgttgccatcgcgcgcggcgcccgccggccaaggccaaccatgctggcgagggctcctccgccgcggccgtgctccagcggcgtttgcatcgcccgcgcacatccaagagccgccgccgtcgcggccaggccggggacgacgaggacgacgacgacggtcgcggcggcggcggcagaggccgcttctaacgggtcagcggcggcggccgtcgcagggatcagcagcagcagcagcgcgctggtgacctcgaccgtcgggaaatcgacgaacatcctgtggcatgagtgcgccatcgggcagaaggagcgacagggtctgctgaaccagaagggctgcgtcgtgtggatcactggcctaagcggttcagggaaaagcacgctcgcgtgcgcgctgagccgcgagctgcacggcagaggccacctcacgtacgtcctcgacggcgacaacctcaggcacgggctgaacagggacctcagcttcggagcagaggaccgcgccgagaacatccgcagagtaggggaagtagcgaagctgttcgccgacgctggcctcgtctgcatcgccagcctcatatcgccctacagaagcgaccgaagcgcgtgtcgcgatctgctgcccaagcactcgtttatcgaggtgttcctggacgtgccgcttcaagtgtgcgaagccagggaccccaaaggcctctacaagctcgcacgcgccggcaaaatcaaagggttcaccggcatcgacgatccttacgaaccgccgtcggactgtgagatagtgatccagtgtaaagtcggcgactgcccttcgcctgaatcgatggctggtcacgttgtgtcgtaccttgagacgaatggtttcctccaggactagacatggaatgcgatcgatgcgtctgatgtgtatatatgtagcagcagccggagcggcattgccaaggctgtgtaatctcatggctgtctttctctttaagaccaaaacaaacaagagatggcagtgtaaaaaggaaaaaaaaaactgcgtctgacagagtcgctgaatcaaccatgcttctgataaaagctattgtttgtaggtacggcgttgattcttacgacatttatgacaatgctttcaaaaaaaaaaaaaaaaaaaaaaaacaaattccatttattgcaatgatggagatggcccatacatgtagtaaagaacagccgtcctgaagattgaaaacaagggcaattttgatgcaaaatggccaggtctatttaatgtcatcactcagggtctagaccaaggcaatagaaatgtttggttgctactggtaccatcacggaaggttgcgtgcgtcaaggtgaatcaaatctgtgaagggaacgtggccgtcagatctacgggttgggagttagatcaattatatcttttgctaaatggtttagctctaaaacatctagcggaaaatgttgacaatgtttaatggacaacataaataagaggagggttggctccaact

SEQ ID NO: 20920 - DNA, 2560 bp, Zea mays
gataaactgtataaaggcctggaggtgcttgctgagtttgagaaggctgcaaattctagggttgtcgactctggtgtcctgaggggaatgaatttagaagacatcaggaaagctggggagcggcttattgtggagtttgtctgtaaaaatttctttcagaagattgggggggcgggggagatcctcaatttggatatccatattctttcctactgctggtgtgcagagcttataagatccgccttctcatcagccggctgtctagatggtttgaacatacatgcgaacgagttcgcctttgaggaatctgtttcaactggtgagattgacagaaagatccagtccccgctagacaaggttgagaagttcaagagcatcagaagcgacgcggacagcacggtgccattcctgtctgtttacatcggagactcggccggtgatttgctctgcttattggaggcagatatcggtatcgtcgttgggtcaagcacaagcttgcgtagagtgggcagacagttcggtgtttcctttgtcccgttgtttctcggtctagtggagaagcagaggcaactgatggatgaagatgcgtccgtgttcaagccgcggtctggagtcctttatacggtctctagctggtcagaaatacacgccttcgtgctgggaagcgatttcagctgatggatctgctgcttcttttctccatctttttccccttgagaagcaaaaaagcttttgccggttgattctgatgcatacgatgcgtgaatcctaatgtggtcattttatgaaagccacatgtcgattctggctaccactatgtatgaatgaatacctgtagtttgtggtgtggaatgggttaagtttgtgcccgtgaattgtgatcaatgtatcattgattcatccttgttccatttgggactaatttctgggtgttgctggcagcaactacagtatactggatgaatgatgaagtacaactcgtttttatttcagattctcagcaggaagcgtactagtactagccactagggcgaaatgcatgctactagatgtatgatgtgtcatatcggagtacaaatactgatgaactgccagcctggggttcggatgggtgcataatatatgatagaatatgaatgtggtctgttttcatatgctgtatcgtgttttagctagttgaaggtggcggcggcgcgggcgtcgacggcgaggatggtgctgaggttgagcgggtgcatgtactcctgtgggccgtccatgaactggctgacgatgatgcggttggccttctccgtggggtggaagttgtcccagaaggcgtagacgctgcggtccgggcagacgctggacgcggcggtgcagagccccacgccgttgtatggtccctggccgcagcacgcgaccttggaggtgacgaagccgtaggccgccgggtcggagatgaagtccatgtgcatccggtaggcgttgacggcgacgaagacgtcggcgccgagctccgcgttgacgcccttgatcatgtccaccagctgcgggttgtagagcgcggcggcgcgctgcagctcggcgtcgcactccccgtcgcggctgccccgcagcgccagctcggctggggcgcaccccagcgggcccgaccccgtgaccagcacccggcgcgcgcccagcgagtagagctgccgcagcaccttggcgtactcggacacgacgtagcgcacgtagtccggcagcgcgaactcgcgggaccgcgccgagaagggcaccaggtagtagttgttgatgaagtcgttgccgcccagggtgacgagcacgagcgctccgcggacgaggcgcgcggcggcgtcctcgccgacgaggcggctcaagcggtcctggtactgccggaagtagcgcagctgcttctggacgcggatgatgttggcgaactggacccccgtgtcgttgagcacgcccacgcccgccgacgcgaagttggcgcccaccagcagcttccgcccgtccaggtgcgggctcaggtacggcagcgccggctccgcgcccaggtactcgctgatgatgtccggcacgttcttgccgttggagaagcggcccgtcgcgcggtgcgtcgggtagtcgaggccgtacggcggcgagtcggcgcgcgccgtcgtggccaggtagttgttgttgccgctgtccaccagcgagtcgccgaagacgaagaaggcgcggggcggggtcggggtggccgtggctgggcgcacctgcagcagcaggaggacgaggaggaagcacgcagtggctgcgacgagcctgccacggctacctgctgctcctggaacggaaagcattctgctgctgcttcttcgccgctgctctgctcagctgctgctgcgggacgcctatataacaggaagaagataacggggagagtgggatgatcaatagtatacgggctgatggagctgctgcactgcattccatggcgagggtccctatttataccgcatttcagtaggcagtctagtgttccaacgatctgtccatgcacctagggtgggcggtggcatggaaattggcagca

SEQ ID NO: 20921 - DNA, 982 bp, Zea mays
aattcggcacgaggccactttctgccctgttggagcccccgtcttcgtcatcttctagcagcagtgactgcgggagtcttggccggccggcggcgaggctcctcccctttctcctatttctctgcacatagtcacatacatacgtatatgcttgttctccgccgcctccgcttcccgctgccacgccctcttctcgtctcctcctccttagcccctctctcaccctcgacctctagttcctcctgttggtcgtcgacaggcgaaggtagaagggccatggcgtcatctccgtcttccgcttccgctgcggtcgtcgccgagggctcggcggcccgccgattctggatcgctgcctccacgcgggaggccgccttcgctgcatacacgcccttcctcctctccctcgccgccggcaacctgcggctcgacctcttccgccactacatcgagcaggacgcccacttccttcacgccttcgctcgcgcgtacgaaatggccgaagactgcgctgacgatgatgacgacagggctaccatcgccgccctcaggaaggccatcctccaagagctcaacctccacgcctccgttttgaaggagtggggagttgaccctaccaaagagataccttcaagtgcagctacaaccaagtacactgatttcctacttgcaactgcggctggaaaagttgatggcacaaaaggttctgacaaaatggttactccatttgagaagactaaaattgctgcatacattgttggggccataactccatgcatgaggctttatgcatatctaggcaaagaactcatggctttccttaaacaagatgaaaatcatccatataagaaatggattaacacatatgcatccagtgattttgagaacaatgcactccaaatagaagaattgctggacaaactgagtgtatcattaactggtgaggaacttgagattattggcaagctctaccgcagcctatgaa

SEQ ID NO: 20922 - DNA, 2410 bp, Zea mays
ccccgcgtccgccccgcgtcgccactttctgcccgcttggagtccccgtcttcgtcgtcttgtagtagcactgagtgcgggagtactggccggccggcggcgaggctcctccactttctctgcacccatacatacgtatatgcttgttctccgccgtctccgcctccgcctcccactgccacgccctcttctcgtctcctccttctcctccacctccccctcctcctcaccctcgacctctagctcctcctcctgttggtcgtcgacaggcgaaagtagaagggccatggcgtcatctccttctcccgattcggccgcggtcgttgccgagggctccgcggctcgccgcttctggatcgctgcctccacgcgcgaggccgccttcgccgcatacacgcccttcctcctctccctcgccgccggcaatctgcggctcaacgtgtttcgccactacatcgcgcaggacgcgcacttccttcacgccttcgctcgcgcgtacgaaatggccgaggactgcgctgatgatgacgacgacatggccaccatagccgccctcaggaaggccatcctccaagagctcaacctccactcctccgttctgaaggagtggggagttgatcctaccaaagagatacctccaagtgcagctacaaccaaatatactgatttcctacttgcaactgcggctggaaaagttgatggcacaaaaggttctgacaaaatggttactccatttgagaagactaaaattgctgcatacactgttggggccatgactccatgcatgaggctttatgcatatctaggcaaagaactcatggttttccttaaacaagatgaaaatcatccatacaagaaatggattaacacatatgcatccagtgattttgaggacaccacactccaaatagaagaattgctagacaaactaagtgtctcattaactggtgaggaacttgagattattggcaagctctaccagcaagctatgaaactggaagtggagttcttttcttctcagcttatagaccaacctgttgtagctccactttcaagatactgtgatccaaaatataaactgaagaaaaaaaatgattttgatttgacgtgcactgttgttgattcatctgccattttggcggagattgcaattttgtcattccaaaaggcaaatcaaagtgggattgataataacctcgaccgtgcaaaatcgggagacctgagaagttcgtggaacatgctctctaagcaatacatggaagagtatgagaaatgcatggaaagactacttcctccagaagaatcgaagtcactagattatgataaactgtataaaggcctggaggtgctagctgagtttgagaagcttgcaaattctagggttgtcgactctggtgtgctgaggggaatgaatttggaagacatcaggaaagctggtgagcgtcttattcttcaaggtggctgtaaaaatttctttcagaagattgtaaaaacaagggagaacctcaatttggatgtccatattctttcctattgctggtgtgcagaacttataagatcagccttctcatcagccggttgtctagatggtttgaacatacattcaaatgagtttgcctttgaggattctgtttcaactggtgagatcgacagaaagatgcagtctccgctagacaaagttgaaaagttcaagagcatcagaagtgacgtggacagtacagtgccattcctatctgtttatattggagactcggttggagatttgctctgcttattggaggctgatattggtatagtcattgggtcaaccacaagtttgcgtagggtgggcaaacagtttggtgtttcttttgtcccattgttccctggtctagtagagaagcagaggcaactggcggaggaagatgcatccgtattcaaggcacggtctggagtcctctatacggtttctagctggtcagaaatacacgccttcgtactgggaagtgatttcagctgatggatgtgctgcttcttttcttccattttttttccgcttgagaagcaaaattgccggccgatgctgatgcacatgatacgtgaatcctcaatgtggtcattttatgaaagccacatgtcaattctggctaccagtatgtatgaatgaataccgataccagtttgtggtgtggaatgggttgagtttgtacccttgaattgtgatcaatgtttcattgattcgtctgtccttgttccattcggggctaatttctgggtggttgctggcattatactgcaccaacaacaacagtataaacatagtggtatatatcccaagtccaagtgtaacgacgactgcataaatgtagagatgtttgtttttaattggcaataaatgaaatgtgatgagactgttgcgcgttaaaaaaag

SEQ ID NO: 20923 - DNA, 2200 bp, Zea mays
atcagtatatttgaattcggatacaaacaaaaatatgaaaacaaatatagttttgatgatgacattcatatccgatccgattacacgcctagtgatttgtggctgtgagcctttacaattgtgtatataaacagatcaataaaacacacctaagtagcagtctattttggcagcaccaaatcttgccatgttctaatgctcgtgttgagtttcattagcatttgggtaatccaaagatcatcttcctcgtctgtgacaaggcggaccgacgagtaaaagcctacatcatttagctacatttcaaaatgtttcttatatttcaaaatcaattaaatcatgagaatataacatcaaacatggtaaatgctaaattgtttcgagcttgaatctcatctaactggtttagggaatgccagaataatttaaggatctgaaatactctactcatgcaaaactcaacctttgagaggtttactgaagtgatgattcatctaacagttttttttttttttttttttagaaaaagaaacacaaagggttataagagtaatatgaaagtgtaggaacaaatgccaacggacctctgctccactcagccaattgtttactaggacagagagactggcacctcaaccaagcttcagaggtgccatttgagttcagcaaggaaaacatataggctaagcacaattctttaaacgcaagcccaggcaactgaagcagaacctcagcttacttgcagagtcgcggtgtcatttgtgtttacatggacggacatggaatgcattgggcagatttcaatatgcagtagtgactggctcactgcaccaggatgacatcatgggttttgccagcatccttgtcaggatttggctcatctacaaaggttttatttcctacagatcaaacacagcatgcgtgcttgaagtttggacgatgttagcagttctcactaaggcttaactatattccagcacgtgaactcagaaggtattatgttttcattacaggaaatcgcagctttggcagtcaactttccaaccaaaccatgatacagaagacctcgtgcaccaagtccaccaactagccaaaatgtgcagttgctcttattgcctagtaaatcatccaaacaacccaaaagtggcaatgacccatttgttgtaagtggaggcatggctcgtattccagctcttgcgcgtacaaaatcccatttactaattcttggatatacgccagaagctttagggagcaactcttcgattgcagtaagagattcttcatcggaaacagttgaagaatcgttctcagaaatccattgccaagttgatccgatagaaacagttcggggaccttggaatgctagccatgcatcagataagattgaagcactttgactgtcatattcttctactgtagtggatggcaactgaaattcagcgataactcctctgcaggtcctaagaggcaacttatttgcaagttcaggaagtgagcaagccttggccccaaggcagatgatcaccgaatcataattgcctgccaaaaggtgtagattatcaacatgttgcttgtaaagcttgatttctttctgctcacttggtaatgaggaggcttcatctgccagattttggcatgcagagaacagtgcctgcagatatttcttagggttgatgttcagtgccagtggcatgtaaacttagcatatctgcataatctcaatccagcagtacctccagcaatatggctgcagctttctcagttgtaggcggtcgtacaatcccccttctccagataaggttatcatcttgactagttgtatttgataccgaggttccatttgcttgctcggcgctgcgaaggagatccatgctttctttccagaactcagcacccctccagagaagcttcactttaggcgagtagggatggagaagtccacccgagacgcccgacgcgcctccgccgaccccgttctcgtcgtagatgtccactgacacgcgggaatccctcgggctatgcttgaggaggtgccacgcgacggagagacccgcaaagccggcgccgaggacggcgtagcgcaaagggcggcggccgtgccctcctgccggcgagggcgaggccgcggtggccgcggcggcggatgcgacagttcgcctggagtagagggtgagattggggacaatatgggaaggagcaaaag

SEQ ID NO: 20924 - DNA, 1178 bp, Zea mays
tgccacttttgttgtaagtggaggcatggctcgtattccagctcttgcgcgtacaaaatcccatttactaattcttggatatacgccagaagctttagggagcaactcttcgattgcagtaagagattcttcatcggaaacagttgaagaatcgttctcagaaatccattgccaagttgatccgatagaaacagttcggggaccttggaatgctagccatgcatcagataagattgaagcactttgactgtcatattcttctctgcagaaagtatacgcaatatccatcaaccagaatcgccaaacaaatggctagcatcagataagattgaagcactttgactgtcatattcttctactgtagtggatggcaactgaaattcagcgataactcctctgcaggtcctaagaggcaacttatttgcaagttcaggaagtgagcaagccttggccccaaggcagatgatcaccgaatcataattgcctgccaaaaggtgtagattatcaacatgttgcttgtaaagcttgatttctttctgctcacttggtaatgaggaggcttcatctgccagattttggcatgcagagaacagtgcctgcagatatttcttagggttgatgttcagtgccagtggcatgtaaactgcgaagtcaaatggagtacacagcccagggattagacgctgtgcagcatcagaatcaagcagttgaaggctgcaactctcgaggcatttctgaacattctccagcaatatggctgcagctttctcagttgtaggcggtcgtacaatcccccgaggttccatttgcttgctcggcgctgcgaaggagatccatgctttctttccagaactcagcacccctccagagaagcttcactttaggcgagtagggatggagaagtccacccgagacgcccgacgcgcctccgccgaccccgttctcgtcgtagatgtccactgacacgcgggaatccctcgggctatgcttgaggaggtccctcgcgccggagtgacccgcaaagccggcgccgaggacggcgtagcgcaaagggcggcggccgtgccctcctgccggcgagggcgaggccgcggtggccgcggcgggatgcgacagttcgcctggagtagagggtgagattggggacaatatgggaaggagcaaaagaaggcggcgac

SEQ ID NO: 20925 - DNA, 1532 bp, Zea mays
agccactaaaacgcttcacaccgacacacggcccccatccttgccacattttttttcattgttacaagataaccaacccagatcagcgtcgactcatttcgggagcaagcaacattgcagcgttcgaataacagatgtttttaaaccccccacgatatgcagtgttctgtgtttaaggacatggaaaacaaatgggtgaataaaacatggattgctatgacgtgcatggtctgaccccgtaaaaatttgaaatctaacttcatgccaaatcgcctctttagattctttagatcccaaaaccgaacactccgcgtatccgctggaatatgagttctctccagcctctctcggtgttctctaccacagttgaatttccatacttgtcttcctctggcacatcagtttgtttgagctttatgattgtaactccagactcgggctcatcaaacaccaaccggaccgaggagtacaagccgtcaggccagcttccaaaccgccacttttgtgcaatcagcttcccttcctgcagctcctcgttgacgccagtgatggacccgtcgaagaggctaaattcccctccaacctctctgctgatcctcgcattgctctgcgtaaaccctttccatctgttctcatccatcaagatctcatatatgtcctttgagcggcagtagaacttctccgtcatctcaatggtcttgaagccctccttgtccttccccttggcctttttcttctccacagccggcgcaggagccagtaccgcctccttcgccggtgcggagccggcgaccttcgtgggagttttcttggagtccagctcgtccttggccggtccacccttggccatggcagcgacgaactcccggatcttctcgagcaccatgggtttcccgcgggagaggaaggcgtccttggcgcggagcgcgaggggcgtctcgtcgccgcgcacggtgacgcggaggtcggggtcctcgtcggcgttctcgtcggcgaggtagggaacctcagcggtgccggtgaccttcgcagctccggactccgaggcggcctcggcctcccaggagagggtgagcgagagctcgtaccccgggatgaccttgcccttgcggatgttgacgtaggcctcgccatcaagcttgtcgagcgcgacggtgcggagactgaggccgccctcgccgtcgaggatggtgaggcccgcgagcagggaagagagccgcgcgcgggaccactccaggcagtcgcgctccgcccagtgccagttgtggacgttggtgccgtcggcgcgctcctccacgatccaccgcttgtcgccctcgccgtacttcgccataggtgcgcggtggtgtttgggggggaggggaggcgagcttagggtttggaagggctcgggttcgtttggatctgcgcgtggtttcgtgatgttgggtgtgtggaatggatgaccagagacgagagttttttaagagcaggaggcggctgcttctggatggttcttttcgattaggatgttctaggtaatggtctcgtgc

SEQ ID NO: 20926 - DNA, 380 bp, Zea mays
aatttccgcggcgagagttggatcagaaacaggcggcgagaaattgatttgtacagcggaggtcacttgtgcattcgatgcaccccttaagttttgtgggagcagtgagattcagaatactagatgaatattactatcattttacagattttctttcattttgttcgtgtcttctttgaaccaaacactacctacagcaacagcgcagtcggccccgttctgtctcgcttcgctactgaaccgaacacaacgtatcaatcaccgtagtggcggcagggagaacgcgctcaccgtggagctcccgctcctgatctccctgagcgccctgagcgcggccaccgtactcttcatgtacatgctctccatgtcctcgatctcct

SEQ ID NO: 20927 - DNA, 2469 bp, Zea mays
gcaaggcaattttcgcggcgggagttggatcagaaacaggcagcgagaaattgatttgtacagcggaggtcacttgtgcattcgatgcaccccttaagttttgtgggagcagtgagattcattttttttttttttttgggaatactagatgaatattactatcattttacagattttctttcattttgttcgtgtcttctttgaaccaaacactacctacagcaacagcgcagtcggccccgttctgtctcgcttcgctactgaaccgaacacaacgtgtcaatcaccgtagtggcggcagggagaacgcgctcaccgtggagctcccgctcctgatctccctgagcgccctgagcgcggccaccgtactcttcatgtacatgctctccatgtcctcgatctcctccagctccatgtcgccagcgccaccgccgccgccgctgggcagcgatgaggcgcctggctccgccggtcgttgcttgtcgtcgtcgccgtcgctgtctccttccccgccgttgtcgctcggcacgggccgctgctggttccggggcaggaggagctggtccagcatctcctcgcaccccttgacgagcttgtacagcacgtcggtggcgcagaacggctcctgcatcacgttccggatgaagggcaggcggatcagcgcgccggtcctcttgtcgtactccttgaggatcttgaccagccctggttaacccagagcatccattgctctctgtcagtacgtttagaatgaatcttgaaatctaacgctgcacgattgtttttcccctctctttctttttgaaataaaaataaaaactctctcatccctagtgagatgcgtctcaccggtgtagttgagcgcgctgtagttctccagcaagaccatctcgccgtggaagtcgacgatctccttgcgcacccgcagcagctcctccgccgaccccacctccgcggcgctcaccaccctgtcctgcaactcctgcgcccgctcaattccgacgaccgagacacgaatcagaccactattctattcgcgccgccgcgagggagcggacaacacgagggggggatggaatcggatcacgacaggaatgggtatggtcaatcaattaccttcagccggatgacgtagtcctcctccttctcgaggaagaaggcgttgaacttgtcgagctcggcgtcgaggagcgcgacgaatccggcctcctccggggtcatcgcaggcggcgaggatccgccgcgcccgtcccccacccgctggcgcttgctccgccgctcgccagagccggcgccgatctgcttcagccgcttcttgaggtccttgtaggacaggaacttgtcgcgccagtccgggagcgtctccacgatctggttgttgaggctcttgccgaacttcattgttgcgattggatcggagcgtggagaatttcgtggcgggatgggatggaacttgggagctagtgcgggagaggaggggacggataaataggggacggatgcagaggacgacgacgagcaacgggtggtgctggtgatgcgaagccacaggaatattccgggcgccgacgtctcgcgccgtggtggcggttttattcgtgagtttgtgacgcgtcattttggatgagtcgtgtaatcgtgtttaggcgagggaggaaaaatggtaagggcacccaggagtggacaaatgggcagcctagctcattggatcatgatgcgtgattccttttgtaaatatagtttgttacagatatttttttaattttttttgcgtgccaatgttttgcttgttttagctcaccaaaacatgctatcaactgctagatgtcaaggcagggccgttccttcctggagggggcgagggtggcggccatcctagagtcgagaacatattactatacacaatatgtatttaggccttgtttgggaggattccgtttcaagaattgcagctttaggtttccagcttcaccatgatatagctttgatagattggtaagacatcgttcaaaaatgtttagcttacacatagactctagattctgtaatacaattaatttgtacgaatttccttaattatccataacgattagcgggtggagaaagagacatgaaatgataggtcatgtaatcaatgtcatgatagataatttttgtgcatctaaaaatgttagaaaacaattttaaggtgatttctacaatatatttgagataataatctctcttctatttaccgctcaatttttttctatgatacatcggacaattttaattagttattttataataggggaaaaaaatcttatagtattaaggcctctatttattatctcgtcccgggtctcttaaaactcaagaacggccatgcaaacaagacagagcccttttttttaatccaacgctagcacggaaataaacaaacatttattttattctagaaaatagaagaatcaaaagtatccatcgatg

SEQ ID NO: 20928 - DNA, 1129 bp, Zea mays
ttttgtcttaaaaggatcttacaaaaggatgttcagcacagacaagatatacacagaaatgggattacgtggtgaatattactatcattttacagattttctttcattttgttcgtgtcttctttgaaccaaacactacctacagcaacagcgcagtcggccccgttctgtctcgcttcgctactgaaccgaacacaacgtgtcaatcaccgtagtggcggcagggagaacgcgctcaccgtggagctcccgctcctgatctccctgagcgccctgagcgcggccaccgtactcttcatgtacatgctctccatgtcctcgatctcctccagctccatgtcgccagcgccaccgccgccgccgctgggcagcgatgaggcgcctggctccgccggtcgttgcttgtcgtcgtcgccgtcgctgtctccttccccgccgttgtcgctcggcacgggccgctgctggttccggggcaggaggagctggtccagcatctcctcgcaccccttgacgagcttgtacagcacgtcggtggcgcagaacggctcctgcatcacgttccggatgaagggcaggcggatcagcgcgccggtcctcttgtcgtacttcttgaggatcttgaccagcccggtgtagttgagcgcgctgtagttctccagcaagaccatctcgccgtggaagtcgacgatctccttgcgcacccgcagcagctcctccgccgaccccacctccgcggcgctcaccaccctgtcctgcaactccttcagccggatgacgtagtcctcctccttctcgaggaagaaggcgttgaacttgtcgagctcggcgtcgaggagcgcgacgaatccggcctcctccggggtcatcgcaggcggcgaggatccgccgcgcccgtcccccacccgctggcgcttgctccgccgctcgccagagccggcgccgatctgcttcagccgcttcttgaggtccttgtaggacaggaacttgtcgcgccagtccgggagcgtctccacgatctggttgttgaggctcttgccgaacttcattgttgcgattggatcggagcgtggagaatttcgtggcgggatgggatggaacttccccccggccggcctcgaggtacccaatg

SEQ ID NO: 20929 - DNA, 1932 bp, Zea mays
  misc_feature (1853)..(1853): n is a, c, g, or t
agatggcgatgtctgaatggttcatttagcgaagacttggaattcaacagccaagggctgtactgtacggattctctggaagtatccagctggtagcaagttcaaacaaaaataaaaggtggagtcaggcgaagacaaaagcagtcccaaaggccctgaggagcctaccccgcagcaaactgcaaatcatcttctgcatgtcctctctgagatcgatacttgaaggtttgcgcgtctgtgttacctagagggtttctctagacaaagttcttttaggccgtgtttggaacacatgaatttcaaggggttcgcatataaatttcacagaaatcagctcagatttatttgtgcatgaaaaacgcaggaacagagggggggaaatcgtgttccagacaggccctcagtgggtactatatatagctcgctgtcgaacgggcgggcggcttttgtagtcttcataatagtcttgtttgacgaggaagcttccaggtatctattttccagagattattctgtgtcacattgtccatcttctcctgcattggtctttgtttttcttggaatatatcaaactagatgaatacccgtgtgttgctgagtgctgacgcactttcaccccccttgagttggaggagacgtctatactagctctgcataccaacagacaacaaaaaatggagttgaagaatggccgccactctgtttggtggatagcaagaagattctcaaccaatgcaaccaagctctaaaatttctggaccgtgactcaagtcactgggtcattcaaaccatgacaaaatcagctggaaccagagccgggttctcctgatgcagagcatagatcttgtcggtcattccctccttgcgataagcctccaccaagatagagtacgtcgaagcatcaggctcgcactgcgtatgcttcatgcgcctgaacaccctctccatctccacgagatcgtccgctctagcgcacgcgccaagaacagcattgtggaaaggcgtgttcacgggcacgtcgagcctctcggcgagcttcaccatgcccaccaccttatggaactggcctgccctgctgaacccgtcgatcaggcagcagaaggtcttagtgtccggcctcatgccctcggaacgcatctggttgaacgcgtgctccatgttcccggcgtcgccggcctcagcaaatgcttcgatcacgttgttgtacgtcgcggtcgtccacgggaacgcgagcttgcgcatgtgctccatgactgcggacatcttgtcatacatccgccgcttcccgtaggcgccaatcaggatgttcagcgtgcgggtctccggctcgaccccgtagcctcggaacttctcgtaccatctctccatcagttcaacctcgccccggttcccgaagaggctgaggatgatgttcatggtccaaacgtccggtttgcatgacacgctgtcgagcatgtcggagagcactcgctccatgtcgtccaaccgcccggccttcccgtagccgctgaggacgatgttctgtgtgaccgtgttgggtgatatggagcgctccgccatgtctttgtacatggcgtcggtgaggtcgaacctggcagcgtcgacgcaggccttgatgatggtgctgtaggtgtagacgtcaggctggcataaaggggagctcttcatgtcgttgaggagctggagtgcctcgtccagtaggccgcttcggcagtaggccccgatcaaggcggtgtagagctcgggggtgggctggcatccttgctgcaacatctcgtcgaagagttggtgtgcccgggtcggctgccctgaccggcccagcagcacgatgagcttcatgtaggtgccctctntgggatggtagaacggctgctccttgagcatctcaaagacctgacgccaccgattcgctatcagcgtcagtaacaacat

SEQ ID NO: 20930 - DNA, 1054 bp, Zea mays
gtaccggccccccctccggttttttttttttttttttttttttttttttttttttgttacctagagggtttctctagaaagttcttttaggccgtgtttggaacacatgaatttcaaggggttcgcatataaaattcacggaaatcagctcagatttatttgtgcatgaaaaacgcaggaacagaggggaaaaatcgtgttccagacaggccctcagtgggtactataggaagcttccgtcactttatagctcgctgtcgaacgggcgggcggcttttgtagtcttcataatagtcttgtttgacgaggatgcttccaggtatctattttccagagattattctgtgtcacattgtccatcttctcatgcattggtctttgtttttcttggaatatatcaaactagatcaatacccgtacgttgctgacagcactttcaccacccttgagttggaggagacgtctatactagctctgcataccaacagacaacaaaaaatggagttgaagaatggccgccgctctgtttggtggatagctagaagattctcaaccaatgcaaccaagctctaaaatttcaggaccgtgactcagtcactgggtcattcaaaccatgacaaaatcagctggaaccagagccgggttctcctgatgcagagcatagatcttgtcggtcattccctccttgcgataagcctccaccaagatagagtacgtcgaagcatcaggctcgcactgcgtatgcttcatgcgcctgaacaccctctccatctccacgagatcgtccgctctagcgcacgcgccaagaacagcgttgtggaaaggcgtgtccacgggcacgtcgagcccctcggcgagcttcaccatgcccaccaccttatggaactggcctgccctgctgaacccgtcgatcaggcagcagaaggtcttagtgtccggcctcatgccctcggaacgcatctggttgaacgcgtgctccatgttcccggcgtcgccggcctcagcaaatcgagtttttttttttttttttttttcaaggtaattaacaaggccg

SEQ ID NO: 20931 - DNA, 1046 bp, Zea mays
aaactcgggacatcttcaatgtaacatcactcgagaaatgatcgtgtgaaacagattctgatttaagccccgttcggttaggctggaacaagactaggaactattccaggttactaattgttatacaaattatacaattattccagctgaaatcctttctggagtagattcctgaataaccgaacgggcccttagccagaacaattacaagcgttttggagtcttgtccaacaacagaaatgtaaagacacagtcacacaacagcagaataaaaacgaagtgctacatcacagctcctagcagccccgatgacaattgtggaacaattacactggcatctcaaatgcttgaaggttgcaatgcttaaaatgttggataacatgtagcttctcaaaacttgatttccggaaaattccacgaattcaatacaagctaccctatgccttcaactgaccgatgcagaaatcctcgatgatatcgaagaccctagtgccgtgctgtggcccaaaaaagccctctgtggaatcaccaccagcattatttagaatggcatctccgcctggatgctcctctacataaggagtgacatcatagaccttgtccttgatgacgatccaacagtccttccttgtgttatgtttagagatctcttccttcgtaaagctcctagatgtcattccagctcctaagtcggttccttttgatttacctttattttgcgattttgggatcgcaaagagagctcctagtgccaaaagaatgacaagtgagataatgataataatctccattttgctcctctagaattacagaactttgcagccacataaaaagttctgtacagtagtagtagaagaagaagccaatccgggtgcaaatgaggtggggatgtagggatatcgctccgacgcaggacggcggcgggagagcggtgtgcgcctgatggccgggagtgagcttgtttggttgaacgaccgaggcgaatttgcatccggacgtgaaagttaaccggggccggaccgatctatcggtcgtccgaatcgatc

SEQ ID NO: 20932 - DNA, 928 bp, Zea mays
gtttttttcttttctttcgggaaaaaaacgtttcagtcttgtccaacaacagaaatgtgcaagcacaacaaccagtggtcgaactgatgctcacattgcccccagcagagaaaaaaaaacgagctcctacatcacagctcagggcaggcctaataacagttgtggaacaattatactggcattcatatgctcatggtcgcaatgctcaaacatagataaaatgtagcttctcacaaatttatgtcccgtaataaattcaatacaaactatcctgtcatcatcatgaagccttcaactgaccgatgcagaaatcctcgatgatatcgaagaccctagtgccatgctgtggcccaaaaaagccctccgtggaatcacccccagcattatttagaatggcatctccgcctggatgttcctctacataaggagtgacatcatagaccttgtccttgataatgatccaacagtcctcccttgtggaatgtttagagatctcttctgtcgtaaagctcctagatgtcgttccagctcctaagtcgtttctctttgatttacctttattttgtgactttgggatcacaaagagagctcctagtgccaaaagaatgacaagtgagatgatgataataatatccatcttgctcctctagaattacagaactttgcagccacacaaaagaagtgctgtacagtagtagaagaagaagccaatccgggtgcaaaatgggatggggatgtatggatctcgctcaaacgcacgagggcggcggcgcgagagcgggagggagaagtgcgcctatgaaggtcgaaagggacagacggcaggccgagtgcctgcgtcgtgtgcagtttcgtgtggatccgcggactggctctacgcgaaccgttggcacccgctgcccatgtcgtagacaattttcgttttttt

SEQ ID NO: 20933 - DNA, 684 bp, Zea mays
ggccctaggggccttttttttttttttttttccgttcgaatcatgcctcaatacttacaaggatggacaacaagtatcttaactacagttcaacgcagtcgcaaatgagattgctttcttcgatgcaacagtaggggctgctgctgcagggaaagcaaatgagcagtaggcttggtttgaacacgagatgacaagcagcacaaaaggtgagctcaaaataacgagctgctactagcaggcagtaacggtcctccagggtcctcgatgatgaataggaaatgctctgatcaggggttgttttcctttcaccacagcatttagagagccaacggcactggttctatttgaactggctcctagaagtccctccagttgctttcggtgcggtctctctgaatctgctcccattcaaacgtccgactgcagctttcacgggtttatatgcaaatgtgcttagatcaggagggttgcctgcatgtttgctccgctcgggacagcagacagtagatgtgtatgcaagcaagcccagatcaggagggccatcaatagtgtctgtagttttacctgtggttttgccttgatcagaagcaacagttttcataggcctataagcaaatgcgctaatatcaggggggctggcagcacttcccttatcaaaaaaaaaaaaaaaaaaaaaagggcggc

SEQ ID NO: 20934 - DNA, 2065 bp, Zea mays
ctgcaggtgctgaaggattctgtgaaacccaaaccagaaaataatctgagatgtataacaggaagctaagcacagagaaaagcaggataaattccatgtatgggacagaaaaatatttactatgttcagatcacttgaaattttcacttgaaagagtatgggacagtaagtccaagcagtttgtttggaccatacggataacagccatcatatagttcaatgataataataaagaataaaaaggttgagaccttgtagaggagacagatatgcaaaaggcaaaactatgagcatctctaggagtttggtataatttacttgctaaactaatagatctagaagttaacagaagaattggcaatcttaattttcgtcctcctccaacagtcaacagtcatagcttcctaaacaattttgcatcaggaaccctgaactattcgtaaccaacccgactttttaaatagtttatttgtctcttaccgctttctcatctggaatccttttttttaatttaattatgcatccaatttaatttggatacagagttcctgtcgaccgtggaatcttagggtgtgtttggttgcgggacagctaggacagagacgtcccctggcgtcctctctcgtccctccaattttaagggacaacaggagacaacactggatagtactgtctcaacccttgacccagaaccaaacaacataatttaagggatcgtcccatctcatcccgtcctgtcattgcaaccaaacgcatcctaatatatgtgcaaccaaatgaaaccaaacagctaatatcacctgtctctcctcatcagcttacagttttgatatgaattaatttgaattggtcggtgcctcatctctgtccaacgaggagtcatttgcatttggcatcgcagatttttttagcatatgtagtacaacaggagccatgcattctgtttcttttttctattaacactactacacaaatcatcgggccttatttactgtgaaattcttcggacaaaccagaatgtgtacgaaacaaataggcatacatcgtggccttctatgtcatgctacatacaacatgattccaagataaccaaatcaatttgaatatcaatatggttgctgcctccgtttcagtatggggacgcaggcgcatccggctgtttttcaggaaccgcgacttgaaatgctgggatctccatataggctttgtagaacctctccagaagagggtactttgacatatcaattccgaagcgcgtcacgcctgcatacatctggggcgcaagaaacacatctgccagttggacttcgtctccagtagcatatttactgtcacaaccttccagaagtttttcgattgctttaaatcccttgtcggtgtaattccgaacaatctgaaggctctggttagagcctaaggtgccatcaagcagaccaattacagcataacattgaagaggttgaatgcttgaacaaactatatttgcaatctgcagatttatagctttctttttgagatcttgaggcaaaagagggtgttgaggatatttatcttcaagatacaatatgattgccagggagtcagaaacaacaaaatccccatcaaccaatgctggaacatacttgattggattgatcttttcgtaatctagatcgttccttgtcacagccctgtactcataatccacacctttgaggttgagggcgatccggactcggaaggagcaggagctgatccacgcgctatacaagatgggcttcgaagccgccatggccgcaacgcctcctgcaaaacggccggcagaagcggggttgtttgttcgggaccggataagaacacgacagtgctcgattttgacgaaatgacgtagggaacgactttgacactttggagacgttgacaacggccaaatgccgcaaacgtcggtatggacatgatctacccattagccgctggggacactttggagatggtacttttttcgattaggatgttctaggtaatggtctcgtgccgctctcctccttcctgatttctccccctccgtagaaaccctaggtggcgc

SEQ ID NO: 20935 - DNA, 999 bp, Zea mays
ctcgaggccggccgggaccaagttgggcttttattggacggagattgtttggcccagtgactctacccacctccagtttccacttagaaaagaataatttctcccgaaaaagggtgaagagcagaacgacgaggagattgcttggtgggaggagttggtgaggagaggtcgcgaacatggagaaccttgctctgctttggggcatcatcggcccgggcgtgtccggcgccatcttcggggccggatggtggttctgggtggacgcggtcgtttgcagcgcggtccaggtctccttcctccactaccttccagggatcttcgcttcgctggcggcgctcatgttcaattgcgtgaacaaggatgagatcggatacgactattactcaccctacggggacgattcagagtggagagtgaagctctggctttttgtggcatatgtcgtttcttttgtctgtttagctggatccgtgggtttattggtgcaagatgcgctgacgaacaagggcccttctgtctggactggtgttgctggcgttctgcaatgtgttcttgtgttgataagcggcctggtgtattggacatgccactcagaagattaagggcgtaatgtcatgagcagacttgcaaggttggtcacagttgtgtgaaggaaattatttctggcaacatatgattttgtgtgatggaaatgacggacactgttcactgctgaatgggatgactagatgtttcatctgtgcatatctgacttttggaaaatgatgtttcttaacaccggtgcatgtgttagccccagcttcttgtgagttgccaatctgtgatgcggtcgtgatcatgcaaatcttttggctaaagctgaaaccggctgcagcaacaagctagtgctactatttacaccatgcctcctagtcaattacagttgacaaaaaaaaaaaaaaaaaaaaaaaaaaaaaaaaaaaaaaaaaaaaaaaaaaaaaaaccaaaaaaaaaaaaaaa

SEQ ID NO: 20936 - DNA, 6446 bp, Zea mays
cttactgtttatatgagtagtgatacacatatgcatatatatgtcgtcacatatatcactctggtttatgaattaaattaaaactgaaaataaatatttctctactctagtcagtgtagtagggccgcacgggacaaggaaaggaggtcgagattggttggcttgctccggcgtttggcctgtccggtggcggttatcatcaccgcatccacacagccggccacttctcagtctgacgacgaacctctctgctcctgcctgccatcacatctttgctcgtacgattttgctctcgtccttccagctcagcatcatccgcgcgcgcgcatgatgcttgcctgcctctctacgtcgtccgctcccctgtgacgacggcagcaatcaatcatgactccgctctcgcctccctccccgtcaccggcgcagaccatggacgaggacgacgaccacaactgcctctgcctgcgcccggcccacgccatccccatggcatggccccatgcatgtggtgggcgcttggtcaggcgttcggcgcgcgcgcatcagagtcgtcgtccgtccggacggggggcagaggaacaccacccaacaccaagcattgcttttttcctggcgcggaaaccggaaccggaagccctcgtctgcccctgtacggacgggtgacagctacggctggctgacgcgccatcatgctgccatggcatcagtgatcagacatgaaccaggaataatagtatgaacgatcaaagcttggtttggtcggcctcccatggagcaagcagctagcaccccatggtttcaagaccaaacacccaacccaacccaatgccggtactgcccaacagttcagcactgcctcctactgctactgcctgccggcggattgcattgcaagcctccgaactgcccgtccgtcgacactgccttggattggatccccgcgtcaacgctgagcgggagcgttttgggtttcgaacacacgccaactcccaacaggaagaaccccatgtgccgcactgatcccgccatttgcacccctctcgaagtactttttttttttttgcagatcctgaggcatcgtcagtgagtagtactagcacagcactgctgctgctgctgcttttgggcatggcattggcgccccatgaaccaggacccggtgaagtgagggcgaaggaagcgttccacccgggcggcagggacggacgacaccaagtgcgccccgctttggcagtgggttcgcgcgctcccacgtggtggtcgcctcgccggccggtaccggtaccgggacgacggtgcttggccggcgggccttctttttcttcttccttttcttctcgatgatgaggtggccgccacttagccaaaactagggcctacactacacgcactgctctggaggaacagcgactgtgcgcacagaaatcgcaggagggggccattgttcagatcaaattattccctctctctctctctctccttcgctactttttctttgtctttgcaaagacttttttttctctcggttgccttttgtcatctgcttttgggaagatcattaggcgtcgttgctgaaactgaatgaatgggtggtgagcgtgagaaggggtgttttgttttgcaattttttgtcgtctgcacattgattggttcggttcctgatcccaacctaaagcatccaatcactcttcatcacctaacagcggtcatcaaagttccttcttctgaagaacgctccactcgctttcacttaacactggacgacggaagcatatcggcggctgctgtcgacgttattaggcagagggcaaagcatctggctaccgagagtcgtctctttcatgcgctcctgtctcgtcctttgacattctgggcccaggccgtctgctttgaagagagagaataccagatcagcttcttttatacgacgacaaacaaacaaaaaaaaagtgagagaaagcagcaataagatgctctccggtagggtgtaccaatcaatcaattcaccttgcaagcaggctttctctttgggaccaaccaatacagcctaaggtctggtgatttcgaggcctttagctatgggcctatggcccactcccaccgtttacacagaagtagaaagcactttaaggtttttggttccgccgcgacttttttttttttttttttgacaagagagagtgcactagtattagagaagggaaatcaaaggctctagcaacgtggctcactcaaactcaactcgctacagactcctaccacaccgcaccagcaaatgaaacatgacagaccggacacaaccaaccaacaaacaaactcggatatgtacagcacaggaggccaaataaacttattgcaaacctaaaattacgacctaagcttgctacactgaagcggggatttttgcgaggaacggtaacgttttcgattccggttactcagatgctgatgagatctggaggcggtggcgacgacggagagcttgtctgctgctggtggtctctcgcttcgacggctggtgcttcgttggtcccaactggtgctgagtgtagagggctgggcgcagagccgtcgccggaattcggaacctcctctccttgcttggtagaattctcctctccctgcttggtagatggcggttttggaagctcgctcaggatctgcaccacctccctcatcgtcgggcgctgcacgctttgctcctcggtgcacagcaacgcgacgtagaagacgtgcgtcacctcgtgcagcgggacggtcgagagccttgggtccaggaccttcatcacttgttccttgtttgagttcgtcgtcatcttcgcccactggacgatgtcgacgccgtcgccgaactcgcctacgggcttccttcctgtgacaagctccagaagcaccacgccgaagctgtagacatcactcttctcgtccaccttcaatgtgtatgcgtattctgggtagccacgggtggcatcgaagagcagaggttagtcaattggaaagaaaaaaagaatactagaatttagaagccaatagccagactgtgtaaaccaaaatcaatgtagatataaagcgagatacagcagtaagatacacataaaaacccattgaacattacaatcctgaaggtgtaaacagacattgtaaattttaaacataagatacaacaatgaagtaattggtctttcagtaaatgtcaaggagaactagcagagagaatattacaacagaaaccatgtagataagcaccaatactcatcaaaacagtataacaataaaggtttatagcttgagagacagttttatagcttgaacaatgtaataactataagcattctaaacttacggtgcatctccacagattcagatgagtacagtattcatattaagctggatcaggaagggtttgtttttacctggcgctatgtagccatatgagccagcgatggcagacatgcattcagatgcccccgagtcctgcaagaattttgctagcccaaagtcggccacatgagcttcaaagttggagtcaagaagtatattatttgacttgacatcccggtgaagtatcaaaggtgaacagtcatggtgcaagtagcaaagccccttggctgcctcaatagcaatgctgtatcgggtatcccagtgcaggtgccctcccttcttgccatggagcatctccccaaggctgccattgggcatatactcataaaccaacaggttagtctcattgtttgagcagaagcctagcaggcgcacaatatgacggtgtcgaattctaccgagtgtttgtatctctgccgagaacccatgatcatgtgatgagccacggcccattgctgggagtctcttcacagccacaagttcaccattcggcatcgcccccttatacacaatcccagcaccacctttgccaataatgtgctcctctttcaagcaatccagcacatcatcgctggtgaagtctaggcgctggaatgcagtgagtttccatactcgagcttcactagctttcttcaatgaccgagccttcagaatcgccgccacagcgaatgcaatggagcagatcaacaagccaaggacaatgagcagcttgaccgtattggtcaaccagccatggccatggacagtgtggtcggcgccacctatgcctgcaccacatggaccgaggtatggtccacacaggcctggattgccaacaaaagatgtggcattgaagtagctgaactggccagtccctggcacaagcccagacaagttgttatacgagaagtccaccgccgtcaagctctgcatggttgcaatggatggaggtatctctccatcaagatggttcctggacaggttgaggtagttcagtattcgcattccagagatggccggaggtatcttcccagagaggttgttttggctcatgtccaagtaagtgagaagccggcatttcccgacctccggtggcacacctccctcaaacttgttgctgctaaggtcagccttggagagctgctgcagccgcccaatctccggaggtatggcaccagagaacgcgttctgatcaagcagcaacttctgaacaccagagaagttcccaagagatgcaggcaatgcacccgtaagctggttgttggacaggctaatctcaccaaggttaggagccgcagcaccgatcacagccgggaaattgccagtgaggaggttatcttgcaactcaacttgagtcagcttcggcaattcgaatagacccttcggaattgagccattcaggtagttctccccgagacggacacggctcaaggacttgcactggccgagtgagtctgggatggcaccgaacaagaagttgccgagggcgattagcgtctgcagcttgccccccgcacagagctccggcggaagcgtgccggtgagcttgttcgacgagaggtcgagcagctggaggcggccgttgcggccgaggcggcgtggcacaccgccggtgaagttattctcccacagctgcagcacctcgaggctgggcaggtcgccgacgaagccggggatgtcgccgcgcaacttgttccggaacaggttaagcagcgtcaggttcttgagctcggagaaactcgcaggtatctcaccggtgagcgcattgttcgacaggtccaaagaactgaggctcctgaggtagcccagctccgacggtatgctgccggtgaggccattcacctgcaagaagagcgtgtccagattctgcagcctcccgagctccggcgggatttcgccggagagcccacagttggcggcgtcgaggcggacgagctcggtcaggttccccagctccggcggaaggccaccggtgtaactgttgtagtagccaatgtagagctccctgaggctggtgaggttccccagctcgggcggtatcttgccggagagctcgttcccggagccgcaaggtactgcagcctaggccaccggccgtactccggcggtatctccccggagaagaagttgccgccgaggtgcaggtggcggagcatgggcatgtgcgtgacctcgagcggcagcgtggcgctggtgaggttgttgttgtagaggtcgagcacccggagggcgcggagccgcgcgagcgcaggcgggaaggagccgttgaaggcgttgttggagaggttgaggtggacgaggagctgcaggcgcgcgagggacggcgggatgggcccgtagaagccgttggcgccgacggagaggcgctgcaggccgcggagccgcgacagcgccggcgggagcgcgccggacaggttgagcccggagacgtcgagcccgacgacgacgcctccgccggagccgcggggcgcgcaggggtcccctgcccacgcgcagtggtcggaggaggcggcgtcccaggacgcgagcgcgccggtggggtcggagaccgccgccttcacggcgagcagcgcgtccgcgtccgtgccgccggccgccgcgcccacggcgagggccaggagcaggagcaggagcatcgggaggaagcgcattgggcttctcttttctcgggcgcggcggcggggtggattggagagggagaaaagagggcgagaggcggttcggctcacactctcggcgaggagagtgcggacaagtgcgtggcgtggcgagggccgaggggttgtgcagttgtgcttggtgtgggtttgaacgctcgataaactataggatatcaatcaaaaaaagttgattttcttttgttcttttgggatgttgcgtgggtttcccttaggggattgagctgtttttataacgtgatattggggcctttcggtatggattagaggtgttaatggaagctgatatccgttaactcacaggtgattactgtattaaaattaaattattgaaagattttgcatatatctgggaaaaatcatttacttgttgagtttgatgagtttagatatgaggaggaatataaa

SEQ ID NO: 20937 - DNA, 1261 bp, Zea mays
caccttgcaagcaggcttttctctttgggaccaaccaatacagcctaagatctggtgatttcgaggcctttagctatggcccactcccaccgtttacacagaagtagaaagcactttaaggtttttggttccacaacaaagattctggcgccaaatttgacaagagagagagtgcacttgatactttagtgcctactacaaacactagtattagagaagggaaatcaaaggctctagcaacgtggctcactcaaactcaactcgctacagactcctaccacaccgcaccagcaaatgaaacatgacagactggaaacaaccaaccagccaacaaacaaactcggatatgtacagcacaggaggccaaacaaacttaattattgcaaacctaaaattacgacctaagcttgctacactgaagcggggatttttgcgaggaacggtaacgttttcgattccggttactcagatgctgatgagatctggaggcggtggcgacgacggagagcttgtctgctgctgctgcggcggctgctggtggtctctcgtttcgacggctagtgcttcgttggtcccaactggtgctgagtgtagagggctgggcgcagagccgtcgccggaattcggaacctcctctccttgcttggtagaattctcctctccctgcttggtagatggcggttttggaagctcgctcaggatctgcaccacctccctcatcgtcgggcgctgcacgctttgctcctcggtgcagagcaacgcgacgtagaagacgtgcgtcacctcgtgcagcgggacggtcgagagccttgggtccaggaccttcatcacctgttccttgtttgagttcgtcgtcatcttcgcccactggacgatgtcgacgccgtcgccgaactcgcctacgggcttccttccggtgacaagctccagaagcaccacgccgaagctgtagacatcactcttctcgtccaccttcaatgtgtatgcgtattctggcgctatgtagccatatgagccagcgatggcagacatgcattcagatgcccccgagtcctgcaagaattttgctagcccaaagtcggccacatgagcttcaaagttggagtcaagaagtatattatttgacttgacatcccggtgaagtatcaaaggtgaacagtcatggtgcaagtagcaaagccccttggctgcctcaatagcaatgctgtatcgggtatcccagtggaggtgccctcccttcttgccatatctcgagccgaat

SEQ ID NO: 20938 - DNA, 1049 bp, Zea mays
  misc_feature (874)..(874): n is a, c, g, or t
attgggtacctcgaggccggccgggacgcggcacggtccgcgtcagcgtccgacctccagcggtccgtgtttccccgaacaagagcgaacaacagtttggcggcggctgatggcaccaagcgcagccgccggaccgccgtccctggcccggccatcgtcatcgagtagcagccacctgcggcgcgccggcagtgccctccagcccgtctccgtcccgcgcgccttggtgctggggcggaggcgcctcacgggcgccgtccgagccgcgccggacgcgccgccggtggtcagggcggccgtcagcgccgtcaccgagctcctcagagccctctccccgaacaaggcgctcaggggcgctgctactacgcagcagcagcagcagggcgaggagccggatccggacccgacctgcggcagcgtcgaggacgtgctcgccgtgctccgagacgattaccggcgcgcctacttcctcaccggggatttcactccgggaatatacaccgaagactgcttgttcgaggacccgacgatcaagttccgcggactctccaggtactcccagaacctgggtctgctggtgcccttcttcgacagcccttcgctcgagctagagaacattgagaagggttcgagggccgaaacgaagttcgtcaaggcgacatggaaactaaggttcatcttcaagctccaaaaggcacacgacgtatctgaggcttccatggaggccgctggtcgcgatcggagggagcacgacgtatgatctggatggagatttcaaggttactcggcactccgagagctgggacgtctctgcgcttcaggccatcgctcagatcttcgtctcggccccggaggagaagctggaaggcagctngaggctgaggcagagcatgcaatgtacagcgccacgcagacgcaggatcagtgatctgaatccgtgatgagcaggtgtccaaagccgtctgtcagagctccgctggtcttctctgtgcaaacaaactgtaccctctctgttccaggttataaacattcgaataattttgctactt

SEQ ID NO: 20939 - DNA, 4774 bp, Zea mays
  misc_feature (2923)..(2923): n is a, c, g, or t
gcctgcagagctgcgctgactcctggagatccatacatgccattgccaaacgaggagatcattagtaaggttcaaaagcaggtaggtttgtaaatagcttctgtttcggtcaaatttctgctgttccctttacacatagctgagcaagaccccatttcaatgcacttaaaaagagagagatttcttctgcttatgttattttgtattcttccaaagctcacctcagtaataaacacatgtaattttcccacaggttgtagaactgttcccatcttcccggggcttggaagttacatggtccagtgtggtaaagatcggacaatcgctgtaccgtgaggctcctggaaacgacccattcaggcctgatcagaagacgcccgttaaaaacttcttcctctctggatcttacacgaaacaggtattgttgtacatcaaaaacatcgacctagctacagccatcaacaggcccagaaaactaatgtctgaatgccttgagtttgttttaaccaatggctcagaaaaccatcagaaacaaccatttcaatttcatttcaatttcatggcgtctgaacaccttggaatgttttttttcctcctatcttgcaacatgcaaacatcggtaggacatggtacattggtcttatttgtgctgtacacgaaacaggactacattgacagcatggaaggagcaactctctccggcaggcgaacgtcggcctacatctgcggtgccggggaggagctgctggccctccgaaagaagctactcatcgacgacggcgagaaggcgctggggaacgttcaagtcctgcaggctagctgaacaacccctcctgcactgcagagaagcttggatctttccaaccacacatacatgctggaatggacaaaccaaccaaccattggcttttctcgcttcagggtgctggcgattcccgcagcgacctcctgtgtatcgtatccaatttgagcattagatctgccccccctgcaggcgtttctttcctatccctgatccgagaagcagggtgtagtctaggtggctggcatacgggattacatcaggcagtgtgtaagttcagctggaactcgattggtaattgggatggatgattgatgatatatatatagcacacactgttcttgcgtcttgcaagaaaatatagcaagcgatgatccggcgacacttgctgggagactgtaccaacgatcttacttcattttggccattgtgttttttttttttttacaaaatagcagcatcctgtatcaactcgagctctcgtgctaaaccttttcgtttcatatgaaaaatatttcgttatcgttaggcttaggccatgcgcatttgagctatggtttatggaaagcttgccggccttgacgctggaaggagaaaccagtcagtctccggcgctgcccctcccgccgtggccggcgacgggtggaggcagtatgtggagcgagagacagtgggcagccggagccggcgtgtccctctgaaggcctcacgacctgccggcttgtgatggccacgagcgcgtgcgcgtgagcgtcagcgtccgacctccagtggtccgtgtttccccgagcaagagcgaacagcagtttggcggcggctgatggcaccaagcgcagccgccggaccgccgtccctggcccggccatcgacatcgagtagcagccacctgcggcgcgccggcagcgccctccagcccgtctccgtcccgcgcgccttggtgcaggggcggaggcgcctcacgggcgccgtccgagccgcgccggacgcgccgccggtggtcagggctgccgtcagcgccgtcaccgagctcctcagagccctctccccgaacaaggcgctcaggtaactaacccagcatctcacactcgtcaaccccatcagtcatccatccgctctggaatatggatccccgtggcgttctgtgctcttgcggtcggctgtgcaggggcgctgctacccagcagcagcagggcgaggagccggatccggacccgacctgcggcagcgtcgaggacgtgctcgccgtgctccgagacgattaccggcgcgcctacttcctcaccggtacgggctccttgcacctcgctgcgttcttgcgtcagtgatgttcgggtcacgctcgtggcgctggcgcttgctagacactgtggtggacaggtggagctactgcctaaacctgacaccggccgaaccgcgacggcgacgttgatgcatgcgcgcgcgcgcgcgcactcagcaatcagcatggcatggatcgttcaaaggacatttttttttaccaaggaaatggtgtgggattgcaggggatttcactccgggaatatacaccgaagactgcttgttcgaggacccgacgatcaagttccgcggtacgtaatttaaaacatctcttttgttgatgaacatttgttagcctgtactgtctgagagaagaagaagaaggaaaaaaaaaaaccgagctgtgacaatgagtgcgtgcgtgcgttcttgctcctcgcacaggactctccaggtactcccagaacctgggtctgctggtgcccttcttcgacagcccttcgctcgagctagagaacattgagaaggtaggaactagtcgaccggcggcgattcgttcgcagtgacatgacatcagtttctgactggaaaatgcgcgtccatatgaccatatcagggttcgagggccgaaacgaagttcgtcaaggcgacatggaaactaaggttcatcttcaagctccaaaaggcacacgtaatttttttttcttcctcctccctacactacacagcagtgtttctgaacggaacaggactgaccgtcgtttcaggacgtatctgaggcttccatggaggccgctggtcgcgatcggagggagcacgacgtatgatctggatggagatttnaaggtagccgtccgggaaatctccaaactgtgggagtttttttttgtatgtacgtttgatgcggatttgaaatgttcttatgtttggatcgatcgtgtttgttcaggttactcggcactccgagagctgggacgtctctgcgcttcaggccatcgctcagatcttcgtctcggccccggaggagaagctggaaggcagctgaggctgaggcagagcatgcaatgtacagcgccacgcagacgcaggatcagtgatctgaatccgtgatgagcaggtgtccaaagccgtctgtcagagctccgctggtcttctctgtgcaaacaaactgtaccctctctgttccaggttataaacattcgaataattttgctacttacctagatatatgttacgtatatagatatatagtaaagggcggttattatgacacaaatttgtagggtgtaggtacaggttttgaatttgacatttgatgaacactatataaaaaccgactctcctatattccaaacgaacatcctcttttgaatcagatagacccatcggacccatccttctcgccacgagccacactcttctgtgcttaccaaaatgggctggccggttcctggacctggcccgtcttgtgccgatcctcctgaagcttctccggcattttccgtccctaaaatcccctaacctacttgtactggaaactaccctattattactatattcttttcccatcatcaaatcacagtccaacattggtacatccaattatagataaaaaaaaggcggtactgcatggggcctgcggtatttattaattaaatgtgtatttgctgattttacatgagacgatatgtacaggctgcattacagagtgtttattcattgtctgacctcctccgctatttcttgctttattttgaagcagataagaagtatctcttttttaaacaatgtcagccacccttgtactgtagatggcacgtttttaaatattccattcatttctacacttccagatgcaccacatcatgaccatcactgtttccactttctattttttttgtcaagttattgtacagtggatcttatcatagtgtgaatgtccgatgctctcggcagtgtaaatctaattgtctgcagtctaccagcatcttcttgtgaagttgcacttgaggaagaggtggataattgtttcttctttttgcaagatataatttcacatgtgtacgagtccatctccataatttttcttctaagcattgcccttgtgttgagacgattgtgtagaagcaaccaaaacaacaccttctgcttgggttgacattttgatttccactgcaaggtgaacgttacggtgcaagtggtgcttttgttatatgtttgtaaactttctgagacgaatatcttggagtgtcccatatatttgaataggtaacccataaaattatgcataccataaatgtaaactttattatatgtgttgtttcggatcaaactgagtatgcaaagggagaagtccacttgccttgcttatagaagagtcgagattcttccatggaatagattctgattctcaactactggatcaatttctaaacatcacaaaaataaataggaagaaacaaacaccactcaataacatacaacattcaccatagattaaactaaaaagaaaatataacgaaaagagcatctgttgttcaaacatcacaaacaatgattataacaaaaaaggtgcgcttttgtaaaaaggtttggtttatattttataatactagacataaacatgaaaataccttagttagaaatatataaacatcaggtgaaccatattaatcttttataaaagcacatata

SEQ ID NO: 20940 - DNA, 2350 bp, Zea mays
ccctgccacgacgcccgcgacaaatccctgcgcgacggcatcttcgcctcccatcccctcccagcttcccctcccactccggccctcacacaaattgcccctctccttgtcctcctctttacacgctgccgaccacggctgccgccaaccacccgccccacccgtccaccgctgccgagtgctagccatttggagctgccgcgccatggcgtccgtggccgccaccaccacgctggcaccggcactcgcgccccggcgccgggcgcggccagggaccgggctgctgccgccgcgccgggcctcggccgtccgctgctcgctcgaccgtaacgtctccgacatgggcgtcaacgctcccaaagggttattcccacccgagccagagcactacaggggcccgaagctcaaggtggccatcataggggcaggccttgcgggcatgtccaccgctgttgagctcttggaccagggccatgaggttgatttgtacgagtcccgtccgtttatcggtggtaaggttggctcctttgttgacaggcaaggaaaccatatcgagatggggctgcatgtgttcttcgggtgctacagcaatctcttccgcctcatgaagaaggttggcgctgataataatctgctggtgaaggaacatacccatacttttgtaaataaagggggcacgattggtgaacttgattttcggttcccggtgggagctccgttacatggcattcaagcattcctaagaactaatcagctcaaggtttatgataaagcaagaaatgcagttgctcttgcccttagtccagttgttcgggctctggttgatcctgatggtgcattgcagcaagtgcgggacttggatgatgtaagtttcagtgattggttcatgtccaaagggggtactcgggagagtatcacaagaatgtgggatcctgttgcttacgctttgggtttcattgactgtgataatatcagtgcacgttgcatgcttactattttcaccttgtttgccacaaagacagaggcatccctgttacgcatgctaaagggttcacctgatgtttacttaagtggcccaataaagaagtatataacagacaggggtggtaggtttcacttaaggtggggatgcagagaggttctctatgagaaatcacctgatggagagacctatgttaaaggccttctcctcaccaaggctacaagtagagagataatcaaagctgatgcatacgtcgcagcctgtgatgttccgggtatcaaaagattacttccatcagaatggagggaatgggaaatgtttgacaatatctacaagttagatggtgtccctgttgtcactgtccagctccgctacaacggatgggtcactgaacttcaagatttggagaaatcaagacaactgcaaagggcggttgggttggataaccttttgtacacggcggatgcagacttttcctgtttttcggaccttgctctctcatctcctgctgattactacattgaagggcaaggttccctgatccaagctgtgctgactcctggagatccatacatgccattgccaaacgaggagatcattagtaaggttcaaaagcaggttgtagaactgttcccatcttcccggggcttggaagttacatggtccagtgtggtaaagatcggacaatcgctgtaccgtgaggctcctggaaacgacccattcaggcctgatcagaagacgcccgttaaaaacttcttcctctctggatcttacacgaaacaggactacattgacagcatggaaggagcaactctctccggcaggcgaacgtcggcctacatctgcggtgccggggaggagctgctggccctccgaaagaagctactcatcgacgacggcgagaaggcgctggggaacgttcaagtcctgcaggctagctgaacaacccctcctgcactgcagagaagcttggatctttccaaccacacatacatgctggaatggacaaaccaaccaaccattggcttttctcgcttcagggtgctggcgattcccgcagcgacctcctgtgtatcgtatccaatttgagcattagatctgccccccctgcaggcgtttctttcctatccctgatccgagaagcagggtgtagtctaggtggctggcatacgggattacatcaggcagtgtgtaagttcagctggaactcgattggtaattgggatggatgattgatgatatatatatagcacacactgttcttgcgtcttgcaagaaaatatagcaagcgatgatccggcgacacttgctgggagactgtaaaaccaaaaaaaaaaaaaaggaagggcggccgccgaataatagctc

SEQ ID NO: 20941 - DNA, 1501 bp, Zea mays
gtttcatatgaaaaatatttcgttgtcgttaggcttaggccatgcgcatatgcgcatttgagctatggtttatggaaagcttgccggccttgacgctggaaggagaaaccagtcagtctccggcgctgcccctcccgccgtggccggcgacgggtggaggcagtatgtggagcgagagacagtgggcagccggagccggcgtgtccctctgaaggcctcacgacctgccggcttgtgatggccacgagcgcgtgcgcgtgagcgtcagcgtccgacctccagtggtccgtgtttccccgagcaagagcgaacagcagtttggcggcggctgatggcaccaagcgcagccgccggaccgccgtccctggcccggccatcgacatcgagtagcagccacctgcggcgcgccggcagcgccctccagcccgtctccgtcccgcgcgccttggtgcaggcgcggaggcgcctcacgggcgccgtccgagccgcgccggacgcgccgccggtggtcagggctgccgtcagcgccgtcaccgagctcctcagagccctctccccgaacaaggcgctcaggtaactaacccagcatctcacactcgtcaaccccatcagtcatccatccgctctggaatatggatccccgtggcgttctgtgctcttgcggtcggctgtgcaggggcgctgctacccagcagcagcagggcgaggagccggatccggacccgacctgcggcagcgtcgaggacgtgctcgccgtgctccgagacgattaccggcgcgcctacttcctcaccggggatttcactccgggaatatacaccgaagactgcttgttcgaggacccgacgatcaagttccgcggtactcccagaacctgggtctgctggtgcccttcttcgacagcccttcgctcgagctagagaacattgagaagggttcgagggccgaaacgaagttcgtcaaggcgacatggaaactaaggacgtatctgaggcttccatggaggccgctggtcgcgatcggagggagcacgacgtatgatctggatggagatttcaaggttactcggcactccgagagctgggacgtctctgcgcttcaggccatcgctcagatcttcgtctcggccccggaggagaagctggaaggcagctgaggctgaggcagagcatgcaatgtacagcgccacgcagacgcaggatcagtgatctgaatccgtgatgagcaggtgtccaaagccgtctgtcagagctccgctggtcttctctgtgcaaacaaactgtaccctctctgttccaggttataaacattcgaataattttgctacttacctagatatatgttacgtatatagatatatagtaaagggcggttattatgacacaaatttgtagggtgtaggtacaggttttgaatttgacatttgatgaacactatataaaaaccgactctcccaaaaaaaaaaaaaaaatcctaatcagatagacccatccttctcgcc

SEQ ID NO: 20942 - DNA, 7610 bp, Zea mays
  misc_feature (237)..(237): n is a, c, g, or t
  misc_feature (4689)..(4689): n is a, c, g, or t
  misc_feature (4908)..(4908): n is a, c, g, or t
  misc_feature (5398)..(5398): n is a, c, g, or t
aaaagaaaaaaaaaagccttttgatctcccctagctcccgagctcctgcccctctctagtatccttctccagcgagggactgaaaggaggatcatgattgctctgtagaaacttgtctctctcactctctctctctccagagtccagactccagactccagttgccctttcttcccggaccctatctgcacgtacagaacctaaggtccttcctattacgggcctgttccataggtntgcccagcagccgcacagctagctatgagagagaatgaattgtcctgccatgccatgcagcatgtctgatgtctaacttaagttaggccatcaagtgcttcttgttatgtacactacagtaatggtgatagggagaggagaccatgagagactggagactacagagaatgtgctggactgctagttgcaagtttgcaacacacagggagagagggatgaggaactggagtgggagagccgagatgccacataagtctagctgcatgcagtgcaggccaggcagcagttaactgaagctgaagggtgccactacgtaccaccacttgtacagctagtcatctagccccacgcccccacccgccaccctaaactccagaccagaccatgagtgaaagagagcaggagaggcatggttatattaagagaagtttcctattatgtgttgctggggtgtttagggctgcaggtgtctgccagggaaaacaatgatgccttgagcatgcaaccccaggcccccaccttgagagaaagaacaactcttgctatagtagctctggttgcagctccaaattgaatggaccaatttatggctaaccaccttattagcagcatatatacttttatgtcctcgaaaaataaatcatctttcaatgttgttcaagttagactgtttgaaccactgcacggttagcttcacagaaaagaattaatgctctctctgtcttaaattactagtcgttctagtcatttatttttatatctatatttaaatgaatgctaatgaatttatatgtatacattaaatattatatgaatctattaaaatgctaaaatgatttttttttaatttgggatagatgaaatagaaaataagtatatatgagtaatatcgtttccttgtatgagtatgttcgtttttgaaggaagtttattagcttgtcagacaacctgaaaagcaagtttatttttgagatagaggattaagtatcactcatgggcccgggaaattactggatacagtatatatatgcgggtagggtctgttaagcaaggaacaagtacgcttgtgaaagaattaaagaaaactattggattgctgcaggacacgaattaataaacacatcaagattaaagtcagatgtttatactgttacaatatatagagttaaaacactgtaaaaatagtagaagcaaatatagattaaatccaaccgaagtcagtggaactgcaacagacaaaactgagactacaaagggacacagcagtgcaactgcaacaagacagagcatttttgtttgtttgtttgtttgtttgtttgttctggattccatcctccacacgttacacgtacttcccagtatcacaaaaggtcttgtctaggtgtctttcacacaagctaaagaagggccgcgaaaaagatccccatcaacgatccttctctttccggccggacggggcactgctgtgcacggagaatcgcggcttgtggcgatgtccatgatttgcatgctaaagactaccttcagtcggttatctatctctgttctctgtttttatattcaaactctattcacggtaaaatgtaaaattgtgttttagataactatatatatataggtgaacctgtaaacacgtcatagaagctgctagagacaagcaagaactaatagatattgattggtgaatagaatttaattaaaaaaacaagaagattttaattagtcatacgcgcccgatcgaatggatcgacgagcagctagctagcgctggccgatcggcggacaggcggcactagagcagctagtcctacaacgaccgtactaggtagtaggggtacaggatttccgcggttggttcagagcgccaatcatgtcgacgatccaacggaagaagacggcgagacggggccgggctgcagtgcactgcaactgcaagcccgcgtgccttcccgaggcgctgcactgaagaactgttatgtaatgtaaccaatccctgttcagcgagctcatcggtgtccgttttacaccaccatcgatcgtctccacgtcgtatcatttcttgtcttgccggccgtctgctgctggtagccgggtactggtagctgtatctactggtactgcagctctctctctcacacactcacacacactctgtttctcgttatcagcgtgcagcgtaatctgaaaaagaaaagattcagcagaagccgcacgcatcatcttcgtgatcatcagctagtagtagaccaaatcaagagcgacaggttggttcagaccgatgggccgcttgcttattcaggctagtcgatagtagcatggatagcatcgggagtacgaagccaacagttttttttttttttggctatgtgattttaatctggctgtgactataatttctacagtattttatttctataaatttcaattgtattagtctgaacagctgtaacaactgtgaccgcaggtcagtcgaactgatatttaaatcgtaatgacatgggttgcctatgaacacctctttgatccatcgacgtctctatccgttcgtatattctaagaccgactgtacccatgcggccatgcgaatgcgaaaattgtttggtccgacatgcgcacgcgagagcaggatctgctggagacgtggataagtgcatcgtggtcacgtgaaatgcatatgcaagagcatattcacataccacgtaaaatgcgcataattcgtatgccgatggagtcgcatacgtacgtggagtgctgagtgcagcatcctaaaaacaaagtactacctccgttcatttcacaaatatatgataatgataaaaaaaatttcaaaactttgactattccttattcaaaatatttatttaaaatataaatttttattttaagttacattcaaacaaccttaagtgataaaataaattaaaacaaaataaacgataactcaagattatttttaataaaatatgtggttaaagtttcgaaaaaaatcaaaggcgataaatatctgtgaaccgagggagtaattggtttgggagaaccggacaagtatgaagtattctaacaacactggccgcaccacgtggtcttcgaggaggttctcggcgggcatctttgcgagaaaagaaaggaaagaacaggctcgtcggcgagcatctccggtggtcaaagcataggctgtccgacagaacgagttgttgttaagttttccaaaactaaattcagaaaacagtgatgatgaccttaacctgaacccttcattttctctgcgtcattctgtgtgggacccttatctgggtacatatattcatgtacactgaacgcgatataattaagctccgctcatgaaaaatccagcattgtttcatcagttcgttcagccataacaattacagtatctggcagccattgtgccacacaacaccaacatcaacatgaacctccccagcaaaaggggtaccgtaagacatgtcagcaagcttggacaccatagacctgtccagaatctccatttcatttattgggaattacgttctgtacaaatcttcttttagtacttcaacctaaataaagcgtgtgacccagccaaatgcgcaagcaaaatactcctatgtgcaacaaacgctgtcgtctgtacatccccggaggctgcaaaccaaaatcaccggtcttcccgtcgaaccgtgtttgggtccgacatcatgtccatcatcatcttctctggagagtcttcccagctagcaaaagttttgagatcaacctgaaagagtaaacgggaatattgtgggcatgcatgcacgtttcaataacgatgaacatggcaacaaatggttcaagtttgctcttagtcttggtagtacctttcttcgctgctctgagaagatgtcctccctcttcttgtacatattctgctgtcgtttcgttgcttctccacccagcccccatacctcaacatcaagcactgaagcctcaacaggcaaataaccctgcattaccccaaaaccataatctaaatttgttagcatacatagttaagcgtacaaaaataaaaacattcacaacctatgccagcacatgaacatggtaactgagtgggcttatttgtgctcatcactaatagggcgtgagttatgatttgtggaatgttctttaggagaaggtgggagcaattcttaaatgggagtggtcaatcaccctattctatgccctgaaaacgcagtgtcatttcaaaagcgcatcggtagatcaacttttgggatagataataacatatttgaatccaaacagaaaggaagattgctaactaaatatcttcagcagaaaaacagcaaagcctaaatccaagattgcaaataaggtgaaatagtgcacaaaggcaatcaggttactatattccttggacaccagtaaatctgaatttaacctgattggggatgagagagccatgttgataanttttatcaacagcatggtgtcgtactaaaactcccgagaagtcttcatcaagaaagatcctctcatttccaattgttccaccaaatgctaagccaacgggctttggattcgcttcataagctcttatctgaggatgtaggtggcagtacatgaagttcttttccttgcctgctaggttagggggtatagtaagatactattagcgcagacaaagttatngtcaataaaagtcataccagatggtggtagcatgcggaatattggatgtgcggcacaaaggaacccagagctaccataaaaggtatctttgttctcaaatccctcctcggtcaatacaccaatcacccatcttcgatcagaatcaacattctcaccaccaccttttgagaatgctgaaagtagaatcagcattggccctttgtacccctcaacacaagaccagaaccggctcagtccttttccatgaacagatgacctacagacaaacatttttatcgatgttagtcttactacatccttaggagaaccgacaatgagataatatatatttaagttcttaaccagatttggaaaaaaaatcgcactcatagtcaactaaaaaatgcaatgttgtacgaaaactaacatacagatataatcacaagaatagatatcatcagcgcaccaagttacctataaaggaggtcttctgtgtccattccaataacanaagctgacagcagcttttcactcaacttgtttcttaggctgagggcaattgcccatgctctcccccgtgttagcagataaacatcagaagtgtcaaaggttgtgctaacagttgaaacagagctctcctgcttgtgacgagtaagaactccagtcaattcatgagataacaaaaaaaaggttcagttgaagaaaaaaatataggcatggttccttaaaaaaggcaaaataaataaggatctatttatctagaagagaatatcatcaacacaatttcacattgttcaaacctagcgcaggaactgtttccagagcacatttttttgtatgtaaaccccaactcccacagtagtggacttagtcgatcatcattatattgtagaatctgtggctggacaacttctaccagaattctttagaggtaattctgaactgtcattccatcaagtaccaaagaaaaggtccaagatataacattacataatttgctgatactttgcagaaacaggacaatctggagacaaatttcaaactatatttatgtatgtaatatatttgtatattatcctaaatcatatgagagagatagttatatactacatttatgttatagcgaagcaagtagaagagtgtgctataagttgtgtatcggaaaaatagcatttaaatttatagaatcaatttccatctatcaacccatgaatttgagatatgcttatatgataattctggaaagtgctggaatgtcacattctaaaaaaatagcctattccatcagtaagattccaattcctctaaatcaaaggaaacaaacgagacttaacagataatgaataactgtagaatatattaggctacaagtcatgatcagtaaaaaaacaagtataaacagaacaatagaaacttttttctacacttatgtatgatctatgaactaacaaggtaacaacaatgtcgcacatattctactgatgacactagatacagaacaaacgcatccaacgtttgacggacgctacaaattctgcaatataatttgattacctccacagagtcagcagccagggaccggaatttgtcccgcacataccgcgagaggcagttcccaaggccgaaaggcgtggacagcacccacgacatgaactcctggaccttcacccccttcccaccgctggagacgtcccagccccaaacgcctgcatcatccgtgacgacgcccgccgagacgagcgccgacagcaccaggtgcgtcacgtccgggaggagcaccgtgacgggctccgatttatctcctccgtcactgaccaccctcgaggccgaagcgctccacgccatgacccagcacacccagaggaacactgcgatctcctccggcgcgagctcccccacgaccttcccatcctcgtcaccaccgccctcgtccggctggagctggacgccgcagggtgcccccgcgccggcgcaggcggcagcgtacacgcggaggagcagtgcgagcgagcgggaggccgtcacgcgcgcgcagcagcggttgaaccccctgaggaactggacccacccggcgcccccgtccgtcaccgcggcagctccgtggccgaagaattgggaggcgatggcggggccgagccccccgaggatgccgtggaagtgcggcggcggcggcgccggggatccgggcagacgaaaggaggcgggcggcggcgcgagggcatccggcagcgcgttggcggcggagcgggagaaggcggcgcggaggagcgggagggagagggcggcggaggcgagagtctcctgctcccgctgctcgtgcgcctctggggacgggttgccagtcgaggaggacgcgcccatggccggcgaggtgtcggtgccgcggcgaaacggcgatgctggatggggattgctgaggcgcgcgggtggggagaatggtggcgtggaaaggcggaaagcttggagaccacctagacctagccgacccttgggaagtccgatggggcggagatcggagaagtggggggcaggcaagcccgggaaggccggcccggggccgcagcgcgcgtccctagttgattcgccactcgtcttggatagataatgatcttgtttcttggcaataattaattcacgaccgtttaacttttcatctaccttaagctgaactatatattctcgttgtttagccttcgtgggactttgcaaaatgctgttagtca

SEQ ID NO: 20943 - DNA, 1491 bp, Zea mays
aagctccgctcatgaaaaatccagcattgtttcatcagttcgttcagccataacaattacagtatctggcagccattgtgccacacaacaccaacatcaacatgaacctccccagcaaaaggggtaccgtaagacatgtcagcaagcttggacaccatagacctgtccagaatctccatttcatttattgggaattacgttctgtacaaatcttcttttagtacttcaacctaaataaagcgtgtgacccagccaaatgcgcaagcaaaatactcctatgtgcaacaaacgctgtcgtctgtacatccccggaggctgcaaaccaaaatcaccggtcttcccgtcgaaccgtgtttgggtccgacatcatgtccatcatcatcttctctggagagtcttcccagctagcaaaagttttgagatcaacctttcttcgctgctctgagaagatgtcctccctcttcttgtacatattctgctgtcgtttcgttgcttctccacccagcccccatacctcaacatcaagcactgaagcctcaacaggcaaataaccctgattggggatgagagagccatgttgataagttttatcaacagcatggtgtcgtactaaaactcccgagaagtcttcatcaagaaagatcctctcatttccaattgttccaccaaatgctaagccaacgggctttggattcgcttcataagctcttatctgaggatgtaggtggcagtacatgaagttcttttccttgccagatggtggtagcatgcggaatattggatgtgcggcacaaaggaacccagagctaccataaaaggtatctttgttctcaaatccctcctcggtcaatacaccaatcacccatcttcgatcagaatcaacattctcaccaccaccttttgagaatgctgaaagtagaatcagcattggccctttgtacccctcaacacaagaccagaaccggctcagtccttttccatgaacagatgacctataaaggaggtcttctgtgtccattccaataacagaagctgacagcagcttttcactcaacttgtttcttaggctgagggcaattgcccatgctctcccccgtgttagcagataaacatcagaagtgtcaaaggttgtgctaacagttgaaacagagctctcctccacagagtcagcagccagggaccggaatttgtcccgcacataccgcgagaggcagttcccaaggccgaaaggcgtggacagcacccacgacatgaactcctggaccttcacccccttcccaccgctggagacgtcccagccccaaacgcctgcatcatccgtgacgacgcccgccgagacgagcgccgacagcaccaggtgcgtcacgtccgggaggagcaccgtgacgggctccgatttatctcctccgtcactgaccaccctcgaggccgaagcgctccacgccatgacccagcacacccagaggaacactgcgatctcccacgcgtccg

SEQ ID NO: 20944 - DNA, 2529 bp, Zea mays
cttttgcgcaaggtagcgacttattcaatccatgagaactttatttagcatatatcatctatatataggagtcgcgcggttggacgttatatgaatcaccttggatcgaataaaaccaattatttgttttatttttccatcgcttatatatatatgcaccagagatttttgtgttacccttgcatatatgcatgcatgcatgtggaatgaatccaagtctaaaattaggcgcctaatggtgaccttccatatattagacaccttaattatttgaattggattttggatgcaaactagcttattagctatctatatataacaagattaaagaagaagccggcccggacaacctaattaaagaatttgaggagagaaagaaagaaagagtgatcgtcatggagagcaggaggaagaatcaacagaagacgagctacattgtaatttccatccaactcctagcggccctcctactcttggagcttgtgtcgctagtgccgggggcgtcatgcgaggagttgcccttggatttttgggtgagtgcactacggggggtcggggcaaaggacgtttcaacagccgatggatgcaccaagaagaataaggacaccgtgctctgctctgcccaggctaacacggtaaccaatttcatcaaccctaccaactctgaggaacaaggctataggaccatcggggagtccatcgctaacatccctgatgatagcaccaaacggtacatcctcatcctcagcggtggcaccgtgtaccgagagaaggtattggtgagcaaaagcaagccattcgtcaccataagatcatatgaccccatcaaccctgccatcattgtgtggaacgacactgccgccaccctggggaaggatagcaagccccttggagtagatggtagtagcaccatgaccgtagagtccgactacttcattgcctatggtgtcgtctttaggaatgatgctgcagcagcagcgaagaagaagaaggcagaaggcgaggcgccagcgttgcgagtgctaggaacaaaggcaaccttctacaactgcacaattgaaggtggacaaggcgccctgtatgaccagatggggctgcactacttcaagtcctgcaccatcaggggcaccatcgacttcatctttggctctgccaagtccttttacgaggactgcgccattgtttccgtgaacaacatggaggagatcatgaccttgcctgtggcaccacctcaacttgacattcacgacaatccaatcaaggttgccccaggggagggcggcttctccttcaagacatgtaccatcaccggggaagggcaacaaatcttcctcggaaggatgggcacgccttccatctactcctacacccagattgctaaggaggttgtgcccataatctacgacaaagggaacatcttcatgcccagtaatatgtatgccgacccatgcatgcagcaaaatctctctctctctctttatatatatatacacttgttatctcatatctatatctatgcaggactggtagacgctgtgccactttcaagtgctatggacctgggttagagaaaatatggcacgtcaaacttagatacgctgaagccatatactttcttgggacagattttatcaacggagattcatggatcctgtccataccacctactgatgctgaaacattgctatcagtttgaatatatagaatcctcagagatcatcaaagatcatcatctaccactaattaataatgagccaaattaaataagttttgcgtatatattttatccctatctataaattatgcatgtgttgtaaacaagtcgtggatgggcttcatttgttctcgcgattgaaaaataacaaataaacaaagtagaaaagaggatgaaccagaagtcttgttcagcaagaaggaaggaggaatgacgatatttcccatgtgatacttgtaaatcatatgtgtaaacttcgtgggcgtgcttgtaatttcatacgaagttgtacctctcgtctataaatagagtaacagtgtcatgcataaattcacctttcgagagctcaaagctttatttagctcagccttcgaagtacctttgagctatcacttgtatgaagccgaaggtatgtttgtaattgtttgttatattgcaaggagtgaaataataagtgtggaagcatgaagatgagtaacatgtcttgctcgtaattgtttacatttcatccttgttaatatataagcatttgtgccccttcttcttctctcttcaattaaccttcgaagaaggattaattgaagggagaagtttatgatttgataacttgtgttggcttgtttttgatgtcctgtagcaatcaaaagcaagcgaccaactgtgtctatggccagtgccatcggcctggaccctatgtttgtgcgtgtgaatcgcagtagtgcgattggggaaggaggcttgatggttgtaagtgcaatcaacccatttgaggtttttggtggtgatatgacaacaaataaggtatctaatatgtt

SEQ ID NO: 20945 - DNA, 1845 bp, Zea mays
  misc_feature (1726)..(1754): n is a, c, g, or t
  misc_feature (1802)..(1807): n is a, c, g, or t
  misc_feature (1809)..(1833): n is a, c, g, or t
gcacgagaccattacctagaacatcctaatcgaaaaaacctaattaaagaatttgaggagagaaagaaagaaagagtgatcgtcatggagagcaggaggaagaatcaacagaagacgagctacattgtaatttccatccaactcctagcggccctcctactcttggagcttgtgtcgctagtgccgggggcgtcatgcgaggagttgcccttggatttttgggtgagtgcactacggggggtcggggcaaaggacgtttcaacagccgatggatgcaccaagaagaataaggacaccgtgctctgctctgcccaggctaacacggtaaccaatttcatcaaccctaccaactctgaggaacaaggctataggaccatcggggagtccatcgctaacatccctgatgatagcaccaaacggtacatcctcatcctcagcggtggcaccgtgtaccgagagaaggtattggtgagcaaaagcaagccattcgtcaccataagatcatatgaccccatcaaccctgccatcattgtgtggaacgacactgccgccaccctggggaaggatagcaagccccttggagtagatggtagtagcaccatgaccgtagagtccgactacttcattgcctatggtgtcgtctttaggaatgatgctgcagcagcagcgaagaagaagaaggcagaaggcgaggcgccagcgttgcgagtgctaggaacaaaggcaaccttctacaactgcacaattgaaggtggacaaggcgccctgtatgaccagatggggctgcactacttcaagtcctgcaccatcaggggcaccatcgacttcatctttggctctgccaagtccttttacgaggactgcgccattgtttccgtgaacaacatggaggagatcatgaccttgcctgtggcaccacctcaacttgacattcacgacaatccaatcaaggttgccccaggggagggaggcttctccttcaagacatgtaccatcaccggggaagggcaacaaatcttcctcggaaggatgggcacgccttccatctactcctacacccagattgctaaggaggttgtgcccataatctacgacaaagggaacatcttcatgcccagtaatatgactggtagacgctgtgccactttcaagtgctatggacctgggttagagaaaatatggcacgtcaaacttagatacgctgaagccatatactttcttgggacagattttatcaacggagattcatggatcctgtccataccacctactgatgctgaaacattgctatcagtttgaatatatagaatcctcagagatcatcaaagatcatcatctaccactaattaataatgagccaaattaaataagttttgcgtatatattttatccctatctataaattatgcatgtgttgtaaacaagtcgtggatgggcttcatttgttctcgcgattgaaaaataacaaataaacaaagtagaaaagaggatgaaccagaagtcttgttcagcaagaaggaaggaggaatgacgatatttcccatgtgatacttgtaaatcatatgtgtaaacttcgtgggcgtgcttgtaatttcatacgaagttgtacctctcgcctataaatagagtaacagtgtcatgcataaattcacctttcgagagctcaaagctttatttagctcagccttcgaagtacctttgagctatcacttgtatgaagccgaannnnnnnnnnnnnnnnnnnnnnnnnnnnnaaggagtgaaataataagtgtggaagcatgaagatgagtaacatgtcnnnnnngnnnnnnnnnnnnnnnnnnnnnnnnnggccgcgaattc

SEQ ID NO: 20946 - DNA, 1423 bp, Zea mays
  misc_feature (1)..(2): n is a, c, g, or t
  misc_feature (4)..(5): n is a, c, g, or t
  misc_feature (9)..(9): n is a, c, g, or t
  misc_feature (17)..(17): n is a, c, g, or t
  misc_feature (24)..(24): n is a, c, g, or t
  misc_feature (27)..(27): n is a, c, g, or t
  misc_feature (34)..(39): n is a, c, g, or t
  misc_feature (41)..(41): n is a, c, g, or t
  misc_feature (43)..(43): n is a, c, g, or t
  misc_feature (49)..(50): n is a, c, g, or t
  misc_feature (54)..(54): n is a, c, g, or t
  misc_feature (56)..(58): n is a, c, g, or t
  misc_feature (60)..(62): n is a, c, g, or t
nncnnctcnctataggnggaattnggnaccgggnnnnnncncnaggtcnncggnannnannntttttttgaatggttttagaaacaataacatccatactatatcacaactgtatgtatgtccactaaaacatcgcacagctcatctctagacaaactagtcatccaaaatcacatcaaggcatcacacacacatacacagcaggccaagatctctggcgagtgtcttggttgtcgctaagatcattactgcgacagaacttaatttctatggcgaagatagagatgttacacaattatttaacaaagtcacaaattacaaggaagttaattaccatttcaccttcaatcgatggcaacatataagacacagcaaacaaaactatgcacattataggccacttgtggttagagcagattgcaacacatcttctaggtacttctctgcggctgcatactgcctctttttgtcctctatagctagtgcagctaaagctttatctggaggtaaatcctggtagctccttaatgtgtcagctatgggtttagtcttcctctcgagatccttcttatgctcagccatttccatcaacacaccatgattgatctctggcgtataacccactcgattaagcattgccttataatttgagacttggaggatatattgccgttccttggagtccatcataacaagctttgtttgccaatcagtcatttgctccacttgttgcttctccacatcattcttaaatttctccagcatcttcttcagctcagtaagcttgtttatggccttccgtgtgtagtcaagtagtgccttggactccttatgcactttgtccctcttctcctccacctctgctcgcctcagagacaagtctgcacttgccactacaaagctgctcatctcggtgtcacggatggcgaggaggttagcgactgcagcaacggctcgtgccgccgcggctgcaggtggtgggagtgcgtccctcgcgagccccgcccgctcgagagcctcccgcaaccgcgccgcctcggcgcggtactcggccgcctgcgcacgcagccccgcagccgcgattccggcagcgcgggaccgcccctgcgaagcagaggccagcgcgcggaggtaggccaccccgcgcggtgtggggtcgggacccagcgacagctccgccgccgcacctccgccaccgcctcgccctcccacatccgcggcgagggaggccagccacgcatttacctccgcgacggcagcagaggaggaggcggacgagggtgccggggcggtggggtcgaggtgctcggcggcgtgatccattggggcgagtggatggatcagtggggagaattttacacggaggagaggaaatcagaggttggtgtttaaatttcgtggcaatttattccccagggaaaat

SEQ ID NO: 20947 - DNA, 2403 bp, Zea mays
atatatataaaaaaaaagatataaaatatattaaaaatataaaaaaagaaataataaaaaaaataaaaaaataaaaaataaaaaaaaaattataataataaataaaaaaaaaaaaaaaaaaaaataaaaaacccataaaaaaaataagaaaaaatataaaatataaaatatattatataatttaaaatatattaaattaattataataattaatattaaaataattttataattatttgagctcacttgttttttttttttttttttaatcgtcattgatgaaatttattatttcaaaacgctagagtacgaaaaagttctgcttacatattatgacttataaaggctgacaattcgggatgtttaagaacatccatcccttgctgaagtttacaggatttgatgcaataatgttacagtagcacagcactagtagctctgtctgtattgtttattatgtaataatgttacaatggaaatacatgtttgatggattcaaaatctctttggccactcaagagtgtaaaccatggatgtagctagaccagtgatcgatctcatcagttctttggtgcattagcacatctgcttggtaattggggttgagtaagttggcagatcaaccattgttcagtgctgctgctagaattgggtttttctccaaggcaagtagtctccgccgaggtcactgctagaatctagtccgctgcacctgagagctgctgcacatgcaacgttatggcttccggacagggggactgggctcgcagaagttcgaggcggttaaatggatgtacaaattgaagaacatagtcttcattctctttgacagtcccatacaaccaacataagacttcatcggcaaaggcaaggcaaacgccaccctgccagtagttctttgccttcaccttttgtgtaatatctttggttcttagtctttccgtccgtacaagtatgccagcatcattcctgaatcccacaacaacataaggaacaccggcaagaaacgattgaatccaaaatctaagtagcttttctttttcatatgcttccactgtatgatattccagctctctgcttgttttcagctccacatagaacctcctgccatcatcagttgcatcacagcagtccatctcagcacccatgacaatccgatgggcacccaattttgtctttattacagaacaaaactctacatttgcatcgataccccttccatcgtcgctgaatgagttctcagtggcaaggttttcaaaagaatagccccaataacatctcttacgctcaacttcactttttggtctttcagggagcttatgaacatcaagatatacaacaccccttcttttatgaacgcccatcttccatggttctcttaggtaagcagtggccaatatcttattaagattgttgcggtatgtcacaaaatgtatagtattctgaagaagtatgttggaatttcgtatgcatgcgagtagatcgccaaatccttcagaacccaaatctctcttctctatatatgactcgaatcctttattgagatctgcaccgcggtattcacagatttcacgtttgaagagcctcaagctgcgatcatcaaaatacacctttccaccctcaacacggcttaagcatgcaatctcacaaggctcctgaaaagtaacagcttttctagacaatgtttcttcgctcttattaagcttcatatctgaaactaaaccttcaacatgacgcccattcccgaatctcccgtaaccaaagttatgtcgccctggatggcctcctggccttggaagaagtggtgggcctctaccacctcgtcctccaaagcctcctcgagaatgattattagtgttccgaattggaggaagcactgggactaggtagtggctgcgcgccggagttctgacgtactcttcgttatctgagccgaacaaatctctctcctcctctacctcctggttctcatattccctcctctcatcgtccagatagccggcggcgccggcgctccttgtggctatgaggttggacgaatcgtattcctccccgtcccccacatcggcgccatcctcgccctcaccggcagcgccgccgctgctgctgaggcttgagccgccacttgaggatgaggaggacgcggcggcagaggacgacgaggacgatgatggggaggaggagcccgacgagtccccgccgccgtcggcctcggcctcggcctcggcgccgccgtcgtggacgtcgtagtcctcgccgaagacgttgacgtcctgttccgagaagtccatggcgggcgcggcgggggcggtgagccggcgaggcctggtcgggaaacgaaacggagaagagggtttcggtcgggtccgacacgacacggaacaaaagaaacctcccggccgg

SEQ ID NO: 20948 - DNA, 973 bp, Zea mays
ttttttttttttttttctttttttttttttttttttctttggggcctttttttttttttttttaactgcaaccaacgatttgttccattccagcaagattgattgatacatacaggaagccctcgatcaccaaactttcgtctgataaaccatccatcagacaacctaaacctaaccaaagatagaaaacaccctaacactactaatcgacgaaacttgagcgacggggggacttcatgcatgttggagctccagttcgaacaagtcagagaaacctgcaaccgccgccgcggccgcttagaactcctgggatgcggaaccgatgtcggccttgcccttcccaccggccttcttgggcagcagcgtctgatgaatgttgggcaacacacctccggcggcgatggtgacagctccgagcagcttgctgagttcctcgtcgttgcgcacggcgagctggatgtgacgcggcacgatgcggttcttcttgttgtcgcgcgccgcgttgcccgccagttccaacacctctgccgcgagatactcgaggacggcggagaggtagacgggcgcaccaccgccgacgcgctcggcgtacttgccggccttgaggtagcgcgcgatgcggccgacggggaactgcagcccggccttggtcgaccgcgacacagccttggaccccttgggcttgcccctgccgccgccggaactcatattcgcctcttctcgtccgagactactctctcgcccagtctactcgacggaatcgcggacacgctggtatggcggtggtggatttgggcggaagtgggatcccgcccggcgcccgccacgcgacccgcccccagaaggcttcgggcgcaacttgcgttcaaaaactcgatggttcgcgggattctgcaattcacaccaagtatcgcattttgctacgttcttcatcgatgcgagagccgagatatccgttgccgagagtcggtcg

SEQ ID NO: 20949 - DNA, 859 bp, Zea mays
  misc_feature (64)..(64): n is a, c, g, or t
  misc_feature (70)..(70): n is a, c, g, or t
caagcatccacagatcacaatcagtagcaacttcaactggtaaaaacaaaatcaagaacaaaangagatncggccagagcaactaactgcaaccaacgatttcttccattccagcaagattgattgatacgtacaggaagccctcgatcaccaaactttcgtctgataaaccatccatcagacaacctaaacctaaccaaagatagaaaacacacctaacactactaatcgacgaaactcgagcgacggggggacttcatgcatgtcggagctccagttcgaacaaatcagagaagcctgcaaccgccgccgcggcagcttagaactcctgggatgcggagccgatgtcggccttgcccttgccaccggccttcttgggcagcagcgtctgatgaatgttgggcaacacccccgccggcggcgatggtgacagctccgagcagcttactgagttcctcgtcgttgcgcacggcgagctggatgtggcgcggcacgatgcggttcttcttgttgtcgcgcgccgcgttgcccgccagttccaacacctctgccgcgagatactcgaggacggcggagaggtagacgggcgcaccaccgccgacgcgctcggcgtacttgcccgccttgaggtagcgcgcgatgcggccgacggggaactgcagcccagccttggtcgaccgcgacacagccttggaccccttgggcttgcccctgccgccgccggaactcatattcacctcttctcgtctgggactgctctctcgactggtctaactcgacggaatcgcggacacgctggtatggcggtggtggatttgggtggaagtgggatcccggccggccctcgaggtacccaatg

SEQ ID NO: 20950 - DNA, 1669 bp, Zea mays
  misc_feature (5)..(5): n is a, c, g, or t
  misc_feature (47)..(47): n is a, c, g, or t
  misc_feature (55)..(55): n is a, c, g, or t
  misc_feature (63)..(63): n is a, c, g, or t
  misc_feature (77)..(78): n is a, c, g, or t
  misc_feature (80)..(81): n is a, c, g, or t
ttttntttttttttttaaatttttttttttttttttttttttttttntttttttntttttttntttttttttttttnntnngcagaaatcagtatcgacttgcatagccaaaaaaacacacttgatagacactgtacgcaccctagaaaggccgcgttgtggcttttcttcttccaaaagcttatcctacacaccgagtccatttcaaaatcaaaccaagatgcttagatcagaacacagagtggatgtgctgctgtttgccagaatttcgcccatccaaacgaagacctaaaagcagttgtacaggcctgctagcttacatacaataacatacaatacaaatggccaaatgggtgttctttttatctacatacaaaagtttgcagccttgtcatgcacaaactcaatcccccagccccagttaccagggttgctcttcttcatcctgctaatccaaacaaactgacacctccttgccattgctaacgcaccatcagaagctgtcaacaaacaaaaacatcatcatctgacgattagcagccaaaagcatgtcctgctcgtctcttggtgtcagacgcggctttgttcaccgtccgtcgtggacgctctgctcagtgggcgatccaggggagaagggcacgaacccgcggccgccaaacatgggccgcatgagcgcgtcgtcgaacttgcgccagtagtagtgcaccgtgtgggttggcttgcttaggagcatccggaggctggacggcctcacaatctgtgccgaccccgtctcgatgtccgagccctgcatgctcgtcaggagaggcgagtgcagggacttgggtgaggacggctcggaggtggccgtgttgctgcaggcagggagcagcagccggatcaatggcttcgtcatcatcccaaacaccatagtgctaaacaggaccacagtgatcgtgctggtgatcattatcgcgttgccgtgcagctcagtgtgtccagatctcgtgaacttgttgtaagcgagagcaatggacacggcacctctcatcagtccggcccaccatattacaatttgctgtctaaatgttattttctccaatggagacttctttgtcaggttggacaaaaacgacaatgggaaaacaaatgcagctctccccaccagaaccaaccctagcaaaatcgagcttatgccgatggatttaccggggctgtcactggcaaactcccacttctcgatgtcgagggcatccatcccaacatacaggaagagaaaagtctcagcgatgaaggacaaagtagcaaaggcatgcttggttgtgactcttgagctctctgtcacattgtgccaggtgtaatgcgacatcacgatgccgcagaagaatacggtaagaatgccactcagatctagcagctcggccagcatgtaggagaggtaagccatgagcatcataagcccgacccctcggtcagtggaatgccttcctatatatagcttcccggccatgctcgcgcggacccatccagtaaacactccaagtaaggtgcttgacacgaataagtaacagaagtttcccaagaaattcagcacaacggctacatcgatgtggttaagatcgaagttctggagtgcgttgaagagcacaacagacgtggcatcgttcacgactccctcaccgaacacgag

SEQ ID NO: 20951 - DNA, 1504 bp, Zea mays
ggacctaaaagcagttgtacaggccctgctagcttacatacaataacatacaatacaaagggccaaaggggggttttttttatctacatacaaaagtttgcagccttgtcatgcacaaactcaatccccccgccctagttaccagggttgctttttttcatcctgctaatccaaaccaactgacacctcgttgccattgctaacgcaccatcagaagctgtcaacaaacaaaaacatcttcttttgacgattagcagccaaaagcatgtcctgctcgtcttttggggtcaaacccggttttgttcaccgtccgtcggggacgctttgctcagggggcgatccaggggaaaagggcacgaacccgcggccgccaaacatgggccgaatgagcgcgtcgtcaaacttgcgccagtagtagtgcaccgtgtgggttggcttgcttaggagcatccggaggctggacggcctcacaatctgtgccgaccccgtctcgatgtccgagccctgcatgctcgtcaggaaaggcgagtgcagggacttgggtgaggacggctcggaggtggccgtgctgctgcaggcagggagcaacagccggatcaatgacttcgtcattattccaaacaccattatggttaaccggaccaccgggaatcggccggggaatattaatggggttgccggccagttaatggggtccaaatttcgggacctggttgtaagcaaaagcaatggaaacggaacctttaataagtccggcccaccatattacaattggctgcctaaaggttattttctccaatggaaacttttttgtcaggttggacaaaaacgacaatgggaaaacaaatgcagctttccccagcaaaaccaatcctagcaaaatcgagcttatgccaatggatttgcccgggctgtcactggcaaactcccacttttcgatgtcgagggcatccatcccacatacaggaagagaaaagtctcggcgatgaaggacaaagtagcaaaggcatgcttgggttgtgactcttgagctctctgtcacattgtgccaggtgtaatgcgacatcacgatgccgcagaagaatacggtaagaatgccactcagatctagcagctcggccagcatgtaggagaggtaagccatgagcatcataagcgcaacctcacggtcagtggaatgccttcctatatatagcttcttaattatgtaggcactgagcaatccagtaaacactccaagtaaggtgcttgacacgaataagtaacagaagtttcccaagaaattcagcacaacggctacatcgatgtggttaagatcgaagttctggagtgcgttgaagagcacaacagacgtggcatcgttcacgactccctcaccgaacacgagactgtacagaaagggcgtctcatcctgatggaggccctgcagcccgcacacagaatccgttgcaaaaaagatgactccaatagcgagaaaatccccgacatctagcgtcccaaggcg

SEQ ID NO: 20952 - DNA, 1791 bp, Zea mays
atatgtcttctttatcgtctcaaacatctataaaaaagtatagactataattgctagatcttctcatagatacaaaacggtaattaaaatcgtaacgaggagaggagatcgcgtaggccgccatgttcgtcgttcctcttctagaaccaaaactgtgtttcttgaattataaatattccacctcaattcgcctccccgtttccgagaccaaattaacgcatctctacaggaaataacgatgtgagatggtcaaagcaaaacaaacttaactcatcagttattgtcgcgcgagagcgcgctcgcgggcatgggcatgcgaacgttagcagcggcgacaaacgatgcgagggcccaaaacgcccggctctctgttgtcgtccgtggagaaggagatcgatcagatcatgttggagagcgagcggcagttctcggacatctcgacgagcgacgcgtcgaactgctccatggggttcttctcgccgatctgcctgaactgctcgtcgcagttctgcatgtcctgcgccgccatgcccatggtggcgcggatggtgacggcgtccttgaagccgatggcgcggcggcaggctcccaggttgtcctccacgtccaggtacaggttgttgcacaggtccagcaccgtccgcgccttgggggacgccgtcacggcggcctccttgacgtgcgccctcgccgcctcggtgcgcttgttgaacgcgtccacctgcatccgcaacaccgccatggcgtccaacaccccggcgctctgcgcctcgctccccaccgtgctggtgcagatgtcggggaacgcggttcccctgcagatctccgccagcgtggccgcgtccacggccgcaggcgtggctaagagcgccgcgacagccgcgacgaggaggtacagggcacgggttcccgccatggctgttgcctttgttacctgtgtctgtgtctcggtgcaatttacgtgggctagctgcgtgtcggaggaggctggtgagaagaggaaaggcgatgatgtgggggccgcccggccggcctcgaccggcccgatcgcccgacgggaggcgtggcgtggctggctgcatgcatcatgcatggacaacggaaatggcgggttatcctcctttgcccggattctctttgtccgttcgttggtattgccgttgccattgtaagtttccatttttagtagcccttaactagagcagatcgcaagataggcaaactccatgcggataatgcatgtcatatacgttccgtaggaagagatgggcctgtttgttttccttagacattattagtctaagcctctaaggtctaaattttagttcctacctagtttaattctagaaactaaagagtactaaagaccattaaaacagataaacaaagaccttccaacaacatgatatgcatattttggcttgacgggtcccacacgatgaagttatataatgtgttgcattgcatcgctcaccacctagcatctggtaatgccactgaggtaaacttcacaattaatggaatccgataaaatatgagatattatttgactgatggcatctacccagaccgggcaaccttagtgaagtcagtatttgttggtcactcgttttttattcccaaagaacataaaaaataaggcaacacaaatgaattattctttcacttcatcctttaagtaactcttttttgagagattaattaaaggaagaatgtaagaaacataaataaagaacaccaggaataaaataatgcaaaacataagagatgaaataggttgctcatcttgat

SEQ ID NO: 20953 - DNA, 1381 bp, Zea mays
  misc_feature (271)..(271): n is a, c, g, or t
tttttttttttttgttctccaaacaaaacgacccatatatgtctttttattagctcgacgagaagaacataatgatacaatccattctttcattttacaaagttaaaaaatctggtctggtccattttgggaactcgttaatccggtttagatggatgagctcccaaaaattctcgcgtgggctcaaataagatggtctaaaggtatgtttggtttgatgcataacttgacacactttgcctaacttttctgcttaaagttagttattcangctgtttggttcgtggcaaagtgtgacacatttaaccacgaaccaaacagcccctaaatatgtcctctttatcgtctcaaacatctataaaaaagtatagactataattgctagatcttctcatagatacaaaacggtaattaaaatcgtaacgaggagaggagatcgagtagagcagcatgatcgacgatcctcttctagaaccaaaactgtgtttcttgaattataaatattccacctcaattcgcctccccgtttccgagaccaaattaacgcatctctacaggaaataacgatgtgagatggtcaaagcaaaacaaacttaactcatcagttattgtcgcgcgagagcgcgctcgcgggcatgggcatgcgaacgttagcagcggcgacaaacgatgcgagggcccaaaacgcccggctcgatctctgttgtcgtccgtggcctgagaaggagatcgatcagatcatgttggagagcgagcggcagttctcggacatctcgacgagcgacgcgtcgaactgctccatggggttcttctcgccgatctgcctgaactgctcgtcgcagttctgcatgtcctgcgccgccatgcccatggtggcgcggatggtgacggcgtccttgaagccgatggcgcggcggcaggctcccaggttgtcctccacgtccaggtacaggttgttgcacaggtccagcaccgtccgcgccttgggggacgccgtcacggcggcctccttgacgtgcgccctcgccgcctcggtgcgcttgttgaacgcgtccacctgcatccgcaacaccgccatggcgtccaacaccccggcgctctgcgcctcgctccccaccgtgctggtgcagatgtcggggaacgcggttcccctgcagatctccgccagcgtggccgcgtccacggccgcaggcgtggctaagagcgccgcgacagccgcgacgaggaggtacagggcacgggttcccgccatggctgttgcctttgttccctgtgtctcgatcggtgcaatttacgtgtcggaggaggctggtgagaagatgaagggcgatgatgtgggggcccgccgggccggcgaatccccatcagccgcccgtgggag

SEQ ID NO: 20954 - DNA, 2573 bp, Zea mays
ggggtgtgtgttttttttttaacatatattatttatatattataaaaaatcatacaatgtacaatgagttcgcatgagggacctgaaaatcatacgaccggggctggctgacacgggtccggaagtcgacaaaatgcaaggtttataggaccctcaagtttctgctgaaggttttcacaagtcccccatctttctcatgaaaacattctcaagtgaaaactctttgcatttttgctgcaacaaccacctcaaataatcagcgaacaatgtaccatctctctctctcccttacacacacacaaagaatgtaacgaatattgaaatccacaaccaatttcactcccaaatctcttagcctctcagcacttcttggcgcaggcgctcttggccttgtgcctgaacagcaccttcttcttcctgtgcgaggtgttctggacggtgagcacgaccttgcccggctcgccggtgcggaacgagttgcggaccgcctcctcgccggacgccatcttcttgcccttcctgacgatgatggtgtaggagccctcgtccgccggcacgaactcctccttgtagttcacctcccaccccagcaccgtcaggtcccatgtcagcgtggcatcagcctgcaaagaaacgacacggaacggccgtgtcgggtcgtgtcattcggcaactctgctgcgtgtattgtctgaaggcttgttcatttcatgtgtcagtgctgtacctcagtggcttcgatctcgatggtctccgtggagcttcccttgacggtgacctccgcgacctcgccgtcgtccgcggagaactcggtgtcgccgtcgcgcttcaggccgccgtacttcaccgggatggcctcgatcggaatgtaccttcggaaaaggtgtacgatgctcgtcaaaaagctgtccaaatctcaagatcgacaacaagagatgttcgagtgcttacttgaggagggtctcggtgaccttggacgggcgagcaacgacgaacttgctcttcgtcctctgcgtcaggaacgggtagaacagggtgctgaacgcgtagtaccagaacggcacgttgatcaagatctgcaggtggaaatcacacagaaaccgtattattaaatcactcggccgggagtttctacccgatcgacgacggtcgatgagcaccaccaccaccacactcacgtttctcgcgacgagctcggggtagttgtcctggaacaggtcgagcacctgcttgacggcgactcggaagtccttcttggccggccccggcgagttcctgaggtcgatcacctgcagcagcgacgcgacgccgccgggcctcaggtccagctcggcgacgtggcgctccatggcgcgcacccgccaccggaggaacctggccttgccttcctcggtgcccagcgccttcttgtacacggcgtcgtccgcgaacacgcccagcgcgttgtagcacaccgggtggccctcgtggtccgcgccgtcgaggtagcacgcgcccgcgagctcctcggggaggtcggcgtcggcgtcgcactcggcgccggagccgaagccggtccagtccctgcgccagcggagcgtgcggcggagcatctcgaacgcggcgccggccttgaagtcgcgcgcgcggaggaacttgaggagcaccacgtcggtggcctcgtcgcccttgctagggagcagaggcacgccccacagcgcgatgtccttgtcgacgacaacggccgccgtctccggctccttcgccgccgccttctccccggcttcttctctttcttggcctcctgcttggtgtcgtctccgctctcctcctcggcctcctccttctccccttcctcctggccttccttcttctcccctccctccacgccttccttcttctcctcctcggcgtcggcctccttcttgccatcctcctctcccttctcctcggcttcgggctgctcatctttcttctccgcggccttcttcttggcctcctccttctccttcacctccggcttaccgtcgtcgaacagcttgccctccacgatggccgcctcgaccttgtcgcggagctcggcgagcgccttacgctcgctctccttgagatcgtccaggaagttgctctcctcccggaaagacgcctgcttggtgctcacctccttcgccggcgccgcggccaccgcctcggtgccatttccggaaacagcctccacggccatggcggtcacagtcacagctcaaaaatcgacaggaagcacgcgtgcggatttcacggcggtggtggcgatgaaagagagagagcgcgagagagagaggagtgggattggagcagcggagagggaagaaacggctatatagtgagggggcaacggctacggagtggtggccaaatgccgacaggtaggcaggcggcgaaggagtgagccgttgggtcgggccgttgtgctcgtggggcccgtgggctgcggcaggcgggggtggctttgcctttgcggtgcatggccaacctgccagccaacggctagttgcttgcggccttcgtttgtttgctacaatacaaggcagctgcaggtcgactttaaaggatcc

SEQ ID NO: 20955 - DNA, 2158 bp, Zea mays
ctgctgaagttgctaaagcagagtgttttccgtgtacttggttttcacaattcctccatctttctcatgaaaacattctcaatcgaaaactctttgcatttttgctgcaacaaccacctcaaataatcagcgaacaatgtaccatctctctctctctctccttacacacacacaaagaatgtaacgaatattgaaatccacaaccaatttcactcccaaatctcttagcctctcagcacttcttggcgcaggcgctcttggccttgtgcctgaacagcaccttcttcttcctgtgcgaggtgttctggacggtgagcacgaccttgcccggctcgccggtgcggaacgagttgcggaccgcctcctcgccggacgccatcttcttgcccttcctgacgatgatggtgtaggagccctcgtccgccggcacgaactcctccttgtagttcacctcccaccccagcacagtcaggtcccatgtcagcgtggcatcagcctcagtggcttcgatctcgatggtctccgtggagcttcccttgacggtgacctccgcgacctcgccgtcgtccgcggagaactcggtgtcgccgtcgcgcttcaggccgccgtacttcaccgggatggcctcgatcggaatgtacttgaggagggtctcggtgacctttgacgggcgagcaacgacgaacttgctcttcgtcctctgcgtcaggaacgggtagaacagggtgctgaacgcgtagtaccagaacggcacgttgaccaagatgtttctcgcgacgagctcggggtagttgtcctggaacaggtcgagcacctgcttgacggcgactcggaagtccttcttggccggccccggcgagttcctgaggtcgatcacctgcagcagcgacgcgacgccgccgggcctcaggtccagctcggcgacgtggcgctccatggcgcgcacccgccaccggaggaacctggccttgccttcctcggtgcccagcgccttcttgtacacggcgtcgtccgcgaacacgcccagcgcgttgtagcacaccgggtggccctcgtggtctgcgccgtcgaggtagcacgcgcccgcgagctcctcggggaggtcggcgtcggactcggcgccggagctgaagccggtccagtccctgcgccagcggagcgtgcggcggagcatctcgaacgcggcgccggccttgaagtcgcgcgcgcggaggaacttgaggagcaccacgtcggtggcctcgtcgcccttgctagggagcaaaggcacgccccacagcgcgatgtccttgtcgacgacaacggccgccgtctccggctccttcgccgccgccttgtcgtcggcttcctcttccttggcctcctgcttggtgtcgtctccgctctcctcctcggcctcctccttctccccttcctcctggccttccttcttctccccttcctccacgccttccttcttctcctcctcggcgtcggcctccttcttgtcatcctcctctcccttctcctcggcttcgggctgctcatctttcttctccactgccttcttcttggcctcctccttctccttctccttctccttcacctccggcttaccgtcgtcgaacagcttgccctccacgatggccgcctcgaccttgtcgcggagctcggcaagcgccttacgctcgctctccttgagatcgtccaggaagttgctctcctcccggaaagacgcctgcttggtgctcacctccttcgccggcgccgcggccactgcctcggtgccatttccggacacagcctccacggccatggcgctcacagtcacagctcaaaaatcgacaggaagcacgcgtgcggatttcacggcggtggtggcgatgaaagagagagagcgcgagagagagaggagtgggactgtgggaagcagcggagagggaagaaacggctatatagtgagggggcaacggctacggagtggggggccaatggtacgccgacaggtaggcaggcggcgaaggagtgagccgttgggtcgggccgttgaggtcgtggggcccgtgggctgcggcaggcgggggtggctttgcctttgccgtgcatggccaacctgccagccaacggctagttgcttgcggccttcgtttgtttgctacaaggcagctgcaggcatgca

SEQ ID NO: 20956 - DNA, 1339 bp, Zea mays
  misc_feature (11)..(71): n is a, c, g, or t
  misc_feature (296)..(322): n is a, c, g, or t
acgagacaagnnnnnnnnnnnnnnnnnnnnnnnnnnnnnnnnnnnnnnnnnnnnnnnnnnnnnnnnnnnnnttgacatcgtgggatcagattcggttttggacaacgaagatgaccaacatgaccttgtgcctcttgtaattggaaatatagaatccagtgttgtggaagaaggaaagttcaggtactacaaattttcagttgaaggaaatgtgagtgagaaagtagcttctgggcatgcaaatatcgagattaaaatagatacggacgcgagcggtggtgacactgatatctatnnnnnnnnnnnnnnnnnnnnnnnnnnnaactcagcaccacatgagtggtcttctcatgaaatgggatcgaaggttcttatactcaaaccacgggatgctacattggtcagtggtgtttacagtattggtgtttatggtttcaaagggacttctaagtaccagctctctgtagctatcaaggatgttagtggccaaaggattggtgaatatgctagtgcctcgggaagtgttgattttgattctgtgctgtgtagaaactgtaagcgccatatagccagccagtctgctcatcttcatgaggcatactgcatgagacacaatgtagcctgctcacatgatgggtgtggagttgtccttcggaaggaagaagcagcagatcatgtgcactgcaacaagtgcggacgagcttaccagcagagagaaatggaaaagcatatgaaagtcttccatgaaccgttgcagtgcccctgtggggtggtcctggagaaggaagatatggttcagcaccagtccttgacttgccccttgcgattaattgtgtgccgcttctgtggtgacacagtccaggctggtggagagccttctgatgttcgtgacaggatgcgaaacatgtctgagcatgagagtatctgcggatccaggacagcaccatgtgactcctgtggacggtcgatcatgcttaaggagatggagattcatcttattgctgtgcatcagaagagctaatcacctactgacgctgggctggtctgaacttgagcctctattgtcatttggtcaacagaagctgtgaactttaatgtgccattccagggttgttggattgaaaactaccccttgggactgggagctatatgtgattcgtaattcgtggtgttccatgggattaaacatactggtgttatctgtattttatttctctgtatacattatttataaatctgattttacattcggtattacctggaaaaaaagcggccctcgagctccagctaaaaaaaaaaaaaaaaaaaaaaaaactcgagggagggccgcgtgtaccca

SEQ ID NO: 20957 - DNA, 1309 bp, Zea mays
  misc_feature (14)..(14): n is a, c, g, or t
ttggggtaccctcnggtctgccgggttcctgaattttgcagcccactttgtgtgatgttgagagaactagttgaaatagatagttctagcaaaactgagcatggtcccacagccagttttgtatcagttctgtctgggattctccgtggtattcagaaggctgaggatccgattaattctgagatcactcctacactgcatgttctctcaaaaatcggcttgcttattgtaaaagaacttgataagcattgcaagatgtctgattgtccacgccatatcctcttgccgtcatcttattatagattgtctgtgagtgagaggaaatcatatgaatgttgccaagaaaatttcattagtgataagcttgtaaagagaattcttaaagctcatgaaccttataaccataatgacaatactaaatgttctgttgtttctgagagggtatcatatgaatttgttcctgaaaggaaagcttgctcctcattaaacaaatcagtggtacagaatgcaagtggttgtgatagcaataggaacaaatgtttggcatctgggaaagctgtgtccaagaaaaaagatcagagtaccaataatagcttggataaagaaaatatgtcatcttgtggttctggtggcacaaaggtgtcatctccaggctccttgggtttagctagggaggttgattctggaaattgtctctccctcttggataaccggaattgtcctatgactaggacctcaaaggcaaatcacaacaattgtaggcaaactgcggacatcttggattttaatctcagagaatgtagttccttcaagaaaggtcatagcaagggtttatctgaagcccagaagcatgaaaagtcgcttcctggctcttcaattgcatgtgatattgaagatgccggtgattgcaatgataaccttgtgaaagcaccttcatcaaacaacgtaacagccaactttaagaaaaagggtaagagaacactggagttggtgaatttgcagaatagctcagatttaactgatgttgtcacaaaagataacgttcgacagattagagcaaggaaggtgccagtgtaaacagctactcacatatgatcttggtatttatgtaatttccgtccgatgtaaataaatacttagttctgaaatcatttatacatgcatatccacttgagagtactgttataatggtaggaatcttggtcccggttccccatgtaacattataatttaaatagggatgggcatgagcctcttaggctatttctagcagatcctatatcttatatcctatttcaaatttttctgc

SEQ ID NO: 20958 - DNA, 1984 bp, Zea mays
ctataacaaacatgggcccttagtaattcggctcaagaagctatgatataaaaaataaagtattcttttatatattttatataattatagtttactttagtttataagtccaacttttctaatactgagatgtaaaaattacaccaacatctataaattcaaaaaacaatactaaaatatatttgacaaaataattgaatgctatatatgttagtgtcttcgtctacaaagaatcttttttaaaatagacaatctcggataataaaaaatagagtgaaactgtaatatagaatggatgtagtacttacgctaccggcgaaatccaactaaatagcaggacaatgagatagcgtagttttttttttgtgtggggagggggcgggagatgcagtatagcaaggtacacctttgacttaaagtatctctaacaataccttaaattaaaatataaagctctatacagtaaaaattataatagtgtatcatttcataaaatttgtctaaaaaattataggacactttatcaaatgtctcaaatatatacaacatagtaagctgcactataaactagatttaagactttactgacagagtagaatatttcccccctaaatttaataaaatatattcatttaaattatagggcattgctacatccgtctaaattacaggtagccagctacgcgagtttcaggagcagcgcgccaggacgacgcaatacctactaatagtatgtgtatcactagaataagagtaaaaaaaattatattaactatatttggtgatataatattaatgttcttttttctattaatcttcttaaacttctgggaaaagcgataatattaagttatttttttcgtaaatcttcttaaacttgtgggaaaagcgagatatgcgtccaaaaggtgtactgttctggtgttgtaattcaatgcgcactttgaagtttgacttttgaaggctagtacagattcaatatttattttagatggcgatgtatatatcaaataaaaaattagcaattcatcttcacacgcaagggggaaggagcacaactgcacaacacaggctgcacgaaaatgatgcacatcacagcatggctaatcctagctacctgcaactaatgacttattattttgatgacacacaagcaacgaatgaatcaaccaatgaatgaagcaacccacatatgaacaaggaccatctaagcagcagcagcggcggcggcggaactggatcgggtcacgcggcgcccatcatgaccttgaactcgtggaagctgagcacgccgtcgccgtcgaggtcgaacctgcagatcatggcgcggcagtcgtccacgtcctggtgcgcgccgagcctggcgagcatgcggcgcaggctggcgggggtgatgcaggaggagccccggccctccgccgcgtcgtcgtcggaggagtacatccggaaggcctggcgcaggccgcggtggcggtcctcctcggcggcacccgcgtgcaggccggccacgagccgcgcgaactcggcggcgtccagcagcccgtcgccgtccgcgtccgcgcccgccaccagcgcctccgcctcctccgccgacaccgccgcggcgtcgggccccagcgtcgcccgcacgcactcccgcagctcggccgccgagatccgcccgtccgcgtccgcgtcgaacgccgcgaacagcgaccccagctcgctgctgctgctggtcgcggacgacgacgaccgcgcggcgacggcaacaaccatcctcggtcggtgtctgttgctgcggtgcgatactgcgatggatgatgattgatggccaagtcgtggagtcggtgctgcgctgggatactccttccttgccgccggccggcttccgatcgatccggcggtaatgggcactagtatttgttgactgctataagcttgcgaccctggcgctgcgaaccatgcattttgattaggatggttctaggtaatggtctcgtgc

SEQ ID NO: 20959 - DNA, 2148 bp, Zea mays
  misc_feature (70)..(70): n is a, c, g, or t
aataaaataatctcatttttttataaatatcttctcttagttaaagtaacatatacacatatttacaaantttctaagaacttcaaatctagacctatataatgttcttagaaatatttatgtgaaaattatgggtgtagattcaaagttctgataaaattctagaaggggttgtatatgttacattatataagagaaggtttatgtaaaaattagaaatcattttattattgtttggtaagtatttttaaaaatataaatataaaatttattgagttagtaattataagaaagaccactggttgataaaatcaacaaaaaatagtagtttagttatagtaataaaaattttatccttaaaagataataaatgaattagagacaaaatattaaacactttttatgtaattttttatttttaataattaacttgtttctgctaaaatttcaagaaaaatatagcaaatataatatataattactgatttttttaaattatataaattatggatactattagatgatagaaatgaaaatacaaaattagtgtcatttaaatcaatgtcacgtcatcaaaaaccaccaattaaaattgtccagaggattatttatctagttttgcaaatctgatggagttaaacaaccggttttgaaagtggagttaaacaaccggtattgaaagtgatggaatgaagtagaccacacactaaaggttaaagggttatatagacttatttcaggtgaaataggtaacctattggagatattgctacccatgtaccaagcattatgtgccccacttcttcaatgtaaagttcaaccgatcaccattccggagctccacataatcccacctacagcaggaaccttaatgccagtgtcataataaaccatctgtcgacctgcgactggaacaaatctttcctgacatggcataaataacataccatagtatacagtgactgggtcatcttgcgtactgactcaaatctggtcggacaaggcatcaccatgcctcaccatgctacccatggacaactaagatgcacaggttgctcaaaacaaagaatgcattataactcagtacagtatatacatatacattctattcacttattccattcctatgaacaaaaatttagggcaggccctactggtcatcaattacatatgctttatccagcttcttctctagcgacaaaggagccgagaaatttaacggcgagaacatgtcgtcatatttggatttgggagcaggcttgaactcgtaggggccagccttggtcccccaaacctggttcccttcgtcgtcaaaacctttgtcccagatatgtacttcgccgtttttgtggatggacagatccgacgtacagtacgacgcgccgctccagttgttgggaaaaccttcaggtggggtagatccttcgtataagcaacgctttcctcgtccgcatcgtgacaagtgtatggtggtcagatgctctgcgatatctgcaattacttcttctgcctgtggcctctgatccttttgacggtcacagaaattcttgtactcttcagcatccctaattgcatatgaactcaactcaacatcgcatttcatctccttcggacagggctttaccatgtagaatctttgtctaaaaggcttttctggagatctccaaaatgcctgctcaaagtaaagcacccttgaaccatccaccatctcggttgcaggacatgtgagcattctcaaattgaagaagttgtcaggatccttcctcgcctgctccctcgagaacttttctccggagagcgcgtcggcgacggctcgcgcgtggtcccatcgggtagtggagcggcgcaggcggcggagcagcaggacgccgccgacaaccacgagcgccttcagcaccgcgccccgcaccgcccctcctccgcctcctgtgtcctcctcgccggagcccatcgctgggggtccttccacggcggcctcgcgagggcccggccgagactgtgtggggattgactggggaggagggagaggagccggggaggaaattcgcggtttgtggagggtgtcagcggtaaattggggaaatggcgatgtattttctgtcgcgcgcggaagctgggcgcaacccacacttggcgcccacgcggccg

SEQ ID NO: 20960 - DNA, 1599 bp, Zea mays
catgactccctcgtggctcgtcccattcccgcaccatctcgacaaaccacaccaactgtcatcggacggcccaaaactgtgccgcgtgttccgttcaacggctatttcagcccgcagaacgcacatcagaagggtaaagccacgaaccccccggtccgcgcctgcgccgccttccctctcctgccttctccgcttcaaatttgcgtagcgttgatttcacgcccggatctcacaacgctcaatccaaacgctagccgcaaccctaaccctagcaaccggtgagtaatggcgcgccctaggggcaagaagcgcacggcgccccgggcggccgccactgattctgtccagccggaggcggcggcgacggagacagcggcggcggagccggcaaatcgggggcggtggaagcgcgtcaaggcgccgcccaagcccaagcccgagacggattacttcgccgagaaaagaaatctggaggatctatggttatctgcttttcctgtcggtactgagtgggaaaacattgataagataaaggagttcaactggagctttgaaaatttagagaaagccttagaagaagggggcgagcttcatggtaaaacagtttatctgtttggaagcactgagccccaactattggatgttaatggcgaatcaaagatagtgcttattccaatcgtagttgctgtagactgccctttccctccatcagacaaaattggcataaactctgtccaaagggaaaatgaggaaatagtgccaatgaaggcgatgaagatggcatgggtgccttatgttccccttgaggaccggcttagcaggattgacagtttgaaaacaaaaatattcactctcggatgcacgcagcggaggtctgcactgaagcatctcaaaattgagagagtcaagaagtttgactactgcatgccttactatatgccgctgcaacctcttgaagacgagaatgacactgttatcagtttcttatatcctctagaacccccgatagtagatgagtttgactgggaaatggacgattacgaggattttgctgatcagaaagttcaagaaggtggcctgccagaggatgagaaagaaaaattcaaggagttcctgaaggagaaggttagagaaaggaagagagagcttaaacaggctaaagaagccaggaggaaagctattgatgatatggatcctaaggtgaaagaggcattcgagaacatcaaattttacaaattttatcctgtgaaaaccccagacacgcctgatgtaaacaatgtaaaggcgaggtacatcaacagatactacaggaatgcccattatctgatgtgatggctttccttatcgcacgtgcttggcgagcttgtcacttgagaggagttgatatgaaaacagttcggtgttgtactagagttggccccagtttttcaccccccctgggcatcttttgctctccggtgtatacaatcctgaggatagattattgtgtagcactaagaggggcaaagtagtttgagactaaacaaatcattaaggaacaatttgttcccttttcatcatctattttgtggttgttttaacaaaaaaaaaaaaaaacaa

SEQ ID NO: 20961 - DNA, 1222 bp, Zea mays
ggggccttggttcatatggcatatgtgttcttttttaggacaaacagctggatccatgtccattcgaggtcactgttcttgcaggtattttttcagtcagtacagaaaggctcaccacatagaagaaaatgaaatggtcacacgtgttttatccttgtgatgatatttctgctctgactatgttggcatggttaacacgaacaatccaaaaattgggcacccatttgcttggtgtttgtcatatatttgatgcagaaaactatctaactgttagtgttgtcaataatctttttacagattctttgatgggcagggtaattcttatttatcctttttatgttgggttgtaggatatatttattgactttgtgttatattataggtgaagcagggaagaacaagaagaggcaggtttcaatctccaagtggacacctcctcgttgtgacactttttgattcgtgatggtctcggatgaaaatctcgggctgagaagaatgaacgatatatgcaaaagctcacaaggagcaggctgagagagatgtaagtgcatatgcttttcatatccatatcaacttgattatgcttgctttagtccatgtcaacactcaaaacagtctacactatggtgttcatttcagagatgaaatagaccaagtaacagctcacctttgattatagcatatctcaccaacattgattatcatctaaaattgttttcggctttcatatctcaccacattttcagtcagtgattacagcatgccttggtcctttaactacaattgcttggatgctaacagcccacttgtttgtttggacattgtgaattacagagaattggagacactttagactttgaaatgaagaggtggtctactggaaaacagggcaacttgcgtgctttgttatcaactttacaatatgtgagttgatgatactgttggtactggagaatgaagctaaactgcatgtggtttctacccatggctctgctgctgcgctcttgtgtcccgacttccttttgggtgggtttacaatttatagatcatctaagaggactatggttgtttgtctggctatgcatttttgtcctgcctggattgcagttgattataaagaagctatagcttccagtcaagcccgtatttccaaggaatttgttaggtgggatttttctaggaagcaatcctggtgactacatgatgccttggagacatggta

SEQ ID NO: 20962 - DNA, 1409 bp, Zea mays
acggtctcaaatctcaataggagtttcatatcactgtttccaaatccctcatgttttggtttctgtttggataagttttatcttccattaaactcgtttatacgaaacttttaccatctccctttatcaataaatactatgccacatcaaattatttaatgttcatgaaactttcataaaaccccattgagatcggtataaacccaagcactaatggatgcacagaacataaccccaaagcaaggcatgcggctttgacctgaaaacccatctccagttctggttagctattagtcgattaaactactcgacgtgcagctaccgctttgatttctgtggtttgaaaatgttgtgcttgtagtacttcagttcggcgatgctttctttaatatcatccattgccctgtgggttttttgctttcttggagtttgtttcctttctttcgggtaccatcgtatgcataaagccattatactactcacatcgacaattacatgagagaagacggctgcaagctgtggcatgtacttcttcagaaatagaaaatccacataaacagaattcccagctaataatggagtgcctgaatttatgtgcttcctaacaaagtctaaaacttttgcctctgcatcatgctcagaaagttcactctgcagtactctttccgtcaaaccactagctgcatgatgagttttgcaccattcatccatattatctaaacaatctttgctctggcttataactaagtcaggaccctctatttgttttgtaagtttgccatccgttatgatacaagcaatctccaaaatccgatcttttgttatatccaaaccggtcatttccaagtcaatccataccaaaggcatcctgtaatcactagatgatgatacaagtgctgcctcctcatagtttactgcagttgtgtcattctgctgatttttatcaggtttgcttgcagcagttttgtctgtgctggaagacgcctgtggtacttcagctcggccaacatcttcattgctttcagcatccagacacagagccgagaacatatttgcaagcttactcatctaaaaaaatattgatcttgagctgatacagttgaatccttaagggttggcgatgtagaggaggacgacggcgtagggacgacggcggcgtaggggactggtatcagcggtcacgactcacgacgaggtccagtgacggcggaggggaaccgacggagagggaccagcgatggtgatggaggggaccagcggagacgtgttgccggtgggaagaagccgactcaccctacaggctcgggtgggggcgtggtgcctctcacggctgcggggcggtggggagaaacaggagtacaagactggttttagccgatgggggatagctagtgaacgaatgggtattt

SEQ ID NO: 20963 - DNA, 1231 bp, Zea mays
attagacaaatgttttaaattggtctttgcaatatacataattcactttgaaaaatgtgtaaatcacgattatcatagagacttgtttattgcacactatgccaaaatataggcctaatcatctatgaagaatgaaacattatgtctaaactaacataaaatgcttttgtgtagtgcataaaaatgatcttttcctctaatggggtgaagttcttttcctactatattggtccatgagttgaggttcttttcgtctcatgttctaacctacagaaaagggaaaacacattaaagaacttgagtaggaataaccaaacaagccccccccctttttttttttttttttttttttttttttaaaaaaccatatggattacttgcattacataatctaaaatacacctgctaagtacttagtccctccagtgtccgcagtacaaccataagtgttgaaacactaacaagtcacagaagttcgaagtcataagtgctgaaacactagaagacaaccataatccgttaacactgaccaagctatattgctcctcttctcgaaggtgctgtttacaatgaccaatttcttaatgccaagagcacctgtaacccgatccatcgtcacctatccatgaagagcttgtgatatcgccactacacaaccacactggatcttgggcagcaccggtgggtcgacgaccaccctgtgctcaccgacctggatcttgggcgccacccagaccgccagcgccatgtcccgccgctccttgccaacgtccacgggccccagccaggcgaggtgcagcacacgaggtcacgagtgccctccgttgcgcacatgtccgacggtgcgaggaggagggagaggccgaagtcaccgaggcatgcccgtatgtcggcctccacgaagatgttggacgaggtgatgtcgcggtgcacgacggcgggttcatgccaaagtggaggttctagagcgccgccgcgatctgggcgaccatcgcgatgtgggttcgcctggggagcagcggtacggcgacactgagcgtgccgttggagacgaagtcatagacaaggatgtcgcgctgctgggcgagctccaggagggagcggtaggatgttgatagctagggtttggcgagcgtgtggggatgagggcggctagcgatgcgggaggagggaaataaggattagattagggtcgtacacgacgggcgtcccgccggctcgaggtcccaat

SEQ ID NO: 20964 - DNA, 1130 bp, Zea mays
  misc_feature (671)..(675): n is a, c, g, or t
tagagagagacaagaagattgttcaacagggtaggatacatcagtatagggcaatttgccgtatcaagtcacgtcccagggcccacccatcaaacagacgctaatccaaacagtttggggtggggcagctcgggcgacactgcgacagaagcttagatggatctaccttctctgtacacgccggaagggtcggcgttctggacgatccacgggtgctcaagaaccttgtggagaggcagccgctgcgccgagctcttgaccagcatctgagaaatcaagtcctttgcggcaggtgaaacgaatggtttcagtgggaacttcaagtcgactttcactatccttctgtaggtttctgagtgctccttagcttcgaaaggtgggaccccgtaaaggaactcatagcacagaacaccaaggctccatatatcaacatggtaatcatgttctgccttctccaccatttcaggtggcaggtaatccagagttccgcacatagtccgtcttctgttgaaggtgtgcacggaccagccaaagtcggcaattttgatctcgccctgaactccaactaaaagattctctggtttaatgtcccgatggataacatgcttgccatgaaggtagatcaaagctctagccaacgaagcgacataagtcgctgtgcgtcgctctgnnnnntgtttacaccttgtcagttccttatacagttcacccttggcagcgtattccaggattaggtaaaccctggtctgatcatagaagtacccatacaggcgaagaatattaggatggcgaagatgactctgaatctccacttcgcgtcgcagctgatgctcaacctgtgattgcttgagctggctcttgaaaagaactttcaaagccacaatctcactactccttttttctctggcaagataaacatggccaaacttgcccctcccaagaggtttcccaacctcgaaatcagacagcacccaccgcttctcctggttcgcatgggctgaagccctgtcctcctgccgcgcgactcggtggcgaccgccatggttagagcctgtaggagcggcgcggagggggaggaagcgtgggtgggacggccggacggggaggggcgagtcgagaagtttgaaatt

SEQ ID NO: 20965 - DNA, 2323 bp, Zea mays
tgtcacttttgcacattgtatggatcaaaaaggaccaaactctcttccttttctttagacccatgacatgcaatatatagctggaacagatctaaagcctgtttggttcactatctaacttgtcgtactttgtcttacttttcttctcgtggtctgaacccaggagctaaatcaaaagtgactaaaatttactttgtatcacatcagatatttgaataactattattatgagcattaaatatggtctaattatagtcacttatagctcttactgtatagatctttagcttctaagtgattaaactttagtcatagcttctaggatccaaacaggacctagggggtgtggatccacctctgtgcagagcaggacgacacaaaagcgcggaatataatcgattaaaggtaggcaggagctgaaggatcatacataacagataaaaggcatgcagcagactagctgatacagttgcttattagtggaggtacagcagggaagcaaccaagtcataaatcataatagggtagaaaaaaaattcaaggatgaccgcgtcaacagtacgatcttcaggcctttttgggcgcgagcctagccttgatcttgtccacctccttggtgccgacctggaacgccttggcgagcacggcgtcgggcagctcgggcgacgccgcgaacagcgcggcggcgagggactgcgtgccgggaagctggctgttgaacgcggacaaaacggcggcggggccgtcgccggcgttgcgctggaagtggaccaggccgcgggggaagacgaacacctcgccgggcgccagggtgcgggccaccaggcggttgttggcggcggtgacgaaccccacgtccagggtgccctgcagcacgaacaccatctcggtggcgcgcgggtgcgtgtgcggcgggttcaggcccccgcccggcgcgtagtcgatgcgcgacatggacacgcccagcgtgttcagccccggcaccttcttccacgttcgcgcccgtcaccgcggagccgtaggcgctggcgctcgtgttgcccgcgccgcctaggccgctgaagtagaagtcgtccgccgtcaccgccgccgccgccttgcaggcgtacccgttcaccttcacggctgcgcacatgtagattatttggacacgtatgtacgtaataataagtaccaagaagtaactagtagctagaaaaccgaggaattatggtaggtagctagctagctataggctatagcttgccgctacatgctgctactcactggacgtgaggtccgcgacgcagatgtcctggagcaggtcggggtcgccggcgacggacggggagggaaggaggataaccatggcggtggtggcgacgacaatggcgagtcgacgcagcagagaaggaatggcggccattgtgatcgagagcttgcttctttgcagtagctagctagctagtgcagctgtgctcgtgcttctctctgagtattatgatgactctctctctctctctctctctagctaggctagctagggggccaccctttcttcgcacccttgctgttggtctcttgctggtggcttccaatggccttgctggatgctggatggggtaaaggttttataaccggtggcctgtgctgtgctgcggtccggcactgcagtgttaaggcactctgggaatgaaggaatgtggcaagattgtcctttcaccccaaggaatgtgtgctggcctggccgccgtgtgcgcgtggtggcgtagcaggagattgctgcaggagtacacaaggaacaacgtgatatataggctgcttatttaatttatttagtccacggtctggtgagcggtgaatacgaacggccagcagatttgcttggtcgtgttaaaccggagactagaactcttgcttcaaatgaaagatcacagttccagctatctgtaagtagactctagctctctctaatcagctgcgacatagatacacatctaggcagtcacaacatcctacaaatctcgaccataaactagatgcagtaggtatactaggtaccagttctgcagcccctttcagtaataaaaaaaatctctttctcctgtcggacagaaccaagtgtttaagaattaagatgaccacaacatcactagataactgccttcttgtgcctgatctcgatgatctgatggctaaggtactaacatgcttatcatattattctttcatattgttccctttagcaagtattcaattaattatgtgggcatttccttttgagcaaacagtttgaatttcctctggtttgtttgtgtattaaggttccaattaaagtactttc

SEQ ID NO: 20966 - DNA, 1059 bp, Zea mays
ttttttttttttttttggagctgaagaatcatacataacagataaaaggcatgcagcagactagcagagacagttgcttattagtggaggtacagcagggtagcaaccaagtcataaatcataatctgggaaaaaaaatattcaaggatgaccgcgtaaacagtacgaccttcaggcctttttgggcgcgagcctagccttgatcttgtccacctccttggtgccgacctggaacgccttggcgagcacggcgtcgggcagctcgggcgacgccgcgaacagcgcggcggcgagggactgcgtgccgggaagctggctgttgaacgcggacaagacggcggcggggccgtcgccggcgttgcgctggaagtggacgaggccgcgcgggaagacgaacacgtcgccgggcgccagggtgcgggccaccaggcggttgttggcggcggtgacgaagcccacgtccagggtgccctgcagcacgaacaccatctcggtggcgcgcgggtgcgtgtgcggcgggttcaggcccccgcccggcgcgtagtcgatgcgcgacatggacacgcccagcgtgttcagccccggcaccttctccacgttcgcgcccgtcaccgcggagccgtaggcgctggcgctcgtgttgcccgcgccgcctaggccgctgaagtagaagtcgtccgccgtcaccgccgccgccgccttgcaggcgtacccgttcaccttcacggtggacgtgaggtccgcgacgcagatgtcctggagcaggtcggggtcgccggcgacggacggggagggaagcaggacgagcatggcggtggtggcgacgacaatggcgagtcgacgacgcagcagagaaggaatggcggccattgtgatcgagagcttgcttctttgcagtagctagctagtgcagctgtgctcgtgcttctctctgagtattatgatgactctctctctctctagctaggctagctagggggccaccctttcttcgcacccttgctgttggtctcttgctggtggcttccaatgcccggccggcccgaggggtacccaaaa

SEQ ID NO: 20967 - DNA, 1219 bp, Zea mays
  misc_feature (71)..(71): n is a, c, g, or t
  misc_feature (74)..(74): n is a, c, g, or t
  misc_feature (1202)..(1214): n is a, c, g, or t
gggcgagctgctgccatggtggctttttcttgcgggtgtgagctccgctcgccgccggtcttggacgccgnggnagggctcctaccacccctccctccacccgggactccacgctgccaccggcacacgacagtacgcatacactcttcttcctcccctcgctctggatggctggcgtccgctccctcagcgcctccgcccatgcccggctcccgcacttgccggctccccgatggagatgaatgaagaaaggaagatctgcaagaataaagtcgaggcggaggcttggtttactggtcttagtgccttgatatgtcgaaaacagcatggatcccaggtccaacatatagatggaatccggattgctggacttcctattgattttccaagatcggagatgcaatttcatactgtgcaaaagcaatttcgctatgcaagtcacgcatacagaacctgaaaagttccaaggatgctttgttggatggtatagatggtggtgatgcatctgctgctgaagctgaaggaggctcagaattcgcccccagattgaaaaagagctagagcagcttactagcatattgcctgatcttggcagttagcttgaggacctgtctgaagcaaacccaagcgctgacatggatgagatggtgaaggcaattgtgtccagggtaactgaagtgatgccaaaagctgcatcttttacttcttcccaaatagcaacctcaagcaatggattcgactcctcggttatgtctacgacagcgacaactggaagctctggaagcactgtgaactgaccttggggttgtaggcagaggcgtcaaacgagctagcatcaagccgatctctgccaaacctgttgctaagaaacctgcacttgattcaccatctctccaaggtgacaacagcatcaactctgaggttgtccctgcgacgcagactgatgaatccagctaaagctctacatttgaaacgaacgctttctgacgggggcacggcgataacacgccttctattctagtatgcttagatagattcaatgttagcgcaaacgactgatgataagtttttcagttagtattttaatttggatttagagtacacttatgtatgatttatttgacaatgcttatttatgagacattgaattgtacttatctatattacattaaatatgatgttattaaaaaaaaaaaaaaaannnnnnnnnnnnnaaaaa

SEQ ID NO: 20968 - DNA, 2588 bp, Zea mays
cacccaaaatttccccatctccgacctcccccttcctctccccctgccgctccccgcgccgagaaggagaaccccagccgccgcgcagcgcgccgcccatggcctcctcgtcggagaacgcggctgtgccgccggaggaggagccccaggccccgccgccgccggacacagagcctaccgaggcggcgcccggcgaggcggaggatgagccgcaaaccctagagcgggcgcaggagctcttcgacaggggttccaaggccatcgaggatgaggacttcgtcgacgccgtagactgtctcagccgagcgctcgagatcaggttagggtttcctttccccttcccatttcccccctctacctcggcgacattagctgtgaagcgactccgcgtgtcggcagagttcggaccaattggcggttggtacggtgctttttctgtccggatctgctgggtttcgcatcagtgcttgtgtggctcggtgattcggtccaatagggttttaaggggttatgtagcaaaatgcttagcaggagtgttttcgtttcgtctctgtcgtgggtgagatgtagagagtctgtcgttgtcagggtctcagggttttgtcggatttggctgcgagccccgctgtggtttgtacagcaacacttggccatgggatgtcatcatgcgcaaactgtgttcgccattggttgcaagtgtactgtggtatacaatgcttaagaaaaatgtgctggctgctgagcctgaggagatgtctcatggccgtgtttgtcgaatccaacggctaagaagaattcaggagacgtggacacatgtggtgttagctttgcgtcgcgctctattatatagaaatttttgattgtgtgttttttcaactcgtctctggaaggtactagagtctcccgtgatgtcgtgctggctgctgagcctgaggagatgtctcatggccgtgtttgtcgaatccaacggctaagaagaattcaggagacgtggacacatgtggtgttagctttgcgtcgcgctctattatatagaaatttttgattgtgtgttttttcaactcgtctctggaaggtaccagagtctcccgtgatgtcgtgctggctgctgagcctgaggagatgtctcatggccgtgtttgtcgaatccaacggctaagaagaattcaggagacgtggacacatgtggtgttagctttgcgtcgcgctctattatatagaaatttttgattgtgtgttttttcaactcgtctctggaaggtaccagagtctcccgtgatgtcgtgctggctgttgagcctgaggagatgtctcatggccgtgtttgtcgaatccaacggctaagaagaattcaggagacgtggacacatgtggtgttagctttgcgtcgcgctctattatatagaaatttcgaccggctttggttgcactgaaggcgaagaaagagaagcaaggggaaagtgttcacgttgatactactatctgctttttttttttttttgatcaccacgtcatcatgacgtgtagacatattgactctccatctccgaaacaatcaatgaatgacacggaatgacgtaaccaatcggacgcacaagataaatcaagcagcagcgggcgcacacacacgaacagatagatacacgtacgtgtacatacgtactgcctctccatgcatcttggaagacagcccagcccacaacgacacagcgaaccgaatgaagtcacatatatagtacacgcgctgccccgtgaatccgatgcacgcccactcaatccgacagacacacacgtacggaaccgacgacaagtctccattcatcagtcactgcctcagtgcctccggccaacacggtgatcgattttatctcaagcctccgtgaatggcgagcaggtagaagagctgcgtcgccgacaggatgatggtgaaggactccatgcatatcagtctggcattcctgccgtgcagttcaatctccttcaccgccaaccccatggcgagcagggtgagcgtccacgcaatgaacccggcggaggccgccgccggcaggctctcggtgctccaggcgcggacgtggttgagccccgccagcgccgagcccgcgccgaccaccccggcgatcacggcgaagatgacgaagaacccggtcgccgcgttcccgatggggaagttgatcggggagaagtgagccgggaggtgcaggccggtgccgatgaagaagccgtagttgatggcgtggttgatggcccagccgcccaccgccgccacgatgacgtacatgcacaagttgagcaccagcaggagtccggccaccggcttcatgcccgcgttcgccatggatctatcctagctactgctctgctagctcgtcgatggccaagctaaacgagctctctcgactgaacacggactgagctcgctcgctctctagtctctacgcctatacctaattttctgctggcttaaggtatatatcatctgcagctgggtgcaatgcaaccccgtgcatatatatatacacaccgcacgagcacctcgctggcggtggagaacgaagcaaatgcaaatatactaatgctttcttttc

SEQ ID NO: 20969 - DNA, 1169 bp, Zea mays
atgccatgagctttgaaaacatattccaatgtccctaaaatcatgaagtggtgtaccacaatggtcgttatggttcggaaatggaactaggacacaccattttactagtttagatatgtgtggcgcaccataaaataaatttagagaacagaaatatatttacaaagacggtaagtctaagtggtatcctctaaggcttgtttggatattatagtatatatcctatttctcttggtttgtggtcgttttggttttgtattaggacaaatactaactttagtatccaaataaaaccttccaagtttaggcttcaccgatgcatttagctccgtacgtaattaacacacagaaatacacacaaacagatacacatatacgtactgcctctgcagcttggaagaaacccacaacgaaaacacgaggaaagccacactctgtcccgtgaaaccgatgcacaccagctcaattcgatacgtacggaaacgataaatctccattccaatgcagtctcttcctccatccagtgtgatgatttcatctcaagcctccgtatatggcgagcaggtagaagagctgcgtcgctgacaggatgatggtgaaggactccatgcatatcagcctggcattcctgccgtgcagttcaatctccttcaccgccaaccccatggcgagcagggtgagcgtccaggcaatgaacccggcggaggccgccgccggcaggctctcggcgttccaggcgcggacgtggtggaaccccgcgagcgccgaggccgcgccgacgaccccggcgatcacggcgaagatgacgaagaacccggtcgccgcgtttccgacggggaagtagatcggggagaagtgagccgggagctgcaggccggcgccgatgaagaagccgtagttgatggcgtggttgatggcccagccgcccaccgccgccacgatgatgtacatgcagaagttgagcaccaggaggaggccggccaccggcctcatgcccgcgttcgccatggattgttgtcctaacggactactgatcgtcgattgccgacgagctcgactgaaaacgaattgagctcgatcgctagctcctagctagctacagcttgctagctctacgcctctctacgtacgatttctgctggcttaatcccggcccggccggcctcgag

SEQ ID NO: 20970 - DNA, 1833 bp, Zea mays
atatctctttctatagccagattctccccacagccagattttcagaaaagctcgtcagaaaaaaagctgaaccaaacaggcccattacccgcccgagatttcgcgctcttcacccaaaatttccccatctccgacctcccccttcctctccccctgccgctccccgcgccgagaaggagaaccccagccgccgcgcagcgcgccgcccatggcctcctcgtcggagaacgcggctgtgccgccggaggaggagccccaggccccgccgccgccggacacagagcctaccgaggcggcgcccggcgaggcggaggatgagccgcaaaccctagagcgggcgcaggagctcttcgacaggggttccaaggccatcgaggatgaggacttcgtcgacgccgtagactgtctcagccgagcgctcgagatcagggcttcacattatggagagctcgcaccggagtgtgccagcacatacttcaaatatggatgtgccctgctatacaaagctcaggaggagagtgatgttttgggaaatgttcccaagagcttgccaaatgaagactcagtgaagagtacagctactaaagatgacagtggaacctcaaaggtctctggtaccgatgcggaggatgctgcgtcatcagaaaaagttgatgctgaagaaggtcacaactcaaatggcaaaaatcaggagaatgggaatggtgaagttgagaaagatgatgacgacgtcgacgatgatgagaagatgggagatgaagaggataatgatttggatctttcttggaaaatgttggacattgctagggcaatagttgagaagagccaagataacactatggagaaagtaaaaatatattctgctcttgctgaagtggcaacggaaagagaggacatggacaactcactcagtgactatatgaaagctttatccatgttggagcatttggttgagcctgaccatcgtcgagttgtggaattaaacttccgcatttgtttggtttatgaactagtttccaagatcggagaagcaatttcatactgtgcaaaagcaatttcgctatgcaagtcacgcatacagagcctgaaaagttccaaggatgctttgttggctggtatagatggtgatgcatctgctgctgaagctgaaggaggctcagaaaaatctgccattgaaaaagagctagagcagcttactagcatattgcctgatcttgagaagaagcttgaggacctgtctgaagcaaacccaagcgctgacatggatgagatggtgaaggcaatcgtgtccagggtaactgatgtgatgccaaaagctgcatcttttacttcttcccagatggcaacctcaagcaatggattcgactcctcggttatgtctacggcagcgacaaccggaagctctggaagcaccgtgactgaccttggggttgtaggcagaggcgtcaaacgagctagcatcaagccgatctctgctgaacctgctgctaagaaacctgcacttgattcaccatctcaacaaggtgacagcagcatcaactctgaggttgttcctgcaacgcagactggagacgagtcagtatctaagtaaattacaatttcattagccctactgtaatgttaacttgctggaacatattagctgctatgtaaacgcttaagaagggactgctggggccatagactcatcgtgagctgaccattgaaatgttaaattgctgagatcatcatggcggtaaatcatgtctgctatatcaaatatgcttggtgagatgtgtaaaaaaaaaaaaaaaagatgtatctgaccgtagtagctcaaaaaaaaaaaaaaaa

SEQ ID NO: 20971 - DNA, 2194 bp, Zea mays
  misc_feature (119)..(119): n is a, c, g, or t
  misc_feature (124)..(124): n is a, c, g, or t
  misc_feature (134)..(134): n is a, c, g, or t
  misc_feature (136)..(136): n is a, c, g, or t
gggggggggggtcaaaaataaaaaaataaagcaaaggggcggagtgtgggctgttctctttacagtttgttgtactgtgcagaatctgcattctttcctaagaattgtctagcgtttcncgccnaaattcattntntaccagtactaggaatcactgccctttcacctctgcatgtcggctggattaacatgaattgaccatggacttgctgttgaccaccttgggccgttggagagagattccccagctcctgcagcggctccacagatctaccctccactctgcatctatcgagccgagcacaagacagcggtgcttctctctaaacgtgaatacaattgcattaaggctatctacaggtttctcattttaaacttcactattttaaacttcactatgttgcacgaccatatacgtgatcttttgaccatagcttaaaagagacaagagaagagccaacaacagaaggggagctatgcctagaaatattctcctacaggaacagccgtcagcagtcgattcaccgatcggtcggtggaccttgcaccgatcatctcaaccaaaaaacttaagcatggtaggaagatgttgtcaattcaattacattatattctaacagtttcgacatgcacaatgtttttcaataaaaggttaagaatgcagtggcatgggttttggtgaaatatgtggagtgcaacatgcacagagctacactacagctgagtcgatgcacagaagtcatggcagccacgacggcgagggtgcatggcctttggtcactgccatgtatgtctgcctgccggggttggtggtggtgaccgcggcgggcggtacgggacggggacggacgcggcaactgccttgaccaccacgccgccactaccagctagccaactcttgtcctctccgttccgtgctggctgctggtgctggccctccctccattgacggcgcaccatttcccatgtggacgacgtgcacccaaatcaaaagactacccgagtgcactacatcccttttcaaatttgatgcattataaattcagttttttcagccggtacgggaaaaatatatatttgatgcattataaattcagttttttataggaagaaagctcgtcaggggagcccgagagcgcaggagtaagcagttttcttttcccacatattgctttcacacatttgtatacttaaataaactgatgagaggctacttaaaacacaaaaggagcatgttatcgcacccactactgtcagacaatgctaaaaaaagattgttcggtaccagtagtactgtagtagtagtactcatcatttattttttaagaagtcaagacatttgtgagcatacatatatcattcacgccctcccgccagggcgcgcccaccttttttttttttttttggaagaataataatgataaatttattggatgatcaacagtgacaacaaatacactaataattcaagtagtaagtacatcgtagcagtataattaacaatcgaataaaaaaaaggccggcaattaaatgaactcttgtcagcaacaaccgtcggtgggtgcgccgcactgacgacaatgcaatgcaatgcaataatgaatcgctggagtatatatgtatgtatataatacatttatctgcaaaaatcatgcgcgtcacgcagcacgactcgccctcacatggccaagaaggtgagcatcgtggcgacggcgagccccacgacagccttggctccaagcgtggaggcgtcagaggacttgggcgccggcgccgcggtgggcgaggacacggtgggcatctcgtcggtggacggcgcagccggagccgcggcaggggccggggtcggggagacgctcctctggtgccggggcttggtcgtcttggcgggggccggcgcggcggtgaccgcggcggcggcgacggtgacctccagcttcatacccgcggcgcagtggccgggcacgctgcagatgaagtagcgcttccctggggccgacagcttcacggaggcgctgccgccggtgtaggacttcacggggttgctgccggagcaggcgtcgtagccggccttgctcacctccgtcccgtcctgcgacggcgcgaacttgatcgctgcggcggcagagacccagcgtgcacaagagaagcggcgcactcgagccgaattccgagcttacgtcggcgtgcgtgc

SEQ ID NO: 20972 - DNA, 826 bp, Zea mays
  misc_feature (33)..(33): n is a, c, g, or t
tgaatcgctggagaatatatgtatgtatataanacatttatctgcaaaaatcatgcgcgtcacgcagcacgactcgccctcacatggccaagaaggtgagcatcgtggcgacggcgagccccacgacagccttggctccaagcgtggaggcgtcagaggacttgggcgccggccgccgcggtgggcgaggacacggtgggcatctcgtcggtggacggcgcagccggagccgcggcaggggccggggtcggggagacgctcctctggtgccggggcttggtcgtcttggcgggggccggcgcggcggtgaccgcggcggcggcgacggtgacctccagcttcatacccgcggcgcagtggccgggcacgctgcagatgaagtagcgcttccctggggccgacagcttcacggaggcgctgccgccggtgtaggacttcacggggttgctgccggagcaggcgtcgtagccggccttgctcacctccgtcacgtcgtgcgacggcgcgaacttgaacgacaaggtgtcgccctgcttgaacgtctgcttggcggaccaggcgtcgtagccggtggtgccgctggcgtcccaggagccgtcgcctcccacggggtggtccgccgccgcggcgagctgcaccgccgccagagctgccacggccgcgaaggtggcgaggatggtggccttggccattgccattgccgttacctccgatctgatcttctcgttagcttcctgatgcgtatgtggctaacacctacgtacgacgacctgattgcaacgcagtcgctacggagaaccgaagcttgtttgtttggtgtccccgc

SEQ ID NO: 20973 - DNA, 4091 bp, Zea mays
gacctacaaaagatgtcacatctgatttatggtcacatagaaataaaagaaatggagcgtgctagtgacaacaaagttccccaacaagcctactgatgccatatacattgctatcgcacttgtgcagcaatgaagcgtgctactgacaacaaagttaaggtgtacctccatcctaaaatctaaaacataagagatttaagtttatcctaaatcaaactatactgaatttagttaaatttatggagaaaatactaaaatctaccatataaaaaatctaccaaaacatattttataatataaccagttaaccaataaattgatgtgttttcttattttcataaatttaattaaagttagtatgatttagctaaatataaaactgtatttcttatattctagtacagaggaagtatggcttgagtaataacatgatgtctgctgtaatacaaattcagctcacttgagtgtttcctagaaaatgtagctcgtaggtgtttctatcacttgttggattgcttgcctgtttgctggtatcccattccaggtttggaagtgtaaatttgaatgtttgctttcttaggttgtatttaaattcttcagaactaatagttagctaaactagctgtagagatttcaaacaccccgactaatgccctagctattcgttagctaaaactatctccaagagaggctcgaaacgtgaccctattttaaatataaggcttagaacaataaaacactcttttaacggttatcctattttacaaaaaaaatatcgaataattatagggctaagtctcttaggtcttaaatataatacctcatatactggagccttattctcgttttcttataatctccaaccatttacttcctaataacttgatttattttctaaatatagttatttaaggcttacatgcagtaaaaaattattttgagtccctcaacattgtaattacgatcatatttcaatttttaggcctctattttagagttttttgtttaagatactctaactcgtacctaacagttagtgaattagccagctaaatacaaataataatttgttagctgtataactattaactttatgagttctaaacaaagccttaataaaagcagagcaaaactcttgcaaaaaagcccatctctaagaaaaaaaatcgaattccagcccaataggacttcattgaagcccacaaagcccaataataactgccatttcgaaactacgtctcttgtcctcaggcacgagaccattaccccccccagcccggccgggacaatccgaggatccgaatccccgacgcaacccttgcgtggtggcgtcaccacccaaatcccaccatccggatctgccgatccgccgccgccatgtcccgctcggagcgccgcctcgcctcggccgtggtgcgccttcccggccgctccagggtctccgcctcgccatccccgcgccgccgctcccagtccccatccccgcgccgcgaccgccgccgccgcgaccgctccccgatcccttaccgcgatcgctccccaagtccatatcgagcccgtcgccgtgaccgctccccgagcccttaccgcgatcgccgcgaccgctccccgagcccttatcgcgatcgccgccgccagtggtcaccctaccacaacgaccgcggccgggaccgtgaccgggtcctgcccgtccgtagcggcgggggcgcctggtccgatgacgacgacgacgacaaggaactccagggcctcagctacttcgagtaccgccgcctcaagcgccagaagcttcgcaagagcaagaaaaggtgcatctggaacatcacgcccagcccgccccgtgttgaaggcgacgaggagaactacggctacagcgacgtggaagaggagaaggtatctccgaaggcctcgccggaggctagcgaggaggagagcaaggatgcgtcggagtcagaatccggtgagtctgatagcctctccgagtccagcggatcggaagcttctatgaggaagaagaaagggaggaataaaagtcgccgtagtagcaagcgcagccggcagcgccaccgccaccgctcatacagttcggagattgaggacgaaagcaagagcgacgatgattctgtgggctcttatgattcggaggagtctagggataggagcaaaaagaggtcgcgcaggcataatagatctaagaagaggagcaggagctccaggaggaagaagaggaggagccaggatacagcatcggagcaaagctctgaggaggaagaggaggaggatagtaagaaaaagaataagggcttgaagaggaagcggagcaagcgatctgattctgaagaatcggtcccttctgatgccactcctgatgatgtaaaagaaattgaagaaactaaagtgccagaaattgatccagaagcaatcaagttcaaggaaatccttgaggcccagaagaaggcttccttggagaacgatatgcctgttggtccaatgccacttccacgcgcagaagggcatattagttatggtggtgcacttaggcctggagaaggtgacgcaattgcacagtatgttcagcaagggaagcgtatcccacggcgtggtgaggttggtctgtctgcagaagagattcagaagtttgaggatctggggtatgtgatgagtgggagtaggcaccagaggatgaatgctatccgtatcaggaaggaaaatcaggtttatagtgctgaggataagagagcattggccatgtttaactacgaggagaagtcaaagcgggagcacaaggttatggctgacttgcagcgcttggtgcagagaaccattggccatgatgtgggaccttcacatgatccatttgctactacagatggttgagtaatgatttcttgttcaactagtcacctgtatcaggtgtgctttacctgtttgtgtttccttccctacattgtaattagtgtttttgaacttgcctagttatgccgcaaattgcttatgacattttgcatgtgaaccatagtaaaaaagagcatattattagcttgtatcttgtatgtgcaatattttttgttatgatgggttatatgtgcttaccgcccctgttatggttccaagctgctttgttttaccattgaagctcaggacttctttttctttctctttttggggtgaaggaaatacagacctggtgtagtggtgagagctgactcaggccctgttcggttttcacggactgactcacagggtcacgggtttcgaaacagtctctctgcatttgcgggaaaatgcttgtcttgatttatcccttgtgcagatcctactcatgtgtgattactttgacaagaacctgtcctccgtgtcttcatttcatttgcatccttactgcagaaggcaactgtatccggagtttggatgcacctttatgggtggcactagctatcgttcagtcttacaatccgaggcgtaaagttccgagaagtgaaatctccatgtctgatttggagctctgtatatcaaaagcagccttctcagctgctcagcattctggtattgttctcgtttggttccttaatatagaattgtttagcaatctaaagcatgccttggaatatcgtaatgccactcatctcttcagcaacgcatgccagttgtcaaaatgtatgttgtttcaagtaatatgtacgcaccaaaaaatcctgttcagcctaaacgtctatttgatttcttaattataaaccgtgagagcatgtttgtatagctattttaaatttataatcctatggctcctcttttgcattgaagtactgaacttatgcaattatctctttagctactatcaggttcggttattttgttttcattatttttctcctctctgaagcggctatccacatgccccgaattggttaccaaggtggctcccaacgatcagaatggtatacaatagaacgcctgctcaggaaacactcatctctccatggaatcgacatttttgtgtatgccatgagaacacagtttcatttatgagttactatccgtcgatatgtacttgctaatgaagaacaactgctaccaaccattttcctcctgca

SEQ ID NO: 20974 - DNA, 2362 bp, Zea mays
ttccgcttcgcgctgagagcttcgagaggctggagaagatcgggcagggcacgtacagcagcgtgttccgggcccgggacctggccacgggccggctggtggcgctcaagaaggtgcggttcgacagcgtggagcccgagagcgtgcggttcatggcgcgggagatcctcatcctccgccgcctccgtggccaccccaacgttgtcggcctcgagggcatcatcacctcccgctcctctccctccatctacctcgtcttcgagtacctcgagcacgacctggccggcctcagctcctcccccgacatcaccttcaccgagccccagatcaagtgctacatgcgacagctgctggaggggctggcgcactgccatgcgcgcggggtgatgcaccgggacatcaagtgcgccaacctgctggtgaacaacagcggcgagctcaaggtggcggacttcgggctggcgaacctcttcgcgccggcgccggcggcgccgctcaccagccgggtggtcacgctctggtaccgcccgccggagctgctcctgggcgccacggcgtacgagccctccgtcgacctctggagcgccggctgcgtcttcgcggagatgcacgcgcgccggcccgtcctgcagggccgcaccgaggtcgagcagatccacaggatcttcaagctctgtggctcgccgcccgaagacttctggcgccgcttggggctctcccacggcgccgtcttccgcccgcagcaaccttacccgagccgcctccgggacaccttcgccgcgtccatgcccgaccacacgttccgcctcctcgccacgctcctctccctcgaccctgccggccgtggcaccgccgccgccgccctcgacgccgagtacttcacgacggcgccatacgcgtgcgagccggagagcctgcccaagtacgcgcccaacaaggagatggacgctaagctccgagaagaatctagaaggaggagcaaccttccgagccaaggcggcgaggcggataagggtctgtcgagggggcacaagagcatgcggctgcaggacacgaaccagagccacgtgcacgccgaggaatcgctgcccgttgtggccgaaaacggggtgacaatggcggggaacgacggcgactcgcggctgttcgtcgacctggagcccgttccggccatcagcaagcggcacggcggcagcgtcggcggcgaccacgcggcgccgtgcgccagggctaggaccatgtccaccagcttcaaggagccgccttgtgtcgccgaacacctccctctctctggccccgtgcagctcgcggcgtccaccggcttctcctgggccaagaagccccggcccgacgccacgacggcggcggtaactgtgacgatgcggagcggctccatggggccagggaccaacaggaacaacaacagcggaggaggagacggagcaagaaccacctccggctccggcgccaccgccaccgccacagcagcggcggcaccatacgaggcggagaagcaggaggtgatcaagcagtgggcacaggtcgctgacgccttcagcgcctctgaagcttacaacagcaggttgaggcagacgcttgacgccaagcagctcaagactggaatgatgcacaaggggaaggtgaacagggtggacttctcagggccgctgctgtcgcagccccggcgcatcgacgagctcctgcacatccacgagcagcagatccggcaagctggtcgccggccatggttcatgaaaggcaccgaggaggaggagcactgatggcagagacacggcatggacacaactaaacgcccatcagatttgcacgtacttaccacagagcaagagaagatgctggaaacatatcaaaggagttggaccgtgagctagctctcctgatgagcaggtgttttttcagggccggggacagacaaacgagtcggcctcatgccatcagggaagagctcagatggaagctgctgtagtggttttcaggtttcatgcaaccagaatttgctctacgcctctacctgaactagacaacaatgttgttgttgttggtgttgtataagatctttttgtgctcgcttgtgatgataatatgcatgacaagctccaaaatgtggtttccaattacatgatccatttgctactacagatggttgagtaatgatttcttgttcaactagtcacctgtatcaggtgtgctttacctgtttgtgtttccttccctacattgtaattagtgtttttgaacttgcctagttatgccgcaaattgcttatgacttttgcatgtgaaccatagtaaaagagagcatattattagcttgtatctaaaaaaaaaaaaaaaaaaaaaaa

SEQ ID NO: 20975 - DNA, 891 bp, Zea mays
gccggccgggccccggagctctagtcttcgtcgcgtggttccacccccacacgcatcacccaccgcgcgccgcctcgtgcgtgcctctcaactccgtctcgttctgcagcggctctcgccggtggtctggcagcagcagccatgatgatggcgtgtgccctcgccgtcgcccagccagcagcatctctcgcgccgccatccggcaagaggaccctctccggcggccgccccccgcggctgccacctcccaggctttcaggtaaacttgccttcgccacaccgtgctgcgtgcgtggtgcaggcaagctaataaggagccgcgctgccgttgccaaggctgcgcaggacggctcggaatcgtccgggagcatagtgaaatacgtcacgagctctttcagcaccgcggaagacatttttgccctagctggtataggctttgccgcagtagctgcattatgggcttcggtcaacctcattgagatcatcgacaagctcccggtccttcctcttctctttgaactagtcgggatattggttgcatggcttttcatctacaacaatctcctcttcaagccaaaaaggaaagaatttctagagaacatcaaaagctcaggatctcgaatcctggggcagtaacctttgtaggcgacagttgacagcaagcactctgtcatgggttctctgcaagcatgccgaatgtaattatgcaatgtaactgtatgcaagctatgggtgttaccattttttattgtataagcatcaccaattttctgtacaggttagtgtgattaaaatcgttctcctagtaccagaacttggacttgtacgagcctaataagaacatacgcccgaatccttcctgaactgaatgcgtcggctattgaatttcac

SEQ ID NO: 20976 - DNA, 944 bp, Zea mays
aatctgcaaaccagacatccgatgctgcgtgagtggacgagagggctccggctcacatctgctgcgcccgccgcagcaagacgcgccggaggaggccaagcaagcagctctagtcttcgtcgcgtggttccacccacccccacacgcatcacccaccgcgcgccgcctcgtgcgtgcctctcaattccgtctcgttctgcagcggctctcgccggtggcctgcagcagcagcagccatgatgatggcgtgtgccctcgccgtcgcccagccagcagcatctctcgcgccgccatccggcaagaggaccctctccggcggccgccccccgcggctgccacctcccaggctttcaggtaaacttgccttggccacaccgtgctgcgcgcgtggtgcaggcaagctaataaggagccgcgctgtcgttgccaaggctgcgcaggacgggtcggaatcgtccgggaccgggagcatagtgaaatacgtcacgagctctttcagcaccgcggaagacattttcgccctagctggtataggctttgccgcagtagctgcattatgggcttcggtcaacctcattgagatcatcgacaagctcccggtccttcctcttctctttgaactagtcgggatattggttgcatggcttttcatctacaacaatctcctcttcaagccaaaaaggaaagaatttctagagaacatcaaaagctcaggatctcgaatcctggggcagtaacctttgtaggcgacagttgacagcaaccactctgtcatgggttctctgcaagcatgccgaatgtaattatgcaatgtaactgtatgcgagctatgggtgttaacattttttattgtataagcatcaccaattttctgtacaggttagtgtgattaaaatcgttctcctagtaccaggacttggacttgtacgagcctcgagccgaat

SEQ ID NO: 20977 - DNA, 900 bp, Zea mays
ctaaaagggggtccacattaaaatcaatgccctttgtttgtgtttttttttgaaggaaatcctggcatagtttctgtattttgccttgtacatcacccgatatgcattgccatctaatattaactttcatattgtaaccgaaaatttaacaatcctgataagtgaccctctatgctatcatttagggctttcactgccaaaattcccctaggctacagattagattgaaaccatgacaagacatgatcagtatgtactaccaagtatcgaaatgggcatcaaagggtaaagaagtgcagacaactaaaagaattctagtggtgttttttctccaagcttgcaactgcctgtttctggcgcttctcccacgccggaatcttccccgggaacacccatcgcaggagccgctcccatccgtagcaaccacaaaacattagaatagcccacaacatcaatttgccacgcattccctctggcaaaggttcaagtttcatgtagtcattcaaacccctgaacatatctgatgtgatcactgtgaagaaagcaaccgctccatacaatgcatacttgaagggcttgttctcggatatgctctgattaaatgggtggcccatgtagtttacagcaaaggttgccacctggatcatcatgttcaccatgtacgaaaccgtattcacaaggtttggatggaagtctgagtcaggctcaatgcattcctctggcatatgctttgatgcttcattgacagccgtgataaggaagaatatgtgcatggcgaactggccaagaatcgagagcagaacgtatgcacagaatatgttaggctgaggccgctctgcagacagcgtttggagtggccgggcatgggagatgaagaggaagaaggctgcagtaaagacc

SEQ ID NO: 20978 - DNA, 984 bp, Zea mays
cccccccgacccaacggttgcagcataccttttgataagcgaatagcgtgcgcgtcagcggccccgcttccatcgggttaccgcgccagcgtggcgctttgatacacgagtagcttccctgttcattcagttgctgaatgttggtatcgctgcctttgacatggcatgcccatctacatttttgatttccttttgtaactgaaagttttaataatcctgctgaccagtatgcaaagtgccgaccctgtgtatcctcctatcatttagggcctacactccaaaaaaattcccctaggctacagattagaatgcaactatgacaaaacatgatcagtatgtactgccaagtaaccaatgggcagcagcaaaaggtaaagaataaagtgcaaataataaaaaaggattctagtcgcgctttttctccaagtttgcaactgcctgtttctgacgcttctcccacgccggcatcttccctgggaacacccatcgcaggagccactcccatccgtagcaaccacaaaacattagaatagcccacaacatcaacttgccacgcattccctccggcaagggctcaagcttcatgtagtcattcaaatccctgaacatatctgatgtgatcactgtgaagaaagcaaccgctccatacaatgcgtacttgaagggcttgttctccgatatgctctgattaaatgggtggcccatgtagtttacagcaaaggttgccacctggatcatcatgttcaccatgtacgagactgtattcacaaggtttggatggaagtctgagtcgggttcgatgcattcctctggcatatgcttggatgcttcattgacagctgtgataaggaagagtatgtgcatggcgaactggccaagaatggagagcagaacgtatgcacagaatatgttagggtgcggccgctctgcagacagagtttggagtggccgggcatgggagatgaagaggaagaaggctgcagt

SEQ ID NO: 20979 - DNA, 7059 bp, Zea mays
  misc_feature (2453)..(2453): n is a, c, g, or t
atttaaattaaacgggctatatgaattatgatgcatatcaaagctgcatccagcctattgcgggaaatggcaactgtcgttagcacagtccctgtgacaggatattcctctgcaatcaggccaccaacaagagttcaagaagcagcatgatttggggggccagccaagtgcctaagcccccacatgcaccaacaggaggctatcaactaggagtagagaggaggctgcgttctcttcttgacgcaaaccatacattaagttcatacactcgcagtccttttcccctttatacagatatatagacggacacgtacaactcatccgtcaggtaatcacatgaacaaacatatgtatgatgggtttttttttccgtgaagagcaagcacagaaacataagcaggcattatgctcaatatactcactatatatgcttgatgctgaccagccaacagatcctgatctctctcttgttatttctcattctacagctccagcaccaagtctgcatccagtcagagagaagagattctgaatcagtacagtataaatgtataatgcacaatgcaggacaggacacatcatggtcatggcaccgtaagactgaattgacagctccacaagcagattcttcgccgataacagtatggaaaagtctctgtcaagactgccttttgcggatgcaaagttaattgttgattgcaaggtgtatgcatggatgcatggacggggatggatgaaacgaatatgcgctcacattcagcgtcggtcttgatccagtggccgctcttgctgccgttgagctcgtcgtcgtcgtcgccgtcgatgggagaggcggcgccgccgaaggaggcccggctggcgcagcagccgaaccccggcgcgcgctgctccttgaggcaccggagcttggacgccgccggctccggcttgtggtaggcgccgctgccgcgcttgcggctcttcttggtcaggttccgcgccagggccgcgctctcggggtacactttcctgtggaagatctggaggatctgcaaacggacagaatcaatgcttctctgtttcagaactgcctcgtcatatttttttcaggattcgacagaatgaaaaattcaccatctagaattaatggcgccagttatatggaatgggaaacgagtagaaggttgttcaaatgattaataaaaaaacaaaaaaaaaaacaaaactgtccagagattatcttatagggataatacatacatgcatgcacagaattaaagattgaatgataaacaaagtcctgtcagatcaagtccaattgttgagttggatgctaaggataacatgacaaatgcaatgagccatgaagataacacttgacaagagattgcaaacaagaggccgtgtcaaactcgccagccccacttctaacaacaacttgactcctagtgctggttggtgtgccagatctataacatataagtggacgtctcatcaaaagggttgtcggatatgattgcttaagctctagagaaatctctcccccttcctgttttggacattactttggtttcgatatatacacttgctcgaaagtagtacagataagccatatatacattgccttggataaactagctaattcctttataagaagattttttttaaaaaaacacacataggcagttcaaaaatttgaatttaacgaaattcggttatgtgggtggtgggccgaataaaaatacttaagttttgcatgacataaataaatgtgttatgtaactctatacttatattctcaattatttatttatttatttattcctctactcaatactctctctgtccaaaaataaatcaatttctaataatgtagaaattgatttatttagggacgagagattatatatgtagtcataaaccatactactatttttcagatttataagttttataaaacattgcacttcatgcatatgtctttaaaactttggaacttttagctggattttacaaatttcaatatttttagagatggcaaaaaaaattctaataccaatatcaaaacactggtaaagggtgtgcatactctacatatgtaaatgcccagcacttaatatataagattatcaagatatagaaaaagttaaatatcatttatgtgacatataaaaaatcttctctacaaactactaatcaaaatttgaagattacagtcattgtgagctttctataagatgcacttaaaggagaatggagaaggtaggaggacattcacgtgcaattgattggtttgagttgtgttttctttgacctgcttgatagaactgtatatctttgcagtgtgccaaatggacccaatgtttatagagaacttgaaccaatgaaccaaatttaaaaggttggttcaatgtcaaaaatttgtacatatatagtagataattatatttcactaaaaaagccctcaaacacanaattagagagataataagaataattgtctgactaagtggagtgttctctgtgcatggaaagattttggtgggctataaataattaatctaaaattacaaaatagatgccttttgcataagtggttttttaggttaatcaataagaatgggttttagcaaaaccttctaaaaaaagaaataattgtccaacaaatctcttacataggtgcaacataagcctagggattcaaattttggggcaggccttatggaagctaaggcaaaatttcaagcttgtagtaattttaaggtgcagagtgatgaataggtgaggttttagatggaggtggttagaagacaaaccttttagaggaatttattataatttatataaaactgtgaggcgaaaagatgataaggtggtaaatgtactacagatagcatcacttaatgtgtcctttaggtggggattagttattgtcaattggaatgtctagcttgacttagggtcaaaagttgcacaagattgcctctcaaataggtaagatattttttatggaacctcaggtagaatggtttgtttacgacccctcctatatataatattatgatctaataaggtgttctacttgagaaaagccgtatttaaaaataaaaagtatcactaaaaattaagattttcttgtggtataaaaaagggtgacaccagaaagataatttagcaaatagaaatcaacaaagaagtgttaagtgttgtctttgtagttcagttgaaactatccaacatttattctttactagctttgttttagagtagtgactgaaaatatcacttttagaatttaaccaattactagcatttgctaaattgtttggttcttaacgacgttatgacttcaacggcgacctgtgctatagcgtatagtgaggaggagcgtccactttttaaaggcttgttcggttaggagtaaattaaagaagatggagaggaagaggaattgtaaaagatggaaggccttaataatgacagtttttgtgaagcttgggttgaatctatgcttagtttttttttccttgtacgttgtggtcatctagttgggctaaacattgttttccacgattgttcgagtcttatgaccttggattgtattctaacaatcagttgtgctggggatgatagaggcaagaataaagttccaccttccctgtggatcgtcgggcggaccttgtgaaacttgctcttggtcactgttgcactcgcctgcgctccgtcacctctggggaccttttcatcctttgcactcctcttcttcgttgtcttgtggccgccgccgcctttccctgctttcctgtcgtccctttcaccgccagcaccaatgtccccgccgtcctcaccttcctcgacggcgacgagcgccaccttctcttcggcgaagcgcgtgcgcatgaacagctcgccgagcgaggtgcgccggccgccgttgctatcccgcggctgctccaggcgcgactcggcgtcgctcaccggggaaccgaacaggaagccctgtagcgggcagtccacgcccatggcaaagctcacccgcgccgacgccaccaggtcaccggcggtgccgctgttgcggccaccgaggaccttctccagctcggcgctcaccaccatgaggtcatcctcagtggtggtgtcgtcgtccttctcggcaatggcctcaaccacggcaactgcagccttctcgacgaccgtggcgtcctctaccggaggcggcgctgcatatgtgaacgtgggcgtgacggcgctgtcgacctggtcttcgtcatcaccggcggtgtcgtcgttgtcgtcaaagtcggagtcagcatcggcgtcgacgtcgtaatcaacttcatcagcatctgcagacaccgcgacggcggcgatgcctagcgtgccaatggtgaggaggccgctgccaccaaaggtgaagaggtcggcggccggcgacgatggatgattgttggtgaagtcgttgtcggcggcgaagtattcgttggcggtggcgaggaaagtggccgggtccgcccacgcgtccgccggtgatgcagttgcagggcccgcctgcagtggcatagtttgtaaggctatgtttcttgagtttctgtgaaatggtttagggtgatttttaggtactttttgcattagtgcgaactctttttaaagccagctatatgaaagtttaacaaaaaatagtattagaataaactttgtagcgatacaagtagatgtgccaattttgtcaaagaaatcaaatagaatcattttgaaatttagttttctagaaatacatatttgtcctatgttatagatatgttattgaagtttagtatggttcacttcagacaaccataaaccttaattttgttactataagggctggtttgatgacaagaaaatgaaagaaatttataggggagaaatcctcttgctatttgaattttaatagcaaggagattcctctcccatagacctatttatttctctggtcaccaaatcaggttgtggaacatgcacacctagtttcataagaaatgatgctattcacctagcagtagggatcggccgattgcgaggcttctctcaagcaaaattatgaatatttagtaacaagtactccattcgttctaaaataatagtcgttttagcttttgaataccacattgttcttaaagtcaaagcaatgggggcaaaaacttgtgatggtaagataaaaacaatctgaaattaagatctccacaaaaaaaaaattaaaaccaaaattgagtattttgttttcctatggaatatgtacggtgtcagctaaggtggtcagtacggaatttacatatggacagcttctgttaaatcgatcaaatatttaaattcgaactggatgtcctgacattttttcagcccacactaagctatacgaaaataccaacacgtggtatatgactaaaaaacgcgcgtgaaaaaaaaatcctgcaatacataccttgcaaaaaaatgaggatgccttcgtataggacaatgttgctataaagaaatactccccttattctaaaatataagtcgttttaaaactaattatacatttattaaatattatataaatgtagtttgtatgtatatttatatttattatcatttaaatgaacacggacagaaaataggtggattagaaagaactatatttcgagactgtcgagctagactaaaagctggaaaggaatggcatgtgccagagtccagtccaatgtgacaaacagcaaaagttcagggacccgttcaaaacctagcgttcttctgaaactacactatgcacggactgtggctgacgtgtggagcacaggaggattgtgtgctgagctggctccacatgtgtgcctgcttgtcagttatgatcaatcacttcatgatctatgaaagatgagcatggaaagtctgctttcgtttctcttcttgaccatggaattaaaagcaagaagagggcaaaactgaagagatgtttgatgaacagatccaataaaaaaagtgcaaggaagaagagggcagatggatgaatgtacctgcagcgttgttgaactctttgaacacatcattgctgttctgtcgtaacttccggtgcatccaacccaggagctgatcacacacacacacatgcatgcgttaaaaaaatgggtcataattcagaaacagagctcttgttgcctaccaatcaactgactgaaccgcagcacaaacaattcagagcaagctaattagggaggcgtagagaatgatttgcagctgcattggtgctctattttttttactcacaaaaccaccgtcgctgaacaggtcaaaagaaaagagggcgataattcgagaactccaaaacgaaatcagttgactagcgaactaggtaggaggagcatgggaattgaggaagaaattgaagcaggtgggactactgactgaccttcatgttggagaggcttgtctaagccgagcgctggagctacacgagccattaatagacgatggagtagcggcgacgcactgcagctgcagctgcaggagtgatccatcagtcggcagaacggaacatgaagaaggctacaaatggtcgacaagaggtggtgtcccacgtctaagggggtgtttgcttccacgcacatcgaacgtttagatgtaaaatatgagtattaaaatatagtttaatcataaaactaattatatatatataaattaaatgagtattaacctatggaccgagtcccttggatttcgattttgagtatcccggctgaatccgagttgcacagtccaagtccgagtcactccaccgaatccgagttgctcggtcctattagtcagagtctttattatcgacatgccttaggtaccccgctatatatccttaattttcttggaatatataaatagagtccctcctggtcagaagaattccaaaaagatgaaaacccaaagatagccttcaacaatcttggaatatactctctccgtcccaaaatagtattcgttttaacatatcagtggattcatacaatatttgatgtatgtgtctagattcattttcatccatctgaatatggacacaaaaatgagagc

SEQ ID NO: 20980 - DNA, 1679 bp, Zea mays
ttttttttttttttttatttttttttttttgtgtggtggctgcgttctcttcttgacgcacgcaaaccatacattaagttcatacactcgcagtccttttcccctttatacagatatatagacggacacgtacagctcatccgtcaggtaatcacatgaacaaacatatgtatgatggggggttttttttctgtgaagagcaagcacagaaacataagcaggcattatgctcaatatactcactatatatgcttgatgctgaccagccaacagatcctgatctctctcttgttatttctcattctacagctccagcaccaagtattcagcgtcggtcttgatccagtggccgctcttgctgccgttgagctcgtcgtcgtcgtcgccgtcgatgggagaggcggcgccgccgaaggaggcccggctggcgcagcagccgaaccccggcgcgcgctgctccttgaggcaccggagcttggacgccgccggctccggcttgtggtaggcaccgctgccgcgcttgcggctcttcttggtcaggttccgcgccagggccacgctctcggggtacactttcctgtggaagatctggaggatcttgtgaaacttgctcttggtcactgttgcactcgcctgcgctccgtcacctctggggaccttttcatcctttgcactcctcttcttcgttgtcttgtggccgccgccgcctttccctgctttcctgtcgtccctttcaccgccagcaccaatgtccccgccgtcctcaccttcctcgacggcgacgagcgccaccttctcttcggcgaagcgcgtgcgcatgaacagctcgccgagcgaggtgcgccggccgccgttgctatcccgcggctgctccaggcgcgactcggcgtcgctcaccggggaaccgaacaggaagccctgtagcgggcagtccacgcccatggcaaagctcacccgcgccgacgccaccaggtcaccggcggtgccgctgttgcggccaccgaggaccttctccagctcggcgctcaccaccatgaggtcatcctcagtggtggtgtcgtcgtccttctcggcaatggcctcaaccacggcaactgcagccttctcgacgaccgtggcgtcctctaccggaggcggcgctgcatatgtgaacgtgggcgtgacggcgctgtcgacctggtcttcgtcatcaccggcggtgtcgtcgttgtcgtcaaagtcggagtcagcatcggcgtcgacgtcgtaatcaacttcatcagcatctgcagacaccgcgacggcggcgatgcctagcgtgccaatggtgaggaggccgctgccaccaaaggtgaagaggtcggcggccggcgacgatggatgattgttggtgaagtcgttgtcggcggcgaagtattcgttggcggtggcgaggaaagtggccgggtccgacgcggccagcccggtgatgcagttgcacgtcccacctccagcgttgttgaactctttgaacacatcattactgttctgtcgtaacttccggtgcatccaacccaggagcttcatgttggagaggcttgtctaagccgagcgctggagctacacgaggaattaatagacgatggagtagcggcgacgcactgcagctgcagctgcaggagtgatccatcagtgatgttctaggtaatggtctcgtgctg

SEQ ID NO: 20981 - DNA, 1186 bp, Zea mays
agagaggaggcagcgatcacatcttgacgcaaaccatacattaagttcatacactcgcagtccttttcccctttatacagatatatagacggacacgtacaactcatccgtcaggtaatcacatgaacaaacatatgtatgatgggttttttttttctgtgaagagcaagcacagaaacataagcaggcattatgctcaatatactcactatatatgcttgatgctgaccagccaacagatcctgatctctctcttgttatttctcattctacagctccagcaccaagtattcagcgtcggtcttgatccagtggccgctcttgctgccgttgagctcgtcgtcgtcgtcgccgtcgatgggagaggcggcgccgccgaaggaggcccggctggcgcagcagccgaaccccggcgcgcgctgctccttgaggcaccggagcttggacgccgccggctccggcttgtggtaggcgccgctgccgcgcttgcggctcttcttggtcaggttccgcgccagggccgcgctctcggggtacactttcctgtggaagatctggaggatcttgtgaaacttgctcttggtcactgttgcactcgcctgcgctccgtcacctctggggaccttttcatcctttgcactcctcttcttcgttgtcttgtggccgccgccgccgcctttccctgctttcctgtcgtccctttcaccgccggcaccaatatccccgccgtcctcaccttcctcgacggcgacgagcgccaccttctcttcggcgaagcgcgtgcgcatgaacagctcgccgagcgaggtgcgccgacgtcgtaatcaacttcatcagcgtctgcagacaccgcgacggcggcgatgcctagcgtgccaatggtgaggaggccgctgccaccaaaggtgaagaggtcggcggtgaagtattcgttggcggtggcgaggaaagtggccgggtccgacgcggccagcccggtgatgcagttgcaggtcccacctccagcgttgttgaactctttgaacacatcattgctgttctgtcgtaacttccggtgcatccaacccaggagcttcatgttggagaggcttgtctaagccgagcgctggagctacacgaggcattaatagacgatggagtagcggcgacgcactgcagctgcagctgcaggagtgatccatcagtc

SEQ ID NO: 20982 - DNA, 2885 bp, Zea mays
atgagaggacagtggagtgaaagattctgaagaagggagtgataacatagggagcaaaggaagtaaataggaggggaatcgaaatgttactcattatccaaaacttatttagggggagagtggggaggtggctttaaggaagggtggcaagacaggttttcgtccctgaaaaacgggccgttgtggccaacccaattaagtgggattagccctaccatttggcgggccaggcttatacacatttaatgattacggattgtttgttgggtgaatttgtgagcgggttaccatttcgcgcagggagcagctttggccatggtttccgcaaagtttgaaattaaccctccataaagggacaaaaagctggggtctcgccgcggtggcgaccggtgtagaattagtggtacccccgggctcgagggagagagaggtcaatagtttcccccctcccccccccccccgcgctcccctctaccgcctccgcaccgcagagccgcagccaagcaagctgcgcccctggacttggcctcaccggtgaagcggagctcgaggataggcggtgctcgggagataccaagcggtcggccgcaggcgccacgtcggcggagatgacggacggtcaccacttcaacaacatcctcctcggagggcgcggcggcacaaaccctggtcagtttaaagtgcattctggtggacttgcatggaagagacaaggtggaggaaagaccattgagatcgacaaagctgatgtaaccgcagttacttggatgaaagtccccagagcatatcagcttggagtcaggattaaggctggcctgttctacagatttattggcttccgtgaacaggatgtaagcaacttgaccaacttcatacaaaagaatatgggtgtcacaccagatgaaaaacagctttctgttagtggccagaattggggagggattgatatagatggtttgacttcaatgtttgttactcttgcctctgtaggaaacatgctaacctttatggttggttcaaagcaagcatttgaggtgtccctaccagatgttgcacaaacccagatgcaaggaaaaacagatgttctcttagagcttcatgttgatgatactactggagccaatgagaaagactccctcatggatttgagttttcatgtgcctacttcgaatactcagtttgttggggatgagagtcgccctccggctcatattttatgggagaccatattgaaatttgctgatgttggttcttctgaagaaccagttgtcacatttgaaggaattgcgattcttacaccaagaggacgttatagtgttgaacttcatctgtcatttctgcgactccaaggacaagctaacgattttaaaatccaatacagcagtattgttcgcctctttcttttgccaaagtcaaacaatcctcatacatttgttgttatcactcttgacccaccaatccgtaaaggacaaacattgtatcctcacattgttattcagtttgagacagaggcagtagtggaaagagatctggcattgagtaaagaactgttggttgaaaaatacaaggacaggcttgaggaatcttacaagggtctaatacatgaggtatttaccaaagtccttcgtggtctatctggtgctaaagtcacaaggccaggttctttcagaagttgccaagatggatatgcagttaaatcatctctcaaagctgaagatggactgttgtatccacttgaaaagggtttctttttcctgccaaagccacctacactcattcttcatgaggagattgagtttgttgagtttgaacgtcatggtgctgggggtgccagtatatcatctcactattttgacctccttgtcaaactgaaaaatgaccaagagcatctcttcagaaacattcaaaggaatgaataccacaacctcttcaatttcatcaatggaaagaacattaaaataatgaaccttggaggagatggtcaaggtgcaagtggtgtagttacagatgttctacgagacactgatgatgatgctgttgatccacatctagagcgtattaagaatcaggccggggatgaggaaagcgatgaagaggatgaagattttgttgcagacaaggatgatagtggatctcctactgatgactcaggtgatgaggaatcagatgctagtgatagtggtggtgaaaaggagaaatcatccaagaaggaagcaagcagttcaaagccagttcagaaaagaaagcataaggccagggatgacgaaggacaagagaagaaaaagccaaagaagaaaaaagatccgaatgctccgaaacgagccatgaccccgttcatgtatttctcaatggctgagcgaggaaacatgaagagcagcaacccagatttgcctacgactgagatcgcaaagaagcttggggagatgtggcaaaagatgtcaggcgaagagaaacagccttacatccagcaggcccaggtcgacaagaaacgttatgaaaaagaatccgctgtctatcgcggtgaagctacagtcgatgtggattctgggaacgagtctgactagagatccaagctcttgggctggcatggtggcacgggatgaaagtctagtgccatgtgtgctattgttatgtcagcaactgttgcctccaacattgctgacagtaaagagagtttctctcgcagcgtacctctgcagggcaaaagaatgtacgagtgtagtctagtgattttgtgtaaaacaaccaacatacgtggttttctgagagatggtaagacgtcaatttaactgctgtcgattggctgttttgcctcctaaaaaaaaaaaaaaaaaaaaaaaaaaaaaaaaaaaaaaaaaaaaaaaaaaaaaaaaaaaaaaacctcg

SEQ ID NO: 20983 - DNA, 2401 bp, Zea mays
acctcgaggccggccggtgaccatttcgctgtggctctatatgacaaacatcctcgctgcgccgcgcgctcccctctaccgcctccgcaccgcagagccgcagccaagcaagctgcgcccctggacttggcctcaccggtgaagcggagcttgaggataggcggtgctcgggagataccaagcggtcggccgcaggcgccacgtcggcggagatgacggacggtcaccacttcaacaacatcctcctcggagggcgcggcggcacaaaccctggtcagtttaaagtgcattctggtggacttgcatggaagagacaaggtggaggaaagaccattgagatcgacaaagctgatgtaactgcagttacttggatgaaagtccccagagcatatcagcttggagtcaggattaaggctggcctgttctacagatttattggcttccgtgaacaggatgtaagcaacttgaccaacttcatacaaaagaatatgggtgtcacaccagatgaaaaacagctttctgttagtggccagaattggggagggattgatatagatggaaacatgctaacctttatggttggttcaaagcaagcatttgaggtgtccctaccagatgttgcacaaacccagatgcaaggaaaaacagatgttctcttagagcttcatgttgatgatactactggagccaatgagaaagactccctcatggatttgagttttcatgtgcctacttcgaatactcagtttgttggggatgagagtcgccctccggctcatattttatgggagaccatattgaaatttgctgatgttggttcttctgaagaaccagttgtcacatttgaaggaattgcgattcttacaccaagaggacgttatagtgttgaacttcatctgtcatttctgcgactccaaggacaagctaacgattttaaaatccaatacagcagtattgttcgcctctttcttttgccaaagtcaaacaatcctcatacatttgttgttatcactcttgacccaccaatccgtaaaggacaaacattgtatcctcacattgttattcagtttgagacagaggcagtagtggaaagagatctggcattgagtaaagagctgttggttgaaaaatacaaggacaggctcgaggaatcttacaagggtctaatacatgaggtatttaccaaagttcttcgtggtctatctggtgctaaagtcacaaggccaggttctttcagaagttgccaagatggatatgcagttaaatcatctctcaaagctgaagatggactgttgtatccacttgaaaagggtttctttttcctgccaaagccacctacactcattcttcatgaggagattgagtttgttgagtttgaacgtcatggtgctgggggtgccagtatatcatctcactattttgacctccttgtcaaactgaaaaatgaccaagagcatctcttcagaaacattcaaaggaatgaataccacaacctcttcaatttcatcaatggaaagaacattaaaataatgaaccttggaggagatggtcaaggtgcaagtggtgtagttacagatgttctacgagacactgatgatgatgctgttgatccacatctagagcgtattaagaatcaggccggggatgaggaaagcgatgaagaggatgaagattttgttgcagacaaggatgatagtggatctcctactgatgactcaggtgatgaggaatcagatgctagtgatagtggtggtgaaaaggagaaatcatccaagaaggaagcaagcagttcaaagccagttcagaaaagaaagcataaggccagggatgacgaaggacaagagaagaaaaagccaaagaagaaaaaagatccgaatgctccgaaacgagccatgaccccgttcatgtatttctcaatggctgagcgaggaaacatgaagagcagcaacccagatttgcctacgactgagatcgcaaagaagcttggggagatgtggcaaaagatgtcaggcgaagagaaacagccttacatccagcaggcccaggtcgacaagaaacgttatgaaaaagaatccgctgtctatcgcggtgaagctacagtcgatgtggattctgggaacgagtctgactagagatccaagctcttgggctggcatggtggcacgggacgaaagtctagtgccatgtgtgctattgttatgtcagcaactgttgcctccaacattgctgacagtaaagagagtttctctcgcagcgtacctctgcagggcaaaagaatgtacgagtgtagtctagtgattttgtgtaaaacaaccaacatacgtggttttctgagagatggtaagacgtcaatttaactgttgtcgattggctgttttgccccctctcaaaaatcaaaaaa

SEQ ID NO: 20984 - DNA, 3905 bp, Zea mays
  misc_feature (3875)..(3876): n is a, c, g, or t
  misc_feature (3883)..(3883): n is a, c, g, or t
gcggttggaggggggcgatgcggactccccgtacagctccacggcggtcacagcggcggaggaggaggaagtgggggagagaggtggaggaggagacgaggtggattcagcggccacggcgacgccgaggcggttgtcgccgagggcagcagcgagccccacggaaggcgacgcccggtggggtgacaccagctcgtacggcgctaagaagaagcatagagttttttgtcagcttccgaatggcgattgggcattatgcacacgtcaattacttcctctggtgcatgagtcggttgtaaaggtttctgaagggaaggtactgagattgaaaaccgagtgtctacaacctgcaaatcctgaaattcttgatggagtggatgatcttatgcagctaagttatctaagtgaaccatcagtactgtacaatctgcagtacagatactccaaggatatgatttatactaaagcaggtccagttttggtggctgtcaatcctttcaagaaagtttcactgtatggtaacgagtacatcgatgcatatagaaataaatcaatggatagtccacatgtttatgcaatagcagatgcagcactttgtgaaatgaaaagagatgaagtcaaccaatctataattataagtggtgagagtggagcaggaaaaacagaaaccgcaaaaattgctatgcagtacctggcttcccttggaggtggaagtggcattgaatacgaaattcttcagacaaatccaatactcgaggcttttggcaatgcaaagacattgagaaatgataactcaagtcgttttggaaagcttatagaaattcatttcagtaccactggaagaatatgtggtgccatgattcaaacatttttgcttgagaagtccagagttgtgcaatgtgcagttggtgagcgatcataccatatattttatcagctgtgcgctggtgcacctgcctctctaaaagagaagttgaatttgaaaaaggtggatggatacaaatatcttaagcagagctgttgctattcaattgcgggtgtggatgatgcccaaatgtttcgaactgtgacgcaagctatgaacattgttcatatcagcaaagaggaccaagagagtgtttttgcaatggtctctgctgttctttggctgggggatgtctcgttcacagtaattgacaatgaaaatcatgttgaaatcatagtagatgaagcttcgaaaacggtttcagaacttcttggctgcagtattgaagatctcaatttagctttatcaaagcgccacatgaaagttaataatgaaaacattgtccagaaacttacccttgctcaggcaactgacacaagagatgctctggccaaatcagtgtatgccagtttgtttgagtggcttgtagaacaaattaataagtctctctcagttggcaagcgtcgaactgggagatctatcagtattcttgatatctatggctttgaatcatttgataagaacagttttgaacagttctgcattaattatgctaatgaaaggttgcagcaacatttcaatcgtcatttgtttaagcttgagcaagaggaatatgtggaggatggcatcgactgggcaaaggttgacttcgaggataatcaggactgtttgagcctctttgagaaaaaaccactgggactattgtctgtgctcgatgggccccccccccccccgaatgccacagatcttacttttgcaaacaagcttaagcaacatcttgactcgaattcttgcttcagaggggaaagaggcaaggcatttgctgtccgtcactatgcaggagaggtggcttatgatacttcgggttttctggagaagaatagagatttattgcacatggactcgattcagctccttgccaaatgcaaaacttctctgccaaaaatgtttgcatcgaagatgctagttcaatcagataattctatgtctgctccatatagatctagtgctgctgattctcaaaaactaagtgttgccatgaagttcaagggtcaactgttccaacttatgcaaagactggaaagtacaacgccacactttattcgttgcattaaaccaaacaatttacaacttcctgcaatttatgaacaaggacttgtgcttcaacaacttaaatgttgtggggttcttgaggttgtccggatttcaagatctgggtatccaacaagaatgactcaccagaagtttgctcggcggtatggttttcttcttgaggatgttgcatctcaagatccactcagtgtttcagttgcaattcttcatcagttcaacattttacctgagatgtatcaagttggctacacaaagttgttcttccgaactggtcagattggcaaccttgaagatactcggaatcgtactctgcatggtattttaagggttcaaagctgtttcagggggcatcaagcccgtcatcatgcaagagaacgaacaagaggagttttgactcttcaatcattcattcgtggtgagaatgcacggcaaatttactcctctttgttgaggaaacatagagccgcagttgttttgcagagaaatgtgagatgttggcttgcaagaaggtatttcataaatgtccggaaggcctcagtgataatacagtctggtattcgtggcagtcttgttcgaagatgtaatggcaatattgatctaataaatgtgctaagagagtttgaatcaaaacaggaggcacatggtgaccaaattttgatcaaggcctcagtcctggctgagttacagaggcggatactaaaagccgaggccacagtacgtgaaaaggatgaagagaacgagatgcttcatcagcggcttcagcaatatgaaaaccgctggttagagtacgaacagaaaatgaaagctatggaggaaatgtggcagaagcaaatgcgttcgctgcaatcgagcctttccgtagcaaagaagagccttgttttggatgaaacgcctaggatgtcggactcatcagtggatcagagctgggaaagcaatgggaaccaccatgtcagcagcggttctcagctggtgccacacactggtggacgtgaaatgaacgctggcctcagcgtcatcagccgcctggcagaagaattcgagcagcggagccaggttttcgctgatgacgccaagttcctggtcgaggtcaagtctgggcaggcggacgccagcctaaacccagacatggagctccggaggttgaagcagaacttcgactcgtggaagaaagatttcagtggacggatgagggagacgaaggtgatcctgaacaagctcggcaatggcaacgagtcatcgcccaactctgtgaagcggaagtggtggggcaggctgaacacctccaagttttcgtgagtttattatgtattgattggtaatttgtagatgtaaccggtattttacacgccggtgtggttctagcttcctagagtttctactctacgggtgctgtgaaagtccagtgtgttggactggatttgtattccacggagggcgagttgtatagttctcccacaatggcttccttttgaggggtcaaggaccactgaattgtgatgtaattacttgctgaagtagctgtcgaaggggggagattgtgagtgcttaatattccactatcctcgtgctttactttctgcccctcgcccgaagcacatcccgtcgcatcccatcccactaccacccatctcgtcgtccgccgattcgatccggttcttccaacccaagggcagtgatggcgacgaagaggagcgtgggcaccctcggcgaggcggatctgaaggggaaagaggtgttcgtgcgcgccgacctcaacgtcccgctcgacgatgcccagaagatcaccgacgacacccgnnatcgcgnctccgtcccccacatcaagttc

SEQ ID NO: 20985 - DNA, 2241 bp, Zea mays
ggctgaaccaacatgaatccattaatttagccctgaggtagctacaggaagagacggagaagtcagagttcattatgataggtagataaactccgatttatccaaaagaatataagggtatttcatagacaaagcttgtgtacttgtttttgaggatttgacgaacttatcaaacaattcaaaaaagtatcatcgactggatccatgcagattggacgattggtctcacgtcgctggttggaattggccttattacatcacaaacacagcaggaattggtgctccgacatgatacaagacatcaaacatagtaggaatttgtgtgtcaacatgccaatcaagacttctagttgctaaatcactgcaatatggtggcaagagagtaccaactttccagcagataattggttttgatgacgtgcctaaaacgcaggccatccactcactacgcattacgcagaagaagaaaaagaagctggcaatgacagagactcggaccatatctttaaccagcatgacaagaaatcctacaaatcaaggcgttccactctctttcagctgcgactacggagacaggaagcttcaagagaaaatgctgtgcgggggccatatcataaaggcatacactggcatgtggatcagaacgaatgctgacaagcagaagataccatgactgccacctcaagtccccaacagtttcaaaactgacaaaggtttaagtttcacttctcttgagcctcatcattccttgaacctaaatgagcatgtagtgggcctatatctgggacttcttcaatacctacagcaggctgtagaaattctaaaaggcgccatagtaggtaattgatgatcataactaggcaaaacagttttccagcccaagatccacaagtaagataccggggaaggcgatctagtaaatttgttgttggagattccattgcacgatcataaacaatctcagttcttttggcaacatcgtcccaactataaagttctttcatccgaagatgcataatctgggggtctattccaggtagcatgtcgatggctttcttgacagctcttaccatatctccaggagctggttctgcaagtactatcatgtcatctggaagaacctcagggacaccaccgactctagtgctcactgtcaacagtccacagctagctgcttctagaatggctatgcaaaatgcctctgtgagtgaactgttcaaaaatatatgtccagatatcagaaccgatcgcacctgagcatgaggtacagctcctaacatctcaactctatcctgaagggagaacttctccctcatttcttcaaggcgcacacgttttggaccatcaccaccaacaataaagtgaacctttggaaatagccgacacacttctggaatgacttcaacaagaaggtcggcgccttttcggtatactaacctcaagacagtgttctctttgcttgtatgtgagacacatattgcctgatcaatatctgcaagagtaaactgcagaaccttattcatgtgaatgcttccagcatcagcaaaaccataaagtgagtgatctgtgaagacaactttgtaccccattgtcctagcatgcattaatgcttcatgacacagtgttgaaaaagcttgatgtccatgcacgacagaaatcttctctcgaataataattgtccttacaattggaaacgtcaaggatagtgtaggaagtgtattctgcatcaggaatggcctccatggtacataatagacctttaaaccatttgtgacatatcgtactccagatctgtttccatatgcatgtgtcatgacaacaaccttatggccaagcttaagtagacattgtgacaggtagtagatatggctttccaccccaccaaagtttggaaagaaaaagtcggacaccatcaaaatcctgtgctttgtgccttgcccatccattacgttagataacggattcgacgagtaggtcggcacatgcagctaccagatcgagcatccgccggcgcaaatcgacaccagcaaactcagcgtcggaaggcgacaaggagcggatggttgggttggggtgtgggggcgaggggcgctgtgcgggtagagtggaggaggggcgcggcgccggtgctcattgacgattcgaggaccaggccaccactggccgcgtgcctcgacttggcaatggcgcacgggacggcggggccacgaccacgaccacaaggagtgagaaccggccggc

SEQ ID NO: 20986 - DNA, 2220 bp, Zea mays
ggccagtcttgaattccaaacagggccgaaaagagattgcacttattttatattcaaaaagtattatcgactggatccatgcagattggtctcacgtcgctggttggaattggcattattacatcacaaacacagcaggaattggtgctccgacatgatacaagacatcaaacatagtaggaatttgtgtggcaacatgccaatcaagacttctagttgcaatatggtggcaagagagtaccaacgttccagcagataattggtttgatgacgtgcctaaaacgcaggccatccactcactacgcattacgcagaggaagaaaaaaaaaagaagctggcaatgacagagactcggaccatagctttaaccagcatgacaagaaatcctacaaatcaaggcgttccactctctttcagctgcgactacggagacgggaagcttcaagagaaaatgctgtgcgggggccatatcataaaggcatatactgcatgtggatcagaacgaatgctgacaagcagaagataccatgactgccacctcaagtccccaaccatttcaaaactgtcaaagatttaagtttcacttctcttgagcctcatcattccttgaacctaaatgagcatgtagtggccctatatctgggacttcttcaatacctacagcaggctgtagaaattctaaaaggcgccatagtaggtaattgatgatcataactaggcaaaacagttttccagcccaagatccacaagtaagataccgaggaaggcgatctagtaaatttgttgttggagattccattgcacgatcataaacaatctcagttcttttggcaacatcgtccctgctataaagttctttcatccgaagatgcataatctgggggtctattccaggtagcatgtcgatggctttcttgacagctcttaccatttccccggggccgggctccgcaagtactatcatgtcatctggaagaacctcagggacaccaccgactctagtgctcactgtcaacagtccacagctagctgcttctagaatggctatgcaaaatgcctctgtgagtgaactgttcaaaaaatatatgtccagatatcagaaccgatcgcacctgagcatgaggtacagctcctaacatctcacctctatcctgaagggagaacttctccctcatttcttcaaggcgcacacgttttggaccatcaccaccaacaataaagcgaacctttggaaatagccgacacacttctggaatgacttcaacaagaaggtcggcgccttttcggtatactaatctactgaccacaacaataactatttcatcacagtttaagcgcttgggagagggagtaaacattgcagtgtcaactgcattaggaaccatgaaaaccttctctggagatatcccagacctcaagacagtgttctctttgcttgtatgtgagacacatattgcctgatcaatatctgcaagagtaaactgcagcaccttattcatgtgaatgcttccagcatcagcaaaaccataaagtgagtgatctgtgaagacaactttgtaccccattgtcctagcatgcattaatgcttcatgacacagtgttgaaaaagcttgatgtccatgcacgacagaaatcttctctcgaataataattgtccttacaattggaaacgtcaaggatagtgtaggaagtgtattctgcatcaggaatggcctccatggtacataatagacctttaaaccatttgtgacatatcgtactccagatctgtttccatatgcatgtgtcatgacaacaaccttatggccaagcttaagtagacattgtgacaggtagtagatatggctttccaccccaccaaagtttggaaagaaaaagtcggacaccatcaaaatcctgtgctttgtgccttgcccatccattacgttagataacggattcgacgagtaggtcggcacatgcagctaccagatcgagcatccgccggcgcaaatcgacaccagcaaactcagcgtcggaaggcgacaaggagcggatggttgggttggggtgtgggggcgaggggcgctgtgcgggtagagtggaggaggggcgcggcgccggtgctcattgacgattcgaggacgagggcaccactggccgcgtgcctcgacttggccccgcccccctcgccgtgcccacgtacgcgtgcatgcgacgtcatagctcttcgatagtgtc

SEQ ID NO: 20987 - DNA, 2138 bp, Zea mays
ggccgcttttttttttttttttttattctgagttatcaataaattttcctttttccaaaaaaagggccctgccggccgttccgttctttgtttttatgcaggacagtataaccgccatgatcagcactgaaccaactgccaactgaatcattgtttgatgcatattttcccccttggtcatcataacgttggttctaagctgactctttattcttgcaactcttctattgcaggtacaagaacactatagcatggcaacataatcttacagtgtgcaggtgacaagtcggctaaatctaacataacagcaaacatgataactgcaaaacatttattcactcagcccgagaaaatctttgggcaaatattcatcaaagataggttttcgccattagcctgctaggtgtattttgctgctatctcacgcatcaggctttcaggagcttctataccaccggtgaaatgctcaaattgacccatggcttgtctaataaacatttccacaccactaacaactttaactccacattcttctgcttctcgaagaagccgagtaacttttggggcatatacggcatcaaataccacatcatagaaacccaaggctttctttggaataggagtaccatcaacatttgggtacatccccaatgatgttgcattagcaaggatcatcccttcttcaggtctgaaagtttccaggtcttctaatctcagggcctgaccaccaattgcattggcaagacgtacagccttctcataggtgcgatttgctataactaccctcgcacccttctcctttgccccataagcaattgccttaccagcacccccagctcctacaacaacaataagcctaccagccaatggtgagatgacagcatcctttgaccctggacctccaatgccatcctcaatagcagatatagctccaatgtagtccgtattgtaccccactaatttgccatctggtcttctaattatagtgtttatggctcctattgacttagcaactggatcatgttcatcacaacactgtacagcatctactttgaaaggaagtgagcaactaaatcctgaaaagtcaggagatgagtatgtctccagaaaactagcaagattatctccaagaagtggaagataaacagcattatatccaatggactgaagacatttattgtgtaaaattgggctcttgctctgttttactgggttggctataagaccaagaatctttgtatcaggcccaatacactttatgttgtaaatgtccagtaagtcctcaactgttggttgtccagaagctgatgtctttgtagcattcagtatcccaaatgtaagatatccaccaaacttgggcgctaacactcttgacattaaacctttttcactcattacgagtccaatcataggcacttggcagtgtaccatcacttggaacatccgtgatacatcgacaatgtccttggcggttgttgcaactttcactatatcagctccaactgcttgtatactagcgacaagatttgtaatttcctcacatgatggagtatattcataattatgtgaagaaacaataagtttacatttctctggcttatggccagcaataaagctcataaatttgtctgcaaccttcaattcaatatcaacatagtctacacctaattccattgctaaacgtagtgtctcaaatcttgtggtgtcatcaccttcatattggcctccttcccagacaggtcgataggtgacgagggccgggagtgggcagccgcggagcaggggcggtaggtgctcacgcgggcggaacccctggatgaagtcaagccggatctcgaccatgtcgccgccggtggcggcggccgccgccgcgtctgtaatcatctcctccaccgtccgccccaccagcggcacgcacaacagcgtcatgtccacctctgagagtctgctactcctccctttcaaatggctcgccggcgcaggtgaccctgatgcggatgcgaacacgaacgcggatgtgagcaatcggcaatggcagcggccggggacagtctgttggcggagaagggcaagtggaggacgggagttgttggcgaggctgtgaagccctagaaacgggggagagtggcttgggttgc

SEQ ID NO: 20988 - DNA, 1357 bp, Zea mays
tccacgcggcatggagtaaggcgacaatccagacgaatgatgcacagaatgattcttgggacaatgtggccaaaaatgccccggattctgccgcagaagactcctggggggctgcaacaccagcggagacaactgattctggtaacaaggagtggaaatcagatggatggggggccaactctggtaactggagcagccaaagaaataatcctgggagacccccaaggagaccagatgaggggggtccacctccaccaagacaacggttcgaactaacagttgcggagaagaacattcttctagaagttgaacccattaaattacgtgtgagaagcatcttccgtgaagcatgtgacggtgttagacttaatccagaagacgagaagtttatcctggagaaagttcttgagcaccacccggaaaagcaatccaaggtgtctggtgaaatcgactacctaacggtcaacaagcaccagactttccaggacactcggtgctttttcgtggtctccacagatggatcccaggcagatttctcctacctgaagtgcctggagaactttgtgaggaagagctacacggaggacgcggacacattctgcatgaagtatttaaggccccgtcgcaggcaggcaccaccagctgatgttgggacagcatcaggcgccccggatgaggttccaccgtcaaccgcagctgagacagagcaaggcactcctccagcccctcaggcagaggttccacaagagacttggggttctcccgcagtgcctctggaaggaggaactcacatcgccggaccagactcaacaggcgacgctgtgatcctaggggagcagcacgatctgactccggcttctccagctgtggcaccacaagtggcttctgagccagacacaaccgacggcacggggcttctaggaaaggctccgcaagctgactggggacccagattcgacgctgactgatatttaggctgtgtgaagctgccgcatgtaaaagccagacctgtgctctgagcaagggagcattcccttgctaagtcgtcagttaactccccttgacttcatctggagaggtggacaggtagtagcggcaaacattctagcccttagcggccgcttgctcgtcctcgtccgtttcgtctcgccctgatgggaaccatgtaaatccttgggaacaaagctaccccctgctgcctttaccgtatctagttggaccttccccactgttggaatctgtgagtccgtctgctgttaaatttttgatggtttctgggctgtggcttgccagcggtgatgccaaactctggaaacctagggatttgtttggtgcggtcgtttggttgtcaggtcga

SEQ ID NO: 20989 - DNA, 3139 bp, Zea mays
  misc_feature (1584)..(1606): n is a, c, g, or t
  misc_feature (1634)..(1652): n is a, c, g, or t
actagaactaactcatctcttcctctccattgcattttcttcttcctccaaatacgtaacaaacttctacgtgagcgccagggcagttgcgcccatgggaaggcatccgcctgtcgatgaggcgatggacttcaacggcaacggacgggacgaggcaaacccgagcggctctgaggcggggaaccacaacgagcaccgcggcgacgacccctcgcgcgttggccagagcctgcccgccgatatccgccaaaatgggcagccaaccctcggggaggagatcaccgcgccgctgtgggaggagttcgaggcgctcggcatccacgtccgccgctccgagcccgtgttcccgccgcgcccagggtacggcgccgcggggacgccgtacgtcgtcagggccaacctcttcctcggtcgcctcgtcgacgaggccctgcatcagtacaacgtaaccatttcgcccgagccgacgcccaaggccgcgtacagagagatcatgacgaagctgttgtccgagaaccagcacacggatttcgacggccgcttctccgtgtacgatgatggtgactcgctcttcacagccggtgcgctgccgttcgacaccaaggagttcgaggtccccctctctgcaggcggcgacgaaaagatggacaggaagtacaaggtgatgatcaaccatgccgcaacgattagtctgctacagctgaggatgctgttagcgggctatcccacggacatccccgcgcaggcgctcgtggtcctcgacaccgtgctgcgtgacgtcttcaacgaacgcaatgacatggaatgcgtcgtgattgacaaaaaggatcgcacactgggtgttgacgcatggaaggggctctatctgagcatcaggccaacacaaaactgcttgtctctgattgcagacgtgtcctcatctgtattcgttcaacccctgctattgattgaattcgttcagaagatcctaaagatagatgccgtggataggaacttgactaaacctgagtatgacaagctcttgaaggccctcaggggtgtgaggattcaagtcacacacagagataatagacgccgagtatggtcaaagaaaaaagataatagacgccaactctctacgtacagagttgctggcttgtcagtgaatcctactaatgatttgagttttgaatcaaaggttggagtcacaacgactgtgattgattacttcagagaaatatacggcctggaactgaaatacaaatatctcccatgcgtcaatgctggcagcgagcaggatccaatctattttcctatagaggtttgcaagatagctcccaagcagtgttaccagaagaagctggaaggtagtcagttttctactccaaggaagtcagcctggatccatcctgaagccgagcaatcctgtcctcagattgttgagcagaggcagtacaaacaaaccaaacgtgcaaaaaaaaaaaaaaaagaatttgatggcaatcttacaacagttgctgctagagttctgctgcctccaaatcttaagtatgatgattctgtatcacagaaaacatggtttccactggatgggtactggaatannnnnnnnnnnnnnnnnnnnnnnggtgccaagatcagaaactgggcatgtnnnnnnnnnnnnnnnnnnncaaggaagatattaagaagttttgctttaagctggctgaaatgtctcgtattactggactggactttgccgatttgaagctcccaatattcactgcacgtccagatcgagttgaagatggtattcgtaggtgctatcaggaagcgaagaacaagctaagggatcagaagattgatttactgcttgctatactaccagataaaaaagacagtttatatggaaatattaaaaggatctgtgagacagatattggtcttgtgtcacagtgttgtcgaaggtcaagagtcttagtgaataataatcagatattggcaaatattgctattaagatcaatgccaaggttggaggaagaatctcagtattcgatgacgtacagaagagtttaccggttgtttcaaataagccaacaattatatttggtgctcatgtttctcacccttctgttgtagatggttctactggcccttctattgcttctgtcgttgcatcccaagactggcatgaggtgtctaagtataatggtgttgttcgtgcacaaggtcacactgaagagatcggtggccttgaagacattgtcaaggagctccttcatgcatttgcaaacgagtccaaggagaagctccagcagctgatattctacagggatggcataagtgagggtcaattcaatcgaattttggagaaagaaatcccagcgatagaaaaggcttggaacgcactgtatgacaatgagaagccacaaatcaccttcgttgttgtgcagaagaggcataaactgaggctgttccccgtggacgacaactataagatccgttctgctaagaagaaaattgttgagcctggcacagtggttgatagtgagatctgtcacccagcagaatttgatttcttcctttgcagccaatctggtggtatcaaaggcccaaggcgtcctgtgaggtaccttgtactgcgagatgataacaacttcacggcagatgaactgcaggctctcacaaataacctgtgctacacttattcaggcggcaatcgttcgttgtcggtcgctcctcccgcatactacgcccaaaagctcgcacatcgggcccgcgtctacctcgccaaaggctcggacaataatgcagcagctgctaatggtggtcggaagcaaattccagagataaagaatgagctgaaggggtccatgttctactgctagtcctttgcctgctgaacggacgatgcattgttctatagtgaaagacttgagtgtgctctgagtctctgactgacatctggagaaggatggcatctgcaatagtcgccgtgttctttttagtacactagaataaatggatgttttttgtggacgcccatgttgaactagttttcttttccagtaagtacttcagaatgagtgagataaatatatcattcagcgtctggtggtctggcattggaattcaaccagcatggcctgccttgttaaaagaaaaaaaaaaaaaaaa

SEQ ID NO: 20990 - DNA, 839 bp, Zea mays
gcctgcagcttcactcatgtcatcctcaggctgaggtactgctggcactgcgccagccacggcgcgtgctgctgcctcatcacgccgtcggcttctcctccaaggtcgaacgcaacggccctctggcacgccgccgccgccggcccgtcggtcggagtagtactcggccgacgaaggcggcggcgacgacagggcgctcgcgccggagcagtcggacccgaacggcgaggagccgccggcggcgttgttgtcgcgctgctgccgctctgctgattgcctccggcgcctgttgctcttgcgccggccgccgccggctgcgcagcgcccgccgacggccagcgtcagctccagctccgcgccggcggcgtccgcgtcgccgtcgtcgtcctcgtcggcgctgacgatgtactcgtcggctggcagctgcaggtccagcgcccggcgcggctgcttgctgcgccggccggcggtcgtcagcagcagcggctcgtcgtcgtatcgggtcgttattaggtcgctcatcagctccctctgtatgcggtacaggcggtgcagctcgtggacctgctgccggaaggtctcttcgtgcttgagcatggccatcctcatgacctccatgtcgcattgcctgacgagctgcctgtccatcatcatcatcatcctagctatatatatccgcgcgctctccgttcctgctcgagcttggctctcgatcccggccggtcaccagattcttcagtgccgagctggcgctggaactatgcgcggcgcaacgacacacgaagctgtttgaaagagagagcaggccggagcgcaggtgttgcggtggtgggtttctt

SEQ ID NO: 20991 - DNA, 1908 bp, Zea mays
tccaccgcggtggcggccgcttttttttttttttttgtcctaagggtcccttgtcataaagtatgaattgatatactttacatagactaagtatacacaatgacaactggccaatttgatgtaattacaggaaaaaacgatgcttgacatttctatatggcgtcgtcctatgaatcagataagatcacattgcagctatcacatggcgtcctaaaatgagagagaaaagagggggaaaagagtatagttggtgacacaattgtatctaagtacacttcaaattcttttccggaaccacaattcctagatgactagcacttaattggcctcaatgtggcatccttcttgcatgctccttccctcaaaacatcatccagaatccagatatagacaaaccacagttgacaacttacaatctgtaatatcaatctatccaaggccaggttgaggtaaaactgccaactccagttctacatcaatcaatcatgtctggaagcagaatgattctcaagagcttcccgtcaaatgttggcgaagaattatctatcagacaatactcgagtccttgtatctaagaagatactcttcctttaggtaaccattttcaaccttgggaagtgataacgtcaaggtctcgtcatctatataatcttgacattttagtggcatcacttcaattgcaaacgcattctgactagcatgctttggccgtcgtgtcaacaaagattgtccaggactatcagtcatatcttttgtcttgtgaagaagaaacgtcccagataggatagtcatgaagccacacatctctgtaacaatttgtgttggattttgatggtcccaatccttgaacattatcacactggctataattgttagtgatgtaaacatcacataatatattggtgagactactgctgtattaaatgtatccaatgccttatttagatagttaatctgggtgctcacacaggtagctacaatcagtgcaaaggcccaagtctgaggatagaataattggtttgttcctgacaatgttagcttcaaggcaattccaagagctcttacactcataaccgtgagtgatcccagaagagaacatactccaatgtacaccattatgtttgtttgtccatgatgagggacaacaaaatatataagcactaaggctgctgcaactactatagccgcatagcaaaggaaagctggttcagttgcaagatcccaaacttcctttacagaatcaatgtcacgctcttgtggggcatggagcacaattgtgatagatccaacaacacagagaacacaaccaagtataccaaatgtgtgcagtttctcctgtagaatggcatgtgcaagtgcagcgctgatgattatactgagtgcaccaagaggagtgacaagaatagcaggagcgaatgcataagcagcaaaattagcaatttcacctacaatcatagaaatcatgcctatccaccaaagaggctccactaaataagaaaacccgccatatcccgcgcggacgccggagtcggcggccctcctgagccccatcttcttgacgatgaagctggcgccaatgaaggcgctcgacgacaccgcgaggaccaggcccttggcgttgtccgacgacatggccccgccgcgcccggccgccgcggaagccggcgccgccatcttcttccccctcaggcccctggttccggcgtcactacaagaccgctgattcaggcggctacgactccaccgccgccaccgccgccaccgccgccgccgccgccagcgtcggcatgtggagtgtgaatggaaggagtagaagaagaggagcggtcggaagcgggaggaaaaagagggaagatgaagaagtaggaactttaatggcccggacttctatataccgcgtagagactt

SEQ ID NO: 20992 - DNA, 1419 bp, Zea mays
  misc_feature (734)..(734): n is a, c, g, or t
tagaatgatcaagagtttcctcaggggcccgtgtcataaagtatgaattgatatactttacatagactaagtatacacaatgacaactggccaatttgatgtaattacaggaaaaaacgatgcttgacatttctatatggcgtcgtcctatgaatcagataagatcacattgcagctatcacatggcgtcctaaaatgagagagaaaagagggggaaaagagtatagttggtgacaccattgtatctaagtacacttcaaattcttttccggaaccacaattcctagatgactagcacttaattggcctcaatggcatccttctggcatgctccttccctcaaaacatcatccagatatagacaaaccacagttgacaacttacaatctgtaatatcaatctatccaaggccaggttgaggtaaaactgccaactccagttctacatcaatcaatcatgtctggaagcagaatgattctcaagagcttcctgtcaaatgttggcgaagaattatctatcagacaatgctcgagtccttgtatctaagaagatactcttcctttaggtaaccattttcaaccttgggaagtgataacgtcaaggtctcgtcatctatataatcttgacattttagtggcatcacttcaattgcaaacgcattctgactagcatgctttggccgtcgtgtcaacaaagattgtccaggacctgtttgagaagaaaatatcaaaagncaaaatcaaacgttctcatggggtgtgtaaaagtgcatgaatcgtgacatactatcagtcatatcttttgtcttgtgaagaagaaacgtcccagataggatagtcatgaagccacacatctctgtaacaatttgtgttggattttgatggtcccaatcctgcacatcaagaaacaaagcgcagataaactgagatgatatacatttgatgcagtatttcacatagaaggcatgatcaccttgcatatatacatatatagagaaagagaataatgtcaatatatagatagaactagcaaaacttcaacaagtatatatatatataaaccacccccacaataccacttataggaacaatatatagttagatcaaggcaagaatagaatcaaacagcaagcgagtaaatttcttaatttttttcaacaaaatattcacttaacaataaatgataatggtttctcatgaaagtaataaaatgggaacacataatatattgacaaaaacattcacttaacaacaataaatgacaatagtttctcatgaaagtaataaaatgggttaccttgaacattatcacactggctataattgttagtgaagtaaacatcacataatatattggtgagactactgctgtattaaatgtatccaatgcctgcaatttaaagagtaaaacacattaact

SEQ ID NO: 20993 - DNA, 1546 bp, Zea mays
agtagttagcattggattttagttaaatacatcaaaatatacaattgcatcaacataatggattacacaggctcctacggcctcccaggaaaaaataccgagaaagaatggaatccaccacagcggtattttttttaacctcgaggcccctcggcgggaaaaaggctgcacactggaagacgaaggcaaaccctagtcgctactccaccgcggcgccaaccacctcgatcgggctccgattccgatggacttcgcggagctggaggccgtggagggcctccggtggccgtggcactcgtggccgccgactgctcccgccgccgcgtccctcgtcgtgcccacggccgtcctctgctcgccgctgcagcaccccacggcgcccgacctcctcccgctgctcccctacgcgccgctccgctgcgcctccccgggttgcggcgccgcgctcaacccgttctcgcgcgtgcaccacggctccgcgcgctggtcctgccccttctgcggcgccaccggcaacccgttcccgcgcctcctggcccccgacgcgctccccgccgagctcttccccacccactccagcgtcgagtactcgctgcctccggaccccgccgaggccgggggcccggggccacctgcgctcgtgttcgtgatcgatgcggccacggcggccgaggagctcgccgtgctgaaggacgaggtacgcagggtcgtgcaagggctgcccgaggggatcagggtggcgctcgtcactttcgctgcgtccgtatgggtgcacgatcttggatttgagggttgcgctcgagtggttgtgctcaacggcgagcgtgagctcgagtctgacaaggtttgtgaatttgtaatgtgatccttagggcaatggatttgtaatttggttctgcaacaatctatatggcatgatcagcattctagtttcgcgagtatgcataatctgttccgacgcaaccagcctgctactactcatcacattttaaaactcttctggcagatttctcaaacctggtttgaaatttgaatgtaagtagcttgttgtaatgctagttatggggcatgtattagctttttgccactactagcatgacccatctaatctttctctctctctcacctgtcttacatttgccactagcccactaccagtggcaactggtcaaatacagcaagtactctgtttcccatcaataaatgcatggaacaatgccatctttgaacttatgttacataaattttgtcttctgatagtattgcttatgttgagtgctgttacatctactgaaatagtgaaatgtacattgtatagacacttgaaattgtttggtttgtaaaattcttcgtgacctggacactttatccctgcattgtactgcttttttataggagctgtaggctcttggagttgtaaggtggtaattgttgtcagctgtataacttgaatatctctgcactgtaggataccactcttgcaaatgctcttgtccaaacgtagtgctagagaaaatgttgaaactgaaaactgcatagccagaaa

SEQ ID NO: 20994 - DNA, 3693 bp, Zea mays
aggaagaaaggaacccaccaaagcttcaaaaaaagaaaaagagctgcacactggtcactggaaaacgaaggcaaaccctagtcgctactccaccgcagcgcccactacaccgatcgggctccgatggacttcgcggagctggaggccgtggagggcctccggtggccatggcactcgtggccgccgactacccccgccgccgcgtccctcgtcgtgcccacctccgtcctctgctcgccgctgcagcaccccacggcgccggacctcctcccgctgctaccctacgcgccgctccgctgcgcctccccgggttgtggcgccgcgctcaacccgttctcgcgcgtgcaccacggctccgcgcgctggtcctgcgccttctgtggcgccgccgccaacccgttcccccgcctactggcccccgacgcgctccccgccgaactcttccccacccactccagcgtcgagtacttgctgcccccggaccccgctgagcccgggggaccggggccacctgcgctcgtgttcgtgatcgatgcggccacggcggccgaggagctcgccgtgctcaaggacgaggtgcgcaggctcatgcaggggctgcccgaggggatcagggtggcgctcgtcactttcgctgcgtcggtgtgggtgcacgatcttggatttgagggttgcgctcgggtggttgtgcttaatggcgagcgtgagctcgagtctgacaaggtttgtgaatttgtaatatgatccttaggacaccgaatttgtaatttggttctgcgccaatctatgtgacatgatcagcattctagtttcacgagtatccacaatctgttcctgccgcagtcagccttgaaatttgaatgtaagtatcttgttataatgctagttcaggggcatgtattaaatttttgccattattagcatgactcatctaatccctctcacgctcacctgcttgtgcttcacacttgcaactagcccagtaccagtggcaactggtcaaatacagcaagtactatgtttccaatgaataaatgcaggggcaatgccgcaatgccatctttgaacttatgttacataacttttgtcttctgatagtattgcttatgttgagggccgttacatctactgaaatagtcaaatgtacattgtacatagcaacttgaaataattatgcttgtaaaattcttcgtggcctggacactttatcaatgcaatgtactcctctttttataagagctgtaggttcttcatgttctaaggtggtggttgttgttggatgtataacctgaatatctctgcactgtaggatagcactctcacaaatgcctatgtccatatataatgttagagaaaatgtggaaacttgaaactgcctagccagagaaaattttccctttgtctaaaactttgggtttggtttacagttcctgttgctatgatcctgttgtccaaacttgcgatataaaactgtctcactcatgttttgaatttcttgaggtttggtgatatgcttttgcaattcctggtattttgaaaattattgtggctactgtatatcacataaaccttcgtttatatttcagatacagaaacttttaggtattcaccgttcaccatacaagaagttggctatgccaaggtccactgaagcacagcggtttttgctgcctgtttctgaatgtgaatttaacatcacatctgcaatagaggacctgagctccatgcctgcgtgtccacgtgggcaccgccctttaagggcaactggcgcagcgatttctactgctattgctcttctagagggttgctgctcacccagtaccggtggtcggattatggtctttacatctggtcctgcaacagttggtccagggtgtgtggtggaaactgatcttgggaaagcaattcgttctcatcgtgacatattcaatagcaacgcaccgctgactgacaaagcacgtgatttctataagaaagttgcaaagaggttgacagaccatgcattagttcttgatctattcgcctgctctcttgatcaggttggggctgcagagctgaggaatccaattgaagtgacagggggtttaatggtgcatacagagtcatttgagtatgagcagttcaaaagctgttttaggcatatgttccgtcgtgaaggcaccaattaccttaatatgaactttaatgcgacgattgaaatagtgacatcaaaggaggtgaagatttgtggtgcccttggtccctgcatttccctccgcaggaaaaataactcagttagtgataaggaaattggtgaaggtgggtcaaattattggaaaactagttcactgagcagcaaaaccagcattgctttccttttccgagttgattgcaatcataaagctgatcccccgactgtcttctttattcagtttatgacaaggtaccggcatggtgatggtagttatcgcctgagggtgacaactgttgcaagaaggtgggctgctcctcgatctcctgaaattgctgcagggtttgatcaggaagctgctgcagctgtaatggccaggcttgctgtttacagggcagagacataccatgttagagatgttatacgatggcttgacaagatgcttattcgctttactgctaagttcggaaactatgttcctgaagatccatctacatttcggctgtcaacaaacttctccttgtatccgcagttcatgtactacttgcggagatcacagttcattgatgttttcaacagctctcccgatgaaactgctttcttcaggttgatgctgaatagggagggggttgtggggtctctaatcatgatccagcctactctattccagtactcatttgatgggccacctattcctgtactgttagatgtcagctccatctctcctgatgtcattttactatttgattcatacttctatattgtgattcattatggctcaaagattgctcaatggaggaagcttggctatcataaggacccaaaccatgaaaatttacggaagctccttgaagcaccagaagtagatgcagaggcactattggtagaccgtttccctgtgccaaaactcataaagtgtgatcatcatggtagtcaggccaggttcctgctcgctcgattgaatccatctgtgacacagaaaacacagttttcaaagggatctgaagtcattttcaccgacgatgttagtttgcaagtgtttattgaacacttgcaggagttggctgttcagggctagaaagtcatgaagcttgaccttgtctgctattccactttggtccattagatactgaagatatggctttgagagggaccagacttcatattcacagatgaagcttgcaagtttttattgaacacttgcagtaattggtgtgcaggattaactagttcatgtggaattatttaaatgcaattttctgctcacttgcaaatactggggagctctactgcctggagtgagatctccctgagttgtacattgctcaagctccagtttgatgtaagacaattacattttacccgttttgtatagcatgtggtattatccactggggacgcttgatttctccagaaatgacttttgtcattccaccattttttgattaaatatcaaatggcgcctctggtctgttttattttatttgtttttttttgggggggggggggctgttttgtagact

SEQ ID NO: 20995 - DNA, 1377 bp, Zea mays
gggtacctcgaggccggccgcgaactcagttactgataaggaaattggtgaagtttatgacaaggtaccgacatggtgatggtagttatcgcctgagggtgacgactgttgcaagaaggtgggctgctcctcgatctcctgaaattgctgcagggtttgatcaggaagctgctgcagctgtaatggccaggcttgctgtttacagggcagagacataccatgttagagatgttatacggtggcttgacaagatgcttattcgctttactgctaagttcggaaactatgttcctgaagatccatctacatttcggctgtcaacaaacttctccttgtatccgcagttcatgtactacttgctttgatcacagttcattgatgttttcaacagctctcctgatgaaactgctttcttcaggttgatgctgaatagggaaggggttgtggggtctctaatcatgatccagcctactctattccagtactcatttgatgggccacctattcctgtgctgttagatgtcagctccatctctcctgatgtcattttactatttgattcatacttctatatcgtgattcattatggctcaaagattgctcaatggaggaagcttggctatcacaaggacccaaaccacgaaaatttgcggaagctccttgaagcaccagaagtagatgcagaggcactattggtagaccgtttccctgtgccaaaactcataaagtgtgaccagcatggtagtcaggccaggttcctgctcgctcgcttgaatccatctgtgacacagaaaacacagctttcagagggatctgaagtcattttcaccgacgatgttagtttgcaagtgtttattgaacacttgcaggagttggctgttcagggctagaaagtcatggagcttcaccatgtctctgctatttggtccacttgagatcctgaagatatggctttgagagggaccagacttcatatttgcagatgaagtttacttgcaagtttttattgaacacttgcagtaattggttgtgcaggattaacatgttcatgtggattatttatatgcaattttctgctcacatgcaaatactggggagctctactgcctggaggagtgagatctccctgagttgtacattgctcaagctccagtttgatgtaagccaattacattttactagttctgtatatcatgtggtattatccactgggaatgcctggattttctcccaaaatgattgttgtgattccatccagttttggctgttggtacccaatatgggggatactcttctggtttgtagactcattaagtttgtatgccccctttacgcacaaaacaaagagataatgtagcctttctctgattctcaccg

SEQ ID NO: 20996 - DNA, 856 bp, Zea mays
gccggccgggttccgtcggttcctcccggccggcccggccttcacttgctaaaccctctccagcccgcgttcctcgctttccctcccaaaaccctagcgctgcttccaccagccacccagatcccatggcgcgctcgacctcactctccgaggcggaggcgggcatctcctgctttgcctcctccctccctggattccgcggcgtcctcaagcaccgctatgccgacttcatcgtccatgaggttgcccgcgatggcgctctcgtccagctcacctcgttcgacctccccaccgagagcgttggtgtgaacgaagaggacaaggcggccccgtcggctgaagcggatcactcgcaggccctcgagtcgttccgttcgctctgcggcgatgccgattgcaacgcattgaggggtctcctggagaaggtgtcgggcgagggtggcggtgatgtctcgcctgtcattctatcgcctgatgccgacaaagcacaccgttcggaggtgcataacttctttaagaagaccttcaagttcctggtcacggacacggtggaacacagtgatggggtccagaagtgcatcagggtgcggttcgggtcagaagcaggtgtcggaaggggtgctggcggccgtgggagaggaaggaaacggaagaacatgggtagttctgattggagagatggtaggccatttgatagtagagggtcaagtaattggccagataatgttgggaagttcctgaggtgatgacatcctgttttatttgttaactatgttatgtgttatttaacttgtatcggactgggttcttttcacatgtatggcatacttgatatgctccaaaaaaaaaaaaaaaa

SEQ ID NO: 20997 - DNA, 2586 bp, Zea mays
gcacgaggtctcgagttttttttgttttcctttggctatcttcaacagcttacacattcttatactcatattcaaaaatccaccctgcgaacagtacaatctacaaacaatacaatctacagtacaaaaacagtgttttggatggccataagggtgaactgctaaacacggtctaagaaactgacaaaaggatggtccaaggcatcttgaagttctgctaattacaaagctgcacatacaaactgtcaccacgaaacttctatgcacacggtattcacaatatttacatgttataaactgctactgtttccaagagagctcaccagaacggacaccacccgacatagttttggcacaaattttcgtgtgaagtcgcttggagtatgagcttctgaacctgaaccttcactgagagaccaggttgggcatcccgggcatctcctgaagccaaatgctcactgccatgttggatagagctacctgctccagccaaagctgacccagaagagaagtcacgccctgttagtttgtcactcatccgtgccatcacagctacagcacgctcattcaaaacctcattggcatcaccgagttgattgacagcctgtagcagttccctctcacgtgctcctcgctgaggttgcatgagctctcggttagccactgcttcttcactactgacaaccgtgtgagcatgaacattaccatagttcgacacttgaggaacctcattgaaattgaacagacgccaattgattaacgggtcatgtacaaatgcctccatcatggccataacgctgtctctgtttgtgcgaaggacttgcatcacattttcacaagttgttcggaatgtaccctcaataccgctaacttccatagctttcacaagcattcgagtcaaacggaatggtactttttcagggaacttttctcgattcattgaagcctcaaagcaatctccgaagtcgatgtgtaatatttttccactatagcgatctaacataaggttgcttggatgccgatctcctaaaccaagcaaatacccaaccatgctcataacagccaggcttctagcgtagtttgtgcggcgctcaagccatacttccgaagttcgactcttcagccacagaaccttcgcaaggtcatttccctcagtattttgcaaagcatgctgaaacacttccacctttgcaatgaggggtaagtgatcataatcgggtgcaaaagccaacataagtctgtgctcctgattcaagaaaatcttcctggcatctctgtattcacggatcagagcatgaagtgtgtcacagtttggaacccatccaattaaaccactgttaggtgacaaaggtataacagcatatctttggattgataaatccttctctgatgttttccttgagttctctaggagagtattcaccaaaccaaaaagctgcattactcgttcatcttgccgcaaatcttcgtggcctttaagcaagaatgcataatcattgccatcacttccatgaattgtcagctttcttggtctttgtttggacgttataacaatcaattggggaacaaaatactcaatcgtcacaagtggtgaatctgcagcataagttcctggcacagcaagttccaactttcgacatttgagtagctcaggcgaaacagagtgcagatcgagggtcgtaagacttggaagctgtttgtcgattcttctgaaaacatggtaatacaaatcccaggccttagttagctcagcatcctctcctgtagcccgatatttcaaacagcattcatgagcttccagtaattcatgcccataagcctgaatgaaggcattttctttaattgtctcatcccccctctcaagcattgcatgcaatggctcaagtacagcaagcattccttcgatattgtgctcaccaaaatacatcctgctagcttcctcgagtgcctcatgccacatttcatgccacaaaattgctacccgtatcagttccttcgacacaagttgtgcctggtcaacaagacctccactgtgctggcggatcttatcaacgacctcctgcgctgcacgttgtctcaatatacttattgatttgcaggcaaccaagagaggatacatcaaagcctgtggatgcccctttccaattcgaactagcaaagattgtatcagttctctaactactctattgttcgaatgaatcctagcaattatctggggcagcacaaccagccacatctcaatcttgacaagggaaaaacctttctgcaacgctgtttgaacttctgaggtatccccatggttgaaccaaagagttaacagacgaaggatatcctgcaagctatcatcgacccctttcgtagtagatgcacaagcaatagaatagaaatacccagttactgctgcaacaacatattttccagcaatatctggtcggcctcggaaagtatagcgtgacatgacttctgtgttgaacaaagcccatatgtgccaggccttcccccagtcctttgcacttagcgtggcattatggtaagaaatcaaaatttcttgaatggaatcgtcatctaatgcagggataggccttc

SEQ ID NO: 20998 - DNA, 1888 bp, Zea mays
aaaccctaattcattttctctcctacttctcctgccgctccaacaggcagccgccaagaactcctggccgaccgcaggaagtggggccgactgcgcccttcacatcctttctctggttctggtcatgccctttctaatctctggttctaagttccagaccgctcacccaagaaccggtctccaggagcttgagccgaccgagctatccttttctccctgttccttttggccggtcgccccgtctcctttgtttctggttttctttctttctagcatctgaccgctaggtatctttctctctttctggtttttttatttatttcttggtcttgaatctggcgctagttccctggccttgcgcgggcaggtcttttccttcaccagagttgggcgctggctttaaccttttgaaaaacaagatgaagtcagtaccatatgcttcagctatcggaagcattatgtatgctcaagtatgtactcgccctgacttagcttttaccaccgggatgcttggacgctatcagaagaatccaggcatagaacactggaaagcagtcaagaaggctctaaggtaccttcaaggtactaaaggtctcatgcttacgtacagaagatctaattccctacaaatagttggctatgcagatgccgactggggagggtgtagagatacactgaagtccacttcagggtatgtctttatgctctctgggggagctatttcttggaagagttgcaaacagacagcgagagcatcgtcgacaatgcacgctgagtttgtagctacgtatgaggcaactggacaggcgatatggataaagaaattcgtacccggattaagagtggttgatagcatagagcgaccactgagaatttactgcgacaacgagccagcggtatttttctcccataacaataagtcaagtggctccgccaagtacattgacattaagtgttatattgttaaggagaagattctggatcacaccattcaagttgagcatataagaacccatcagatgcttgcggatccgctcacaaaaggtcttccacccagcgtgtttagtaagcacgcagccggcatgggattaagggagtacctatgatctagaatcacaggggctacagattgcaacctagtaaaatctttcgttctgaagcaggggagcatgttgtagtcaatgagtgcggtgatacttaatagatcattgtcacgcattggtctctatgtgtaaacttgttaaaggacggaattaataaaagtttgagtgtgagatatgtagagaacaaaaaaaaaaaaaaaaggatgtgtcctctacactagccagttaacagtaaccggggtagggttaatcctaactgtctaaccgcgcccctgatcgggggggctatcctaaccgttggttgcagcccccggtcacacgacgccatataaatagattaagggggccgacgggtttagctaacgctaatcgctcgaccacaaaccctaatcgacactttgagaggaaccgatcccctaggcgctcggagtgaccggaatcactgtgactatgtctcagatccccgttgtcccatcggggtctgagattccccctgtaggcaacattggaggagctgatccaccgccgatcaacgacgtgaaccaatctcctcgacaccagcagggagatcgacaagaaggaggaggcgggtcttcgctgcaagacgccgccgcaatgatggctaggaacaacaacgacggtatgtatacatatgtcccttagtagaatagatctactcatcatcgaggtattttagacacggattggtattcttagggacttaggaaacgatcctaagcaccagaattctaacaaacctgagaccctagcaatcacggaaacct

SEQ ID NO: 20999 - DNA, 1476 bp, Zea mays
  misc_feature (1434)..(1434): n is a, c, g, or t
  misc_feature (1462)..(1462): n is a, c, g, or t
aacgctaatcgcttgaccacaaaccctaatcgacacattgagaggaaccgatcccctaggcgctcggagtgactggaatcgctgtgactatgtctcagatccccgttatccaatcgggatctgagattccccctgcaggcaacattggaggagctgatccaccgccgatcaacgacgggaaccaatctcctcgacaccagcagggagatcgacaagaaggaggaggcgggtcttcgctgcaagacgccgccgcaatgatggctaggaacaacaacgacggtgctcataccgccatgctgattagccagattgctcagatgaaaccgctagatggtagtaattaccattcttggcgggaggatatagacatgataaccacagtgggtgagatagattacgcactgaggtttgataaaccagttgagcccacagtgggcactcccaactatgaccacaggtggatgcaatacagcatcgacaaggtcaagtgggagagatcaaatgacaaatgtatgattattcttaagaggagcatcaaggagcctcttaagagttccataccagagtgcgagactgcaaaagaataccttgagagggtagcctctcatcaccaagggtcttctaaggcttatgcttgctctctaatgacagaatttgtcaatgcaaaatacgatggaaatggtgttagaccattcattcagaaaatgatatccatcgtagctaagataaacaagtacctcgggtctcctttacacgaggaatttgtagtatttatgataatgaagtctctgcccaaggagtttgagacttttcacatacagtacaacactagtgtcactgataagtggaatatagaccaactcttggcacagtgtgtccaggaggaagagaggttaaagcagactggagactctgtcaacctcatcaaaggcaatatccccagacagaacaagaactcaaagaaaaagttcaagaagcaaggtaaacagaataaccaggcttcctcgagcaataataatcagccaagacaaggaggcagtttctcagttccccctgatacctgcctctattgcaagaagacaggtcattacaagagaaagtgccctgaattcctgcagtatctactagagagtgggactccgtacaagccaaaggctcccaaagggccgaagaacaattagagtggcaaatggagttgaagcagcagtcgaggccattggagatatacatcttaaattagttaatggttttgtactgttgttgagagacgtactttatgtaccttccttgcgaaggaaccttatttcggtttctagattagatgatcagcacattcattgccattttggtgatagacagtgtgtcattcagtttgataataaagatgttggtctcgccatccgacgagatatgcttttaaaaaaaaaaaaaaanaaaaaaaaaaaaaaaaaaaaaaaaattnaaaaaaaaaaaaaa

SEQ ID NO: 21000 - DNA, 982 bp, Zea mays
aaaaaataattacgcagtctctcattaattctcgtatacatttctacaagggaagtgtagaatcaaaaccgtccactcagcatcattaaaaacgagcgccggcgcgggccaggtacagtatgaccttacaagcatgaccacagttgagtgatgtaaatcaaaggtcatacaaggtaacaggcttaacttcattactttgctcttcctgatagtccagattcgactttcttaatctcaaatatcagcatccgccacatcttgaggacaaacatctcagcctcaacatccaaaatcgactgtaggagctctagcatcttttctgcctgaacgtggtctttggtgcaggaaacaatatagtccaccaaagttgattcctcctcgccaagaaattcaataatcttttttgaaatccaaggcctcattctctcgtgcaactcattcttgtcatatatcacccagtttatatcataggcaaaaagttcttcctttgtccttgggatcatatcaattaattgctttgcatccagaatcttcttgttctccgacttggacttatccttctcacgatcatgtagcttctctcttcgctcatcgctaggacgaccttcactggatctcctattcctatccttctctgtgtcaaccttctcttcctttgagttagaaactgagatgcgcttggcaaactcagcagctgctgcgacatttgccccagtcgaagaattagcctgtaccgcggccgcgtcctcgctgtagtcgataggtactagaggtcttatgcttttatcaacattattttcatcatcctcttcagcaaaaactgatggaacagatgtccttttgcccaagccaatcaaaccaaaacccagtttctttactgggacattgttgttttgcttggtatgactaggtaccatgcttatttcctcactgtattttcctaccacatccaccagcaccaacactattagcggagctcggg

SEQ ID NO: 21001 - DNA, 4644 bp, Zea mays
gttatacttttccaagttttatgtgtttaaataataaaactatattttgttaacataaagtttatggtgagaaaatatataactacatccattcaactttaatctaagttattagtcaaattataactataagatcagaatattatattaatatttagagaagctaatccaacaaacatagattaatcgagttagttacctaattataatagtatgtgatatcgtataattaatattgttattgtgtaataaatatttatacaaagctaacacaattcgaatggatcaaatcggagttaaaacagacaagatacgaatttccaaagttttcagggaattatttatgtgttaaaagtattttttctatatttattttataattttttgggatttatggactgcgagtactatttcgaaaaactcggggtcaaccagcaaattttaggggctttagttaaatatttcttcacttaacggggatggagggttgattttgactttcctcgggggctcttttacaagatggcgcggacgaaggggtaaggtggtttatcaaccgcccgattagaaacgaacgcgccagatcggagcctaaagattgtgaacagatacccaatgcggaccatccgatctagtctctacggtcacgatttaaataaccgagctctgatctcaaccgtcccaaacaatgtagacgactcggatgaaacaaccgaacgtgtacggtatgatttccccaccattgatgtatgacccaacggcaaccgtgccttgagccgaaccagtatggctcgagttaatctgagttgttcttcccatgagtgacggtagctccatcgtctctcacccccagaccgcacaaacggcggcgccaggatccccgcggtggagcgcccccaccgataggcgccagagcaccctagtaccccaaatcacctatggatggataccgcacatagagagaacttaggtgaaatcaacatacccctcattaccttcaatcgtgccgcaaaataactccggcaccgacgtctagtgtttctgtggtgatgtgcttgcttcgacgagcaattcattcggagcaccacacgattctcctctccgatgacctcgtacatgccacgtgcaccctgacgaactccctccgccacaccaaggtcacagatcggtgacgttgacgaattggaggtgcgacgaccacatctatctcactcggcgaaacatcgcttgatcctctctctgttttggtctcgagcttggccagaggctcgagtttggacgtggcaagggattgcaacgatttttatacctgggaacgctaggagtccggaactccggatttgacctgaactcccgaattgcacacgcggatttcgatgttgattctttcatgagtgattcagttactaggaatggaacatcccaccaaaacagacaaaagaccgcacaacaaaacgagcaatataagtatatgagcaagaaactacagatttatcgcacagcagcaaccacgaaaagctcaacggtactgctacagtacagaagcaaaagtggggtccttttttttttttttttttgcacacacaccatgtatgattagggatcacttgtggctactgccagcattgacattcttcgttcaccagagaacaagttaagcaaaagtaggcagttgactcgtgtgaactgtgccaaacacagttatgcaatctatcaaaataaaaatattacgcacagtatctcattaactctcgtatgcatttgtacaagaaacaagtaaaaagatccatcaactctgtcactaaaaatggtttttgatacttgtagtgcagtatgaccttacaagtgtggtcacagttgatgagtaatgcagatcagaggtcatacagggtaacaggcttcgcttcatgactttgctcttcctgatagtccagattcgactttcttgatctcaaatataagcatcctccacatcttgaggacaaacatctcggcctcaacatcgaaaatcgactgtagaagatctagcatcttttcagcctgaacatggtctttggtgcaggaaacaatatagtccaccaaagttgattcctcctcgccaagaaattcaattatcttttttgaaatccaaggcctcattctctcttgcaactcatgcttgtcatatatcgcccagtttatatcataggcaaaaagctcttcctttgtccttgggatcatatcaattagttgctttgcatccagaatcttcttgttctctgacttgggcttatccttctcgcgatcatgtagcttctctcttcgctcatcattaggacgagcttcactggatctcctattcctatccttctcagcttcagccttctcttcctttgaattagaaactgagatgcgcttggcaaactcggcagctgctgtgacatttgccccagtagaagaattagcatgtacagcttgtaattcttcagtggagtaatcgataggtactagaggtcttatgcttttatcaacattattttcgtcatcctctacagcaaaaactgatggaacagatgtccttttgcccaagccaatcaaaccaaaacccagtttctttgctggaacattgttgttttgcttagtatctgcggtttgaccaggtgtcatacatgtttcctcaccattatttcccttactaagtcgaccagcaccaacaccattagcaaagctcgagatgttatcagcttccacaacagccgacttgttttgtgcatctgtttccttttcgtcatcaccatcaatctccataagtgatgcagactcttcggcggctgcagccgccgccgcagctgcttcatctgcttgccgttgcaactctacagccagcctccttgcttctgcaatttcctcctcctcccttattttatctgccaaatcttcctccttttcacgttgcctcctcctcttcctatcttcaagtgagctaatactccttcgtttccttttcctattatcctcgtcatcgctctcatcttcctgcttcaggatctcccttctgcggttatgatctctatctctttctttctccttttcactatacctctgatattctctctctctttccctagattcccactccttaaggcgatccctgtagagcctatcagcttctctatgcttatgatccttctctctatccctccgtactctttcacgttcacggtcatgcctttcaagatctttgtcccgtttgtccttatcatgctctctatccttcctcttatcaggagaggcagtttcagatctctcagtttcattagctgcccttttatcagcatcagcagcattcttatcatcagaatcattttttgccttatctacgccagagctatcagcagatggttgaactggtgaaggtgggggtggcggtctagtctttaaccactcctcaatcatattgcttattttttctgcgacatctttgtcagtttgagagtcttcgtcagtaacaatcccaaatttatcagtgttgtcttccctgtacttatctccagcatctcctgtctcatccaattcatcagggacaggttttgatgattcattttcagcaacagctgtagttccatccccgcttgcatcttctgtttctttttccttctcttgtgctctcttctttccctcaacatgtttcttcaggtattccttggtggcatcatttatattaatcaccagttcctgaccatcaatgctcaatttgttgagaagccgtgtcgcacgaaggatgccttcagcagattcaaattcacaaaacccaaaacctttaggttttccattactaggatcttgggcacgcttccaactcttgacagatccacaaagccgaagaagtgaaagaaggaaatcactgtccactgttggggcgatcttcccaacataaactgcggttggcggtttatctgccagcttaacagctggagcaggtggccgggcagttggggctaccaaaggaggaatagcccggatcccagaaattattgttggtcgttgaattggcacaacaccaggcggcggcattggacgtggaacaaaaccaggacgaatcataggatacggtgcaggataacgagacattcctgcagagagagacaaatgacacctatgcaaccacatcagtaagtatacctacaagtaaatcatatagtgaacaaatgaaacctcataacacatatagaatcagagaatgtggccatgtgtaagcagaagataccaaaagccataaacaaataccagagtgaacattgacagaagcaatatcttgctcaaatgaaaagggagctaagcaaagctggccttacctctcaacctcatggacaggagggcgcgcgggcggggggtcttgggggcacttggtatagctcacaccattgcaatgcactactcaggtaataagagctcaggcaaatatgtcactactctacacttcttatcaacaaagaagtttatatgaaaccagaaaaaaaaaaaagatatagccggcatatgaaatttaaacggcagaaaatcatgataccttagcaagtttttggaacaacccagagctgaagcatctaagtacataaagaaactgagcctaattaagccacgagctaaagcatgtaaatcaac

SEQ ID NO: 21002 - DNA, 2817 bp, Zea mays
ttttttttttcttttttgatcaatcgatttgctttcttttcattatataaatttatattatgaacagatacaaagaactagctataactcaacatagcctgaaggccaataaggaaaaaaaaaggttaatggcctcacacaccagttgttgagatcacaactcaccacactgacacaatcaatcgggtttattgtcactcattgctgtactcaagaacatcctcacaatctctcgtgacaaacactgagaaaaaggcaaaaaatgcacacgatcattgtaagtccctactttgcaccagattgtcttccatttgatgaaagccttctgctgtcgcttctgcttaaaggctgcctaacagatctgtttgaaccgtttgcaacttttcttgacgctgatggtatttgagaatggattggtgtcctggcatctgaaccatctctaagctttatttgtggtttcttaacctttgaaccgctcaaactaatagagttatccatgctttggacattgagctgctgccatagcgcatctgattctgaggaatcacttgttgccatgtcaatgtcatcagaatcatcagtattggtagagtaaaatcgagacctttgctcttcatactcatggtcatccttttgtcttgtgttattcctctggtactgcttctccctcatacctgaatgatatctctggtaaaagaagtcaggtaaagctgcattgtcaccctcccagtcaccgactgaattattgttgttcactacaaccttatctatccagtccccaccaattacttctctttcatctcccgtctgaaaatttaccctcaaattgctatctggccatgaaggagaatcacttgctgttaataaatcctggagatcaaagcttggtttcttttgcctcagtgtatgattggctctagcctctatgtttccaacatcctcctccattggttgtctgaagttactttggctagacagtagatcacagctaccctgtcgtgtgtttgaaaaaccaggcgaaggcgtctttatgttaaatgcctcagtgtcatgactgatgatttgctccgatcctaaatctttcgcagctaatgctgatttaagtcgagcaatctgcgcctgaagctctctaacttctccagattctttatttagttgagcagccccaagttcaacagttgacacacgctcggcaaacttcaaggtgctgatggtttctcctacagcatcactttctgggcttatatgaacaaacatcaaggttttggcctgacctccaagtgaatcttggagaagttgtgttaatttactattcctgtaaggtacatgtgaattcttttgggcaagcgaagcaattacatcccctaaggctgacaatgatttgtttatatgctgtgcttcttttaacctttctccagtgacctctgatttatcaacccgttcactgccagcaagatcaactaaatgcatgcaaccgcgaaggattgtccctgatgtcagatcccttcccttaacatgaacagttaaacaactgtgggaacgactactcctgtcatttagtgcagtggcaccaacagcacgattcttgtgcccaacattcatccggacgcgtggcgcccgcggtggtcccccccgaacaagacttgcatctggcacatttagcccattttgagagttattccgaatctctaattttttgttgagaccgtcagtgacaaggaggtccctgacttgttcattgtaattctcaatcatttgcacagcaatatcataaatgaaggttcgcttcctttgttcagcaagcttaaatagatcaccaagtgcccgatagttgacaccttgggtttgctcagtcatgtttttgggcccactcatcgtgtatgtcttccctgatccagtttggccatatgcgaagatacatacattgtatccatcaagaaccgagcgaataaggggttgagtatccaagaacacctcatcttgtgtcgctgatgagccaaaaaccttattgaagctaaaagttttccgtacttcctttccagacttggaagggatgacaagggttatgttgccctcgtcaatggaagccacagtggacggacttgcttgtcccggcaaaaagggacgcaccctacaatataccctaatacttcctttaagatcctgcacctggttgtatagttttctattttcttcaagaactttgtgataaccagaagcagcatgagccaagctaaacaggtgccttccaagaaggttgagatcctcagcgtacttcatttgcatatactccataccatcccttgtagttattaaatcactcttaagttcctcaacattctttgactgttgctgtagaattgaatattgcttcagtgccaattcacttgatgctactttttttgtttgtttatggttacagtaaatatctgctgtatccatctttctcccactagtattaggagtggtctcaaccagaacctttgattttggaaaggatctggtgttatcaatgccggtttttagagccgctttgaccagttcattttggctgtttagacgattttcaaattcttcaacaagtttgctcagcatggactccaagagctgtggaacttcatctggccttttgtcggacagagctgcgctgtccagcattttaagggggcgccatgttgacatgtcgctggaatcaaaatgagcgtagccattgaacccagcttcctcatagggcacttcaccttcattgaccgcgaacgcgtgggtcggtccagccaggaagtgtccgggccggtcaggcgggcgagccagctttac

SEQ ID NO: 21003 - DNA, 2831 bp, Zea mays
ggcaggccattattatttgtaagcacgaaaacttgttaacctctcacagttggcttgctaaatttatgataattcctttatctatctttagcttatcaaatctttggtatggtaaattttggtcgtagaccagacaggctcatcgcctcaaccgtttggcttcggccactgtttttttagcttcttgttggcgtcaatccgaacgtcaaacactggaacgaaccatctgacagcgctctctgcggagacgcggacggtccgcgacctagcgcaggagcagctccttctctacgtatgtctggatggtctgtgtctgacgctcggacgatccgtgatgacgcaggaggtgttcttgagttcttcgttgtcgcagacctagatcttccctcccggaaaggacctcgttgggaaggagatcctaaagtgtatcttagcgttggcaggccacccaagatacatctagtcgacgtagagccgaagagatgtgaagattcaaggtataggaaggctaaactagagctactcctaatacataaggtaaaaacgagaagtaaagttgattggatcgattgtgggggttcaatcggccgtaacctttcatctatataatgggatgaagtatgtacctgttacaaatcggttcccgagttaatcctgtaggttttgctaatatatcctgctagaaattcggaaccctaactgattccgcgctcttgcggaccgtctgcgccgccaccacagaccgtctagaccatttgacttacagggccggaccatccgcttgtccattttgggtctcaacacttttgttttcaagatgacatgggtgatgctaatattttattggctaaaaagttgctattgaaattagctattaactattccctccgattttttatttgacatttcttagtataaagttgaactatccagcgtcaaataaaaaatgaaagtaatactagttaatttgctaaaagtaactaatagttgaactattagctacaccgtttagacatctttaactaattttagcagctaattattaactctaatatattcaaacatagcggttatatgcataagctataagaacatagcggttatatgcataagctataaggtccagttactgagttacgtatgcatcactgtgagtctgtgacactgtccgaaattatgtaagcttagcggcacatatagtttgtgaccaatttccactcatgcatgagacgacgtgcaagtttacagtgaagctcgaaaacaaccaccagagtccagaggtgagtatccacccgtaggtgaacagaaaattagcaggcaccgcagctctacagcgatgtcattcatatttcaggtcactcggcaacgccgtcagtaacgcaaaaattgaatgcaaatgaggttgttggctcgtcagtagctgaaaagaaacctatgtcaccagatgctgttatcatataacttcatttgttcatggtagggtgggccatgggcatcatatgttgattgaaaagaattgcagcaaaagcaaaagccactccataggatgtagcaagaattgagggacactgcaaaggaaccttggtcagaagagaaaattgaagcattcgagtataaaaaattattaggcaccagcttttgatcaatcaatttcctttcttttcattatgtatttatattatggacaagatacagagaattagcaagaactcaacgtagcctgataagccaataaggaaaaaaagttaatggcctcacacaccagttgttgagatcacaactcaccacactgacacactcaattgggtttattgtcactcattgctgtactcgagagcaacctcacaatctctcgtgacaaacacagaaaagaaaaaggcaaaaactgcacgcgatcattgtaagtccctactttgcaccagtttgtcttccatttgatgaaagccttctgctgtcgcttctgcttaaaggctgcctaacagatctactcgaaccgtttgcgacttttctcgaccctgatggtatttgagaatgaatcggtgtcctggcatctgaaccatctctaagctttatttgtggtttcttaacctttgaaccactctcactaattgagttattcatgctttggacattgagctgccataatgcatctgattctgaggaatcacttgttgctatgtcaatgtcatcagaatcatcagtatttgtagagtaaaatcgaggcctttgctgttcatactcgtggtcatccttttgtctcatgttgttcctctggtactgcttctccctcatacctgaatgatatctctggtaaaagaagtcaggtaaagctgcgttgtcaccctcccagtcaccggctgaattattgttgttcactacaaccttatctatccagtccccaccaattgcttctctttcatctcccgtctgaaaatttaccctcaaattgctatctggccatgaaggagaatcacttgctgttaataaatcctggaggtcaaagcttggtttcttttgcctcagtgtaggattggctctagcctctatgtttccaacagcctcctccattggttgtctgaagttactttggctagacagtagatcacagctaccctgtcgcgtgtttgaaaaaccaggcgaaggcatctttatgttaaatgcctcagtgtcatgactgatgatttgctccgatcctaaatcttttgcagctaatgctgatttaagttgagcaatctaagcatgaacagagaacatgaatatgttgaatagagaaagggcagtaagaaatatgatagcataacataacagcaaaaataaacctggtggcgaat

SEQ ID NO: 21004 - DNA, 1603 bp, Zea mays
gcccttcgccgaatatatttgcatagagttatttgaagatacaaatggtgctaatattttctatgaacctagttaaacttaagaaagtttgactagcactagccccatagcgacactctttttgggatggagtaaacaataatgtcaggatccttttgttgttcgcttcaatatttttcggtaaatcattttttgcagtccatattacagtcaggattgctctagtaattaagcacacgttctaagtgcaggctaatcctccgcagctccactcaaatctgttgtacatacaaagatatagacggcaaacaagattggtgtcagaggctcaatacttttttacaaacatattgtctgctgagtctttcatatggaacattgatggggaatcattatcgatgaatgaattggattttcaaaggagaatggattcagcaagagaacgcatgttggggttatcagctgactcagaataccaggataatcaagccaatcctgatgtccaagatcgtacgtcacaaagtcttggagctaacagaaattctgatgccagtttatctttgagggaccccgcccgaggttcagggcaggatatgagaagggacagtgatgtgactgtgagtggtaaacaagttgagcaggtgcaatctatttctgatttagagaagaaaggaactgcggaactcctcaatgaggatgacttgaacaaaaaattccaggagtacccgtttctgtttgcccgtgctggtgatctgactattgctgatgtagagagcctattgaattcgtacaagcaactagtacttcggtatgtagcacttgcacaaggtatgggtgtcagtcctgaaaccactcttactcagaacgggcagacatctgatcttgtagtatctgaggagccagaaaatttgaatagcgtggtaaaggacaacgagaacagtgcaataattaacaaaaatgttgatgatgttataagcttaaaccatcgttcagaagcagttgacacagaagcatctgaacaaatgaaccagagaactgctgttgattccagtgatgatctgaaggcattgggtcagcctgagaatgcatgacctgttggttaagccaagatgaaatggccatacatggcagaagtagtctgaagtttgttcttatacctatagacgacaatgatcacaaaacaaagtgcacatttccctgagtgatatgcagcagcttctcgaaccacaattttgtatgctggaggcttgaacgtcaacatagtggaaattaatctactctgccgaagctgttcttagatccaaatgttcattgcattgaagttcctggactcttggctctgttgtaagtccaatttgtggtgaacacaccctttcgtgtttttatgtaactataatttccgcaagtgaagattaattcatataaaaaaatatattcagagcaaagagtgaaaatgccatgagcgtatggtgccatagaaaacctgttgcttcaggtttcggcagtcgctggccttcgagagaaaatttatccccttagcgaagtacaaacgtaaattgtaagccagtttttttactttattcaagccaaactcttttttgct

SEQ ID NO: 21005 - DNA, 2645 bp, Zea mays
cgaaactgaatttaatctgaaacgaacaacctgatataaatattgacacatagaatgagtatttatttaaattaacagaaggaatatttggtttgagatggccgagatgccagtatcccaaaacgaagcgtcgtttggagcatttctgatttatccacagtccacagttccacacacagacgcaggtcggaactcggaagggcaaagtgaacacagtcacagggccactgccacctcggagagcatgcggataagaacaaccacgtcggcccgccacgccgtcgaactgtccacgtcggcttactccactgctttaaaaccggtcccctccccctcgtcctcttcccccactccggcattcgcccccaaaaaatcgagccgaaaaagatcaaaagaaaaaaaaaaagaagaaaaaaaccctaaccactccgatcgaatcatccgagggccgcagcagcccggcgaggctatgtctcaggcaaccgccgcctcccgggatcgcttcccctggtgatacaactcgggccgttcatttcgtctttccgtggggatatgagggccgctccgaccgatccgcccacggcgccggcgaagtcgatgctgaggcggctgttcgatcgccagctcctgcggatctcgccagcggagcgtctaccgtcggcgggggcgggagagaaggatgaggcggagccgagctccgtgtgcctggacggcatggtgcgcagcttcatggaggacgacgtcggcagcgagaaggctgcccacgggggccggtactgtaactgcttccacggaggcgataattcagatgacgaggaggacgacgaagcggcggcggcggcctccgacgtcgccgagacgatcaaggtactagagtagcaactgactgcaactgcttgatccacaacacacacacatatatgattctcctcttcgtcgagggcgcgacaagtgatcccgtttctaaccgtgtcgctcgcgccgccgtggccagggcctcgtccactgcgccacgcttcgggagcgcaacctcctcgccgacgtgtgcgcgcacctggagcggcatcgcgaggcgggggcgcggcggcgcgacctcctccgcctggtagcctcgtcgctgcgcggcgcggggcacgacgcctccgtctgcgtctcccgctgggacaagtccccgtcccacccggtcggcgagcacgcttacatcgacgtgctcctcccggcggcctcggaccgcggcgcgcgcgagcgcgtcctggtggacgtggacttccggtcggcgttcgaggtcgcgcgacccaccaaggcgtaccgcgccctgctgcagcggctgccggcggtgttcgtgggcaaggacgacaggctccgcctcctcgttgccgccgccgccgacgccgcgcgcgccagcctcaagaagcgcggcctccacctcccgccctggcgtaagcccgagtacatgcgcgccaagtggctctccccctaccaccgcgaggcgccggtggccgaagaggcggcctccgcctccgcggacgaggacgacggggacggacccggacccggaaccggaaccggaaccgcggcgtgacaactggacacttgcaatttttgtcttggaagaggttgtagctgcaaaagcttgagattctcttgaaattgaactcttttttcgggggttgtacctagagtaactatggactacgacgtgtgtgtgagagagaggtatgcatcacagcatcactcatcactgtgctgagtaccgcgcgagaaatgaaggcgaggggtatgatgggtagtgctagttttaggaagagaaataaagcaaaatatcggattaatatccacttttggtaatgttgtttgtttgtgtagtcatcaaacgtgccatgatatgatttgcagtaaaaactgcttacggacttaaaaagctcgcacactcttggtaattgacatatttctccgttactgaccaatatatagtataatcatttaaaatggatttgacatatttctccgctttttaaccggaagagactactacacctctctgttttttttttgtcaaagttggagctttgcatttggcagacttagctgtgggggcgatgttgatcgaatggaaatgctggaagggaaccttctggattgactgttgtgcacgcaatgctaacaggattagcagtaaacaaacccctgcccatgagaagatgcaattcttccgacttccagattaggttgttgaactgtctcctgcaaatatgctcttgatcttgaaagaaatataatattctccgacctctcttgatagaaaaataaataagtaaacgaataaaagaaaagtactgcaccctgcccaggtgccggttgtttcaagggaatggatgggagacagccgcaagtggcaaatatttatccacgcccattctggaggttccctgtaatgtactagtagtctggtactatctccaaaaatcaaaaaaaaaacctctagtagtactatctcttaaaaaaagactctggatcggatttggtttacattttttttgtttgctgtttgttttggactgcattgtcactgcaacaaggggtgtgtttggatacaagcccaaacaagccaatccaaatattagtcttgccaagacaatttgccc

SEQ ID NO: 21006 - DNA, 1438 bp, Zea mays
cattgggtacctcgaggccggccgggccactccggcattcgcccccaaaaaatcgagccgaaaaagatcaaaagaaaaaaaaaagaagaagaaaaaaaccctaaccactccgatcgaatcatccgagggccgcagcagcccggcgaggctatgtctcaggcaaccgccgcctcccgggatcgcttcccctggtgatacaactcgggccgttcatttcgtctttccgtggggatatgagggccgctccaaccgatccgcccacggcgccggcgaagtcgatgctgaggcggctgttcgatcgccagctcctgcggatctcaccagcggagcgtctaccgtcggcgggggcgggagagaaggatgaggcggagccgagctccgtgtgcctggacggcatggtgcgcagcttcatggaggacgacgtcggcagcgagaaggctgcccacgggggccggtactgtaactgcttccacggaggcgataattcagatgacgaggaggacgacgaagcggcggcggcggcctccgacgtcgccgagacgatcaagggcctcgtccactgcgccacgcttcgggagcgcaacctcctcgccgacgtgtgcgcgcacctggagcggcatcgcgaggcgggggccgcggcggcgcgacctcctccgcctggtagcctcctcgctgcgcggcgcggggcacgacgcctccgtctgcgtctcccgctgggacaagtccccgtcccacccggtcggcgagcacgcttacatcgacgtgctcctcccggcggcctcggaccgcggcgcgcgcgagcgcgtcctggtggacgtggacttccggtcggcgttcgaggtcgcgcgacccaccaaggcgtaccgcgccctgctgcagcggctgccggcggtgttcgtgggcaaggacgacaggctccgcctcctcgttgccgccgccgccgacgccgcgcgcgccagcctcaagaagcgcggcctccacctcccgccctggcgtaagcccgagtacatgcgcgccaagtggctctccccctaccaccgcgaggcgccggtggccgaagaggcggcctccgcctccgcggacgaggacgacgggttcggacccggaaccggaaccgccgcgtgacaactggacacttgcaatttttgtcttggaagaggttgtagctgcaaaagcttgagattctcttgaaattactctttgttcgggggttgtacctagagtaactatggactacggtgtgtgtgtgagagagagagagagaggtatgcatcactcatcactgtgctgagtaccgcgcgagaaatgaaggcgaggggtatatcatgggtagtgctagttttaggaagagaaataaagcaaaatatcggattaatatccacttttggtgaagaaaaaaaaaaaaaaaaaaaaaactcgaggaggggccgcgggtacc

SEQ ID NO: 21007 - DNA, 985 bp, Zea mays
gtcctcaacagaaagcaaaagagaaacgtcacttctccgcgtataaaagcatccgcctcaaccccgcccggcggactgctccaccagttgcagagtccagagtccagacgccagacgccctctacttctcttctctctagttatacatttcaaactcttggccgccgcagcggtctctgttcgccgcgccccgccgcagaaatggcgctgccgaatcagcaggttgtggattaccccagcttcaagctcgtcatcgttggcgacggtggaactggcaaaaccacatttgtgaagaggcatcttactggcgagtttgagaagaaatatgagcccaccattggtgttgaagttcaccctctggattttagcactaactgtggcaaaattcgcttctattgctgggacactgctgggcaagaaaagttcggtggcctcagggatggctactacattcatggtcagtgtgccatcattatgtttgatgtcacttcgaggctgacatacaagaatgttccaacatggcacagggacctgtgcagggtgtgtgagaacatccccatcgttctctgcggaaacaaggttgatgtaaagaacaggcaggtcaaagccaagcaagttacattccacaggaagaagaacttgcagtactatgagatttctgccaagagcaattacaactttgagaagcccttcctttacctcgcaaggaagctggcaggggatcagaaccttcactttgtcgaagccgttgctctgaagcccaccggaagtgcagattgatatggccatgcagcagcagcatgaagctgagcttgcagctgccgctgcgcaacccctccctgatgacgatgatgacctgatcgaatagatgttccatggcccttgttgatgcgagggggagcttttattacaaatccgtggtggttcagttcttgtcaggcctagccgtgtgggtgtcatccttcacagtagtattatgtgcgta

SEQ ID NO: 21008 - DNA, 6123 bp, Zea mays
  misc_feature (3404)..(3404): n is a, c, g, or t
  misc_feature (3406)..(3406): n is a, c, g, or t
tggatggaaaaaccaccaaaataaaagttgtaggtcttgaaatgtaatgaaactttgtaattgtcaacttttttatttgaaattatcttatcaatatgggtgtaaataaatgtttagtgctaataaatatggtttaaaccctcaaatatatatacttttaggatatttttattatttaaacatcatatgatgttatggatccgttagtcccatcagaccgactcgtcacggttattaacctagcggaccgtgtttggacctcgctcgaggcctatgggccagcacaacccgctagctaatcctgggcatgcagacacggtctcaatccattccggacctagctatgttcgggccgagccgccacagctcgtctacttggacatctatagtttaattatacggtagtggtgatggacgacgtaatgggcatgggcgtcggcgtggatggacctaccattatgatgttatgtcagtctaaacgtcatctaaaatacaagtagaaccatacaactcatcgtggaagttttcaaatatgacatgtctaatatcaatatgatataaaatattttatgttgtgcaaaaagacgtaccataaatctatcttcagtagagtatggaaaatagggaacgtgttgaaaagagaagtttaaaataggagataagataagagatatgtcgaagatagtctaacatatccttataaacaatcgtcttggatgttatacaatgtttgtttaagtctaaccgtaatttgatactagatggaaactaaaatcggactatttaaacttattactgctttcactcgagtgttagtattatcatttatgttacaattcgtgaaccaaataatgccttagctatagcatgaaccctgtatatcacgcctagagaaggcagcgacgagcacgtttgaccgttttttttttttgcttttttgaaccttttccgaaagattttctcctgatttgttaatccatcacgttttacgtatcctatgtgattataatcatcatatataccagtattaacttgtaggtagccaagctaagctagcatttgcggcggacgatcgagacacacgacacatgtaatacagctacctagctctcccaaggtttagttgcatgcaagatgccacgttcttcatctggtcggcacgtgttggacggctggctcatgagacgcgagcccgacaatataaagccacgttcattatcgcagacctccttttggatgaggccgaccggccgtttctaggaaagcagtcgccgtccatctcttgccatgtagacgtcagcttaatttatagattttagtgtcatttatattgacgacgagatatctattttctaaattcaaactaaaaaagacgcaattgtaaaaatctttcaaaaaagggtcaaaaagccaaaaaaaaaagacgggcacgtttgatggattggatgtgcttgctacacggcgatcacgatgcttgatacgtactttccattgatacaacagtggctaagttaaagaaaaaattctttaacttataaatattttaagccaaactttataaaaagtaggagaggaacatccctgaccaaatatgagtttgtttgataaagctctggctttgactttttttctaaaaaatagctttatttaagttaaagctatttcgtaaatcgtttgttagaaacggcttagcttaaggtcaaagtcatgtctatgtattaaagtgttaaagccagagccagatcataaagctattatttataacttattctcgacagtaaaaacggctgacttttaggtatttcccgtaataaaccgtttttaaagaaaatgtttagtaggacctcaactttttaaaagagaagttagagccaaagttctgccaaacgctcactcggcggcagggcagtcacgcagtgacaacggtcaaaacgagacggaggcagccgcgcaggtgtccgttggcgtagagacgactgttcgcgcgcaggccgaaaatcggggcccaatgggcccagatacctcgcgtgggcggaaagctagcgacgcccaccgatccgcaccttccgctgcgggcaccagatccctgcgtccatccaaagctacacctacacggccacacgggccacaccggcaccgctcccccaccagaaagcaatagagaagcgccatttcccccatataaaagcccccgcgtcggccccttcagctccagacgccctctactaatccagcccatttcgaactctctctagacgcttcctcggtctctctgttcaccgccgccccgtaccgtactcctcttcgcgccgtagaaatggtgagcacgaactgccgcgatagatcgattattccagggtggttgtcgctcggtgatcctgacgtagatcctgcggtttgccttggtcggatcgtctgatcgttcggtgattgtgtggttttttttatgtcgcaggcgctgccgaatcagcagggcgtggattaccccagcttcaagctcgtcatcgttggcgacggtggaactggtgattctctctggccttccatatgcctcgaatgttgttgttattattattattattcgtatccggatgttgggagatacagtttctggtgcccgcgccacgtttattgccgtgatttcttagagatctggcggactgggtactgatccgtggttgaggcagcagatattttgcccggtgggattgtgggaaggcatatggatatgggattggtgggggggcgtggttggttttgtgggcactggattctacacggagggccgttagctattcgtgtgctgatttgggggtttttagccatctttgaaacgcagtaataggaaaacataggaataaaatgctctaacatcttgaatcctatggattgagaaagcacataaaactgccagagcaagtttaaacgtattagacggatcacaggaaaaacagaggaattcgatgagagactgacacgaaggaagctttccatgaggttcaacctctgtagtaaaaattgttccaaaattcctatgaaacaagccattaaataggatttgcaaaaaacccactcctttgttccaaaggggttattcctataggatttgtatcctcttgtgttttggataatacatgggatgcatccggtttcttgcggattaattttgttactggcaatttttgtcttcttgttctgaccagccttaaaggctgtatcatcttctgctgatagtacccttgcaacaaggatctactcaacagtaccgtaagctgtttggtgactggtgagaatatggttaaggagacttgaaaggatggaagatatctaaagatttagtcttgaatatgagtgcatggataacagctatccatctgcggaaccttaaattgcggttttggttnanttttaactctggcctatcccaacttgcttgggactaaaaaggctttattgttgtactgtttagtctctgatgaaaggttgaggaattactcaaaaaactcggccggggagggaaagaccgccctcccggtattatattaagaagagaccgaaacattggtcccggccgagaaaattcccgaaccctggccccccatcactaacgggtcgacgtcaactgtccactctacaacggcccaaccggagggtggcgcacaggacatcgtaacccgagagcggatggggcacaacgaggggatttttttaaccaagcctgaaaattcgctcccgaggggaatcgaacccaggacttggaggtgctactcggaagtcctcaaccactaggctagaggccctttcgcggttgaggagttactcgaggacagaatgtttatatctgatcagaaataagtgttgcagttcgcacatgattttaattcgaagcaatttggggtaggataatgggtattcaacttaaaataaaaggtgtgctccttttcaaaacaggtattgtgttgatatatgtttagtaaaaggcgtgcacatagaagggtacccatgtggttaaaaatctatgtgcaatctacagtgttgaggtgcattggaggttaacttttggttgtgtgtttctcattagtataaagtgccctgttctttttcagtgattacaaatttacaatttgcaagtgctggctacattacttgacttgctgctgtgttcatattttatattataaagtaagtttaattatttcagtttatttaaatgactttaattcttgccaataattgtctaatgccttgtgctttcttgcaggtaaaaccacatttgtgaaaaggcatcttactggcgagtttgagaagaaatatgagcgtatgtctcatatgattgttactgtatcattgtatgtctcatcattgccttggggaacactgaacttataatcacttgaacttctgttctccattgcagccaccattggtgttgaagttcaccctctggattttagcactaactgtggcaaaattcgcttttattgctgggacactgctgggcaagaaaagttcggtggccttagggatggctactagtaagtgataaattcatatttcattcaatgtgtttatatttcatccaatgtgtttatttgtgttcatgtaaagctatgtgcctatgtctctatgcatactatgttgttctgattgctccaggctgcaattacgcattttagaggttgtcattgggtattctggaactttctttattgatgaatacttcaagaaagttagatagatcacatcttgagattctctttgatagtttgaaaaattgctgacgtaccacctttttaaccacataagggcttgtttggatgcaaatgtatccacatcattccgtgtgttggagtaggtaggaatggattttggtctaagttcctttgggggattgaaagggatggagggcaacaaaattcccctctggcccttgttcggttgcatggtgattgagggggagggattaaatctctttctattcaatttttgactagcaagggatttaatcctgttcaaccgccttcaatccactcctaaccgaacaagcccccaatcgggggcatcatgtccgtatccgtacatcctgaaacgccgtcctgaaaatcttcagtggttagctagtatcccatcagcattcggttaggtttataatcttatagcaagttataaccatttttctttcatccagtgttaagtcttttgctttttcattcatttgcccttgtctaaattgaaattccaaccatctgatctggcagcattcatggtcagtgtgccatcattatgtttgatgtcacttctaggctgacatacaagaatgttccgacatggcacagggatctgtgcaggttagtatcggtacaatttgggtaaaaggttagctatggttgacgtacaagaatgttccgacatggcacagggatctgtgcagggtctgtgagaacatccccattgttctttgtggtaacaaggttgatgtcaagaacaggcaagtcaaggccaagcaagttacattccaccggaagaagaacttgcagtactatgagatttctgccaagagcaattacaactttgagaagcccttcctttacctcgctaggaagctggcaggggatcagaaccttcactttgttgaagctgttgctctgaagccaccagaagtgcagattgatatggccctgcagcagcagcatgaagctgagcttgcagctgccgctgcgcagcccctccccgatgacgatgatgacctgatcgaatagatatgttatacatggcccttgttgatgactcttgttaaaaatctgtggtggttcaatccttgttagtgttaggcggtacctgaatgttctcttgatgtatccgaagagttgagaaggaagttaatgactcagtatcctgttggcttgttgacttggttttttggtgaacctgtccttgagggaatacagaggtattgtcaggcagtacgcttcaaaacaaaaaagaaactttctgtctattggtatcgattgaagcgtggcttgtatgaaagacgatgaggaattcgtgggccatgggcggcgtggttgaacgaagattaaatcgtttaaagcaaaaaaaaaaaaaaaaaaaaaaaaaccttag

SEQ ID NO: 21009 - DNA, 1128 bp, Zea mays
gccgggaaaaaaaaaaaaaaaaaaaaaaaaaccctcgcgggccggcccgggacagcgcctccagttgcagagtccagacgccagacgccctctacttctctctagttagtgtacatttcaaactcttggccgccgcctcgctctctgttcgccgcgccccgccgcagaaatggcgctgccgaatcagcaggttgtggattaccccagcttcaagctcgtcatcgttggcgacggtggaactggcaaaaccacatttgtgaagaggcatcttactggcgagtttgagaagaaatatgagcccaccattggtgttgaagttcaccctctggattttagcactaactgtggcaaaattcgcttctattgctgggacactgctgggcaagaaaagttcggtggcctcagggatggctactacattcatggtcagtgtgccatcattatgtttgatgtcacttcgaggctgacatacaagaatgttccaacatggcacagggacctgtgcagggtgtgtgagaacatccccatcgttctctgcggaaacaaggttgatgtaaagaacaggcaggtcaaagccaagcaagttacattccacaggaagaagaacttgcagtactatgagatttctgccaagagcaattacaactttgagaagcccttcctttacctcgcaaggaagctggcaggggatcagaaccttcactttgtcgaagccgttgctctgaagccaccggaagtgcagattgatatggccatgcagcagcagcatgaagctgagcttgcagctgccgctgcgcaacccctccctgatgacgatgatgacctgatcgaatagatgttccatggcccttgttgatgcgagggggagagcttttattacaaatccgtggtggttcagttcttgtcaggcctagccgtacgtgatttttctgttatgtaacctgctgttgacgagggtttttggtgatccttgattttggtaatacatcgctattgtcaggcagcatgtttcagagcttgattgtgcatgtttattggtttaattgctatcgattgatttgaagccgggcttgttttaatggggacgattacttccccgttggcgggttgaaccagtgaacgaaatca

SEQ ID NO: 21010 - DNA, 1074 bp, Zea mays
cattgttgggccccgccgggccggccagcagacgccctctactaatccagcccatttcgaactctctctagacgcttcctcggtctctctgttcaccgccgccccgtaccgtactcctcttcgcgccgtagaaatggcgctgccgaatcagcagggcgtggattaccccagcttcaagctcgtcatcgttggcgacggtggaactggtaaaaccacatttgtgaaaaggcatcttactggcgagtttgagaagaaatatgagcccaccattggtgttgaagttcaccctctggattttagcactaactgtggcaaaattcgcttttattgctgggacactgctgggcaagaaaagttcggtggccttagggatggctactacattcatggtcagtgtgccatcattatgtttgatgtcacttctaggctgacatacaagaatgttccgacatggcacagggatctgtgcagggtctgtgagaacatccccattgttctttgtggtaacaaggttgatgtcaagaacaggcaagtcaaggccaagcaagttacattccaccggaagaagaacttgcagtactatgagatttctgccaagagcaattacaactttgagaagcccttcctttacctcgctaggaagctggcaggggatcagaaccttcactttgttgaagctgttgctctgaagccaccagaagtgcagattgatatggccctgcagcagcagcatgaagctgagcttgcagctgccgctgcgcagcccctccccgatgacgatgatgacctgatcgaatagatatgttatacatggcccttgttgatgactcttgttaaaaatctgtggtggttcaatccttgttagagttaggcagtacctgaatgttctcttgatgtattcgaagagttgagaaggaagttaatgacatcattatcctgttggcttgttgacttggttttttggtgaacctgtccttgagggaatacagaggtattgtcaggcagtacgcttcagtgcctcgtgggtgggaggcccggtacaaaaaaaaaactagagggggggcccggtaccca

SEQ ID NO: 21011 - DNA, 1476 bp, Zea mays
agatagaatgtagttcattccacatcacagaatagaacattgttctttgaaacttttaaccatgaaataaattttctatcacccggggggaaacgacgggcggattattctgttggcttttcttgcaggtaaccgaaaaatccatgttgggcacgctcatttaagctgaaagtagtcaaaccgcacgcacatttcaacggattccaaaagatacaagctgcggcaatgaagccgcttggtcttcagcagagtagaccgacaccaaccggattcactaacaaggtgtacttaaaaaatactcttaactttatcagcccaaccagaccaatattttcaagctctcctcaacaaccgtgcacatcttcagacgcagcaacaaccaacaaatttggcatttcctcacgcaacacaaccgagcaatactacaattcaagtaacaaatgccacccctcctttgctgtgaagtgacccatcagataactccagcacgaacaggcataagacctaacataagtaaggataccaaagccacccaaagtgctccagatcagaactggagatcacaaagggcctaaatagggccataagcagcttattcagatgcagttcaccttacaagatgcttcactggctgaagttcatctctgagtatctcctaggtttgttctggcgctgatcaagctcctcatttccaatatcatttcgaggaggagatttagaccctctattagcactaggttccctggatggaactgatgatgatgtctgtcctggagacctggagtaaaaactcggatcaagagttatatatggtggatatgatgctccaaaagcaccagcagcaccagccaataatggcaaccatgccatttcattgtttcccattcccatctgctgttgagatacatagccagggagggccataccaacagtaggaactccaagaccaccaggatgctgacccccaaattgcatcactggcagcaaagctggagtgccaggaaaattttgatctccctgggaaagaccagcagccccaataacttgggcaccaccatacatcaatgaatccattccagtttcctggctattggcttttaccactgcagaagctgtctttgaattgttcagactagggtatgaaccattctcgccactttctgttgatttaacagatagatgctgagctgctggtaatgaattgttagtccgatggctcaattgctgagttggaattcttgctgcagactgattctgcacttgcattgacttctggtgcatcactggtccatgactttgtggatgtgtagaaatccttgacgtttggtgaagcgatgaagtaggctgattatttgaagatattccaatgtttgaattgccccctgaagcccggacaatagggatggctaggatttccgatatatagtaatcctaattcagtacgccgtggcaccctcccggccagcctcgggggtc

SEQ ID NO: 21012 - DNA, 4461 bp, Zea mays
  misc_feature (4133)..(4133): n is a, c, g, or t
ctgtaaggctatgacccgcacccgtgaaatgctctattcgcgatatgacatcgaaaattatataaaatctttgtatgccactggatctacatatcatacatataaaaaatatcacctaaatgtcataatggcatataagggatgggtataaaatccaatggcatggctctttcaacattagactagtttgctagtcatatgggttttcagaagcatcgtcatggatatatgaacttacgtttaattacttttgtactagttatttttatgctttctaaaaaggtgataacatgctaacataaaaaattgtcctctatagttgaatgtaatccaacctagggttagtgcgccctatgcccctattccgtgaaaatgtggtgaatctgatagacaagatttgatgttagctccctaattcttttggggcaattacgtcaatgaccctattttaggtgtaactacaaatttgcccttagtttttaaactttgtgtgttttcctctgttttttaaaatgaaactgttgtatatgctcctagtctgttaattgtactgaaggagtgaagggtgtgaagtacgttgcacggtgtaatatgaaatttgggcttctcttgaaccatgtagctttgtttacactgtcaaggtgagtgccgtcgtgacactgacaaggcaacgttggtagacaagcagatcaaagcgctaaagataccataaacatggacgaacaaacaaggctttatgatgatttgacaacacaagggatcaggttgaagcagctgcagccataaaagtacaagggatcaggctgaaggtctaacgtaatcaactaattgaaagtgttcgaataaaacataacacgatgtatattcaatcatttttcaccaatcgtcgatatgtccgagtggttaaggagacagacttgaaatctgttgggctacgcccgcgcaggttcgaaccctgctgtcgacgttttttttgaattttgccccaactgttttttttcatctcattctgtaagattcgatgcacgccgttgatactttccgttgtaaaagaactgttgctagaatagctcccggcgaagcaaaggtaagtttagagccccagttgtatttagattatttctgagcttaactgatgttcttgtagtagtaaacgacgtgatcgtcaacactataggtcacgtatgatggtttcgcaggcagtgcttggataggcttatgatcattgatcctgagcctatctgttcgaaatcggactagcgcttggcccagacagctagctcccgttgtggagccaaccaaacagaccgcatgctcttaactgcagccgaataagcccgatcaatcaggttgatccttgaccactcaagcttcggctgtttgccttcttcggtgtcctagagaagattcggggattccaaggctcaaagagctgaatcaggaaagatctagatgagtctagagtgttctatacaatcaaggacagttctaaaaccctagtctaaaaatcaggcttcaatgcgtttaattgataaagcttttgacaactatatagctttatgattgtgaacatctgacttttttttagcaaaaccagtagatggatgacaattccaaataaaaatcaaaagttctgcatagtataaaattcagtacttgcctaaacaacttctacaacacatcagacatcactttcttaataaattactagagtaaagaactttctagctaacgttaccacggaaaattcatacaataaagcagctctattaggttcacccattctctaataccttttttttcaccaatcaaagtaattgattatgaaaatattcccttgagatagaaaccatgttccagtagtattggtcaacagaaagaacattccactgcatgaacgtgagaataaaaacaacatataagtaatattattaagtcccatgacatttttttggcctgaatgcctgatacactttctaatagcattaaagctgccacaatatctaaggttgtaggttgatgattatctaaagttgatgagtctacttctcgtcaggttgttcaccatgccatgcccacacaatatcttctagtgccggtctcatgctttggttcataaagttatgatactcaaggatgtcaccattgattttcttgatctccacgagatgataatttggtgtgatttgaaatatctcagcatttatagacatcacaccttttattcctgatttggcagcttccatattcaacaatccaccagtttttgttataaccttcagatccaggctctttgcaacttccattagctttgtgataattgtcatagctgtgttggtagacatgaatttagactccttgtttgagttctcaaatataccagagagatcaaacccgttagacagggagatgatatcaaaagcattcaaaatagtcagtttctctgccgctgaattacactcgaccatattgctatttaaggaattcaaagccaaatccatgtcactaggcacataatctctcgttgtagaatcaaacaatcttgcatcaagaccaattctaaaccaaggatgagtccttatttcttcaatagatattcgtctattagggtttggatgaaggatgcgccgcaaaagctttcgaacatctgaagaaaaccaacttggccatttgagttctgctttgcaaattttcttatacatgtccatcatgttcttgtcttggaaaggaagatagcccgccaacaacacatagaggatcactccacaagcccatatgtcagcttttgcaccatcatatcctttttgactaattacttctggagcaacatatgcaggagtcccacaaattgtgtggagtaacccatcttttctcttgcagtttggaagtgcactcaaaccaaagtctgaaatctttaagttgtgacttccgtcaagaagaagattttcgggctttagatctctatgataaacttgtctagtatggcagaagtcaacagcactgatcaattgttggaaatatgtacgagcaacatcttcttttaaccttccacgttgaacctttttgaacaactctcctcccttgacatactctatcacaaaatatatcttggttttggtagccataacctcatacaattggacaatgtttggatgttttaccaacttcatcaccgaaatctcttgaattatttgatccataagaccacacttcttgatcttatctttgtcaatcaccttgatagcaacgctttctgaagtcttaacattgcgagcatggtaaactttggcaaaactcccttttccaagtaactttcccatctcatatctctgcattagaatattctctttctcagccatcttctcagtgttctactttcaaacttgaataagttggcgatgaacaacaatgacgtataagatgctggtaattataagtgaccagcaattttaaccatctccacctagaaagaaaccagagacgatggttgagctacaactcgcggccccattatgtgtgtgtgcatgaggcaattgttgtgcatatatttgcagtccaatgtcatcgagatcaagtaaagtacaactatgtttgtgtatcctgccaatttccaggcaaggtactccatcatgcaaccacatctttctgcatccctttgatattttggacctctgactggaagcaaaatactgatcccgggcgatccaggcaacgcggaggagccgctcccgaagtcagatttcctcttcagaaaagattcaagtaagaatgggtagaggagcgatggacacgagaagagggagaggggatggcgatttttctgaagatccaatcgggtttgccaagccaaagcatgcgcacgccgtaggagagagaccccggccccttgtttataggcgaggaggcactgactccgccccctctcgtcccaggggtccgtaagtactcaccatagccactgcccatgggcccatcagaacagaaacatcgattggacattggagtggactaggcagtgagtggagtggataaaattgttaggcatatcacatagcgtttgtcttctgtatatatgaagcgacccgatgattatactgatcaatggtaatcgttgagtaaaaggtaaatgaaanccaccagatgcgggattgaacttgttggctgttatctaaacaatatcaccaggaagtcaaaactaagtccgaaagatgttgtagatgataagttagagcctggaatgggaaaggaacaagacaccagagcaaatctgccgaaggggaacatggccagttcatggttcctctgaaagtttgctgagttgatgcttctccaccgtcacctctttcagccagtagtttggcagcacagggaaagtagtggagctgtggagggaactgaagcctatgtcgccattgtttctattctctacttcacgaatggccggcctcgaggtacccaatg

SEQ ID NO: 21013 - DNA, 769 bp, Zea mays
cacccattctctaatatctgtttttttcaccaatcaaagtaattgattatcaaaatgttccttcagatagaaactatgttccggtcaatagaaagaacactttactgcatgacagcatgagcatgagaataaaaacaacatagaagtaatattattaagtcccatgacattttttttggcctgatacactttctaatagcattacacctgtcataatatctaaggttgtaggttgacgattatctaaagttgatgagtctacttctcgtcaggttgttcaccatgccatgcccacacaatatcttctagtgccggtctcatgctttggttcataaagttatgatactcaaggatgtcaccattgattttcttgatctccacgagatgataatttggtgtgatttgaaatatctcagcatttatagacatcacaccttttattcctgatttggcagcttccatattcaacaacccaccagtttttgttataaccttcagatccaagctctttgcaacttccattagcttggtgataattgtcatagctgtgttggtagacatgaatttagactccttgtttgagttctcaaatataccagagagatcaaacccgttagacagggagatgatatcaaaagcattcaaaatagtcagtttctctgccgctgaattacactcgaccatattgctatttaaggaattcaaagccaattcctggcccctggcccctggatctctcgttgtagaatcaaacaatcttgcatcaaga

SEQ ID NO: 21014 - DNA, 1893 bp, Zea mays
ataccagcgccgttaaatttccaacgcccctgcccgtccggccgtccccacactagactagaccgaccgccaccattgcccccgtgtcttaacacggggcgaaaattcctttcgagatctcgcttctctaagcttccgcggcggcacggtgatgactatgacccccgctccggtggcgaacggcgcagcggccggcgctggcgggggcatgaagcggcggggcggtaggttgtggtacgcggccgccggtgccctcctcgtggccctcctcgccgtggccgtgagctaccgcagcttcccgggcgtcccttcctccccctcgtcacctggaagctgcggctgccctgctgcgaggaagtacacggggatggtggaggactgctgctgcgactatgagacggtggacgccatcaacgaggaggtcctgcatccaatcctacaggaactcgttaagttgcccttcttcaggtacttcaaggttaaattgtggtgtgactgccctttttggcccgatgatggaatgtgcaagcttagagattgtagtgtttgtgagtgtccggagaatgagttccctgaaccattcaggaaaccttacaatggactttctccagatagtatgatgtgccaagaaggaaaaccccaggctgccgttgataaaactcttgacagcaaggttttcaaaggatgggttgaaactgacaatccgtggacatctgatgacgagactgataataatgagatgacttacgtgaatcttcaactgaatcctgaacgatacactggctatactggtgattcagcaagaagaatatgggacgctatttacaaagagaactgtccaaaatatccctctgaagaactgtgccatgagaagaaggcattgtacaagcttatttcaggattgcactcctcaatttcagtgcatattgcttatgattaccttcttgatgaatctactaactcatggggacaaaatcttcctttgttgtatgaccgcgtcctgaagtacccagaacgtgtccagaatctgtacttcacctacctgtttgttcttcgggccgtgacaaaggcagcaaattatcttgagcaggctgagtacaataccggcaatcctgaagacgacttgaaaacagaatctcttgtgaagcagttgctttacaattccaagttaagatctgcatgtccattgccttttgatgaagccaaactttggcaaggcgaaaatggtcctgagctaaagcaagagattcagaagcaatttagaaacattagtgcaattatggactgtgttggatgcgagaagtgccgactgtggggaaagctccaagttcatggtcttggaactgcactgaaaattcttttctctgttgatggggacagccatatgaatcagccattgcagctgcagcgaaatgaggtcattgcattgttcaatcttctgaacaggctctcagagtctgtcaaatttgtacatgaaaaaggatcatcaattgaagaagtcattgaggaacagatcccttcaacggttcaaaagagtgtttccatgccgaatcttaaactggacttcctctgagatgtatgagagtaatttgtagttatacaagattgcaatgacatgctggaagattaacatagacatgtacggatataacgaaagattaacatgtgctggaagcagtttcatacatacttgtgttgcagctgtatttaagagaatgagagatacagatacttttgagctaaatgcgatgacacagttaacatagcccccccgcacctcaaacttttccgtgtatagggttcctccgctgtaaatcaaaggatgtcacccctctgcactcgccatgatcaagagaatattctcgctcaacttgatcaaaaaaaaaaaaaaaa

SEQ ID NO: 21015 - DNA, 1174 bp, Zea mays
tagggcggccccccctttttttctgaggcacattctcttagttactccccctttttttttttaagagggaataaatccactactaatcaaaatcctcatccatccacttcaatacacctcaatccaaatggaacgcgttcagatagctcttggtaaacttaaaaaataatgacaatagcacggcattctagaccagcccttgtagacgtctagtgtcaaccatattcttatgttgcaacagatgctatttcatacagatatagaaactccaaacgtttaatgattaatcaacccagacgagaacaggaaaaaaatacatgattatcacgtgtaaaatcaaacccagagaatcccattcgcctttgtaatttcttgcatcatcgaccgcttgttaggataggtgaagtatacaacaaaaagacttcagaagtattagcaccgtcaacgttctgaaatacaacagcaatcgagttaagctgattggaatacatgtacaaaaggtataattacagcatcgtgatggcagccacgacggtggccatgtagatttacatctcctgccgcccctgcaaagaccagtccccaaggcacttgaaagagcccattgagaattatctgttctaatgtagttggagatggatctaatgttttcccttggacggatcacacagatgaagcctgcagagaagtctttcatggaagtaagcctaaaattcacatgatgtggtcaagcttattcagcattccaatgcatacctctggatctcaaccatattttcctcaatgaagcaacccgaccccatgtttatcatgtctgcgccattgtgttgaaggatcctgagcttcccttccttagtcccataaacaaggccacctcctggtaaaggatgaaagcatgcaacattgacttcatcttcggcactaggaagcactctcacaagctccatatctgaaactctatatacctccaaaatagtatatacaggaatcccattttctccctccacgactatgctcctaagcagcgagctatgacgacgaccatatgccaaaagtatgtgttcggatgtaggtgagaactgaatggaagttaagcaatgtgctgcccttattgctctagaagcaagaatatccccaaatgtcgaaaaaacgtgcgaataaacccgaagctcat

SEQ ID NO: 21016 - DNA, 917 bp, Zea mays
aaggtagtttcagttccttcgcgtgcctcgcggcccgccttcccctaactccgccgccactgccgtccgcgctcgccgtcgccccgaacctatcgcccactgcatttttccggcggaggtatgcgatgaggctgctgcaagcggaggagctatttcggaaggttctggaggtcgggtcgaagaataaggcggctcggctgctggggctcgacgtcggcagcaagtacgtcggggtggccatctccgatgagaagaacagggtcgctatgcctctgagtgttttgtgtcggacaaaaacaaacatcaacttgatggcagatgatttcaaaacattggtttcgatgtattccatagctgggttcgttgtgggctatccattcaaaatctatggtcaaccttgtgcaagtgcaatccaagtaagtcttgctggggaactttgtaaaacagggaaacttgatgatctgccctacgcatattgggatgaaaatttcacctcaaagtgtgtagaagccctcttgcatcccctgaatctaaaagacttggacgatgccaaaacaatgacagacaaatttgctgcagtctgtatactccagggttatcttgacaacatgaacagaaaactgagatccacagataagtctgaagcataaaggtggcacctaagattccagtttgaactaaaccaaagagcaagggaaccttttttttgatagaacaggaggggagggcccctactgaaaattttatttaaaatttgaaaagaaaacaaagtttagaacaaacaagaagacaaattacagggggttagggagagtttgtactgccattgttttctactgccattgttgaagccaagtcgggatggcagaatcaaatctacccaaagctctgtgaatgacaaggagcaattcatttgc

SEQ ID NO: 21017 - DNA, 2857 bp, Zea mays
ttttttttttttttttttttttaaacaacttaagagaccctatattaaacatcattgtacatgtcaggttaggctacaaggcgccattgttctccaagacaagctagtcagctagatatgactggacggctaggcgatgtcttggggcccttctttttttttttttatgaaaccagtatgaatgagcatttattttttcacaaaaaagtttgaattcttgacaaacttaaagtagcaatgctgtacatggtcgcctagatgaaccaccaggccggatctgcttcatgccactgcattcagatgtttcttgaaccataccccaatgttgaggaagctttcgaaatcggaccgcggtaaattgatttcgtgtatgtcctctgggaacatcatgattttgacatcgcctcctctttctatcaggctccttgcgtactgtaggccattagaagcaggcactcgaaggtcagctccgccaagaagcataagaaggggcgctttgactttagagacatgggcgatcggcgatctctggtagaagagacgaagatggtcgggcgaaggcgcttcagaggcgtatcgcttcgcttgggttccgcaggccactacgtaacaccagtccgggatgtcggtggtgccggccatcagcgacaggttgcagacagggttccgagcagctgccacggcgaacctgtccggagcctgaccgatgagatgtgttgtcaggaacccaccatgcgagatcccgacaacagctactctagacgcatctaccagctcttcctcgacggcgaagtctagcgctgcaaggcagtcctgaacatcctgggatccaacttttccagggagcgactgcaaggcttcctctccataacctggcgtgcctcggtagtttacaacaagcaggttgaatccaagcgaagcaaggaacgccgaggattttgagtagcttgatacggacaccgagtgtgggccgccgtgaaggaccacaacagttggactgcgtgagctacccttgcagctgcaggacacgaatatggcctcgagtggaagcttgccaccgtcagagaggtcagcagatgggctagggacagggattttaagtatgctgacgctgtgatgcagcaacaaggacttaaccttgctgttggatgccatgaatggactagtaacttcatcccaggtccatctacgtgcttcacctcagctggtgtcacggcgagacgtcgtcccgtagctgatggaaggagggtcgatgggactacttgacacagcaagaacattggtgccatctaacgcaagagcacgccacgagtagcacgagtcttccggagttattcttgccactttgccacttaacacatcaaccgatagtatcacttcggcacttctccaggcagatgtcaatatcactgtacgtccgtcggagagccaaggatcgggtagcacggatgaacagtagaggcctggaaaacagccgccgtcgtcgtcttcagggcacattacaacaggtaccacttgagtaacatcgagttgttcatccattttccagtccgaaggccagttgatcacatgcagggaatccgttgcgttgtgtgcaccgctgtccacggcttgttttgaagacaggaagaccagaagccttccatcccggctgaaccgtggaaacaaagcactgctgaatcctggggttaggttgcgcgccaccgcaccgccggagcatgatttgccatcactgctgctggtcgtagccggtggcggctctggtccttggatagggcaaggggctgcatagagagcacatggcctgttggagcagtacttgatgccgagttttctagcagtgttctggaagaacccgttgcgctctgaccatccaacgaaaaccagatacttgtgcctgccagtgccacctggtgattccggagcccaaacaacctgcccaacgctcaacgatgttgggacgcctttagccgctaccacttctcctctgggaatgtcaagaacaaacagtgagggtcttcctttcttggagtacgtttcaccccagtcctcctcccacacgctctgccctttccaggcactgcagtcttcctcggaacaaccttcccctgtggtatccggaacgattgaaagctggtcttggtggggctggagcttcagcgacgtatgctaccatggtctcttcttgattccaagaaacaccatgaaaccattcatccgtgtagagaggaccgtgcacagaacctgctacgtgtatctccttctccacatgtgactggcaaacgatttcgagcttggtggggcagcctctctccccgtttcgcactacgaggagcttcgacccggaaggggacggaacggtggcggacactccggttgtttcagtggggaaaggggaccactggaaatccggagaggtggtgccggtgccggtgccggtgccggctctcgtcgtaatatgagaatacaaaacgtattttctgttggtgttcgccagcaagtctggctggctaatggagaacatcgctctggatctgtcctcatcgttggttttgaggatgaaagcactgtcgatgcttgggacgttggtgaattcttgcagtagcttggattgcgaggcatattcttcaggtgccattgttgcatccatcctgactggatcttcttctttctctcccaggacacatgcacaccttgatgacccaccggagataattggatttttgccacttgtcttcacagaattttctgctctaatttgcagtgaagcaacaacaccgccatatgggagtacttgagtccagcagaggaagaaagacgccacggcccgcccgccaaaggtcccagcccggccggc

SEQ ID NO: 21018 - DNA, 1298 bp, Zea mays
ttttttttttttttttttttttttttttttgtataataagtgttcctttatttcacaatatatatcacataggtttaacaacagatcattgtgtgtgcaatgcatatagtatgccctttgttttcacagtagcaatataacttattctccagccctataaatggccaaagcagcagaaggccttccgaaccagacgctccccatacacgaccttgtcatacttggcgacgccgcctgttttctccacgcacaactcaacgggctctacggcagcatcaaaatcggtctcatagaaaaacacagcagaaacgcggcgttgatgggagctgttgatgactctatgaactgtgggttggtaaattccatttgaccagacctggagcatgtcaccgatgttgcaaagaaaggtttcaggaatcgggttggcacgtatccacacaccggaacgattttggacctcaagggcacaaatgtcatcatcctggttaaccagtgtaacaagtccgtagtctgtgtgcgatcccatcatcccagtatcatcagtgcgtttctcatcactgcttgaaacagggtagctaaccagcctgagagcccagtaaggatctcctgctattcccctttcaaaggcatcagcaggcccacccaatgccaaagctatacctcgcatgatcttccttgacagatctttgacaaggctgatatagttttccagcactaccttcaaatttgatgggtattcaggccacagattgtctccttcaagtgttttaccaaggtctccgtatttgccaggtgcaataggagtcaagcaattgactgcttcgtgcatatcacgtttttccttggtaacattctctcctagcttttgataccctctatacccactttgacgtgtcatcttaatcttcatcttttcctcatgtggaagctgaaagaatttgtgtgacacatccctcacttccctcattagcatctcacaaatgccgtggcctttcacataaaagaatccaacctccttgcaagcatagtccaacgttagaacaactcgtagcaaatccttatcatttgccatgtctggatcatcaatctttttgacaagtggggcaacatcgattagaggaatcgccgtgacatcattggaagaacccatatattgtttgtttgtttgtttgtttgtgcgcacgtacgctcaatcgtgaaattagagagatgttccaaaagcaaaaactaagacttagacttgctatatatatctgaacgaagtgagatgctggtgataatcgatcgaggaactaatt

SEQ ID NO: 21019 - DNA, 1804 bp, Zea mays
  misc_feature (1797)..(1798): n is a, c, g, or t
  misc_feature (1801)..(1804): n is a, c, g, or t
tcactcgtccggtcaaatatccttcctaattgcattgatgctaatgatgccctctctctaatcagctttctcaccgacggcgaccgaccgaccagccatataataaagaagcgaagcgaagcgagaccggaggggcacgagcgccaccgcatcccgcccgctcctccccgatctcctcgccattgccgccgccctgccaggattcgcgccctactcgcccagatccgaccgcggctctgattttccaaccgacgcaggagcgggacaccggacagcgtgatccctgcggctcgattgtaaattcgtgatctttcggggcattccttggtttgtctgtcggtgccggtggtgctgcgtttggagggccgcggagatgggcgtcggcggggagaagttccagctggggacggtgggagcgctgagcctctccgtggtgtcctctgtctccattgtcatctgcaacaaggcgctcatgagctccctcggctttaacttcgccactaccttgacgagctggcatctgctggttccttgcggcccccgtcgccggccggtatggatgaagttctttgagcataagccttttgattcaagaactgtcatgggatttggagtacttaacggaatctccattgggctcctcaacttgagtcttggcttcaactctgttgggttttaccagatgactaagctggcaatcatcccgtgcactgtcattttagagacacttttcttcaggaagaagttcagtcggagtatccagatgtccctttctgtgcttcttcttggtgttggtgttgcaactgtcactgatctgcaactcaatgctgtgggatccatactgtccttgctggcaattatcacgacttgcattgctcaaattatgacaaacactatccagaagaagttcaaggtctcatcaacccaactgctttaccagtcttgcccttaccaatcactgaccctgtttctcattggccccttccttgatggctttttgactaaccaaaatgtctttgcttttaattatacatctcaagttgtgtttttcatcgtcctgtcatgcttgatatctgtttcagtgaacttcagcactttccttgtgatcggaaagacatctcctgttacttaccaagtcctgggccatcttaaaacatgccttgttcttgcttttggttatgttttgcttcacgatccgtttagctggagaaacatacttggaatcctaattgctgtagttggaatggtcttgtattcatacttctgcacagtggagacccagcaaaaaaatgttgaagtctccccacaacaggtgaaagaaagcgaggcaggccctttgatcgcagactctatgagcaaagttgaaaacgggggtggtggtgttgatgacgagcctttgaaggtacccatgtggagctcaaagtactcgcgggagtgaaaaggtcacgatggcatggcaccatacaggattcaatttagtaggcagatagtagggttggaagccaacccagagtgtaatgaacatttcagttacatttttgggcttctttagtgtcgcagtctactagcagttaaaggatctgtttcttggaaggatcctaccttcagggctctcagacctaccttgaaactagacagcaggtattgtatgattgtatctcgatatgctccacatcctcttactgtaacttccaactggtacatggcgtgcctatatccaaagatagacctcattctttttgtatcaagaagatccggataagaagacttgtgcaagatttgtagcgtttaaagaannaannnn

SEQ ID NO: 21020 - DNA, 1799 bp, Zea mays
gcacgagaccattacctagaacatccggagcaccgaactctactctcgtctccctcctccccgttccttattcgccagaccggagggaggggtacgagcttcaccgctttcatcccgcccgcgctcctccccagatctcgtctccattaaagccgaccttgcccagattcgcgccctcctcgctcatatctgaaagcggctctgattttccaagccgaccgcaggagcggtgcaccgggccgcgtgattccggcggcttgatttggaatttgtgatctttcggggcattcgtcggtttgtctgtcggtgccggtggtgctgcgtttcgagggcagcgaagatgggtgtcggcggagagaagttccagctggggacggtgggggcgctgagcctatccgtggtctcctccgtctccattgtcatctgcaacaaggccctcatgagctccctcggctttaacttcgccactaccttgacaagctggcatctgctggttacattctgctcccttcatgtggcattatggatgaaattctttgagcataagccttttgattcaagaactgtcatgggatttggagtacttaatggaatctccattgggctcctcaacttgagtcttggcttcaactctgttgggttttaccagatgactaagctggcgatcatcccgtgcactgtcatcttagagacacttttcttcaggaagaagttcagtcggagtatccagatgtccctttctgtgctccttcttggtgttggtgttgcaactgtcactgatctgcaactcaatgctgtgggatccatactctccttgctggcaattatcacgacttgcattgctcaaattatgacaaacactatccagaagaagttcaaggtctcatcgacccaactgctctaccagtcttgcccttatcaatcactgaccctgtttctcattggccccttccttgatggctttttgactaaccaaaacgtctttgcttttaattatacatcacaagttgtgtttttcattgtgttgtcatgcctgatatcggtctcagtgaacttcagcacttttcttgtgattggaaagacgtctcctgttacttaccaagtcctgggccatcttaaaacatgccttgttcttacctttggttatgttttgcttcatgacccatttagctggagaaacatacttgggatcctaattgcagtagttggaatggtcttatattcatacttctgcacagtggagacccagcataagaacactgaagtctccccacagcaggtgaaagaaagtgaggcagcccctttgatctcagactctttgagcaaagttgaaaatgggggcggtgttgttgatgacgagcctttgaaggtacccatgtggagctcaaagtattcgcgggagtgaaattttctcccgctagacggtggcatcatacaggattcagtttagtaggcagatagtagggttggaagccaacccagagtgtaatgaacatttgagttacattttttggccttttttagcgtcacgatctactactggtaaaagggtctgtttcttgggaggatcttaccttcaggattgccagatatacattgaaactagacggcagatattgtatgatttgtatctggacatgttccacatcgtctaactgtaacttccaactggtacatggcatgcctatatccaaagatagatttcatttttttttgtatcagaaagatccggacaagacttgtgcaaaatttgtagtactattggttcgagtttgttgctttcaaaaaaaaaaaaaaaa

SEQ ID NO: 21021 - DNA, 955 bp, Zea mays
gcacgagaccattacctagaacatcctaatcgaaaaatcttcctctcgtcttccctcttcctctccgaggatacaaggcgccgtcccaggtagaggtagggtcgccaccaatcttgcaaaggttgcttattggcttcttcagcataacctcagtgttacacttgcagcatgtgacaccttcagatctggtgctgttgagcagctgagaactcatgcaaggaggcttcagatacctatatttgagaagggttatgagaaagatccggcagttgtagcgagggaggctattcaggaagcaacccggaacaaatcagatgttgttctggttgacactgctggacgtatgcaggacaatgagccactcatgagggcactctccaagctaatcaatctcaatagcccagacctggttttatttgttggagaagcattggttggaaacgatgctgtggatcagctcactaaatttaaccagaaattagcagacctatctgctgttcccactgctagattgatcgatggtatcctgctcaccaagtttgacaccatcgacgacaaggttggagcagcgctttccatggtctacatatctggagctccagtcatgttcgttggctgtggtcagtcctacacggacctgaagaagctgaacgtgaaatccattgtgaagaccctcctgaagtgattgcaccaccgtgttggaggtgcagtctgcccaaagtctgttatctattgtatccccagtgacctttgtcatcctcatgttggacgtcgtcgtggatttgtaactgtcggagttgcaacaaaacttgtgtgcttgcgtcaacgtgtgccgtcttgctctaataatgcactatctgcattttgaatgggtaaaaaatggatgagtatgcgagtttgctaaaaaaaaaaaaaaaaaaaaaaaaaaaaaaaaaaactcgagagtacttaactc

SEQ ID NO: 21022 - DNA, 2540 bp, Zea mays
  misc_feature (8)..(8): n is a, c, g, or t
  misc_feature (10)..(13): n is a, c, g, or t
  misc_feature (2511)..(2511): n is a, c, g, or t
ggccgggnannnnttaccatgggtaccctcgggccggccggaagggcccaaggcttctctatctagggattcatcttcctctcgtcttccctcttcctctccgaggatacaaggcgccgtcccaggtagaggtagggtcgccaccatgctggaggagctgctcatcttcacccggggcggcctcatcctgtggtcgtcctgccgggcgctcggcgccgcagccctcaagggctcccccatcgacgccctcatccgctcctgtctcctcgaggagcgatccgccgacgccagcttctcccaggacaattacgccctcaagtggaccttccacaacgacctcggccttgtcttcgtcgccgtataccagaagatactccacctcctctacgtcgacgatctcctcgccgccgtccgcaaggagttctcccagatctacgaccccaagcgcacctcctacgatgactttggggacatcttccgccagctccaccgcgaggccgaggcgcgcgccgaggaaatgaagaagtccaagcaggccctctcgtcccgtccgcagcctgctctcacccagaagaagcctggtcccaagggccgcggcggtgattcccgcggcggcgctgctaacaagggcggctctggtgccaaggatgactctgatggcgacggctatggcaaccaggaccaccgtactctggcaaatggtgccttcaagggccaagagaatggcgtccgcaaggagaattcttctcatggccgcactgttgttgtcaagggaaaggagaatggggcccccaaggatgaaggggccttcgatgtaagtaaactacagaagctacgggccaacaagaagaatggtgccactgacaatggaaccaagaagctgaccaaacctgacataaagaagaaagggaagcaagatagggtgtgggacgacaaaccttccaacaagaagctggattttacagacccggcagacgagagaggggacgaggtgacagacaatgtggcggtcatcgagggagaaagcatgatggataaggatgaggatctgagcagcgacagcgaggacgaagaggtggaagatggacccaaaaagaaaggatggttctcatcaatgttccagagtatttctggtaacaatgtattggagaagtctgatctgcagcctgcgctcaaagctctcaaagataggctgatggcaaagaacgtggcagaggaaattgcagagaagctttgtgaatctgtcgcagctagccttgagggcaagaagctaggatctttcactagaatatcatcaacagtccagacagctatggaggatgcgcttcttcgtattttgaccccaaggcgctctattgacatactgagggatgtgcacgctgccaaggagcgtgggaggccatatgtcattgtttttgttggggtgaatggagttggcaaatccaccaatcttgcaaaggttgcttattggcttcttcagcataacctcagtgttacacttgcagcatgtgacaccttcagatctggtgctgttgagcagctgagaactcatgcaaggaggcttcagatacctatatttgagaagggttatgagaaagatccggcagttgtagcgagggaggctattcaggaagcaacccggaacaaatcagatgttgttctggttgacactgctggacgtatgcaggacaatgagccactcatgagggcactctccaagctaatcaatctcaatagcccagacctggttttatttgttggagaagcattggttggaaatgatgctgtggatcagctcactaaatttaaccagaaattagcagacctatctgctgttcccactgctagattgatcgatggtatcctgctcaccaagtttgacaccatcgacgacaaggttggagcagcgctttccatggtctacatatctggagctccagtcatgttcgttggctgtggtcagtcctacacggacctgaagaagctgaacgtgaaatccattgtgaagaccctcctgaagtgattgcaccaccgtgttgaagtgcagtctgcccaaagtctgttatctattgtatccccagtgacctttgtcatcctcatgttggacgtcgtcgtggatttgtaactgtcggagttgcaacaaaacttgtgtgcttgcgtcaacgtgtgccgtcttgctctaataatgcactatctgcattttgaatgggtaaaaaatggatgaatatgcgagtttgctatcatctggatgttaccagattctcgcgcctgcccccgtgcatgcaagcgaaaccagtcacgagctcacttcatgtcttgatgtgttggcaagctggaagctgcatggatgtctgacatgatttcattcagcgtacacggttgcttgcaacattagtaatgagtagcgtgttgtcttgtggtgttcatacgtaagggttctgatccccttgtgtgcaagtctcacacatacaaaaacctgatacatacgcgtcccggaaacatgtgcccttncgtattcaggcttcttattttttttaaaa

SEQ ID NO: 21023 - DNA, 1081 bp, Zea mays
ggacgcacaggcgcacaccgacaagcgcagcgatggcggccgcgggggacggacagacgccgccgacgccgcaggagccggagccagtggcgggagcggcggctggaggcggcgtgatcgcgaagctggaagaggagtggcggaaggcaaaggagcacgcgcagacctacccgtacgtgtggggctcctacatcctcgtctacggcggcctcggcgcctacctcgcctggcgctggcgtaagctccgccgcaccgaggaccgcgtccgcgttcttcaggaacgcctccgcaagctctctgcggccgaggagtcgcaggctgcctctgccaccggctccgtttccactccctcgacccctcccctgccgcaggagtcggcctctggggccgcaaagccggcttctagaccgtgaaggagtaagcttccttttttttttccagcttcttggcatgacggattacaaatttacagagcgattcatcgtttgagctcgctgctgtgcttggttccttacttggttggtgatcctagttcagaagtagaggtggaggaatataatacaagtgctgagaggttggtgattctctcattgtcatctaatcgtttgggggaagctcaaaatcttgtacatcgtgtgtggtcattcccacgaaggatctggatttactgttgatgtcaccgaaacccgtcttagtgacatcgtaacttttggctccatgatgctggtttgcagttttctccatccacttcacttcactattgttactaatgtattgcgccttatactgatctcgccaaatcttcttggcgtgccgcccttgcgcgcttattttgcgatactaaggacaaatgaattatggatagagaaagcttaaccaacatcctggcagtctaattttgacgtttgacagggctttcggttgcagttccctctggataagttgacagagctgaactgacgaaccaaacgttcctgctaaattccatagtctgcaacctaacttcgtcgattgtgaactatcaggtaggttggtatgaagttcagttgtagaaatcaaattttcagacagcataggttat

SEQ ID NO: 21024 - DNA, 1951 bp, Zea mays
cacagtcatttagctctgtactactactttcctttttttttgttccttctactttctggatgtgccatgcttaggggttagggccacaaaatcaaggtgacgatcatttctttagttctgctgtacagctaattgtacttaaaatcgtgaagttccagtcctagagagaacctcgtggtgcggcagagcctctcgagatcggcaatgccgtcgcagcaatcaatccctagcgtcctgagcaccatgagcacgcaagcgaggccgcagtcccaggtgaaggcctgctgcacatgcggaacctgccagcacgagaagtccatgacaggagccaaattttgtcaagcaaacagatgcagataatgaggaaagcgcatggtacgcagaaagtcagagacgcacagtgagataataataagctgaggccgcagtcccaggtgaaggcctgctgcacatgcggaacatcgacgtagtacgatcggcgtgctagtgaaatccgcccgtcggggtacggcgagcccgccgccccctgcgcgccgtcgtcgcccgccatcctgaagagcttctcggagatgacgcacaggggccacatgacatcgtcaacggcctacgcaagagctcgatcgagcgagcaggctgcagcttcccctcggtcgggccggccggccgggcgaacaaacacacggccggcaacgaacctggcaggcctcctcctcggttggaggctttggggagttcggagcggggaggggagggaataagagggcgagcaagacgagagcagcgcagaccagcagggggcgagcgcggtggacacgcctgtatttggagcggagccgctgtggcggaacggaacggaacgaacgattgggcgcggccgcgctgtatatgggcgagggccgcggcagcgctagtgggggagggaggcgaccggtgcggacggcgccttaaagcggacagagggggtggccttccagaaactgcagcgtgtggagcgtggtggtggcggtgctattttttatgcgcctgcgtcctgttgccggcagagaggaggaggaggaggggtgggtggcgactgccgagcgcggaggcgagttggagggaagcgggggtcgaatcgaggagcgcttcggggagatggatagggattgggggaggatatggatgtccgcggggagttcgctttcggcaccaccgcttggcgacgtgtagtgtagggcagtagggccgtaccgtacgcgccctggtctggtgccggaccggaccgcgtgtgcgcgtacgtggctcggctcgccaagcttcatgggtgcgctggttgctgaactggacgactggatccaatccaaggcgggcgcgccgcgacggggcgggcactgcattgacccaatcgaaggccgccgacgagtttgctgggtggacctggacggtggtggtgggccggccgtgccgggctgtgggttactatttgtcgatcgcgatcatcaatgcgagcaggcgacgccggccgggttggtgatactacttgacaacgaacgctccaactgaactgcgtgagggtgaaacagtgcaactgtgcaagtgaaaacgggggacgacggccccgagcgtatatctctatcgcttcctctccgtcgcatagtcctgccctcttttttttgagccttggacctccaaaaaccaaaattatgtggccagcttacggtcaagcgctagccgcacggccccgtggaaatatctagtaattgcaatttggcatgttcgatttcttctgctcctaagacgcgacaaaggcacaaagctaaaactgtggacaacggttcattctatatttcttcctctatattccagtcacatactacgtcagcaatctctcttcctctatatctctatcctctactgtggttcaatctatatcaatcctctatatcgcactctaaacataaaatatcatttt

SEQ ID NO: 21025 - DNA, 1682 bp, Zea mays
cgaggtcgacggtatcgatattttttttttttttttttgcagagaggagcacgattttaattcttatttccggagatctgtacacgttcagttaacaatcgtacatagaacacttgctcgtttacaaggtcagcagagccttttgctgccgctgaacccctttgcgcggccaacatacagggtgcctacttagctcactaccacactgctgctatcagctgtaactgcgagaacgttctcgcctacgtacagggctggcactcgacagtcataactactacagggacatgtacagcgtattcacaaggttgctagtgacctatttatttatctacatggagcaggcaagtagcttacgcgacagcttcatcccactcttacctgttagagaaaccaagagaatgtcctcgtctgtcccaaaggatttccgggcctcgtccaagctcttcatcgtcacccgttcgtgtttcctggaactggctggatctcttatctcaaattcacaatcatcagcatcatacccacatattacgacatagtgtcccatgtagtcaggctcatcgttgtgctgttgtacatcatgatcactcatgcagggcaaatttagcttcgatttgtccactaaagcaatagcaatgcagtgcccggataacagtagaaaagcaatgtcgtatgcggtgatggacctgcattgaatgctaattccagcatcgagcgccttcccaaatagctcatccactcgatcgatgtcttcttgcaattgctccctataaaaggattcagcagaatattgtggatttgctccaagggtcacggtacagaaagaaaagctgactgaaaacttgtttaacagatatgctaagtcaaccgtccaaatgctcgtggtgcggcagagcctctcgagatcggcaatgccgtcgcagcaatcaatccctagcgtcctgagcaccatgagcacgcaagcgaggccgcagtcccaggtgaaggcctgctgcacatgcggaacatcgacgtagtacgatcggcgtgctagtgaaatccgcccgtcggggtacggcgagcccgccgccccctgcgcgccgtcgtcgcccgccatcctgaagagcttctcggagatgacgcacaggggccacatgacatcgtcaacggcctacgcaagagctcgatcgagcgagcaggctgcagcttcccctcggtcgggccggccggtcgggcgaacaaacacacggccggcaacgaacctggcaggcctcctccccggttgctggctttgaggctttggggagttcggagcggggaggggagggaataagagggcgagcaagacgagagcagcgcagaccagcagggggcgagcgcggtggacacgcctgtatttggagcggagccgctgtggcggaacggaacggaacgaacgattgggcgcggccgcgctgtatatgggcgagggccgcggcagcgctagtgggggagggaggcgaccggtgcggacggcgccttaaagcggacagagggggtggccttccagaaactgcagcgtgtggagcgtggtggtggcggtgctattttttatgcgcctgcgtcctgttgccggcagagaggaggaggaggaggggtgggtggcgactgccgagcgcggaggcgagttggagggaagcgggggtcgaatcgaggagcgcagc

SEQ ID NO: 21026 - DNA, 5049 bp, Zea mays
  misc_feature (3989)..(3989): n is a, c, g, or t
cgcccgctcatctcgcctcacatgggagtatgggacacgggcacacggctccctcccgctggctgttgactgttgtgttgcgtcgtcgtcgaggcacggccttcgacgtgcgctcagtgggatgctgacactaccacgcagacaaacctggcgtcttgcattaataattctgtaggagaaaaaaaaagacaagtcatcatcatatattaattatgaagagtcatctgctatatagataaactcagggatgagttgcaaaaattttacatagctaacaatagactaccattaatcatgttggtatagatcggtagaaaacacaatggaattgaggagggacgccacgatgggcatattatttggttttcaggtttcgttaatgctcctatccgtgacgtaaacattctggatccttcaaccgcgtctgggtagagcccacgatagatcttaactgctgctgtgggtagctagcactagcacatgcttgaccggttatcccacgtgaaggagctctctctgacagcggaacagcttcatccaatgagcttgactgtcaaagcacgcggcagctgacgccgagcagagagtctgctgtttctctgcaaataacttgtaaactattgggtaattgctaaaagtggctaataacttaattattaactagactggttgtatgtatttagctaattttagcagctaattattatattagtacatttaaacacctctatgactgctagagataaccttacaccgatgtagttatatagtcaaagcaagcactctaaattaagattaaaatactatttcgattacagaggaggtgaaagcctagaccgaggaataccttttatcctatatagtgtgcgccccttaattaaagctggctttttagactgttgtttctgtaatttacagaaacaaaaatattgcagcagaaaatagctaaacgcacaggctacgtagctgctccagctctactgtagcaaatttttgggcttctttgaagtgcggcccaaaaactgaggaggttccttcctatcaaagggaacaatattatagtttgggccgttgtttatcacacagggtccctcggcccgcaccatttcgcgcttgccctaaagaaacccgacacgagccccactcgctcggacgcacaggcgcacaccgacaagcgcagcgatggcggccgcggcgggggacggacagacgccgcaggagccggagccagtggcgggagcggcggctggaggcggcgtgatcgcgaagctggaagaggagtggcggaaggcgaaggagcacgcgcagacctacccgtacgtgtggggctcctacatcctcgtctacggcggcctcggcgcctacctcgcctggcgctggcgtaagctccgccgcaccgaggaccgcgtccgcgttcttcaggaacgcctccgcaagctctccgcggccgaggagtcgcaggctgcctctgccaccggctccgtttccactccctcgacccctcccctgccgcaggagtcggcctctggggccgcaaagccggcttctagaccgtgaaggagtaagcttccttttttttttccagcttcttggcatgacggattacaaatttacagagcgattcatcgtttgagctcgctgctgtgcttggttccttacttggttggtgatcctagttcagaagtagaggtggaggaatataatacaagtgctgagaggttggtgattctctcattgtcatctaatcgtttgggggaagctcaaaatcttgtacatcgtgtgtggtcattcccacgaaggatctggatttactgttgatgtctaaaaaaaaaaaaaaaagtgacatcgtaacttttggctccatgatgctggtttgcagttttctccatccacttcacttctctattgttactaatgtattgcgccttatactgatcttgccaaatcttcttgaattatctcctggagcatatttttgcggtgttatgtactaaggacaaatggattatggatagagaaagcttaaccaacatcctggcagtctaattttgacgtttggcagggctttcggttgcagatccctctggataagttgacagagctgaactgacgaaccaaacgttcctgctaaattccatagtctgcaacctaacttcgtcgattgtgaactatcaggtaggttggtatgaagttcagttgtagaaatcaaatttctcagacagcataggttataagaaaccatagcttccatattgttagcatccatagattcatttttttgaacgtaatggcaggagctttgcctttccattaagaagaatattagaattgacctagttttaaggtaaattaggcctgaaacctacacagagtgcccaaacaacacaagcagcgacaatcccacacacaaagcctattcagagtcatcgttgccgagcttttaacacaaggtacgagcagctccgacttcgccagacggtccgcacatggccaaaagaaacatgatgacgccaacacctaaaacctggcacacaaggaggaagaccgtgacacgctatcgttgtcaagcctcaacacacccacactcgaggcagctccaattcttcatcaacgatcttgatctaacgcacatctccggctatttgttcgatctccaaaacaatccatatcacgaggaagggggctcgcctcatgtcactgttgccgagccacatcccctaacgtggtagtttcgacttcatgttgcaaaaaccccacctccacccgcaaatcagacatcgagaagcgagagcatcaaccgaagccaacgtcgaggtcgagacgaactttagagcaatgtgacgccctcaacagggagaagtggcgcccacgggtgtcactgtcgccgaggctttcgcccaagatgccctctagcatatcataggtcaggaccccaggtcacagtatgcagcctccgcggtcgccaccgccctagcctccgcacaaacccctctagaggggcaccgacgtgtcggctgccgcagtagtcgcaaagctgcgtcgatcgccatcccatccggctgggcacatggaaccaggaaacaccttgtcgtgtgcgcacccacatggaggtcgagggagatccatagacgacaccgtcaacagggtgggagtggcgtccataggcgtcaccgccgtccgctcgcaagcgggcatggctttcaccttgaggatctaccaccaaacgtcccgctgcgcggaaccagacacccgtcagccgaaccggaggtgcagagatggatctggccaaagaggctcaagattcggcctccaccggccgacctaggagttcagttgtgcagtgtgattattgtatagtcgagagattataataatttcaatttcatctagcatgctcttgcaacaatactcgtcaataactcctagtacttaggttcttcaactcaaaaatcctgccattttatagatgccagttatacccatatcattaacctactatgattcaagaagcattcttggctgcaggaattactccattttaagccttgtttggttgcatggggactgagaggattaatcccctttctattcaatcaaaattgaatggaaggatattattttcaatttattatacatgcacttgatctttaatacggttcctcgtcccattcaccgctgtcttgtaatgtgaatctgtctcagagtacaataattccgacccatggggagctttgtggggttgctgagcgttgaccaaggtccaagcatggagctctttggaatctagttgtggcttggcttatttccatggcctgcataggttccccacactgatacagtgatacactctagatatggccttgcacctccatgccagaaatccagagttttcatatcaataaaagagttgcctaccctcagctttcatttctttgtaccactacaaggccgcgtgacatgtgtgaggttcctgtgttcgaacactgcangctgagccatcagtgtgctgtgtagggtcggtcattcagctgtctctttcatagtattgttaggctccagtcacttcacaaaatcaggctggtattttttggcgagccggttaaaacttgaacgctgagcaaaaacggcacgtttgcaagctgagccccggccatcgctcctaccacaatatcttgccaacgaaaagactgcagctatatgtacagcgtgcagcgaagacaacaaaatagtacagatgggcctggtcctggtgctccgctgatgcccctcctctggtgctcaccacccagtccgacatcgccatgtgatggccgaacagcactacgtgcccagaactggccttgattccttttaccaagccttgctctgcgtcctgatcaagtcatcagaaacagtcctgcagagtagattatcttgatttgcccttcaaatcttggttctgagtttctgacctctgtttaaaaaaaattaggtgccgtgctggtgctgctgagtgaggtttacggtttagggtttaccctgcggtgttctctgaccctatgttagtttgaggatgaaactgttttaaactgacgacgggcgtcgacagattcaacaggccgaactgttatttattgttatttgcgaaaatcataaagcgcagcgacagattcttcgcagtttttggtggccactgcgtaaaagacagatcggtctcagggggagtcgtcgggcgttccacgctgaaatctggaatgaaaagactaagctcatatattgggagggccgcagcagaaaatgggctctgtcggccgggagtctctccagatcggctggccactcctgtctgcccccaccgttatcttggacttgccaggtaaattagccctgctgaactacagtatatatccttcttggttgattgctgcacaatcccgttttccgttttaacctcagctagtgaatcgacactaggtgaaacactccattcagctttactaggactggtattttttagggggggaggggcaaatagtcgaaatccgtttttgcagttcgtttcgtttcaga

SEQ ID NO: 21027 - DNA, 3272 bp, Zea mays
  misc_feature (1360)..(1360): n is a, c, g, or t
tgtgactaaattaagacatacaattagtttggtagcaaaatataccattcaatattcgtaattttaatattataaaaatgaattaaatcttaaattataatttaggaaactactttatatttaagtgtgactaaattaagaccttgtttagtttctttagtcacttgactaaactttaagtattatgtttggttctagtgactaaatcaaactaaaaaacattaaataatgcaaataatgactgcattaccctattaattagtacatgcctactatacggagaaagagaagtggacaagtgagataaaaatcctattttagtcccttttggtcaatcccttaatgactaaagaactaaaatttagttaccccactttagtctccctgtttgcttctttagagactaaaagtgattaaagtttagccactaaactttagtcactccaaaccaaatgggcctaagtacttgataaagcattttgtttcttagctcccacacttcttaaataaccggttgtagtcgttacaagcaaaacagaaattctatgtagcgctgtctggtgcgtcgccagatatgtccgatgtgttgcaaacttctgtaaacacgttgcaaacctctttaagtgccatatctattgcaaggtttgatgttttgtttgatacacacatgcatgtttgatgtactctaattcttcagccccttttccagtttagcaccgctcctgtttggtgctttatttaatgcaccaccagactcattaggtgcgtctaagcaacctgatttctttttttcttcacgtttttcgttcaaccttctttcgttttgtgtcttgaactcttgcacgatcttcatacatcttttaatgagttttataatattttattttgaggtgttgatcttgttgatcatcatgttacctccgtccaaatctttaacactagtcaacagcactaatttaaatgtatttattaatgaaatcggctaagactcattttctttatatgtgccatttagtcaaagctgaaggccgcaaagctctaccaaattctacgagagccttgagagactacttgtgagttgggaaagatagagtttcgggtttgcgagggcatcgtaggaagtggaaagcgtgagctttttttatcttgaaacaatgcgggagcttgcttatattctgcatttcattagaatctagatgtgcacttttttacccctcgtagcctcctaggtttaatagatagaaattttagactacaaaatttaaggatcgaatcagattaaaataaagctttattctatttatttttaaactataatttttaaagactcaaacaaattataaaaaatatttggcctttntatatataatcacactccatataccttgttggactaagggatatttggtttttagggactaatttttagtcccttcatattgtttcattttattttgcgtgcggttttgtcgtttatgaaattttagtttcaatattaagcaaattaaagactaaaatgaaataaaatgaagcgatacaaattagtttactagaaattaaacacccactaactcactgcatgcatgcaaaagggcatgtcccgtgcccacggtacaccaacttcatcttacgctagatgtcttaaagttcagacggtcagaactattcctacacttcccaggagtggtggtggtggtggtggtcgcggtgcaggtgcccggcatgcctgacctcgtatggccttcgttccctgaactccaggtccagggcgtcctccgcgaccaccgctttgccatgccgacgcttgtgccccaagtgcccggcctccctgtgctgcacgccgagcgccgggtcgtgcttgtgccggtggccttctgccgctgtcccgggctgctgcctgtgtaggacgtggtggtggctgggctcgatctttctcctctggtgcgcgtggtggtgactgtgggggtggtggtcatggccgtgcgagtgcccgtggtggtggtggtgccggtggtggtggtggtcgtggtggtgatggtggtggcggcggcggcctttcttgtgcctccggtgcgcgcggtagtcggcccccagcaggtcatcccaccagtcgtatactgggtcgaagaagcctttctgatgaagaagatacaggacaattgcgcctgcgggccacattgtccgaaaaaaaaaaaattgtttgctgaatgatgagcatgggcaacgtcactctcgtcacaccattcgatattgaaatgttgaaaagcgtacgtacctgcgggtaacataaaaagtagcagcaccaacatgacgagccaggttatgcatctgtactgcgcatggcagctgaagtcaaaaaagctccgacatttgttcagcctgctcccagataatatggtaagaatcagaaaatgcaataaaacatttcctgttcatgaaaactgatcggaggcagcaagaatttgtcaaagatagtgagcaaacaggaaggaattggagcacctgcaggatttgccactgattaaatcaatcagaaaatcccagaagctaaccaaatagcctttgatggtgtcaaagaaacccaatttgtagccatttgaaccgataatctacagattgaaagcaagaagcatcaggattttgcggtaaaatgaatggatttaattgttcagggcacactcagagctttctcaatacaacaacaagacgttttagttctagggtatgataaagttgaaacctaatagtcaaggtttagggggtgtttggtttccacttcctaaattttagtgactaaagttaagttatatttaatctctaaactgccaaatggtatgactaaattatgcctcccaaatagaaattttagggactaaagtttagtccctaaagtatagtagggtgactaaaggaatcaaacacctccttagatacatagatactcttattcaaggctaaatctttgggcatattatattctttcaactctccttttatttttatgtcaacgtaggtcctcctttgtctatccctttctatgtcaaatttgttctttttctacctctctttacattgttgtagcaacttaggatcctacaatacattgatgtctctaaaggtctatctcaaccggtattagacaagctttttttaattggtgctatccctaacctatcatgaatatcatcgttccggactcgattccttctttgtatggcacaaatccaatgcaacatatgtgtttccataacatttatatgttgaacacgtca

SEQ ID NO: 21028 - DNA, 1843 bp, Zea mays
ttttttttttttttttgaatgtaatgacaggagctctgcctttccattaagaagaagattagaattgacctatttttacgaaaaaccgggccaaaaacttacacagagtgcccaaacaacataagcagcggcaaccccacacacaaagcccatacagagtcaccgttgccgagctcaacacaaggtacgggcagctccaacttcaccagacgggccgcacacggtcaaaagaaacacgaaggcacctacacctaaaacctggcacagaaggaggaagaccgtgacacgccatcgttgctaagcctcaacacacccacactcgaggcagctccgattcttcaccaactatcttgatccaacacccacctccagttttttgctcgacctccaaaacaatccaaaccacgaagaaggaggttcacctcatgtcatcgttaccgagccacatctcctaatgtggcagcttcgacttcatgtttcaaaaaatcccacctccacccgcaatccagacgtcgagaagcgaaagcatcaaccgaaggcaacgtcgaggccaagacggactcaaacgtgacgcctttaggaagggagtgacatccaggacgccaccgtcacattccagatggattgggctttcgcccatggaagacatagcaatgcgtcgccctcaacagagtgaagtggcgcacacaggcgtcaccgtcgccgaagctttcgtccaagatgccctccatctcatcgctagtccaggaccctaggtcaaagcatgcagcctctgtcgtcgccaccgcccttgcctccgcacacacccctccagaggggcaccgtgccggctgccgcagcagccgcaaagctgcgccggctgccatcccttccggttgggcacatggaaccagggaacaccttgccgtgtgcgccacactgccactcgccagagctgaaaccagcttgagctaccgccactggccctggcacccgcgacatcgaaaccagctgtcgccgggcgcaccgcctccgttgcgcaccaacatgcaccccgcaatgacaaccatcgccaaggcgtagatcagttgagggtgggccatatctaggccgatggggcctagatccgccgacaatgccagatccgccgccgaccaaagcccacatagcccactcctccccgcgtgtgttgccgcgcacgcagcgaacacgcgagcggcgccgcgagccagcctcaagagcgattgccggggatgccactactcgacggaagagcaggcgcgtgagccacaccgccgccgcgagcaagccatcagctaactccggggcacctgctcccgccactgcagccacgccagctccgctctcgccctgttgttcgtcaccaccaccgccatgcttaccaaaccggtcggccacgcgttggagcacagcaatgccaccgccgttggcgtgcgcgcgagcacaggccaccgccgccgcgagccacgacacgccgaaacgccccaccgccgccttcctcacgagccgggcgaacaacccgccggctagctccgacggcggcgaggtagagaggggaggaagaggaggagacgacggttagcgccgcccaagcgggggcgacgcgggggcctccactttctgcatttatggtttggttcttcaagatcatgcctgattgacataacatataatgttagtcactagtcatgttcagaaatttacagttaggtcattaagtcatagtcaagacatgaacctttatttcagttaactcagtacattgcgtcaaggaattattgatacaaaataaaaaaaaatagggacatcaccaatacgtaccagtcacctggaaatcttagac

SEQ ID NO: 21029 - DNA, 4718 bp, Zea mays
  misc_feature (433)..(433): n is a, c, g, or t
  misc_feature (700)..(700): n is a, c, g, or t
  misc_feature (4491)..(4491): n is a, c, g, or t
  misc_feature (4688)..(4696): n is a, c, g, or t
gaggatcaagaccaaatatttttttgaacctttttgttatatctgtaaaaagaattaaattagtaaatcgattacacatttacgtaccttacaattctataaataaaactatactatatgttggcgccgatctagacgccaaacactggattgaaccacgtggcaatgctctctgcgacggcgcgaacggtccacggtcttgacctcgatggtccatgacctgggtgcaggagcagattgttctctgcatgcttccagacaatccgcgccagaggttggactatccgcgatggcgcagggtctttttcttcataaagaaccatagaactcgtatccaggtaaatctcgtcgaggggaagggttccaggggttgctccagggtcagcaggtcacccatggcgtccctaattggtgtagagtcaaagagggatgntcgcggaaggctatactggatctaaactagggctagattacccctattcctaaggaatgaaagaacattgcaaataagatgaatttgaaaagtagaattgattagatcgattatgtgtaattcaatcgaccgtaccctttatctatataaagggtgaaggtttagtcccgttacacgtcggttttcaagttaatttcgcaggttttgctaataaatccgcaaaaatccagaacactaacagattttgctcacgcgaggatagtctgnaccgtccaaaatctgttttggtgttcaacactacacttattatataatttttttgtaaatagttttaatttttttattctcattccatctcgattctaatccagctaacaaaacaccatattttatgattaggtgcaatgcaacacactaatggtttattttgttggacgtacaaagaagaatgaaggggacggctatattttatataatgtttagatgagaactacaagaaaataaggtgaacacctgagaaatttttagtaacagtagtcttaaaaaaaaggtccgtgtcgccccggcttatcttattttgaccttaatcaaaaccaaacacattcgtccggcaccctcgccgcccagccacagctgtggcgggagccagacgcccagacatgcccaaaatcgggcagaacactggctagatttgcctgacgccgaggatgtctggaggctggagcattcattcacgtggccaagacgacgcgtgaatcctacctagctcatcaatgcttctctggctatttagtagcccactggacaacatcaatggcgctgctgccgtagcgccatggcccatggctgcgtgcttgtccggagagagtactacggcgtgctgtgttgtacagtatgtagtaggcttgtagtatgtaggagtaactacggcatttagtgtagtagcctagtataaggttagatcttcctgtaccactgtcatcttcattagaccaacagctgctgaagatcgtggacgaacgcagctgggcctggtcggccgcgtttatggacgagcacggtcagcttttgagtgccgggtcggtacaactcttactactactacagttgttggccgttgctgccactgccgcccactcactgaaggcaggcgccaggcacagccagccgcacacgcacacggagtggtgggtgctctcacgccatcgttatccaaaatggcgcgctccccccgtcccccactaccgaaaccagtggtagcggtgatgtttgcggcgcggcgcgtggctccgccgcatggaagccagcggcctagcggctagcgctcgcacggccggaaaggcggcggagctggacgtcgctcagcacaggacggggcgcgacggcggcgagccgaaagacggtctgcgcctgctgatcgatctcctgggcgtgcttggcggccgtgggcgatcgcacgatggccgatgggtgcggctgcggctgcggcctatcgccactggggaagtagggagccgggcgtgcgtgaccgcccggcgccacggcggcacgccgaaacggcagggcaaaacgtgcgcgcgttgctgcgtaccggacgtccgtgtcgtgtcgcgtcacgagggaaagctcgatcgggcgcgcaccgaaaccatcactccggcgaagcgacgcgaagcaaagcaaagcatccaaggagaagaagggggatttgtgtgtggctgtcgcttccttttcggtgagccgagcgagagctttcgttcgtgaccactagatcaaaggcgtggccagggaacgccgtgacgcggatcgcggtaggactgggctctgggatctccggtaggggtaggcagccgcctggtctgtcgacgaggtaaacggccggccccggtcgaaaggtcctttcgatcgcaccttgcttttgctctagccatgcatggtacccgatcggctgacccggtagtgactcgaaagttggtgcggctctgtttgttccattccatgcgtacctgagagactcgacagctcgtagcgtcgcatctcggtctcagtttcttatctgcctttctgcagcctgtggctgagatgggttccatcccgtccggtacgaattttcccctgtttctgccacagcaggtcgagagctgccttgatcgatgctgcttcgtgtggcaccagtttttgcgcttctcgaaagagacgggtcgaagggaagcacgtaggccagctacgaaagacgccagtctctgaagtgctgcagttcaaggcagctcttccatccactcgggcggcccggcgggagcgactgcgcgacgagaaacaagcccgtccggccgtcccggccgcgcgaactcgcgtccctgtcgcgggcgtcacgtcgcaccagcaactcctggtagcgggtgtcccatgggcccgtggcccgttacgtcagtttgctccgcggttgcgactcggggagaagaatcctgctgcccgtgcccgccgtggcggttaccgagcgccattttccgcggacttttccgtaactaccttgcttaccgaacgcccgtcgcgtttggttttaggtgagacggcactttgtacgaatacacactcttacccaaccccgccgctgtgttacgcatctgatgactgacgaatcaatcccagcactttttttgttaaaaaagacgacacacacgcacgcaagctctgcatacactgtccattgacaacgagacggctgtttcctaatcaccagctccctccaattattatcgctccctctaaaatgcaaaccgctagtagaaagcaacgtgcaggcaggtaggaagggtgagtgagaggttggattcggcgccagttcgattcctgcgacctaacactcaactcaccagcggttgggtctggcagaagctacctcgaatgattggcgagattcagacacgaccgacactccgacaggcgacagcaacgcgagcgctcccagcacagcaccccccgcgggttttttttttttgcagagaggagcacgattttaattcttatttccggagatctgtacacgttcagttaacaatcgtacatagaacacttgctcgtttacaaggtcagcagagccttttgctgccgctgaacccctttgcgcggccatggtttggcgacggcatgggccaacatacagggtgcctactaagctcactaccacactgctgttatcagcggtaactgcgagaacgttctcagctacgtacagggctggcactcgacagtcataactactacagggacatgtacagcgtattcacaaggttgctagtgacctatttatttatctacatggagcaggcaagtagcttacgcgacagcttcatcccactctttcctgttaaagagaccaagagaatgtcctcgtctgtcccaaaggatttccgggcctcgtccaagctcttcattgtcacccgttcgcgtttcctggaactggcaggatctcttatctcaaattcacaatcatcagcatcatacccacatattacgacatagtgtcccatgtagtcaggctcatcgttgtgctgttgtacatcatgatcactcatgcagggcaaatttagcttcgatttgtccactaaagcaatagcaatgcagtgcccagataacagtagaaaagcaatgtcgtatgcggtgatggacctgcattgaatgctaattccagcatcgagcgccttcccaaatagctcatccactcgatcgatgtcttcttgcaattgctccctataaaaggattcagcagaatattgtggatttgctccaagggtcacggtacagaaagaaaagctgactgaaaacttgtttaacagatatgctaagtcaaccgtccaaatgctcgtggtgcggcagagcctctcgagatcggcaatgccgtcgcagcaatcaatccctagcgtcctgagcaccatgagcacgcaagcgaggccgcagtcccaggtgaaggcctgctgcacatgcggaacatcgacgtagtacgatcggcgtgctagtgaaatccgcccgtcggggtacggcgagcccgccgccccctngcgcgccgtcgtcgcccgccatcctgaagagcttctcggagatgacgcacaggggccacatgacatcgtcaacggcctacgcaagagctcgatcgagcgagcaggctgcagcttccccctcggtcgggcccggccggccgggcgaacaaacacacggccggcaacgaacctggcagcccccccccccggtggggggnnnnnnnnncccccccgcgggggggggggaa

SEQ ID NO: 21030 - DNA, 2603 bp, Zea mays
tctggacagatgtatgtcatatgaaacaaaaaaaaagtcacccaaagtaaatttcaagaactgcagactgttctcatatactatctccactgctgcttcaacagagatgacactcttgaaaagctgggagcagagcaaccagtatatagttgagcttttcaactaccactgcttctgtcacacaagtacacaacacacttgaaagttgaaataacgataggctaacagtcaccaattttaaaaccaaattcaactttgtttctatgaaattttcagttcatggagaaagagtgaatcaaaagcagctagatatcactctagtaacagcaacatgaaagcactcactttagcttcgatttgtccactaaagcaatagcaatgcagtgcccagataacagtagaaaagcaatgtcgtatgcggtgatggacctgcactgtgagaagccataaattggggagaaaagttagcttggaaaaccaatatgtgaagtacatgtaatgcagaattttcatgctgctatctgttgtgagcatacttgaatactaattccagcatcgagcgccttcccaaatagctcgtccactcgatcgatgtcttcttgcaattgctcctatgtaatgaccatttttagaacattattgatgagaacttcagaagccttgtgcagtagaagtttgtcagaacaagtaccctataaaaggattcagcagaatattgtggatttgctccaagggtcacggtacagaaagaaaagctgactgaaaacttgtttaacagatatgctaagtcaaccgtccaaatgctgcaaacagaagtgttaaagggcattagttttccaaacaaaaaaaatggaacctgcgttctttaagtatacctgcatttgttttggatgaagcaactattgcatttttctgaacttatgactactctgaccaaatattctcttatgatcattgaacaacagtcatttagctctgtactactactttcctttttttgttccttctactttctggatgtgccatgcttagggccacaaaatcaaggtgacgatcatttctttagttctgctgtacagctaattgtacttaaaattgtgaagttccagtcctagagagaacctcgtggtgtggcagagcctctcgagatcggcaatgccgtcgcagcaatcaatccctagcgtcctgagcaccatgagcacgcaagcgagaccgcagtcccaggtgaaggcctgctgcacatgcggaacctgccagcacgagaagtccatgacaggagccaaattttgtcaagcaaacagatttacactatttacctcatcctagtctccaaatggatgttacactaaggccagatttacaaatatccttttctttcttgtatgaaggaaaaaatacataccttatcttcatcatggtaggaaaactaaacaactaagcataatccatactaataagcaacatgatgcatactggtttcggtgcttcaagtttcatttgaagatctacatggaaaaatgtgaacacaagatgatgctggggtgtcaaaagagcaggtaggctgattttaacttcatcatggtaggaagccattcttgttccaacagcaatctgtgtatggccccacttctgtagcatcatattccgctccctaggatgaacagcctggaagcccacgtctctaatggataaggatgtttgaatagacaccaacattcaacattaggacaaataattcagcagggaaacctctaatggtggctttcggatgtcggaatcgtcctttctcagttccactctaacaaacaggtttcttttgcggctcaagctaacagtcaacgggtacacatagaggcaatgaaaaagttgtgaaaacggctcacttcgggtcagcatccgaaagtcaaaagcttcaaactgcaataagaaagtgcatctcctctaagcagaacaacatgaataacacaagaatgtatcacaaataaacagaaaagtgttgtcctatatgaccagtacccagctacttacattgtcaccattcttagcattagaaatgattccattgtgatgagcatctttctaggcaatagcaatagaattcacaaaactgtgaatcccatcaaagctacttctgttgcttctgccattattgatgtcgccagcatcattcaaatcattggccatgcttccgccttcagaagtgttatccacatcattgtggccaccatgaagtttttccacttctaatctcaatacacctttcactggtttatgtactttccgttttggatcctataggagacaaaagttataactatttagcataacaaattacaaatattaactgcatgtgctgcactgatccttcttacttggagggagtccactatatagctttccttcacttagtttaggtttgatatctctacaataactgagcttccactcgagtaatggttcacttttccatctaaagtaagctttaaaatagggtccacaatactatcttgagaagttgatcctggtaaacttgttgctaaaggactgctaggataagcagcatcactaagaccacccgcatggttacctcaaacagaggaatc

SEQ ID NO: 21031 - DNA, 1284 bp, Zea mays
tttttttcgcatgctcgctaattttatatatatctatttattttgcaaataaataacacgagcacgcgtcgtggccacaaaaacagtctggatcagaatgtggaaatcacaaaaccacctcccttgagaccacaggatacaatatctgagtcacgacagaaacaatgaaccggatactgctatggtctagttatacatttgagccatgtttcgacctcgtctcgacacgttctgctccacttgttgcacaatatagatggaaaccttctcctatgccctcgaaagagaatatccagacgcatactgcataccacattgctccatcgctcgggtgcctaaggttgtacagcttctaggagcttctcatacacttgccgtgcagacaaatcctcaacaattagaagcttagatttgttattccatcctctttgaagggtcatctgagtcagtcttaggccaagaaccttgcccataaattctagcaactcactgttagcttcccctcgagcagcaagggcagctaccgttactcgaacgtcatcagcattcactcttgttattgctgaacgttgtgcccggtcttccacttcaatggctacttggacaagtccaccttccagttgtgtgatgcaaggaggtacaggagcatcatgtggatttgtctcagcagcaactgaactcagtgctccgtcaataacgtatatgaaaggggcaacctccagatcctcttctgatcggtaacaaacaaaaaggtcacatcccacacagctcatgcgaaactgcttttcaagctttccttcaccacgtttcaacattacttttcctgcctccttaacatttagccttgaaagatgcttagccttgtctaaaacatgtgctctgtcagtctttcgcttgggcattttctgcaattgggtatcggtgatgaggacatgtgaggcgcagtgcttgcagtagtatacgaaaaggtcggactcggggccctccggcagtgcgtcctcgctcgagtaggtgtgtgtcgtccgcttcggcatcgccctcccctccgccgccgccgggatcaagaggcgaggctttcaaggtcaggccttatggggcaagggatattcaggcggaggcaatcgagcggcggcgaccggcgacgccagcgccaggctggatgagggattcgagttcgagctgtcgcctccgagaaagaaaggagcgtcggagccacgagagaagaaaaattgattgcccgggcctcgatcactccctatattactctctttttaaaactctatt

SEQ ID NO: 21032 - DNA, 844 bp, Zea mays
aataccatacagtccacaagtcgcgcgcgggcctcggggtagaacgcgcggaggcgtccctggcaacaaaggcagcaatgacgacggggtggctcgcagggtctctccccctccgctccgcatccacagccccgtcggcggccagggcacagcctctcccctccgccgccgcgccacgccgcatcccagcgcgactttcggttgccacgggcgggggcgagcagcagctcgtcaccgcgcaggaaccggcgcacgcagaacctgattatggagttgtcagcattcaccatgtcgggatcctgtgcgagaatcttgagaggtcactggcgttctacaaggacctactgggtctgagggtgaatccagctcggccaaacgacaagctcccgtacaggggcgcttggctctgggtgggttctgagatgatccacctgatggagctgccgaatcctgatccgttgaccggacgccccgagcacggcggacgtgatcggcatacctgtatagcgattagagatgttctgaagctgaaagaagtatttgatgaagctggaatcagctacacgctaagcaaatccgggaggccagcgatctttgcaagagacccagacgggaacgcgttggagttcacccaagtgtagcaactggaagactccttccatgctagagcatctcatggataccaagaggtcatagactttgctgcttgtatgctggcagataaataccgcttgtacatatatgacatgtcgatcaaggatttgagcaagtaaaaataaaggcagataaacggtgtgtttggtttaaaaaaaacaaaaaaaaaaaaaaaaaaaaaaaaaaaaaa

SEQ ID NO: 21033 - DNA, 865 bp, Zea mays
  misc_feature (863)..(863): n is a, c, g, or t
cattgggtacctcgaggccggccgggaagtcgatcgcgggccgcggggtagaacgcaagcggaggcgtccctggcgacgccggccgcgatgggattctggcgacggggtggctcgcagggtctctccccctccgctccgcatccacagccccgtcggcggccagggcccagcctctcccctccgccgccgcgccacgccgcatcccagcgcgactttcggttgccgcgggcgggggcgagcagcagctcgtcaccgcgcaggaaccggcgcacgcagaacctgattatggagttgtcagcattcaccatgtcgggatcctgtgcgagaatcttgagaggtcactggcgttctacaaggacctactgggtctgagggtgaatccagctcggccaaacgacaagctcccgtacaggggcgcttggctctgggtgggttctgagatgatccacctgatggagctgccgaatcctgatccgttgaccggacgccccgagcacggcggacgtgatcggcatacctgtatagcgattagagatgttctgaagctgaaagaagtttttgatgaagctggaatcagctacacgctaagcaaatccgggaggccagcgatctttgcaagagacccagacgggaacgcgttggagttcacccaagtgtagcaactggaagactccttccatgctggagcatctcatggatacctagaggtcatagactttgctgcttgtatttcttgtagctgctacaaataaagacctggcagataaataccgcttgtacatatatgacatgtcgatcaaggatttgagcaagtaaaaataaaggcagataaattgcttgaaaaaaaaaaaaaaaaagcggncc

SEQ ID NO: 21034 - DNA, 753 bp, Zea mays
cccgcgcgtccgcccacgcgtccgcccacgcgtccgcccacgcgtccgggctcgcagggtctctccccctccgctccgcatccacagccccgtcggcggccagggcccagcctctcccctccgccgccgcgccacgccgcatcccagcgcgactttcggttgccgcgggcgggggcgagcagcagctcgtcaccgcgcaggaaccggcgcacgaacctgattatggagttgtcagcattcaccatgtcgggatcctgtgcgagaatcttgagaggtcactggcgttctacaaggacctactgggtctgagggtgaatccagctcggccaaacgacaagctcccgtacaggggcgcttggctctgggtgggttctgagatgatccacctgatggagctgccgaatcctgatccgttgaccggacgccccgagcacggcggacgtgatcggcatacccgtatagcgattagagatgttctgaagctgaaagagctggaatcagctacacgctaagcaaatccgggaggccagcgatctttgcaagagacccagacgggaacgcgttggagttcacccaagtgtagcaactggaagactccttccatggctagagcatctcatggataccaagaggtcatagactttgctgcttgtatgctggcagataaataccgcttgtacatatatggacatgtcggatcaaggatttggagcaagtaaaaataaaggcagataaaccgtggtggtttggttg

SEQ ID NO: 21035 - DNA, 1106 bp, Zea mays
ttttttttttttttggaaaatctctacttcatagacaataacattaacaaaagcatagaatgaacaattacaagagctcgcatacaaaaatgtaagacacgaactcagcatacgcaattatgtaaatacactcgacattctgtattcttctttgaagcatccatcatctgctttccataacatatgtgaagactcgggaaatagatggctcgccaaagaaatatgccacaaaggatagaacaaagaatatgatcagatggtttttatgctaattttcgcttttcttcttcagcagaccaccgaatctcttgagagaaagcttcttcttatgctgctggtgctgtttagttggtgatgtcctgccactgctctgcttagttgggagcaggccgttgctgtcaacacctgcgtcgcccctgtttgattccaaatcaacctgcgagtcgccatcgttctccttaaccttagatgaatcgtagtcagcaaagttgctgttctcccatactttggcaactaccacaacaggttcgtcatccttttcggtgtcgcccttctcattatcttcttccttggctttaccattcatcgtgccatctcttgcattggcaagctgggaagagagttccttaatcttctcagaagcagccgatacctttgcctgcaggtcgtcattctcctgttttatgttctgcaattcattctcttggtctaacactttctccttccattggatagttttagcgttggcttcctccctgattctgttagcttccattagctgagactcaagctgcagcagcttctcctgcaactcagtgttttcattttctttctccttaacaacctccaaggtcatgtccatctgaactttgacagcgactatttcttctgcttgaattcttaagtgagttgacaaaacttagctctttagactgccattcgtccccccccctcgcgcctcccgcccctagcctttcaactgatttggtaaggcaaaccttctcgtagtttgcttcatcaagcattagctcatagttctctttagtattcttcaggttcatgttaagctcctctacctgtgcctgagcatgctcaatctcatcttg

SEQ ID NO: 21036 - DNA, 1763 bp, Zea mays
ttttttttttttttttttttggagtaaaacagagagttttctctttttgctttgtggttgctgttgggaagcaacagaaggctccaaactgccccttagccgtgttcgtttcttccggattccatcccggaacgttccagcgatcaaaacttataagttacacaaacaatccgggtagaaccgaacgggcccttaagcactccaggtaggttaacaacaaatccaggttataagcaagggtggcagtcatagctgtaatacattcttaaaccaaaagagaaacaatgaaccagaaaacaaaacgcttccagtgtggcctggtggaatgcaacagcctaacagcgtcggtgttattgacttgtctatacagatagacatgcaataaatatgtcagtgttacacgtcgatttccttttccaaaaacatgtatgcgcctagctacaatagcagctgtccgccacaggcaccaagttcgttcgttccttggcaagggacctcaactccggtggctaccctaacaaaactgtctcccttcctagaacgccaactcctctttctcttcagctgcaaccggcagcgatccctccgaggctgcgtcctgcatctcgttagccttctcgttgctaatgccgagcaggtactgcaaccttgatagcttctcaggcttaggaatgctcttcaggtagatggcaaatagatcatctagctctcctggtgtgggccatgacaagggtcgtgatgcagggaccgcagcatcacatgcgagcatgtcattcagagatgaaagcacatcatctctcttcttctgccgaagcaacgcaatagcctggacaagggagttctccaacctaacctttgcaatatcctgtacaattgacttggccttctcagaacttattatgagatcagctggaatcttcacatacatttcctcttcatcgaaatcccctgtacctgaagaaaagagctcttcaacagtttttctataaatgctttctcgctgcggctccgcaatcaagctatctagttggaagtttgcttccttcaatcctcggacctgctgtataccgatctgaccccgagcaacagaggcttcaattgcagaagataactttgtagttgtaatacccttaatgattttctgtgcatgttcagtaggcaaaccgacctgcttttgaatcttagcaagctggtcagccttagcctctgttaatttcccatcagcaagaattacttccgcctgttgcacaaaagctttctctgcaaacttaatgtgaacatcttgagcttctttgcgagttaaaccaagtatgtcacccaattgctttagcattaaaaactctgaatcatctttctttgtagagatagctgttccaaatgatacattagtagtctccccagtgatgcagaacatcaggtacgtttcatacagctcagccctatccctcaatggaatgtcatccttgagagttatctctttctggcttgactttctcagcttttctttgagctctttatcaggtctagtcttcctcagtgtatccaatgattcccattcatgttcaccatcctctccttcagattctgcagctgcacttgatgcttcagtttcagcaactggagatagttctcctttaatgtcagctaaaagctcggtgacaacaactatgttgaaggaaagtgccttccgcacgccttttgcagtttcaatgcggtttccagcttcttttgctctctgaatgtagctcaagaataacttccgt

SEQ ID NO: 21037 - DNA, 3567 bp, Zea mays
ctgcagcggcatgtggcggccgcgggtgcagctgctggcggggcgagggagagcctgagcgccattggattgggtggaaacggagcccaatggatggctcaggatgcacactggcagtagctgggaatggattagtgcccggggcagcggggctgcctttatatcgttaaacctctttttttccagcttctagtcccttctgcaacctcaacgccactcattctcgtcatcttcttcctgctccgtggagccctcatcctcatgtggacatcaattgaacagattaatttgcttatgaacagatagttcaattctgaatacagtcacttgcagatcacagcactgagattttaaggcacataaacatatttgtttaagtagcatatgatacatcactccaaagtgcagttcagctgcttgacaagcaggtacagtacagtaaaatacagactgaatacagaataggtacaattccacaatgctttagaaatccccactacacactatccaggaggggacttcgacatatactgtatcagaatccaggtgtccaatatcatgacgtctatttacaaaaccatgctgtctgttacatgatgctatagtatcatatttgcactacaccgccaagtggtaggctctcttaccacgttacacaagagctctgattcagccacagctgaatcagagcgaatgccaatgtgtagtttatgggtagaccgccgagcaatctactagagctctgatgataaaccagaggacattgaggccctgctggtgagagcaggcctcatcgtcaccaaagcagattcatttgcaccagctctcaaagcaatccgaccagcttccaggaacctggcgacagcatcctctgcgtagcggtttgcttccccgacagtcatggtcctgccaatatctgggtacgtgttcagtacgtgatcaccgttgagctgtgaagcaagttgaatcaactccacttgaaattccgagagagacgaatcttccttgggaccaaatggtcgcaatgacttcgtcacctctgggagcttctctgtttgagagaagaaagagtatctagttaggactctagtaaaattgatcattcaagtatatatagagccaaaagtgtcataattgttattccattggcataacacatataccaaactaccataaatacatacctggacagtcagttcttggtgttttccggattttgaagtagctctcaaaggtcccagcccatgcatctctctttgtcagaaagttagaatgtaaattgaatagcttctttactgttgcagggatggacgaatgctcatattgcgaggtatcctgtggaccatttggttcatggatcactgcagaaatgaaaagtaaggtgtgaattctgctggtgaaaacatgcagctcaatgttggaagcataatttaccgatgaataggttcggcacatggttaaagttcctaatttcattaacattagtatgaagataatcaagacacagagatagcataacaatagcataaaaggcagttcagtcctctttcatgagaatctcgttgaaatgctacttatatataagttatatctaacaaactctccacatggagagctgcttgccagacatataggatgtctccacctgcccaccataacacaagtcgatgtaggaagtctgaaatttattcacatagttgataaattccttgcagagctacttccaacacataaattaaacctggaagctgaaagactaaacccatttgttcatcaacagctattaggagcaagaaaattaaagcatcctctatggcaggaaaattaaagattcggcgcatagaagtactcaccagtgcccttctctatccaaggtgagatgagaaaggtgggaactcgcaccccaagccgttcgaacttgaagtagtatggatcaggcccaactattccatcaggctggggcactccaacgaccggcgtaggtacatggtcatagaatccaccatgctcatcatatgtgataatcagggccgtctcgttccactgcggactggctctcagtgtttcatacacctctttgacgaacctctgtccccttgccacatcatgcgagggatgatcatcgtttgctgggaacatctcgcaatcaaagtacctttgttcaatcaccacataatttggcagcttccccaacttggcgtgcaacttgaacttgaggctgtactggtggaacttaatgaggtgctttaggcggcggaggctctggtagaagagcgtggccgggatgttctggtagtagatgccaaaagacaggccattctcctcgaggctgtcaaagatggtcttctgcgggaaaccatggatgaggtccttgcgggcgttaaaggtgaggccgtgggaggtcgccgagtggacgaacaggcggttgggctgcgtggaggtgggcacggaggcgaaccagcggtcgaacacggcgaagtcgtcggcgagggaggcgtagatggggacggcgtcgggcttgaagccgctcatgacgttctgcggcatgccgaggcccatgccgcgcgcgttctgggcgaatccggacatggggggcggcaccgcggaggtgtcggcggagccgaagatctgctcccggatgtcctcgaagccgtggccggggtcggagtctacgtagccggcctcgtcggtgacgaagatctccggggatgcggggtcggaggcgttgaggcggttcgactcgcggcccgtgaggccgtcgatgtcggggcgggtgcggcggagccagccgaggatgtggtcgaagctgcggttctccatcaccaccaccaccaccgtcttgaccggggaatggatctcgtgcttccgccgccggcgcttcagcccgcggtggtgcgcgtccaggcagtgcccggagacgaccagcgccagcaggaggagcgccgcgaggaggcgcgccccggggccgcggcgggccacggcagccatcgcgacggaccgggaactaggtcttcgccttcgacggcgggcggtgcgcttgcaggtagggtaggtgcgcttgctgttcagttgaattggtgagctctctcccggccggcctcgagggacccaatgcctttccgctgttgcttcgcttctgcgtacgggcggcggcggtgactttttttaatcgcttccaattttaccccgtgagaaggtagttagggaaagcagacaggtgggtcccacttaggcgccgcccgtggctccacacgtcattgggagggagttcggttcgtggagagtacggtgctggtgaccggtgagagcatatgccacgtctgaactcataaatgtgatttttttacgttttgtaatgggctacgctaacccgacaagagccagacgctcccgcttccattccatgacaatgggtcaatggcccggtttgttttagatttttttcaggttcagatcatcagaaacaattacagactgatatctagctttttagcctgtttataataaaaatattttagttaaaattatctagaatcaacatgaacacataatcgaatgagccattgc

SEQ ID NO: 21038 - DNA, 1245 bp, Zea mays
  misc_feature (1231)..(1231): n is a, c, g, or t
ggccaaggcacataaacatatttgtttaagtagcatatgatacatcactccaaagtgcagttcagctgcttgacaagcaggtacagtacagtaaaatacagactgaatacagaataggtacaattccacaatgctttagaaatccccactacacactatccaggaggggacttcgacatatactgtatcagaatccagatgtccaatatcatgacgtctatttacaaaaccatgctgtctgttacatgatgctatagtatcatatttgcactacaccgccaagtggtaggctctcttaccacgttacacaagagctctgattcagccacagctgaatcagagcgaatgccaatgtgtagtttatgggtagaccggagcaatctactagagctctgatgataaaccagaggacattgaggccctgctggtgagagcaggcctcatcgtcaccaaagcagattcatttgcaccagctctcaaagcaatccgaccagcttccaggaacctggcgacagcatcctctgcgtagcggtttgcttccccgacagtcatggtcctgccaatatctgggtacgtgttcagtacgtgatcaccgttgagctgtgaagcaagttgaatcaactccacttgaaattccgagagagacgaatcttccttgggaccaaatggtcgcaatgacttcgtcacctctgggagcttctctggacagtcagttcttggtgttttccggattttgaagtagctctcaaaggtcccagcccatgcatctctctttgtcagaaagttagaatgtaaattgaatagcttctttactgttgcagggatggacgaatgctcatattgcgaggtatcctgtggaccatttggttcatggatcacagtgcccttctctatccaaggtgagatgagaaaggtgggaacacgcaccccaagccgttcgaacttgaagtagccggccgcccgcccggctcccccatcaggctggggcactccaacgaccggcgtaggtacatggtcatagaatccaccatgctcatcatatgtgataatcagggccgtctcgttccactgcggactggctctcagtgtttcatacacctctttgacgaacctctgtccccttgccacatcatgcgagggatgatcatcgtttgctgggaacatctcgcaatcaaagtacctctgttcaatcaccacataatttggcagcttccccaatttggcgtgcagnttgaacttgacccg

SEQ ID NO: 21039 - DNA, 2012 bp, Zea mays
aagtgttaaccctcatcctcccaagcaaagggttaagtatcatattacacatgtttaagcccatgtttacagacatgaaaattcagttactgtacagtatcatacatttactccagagtgcagtccagctgcttgacaagcaggtacccacaaattgcttttagaaatccccactacacattgaggctttgacatgtaccgactgtctatttacagaaccaaactatcatatttgcactacaccacccaagagctgaatcagagggaatggcgatgtgtaatttgtgggcagactggaaccatctactagagctctgatgataaaccagaggacattgaggccctgcttgtgagagcgggcctcatcgtcaccaaagcagattcattcgcaccagctctcaaagcaatccgaccagcttccaggaatctggcgacagcatcctctgcgtagcggttcgcttccccgacagtcatggtcctgccaatatctgggtacgtgttcagtacatggtcgccgttaagctgcgaggcaagttgaatcaactccacttggaactctgagagagacgaatcttccttgggaccaaatggtcgcagtgactttgtcacctctgggagcttctcaggacagtctgttcttggcgttctccggattttaaagtagttctcaaaggtcccagcccatgcgtctctctttgtcagaaagttagaatgtaaattgaatagcttctttactgttgcaggaatggacgaatgctcatattgtgaagtatcctgtggaccgtttggtttatggatcacagtgcccttgtcgatccaaggtgagatgagaaaggtgggaacgcgcaccccaagccgttcgaacttgaagtagtatggatcaggcccaactattccatcaggctggggcactccaacgaccggcgtaggtacatggtcatagaatccaccatgctcatcatatgtgatgatcagggcagtctcgttccactgcggactggcccttagtgtctcatacacctctttcacgaacctctgccccctcgccacatcatgcgacggatggtcatcgtttgctgggaacatctcgcaatcgaagtatctctgctcaatcaccgcatagtttggcagcttccccaacttggcgtgcagcttgaacttgaggctgtactggtggaacttgacgaggtgcttgaggcggcggaggctctggtagaagagcgtggccgggatgttctggtagtagatgccaaacgacaggccgttctcctcgaggctgtcaaagatggtcttctgcgggaaaccatggatgaggtccttgcgggcgttgaaggtgaggccgtgggaggtcgccgagtggacgaacaggcggttgggctgcgtggaggtgggcacggaggcgaaccagcggtcgaacacggcgaagtcgtcggcgagggaggcgtagatggggacggcgtcgggcttgaagccgctcatgacgttctgcggcatgccgaggcccatgccgcgcgcgttctgggcgaatccggacatggggggcggcaccgcggaggtgtcggcggagccgaagatctgctcccggatgtcctcgaagccgtggccggggtcggagtctacgtagccggcctcgtcggtgacgaagatctccggcgaggcggggtcggaggcgttgaggcggttcgactcgcggcccgtgaggccgtcgatgtcggggcgggtgcggcggagccagccgaggatgtggtcgaagctgcggttctccatcaccaccaccaccaccgtcttgaccggggaatggatctcgtgcttccgccgccggcgcttcagcccgcggtggtgcgcgtccaggcagtgcccggagacgaccagcgccagcaggaggagcgccgcgaggaggcgcgccccggggccgcggcgggccacggcagccatcgcgacggaccgggaactaggtcttcgccttcgacggcgggcggtgcgcttgcaggtagggtaggtgcgcttgccga

SEQ ID NO: 21040 - DNA, 1645 bp, Zea mays
cactccaaatgcagttcagctgcttgacaagcaggtacagtacaatacagactgaatacagaataggtacaattgcacaatgcctttagaaaatccccactacacactatccaggaggggactttgacatatactgtatcagaatccaggtgtccaatatcatgacgtctatttacaaaaccatgatgtctgttacatgatgctatagtatcatatttgcactacaccaccaagtggtaggctctcttaccacgttacagaaaagctctgattcagccacagctgaatcagagcgaatgccaatgtgtagtttatgggtagactgcggagcaatctactagagctctgatgataaaccagaggacattgaggccctgctggtgagagcaggcctcatcgtcaccaaagcagattcatttgcaccagctctcaaagcaatccgaccagcttccaggaacctggcgacagcatcctctgcgtagcggtttgcttccccgacagtcatggtcctgccaatatcggggtcccggccccgtacgtgatcaccgttgagctgtgaagcaagttgaatcaactccacttgaaattccgagagagacgaatcttccttgggaccaaatggtcgcaatgactttgtcacctctgggagcttctctggacagtcagttcttggtgttttccggattttgaagtagctctcaaaggtcccagcccatgcatctctctttgtcagaaagttagaatgtaaattgaatagcttctttactgttgcagggatggacgaatgctcatattgcgaggtatcctgtggaccatttggttcatggatcacagtgcccttctctatccaaggtgagatgagaaaggtgggaacacgcaccccaagccgttcgaacttgaagtagtatggatcaggcccgactattccatcaggctggggcactccaacgaccggcgtaggtacatggtcatagaatccaccatgctcatcatatgtgataatcagggccgtctcgttccactgcggactggctctcagtgtttcatacacctctttgacgaacctctgtccccttgccacatcatgcgagggatgatcatcgtttgctgggaacatctcgcaatcaaagtacctttgttcaatcaccacataatttggcagcttccccaacttggcgtgcaacttgaacttgaggctgtactggtggaacttaatgaggtgctttaggcggcggaggctctggtagaagagcgtggccgggatgttctggtagtagatgccaaaagacaggccattctcctcgaggctgtcaaagatggtcttctgcgggaaaccatggatgaggtccttgcgggcgttaaaggtgaggccgtgggaggtcgccgagtggacgaacaggcggttgggctgcgtggaggtgggcacggaggcgaaccagcggtcgaacacggcgaagtcgtcggcgagggaggcgtagatggggacggcgtcgggcttgaagccgctcatgacgttctgcggcatgccgaggccccatgccccgcccgcccggggcgactccggacattgggggcggcaccgcggaggtgtcagcggagccgaagatctgctcccggagtaatcgaagccgggccggctcgaggt

SEQ ID NO: 21041 - DNA, 2898 bp, Zea mays
  misc_feature (695)..(695): n is a, c, g, or t
aagtgttaaccctcatccttccaagcaaatgtttaaggatcatattacacatgtttaagcccatgtttacagacatgaaaattcagttactggacagtatcatacatttactccagagtgcagatccagctgcttgacaagcatgtacagtacagacttaattcacacaaccccacaaattgcttttagaaatccccactacacattgaggctttgacatgtaccgactgtctatttacagaaccaaactatcatatttgcactacaccacccaagagctgaatcagagtgaatggcgatgtgtaatttgtgggcagactggaaccatctactagagctctgatgataaaccagaggacattgaggccctgcttgtgagagcgggcctcatcgtcaccaaagcagattcattcgcaccagctctcaaagcaatccgaccagcttccaggaatctggcgacagcatcctctgcgtagcggttcgcttccccgacagtcatggtcctgccaatatctgggtacgtgttcagtacatggtcgccgttaagctgcgaggcaagttgaatcaactccacttggaactctgagagagacgaatcttccttgggaccaaatggtcgcagtgactttgtcacctctgggagcttctctggtcgggcgggtcttgcccatctcgttgggacccgagtaaaatcnatcattctccacattgataactccaggagcagaacatgctacactatcagttgaccttcgtttttgttaacagttcattgacgaagtaccgccgtggcagctatagtgccaaaaaaaggtcataattgttatcccattggcataacacatatatcaaactaccataaattcataccaggacagtctgttcttggcgttctccggattttaaagtagttctcaaaggtcccagcccatgcgtctctctttgtcagaaagttagaatgtaaattgaatagcttctttactgttgcaggaatggacgaatgctcatattgtgaagtatcctgtggaccgtttggtttatggatcactgcagaaatgaaaaggtaaggtgtgaattctgctggtgaaaacatgcagctcaatattggaagcataatttcctgatgaataggttcagcaaatatttaaagttccgaatttcattaacattaatataaggatgatcaagacacagagacagcataacgatagcataaaaggcagtgcggtcctctttcatgagagtgatcgttgaagtgctacttatataagttatatctaacaaaactaaccacatggactgctgcttgctatacatacaggatatctccacatggaggaagtcatcaacagcttctaggaaaattagagcatcctctgcactgaatgtttctgggctaagtttacaacaaacttgtccttataaaatgttgacaagaatccaatgacatggaaatatttgtactatcgcttcaatcaaaaaaaaacacaagctgaaccttaaaatttagtttctacctcaaactgattagttaaatatattgccatgccaggcatcaaaatttttcagagttgtttcccagggaaatttaagaattcaagtactcaccagtgcccttgtcgatccaaggtgagatgagaaaggtgggaacgcgcaccccaagccgttcgaacttgaagtagtatggatcaggcccaactattccatcaggctggggcactccaacgaccggcgtaggtacatggtcatagaatccaccatgctcatcatatgtgataatcagggcagtctcgttccactgcggactggcccttagtgtctcatacacctctttcacgaacctctgccccctcgccacatcatgcgacggatggtcatcgtttgctgggaacatctcgatcgaagtatctctgctcaatcaccgcataatttggcagcttccccaacttggcgtgcagcttgaacttgaggctgtactggtggaacttgacgaggtgcttgaggcggcggaggctctggtagaagagcgtggccgggatgttctggtagtatatgccaaacgacaggccgttctcctcgagactgtcaaagatggtcttctgcgggaagccatggatgaggtccttgcgggcgttgaaggtgaggccgtgggaggtcgccgagtggacgaacaggcggttgggctgcgtggaggtgggcacggaggcgaaccagcggtcgaagacggcgaactcgtcggcgagggaggcgtagacggggacggcgtcgggcttgaacccgctcatgacgttctgcggcatgccgaggcccatgccgcgcgcgttctgggcgaagccggacatgggcggcggcaccgcggaggtgtcggcggagccgaagatctgctcccggatgtcctcgaaaccgtggccggggtcggagtcgacgtagccggcctcgtccgtgacgaagatatccggggaggaggggtcggaggcgttgaggcggttggactcgcggcccgtgaggccgtcgatgtcggggcgggtgcggcggagccagccgaggatgtggtcgaagctgcggttctccatcaccacgaccaccaccgtcttgatcggagagtgaatctcgtgcttccgccggcggcgcttcagcccgcggtggtgcgcgtccaggcagtgcccggagacgaccagcgccagcaggaggagcgccacgaggaggagcgccccggggccgcggcgggccgcggcagccatcgcgccggaccgggagctaggccttcgccttcggcggcggcgggtagggtaggtgcgcttgctgttcagttgaatgaatcgatgagccctctcctctctgggtttccttttgctgcggccggccggcggcggcccctttttcccggccggcctcgag

SEQ ID NO: 21042 - DNA, 810 bp, Zea mays
gttctggtagtagatgccaaaagacaggccgttctcctcgaggctgtcaaagatggtcttttgcgggaagcccatggatgaggtccttgcgggcgttaaaggtgaggccgtgggaggtcgccgagtggacgaacaggcggttgggctgcgtggaggtgggcacggaggcgaaccagcggtcgaacacggcgaagtcgtcggcgagggaggcgtagatggggacggcgtcgggcttgaagccgctcatgacgttctgcggcatgccgaggcccatgccgcgcgcgttctgggcgaatccggacatggggggcggcaccgcggaggtgtcggcggagccgaagatctgctcccggatgtcctcgaagccgtggccggggtcggagtctacgtagccggcctcgtcggtgacgaagatctccggggaggcggggtcggaggcgttgaggcggttcgactcgcggcccgtgaggccgtcgatgtcggggcgggtgcggcggagccagccgaggatgtggtcgaagctgcggttctccatcaccaccaccaccaccgtcttgaccggggaatggatctcgtgcttccgccgccggcgcttcagcccgcggtggtgcgcgtccaggcagtgcccggagacgaccagcgccagcaggaggagcgccgcaaggaggcgcgccccggggccgcggcgggccgcggcagccatcgcgacggaccgggagctaggtcttcgccttcgacggcgggcggcgggcggtgcgcttgcaggtagggtaggtgcgcttgctgttcagttgaattggtgagctctct

SEQ ID NO: 21043 - DNA, 1665 bp, Zea mays
ggccgcttttttttttttttttttgctccaaatcaatggcattgcgtcattgactaccaatttctttttttttttttttttattttttttttttttttatcaaggcatgcatgacgctctggtgttaacagtgatcctccgtgtcgttctagtacagggtcaaaggtatgaaacaccgatatagactacagtggacaacaattggatacactgaaatggcaagctaacactcttccactgaagtcagctccgcatcaaattttctaaactgaaatggttgtgtcaaaatgtcctcgatggctcacaacctcttggctccaatgacaccaacgcatacatgaagggtcaagatactcagtgagaaaactccactattacaactggaacttgttggccatggctagatttgcagttttctgtattcccttctacaatttctgttccgctcgcctaatgggatcttggaagtattgaagggaaatgagaagtgcctcctctgttcttattgttctgctcccttggttggggcatgtattgaaataagatgtgaatacatcatctgcacgtttacccttcaagtttgtatcttcttcaatgctttcttccaaaccagcaagtccaccaaatgcaatcagtaggtgcctaaaagtaggtaaggtaagctcggaagaattaactatttgtccatgctctgaggtgccaatgatgtggtcgtattcttccttgaatggggaatttttgaaaacaccacttaaatttgaagtataacggactttgtagccccaataagatcccatctgttccctgggtgtcgaaggggggacgactttccttatgcaagctgtcgttaggtcacggtttgttcccatggctacagtaactcttttgcctggttctagtttttgttcaaccagaacattcttacttaatccgacatcaacaagagtcccctttgagggatcactttccaatgttacaccttcacgaaactcggaccattcgtgcttgcgcacatggtgtggtgcatcgagcggtggaagcagtcccacaaacttcaggttcttgtgcatcggaaagaggcggcggcggaggtactgtggagtttccagatactccaaaatccgaacaaggaaccgcgcgccgctctcttcaccatcaccggcgctgccgttctccgccgcgggagtactgtcaaagacgacgacctcgtctatgcgaaagacggtggcggcgcgagcgatctgaccagccaggagggtggcgagctcgagggactgggcgttgtcaatgatggagccggcaacggctatgctaaccgtcggcttcagctttttcttctcctcccgctcgtccttatccttcctctgcttctgcttctgcttcttctctttgggtgcttcttcctcggccatcgaggcgccgcagtcatcctccttggcatccttgtgcttcttcctcttctccctcttgtcgttcttgcgctgctccttcgcagcagcggcagcctcgctgtgaacgcggttcatggcggtggcggcgccgctggccagggaggaattcaggaatggatgcttggattgggagtcttcggcccttcgcgagttttggtctgaaggggaggcgtattcttttggtgggccgattgggagtttagggctcgtgccg

SEQ ID NO: 21044 - DNA, 883 bp, Zea mays
gaagacatcaaatgtagttagctatttgaattagaaatgctgcataaagacagttacaatacaccattgcatgccgacaagctagtgctagtgccccctgaccacatgctccctaacagcacgcgcaaatgactactacaaaactctcctacactttccagagcatcgacacatttcctgattgccacatattccaggaacggtttttctagggggtatgcaatcgcaacaaaatcttacatcgtgtacttttagcacatcacatgaaaccccttcgcaagggcgtatttctccagctcagatgggtgatgttctgtgaaaaaactggatgccaaaatccaactctcttacaaatcatggacctgaagatgacactcaatttacacatcctgaaaaccacctcctggctggaaaaatgtagggcctgagctcttcttgcaacatgaggtccagcgcttgaaagcacagtaagctcaagcgttcgctgtgtagcatcacagaaagtaatctggtgctggcctcttagcaggaacacctcttgattcatgtggagcagcttcaaatacgcggaactgcttattcaggttctcatccagctctaggattgcagcaatattgccacacctgtagcagtaattaggagcagaccatacagttacaatcttgctattgaacatccatttatacccttccatgacaagttgatgtgcacgacaaatgtaatctatgttgtttgaatggttaaatggtgagaccacatttccaccaaagaggaatcctgcaccccgaggacttagtccccaaccatctacagtgtcctctggagcccaccatagaaggtcacacatagccccatcatgaggtacctcggccgcgaccacgc

SEQ ID NO: 21045 - DNA, 1659 bp, Zea mays
tgggtaccgggccccccccctggtttttttgtcttcttttgtagttagctatttgaattagagatgctgcataaagacagttacaatacaccattgcatgccgacaagctagtgctagtgtcccctgaccacatgctccctagtccctaacagcacgcgcaaatgactactacaaaaatctcctacactttccagagcatcgacacatttcctgattgccacatattccaggaacggtttttctagggggtatgcaatcgcaaaaaaaaatcttacaacgtgtacttttagcacatcacatgaaaccccttcgcaagggcgtatttctccagctcaaatgggtgatgttctgtgaaaaaactggatgccaaaatccaactctcttacaaatcatggacctgaagggagaagatgacactcaatttacacatcctgaaaaccacctcctggctggaaagctgtagggcctgagctcttcttgcaacatgaggtccagcgcttgaaagcacagtaagctcaagcgttcgctgtgtagcatcacagaaagtaatctggtgctggcctcttagcaggaacacctcttgattcatgtggagcagcttcaaatacgcggaactgcttattcaggttctcatccagctctaggattgcagcaatattgccacacctgtagcagtaattaggagcagaccatacagttacaatcttgctattgaacatccatttatacccttccatgacaagttgatgtgcacgacaaatgtaatctatgttgtttgaatggttaaatgatgagaccacatttccaccaaagaggaatcctgcaccccgaggacttagtccccaaccatctacagtgtcctctggatcagaccatagaaggtcacacatagccccatcatgaggtacttcttgcttgcggtctattactcttatctgatccagtgtcgtgatagcaggagaaaggcctccatggacactaaatattttgttctcaataagtgcagacaaacttaaatagtcgaatatatcagtgcaatatctccagacattgactgagccatatttgcgaaggcactcatcatagaatccataaacctgtgtgatctgtctgctctcatggtttcctcgtattaaggtaatacggtctggatacctaacctttaaagccaaaagaagcaaaaaagtttcaacagaataaaatcctcggtcaacaaaatccccaaggaacaaatagtttgtctttgggcagtcacctccaactttgaacagctccttcatgtcatagaactgtccatgtatgtctccacaaatggtgacgggggcgtcgacgcgctgcacgttactctcctcgatgaggatctccatggccttgaggcacagtgccttgacctccgcctccgtgagcggctcgcaccgcttcagctgctcgatctgccggtctagatccgacgcccccatctccgcctccgccgctgcggggccgtctctctctctctctctctctccaagaagtttccggaaagcgccgtggcagcgcgctcttcgccgggtgcttctcgaagattctagggttaggaggcggcggaagccgtggggcgcgtgcggaccgcggtgacgtggcgtgggccgtaggggagccgagtcccgtcgtgccgg

SEQ ID NO: 21046 - DNA, 2534 bp, Zea mays
gtccggacctcccgggcagctaaaatggctttatatactactggcttggcttgggcgtcgatggatgtgcgtggcaacgtccaaaatccagaccgctggtaggagtatctcgtagacattgaacaacggctgcatggcgagcgcctgcgccacctccatccccctcgtctcggcgccctctgcatgcccgtccaagaagaccaccgtcgccaggttccggcgccgcacggcgacgtgcagggccagcagcggcggtggcggtggccggggcggcgaaaatgatggcctcctttggctgccccggcgggacgtgatgctcaacggcctgtccagtgtcgccgccgggctcgcctggtacccgggcgtcgcgtccggcgcggatgcggtgtgcaccagggccgacaaggtgaacgagaagaccgtgcagtgcacggacccggccgggcagcttccgtgccctctggtgtcgccgacggaccccgtggacttcaagccggaaagcaaggtgacgcgcatccggcagccggtgcatctcctgagccgggagtaccaggagaagtacaaggaggccgtcgcgaagatgaaggcgctaccggaagagaacccgctgagcttcgcggcccaggcggccatccaccaggcctactgcgacgcctactacaagtatgacccgacggccaaggacgcgccgttcgacgtgcacttctcgtggatcttcgcgccgtggcaccgcatgtacatctacttctacgagcgcgccctcgggcagctcatcggcgacgacaccttcgcgctgccgttctggaactgggatacgccggccggcatggtggtgccgccactcttcaaggactccatgggcaacccgctgtacgaccccaacaggaacccgtcgaacgtcgacgcgctggtggacttagactacctcaacgacaggaatgcggagcccatccctttcaagggcccacgggacgaaaagtacaaggaacttgtgaacaagaacctgtgcaccgtatacacccagcaaatacgtagcggcaagggcgccgagtcgttcctgggcgagaagtactgcaccgacatcgggtcaagcacgagcagcatgggttcgctggagcggatggcgcacactgccgtgcacgtctgggtcggcaaggcgggcccgacgccttcgtcggaggcgtgcagtgccgctaccggcggcttcccgaaccacaccaaaggcgggtacagctgcaacaacgacatggggttcctggggtcggcgggacacgacccgctcttctactcgcaccactccaacgtcgaccgcatgtggcacatctggtcgaccaggctcggcggcgggcagggcatcacggaggcggactggctcgacaccagcttcgtcttctacgacgacgtcaagagcccgcggaaggtgcgcatcaggttccgcgacgtcctggacacgcgcgacctcggctacacgtacgacgccgagtccgacaaggacctgccatggctgcgctgcaagatctcgtcgctggtgccccacggcaaggacagcccgccgaggtcatcgtcggcgaggaaggcggcggcgccggtgttcccgctcgccctgaccaagggccaggtggtggaggtgccggccgtgcctgtgccggccaaggacccggggaaggagcagctgctggtgatcgagggcatcgagtacgacccccaggcgaacaataagttcgacgtcgccatcaacctgcccgcggacaaagcgttgcaggtaggcccacagtacaaggagtacgccggaagcttcgccgtcgtgccgggctccggcgccgggaagacgcggaaagtgaagctctccctgtgcatcaccgaagtgctgttcgatatcgacgctgacggcgataaaaccgtcgacgtcgttatcgtgccgcgcacaaatgctaagatcacgctcaacgctcgccccaccatcaagaatcggaactaggagctagctgctactagtgctcatcaagcacactgtacgtacgtacgtatgtactcgatcgcgtggtcattcatcgaccatcatcgtttatatgctgtcacgcacagtgcgggacggccagtgttgcattattgtgtgttttatttcgcatggattaggatcgagccgcgccaatggtagattctacggaataaatataataacattgttatgattgatatcattatgttttaaagacgatcgtggttttatatcaacggaacgtatctacaactgaaccaattgatgcaaccgatacaaccaaggcataaagacggagggagaaggacctttttaaaagtatctagggagatgggaaaagttgttttacaaaaatggtacgtattaggtcacttcaacttcatttttatgtcttggttgtacggttgcaccaattagttcggttacacctaacaagatagatattggatgctatatttttataaacaatttcgtcctcttgcattaaaatatccaagcccttaaatgatttcaaagaaaagtgtttcaaggggat

SEQ ID NO: 21047 - DNA, 3731 bp, Zea mays
ggcgagcgcctgcgccacctccatccccctcgtctcggcgccctctgcatgcccgtccaagaagaccaccgtcgccaggttccggcgccgcacggcgacgtgcagggccagcagcggcggtggcggtggccggggcggcgaaaatgatggcctcctttggctgccccggcgggacgtgatgctcaacggcctgtccagtgtcgccgccgggctcgcctggtacccgggcgtcgcgtccggcgcggatgcggtgtgcaccagggccgacaaggtgaacaagaagaccgtgcagtgcacggacccggccgggcagcttccgtgccctctggtgtcgccgacggaccccgtggacttcaagccggaaagcaaggtgacgcgcatccggcagccggtgcatctcctgagccgggagtaccaggagaagtacaaggaggccgtcgcgaagatgaaggcgctaccggaagagaaccgctgagcttcgcggcccaggcggccatccaccaggcttactgcgacgcctactacaagtacgacccgacggccaaggacgcgccgttcgacgtgcacttctcgtggatcttcgcgccgtggcaccgcatgtacatctacttctacgagcgcgccctcgggcagctcatcggcgacgacaccttcgcgctgccgttctggaactgggacacgccggccggcatggtggtgccgccactcttcaaggactccatgggcaacccgctgtacgaccccaacaggaacccgtcgaacgtcgacgcgctggtggacttagactacctcaacgacaggaatgcggagcccatccctttcaagggcccacgggacgaaaagtacaaggaacttgtgaacaagaacctgtgcaccgtatacacccaggtatatacatacgtatttctttgtttgtctacgtacttaggaccttaggtagcttgctctcgcttcgttaattttgacctttctggctgctactgctactactagcaaatacgtagcggcaagggcgccgagtcgttcctgggcgagaagtactgcaccgacatcgggtcaagcacgagcagcatgggttcgctggagcggatggcgcacactgccgtgcacgtctgggtcggcaaggcgggcccgacgccttcgtcggaggcgtgcagtgccgctaccggcgccttcccgaaccacaccaaaggcgggtacagctgcaacaacgacatggggttcctggggtcggcgggacacgacccgctcttctactcgcaccactccaacgtcgaccgcatgtggcacatctggtcgaccaggctcggcggcgggcagggcatcacggaggcggactggctcgacaccagcttcgtcttctacgacgacgtcaagagcccgcggaaggtgcgcatcaggttccgcgacgtcctggacacgcgcgacctcggctacacgtacgacgccgagtccgacaaggacctgccatggctgcgctgcaagatctcgtcgctggtgccccacggcaaggacagcccgccgaggtcgtcgtcggcaaggaaggcggcgccggtgttcccgctcgccctgactaagggccaggtggtggaagtgccggccgtgcctgtgccggccaaggacccggggaaggagcagctgctggtgatcgagggcatcgagtacgacccccaggcgaacaataagttcgacgtcgccatcaacctgcccgcggacaaagcgttgcaggtaggcccacagtacaaggagtacgccggaagcttcgccgtcgtgccgggctccggcgccgggaagacgcggaaagtgaagctctccctgtgcatcaccgaagtgctgttcgatatcgacgctgacggcgataaaaccgtcgacgtcgttatcgtgccgcgcacaaatgctaagatcacgctcaacgctcgccccaccatcaagaatcggaactaggagctagttgctactagtgctcatcaagcacactgtacgtacgtacgtatgtactcgatcgcgtggtcattcatcgaccatcatcgtttatatgctgtcacgcacagcgcgggccggccggtagggtgtcggcaataataaacgcggccagtgttgcattattgtgtgttttatttcacaaggattaggagcgagccaatggtagattctaaggaataaataacattgttatgaatgatatggttatgttttagagaaaaaaaaaaaaaaaaaacaagggaccgcgtcctgtgcaactgaaccaattaatgcaaccaatacaaccaaggcataaagacataggtacaaggacctttttaaaaatatctagggagaagggaaaagttgttttacaaaaatgttacgtattaggtcacttcaactttatttttatgtcttggttgtatggttacgttgtaccaattagtttgattatacctaacaagatagatattggatgctatatttttataaacaatttcatcctcttgtattaaaatatcccagcccttaaatgatttcaaagaaaagtgtttcaaatgtgaagtatttagatcttgtgaggatctataattttgatcaaagtgtcagtttccatcagaatatgagaagtctagaacaaatatttgggactcacaaattttccaaataaaaaacttgtcaactacaacggccaaatgtcgtttgaaatttctaaatttcaaagttctaatttttataacataaaataaatgtttatgaatctaaataattttaagtcaaaagcttgttaaaactatatagagacccactacttttagactatatcaacatccaaaatcatttaaaaaattataaatattaaattacaaaatcttatagtttaaaataaacttttaggttctaaaaaattataaatgaaaatttatcaaccataaattgtatattgtgttatgattttgttataaagtttatattcaccaaccctaaagttgtagatcacattgaggtctatgattttgatattaaagtttatctccatcacagttccataaaaaagttacgatatttttttaaaaaataactatttaagaggtggacctttagaatataggtctctattaatcgatttctgaagatgaactcttacaatgcctgtctttgttaattgtcattttctgatgcggcaattatctacaaatccacctttgttagtagtcattttctatagaagtccgattctattaagcattaaacgattaatagatgcaatcatctcgtaagataccacatctgttagtagttgactaacagggtcatcttggaatggccgcctctaataattattgagatacagaggtggattatttcacgggagtctcctgatcagttgtaaagaagacaccacgaagtgtccacttcagttaatcacgggtgtgtctccaaaaatcgtttaggtagtaatgatgataagccctagcatagttttaatgctaatctggcgggacgattaggtgtgctcgtagtgggttagttgtgcatcgcttggtaatctctactatatataagagtaagtttcgtcgtgtatcgttgcctccagtgagtgcagcgagcgaataaattttctctcccatgcgagcgaataaatgtgcgaaggatttgaaccccgcttgcttggtataaagcgcttagcttttccactgcaatgtatggttgtgtttatatatggagagatattataaatatacatatatatacgctaataatga

SEQ ID NO: 21048 - DNA, 2757 bp, Zea mays
ccccgcgtccgctcatcagcaatataatacccaagatacaatctaggcagcctacaatctaacgtactccaggctccagctgatttgtccacgcggcatggcgacggccagcgccgcttcaagcttcctcgtcccggcgactgctatcgccccgacaccctctgcatgcccatccacggttcccaagaacaagaagaatgctgccggccggcggcggcgcacattgcagtgcagggccagcggccggcggggcgacgacgaagacagccgcctcctctggctgccccggcgggaagtgctgaccggtctgggcggcgtggccgccagcttcgtcgggtacccggatctggcttccatcgccctggaagcgaaccccgtggagagctgccggcggggcgagaaggtgacggagaagctggtggagtgctcggacccgaacagagacttcccgtgcccgccggcgtcacgggtccccatcgtggacttcacgccggaggcgagggtgacgcgcgtccgcaggccggcgcacctcctggacccggagtaccaggagaagtacagggaggcggtggggaagatgcgggcgctggacgggtcgaacccgctgagcttcgcggcgcaggcggccgtccaccagtcctactgcgacgggcactaccggctggacccgacggagaagaaccggcccttcgacgtgcacttctcgtggatcttcgcgccgtggcaccgcatgtacatctacttctacgagcgcgccctcggccagctcatcggcgacgacaccttcgcgctgccctactggaactgggacgcgcccgcccgcatggggatcccggccatcttccagcagggcgtctccacggccgacaacccgctgtacgacccctaccgcaacatggagaacatggacgccctgctcgatctggactacctcaagaaacccagacgcgacaccatccctttcgagccgccgacggacccagccgcgcgcgccaagtacgacgacgccgttcaaaccaacctgtgcaccatatacctgcaggtccgtatttgcattgtacgtatagcaagtcctgactgtacgatgcatgacgctttgttgtatttgtacgtgtagcaagtccgtgacggcaagggcccccgtttcctcggcgagaagctgtgcagcgagtcgagcttccgggtgaaggagatcaacgagcggtccaagcggaggcaggcggacgggcagagcagcaaggtgagcccaagcaagtcgcagagccagggcacgctggagcggatggcgcacacgacggtgcacgtgtggacggggcgggcgaacccggcgacgtgcagcgcggagcagggcggcgtggtggggcacgacggcaagccgcactgccaggtggacatggggttcctgggcacggcggggcgtgacccgctcttctactcgcaccacgcgaacgtggaccggatgtggcacatctggtccactaggctgggcggtaagggcttcgacgacccggagtggctggacaccagcttcgtgttctacgacgactaccggagcccgcggctggtgcggatgaagttccgcgacgtcctggacgcgaccaggctcgggtacacgtacgacaaggagtcggaggcggcgctgccgtggctgaacagcaagccgacccggttctccggcggcggcaaggcgaaggcgaaggcggcgcccaaggtggcgtcggagttcccgctgaccctgacggacgaggccgtggacgtgccggcggtggcggtcccggcgcggcaggccgggaaggacctggtgctgctgatcgagggcatcgagtacgacccccagatcaacaacaagttcgacgtggtcatcaacgtggcccgggaggacgccgcgagggtggggcctaaggacagcgagtacgccggcagcttcagcgccgtgcccagctccaacgccgccggtggcacgctggtgggcaagttcacgctcgccctcgacggcgtgctcgccgacctcgggctcgccggcgcgagcgccgtcgacatcgtgctcgtccctcacacggagggcgagatcaagctgtacttgcccccgaccatcgagaacgcgtgagaactgagatgagatgagacccgccacgcactgctggctggctgtttcgtctgttcaccgtccccatgagccagcagtggcgatttttaagttctaattgaagtagtatatgccgtcctgataatcctaccgctttgtatatatgttgcctggaattataatctcctcatattatatatcccacaaattttgaactaaaattattgaattatataatttagataaattataaatccaaacaaacaccaagtttataaataatgaaacgaggaagggtgctctgtgcttatgcacggatattacaatgccactttttttaaaaaaaaacatgagccgacaattttctgttttcaaaaaagtcaggaacatgcgtgcagggccaacaacagagagagcacaggggtcatgtcctcctaatgctaccctaattttatagtagctattattttttaactaattctcatataaataataaaaaatccttttaactgccctctaatataatttgatccctaatttcatattctggcttggcccttgcatgcatgctccagctacatacctaaacccgacgctggcctttcaacgcaactaccgacaccttatctttcgacaaatgaccaaggcagcgcgggtcctagactcgtagt

SEQ ID NO: 21049 - DNA, 2175 bp, Zea mays
aaaatggctttatatactactggcttggcttgggcgtcgatggatgtgcgtggcaacgtccaaaatccagaccgctggtaggagtatctcgtagacattgaacaacggctgcatggcgagcgcctgcgccacctccatccccctcgtctcggcgccctctgcatgcccgtccaagaagaccaccgtcgccaggttccggcgccgcacggcgacgtgcagggccagcagcggcggtggcggtggccggggcggcgaaaatgatggcctcctttggctgcccccggcgggacgtgatgctcaacggcctgtccagtgtcgccgccgggctcgcctggtacccgggcgtcgcgtccggcgcggatgcggtgtgcaccagggccgacaaggtgaacgagaagaccgtgcagtgcacggacccggccgggcagcttccgtgccctctggtgtcgccgacggaccccgtggacttcaagccggaaagcaaggtgacgcgcatccggcagccggtgcatctcctgagccgggagtaccaggagaagtacaaggaggccgtcgcgaagatgaaggcgctaccggaagagaacccgctgagcttcgcggcccaggcggccatccaccaggcctactgcgacgcctactacaagtatgacccgacggccaaggacgcgccgttcgacgtgcacttctcgtggatcttcgcgccgtggcaccgcatgtacatctacttctacgagcgcgccctcgggcagctcatcggcgacgacaccttcgcgctgccgttctggaactgggatacgccggccggcatggtggtgccgccactcttcaaggactccatgggcaacccgctgtacgaccccaacaggaacccgtcgaacgtcgacgcgctggtggacttagactacctcaacgacaggaatgcggagcccatccctttcaagggcccacgggacgaaaagtacaaggaacttgtgaacaagaacctgtgcaccgtatacacccagcaaatacgtagcggcaagggcgccgagtcgttcctgggcgagaagtactgcaccgacatcggggtcaagcacgagcagcatgggttcgctggagcggatggcgcacactgccgtgcacgtctgggtcggcaaggcgggcccgacgccttcgtcggaggcgtgcagtgccgctaccggcggcttcccgaaccacaccaaaggcgggtacagctgcaacaacgacatggggttcctggggtcggcgggacacgacccgctcttctactcgcaccactccaacgtcgaccgcatgtggcacatctggtcgaccaggctcggcggcgggcagggcatcacggaggcggactggctcgacaccagcttcgtcttctacgacgacgtcaagagcccgcggaaggtgcgcatcaggttccgcgacgtcctggacacgcgcgacctcggctacacgtacgacgccgagtccgacaaggacctgccatggctgcgctgcaagatctcgtcgctggtgccccacggcaaggacagcccgccgaggtcatcgtcggcgaggaaggcggcggcgccggtgttcccgctcgccctgaccaagggccaggtggtggaggtgccggccgtgcctgtgccggccaaggacccggggaaggagcagctgctggtgatcgagggcatcgagtacgacccccaggcgaacaataagttcgacgtcgccatcaacctgcccgcggacaaagcgttgcaggtaggcccacagtacaaggagtacgccggaagcttcgccgtcgtgccgggctccggcgccgggaagacgcggaaagtgaagctctccctgtgcatcaccgaagtgctgttcgatatcgacgctgacggcgataaaaccgtcgacgtcgttatcgtgccgcgcacaaatgctaagatcacgctcaacgctcgccccaccatcaagaatcggaactaggagctagctgctactagtgctcatcaagcacactgtacgtacgtacgtatgtactcgatcgcgtggtcattcatcgaccatcatcgtttatatgctgtcacgcacagtgcgggccggtagggtgtctgcaataataaacccggccagtgttgcattgaaaaaaaaaaaaaaaagcatggattaggatcgagccgcgccacaaaaaaaaaaaaaaaa

SEQ ID NO: 21050 - DNA, 10622 bp, Zea mays
  misc_feature (4009)..(4009): n is a, c, g, or t
gaagttttggaagatatttttttcctcttaataactatttcaacaattgaccttgaccttgtttcacgctttcgagaagaaaaaaaacatgtttcacctctattttgaaatataaggtttgctattgaaaggaattgttttacaggatattgattgtatgcccctccatcccatggaaaatgagtccctcaggcaaaaaaacatcgtgaataaatacttatccgaggtgaaacttgaggatcagatgaatgacttgggtagtgggggtgcagcaaggttcgcatcaaatgtgaatgtgaattgtggcgatgcagcgttccaaataccttctagccacccggtaaatagtttaacgaagcaagcaaaggtagcatatttgatgttgatgctaattaccttcatatatagaatatgctaactgtttcccttttggtttgcataataggttggcacagttgattcaattgtacaggccaaagctacagttaatgaggttgcaattgcagcacaacaagcaatgtacaatcagccatgcagtctctcacagatacaggaaagagaagctgatataagagctcttgctgaactatcacgtgcccttgataaaaaggcaagtgcagaaaggcctgtgcctcattcttgtttctgtagtgtttgaaagtagcaacaaaataaaacatggctagataccaaccgtgtttctttctttaaaaagttctgtcttgcaacaaagaactagatttgattaaaatccattcactcacaatacagttggcataactgagtttacattggtttttacagcagtgctattaactgactcatggtagtgctgacaattcagctggctcgtgtttgatttttacatcagtgttctatatttcagttgcacaatttaatgataattttgcacacatgcagtagttacctgtcagcagtctcgtatcaagtttttcagtttgttcagtttgaaagtagtcggcgcatgtatctaggttcatggtcatgcccaggtttaggggccactaaggctttacttagtcatgtagggccatgtcgtgaatatatttccctatttaaattcaatcaaagaactagaaagctgctgctgccgcagcaccaatttcctctgctgtgttcttcagacaaggaactcacctaacattcttctcctgcagcgttttggagctgcattttttttaaaaaaaactgttataatacatattgcgtctcctgtatttagccgtatattgccgagctgggctcctctcctgcaagcgtgcagggcccagcccatggtgtacgtaccagccctggttgggtaagccgctcctccctgtcttgagtgtgccgccaccaggagcccctcattagggttctcctccctataaatgtaacccttctgcaatataatcatcaagtcttgcggctctacaccttccaacagaaacgacagtttgtatttcactatgaaaaacctaattggcatggtattattgtttgtttgtacatttatcctttggatatttgcatcataaaaatatagatttaaatatgttttagatgttttggctataatgaattgctattttcttttaggaagctttattggtagagttgaggcacatgaatgaagaagtgtccagaaagcaaaaggatggtgagactgttagagttgaagcatttcaggacgcaatatgctatggtgcttgtgcagctaagagattctaatgatcaagtaacctgcctttgtcccaatatctcgttttaagttttcatatgcttaggtgaatgacacaaagtgctctcatgaacaggtagcctcagctttgctttctctgcggcaacgtaacacgtatcatggaaatcaattaccgtcatatcctatttccatggaaaatggtggaaccattactggagcaccagatccatataaccgttttggttatattaatccagaatccggttcccaagtaatggaagttattgagacttcaaggtgcaaagcaaaaatgatggttgatgttgctgttcaggtcagtatgtcagaattatttgcatgtttgtgctatctgatttaggattcctcatggatctcatcaactcatgtttatattctgtattttgcgaagaaagttcttccaattgaacaaacagtgagtgatgtgcaactcaccttagtttgcttactcaatttgccaggcgatgtgcaaagtgagggaaggagagaacgcctttgctaaaatcggtgaagcactagatgatctcgatagtcgtggcacaggctctggttcaagcatactaggaataagacggatacctcccgattcagggaaggcaaatacatcctttcaagataacggaacgcctgcccctgcagcaatcaactcttcaggtccaagattgcccaacgggtatgattctgaagctcaggttcctactgatttgatttcgtcctgcgtagccacgatacttatgattcaggtaaatcgcccaagactcatgcactgtttgatttgagaatacctcagcgctcccacgtctagtgatcttacagctgctgcttccattcgtagaactgcacggaaaagcagtatcatcctgccgaagttgcacacatccttgattcggccctgtcacgcctacaaccgtgcagctcccagaacatcccgatcttcagggagattgagatgtgcatgggcattataaagaatcaaatgttggcgttgatacccacaccaagcggctagttccttgctttcctgtgagctggccggaagaggggtaaatttcggaaagaaaccggaatactgtatgtggcgtgtattgttttttttttcccattttttactgatttgttgtgttgtacaagctgtatgtttttttactgtcgtacaagctgtatgttattgctttatacatgtataatagtaatcatgaaagttcattgttctggcaagcgcatgtacattcagcttgaaatactgaaccctttttccaaacggaaattttttcctgttcctttacttttttgaaattcttgcgttccaaacggggcctcattgttctcgcaagcgcatgtgcagacactctgaaatgctatattttatctaccggcaataaaaaaaatgagagatggctgaatccgctggtttaccctttccgtaagtaactacgcaaaaatagatgactttgatgaatgctgctgcctaataggtaactaggcagacccaaacaccatctatcggtttgattacatctaaacacaaaggaaaaaatatatatatatatataaagcgacccgggcaccaagtcatatgtaacgacaaacagtctagaaaaagaatgccccgaaggagtcacaaaattatttccgctcagatgatacgtgcattgagaaacaatggacctaataggtagtagctagtgatattgattcacccacagcaacaggaaatgaggaaaaaggagaggtattgctacaggtcgatatgtatcaaccatggaaccaagaacctatagcacagatccaaatctacttgttctaaagcacgcattctcgatacattacatatatatatatataaacaaagcgggcatttgagacaagcactataaggatagggaaccagtacagatgtaaaccatgcattgcagacaaatcaccaccataccacaacaagaacgccaacctccaggagacattcctgactgcacagcaaaaataacttattctttgagcttggtcagattccggagcctcaagtggtgttccaagcttaggctgcaaggactattatcactatgagctggacagcaacaagcatatctgcaagaagcaagacggagggttactgattaagaataatggaagatttaaagatattagcagtgtatcaaagagctcgtgatgtaccagagaagagtttttagcagcctttgagagctggcctttggcctgcatagtcgatgccgcagcattatctatatgggagtcgatgtcatctgnaccaaacaagaagaaatataattagataaattgatgaaataacaaaatcaagtgcttaaacccatcaaactgcagaaatttcatacgtcaggtcacataccaatcattgctccttgaccatgaactagcacagcaagatctttgaaaatttcgtttacttcagtaatttggtgctgaatctcttgtattccctgatccctctcctcaacaagttgtcgcattatccaagaagactatggttgaagcaaggagtacaaagttagcaccttacaggaatacagacaaaaaggataacaggtaaaagaaggttctgatttttgacatggaaaatgaaggttgtatgtattcccgtgcacagtaaaaaacagatataagtgcagagcaaataaataaatctatacaaagtaacagcatgcacaagacaatcatcccaccttcttgactcaaggagctgagtgcgctgctcggccaacttatcagcaccattatttgactcgcttgagttataactgcaaacaacgatccacactagattagttaactggtagccacaaagtgcagcagctttgatagtttaatgatttttgtaactgataatatctaagacatattaccagagttggattagagagaggctacagttgttcatacagattcttattttgaggacgataccaaagttggattattttttttactctttataaacaactttccagagcaacttaaagcgccccaaaataaaggtacatcaagactgaaggaaacagatagtccaataaaaagtgtgtttgaacattttgaaggtgtttttttttattaaaaaaatcacaaggttctgaaaggtcatcaagcacaattcatatacaaactcagaaatcttcacagttcattcaatacacttctgttagcctatatatatgagagatagatggtacacgcagtataatttacagacatcctatcatcagaatattacaagatacacatttcatttagaacaacaaaaatttaggtaacaggtaggaatgagaaataatgactagatgtgcaggcaaaggcaaagcagagcaaaaaaaaatcacctctgtggcagacccgcttgagaaacaaacggtgcatactgccaatcgctgagctttctggaattcttttaggactgcttggaaatccttagcaatcttcttggtagcctgcagttggaggcatggttatgaacccaatttcatgaaacagaaaagaagatggactaccaacacatgtgtgattacgcgagttatcgaaataaaagaagagaatgatgaataatgcgacagccaacacgataaattcaggtcacaacaacccatgaatccaaggtttactggcagctcttcatttcgccacacaatgagaagcaaccatgaggaggagaataaaacaagcggtattgaacgaaaggagcacgaagatgatgcgagtgtaggagagatacgctgacttggacacgatggtcggcctcgctagcttgtttaagcttgtctgatgtgtccttgaccagcagctgggttatttgttgccgcgtcttatgtctgcacgtggaagcaagccggtagtcagtcgaccatacaacagacccgaaatactaacgtagcccgtattttgccaacacaggtatacagcagcccagcatggctaggtcgtgacagtaagaagttggttcaagttctcagaagagggatggcatttggaatcgatgtcagagcccgtggaattggaaggtatgttgcggtgtggctagattggacaaaaccaaacaacgccgtgaaggcctccagaggaggcgatgtatagacatgatgataaggtatagggtccgcaaattggatacggaagcatcagcgcgcctgccgaaggctgctccactgcggcttcagtgcttatgtccacggtgttcaagagcacgacccctgccctcctgccgctgccatcgggccagcgtcgaccaccaaggcagcgtgcatcatcagtggaaccaacccgtcgaagtgagcgccaagagaagcagcgtgtcattcgtcagcttgatctggctggcaacgaggaaccagttggtgatgaagcagtcaaggaactctccgagatgttcaaacatcagttacccaaacaagagggcaatgcaggcactacgggttgtttcaaagttggccaatggtgcggtgacggatgccacggcggccatggcgacccttgtccccaatatgtgtcaagttttcctctgttccagatgattagcgtcttcgttagcaatgttgcggctttagttgtttctcctttattgtcttggcaagaacgttcttcccagtttgttttgccaggcgggtctgttcttggagacccccctgtgtgttgttcctctatttcaaatatgagtctacaaacaacttttctaagctggaatgtcagaggcagtgagaacaaatcttcttcaaattcagccaacagttgtttgtctacaagagaccacaatgagtcgttctgcagagtatagcctaaggtgttctaagaattgtgcaagtcttgttctacatctatatacaagtaatcaacgcagacgaaacacctcttgcacgtgtggagtctggcttatagtaaccgaataataggttacgatgcaggacgacaatcagaaccaaaaacccttaggcctttgttacggattgttggtcgaaacaattacgagaggaaaccgccatccccatcctcgcggacggccggacgccattcctaccgccgtcacctcatgcacatgcctgcatggtcatcgaggttgtcatcattacccgcgagccaccatagctgtcatcgttcctggcgtcccccacaagctcaaacaggagcatcccaaccaggttagggttcgagccctctgcgatcatgattaattgattgaatactgctttattattttttagcgttagagcggacaaaccattggttacttactaaacatacagacgattgattgattggttggttgagcgtgcagtttttttttcttcccttgcagttatgtagctggtggcggagtttctggcataaacttgaattactccttggattatttacgtactagtactactaattcaacaccatccatccacccgattccgatccgcgcaatcggcggtccatctcggccgtcgtcgcagccaccgaaccggctggcaccggaaattcaactcgttatcccacgggccccgccgacaggccccttctgcactacaaccagtacacgacgcgctgtgcagcctgcaagctgcaaggcaagttccgtccagctcctcctccatttaagccgcctgcctggtgcctccactccacccaacaaattcccgagacgccattctcaccatccacacaaagccacagcccaagagcagagtcgtcgtcgtcgtcgggcatggcggggttcaaggtgacgcggatctcggagggccccgtgaagccggcgtcggcgacgcccgaggagacgctgccgctggcttgggtggaccggtacccgacgcaccgtggcctggtggagtcgatgcacatcttccggtcgggcgcgggcgaggccccggccgtgatccgggcggcgctggccaaggcgctggccttcttctacccgctggcgggccgcatcgtggagggggagcagccggggcgccccgccatccgctgcaccgccgacggcgtctacttcgcggaggccgaggcggactgcagcctggaggacgtgcgcttcctggagcggcccctgctgctgcccaaggaggacctcgtgccttaccccggcgacgaccgctggcccgtcgagccgcacaacaccatcatgatgatgcaggtatcttagaccacaccacacctcgcctcgcctcatcccgtcagtcaattccgcagcgagctttgtttggaccatacgacccgccgacggccgacgagctcagctcagcgcgcgcgctttgtttggagagggatccgttgttcgtcgggccagatccgggcacgcgcgcgcggtagatctggggagctgcggcgccctgcagcctggcgaggggtcaaaagcccagggtcagagaaggcgcgctcacggccacctagggaggttgaccgtgtcggttaatcaggatggcaagtgggaccaacgctgccagattcccgccgtcgcataatcacgcacatcgtgcttccatagtactgttttttttttattattttcttcttgcatttgaatcgaaaaaaataatgcctaaaacagagttttagtttccgaaataaaatagtgagacaaaatcctagaaaccaaacggtcaggtaaaaagcagggagggactaccggacaggcagcgagaacgattaatgggttaacggctactagtagtactagcagcggctgtagggagattccctcgacgccgcggtggcggtgggagcggatggccaccgtacagtactgaatgcgggcggtgaggctgatccgcgccgatctggatatgcgtgagcgtccgtgctcgcgtccgtgctccggcagacgagcccaggttggtcgtctgacacgcatggcgtctgaggtcagcagtggagaacttgcggccaattctcaattccgccgacagaagccgctacgtcacactccagcgtgaccttgcgtcgactatccaacgtgaccttgggtggtgggtgggtgggtagggtgggcggctggtaggtaggtccgcgctggcgtagacggctgccgcgaactcggtgcccgaaagcggtgccagcgccacgatgtgaaccccggacaaagatgcggggagaagaggcgtgctgaactgggcttgctctgtccacgacgctccaatttgccatttggtagtagtacatgttggtagtggtcatcttgccgtatatattgccctgcccttataaaggcacgacgaactgtacccgtggtcatcttgccatgtcctagttttcaatatatttatgacagtagtagatgctggtagtggtcatcttgccatacacccatatttagccacaaaattgtacccgtggtgttggtgccgagtgccgaccgggcatgaccagtagctgaccggttgttgtcgttgtcgttgccggtagtttactcgatcgtacgtggatgttgcctttgcgatcagggttcagggatcagccatggctttagcttcttttcctgctttcgtccacggcccaccgacatctttgcggggggtagttggacaagagccgtgtcagtatagatcacaactttcgcaactactgcacctttcatactgctgccagtggttgccgcccgcggcacaccctttcctttcttcacgggtgcgtgcgactgatttgccaccgagagacgattaattaagacgcacgcttcggatctgaacaaaataaacctgtgtagaacggcgacgaccgctggcccgtcgagccgcacaacaccatcatgatgatgcagatcaccaagttcacctgcggcggcttcgtgatgggcctgcggttcaaccacgcgtcggcggacggcatgggcgcggcgcagttcatcaacgcggtgggggacatggcgcgggggctggcggagccgagggtgctgcccgtgtggcaccgggagaagttcccggacccgagcatcaagccaggcccgctcccggagctgcccgtgctggcgctggactacgtcgtgctcgacttccccacggcctacatcgacgggctcaagcgggagtacaaggcgcacagcggcaggttctgctccggcttcgacgtgctcacggccaagctctggcagtgccgcacccgggcgctggccctggacccggccgccgaggtcaagctctgcttcttcgccagcgtccgccacctgctcaagctcgaccgggggtactacggcaactccatcttccccgtcaagatgtccgcgccggccgacaaggtgctggcctcctcgctcgtggaggtggtcgacatcatccgggaggccaaggacaggatggccgtcgagttctcccgcttcgctggggaggagacggaccaggacccgttccagatgaccttcaactacgagtccatctacgtctccgactggagcaagctcggcttctccgaggtcgactacggcttcggcccgcccatcttcgccggcccgctcgtcaacaacgacttcatcgcctccgtcgtcttcctcaaggcgccgctcccgctcgacggcaccaggatgctcgccagctgcgtcaccaaggaacactccgaggagttcgcccgtggcatgaaggaagacctgccctgaacttgttcttcctagcttattatatactgctgatgatcatcctgagccctggctgcagggagatgatgaatggtgacgtaaacatgcttctgtttcgttgatgctgttgttacttttggttgtattttttttggggttcactttatcttggtcaatacgtaccacattagatcacagcaagcaaattcgatcttaatttgtactacaccatttgatatgagaccgagacaataaaaaaggttatactgtccaaaaaaaaaaaaaaaaaaaagaaaacgaaaaaaaaaaaaccac

SEQ ID NO: 21051 - DNA, 1687 bp, Zea mays
actacaaccagtacacgacgcgctgtgcagcctgcaagctgcaaggcaagttccgtccagctcctcctccatttaagccgcccgcttgcccccccggcggcacggaacaaattcccgagacgccattctcaccatccacacaaagccacagcccaagagcagagtcgtcgtcgtcgtcgggcatggcggggttcaaggtgacgcggatctcggagggccccgtgaagccggcgtcggcgacgcccgaggagacgctgccgctggcttgggtggaccggtacccgacgcaccgtggcctggtggagtcgatgcacatcttccggtcgggcgcgggcgaggccccggccgtgatccgggcggcgctggccaaggcgctggccttcttctacccgctggcgggccgcatcgtggagggggagcagccggggcgccccgccatccgctgcaccgccgacggcgtctacttcgcggaggccgaggcggactgcagcctggaggacgtgcgcttcctggagcggcccctgctgctgcccaaggaggacctcgtgccttaccccggcgacgaccgctggcccgtcgagccgcacaacaccatcatgatgatgcagatcaccaagttcacctgcggcggcttcgtgatgggcctgcggttcaaccacgcgtcggcggacggcatgggcgcggcgcagttcatcaacgcggtgggggacatggcgcgggggctggcggagccgagggtgctgcccgtgtggcaccgggagaagttcccggacccgagcatcaagccaggcccgctcccggagctgcccgtgctggcgctggactacgtcgtgctcgacttccccacggcctacatcgacgggctcaagcgggagtacaaggcgcacagcggcaggttctgctccggcttcgacgtgctcacggccaagctctggcagtgccgcacccgggcgctggccctggacccggccgccgaggtcaagctctgcttcttcgccagcgtccgccacctgctcaagctcgaccgggggtactacggcaactccatcttccccgtcaagatgtccgcgccggccgacaaggtgctggcctcctcgctcgtggaggtggtcgacatcatccgggaggccaaggacaggatggccgtcgagttctcccgcttcgctggggaggagacggaccaggacccgttccagatgaccttcaactacgagtccatctacgtctccgactggagcaagctcggcttctccgaggtcgactacggcttcggcccgcccatcttcgccggcccgctcgtcaacaacgacttcatcgcctccgtcgtcttcctcaaggcgccgctcccgctcgacggcaccaggatgctcgccagctgcgtcaccaaggaacactccgaggagttcgcccgtggcatgaaggaagacctgccctgaacttgttcttcctagcttattatatactgctgatgatcatcctgagccctggctgcagggagatgatgaatggtgacgtaaacatgcttctgtttcgttgatgctgttgttacttttggttgtattttttttggggttcactttatcttggtcaatacgtaccacattagatcacagcaagcaaattcgatcttaatttgtactacaccatttgatatgagaccgagacaataaaaaaggttatactgtcc

SEQ ID NO: 21052 - DNA, 1663 bp, Zea mays
gcacgagaccattacctagaacatcctaatcgaaaaacccaacaaattcccgagacgccattctcaccatccacacaaagccacagcccaagagcactagagcagagtcgtcgtcgtcgtcgggcatggcggggttcaaggtgacgcggatctcggagggccccgtgaagccggcgtcggcgacgcccgaggagacgctgccgctggcttgggtggaccggtacccgacgcaccgtggcctggtggagtcgatgcacatcttccggtcgggcgcggccgaggccccggccgtgatccgggcggcgctggccaaggcgctggccttcttctacccgctggcggggcgcatcgtggagggggagcagccggggcgccccgccatccgctgcaccgccgacggcgtctacttcgcggaggccgaggcggactgcagcctggaggacgtgcgcttcctggagcggcccctgctgctgcccaaggaggacctcgtgccttaccccggcgacgaccgctggcccgtcgagccgcacaacaccatcatgatgatgcagatcaccaagttcacctgcggcggcttcgtgatgggcctgcggttcaaccacgcgtcggcggacggcatgggcgcggcgcagttcatcaacgcggtgggggacatggcgcgggggctggcggagccgagggtgctgcccgtgtggcaccgggagaagttcccggacccgagcatcaagccaggcccgctcccggagctgcccgtgctggcgctggactacgtcgtgctcgacttccccacggcctacatcgacgggctcaagcgggagtacaaggcgcacagcggcaggttctgctccggcttcgacgtgctcacggccaagctctggcagtgccgcacccgggcgctggccctggacccggccgccgaggtcaagctctgcttcttcgccagcgtccgccacctgctcaagctcgaccgggggtactacggcaactccatcttccccgtcaagatgtccgcgccggcagagaaggtgctggcctcctcgctcgtggaggtggtcgacatcatccgggaggccaaggacaggatggccgtcgagttctcccgcttcgctggggaggagacggaccaggacccgttccagatgaccttcaactacgagtccatctacgtctccgactggagcaagctcggcttctccgaggtcgactacggcttcggcccgcccatcttcgccggcccgctcgtcaacaacgacttcatcgcctccgtcgtcatcctcaaggcgccgctcccgctcgacggcaccaggatgctcgccagctgcgtcaccaaggaacactccgaggagttcgcccgtggcatgaaggaagacctgccctgaacttgttcttcctagcttattatatactgctgatgatcatcctgagtcctggctgcagggagatgatgaatggtgacgtaaacatgcatgcttctgtttcgttgacgacttgacgctgttgttacttttggttgtatttttttggggttcactttatcttggtcgatacgtaccacattagatcacagcaaccaaattcgatcttaatttgtaccatttgatatgagaccgagacaataaaaaaggttatactgtccaaaaaaaaaaaaaaaaaaagggcggcc

SEQ ID NO: 21053 - DNA, 1455 bp, Zea mays
cggccgcccttttttttttgccgctgaagcagccgggtgtttttttttcattatagtgttctaagttttattcgttgcatagctgatatgagatgttatttataacatcggaatacacggcatgtgtgctgtttgtagtttgtaatactgcaccattctctctagcgttgctgctgtttgaactatgtacaaagcaatgggggtgatgttggaacgcagctgctacttctgtgccaatgcgaagctgggagcgggctccaagtccttcaccacattcttcaccgcgttgaggtcgatgtcgatcaggttccccgtcgccgaagatatgacggtgcagctgctcttgccctccacgtatggcaggaacagccttgccttctctgccgacgagaacaacgccacacatggcttgtcgcgggcgttggcgagctgcacggcagcggtattggtcgcgacgacgccggcagagtcgttgatgaggcaggtgagctggcctggggtggtgatgaacaggatgcttgtgtcgtcccccacctcctcctcgatttcatctctgtgcttctcatgagggatcacgaacagaggcttgagccccctgtcgccggagctgatttccttggctatctgagcccagtgcccgaggggaagaaggcagtcgtcgtcgcctctggacttcatgttggcgacggagtcagaggcgatgccgtggatgacgacgtacttgcccttctccacgccggcgcggctatacttgtcctccacgtacgcccgtagcttcttggagatggacacccgcagcggctgtgtcggctgctggggaacgttcttcgccggccggccgatccactccagcatgtctttatacatgtggtacccgccgtcggcgaggttgttagtcggcgccttgaacatctcgttgaggaagaggcccgcgccgacgctgttgacgttggggtaaacgtagccgaccttgtcgcgcgccgacgacatgaaaaggaagagcgcgtgcccgatccccgccagcctcgtggagatgatcagatcatagtacctattctttaggacgccgagcatgtgcgtgtattcggcgggctccggccagtcgtcgtcggggtcatagacgttagcgtacctgacgttcttgcacatctcgtacacctgcttgcccctggccgacgccaccacgtccaccagcacgccggggtaccggtccttgagcatctgcacgacggggaagaaaagcacgttttcgtacacgccgcccgacacgacgcagcacgcgcgccgcacgtcgccgcggaccttggaggcgaggctgtccagctccgggttgtagccctgcgggaacctcaggaacccgtacgggttctcagggtcctcgggcggcccccgggctcccgcttgcttcccgccggagaccatcctctgaacccggccgcctcgagcgccgcacag

SEQ ID NO: 21054 - DNA, 1632 bp, Zea mays
cggtacccctgtgcagccgcagatttcctgcagcccaaacgtagatttcctgtgctgccttgcaagtgcagacgtagatttctttgcatgtgtggtccatacaagtgaattcctttttttcttagaatttgattgacaatgaaatcactcgctagtactgacgaatactagaaggaaattgtgagttacaattgtgtctagctcttcctgtcttgttcatgtggttcttgttttaatgtattggtgtacattataactgcattattacactcatgcattgcagtggtaaaataaggcgtacatgtaacaataagacatgacggtagtaacagtattgtaaggcaaaagcacacagataactattgtagtttccattattttatattttaattatgaggagaaaaacctacttctctttagttaacagtgataccataggctcatagcacatatgcttcttagttcttcatcacattcttcatccaagtactacttaacaactaccacacaattcttaaagttaaagcacgaagaatagataggctatgatttcttacctactgaaggcatcaagtaacttcccttgcatattggggcgatggacgcttatttaaatttgaatacatagccacggaaggaaggctcagtttaacttctagagtggttagtttcattgagttcaacattacagatctagtctttgagaagtccaaacagtgaatacaatacacaatacgcgtcagctgattacagaagagggaagagagtaaatactcacataaatgtactgattgtgattgacccataaataagagtacaaaataatgcaaataagcagggatagcaggtatcagtaaaaatattgatgctaactgtatgcttctgcttctggttttattctttccaatagcttttctgctgcgataaacccccctaaaggtcccagaggggtatattttacttgcctccaactggggataaatggcagtgccaggcaatgaagatgaaggtgatcaatactattaaatgggggctgatggaacccaaacctgtgttcctcagaatttggagcatcttgattgaggaagtctttccccaccttcaccatgtggctcactaactggtgatcatctttggttttgcggaggctatttacagttggtatatgatcaatgggtatgacaagatagtgcctgaacgccgacgggttgatgtcgcggaacgccacgaccttatcatcggagtagaggagagcggtggtggaggcgggggcgccgcggacgatctcgcagaacacgcacccgtcgaccatcggcgcccgttccgacatcttcctggccacacgtctgcccccgaagcagaaagtcttcctcatggcgtcccccctcccccgcgtgttggtaggggagtaggtgggagtaggatgccgaccgacgcggggggccctgccgctattcaacaacgacgctctcggacgcggcggccggcttggggtccgggatgccgccgtcgtgtcggctgtcggagtcgaaggcgagttccggccttccgggatgccgccgtgtgtgtgatttccacagcccaggaactgcaggcagttaaggcccactgaatgctatgtgttcattggtt

SEQ ID NO: 21055 - DNA, 916 bp, Zea mays
tttttttttttttttttcgacgagaaattcgagagggacttgtttaggcctctcgcttgtttcataccgtatcgacagggtttacacggcgatcagcacgcacaccatttcactcgtgcaaccgtgcaaaaactcacgcacaaaccaacccctccgtctccatctttcggagatcaggaggagggaggccattcggtttcgtcaacaaacgaaggtaaaaagacgcagcagccggttggatgggctctctgccctgccctgccggcctgtgccgtggcgcgtggccttcctcctcctgcgtcgagccggcggtgatccacgggcgtttgtttccacacgcagcgcgtcgcccttgcttggggggttcttcttgaggtgcagctaaatcctactacgttcgttcgttcgttttcccggcgcccaaaatttttctcatcctaccacgcccagatggggatcctctgggggctctgcttctgctgccgctgccgctgctgctcggcccgccccgtctgcttcagccgctgctccctcgcctcgtcgatctcgatctgctcctgccggcactcctcgctgcagaacggcaggtcacctctgtacatgaagatgtctctgttgccggacaggagtttacggcaccggaagcagatgtcgaggtagtggtggcggccgtggagctcgtcgccgtcgtcgcaggggtcgcagaacatgcggccgggccgcctcggcgaggccgcgggcttcagaggggaggaggagtggccggagaagccagcctcgaggtcttggtaagtgtccgcggacacggggtggtagtgcgccatttccttggcttggctatgcgccgaattggtgctcctgctttctcttttccggctgtggaaggaagtggggtccgcccgccccgagcctcccg

SEQ ID NO: 21056 - DNA, 924 bp, Zea mays
  misc_feature (913)..(913): n is a, c, g, or t
gacgagaaattcgagagggacttgtttaggcctctcgcttgtttcataccgtatcgacagggtttacacggcgatagatcccagccagacgcagcacgtacgcacaccatttcactcgtgcaaccgtgcaaaaactcacgcacaaaccaacccccctccatctccatctttcggagatcaggaggagagaggtcattcggtttcgtcaaccaacgaaggtaaaaagacgcagccggttggatgccctgccctgcccggcctgtgccgtggcgcgtggccttcttcctgcgtcgagccggcggtgatccacggccgtttgtttccacacgcagcaagtcgcccttgcttggggggttcttcttgaggtgcagctaaatcctactacgttcgttcgttttcccggcgcccaaaatttttctcatcctaccacgcccagatggggatcctctgggggctctgcttctgctgccgctgccgctgctgctcggcccgccccgtctgcttcagccgctgctctcgcgcctcgtcgatctcgatctgctcctgccggcactcctcgctgcagaacggcaggtcacctctgtacatgaagatgtctctgttgccggacaggagtttacggcagcggaagcagatgtcgaggtagtggtggcggccgtggagctcgtcgccgtcgtcgcaggggtcgcagaacatgcggccgggccgcctcggcgaggccgcgggcttcagaggggaggaggagtggccggagaagccggcctcgaggtcttggtaagtgtccgcggacacggggtggtagtgcgccatttccttggcttggctatgtgtttcctcgccgaattggtgctcctgctttctcttttccggttgtggaaggaagtggggttttgtttttttttttttttttttncccggccgagc

SEQ ID NO: 21057 - DNA, 760 bp, Zea mays
cccccccctccatctccatctttcggagatcaggaggagagaggtcattcggtttcgtcaaccaacgaaggtaaaaagacgcagccggttggatgccctgccctgcccggcctgtgccgtggcgcgtggccttcttcctgcgtcgagccggcggtgatccacggccgtttgtttccacacgcagcaagtcgcccttgcttgggggggttcttcttgaggtgcagctaaatcctactacgttcgttcgttttcccggcgcccaaaatttttctcatcctaccacgcccagatggggatcctctgggggctctgcttctgctgccgctgccgctgctgctcggcccgccccgtctgcttcagccgctgctctcgcgcctcgtcgatctcgatctgctcctgccggcactcctcgctgcagaacggcaggtcacctctgtacatgaagatgtctctgttgccggacaggagtttacggcagcggaagcagatgtcgaggtagtggtggcggccgtggagctcgtcgccgtcgtcgcaggggtcgcagaacatgcggccgggccgcctcggcgaggccgcgggcttcagaggggaggaggagtggccggagaagccagcctcgaggtcttggtaagtgtccgcggacacggggtggtagtgcgccatttccttggcttggctatgcgccgaattggtgctcctgctttctcttttccggctgtggaaggaagtgggtcccggccgcgccagcgtcgcggtcccc

SEQ ID NO: 21058 - DNA, 1914 bp, Zea mays
gcacgagaccattacctagaacatcctaatcgaaaaattttcctttccctccctcagcccgcgcctgtgcccatatctctctgactgtcatggcgacgcggcggcgcctctctccgactttcttcggcgggctccgggcccgtgagctcggcggcgccagtgtctcctcccgcgccacggcggggctcccgtatctcgctgacctctcctccgaccccggcggccgcggcggcggggtcatagccgtcgagcactccggtgaccccgccatccccttcgccatctccttcggcaagactgcacaaacctgtaacctcctggcggtcgccgacgaagacgggtacgttggcctctacgacacccgccggcgcctcccttccgcctcctcgtcactagagaagtcagctgaaacgagggtgtgcgactgggttgctcacaacaatgcagtctttgacgtgtgctggatcaaggagggatcccaaatactgactgcatccggcgatcaaactgtcaaaatatggagtgtaggtaacaggaaatgcattggtgtcttgtcagggcatactgggagcgtgaagtcgctgtcttgtcattcttccaatcctgagctcattgtttccggttcaagggatggttcatttgctctttgggatttaagatgtgaccctaaatctccaaacagccatggtgaaacgtgtctcacgtcttctgctgttgtcagagaagcccacagtcccatactaaggagccgaacacggtctcgagcaaaggcggcttcaacaagtatcacatcagttctttatctgaaagatggtgtctccattgctacttctggagctgcagacaatgttgtgaaaatatgggatacacgaaacctgaaagtgccgttctccaacaaaaactctcaagcaggggcccaacctttggagggggtgaaacatggcatctcttgcctgtctcaagattcgtatggtgcatacattgctgcgtcatgtatggataacagaatctacttgtacagtgtgcttcatgtgaacaaaggtcccataaaggtttacactggcagtaaaatagagtctttctttgttaagtctgctatcagtcctgatggaactcacatccttggtggatcaagtgacggaagtgtatacttgtggcaggtggatcaacctgaaagtgctcctatagttctgaaaggccatgaaggtgaagcaacatcggttgactggtgtgcatcagaggttggaaagatagcaacatcttctgatgattccacggtacgtgtgtggagtaccatgaaaatggactgtacaaatgtaagctcgccaacagtgatccgtaagcggataacagcaccaagcaccgagtaccgaaggtccattacccatgagcctgctactacatcaagagacggagttgtctgcactagcggtgatggcgaattgcaaagcggttgccactctccccttcaacctagagcactgcacttcggcactcctgaatcttcaaagaagagggccttggcattgttcgaggaggaggcacttgattcaaggaagagcccggaagcacagacgaacagcccctcttctgttctgagcccgccgccgtcgttgaaacggagaacgattcgagactattttgccagtgccgcatcttgaatcctgactgacaaatagctggtccccataatttttagtggtcctgacccatgagtactacggctctccttaactaatggtgaaacagctgcaatttttgggaaatccttctagctctagttcaaggtcatcgatcttttggaaatgcggctgtacataatttatcattacagaattgggagaaactattatgtaattaaatttctccgaaaaaaaaaaaaaaaataagtttcaaaaaaaaaaaaaaaaaaaa

SEQ ID NO: 21059 - DNA, 3026 bp, Zea mays
  misc_feature (4)..(19): n is a, c, g, or t
  misc_feature (1108)..(1110): n is a, c, g, or t
cggnnnnnnnnnnnnnnnnttttttttttgaatctccaaaaagttaaaatgctctataatttaaacagggggagtacataaacatcctaattcatttccacattagtcacccgtctacttttagactcaagagaagacaatttttttagaattgagggtagctttaagacaaaaccgaactgtatttccactttcacagcaaccagtcaaaatttcggttgcgaactacctgccgaaccacaactctgtagagtaccctatcacttgtatgcatgtcacagtcacaccatctttacagcaacgagttattctaccggggtctctgactaggggcaccaaaaacgcctgtactgccttctgattaaccaggcacagccatcaagtaactgagaggttggtagttttcttcctgaaataataggccacccatctagatactcgggctgtttccacctactgccgtgattgctcttcgtcgtcgttgtgttcctctgtttgcgatgctagcctcacgatatcttccacgaggatctttccttctgtgtccttcgaaaggttggtgatgagctcttgcacgccttccttcccgatggtgtccttcagataggcagcagctgcggccacctcctcaggagtcaccttgccatcgtggtccctatcaagcagctgccaacggtttccaatttgtgcatccacatcatcaatctccttttctaattcttgaagcatagcatcaaccttctcaatcaacgccgacgagaccttttcttctgcagcagcctcagcatcattgtctgggtcttccctagcggctatatatgcttttttagctgcttcttcaccttcagtaccctcttttttgagcatggagttatatagctctatctctttattgacgaggctcagaaactcttgacgctccttgctaacagaagatgcagatgcgagcacagccaaggcacggctgatattacagagcttctctttgtcatgttcttctgcttttctcagttcttccctagcagtagcatcagtcatttccttcaaagctaaatcttcttcagcagtttctggttccttctgccgaattccttctttctcgagccgnnnttttttttttttttttttttttttctcttcctccttgataagttcttcctgcatctcaaggaattctaattttctcctcctttcagaaactgaatcttcagatggcaatactgtcccaattgtatccacaacttcgtctggtaaagaagatagtgttgctacaacagcctcctctggcttcattctcccagacacagtaaaggctcttgaaagtatgagaagtgaagatggcacagcatgattaagtgataggtccaaccagtctcggagctgctggcacatctcttcagttgacagcaggcctagatgaccacgttcccggcaggcttgccggagctcttcttcagagagagattcaactccctcagcttgaatcagtttatcatcattcttaatgtcctgaagttttttgcgaagcatgaacctcatgtagtgatctgtaccaaaaggccggatacccatatatttgcacatatttaccaagcgtggtctgttcatgttatccagagtaagttcatcattgaatagctttgcaaaattcaagatttcatcattagagacacgtccacctctcctaaccttattcaaaaattcgtccagatcttcagctgtttgttttgtttctccgctacgagatgtttgaacttcctttgccatttcttttgcggtatcttgcaaaaattttgcatactccatccttgctttcaatttcctttttaatgcttcctcttccttcattttgtcctggaaagttgatggaagcatgtttggaaataacttgaggaagactggcagtaagaattccatgaatggaacaatgatgaacacagcaaacggaaccagcctgaagatatctgctgttgtgcgtgtcagctgttgcctctctcttcttgaaaggctcttccccccagcaagtttcaccagcaatcttgatgagatcctaacatctgcccagagtagttttgtccctaaccagtaatgctgcagtgtacaaacgaattcatccttccaatgcttaagttttgctgcccaatcagccctgctcattgaagcaacagcacgaagagcagggcccacacccaggactcttgcccaaaatttctgtataattgattggccaaccttcagagattcttgtacctgtttagctttagccttagcttttgcagtgctgaggccttccacagcctgatcacattcttctggggatgcctcctttttccttttatttcgctcgcggtcctcgctctgttcatcatctgtatccatcttaggctgccttgctgttgcagttgatgctgtgcggaccgactgcagcaaagatctagctcccaggctcagaggcaatctaaattcattccttccaaatccaccatgagaaagagaaatcacataagatggacgttgccaaaacccattaccaagacctagtagatccttttttatcaaattcatattgtgttgctccttctcgcatttggaatccccagaactatgctcgagaaatcgctgttctgttcttggctcaacctccaaaccgagtcttccatgttggaatgtaaagaaagcagacgatgaaatggtaggtgtgttaacatgatccaagaaatacttccttctcctaatgattgccattgaagccatacttgattgcgtctgaattcacaataggaagatcacactcatgtagaaatctggtggatgctcgtcgctgttgaaggtcgacctgggcacctggcctaggcggcggcggcggcctacggtcgcccacccacccgtcgacacgagagagagagagagagcgcacggcacgggggtggcggcggtcgcccactcgacgccacggcccgagagagagagagagagagagcacgcgggatgaatgtgagcgaagaaagggcgcacgccccggccgg

SEQ ID NO: 21060 - DNA, 1964 bp, Zea mays
gacaagggtagccacggctaattgatgagacacgtttcacagctagaatgtacatatcagggattgaaatgaaataatcgtgaacttaatttgtagtatccctgaaaatatacaagatagttcgtgcctctgatctatgcaccagcggtcagcggatatcaacatacacttgtcgtgtcaaccacagaaaccaatgttgaaggagatgaccgaggtctcaggcagatccaaactcagccatccacttctcgtgcttttctatgtctgcaggcgagacactcttctggaccttcaccagagcctccacaaagtcgcacatggccactgggtccttggctatatcgtcctttgacatgttcttgatctcgtcgcgggttttgcctgctatcttgcgccgcataccgttcattgaagcatcacggcaaacatttgtcaagtcatctccactatagccttctgtcctccgagcaacctcatcgatgttaacatccgcagctatctgaactgttctaagattaatgttgataagtgcctttctgctttcgaaatctggaagtgggatataaatacgcttctccagcctccgcctcagtgcctcatcaatatcccatggaaaatttgttgcagctagaaccataacaatttttggctgaccatcttcagtggtggagctattgtttacaccatcaatttgcactagaagttcagacttcacccttcttgacgactcatgttcaccagatgctccacgtgatgtgcataaggagtcaatttcatcaatgaaaattgtacttggagcataggccctcgcaagatcaaataaacaacgaaccatgcgctcactttcgccgcgccatttagaggccaatgttgcagaggaaacattgaagaatgttgttccacattctgtagccactgcctttgccaaaagagtctttcccgtgcctggtggaccaaacataagaactcctttccaaggtcgacgaataccctgaaaatattcaggcatccagagaggaagcacaactgcttcctcgaggagtcgtttggcctcactaagtccggcaacatcatcccatcttactcctggagtagaatccagaacatccctttcaagcattgcagctaagtccatatctggcccttcatattgacccttcttggacttaccttcctcagcatcactactcgctgaatcagccttgcttgaacttggttttcctttccttacagaactgttagaggcagttgatgatttaaccacagagcctcctttactcccattaggttttgagcttcggctaggtgttccagtccttgatgaaccacgtgcccaggctccatcttgggaggattttcttgcactagattgacctcttgttggtcttcgggtcggtgtatcccttggtggagcccacacatcaggatcatcaaaaggagctggtgaagatgttggatactcgtccaacggttggaaaacaaatgatttattggagcgaataggaggtgatgaggaccgcctcgtcccaggagcttctttaagggactttaattgagcatccaactgtttcacactttccacttcttcagagattgctttcttgcagttcatccatttcgtacgaaccaaagcatcgtccaaagtagttagatgcttgttgatctgagcaatggcgccgtcgaagaagattatggaggtgtcgtataggccctcgagcgcgtaatcccgcgcaagcttgatgtggtcctgcagccccgcgaggggattcgccatttccgccgccgccgcgaagatccggcgatagggttcccgaatcccgacaaaatgcgtggtgtgggaagagacgagcaggagcagttcgccagttcgatggagagaacgcgagggaggccgagagctgtagtaggagaggggtggggggttcccgcgaaaatcgaaattttggggacgaaaatccggccgg

SEQ ID NO: 21061 - DNA, 2169 bp, Zea mays
tttgtgtttggttgtggtttgtttctcgctaaaactttggttcctgtgatattccttcaaccaaacacggagcatctggaaatagaggcggccacggctacttgatgagatacgtttgacagcagaaagtgcatataccaagaactgaaacgatcgtgaactcaattcctagcatcactggaaacagacaagatagctcgtgcctctggtctatatgaagcaagaccaccggcgggtaacaccgtatcattgctacggaatgccgtgtcaacccacacaaaacgaatgtttgaacaggacccaagcagatggccgaggtctcaggcagacccaaactcagccatccacttctcatgcttctctatgtctgaaggcgagacactcttctgaaccttcaccagagcctccacaaagtcgcacatggccaccgggtccttggctatctcgtcctttgacatgttcttgatctcgtcgcgggtcttgcctgctatcttgcgcctcatgccattcattgaggcatcgcggcaaacgtttgtcagatcatctccactatagccttctgtcctccgagcaacctcgtcgatgttaacatctgcggctatctgaactgttctaagattaatgttgataagtgcctttctactttcaaaatctggaagtggaatataaatacgcttctccagcctccgcctcagtgcctcatcaatatcccatggaaaatttgtagcagccagaaccataacaatttttggctggccatcttcagtggtggagctattgtttacaccatcaatttgcactagaagttcagacttcacccttcttgacgactcatgctcgccggaggcaccgcgcgacgtgcataaggagtcaatttcatcaatgaaaattgtacttggagcataggccctcgcaagatcaaataaacaacggaccatgcgctcactctcgccacgccatttagaggccagtgttgcagaggaaacattaaagaatgttgttccacattcggtggccactgcctttgccaaaagagtctttcccgtgcctggtggaccaaacataagaactcctttccaaggtcgacgaataccctgaaaatattcaggcatccagagaggaagcacaactgcttcctcgaggagtcgtttggcctcactaagtccggcaacatcatcccatcttactcctggagtagaatccagaacatccctttcaagcattgcagctaagtccatatctggcccttcatactgacccttcttggacttaccttcctcagcatcactactcgttgaatcagccttgtttgaactttgtttccctttccttacagaactgttagaggcagttgatttaacagcacctcctttaatcccattaggttttgcgcttcgactaggtgttccagtccttgatgaaccacgtgcccaggctccatcttgggaggacttccttgcactagattgacctcttgttggtcttcgggttggtgtatcccttggtggagcccacacatcaggatcatcaaagggtgctggtgaagatgttggatactcatccaacggttggaaaacaaatgatttattagaccgaataggaggtgatgatgaccgccttgtcccaggagcttctttaagggactttaattgagcatccaactgtttcacaatttccacttcttcagagattgctttcttgcagttcatccatttcgtacgaatcagagcatcgtccaaagtagttagatgcttgttgatctgggcgatggcgccgtcgaagaagatgatggaggtgtcgtagaggccctcgagcgcgtagtcccgcgcgagcttgaggtggtcctgcagccccgctaggggattcgccatttccgccgctgccgcggagatccggcgctagggttcccgaatcccgacgaattgcgcggtgtgggaggagacgagcaggagcagctctcgatggagaggacgcgagggaagtagagagctgtcgtaggttcgtacacgtgcagtgtcgcttcgtttggtttggtttcgaaactcgaaattttggggacgagaaattgggctgggtggtggtggacgggtggctgatgacgaggctcggcgctggcgaaacctttcgtcccggccccgccggccccggccggcctcgaggtacccaatg

SEQ ID NO: 21062 - DNA, 884 bp, Zea mays
tcttgcatgcctgcagttacgttcaatcttttttttttttttttagccacggctaattgatgagacacgtttcacagctagaatgtacatatcagggattgaaatgaaataatcgtgaacttaattcgtagtatccctgaaaatatacaagatagttcgtgcctctgatctatgcaccagcggtcagcggatatcaacatacacttgtcgtgtcaaccacagaaaccaatgttgaaggagatgaccgaggtctcaggcagatccaaactcagccatccacttctcgtgcttttctatgtctgcaggcgagacactcttctggaccttcaccagagcctccacaaagtcgcacatggccactgggtccttggctatatcgtcctttgacatgttcttgatctcgtcgcgggttttgcctgctatcttgcgccgcataccgttcattgaagcatcacggcaaacatttgtcaagtcatctccactatagccttctgtcctccgagcaacctcatcgatgttaacatccgcagctatctgaactgttctaagattaatgttgataagtgcctttctgctttcgaaatctggaagtgggatataaattcgcttctccagcctccgcctgggcaatttagaagtcaacataatgcacattaatgtgaacaatagtaagttactaacatattccctctattcaaattgtagttccttatgctttctcctacgttagacttctctaactttgacccttctctaactttgaccaaagttttagaaaaatatattaacatctataagttcgaatagatgcactattaagaaatatttaatggagaatttaagaaaatagattgatattgcacccggcagaacccggagggtac

SEQ ID NO: 21063 - DNA, 1632 bp, Zea mays
ttttttttttttttgtttttttttttttttttttttgaccaatcctcaacctcgttttgtttatagaaaacaaaccccaacccaatcggtctcaggccagccatatgagccacccttgtcagggaaacaacacaggcccataagagccacagccaccacatctccacaccactacatcgtgcagcatttaggcatgtagcctccaacaacaggctaacttacaacagcaccccggtctgatataaacgtttacgtaactttcatatatataacacaaaagtggcccagccgttgtcgtatacttttcctgactgcgtacaaccacaaccgtttcacaagcgaaatgcacaagttgcctcagcgacaaagatttggtccaaagcaaaggaaggactgccaaaggagtagcttcttgccaaatcattcgtcaatatcttggacccattgcaaaccttcgagtacagactccactgcagaatttggaatgataagcccaacaaaccgtttgttctcagtcgtggtctccaagcggaccacacgtattctcctgtgaatctgccgtgcctgcttagccagtgcctttgctactgcaccccatacaggaagtattagaccacccaatatattaatctcctgcaaccttctacccactgtgcaattgcttccgagtttgcattttggcccgtgcatacactgcttggatgaagagtcgtactcttcttgccagcctttactaattttgtcaacagatgagaccttcctgtacttgcttttaagctcaaccaaagacatttccctcgaagcctccccaacagctggccgaattactatgtacaatccttcagctgaaccttcgaaagctagcagaaagtgtcttctccccgcccattcttttctggactcatagaatccatcactagaagaacctgctttatctttcagcctttcttcaagtattgaatttgctaactcccaagaaactccacggtcaactgtaaaagtatataatattgtactagcaccggacacagtatcaacatgaacagtctttggtgattctttcatttcgacacttttagctttgatatcaacaataccagaatcaagttgtccttcaattcgtgcattctgaatgactatatcaagtatgcttgtgaaaaggtcaaataatctattctgaatgtctggaaacaatcccagaatacgattaaggaaacgggcaacatcatgcatatcagaatcaataatcctaccagtaagctttccaccatttttaccattgcacattatagggtccctaataattccaactgacactaaagcagcttttgctttagtgatgaactcttcaagggtagcttgattctcagagcattcgaaaggcacaacaggaaaggcatcctgttccattattcctctgtacatcattgtcagggctttctttccataattactgtcatagttgaaggcgctaagtgatggtccagcccttcgatctccttgcgttaaagctccaagactccagtctctttgccacgattgatgcaaatcgcttttcaccaccaaggtttgtgaaaagaagcctatattcaggtgcagaagtttgattagaacgatgggcggacgcgtggg

SEQ ID NO: 21064 - DNA, 1298 bp, Zea mays
ttttttttttctttttgcacggtaaccagattcgtttgtacagcctaccaaacaatgaccaatcctcaacctcgttttgtttatagaaaacaaaccccaatccaatcggtctctggccagccatatgagccacccttgtcagggaaataacacaggcccgtaagagccactacagcgtgcagcatttaggcatgtagcctccaacaacaggctaacttacaacagcaccccgatctgatataaacttttacataactttcatatatataacacaaaagtggcccagccgttgtcgtatacttttcctgactgcgtacaaccacaaccgtttcacaagcgaaatgcacaagttgcctcagcgacaaagatttggtccaaagcaacggaaggactgccaaaggagtagcttcttgccaaatcattcgtcaatatcttggacccattgcaaaccttcgagtacagactccactgcagaatttggaatgataagcccaacaaaccgtttgttctcagtcgtggtctccaagcggaccacacgtattctcctgtgaatctgccgtgcctgcttagccagtgcctttgctactgcaccccatacaggaagtattagaccacccaatatattaatctcctgcaaccttctacccactgtgcaattgcttccgagtttgcattttggcccgtgcatacactgcttggatgaagagtcgtactcttcttgccagcctttactaattttgtcaacagatgagaccttcctgtacttgcttttaagctcaaccaaagacatttccctcgaagcctccccaacagctggccgaattactatgtacaatccttcagctgaaccttcgaaagctagcagaaagtgtcttctccccgcccattcttttctggactcatagaatccatcactagaagaacctgctttatctttcagcctttcttcaagtattgaatgtgcgaactcccaagaaactccgcggtcaactgtaaaagtatataatattgtactagcaccagacacagtatcaacatgaacagtctttggtgattctttcatttcgacacttttagctttgatatcgacaataccagattcaagttgtctttcaattcgtgcattctgaatgactatatcaagtatgcttgtgaaaaggtcaaatgatctattatgaatgtctgaaagcaatcccagaataagattaagcaaacggcccacatcatgcacatcagaatcgatgatcttaccagtgagctagtcaccatattcaccattgcacattatagggtcccta

SEQ ID NO: 21065 - DNA, 1590 bp, Zea mays
tttttttttttttactttgttttgtttttagtgtgttaagcttacgatatatatcagttctcacacttcaaacgcatacagccaatattacttcatccgagcttcccctgcaagatccattattacaacaagtatgcaaggaccagtgcactgccaaccctaacatgctatttcatctcagcttccaggtagttggaccttagtgttgtcgactccaatgatggggtacgatcgtatatgcagcatttgagtcgaacttgaggtcctgagtctacttatcttaataggtactacctcgattttttttatttgacactgcttagttcaaaatccaactgtacagcatcaaatattaacgaacgtccatgcataattattctgttgagccatggcagacattagaagacgtcaggcgggaaacgtccatgcatagaattgccctgctgagcctgcttcaaatgcactctaagtgcgtaattatttatctcaagagtttttatctgctcctgatattgcagtaccaactgtttaaggctgtcgacttcctgagtcctcacatcaaactctttttggcgttcgtgttgtatcgcaacgccccgcttcagaacagcattctctcggagaattattgcaagttgctcctttagcatcacattttccctatgcaaattctgcactgcttcaggtccaactcgatccatgatggacttttcaaacacctccaaagccctggatgcacgagctcgcgcatcatctatgtcagaggagctcatcatctctttgacaaataggtcaacccattcagagctatgatgacttgtctgagagttatcaattgcaggtggattttcagtagctatgtctaaatggccattactggtggtaccttcagccaataagttatgagctgatgatatgtccttctcagattcacaaacagtggcagataggatagccccagctgactccagtcgcagctcgtttaatctctttattgcagagtccaagtcatctccagaggcctcaagagctttttcaagtaactggggatccatgtcggggaagagggtgaggaggtggtggagtagaccctccctccagcgggacggggagcagcgggccctcttggcggggtgatggtggtgggaaggggacggaggggaggaaggggaaggtacaagctcgtcgccgaagatggaggaggacctcttgccgcacactacagcagacatggtggcccccgctccgaccgacgcctcgccgcgccgccgccaatccgttcgtggccgccgaccgcgctactcgccccctccggcgccggacaccatctggccctccggggtccggtcggtgcgccccacctcacgcggtgatccacggcgggatggagctcgagtctgggctcggaggaggcgcgcccggggtgcccgtggacagcgactggaggcggcgctggtccggagatggggaatagcttggttggttggatttgtcttgggtttgattgcgttgcggtgctaggcttgcttttgggctgtgtgggatcacgccaaatttttatggacgttgcgatgttgcgtcttttggtgt

SEQ ID NO: 21066 - DNA, 1110 bp, Zea mays
aaatagtgaggagtgagaaaataatggactagctcatttctcgaaccaaacaccctataaaagaatgcaccgaaaatttctcatttttcagcatcatcaaaaatcagctccaaaaaggttaaattaatctgcagaatacaatgaactcatacaggcatttactcagctagtgaaaatgttttggtgatgtctctctcggacacggcaccataaaaacatatcttcatgttcccttctcggatctttggatctaggtaacctttgtacaggtcccagaactcattgctgacttgtggtaatgtaaacaaggtgaaggactttgcatccttctgcatgtcaagtaccactagtttcaagcgtgacaaggacaaagcttccatgtcaattagtttcttgatcctgctcggtgtaccacaggcaatatttactcgagcattaagcatcgccacctgctcctccactttcaagtgtttggcaaagagctttactggtcggcattctttagtaaacatcttcaaacccctcagtaggtctaaagatcgcaaagcagatgagctgataaccagaagtgttgggctgcccacggcgatctcaccatcgatgtgatttccctcacagagctcttccttccacgaagagccgaacaccccttttacatgatcaccgaagctctcgacgtcctgggctgctccctccgcgagctgcaccatgcagccctctgagtaggaatcgagttcgagaggagagaggcgcatcttagaggcgcgctcgaagctacggaggagaaactcgagctgccgcgacggctgcatcaatgccgacagtaggaccgttgcccctgcgacgccatctccgatggtggcggcgatttggtccggctcggcgggttttagccgcgacttcttctccttttgcttatgcttctctttcttcttcttcgcgtatgcccgtttgggatccgcggatttcttcgcgatgattttggatggcccgtgcggtttcttgcgcttgcggccggcggccgctgcggtcggttccggcgccggtgccattttgggggttccggtgtgttggcttttgattaggatgttctaggtaatggtctcgtgc

SEQ ID NO: 21067 - DNA, 4381 bp, Zea mays
ccctttgccagttcgaggaccgctgatgtatttaccccttctattctacgttaaaaaaccaaacaactttagggcctgtttggttggactatgacaatgaaaaagctgttgtgaaatgtgagccataaaaaaataatataaaaatcgtttagtgaaatccagtaaaagttattttatatatttgtaaagttcttttatccgagaaccactaaaagcaggtccaaagacgctttcaattttacaccacgagaaagccatcttttaaaaagttgccagttggactaggtcatttggtttagcttttggcttttgaggaataaaagccacattaaaaagtcaaaccaaacacactgtcattctcttagagctcaacttgtgacaatttcacgataatatccactctgttgaaaccacatcttgtttctctaagaagtaatatttttaaattacatcaactagataaaaaataataagtataatgtatactaagtttagttagattaatcttggcatacatttcataatgtttttatttaaagatgagagtattaatactattttctttagagctcactaaacttaaataaatttaacccatacaagaattgttttttaagtggggagggaatatgccatccaaattccacgagggcactgcattttttttaaaaaaagaaaaccatttgttctgaaagaaaaaaaagaggaccaaacaggaggccatcctggtcatttccgttctctgtccaaaagccagcgcaggcccggacaaaagcaaacaaaaactaataaagcggggctggcgggcgcgcgcgcgcgcagccagaggcacacctcccaagccacgtcaccgatccgcgtgctcccccgtccagcaccgcccgatcccgccggcccgagagatccacgccgtccgggcccgcgtccccatctgatcccatcccttctcactctcctcgcgcacacatacactgtcttgctagacacacccgaaaaacaaagggaaaaaatagtaaagaaacggagcgaggctcctcctcgtttcctatctatcctgatccaaatccgccctactcgcttcatatatcctcctgcgaggaaaacaattcattccgcgccgcatctgggaaggtctcgtcttgctcgcctccgtccgtcgccgcaccctgcgtcgtcgccatggccaccgacgaagccaccaagccgtccccgatcccaccctatcccgaggtgagacgctctgtccggcgtacgtttcctccgcggtttctttttttctgttttcgccccccatgttccggtgctgttcttgccggggattcgttccggtggtgggatgtagtagctggcttctggacgctgccgcgctcgatgcgtgttcctcggtggtttctttcgtcactggtgggccaaaaaagaaaagaaagaaagaaagaaaggagactttttcggttgtcgttgggggtgcgaaatggagtgagctaacgggcggtgtggcgtgtttgttgggcgttccggcagatgatcctggcggcgatcgagggtctagacgacaagagcgggtcgaacaagtccgccatctccaagtacatcgagggcaagtacggctcgctgccccccgcgcacgcgtcgctgctgaccgcgcacctggcgcgcatgaaggagtccggagagctcgtcttcctcaagaacaactacttccgcgcgggcgcccccgacgcgccgccgaagcgcgggcgcgggcgccctcccaaggcgcgggacccgaacgcgccggcgccggcgcccaagtcgccgtcgtccacggggcgcggccgcgggcgcccgcccaaggccaagagcccgctggaagccgccgtgaagcaggccaccgcggggatgcccaagccccgcggccgcccgcccaagaaggccaagaccgacggcgccgcgtccccgtccccgtcccctgcccctgcccctgctggcgacgggtccacccccggcaagcgcggccgcggcaggccccccaaggtacgccccgccgtgcccagcgagacggccgcggcttgaccccgcttcttggggataatagttcgtcccgccgcgagatgggatggttagggcgtagcaattcgtcccgctgcagctgcggctgcagctgccgtgttaatgttggtaggcttggtctccatgcttcatctaattgttgtcgtcgtcggcgtcgtcgttgctcaattaattaatggagtaattaggaggattcgatgtgctgtcttctgtgctgtgttgtgttcagttcagtttcaccgtgtgtctctggtgttatgtgctggatctgttgtaagctaagctagggagcttgagtgctgtgttggtcgattaattattataagctgctaatgtggatgtgtacaattaattagaagatggtgatgatgttcgtaaaatgttgatttgagggttttgcactcggctctactatttatatttctgatctgttggcactgctgatatcgacgttgttaagtacagtagttgtcgtagtagctgcataataatcactgccgtcaaccggtagccgtgttggtttgactatcctagcagcaggcagcaagctctcactcaaacacagtcactggactggagtgtggcctgctcggtgcgttcgctttggtttgtcgcgtagctgggcagtgagtcagtgcagtgcagtgcagtggccgcgtgcgttgtacttgcaggacgcttgggagctgcagctgtttgcttctgccgtgcattcatgtggtgtgggtgcgtggtggggccgtggggggtgaggtgtcaattacggcagggtgcatggtgcaagcagcccgcgcctccgttcaaacgagccggccgcagcccgcagggcgaaaatgatggatgggcgctgctcgcgccggatcagggagcaatgtgcccctccccccatccggaccctgctgcttaccgaaaatgggagttgcgatttggactggtaacgccagtactaagggtatctgagatttacaaagaagctgaattaagctacataatgctagcttatttcatcgtagcatatctgatattttaccctcaaacatcataaatagaagcagtgttttgtttgtacaaggctagcgacatttatgcggagcagagatacgtttgaggcgtgtacagtgtcccatggagcgagacattattgctcccgctccctacagtacagtgtgccggggggtacccatgctgctcgcgggcacgggcaagcacgttattatgagcaaagccaaagccgcagccgtcctttattaccgtccggtagtacaagtacattgccctccctcccctccgtcggcaaagcgtcttaattacgcaccacggtagtgctgcttcaccatggcatggatatccccagcgctcggacttgcgaggaagaagcagcccgtatcatcggtcgcctttgccctggcacatgcgatgctcacgagcccacgttccggtgcaggcagagcggcgcctttccagcctgggatcttgcttagctgtaatgcgtatcccgcgtcttgaaatatcggcgtcgggtggctcagctcagttactgtgcaacgtcatactgtagttgtttctctgcaagctccgtaccccatctgcatctgccgctttgactggacttgtttctctgcaaaaaggaacactgggtaggggtgggctagctggacctgtacgtgacgaggacgagacttggggcgagcaagtgtccaccgttgacactgagtcagcccgcccggaggggctacgccggcgtaccgcgtaccacctgcccgaacctgaacacctcgggttggggtgggtcattgggtggcggggcgactgcttgcttgcaagtcggggtgttgggggacggaacgtgggtgcaaggggcgtcatccagggccggatccagagctggggcatacttcaaccagcttagcagcataagaacggctaacaaatatttaatatagcattactatttactatgctaaaatgtacagtatatatagtaaattgttgcttgcacttagctaaatttaaccgaatagagtgctcattcttctcaagctgactttgttttttcatagcagcagtgattgactgataagatcctcataatccttgagagccttgttgtgaaaactggtgcgagatcacctacaagaagtgctaatctgtcattgttcttccaatagttccagccttgtaccacaaatgcctcacggccatgatgggtgtcaatatttttatccctaaacaagtagcaacacaagcagtatgctttgtcctccttctcacaatctcactatattccagccaattagcatactggccaaaccaatctggattgaatcgacgc

SEQ ID NO: 21068 - DNA, 1190 bp, Zea mays
agaccacccgaaaaacaagggaataaatagtaaagaaacggagcgaggctcctcctcgtttcctatctatcctgatccaaatccgccctactcgcttcatatatcctcccgcgaggaaaacaattcattccgcgccgcatctgggaaggtctcgtcttgctcgcctccgtccgtcgccgcaccctgcgtcgtcgccatggccaccgacgaagccaccaagccgtccccgatcccaccctatcccgagatgatcctggcggcgatcgagggtctagacgacaagagcgggtcgaacaagtccgccatctccaagtacatcgagggcaagtacggctcgctgccccccgcgcacgcgtcgctgctgaccgcgcacctggcgcgcatgaaggagtccggagagctcgtcttcctcaagaacaactacttccgcgcgggcgcccccgacgcgccgccgaagcgcgggcgcgggcgccctcccaaggcgcgggacccgaacgcgccggcgccggcgcccaagtcgccgtcgtccacggggcgcggccgcgggcgcccgcccaaggccaagagcccgctggaagccgccgtgaagcaggccaccgcggggatgcccaagccccgcggccgcccgcccaagaaggccaagaccgacggcgccgcgtccccgtccccgtcccctgcccctgcccctgctggcgacgggtccacccccggcaagcgcggccgcggcaggccccccaaggtacgccccgccgtgcccagcgagacggccgcggcttgaccccgcttcttggggataatagttcgtcccgccgcgagatgggatggttagggcgtagcaattcgtcccgctgcagctgcggctgcagctgccgtgttaatgttggtaggcttggtctccatgcttcatctaattgttgtcgtcgtcggcgtcgtcgttgctcaattaattaatggagtaattaggaggattcgatgtgctgtcttctgtgctgtgttgtgttcagttcagtttcaccgtgtgtctctggtgttatgtgctggatctgttgtaagctaagctagggagcttgagtgctgtgttggtcgattaattattataagctgctaatgtggatgtgtacaattaattagaggatggtgatgatgttcgtaaaatgttgatttgaaaaaaaaaaaaaaaaaaaaaaaaa

SEQ ID NO: 21069 - DNA, 432 bp, Zea mays
cggcaggccccccatggtacgccccgccgtgcccagcgagacggccgcggcttgacgccgcttcttggggataatagttcgtcccgccgcgagatgggatggttagggcgtagcaattcgtcccgcagctgcagctgccgtgttaatgttggtaggcttggtctccatgcttcatctaattgttgtcgtcgccgtcggcgtcgttgctcaattaattaatggagtaattaggaggattcgatgtgctgtcttctgtgctgtgttgtgttcagttcagcttcaccgtgtgtctctggtgttattatgtgctggatctgttgtaagctaagctagggagcttgagtgctgtgttggtcgattaattattataagctgctaatgtggatgtgtacaattaattagaggatggtgatgatgttcgtaaaaaaaaaa

SEQ ID NO: 21070 - DNA, 1061 bp, Zea mays
ccggccgggaatatcccctccgtttgatcaaaaacatttgcatttgtgtacgaaccatcctcgaatccaacgtcctctcctctccgtacttcctccgcagctacccccatcacattcccaaaccctccgtcgacccctcctcctcgatctacaccggcgatcggcggcgagcgatggggtgggcgacgcggttcctggcggcggtgtgcttctttgctgcgggtgtcctcttcgtccccgaggctctccttggttccccctccggcgcaggcgccgtcaccgccgccaagctggcccacgtcctctcctttgccacttcctggggcgccgccctctgggccacctttatcggcggcatcatcatgttcaagaacctgccgaggcacatgttcggcaacttgcagagcaagatgttcccggcctacttcacgcttatctctgcctgcgcagccatctcggtcgccgccttctcgcacctccacccgtggaagacggcgtccaccgtggagcgctaccagcttggattcctcctatcagcgctcggttgcaatctctccaacctgctagtcttcacccccatgacaattgagatgatgaagaagaggcacaagattgagcgggacctgagtatcggtgaggaagtgggatggtcaaagaatcagcaggtggctaaatccaaccccacccttgctgcaatgaacaagaagtttgggatgatccacgggctgtcatcactggccaacatcatgtcgtttggtagcttggccatgcactcctggtacctggccagcaagctggagctgtgaagaggagccaagacgtcttccatctccgcgttcttgtgaattttatcactatggtggtaatggtgcacgtcaggttgtcagatcgctagactaaactgtacgattgcgctattggcttcacaagataataaattgtactcctagttaaaaaaagaaatcctgtgttgcatggagctcccaaactagttattcaaaatcagaataattcagccaaaaaaaaaaaaaaaattgatcacaaaaaaaaaaaaaaaaaaa

SEQ ID NO: 21071 - DNA, 1062 bp, Zea mays
ggccccggccgcgggcctctcaaaaacacagctctgacctctgaccgtaattaccaaccactgccagcgacctctcctcggaggcgtgaccgtaattgctccgcaactaccccgataccattcccaaatcctccgtcgacccctctacaccggcgatcggcggcgaacgatggggtgggcgacgcggttcctggcggcggtgtgcttctttgctgcgggcgtcctcttcgtcccagaggctatcggttccccatccggcgcaggagccgtcaccgccgccaagctggcccacgtcctctcctttgccacctcctggggcgccgccctctgggccaccttcatcggcggcatcataatgttcaagaacctgccgaggcacatgttcggcaacttgcagagcaagatgttcccggcctacttcacgcttatatctgcatgcgcagccatctccgtcgccgccttcgcgtaccttcacccgtggaagacggcgtccactgtgcagcgctaccagcttggattcctcctctcagcgctcggctgcaacctctccaaccttctagtcttcactcccatgaccatcgagatgatgaagaagaggcacaagatcgagcgggacctgagtatcggcgaggaagtcggatggtcaaagaaccagcaggtggctaaatccaaccccaccctcgctgcaatgaacaagaagtttgggatgatccacgggctgtcatcactggccaacatcatgtcgtttggcagcttggccatgcactcctggtacctggccagcaagctagagctgtgaagaaggggagacaagacgacacctttctccgccttgttgtgaatcttgtcagttgtcacgatggtgttgcttgctgctctcaaaccagtttcaaaattggaataactagaaaatggccagacacatacagacagggttttgtaaaatcacactatctccgatctcgaatattttgcaaaaccgcatgtcctcgtgcaaaaaaaaaaaaacatgatgacaccgttctcgaatattcgcccgaccccagcggccaaaaaaaaaaa

SEQ ID NO: 21072 - DNA, 1928 bp, Zea mays
aattcggcacgaggcttgctcgtccacccagtactccactgctcctcgtcctcgtcctcgtcctccctctcccgccatccccatccccgcgacgacgcgcatcggaccctgcgtcgtacgtgctcgcccattccctagccgtcagtggatgtgccgggctggccgcgggccgtccgagcctgcggcggcggcaggggagggccgcgtcccggcggccgcccgcgcccgctgcgggaaggaagccatccaaccgcggagatgtgggagcccaggaggtcgtagcgaggggtttccttgattggtgaatcttcgatcaaggatggagcaccgggctttgctgctcggcgtggcgctggcctttctgctggcctctggctcccagggcttgaaccatgaaggttggcttctcctagcgctgaagagccagatgaacgacactctccaccacctcgacaactgggacgcgagggatctaacaccatgcatctggaagggcgtcagctgctcgtcgacgcccaacccagtggtggtgtctctcgacctcagcaacatgaacctgtcaggcacagttgcgcctagcattggtagcctgtctgagctgaccctccttgatctgtcctttaatgggttctatggtaccatccctccagagattgggaacctgtcgaaattggaagtgcttaacttgtacaacaacagttttgttggtacaataccccctgagctcgggaagctagataggctggtcacgtttaatctgtgcaacaacaagcttcatggcccgatacctgatgaggttggaaatatgacagccccacgcgtccgcggacgcgtgggtaataatctcactggctcactacctcgttcacttggcaagctgaagaacctgaaaaatattaggttgggtcagaatcttatatcaggcaacattcctgttgagataggtgcatgcttgaacataactgtgtttggtctcgcacaaaacaagctcgagggtcctttacctaaagagattgggaggttgaccttgatgaccgacttaatcctatgggggaatcagctttctggtgttattcctccagagataggaaactgtacaagtctgagcacaattgccctctatgacaataatctagttggccccattcctgcaacaattgtgaaaatttcgaatcttcagaagctatacctttacaggaattcattaaatggtacaattccatctgacattgggaatctttctcttgcaaaagagatcgacttttcagagaatttcttaactggagggataccaaaggagctggccgacatcccaggcttgaatttactctacctctttcagaaccagcttacaggccctattcctacagagttatgtgggttgaaaaacttgagtaaacttgatctgtcgatcaattcactgaatggcacgattccagttggatttcagtacatgagaaatctaatccaactgcaactcttcaacaatatgctttctggcaacatacctccaaggtttggcatttatagccgtctttgggtggtggatttctcaaacaacagtctaacagggcagataccgaaagatctttgcaggcaatcaaaccttattttagttgattttggggtctaacatgcttacaggatacattcctcgtgggatcactaactgtaaaacattggtgcaccttcgtctcagtgacaacagtctgacaagaaagtttccccactgatctctgcaatctgggtaaatttgaccacagttgaactaggtcgaaacaaatttagtgggcctattccttctcagataggcagttgcaagtctcttcaaaagctggaccttacaaataattatttcacgtcagagttgcctcgagaaattggtattttgtcaaaactcgttgtcttcatatctcttctaatagact

SEQ ID NO: 21073 - DNA, 1359 bp, Zea mays
aaaaaaaaatttagtgggcctattcctcctagataggcagttgcaagtctcgtccctcgcggctccctccggataattatttcacgtcagagttgcctcgagaaattggtaatttgtcaaaactcgttgtcttcaatatctcatctaatagactaggaggaaacataccactagagattttcaattgtacagtgttgcaacgccttgatctcagccagaatagctttgaaggttcgttgccaaatgaagttggtaggctgccacaactggagctgctatcttttgctgacaataggctaaccggccagataccacccattcttggtgaactatcacatttaacagcactacagattggtggcaatcagttatctggtgaaataccaaaggagctgggtctgctgtcgagcttgcagatcgccctgaatttgagctacaacaacctctctggcgatattccatcagagcttggtaaccttgcactgttggaaagtttgtttcttaataacaacaagctgatgggtgaaatcccaaccacatttgctaatctgtccagtttgcttgagctcaacgtctcctacaattatctctctggtgccctcccgccaataccgctttttgataatatgtctgtgacctgttttattggaaataaaggattatgtggtggacaacttggtagatgtggattccggccatcctctagttctcagtcatccaattcagtcagtcccccattgggcaagatcatagcaattgttgctgctgtcattggagggatttcacttattcttattgcaataattgtgcaccatatcagaaaaccaatggagacagtggcccccttgcaagataagcaaccttttccagcttgttctaatgtgcatgtttctgctaaggatgcatatacatttcaggaattgctcaccgccacaaataactttgacgagagttgtgtgatcggaaggggtgcatgtgggacggtgtacagagccatcctgaaggctggacagacaattgcagtcaagaaacttgcttctaacagggaagggagcaacactgacaacagctttcgtgcagagatcatgactcttggaaagataagacatcgtaatattgtgaagctttacggttttgtataccaccagggttccaaccttctactctacgaatacatgtcaagaggtagtcttggtgagctacttcatggacaatcgtcctcttcacttgattgggagacacgcttcctgatagcacttggtgcggctgaagggctttcgtacctacatcacgactgcaagcctcgtatcatccaccgtgatatcaaatctaataacattttacttgatgaaaactttg

SEQ ID NO: 21074 - DNA, 2881 bp, Zea mays
tcggtacccttggatgctctacatcgacctgcagctgcacctcttggattaaatcccagaccaacgagaactcaaacagcacctgcgccggaaggctcccagagagatcatgcacccatccgtttgctgttaaggctccttggactgatctgctcttcctagttctcatggaaacacgatttgctagagcaggagcaatctgttacaaagactggacatgtatccatttatctgtccagaagagagtgtttgcccaatttccaacaatagaacaaaaagaggctgcgaagagggctgtaccaaatctgtgtacctttatttcaaaatcagcccaaggcctatctggttcagttttctggagccaaagccatctcaaatttgaagaccaacccatcacttccaaattataatagttatccacttgtaactgtgtttttggtatcctgatacatcaactttctttattttccaatacttgtcatatccccacaccccattagtgtagctgtaaatacggctggcttaacaacatttttgttttacaagcagtttatcagatggtttagacaattgcacctttctttcctgaaatgataagtttatctggtagaatggataattaggatcagtttggtaaagctctaatacaacatcctttcgctctagttcctgctcccagtcgctctaggttcctgcataaaccgtttggtagagcttctcattgctccatgtcaggcgacggcagagtcagcatgtggttgggccagggttggtgtaggcgaattgaactcacatggatcgaggttgccctctggccagttgtgctcttccaggaatcaaggtcagccagttgtgaattggcggagaaaggcagagggggaggtgggcggtgagggaggcaaggcgagtggcggggaggcggaagggcggcggccggtggggtagtggacaaatacggtgggagtggagcagagtgtggggagcggattttttctgctctccaccagcagtgcaaaacagttgaagtgcttcatgtgcggagcgggcggtagcactggcttttggcagcactccgcgtgaatcttgcggaccggagctttggcaaactggcccttagacttgcatttttgttatcttctcgtctgttgcaagtatctagttaactaatgagaaaaatgtccttttgcctgctcagattcgagtgagaagtggggataaagttttcaagggttcagttgagcagatggaccgcatcaaattaagaacctttgttgctttgacaatggatgtcgtgtcagcttcccctcggcgatatttctttgaggcaagaaccaatattttgaattaatcttataacctcttttcttttcttatgatgtcacatgtttatatctacgcgtctgatgtgatgtctaactaatatttgtcatgccaagctgcgaatgctcacataactccaatgttctttggtaggtcatgagcttttttgcaacaagtgaacgtgaaaaggagaggcttcagtattttgcttcaccagaaggaagagatgatctttaccagtacaatcagaaggagagtaggactgttctagaggtgaggaaggcttcactgaatcttttcataacaacattgtttccatagatggcttgccatgcagaataacttttggtagtaatattcccatttttctcttcagttaatttccatggttcacagtagttacatgatatagtgtcatttttaggtgttggaggattttccttcagtgcaaatgccttttgaatggctggtgcaactaacgcctccactgaagaaaagagccttttctatctcatcatccccactggcacacccaaaccaaatccatttgaccgttagcgtcgtagcatgggttactccattcaagagaacccggcgtggactctgctctacatggttggccgggctcaatccaaataaaggtatgttctgcttcatttagctgaaattagtatcctctcttcttaacttcagttagctgttgtagctacgctgctcagtactgaccagaacacaaccatctaccctctctcacattatgcttgtgtgcaggcaatcttatcccgtgttggatacaccaagggtccctgcctcctccacgtccattggttcctctcgtgttgattggaccaggaacagggtgtgcaccattccgtgcatttgtggaggaaagggctgcacaggctgcagctgaaccaacagccccggttctgttcttcttcggctgtagaaaccaagaaaacgattttctatacaaggatttctggctaactcatgcgcaggatgagggggtgttgtcctcgaaaaggggcggtggtttcttcgtcgctttttcccgggatcagccgcaaaaggtctacgtgcaacacaagataaaggaacagagttcaagactgtggaacttattactgtccgatgcagtgatctacattgcaggctcttcgacgaaaatgcctgccgatgttacagctgcgctagaggaggttatttgtaaagaaggtggtgtcaagcaagcggatgcttcgaaatggctcagggatctagaaagggctggtagacttaacatcgagacatggtcatagttgtgatgggcaagaaagtacatattatttatgtttgctgaatatagaaccagtgagaatttcactgtaaatcaaaggcattggaaatgtggaaacgtgtagatgttaaagcatccaatacggagaaatagttggaggatgatctaaactttcctcatttagccctctgtacgaaacgccatttcgtttgattaagtgagcacagtaattacatcagcttttgttacaaaaaaaaaaaaaaaaaaaaaaacgggggccca

SEQ ID NO: 21075 - DNA, 1452 bp, Zea mays
  misc_feature (1256)..(1268): n is a, c, g, or t
  misc_feature (1272)..(1280): n is a, c, g, or t
ccggccggactttgtttggaagatccatcttcggccatggccatcaactataaaattggtgatgctcttgaaattctaccaagtcaaaatccatcagctgttgatgccttcattgaacgctgtaacttggatccagattgttacataacggtcatgagcttttttgcaacaagtgaacgtgaaaaggagaggcttcagtattttgcttcaccagaccgcgcggccgatctttaccagtacaatcagaaggagagtaggactgttctagaggtgttggaggattttccttcagtgcaaatgccttttgaatggctggtgcaactaacgcctccactgaagaaaagagccttttctatctcatcatccccactggcacacccaaatcaaatccatttgaccgttagcgtcgtagcatgggttactccattcaagagaacccggcgtggactctgctctacatggctggccgggctcaatccaaataaagacaatcttatcccgtgttggatacaccaagggtccctgcctcctccacgtccattggttcctctcgtgttgattggaccaggaacagggtgtgcaccattccgtgcatttgtggaggaaagggctgcacaggctgcagctgaaccaacagccccggttctgttcttttttggctgtagaaaccaagaaaacgattttctatacaaggatttctggctaactcatgcgcaggatgagggggtgttgtcctcgaaaaggggcggtggtttcttcgtcgctttttcccgggatcagccgcaaaaggtctacgtgcaacacaagataaaggaacagagttcaagactgtggaacttattactgtccgatgcagtgatctacattgcaggctcttcgacgaaaatgcctgccgatgttacagctgcgctagaggaggttatttgtaaagaaggtggtgtcaagcaagcggatgcttcgaaatggctcagggatctagaaagggctggtagacttaacatcgagacatggtcatagttgtgatgggcaagaaagtacatattatttatgtttgctgaatatagaaccagtgagaatttcactgtaaatcaaaggcattggaaatgtggaaacgtgtagatgttaaagcatccaatacggagaaatagttggaggatgatctaaactttcctcatttagccctctgtacgaaacgccatttcgtttgattaagtgagcccagtaattccttctccaagcatgaactttgactttannnnnnnnnnnnngggnnnnnnnnncaaccttttaggccataatgtcatagaaggcttaacgacaatttaatgaacatgtaatgggacatgtaatgtgctatgtagtactatcctagtgttactactttatccaattatctttggtgtgttgaatggatggttaaatgattctagaaattttgtaatggtatttaga

SEQ ID NO: 21076 - DNA, 1382 bp, Zea mays
ttttttttttttttttgttaaaacaaaaattatatatatcactaggaaaagctgcacggattgaagtcagatgatattaagatttgtttggtttaactacactcgatggattacctgtgacccctcaaacacacacaccattgacggcattctcagtgcctacagtatcactcgaacacaagatactactttgtatgcctcgaaccagacacgccattgacggcattctgaatgcatacagtatcactcgaacacaaaatacctaggatgaagtcacaacatacaagtaacaggcaaaggattagaaagcgtgtcatttctgtcgagagctctgtgtgcatgtaaggacctcagtggcaaaagaatcgatacaattagcagcattcgacattcctggagtcctgcgcggctgcgccacccagagaagcactcagcggacatccactgcagcagtccaagttatccttgctatgtgaaaacccaaagtgctgaataactcagagaagatctttcgctagctttggcggcacgtctatagaatggacgtcagcagttgatggcagaaggtgttggtccagctcttccagatcactgtctccaataaccgatgaagataccgaatccatatcatcatcagaaaatgcaggatgagtagggacgtgtcttactgtggaaacttggatgctttctggtagaagacagttgaaaaatgaacccactcttgctagccgattgacccacccagggattgatttcctggtcaagttcttacagacatcatctgtaaaatggttgcagttctttgaaatcaaatggtatgtgttgccattgtactttcctgcaagattttcaatgaacgagcggaactctgctctagacaagtcagttgtgcccatccacacagatcttctgtaggtgaaaccaggacagctctttggttccacctcaaataccccacttgttggaaactcgtgtgctccatatccgtactccatgccgtggacttcgattccggagtggaaaataccgaggccgaaccagtagaggtagttgttcatgggcgtaaggtcgtacacgttgagcaccacgggcgcccctacgccggagccgttctgcgcttccatgcccgccgcgccgccggtgaagccgagtggcgctacagatctcgcgatttgtgcgtcattagcttctcgattagtgccccattcgagatgattcgaatggaagcgaggcaagggatcgttttgctccgccgctccgaattgatttggttccaagcgaggaagggaaagagctcaactaacaagggaacgagaacaactagcatgattaccgcccggaccgctccggggcccgttattataacccggccggcctcgagg

SEQ ID NO: 21077 - DNA, 1073 bp, Zea mays
aacaggaaaataattagaaagcacgtcatttctgtcgagagctgtgtgtgcgtatgtaacaaattcagtggcaaagaatcaacacaatcagcagcattcatctacactcctgcattcctatgccacctggagaggcactaagtggacatcaactgcagcaatttaagctatcctgctcggctcgagccaaagggttggataattcagagaagatccttggctagatttggtggcacgtctatagaatggacgtcagcagttgacgatggcagaaggtgttggtctaactctcccagatcactgtctccaagaaccgatgaagataccgaatccatatcatcatcagaaaatgcagattgagtaggaacgtgtcttactgtggaaacttggatgctttctggtagaagacaattaaaaaatgaacccactcttgctagcctattcacccacccagggattgatttcttggtcaagctcttacagacatcatctgtaaaatggttgcagttcttcgaaatcaaatgatacgtgttgccgttgtactttcctgcaagattttcaatgaacgagcggaactctgctctagacaagtcagttgtgcccatccacacagatcttctgtagatgaaaccaggacagcttttcggttccacctcgaatactccacttgccggaaactggtgtgctccaaatccgtactccataccatgaacttcgattccagagtggaaaataccgaggccgaaccagtagaggtagttgttcatgggcgtcaggtcgtacacgttgagcaccacgggcgcccctccgcaggagccgttctgcgcttccatgcccaccccgccgccggtgaagccgattggcgctacagatctcgcgactcgcgcggcattggcttcccggttagtgccctggtcgagctgaatcgaaggtaagcgaggctacggatcgttttgctccgccgctccgattttggtttggtttgaagcgagaagggaaagagctcgactcattaaccagcgaacgaaacaactagcatgataccgaccaccccgacctctcgagatattttt

SEQ ID NO: 21078 - DNA, 7705 bp, Zea mays
  misc_feature (2123)..(2123): n is a, c, g, or t
gatgagtgtttagggcaagtttgcgagctacaaaatcggagggattgaatggactaaaatcaatgagaagaggattttaacctctcaatcccatccagtattttagctcttaaactagtccttgtgggttaagtgaaaaaaaatcaagagacgtctctctcttcataactttctatacaacatttatgatacataatctttgggttgtattatatagtctcttagctgtctcctaaatttagaaaaccattctagtgtctctaggttgtacatacccttatatgtttttatcctataataaaagtaagcacttttaggacccctaaactgaataatgcagagattggccaattttagctgccttgcctcattgcttgcatgatgtgcttttttgtgacgacactggtggatattcctcttcagtcctaaaagaaaacgcaattctataatgatatcaagtcaaaccatttaaattaggtaaaatttacaaaaaaatatggcatcaaataagtattatcatactaaccatggaatatattcttgtccataactattttattattataaacattgatgtttttttctaaaatagatctggttaaattttggacagtttgaataggatcagaactgaaaccgtatcgttttctggatggggaagtattcttgttttcattttgaggagtaaagtttcttgattttcacttttaccttggaagagtgaaaataaaaagaagaaaaccccaatttttagaaaatggaaacgtcccgggggtatacggcgcgtatttccgtcttgcaagtcgcaattgcagagggcgagcctgcctaggtccacatggcgctgcacattaaacctgggcccatagtaaggaccaatctatctctgtcgttacaatggggcaatgggctaccaaatccattgaaactgtcagaacatgggccgttcagcagtagtaataggctaatagcgttgtcacttgtcagtttacgaagcctgggttatatatatccggacatgagcctcaagtgccaagggcacacacctgtatactcctcctcgttcacgtggacgacacatgccgccgtcctctccggcgtgacatgccatgcatggactgccgcgcaactgccgcgatgcccggcgcagcggccgcgggcgccacctgtgcagcctcgtcaactctctcggtcgctcgttgtcgatggccgtggccccccaaatgttgcacgccgatacccaaaccgcccctttccagtgtccagccttctccggcttcctgtgctctgggccggggcgtttgtgggagtctgcacgcttgctctctgcttctgggtcacttcgcgcggaagtcaaaccgaattctatatgtgcgcagcctccgagaagcgccgatcctgagaggcccaagggattgttagcaggtggataaacaatgcggcgcaggcatccaaggcgcggtttatttataaagattgggttccgagtgatccaatctggcccagaattgttctagacctgacacattctgctcaggaacctctaatgcactgtagcagagcacaggatcttgtgccactgcttggacgcggaaggggactgaacgaagatacttccatgttgaggtcagcgacgaagtttactccatcttgtttcactgcagctttgcaattttccgcatattttgatgtcgaagcagacaagaagtgtgctcgttttactgtcgctttggtccgtagcaagaatttcgtgaaaaaaagccctgaagattttgcaaataaattcaatctgttgttctcgcgtgttttttctctccaaatgcaggctaccaaatctctgaagcacggacaagctgatagctaaagagtaccgccacctcgatcaaaagctgagagcttgctctctcgcagcaatggtgtcggcaaacctgcggctcgtggccgcgttcttgctgccgttccttgccatcgcctccgcgtttgatctcttccaccagactgggccacggatggatccaaagatggtgccgatgggaggcggccagcctctcttcatcccgcacgagtacgtccgctccgccgacgtcaagcggcaatgccggtcggtgctgtccgccgccacngagctcacgttcgacgccaaccgcgccaacgccctcatgccggagctcagcttcgtcaagggggactggaagcaggacgacgacggcgtgccgctgatgccgttcgacggcaccgacgtgtcgggcgatcaggcgccggacccgctgcggctggcctcgttcatgctcacgcacgtcgacgtggggttccgggggaaaacggccctcaacgtcagcggcgtgctcggcgtcgccgtctcccgcaacggcacgggccccgtgatggggacgtacgtgtcgcccgagctcaaggtgtggcccgggagcaccgagcttaagatcctcttcgagggcgtgtacaccgagaacggcgacggcgagagcgtgctctgcatggtcggcgacgccctgctgccgaggcgcggcagcgacggcggcaacccctgggactgggccaaggacaccggccgcgacagcttccagccgccggtcaccaaggacggaaacctactgctcgtgctccggtacccgacgacgctcacgctgacgacgcgcgccgtgcgcggcgagctgacgagcacgagcgccaagtcggacgtcgcgtacttcgacgccgtgcacctgctgtcgcagctgggcgcctactccaactacaagttcggctccgagaagctcgtggacagagcgtgcagcgctcacccttaccgcgacgacatcctcggcggcggccggggcctgtacaggggcaactccttctgcggcatcctcgaccggttcacgtcggaggacgtgctcgccgtcgtcccgaactggcggtgcaactccacggacgcgttctgccgaaggctcgggccgttcgagacggacaagaccgtcgacgcgacggacggtgccttcacggacgtgagagtcgtgatgcaggacgtccggtgcgagccgaggaacgccccgggcggcgagagcacggcgcgggtgtcggccgtgttccgcgccgtgccgccgtgggagcacaagtactcggcggggaagcggagcgggctcggcggcacgaccctctcggccgagggggtgtggcgcgcgtccacggggcagctctgcatggtgggctgcctcggcgtcggcgccgaggcgtgccactcccgcgtgtgcctgtacgtgcagaccaccttcacggccacccgccgcagcctcacggtggggcagatcacccgcgtcgacggcggcggcggcggcgttgcccacttcccgctcacgatcaaacacacggtgcacccgatggagctctggagccggttcggcgtctcgggcggcgcgcctctgagcatggcgtacaactacacgaaggtgcggcaggccagcgattttctgaggcgcagcgagccgttcgaattcggggccgccctcgccaagtcgctcctcagctacccgaagaaagccgaaggcctcaacgacgacgcgatgagcttgtccagcctcgcggccgacctcaccctccacgtcgcggccgtgccagacccgttcccccgcggccggcgcgcgccgccgttcctccccctggaggtgctctcgctcggatcactcgtcggccgtacctcgatagagcagttggctacggagtttcccggaatgcccggcgagctcggagggggcaaagcgtcctcctggacgtcgtcgcagtcagagtcctcatcgacgacgtcgtcgtcgtcgcagccagcagagtcatctcttctcaacgtgtccgccgaggtctcgctgtccgggaatccttacgggaacgtgtcgagcttgttcatggaaggcgtgtacaatccggtgaatggacggatgtacctgatcggctgccgaagcattcaagcgactcggcaaaccttctcggcgctgaaagaggtcgaggatggcatggactgctcgatcgagatgagggtggattacccgccgacgacggcgcggtggctgataaaccccacggtgaaggtgcacgtagccagcacgcgcgaccccggcgacccgctgcacttcaacgcgaccaagctccagacgctgccgatcatgtaccgggagcagcggcaggacatcctgtcccggcgcagcgtcgaggggatcctccgcatcgcgacgctggcggcggccatcgccgtggagctgagccaggggtcgcacgccaaggcgaacaccgacgtgatgccgtacgtgtcgctggtgatgctgggcgtgcaggcggtcgggtacagcgtgccgctgatcaccggcgccgaggccctgttcgcccgcatcgccgcgggctctgacgacggcgccgtgccgccgtcgtacgaggtggacaagagcagcctgtactggaccatcgactgcatcgtgaagatcctcatcctcgccgcgttcctcctgacgctccggctggcgcagaaggtctggcggtcgcgcatccggctgctgacgcggtcgccgctggagcccggccgcgtgccgagcgaccggaaggtgctggtctacagcctcggcgcgcacctggtgggcttcgcggtggtcctggcggcgcactacgtgaacgtgtacagccggccggtgcgggacgacgggtcgtacatggacgcgcgcgggaggacgcacgcgctgcgggagtgggcggtgacgctggaggagtacatcgggatggcgcaggatttcttcctcctcccgcaggtggtcggcaacgtggtgtggcggatcaactgcaagccgctgaagaagagctactacgtcggcgtgacggcggtgcggctgctgccgcacctgtacgactacatcaaggcgccggccatcaatccctacttcgccgaggagtacgagttcgtgaacacgagcctggacttctactcccggttcggcgatgtggcgatcccgctcgtggccgtggcgctggccgccgccgtgtacgtgcagcagaggtggaactacaagatcatcagcaagaccgtgaagacgcagcagaagaagctgcagcacctcgggtccagggtgtacgagcggctgccgtccatgtcgtcggggaacttcgaggccgagctcgtctccggcgtcaacgagggcgtcggcctgcggcgggacaccagcttgagctgagcgcctgagccatcgtctgttgatcagctagctagctcgtttgctttacttctttgtgtgtgtgatgcgatcgatgctatttgtgttcccctttgtcttcacaaatcacaacagaaaatgtgtactagctcaatattttttttttttttttgtaaaaaatatttatttatttggtaggtcgctttggttcacaggctatgtacaagcctgtagtcatgctcatgcaaactgtatggcaaatcgtcattgcatggcttacagattgtgaaggacgctgaggtgatttacaacttccttccaatattctttgacagtactacggcacgctggctggtcgctagagttagttagagcagaagggtggtagctacatgtaggcgaaggaaagggtgagctcaagtgacatgttgactccctcctcccgctgcccctgatgctgctgctcctgctcctgctgcagggtcgccgcctccaccgttccgcttatggaggaaggcttctggtgatcggagctgcagcttgggcccgccgcgccgtcgccgacaccctgcagattcagattcagattcagattcggccgtgcttggaccctacgctccacctcggcggcacgccttcgcgtccgcgcctgcttcctgccgctgcggctgcggttgcgcccggctgccgtggggcatgccgtcgttcatggacgacaggtgagggactgaggaccaacaggaacatagaaggcccaatatgtgggttactgagctgggagttgggtgggctcttttttacttcgttgaaagagcccagtggagccaacacccagtcgcggcccaaaatcgcggatcccacttcgtcttcaactaacctcccgattcgtcagattgaactctcctcacacggtcacaccgcgcccacgaaaaaaaaaacaaatccctaggtgggggctgagacgcgaccgagaacgacgcaatgcgtccatgtatgagggacgggcgtggcggcgccgacggctgacctggtgacgcgtgacgttgccttcgtcgtcgacgtggtagccggcctcggcgcagagcgcgcggagcacgtcgttctggtcggcgtgcttgggcagcgcgtacccggcgcgggcgcgcaggccggcgtagatcctggcggcaacctggcgccgccggcgctcgcgctgccggttgttctcccgctcgcggggcgtcgggtgccgcagcgacgtcgtcagcccgccgccccggccgcggcgccgcaccgtccacggcccttgcgtcgagcggatgcagcccttccgcggcgccgccgccgcgccctcctctctccctgccccggcctgccgctccatggactccgccgtcgcctccgatcgtcggtcaggcatgcatgcacctacactacactgcacacacacactagctccggtcgcagcacgtactaccgctcgctcgctctcgcccgctcactcaactgatggccgatctctctctctctctctctctctctctctgtccgtgtcttactcacacgagtatttataggcagaggaggatcatgcatgagtgccactgtggactgaaaagctagctgctgcttcttttacacactgcgagttgaagaaccaagtgcatgctcctcgttcatgaaggatcggaatgctcttgctgctatgtgcatgtaagtttcttggcatctctctctcattgtttgtgtgtggcctgtgggtgtgggtgtctgaggagagaacagagaaggaataatgtagttgggagcatgtaacatctgtgtgctagctgagcactcgggctgttcctgtactctactgcaagaggatgctgcaggcgtccgccagaagaagaggaatatttccgccgcagtacatgcggccaattgcttcagctttctagtcccctttctgcatcccacctgcctttttcagtcttcagccttgttcgtctctctctgcacgtagatgctggtggtgggcgctagctagcgtactgccgccaaggctgcttccgagtagtgcctagagatcagatcacgacttcgcaagcctatccaacagttggagaaagctggtacaggctacagtacgacatgcatgtaatgttatatgcatggtaacgcatcaaattgtgcatgcatgcattcgtggcccatactatgttatatgcaatgcaggcggctctagctttatgtgatggtgtagccaagcagatcgaaacatacgtactgttttttctttctttctttctttcttctttctctgcagagaagataaaaaaactgaagcagttcctgatctggttttccagtttctgtatttttttcttcttgttcagaatggttctgttttctcctgaaaaaagaatggttctgttttcctgttagtttttactcgcttcgatgacggagtaaataatttggtggtcaaaactcgagaggtgagcactgcaaggagccaaggaccaagcaccaagcaccaagcaggagcatcatca

SEQ ID NO: 21079 - DNA, 1117 bp, Zea mays
attgtgttgggccattgtgttgggccattgtggtgggggccgctccgattttttttttttttttttggcaaattcttcagttcattaaaaaaatatagcagtaggaggcaagaacacaaaaaaatgattgaatttgacagaaccacgaattcagagctgataataaataatttaagctgatagtctctctcaacggtcctctaaccctcagcatccacagaaagacaatcgaacaaacagttcgtatccggctattcgccttagtttgagcagcacccaaccctcttcatcgcagaaacgtcatccttgacgtttatcttctcccccttgccaggggcggccgccccctcctcggaggcctccaccgtcttcttgctcacgatctggtatatctgggtcagcacctccgagaaggagctgtccacgttggtggcgtcgagggcggacgtctccatgaagtacatggactcggcctcggcgaactccttggcgtcgtcggtcgagacggccaccaggtgccggagatcggacttgttgccgaccagcatcaccacgatgctctggtcggtgtggtctctgagctccctcagccaacggcccacgttgtcgaacgtggcgcgacgggtgacatcgtagaccagcagtgcccctacggctcctcggtaataggcacttgtgattgcacggtacctctcctggccggcggtgtcccaaatctgggccttgatgaccttgccgtcgacctggagactgcgggtggcgaactcgacgccgatggtggacttggactcgaggctgaactcgttcttggtgaagcgggagaggaggttggacttgccgacgccggagtcgccgatgagcaccaccttgaagaggtagtcgtagtcgtcctccgcccggtacccgcctccgttggccgccattgcttcccttcccttcccttcccctccgagcagaggttggctgcgaggtgaggttttgggtctggatctcgctggagccgggtggtctggtgcagtgtcactggaactggagccgtggagcggaccagcggtgccagtgaggcgcccggccggccgcggggcgcccctggtatttgtttgctggttgccaaagg

SEQ ID NO: 21080 - DNA, 2153 bp, Zea mays
ctcttttgccatatttactcagtacatctcaccttgtctaatagaaatcatgacgactaagccaattcttcagttgatctaataaagttgaacacaataaatatggaagggaatcataatgtaacaatacatgttacatcatcagcaacaagaactgtgaataacaataagcattcataggtttaagatttgagtgctctgacatgttagcgtacagatgaatgatttgtgtaccttgagtacagatttcagtactatacacagtagaaaaaaattaagatccaagtgaacaacaaggaaatacttagttacggccttacggatccgatattcaattacacaaataaaaatctaagtacaggttgaaaagaatgaccagtgagatcaactattggccaaaacggttgacatcatagaactcaatattcttatatttctgggaaattatttctgcttgaacttttcgagctgtgtctgttgcacatccaacaaggataagcactgaagtcccagcaaatccacggaatgctgtcaagtgacttgtctgttcaactaaagatggtccagcagctagcacagccagaaatgcagatcccaagacagatatgcgactaagaactgttttaatataagcagctgtactttttcctggtctaacaagtggtatcgaagcaccttgccgcttcaattgttcactaagatcatcaggatctaactggagaaacgtgtaataatagttgaagaaggctataagtaatacattagttggaagatagagagcacctcctggattaagggctatggcagccttcttaagaaagtctaagccagaaaaccgtgccaaagtaccaggcaaagccagtgaagatgtagaaaatatgataggcatgactccagaactgttgaccttaaatggtaaatatgcagatcgctgaagttccccagttcgactgctgtaacgagaagcataattgaggggtattttgcgctcagcttcttgaacatagacaatcccaaggactaatagtaagaatgacaatatgattgtgagaagtccaacataattcccatcttgaaatgcctgcgcaactgtcctcccaaatgatgcaggcaaatatgatattatacttgtaaatataagaagtgatgttccatttccaagtttcagatcagatattctttcaccaatgaaagtagtaaagaccgatccaagtgtcaataatgtcacagatgttagaacccattctgtgctgaaatcattcacatagggacggagataaagaacttgtccaatggcctgaacaattgcaaatccaacagaagcatatcttgtatactgaagaaccttctttcttcctgcttccccttctttccgctgaaggtcttgcaattttgggtagagttgcgcaaggagttgaaacacaatctgtgcattgataaatggtacaatgccaagggagcaaattccaagccggccaatgcctccaccagagaaagaatctaaagtgcccagcaggctgttctggtcaaggttcccagcaaaagcttctcggttgaccccacccaaaggtatatacacaccaagccgagacaaggccaaaaaaccaaggagcttcaggaacttcccaggtagagggcccttgaagaagtcaccaatgtcaatggagctatcctcaattgcagctgctgctcctcgcccggacgccttctccctacttgcaccaccgccgctggagctcccaaataccggcgccatgataccaaagaaggtagacaggggagaccgcgacagagaattagacccctcctcgtagagccccagagggtcgaagccagggccggcggtttccagcgtacacctgggggaacagtccagtgtgcctcgccttcctctggttgtagtaatagcgatgcggcgcctgagaggatagatgggagccgcagccgctacggcacgcggccgaagaggagaggagaggggtggaggtgcccgggccaaggcggggagccctcgccagcattgcggcggggttgtcgtggcggtgaccatggaggcgtggggccgagagtggacggaggggggcacaggatgacgagtgcctggccccgtccggcggtgagggtcccaaagactatcccggccggcctcgagg

SEQ ID NO: 21081 - DNA, 1044 bp, Zea mays
  misc_feature (248)..(249): n is a, c, g, or t
ccacgcgtccggcgcttctgtcccgtttaattgagtctcttccagctgacgctgaatctttgatcaaatgggttgtcgaagtcaggagaaaagaggagggtggaccaagcttaaacaaagaggagaaagaaaggcttttcttgaaggaaaatgtactaaagcaagttcgtgataccaggctatttgccatagtccatgatttgcagtatgctaataaaccatgttataattgctcatcgtccgctcgnnataagctgatatcgaaattccattgtgttgggtgctgtcagggagctgcaatgctatcaggtaaccttgtgccaagagatgccttctgctgcagagaaacaagctttgaatgtgtccaagcgaatggtgacgggcttaagactgttatctcaggctccgtggtatgtgaaggcagtgaacaaggtgttgatatgcttttaccaatgtcttcacctggtgccagttcatgcaattcaaacttgaagagcaatgccgtcaaatatccatcaagcgtggatgttctaactgttcttctgctggctttacatcccaacacgtggttgggcatcaaagacgagaagctcaaagctgaatttcagactcttatttcaacagacagtctacctgatgatctgaaacgagagatattgcacctaaggcggcaactctactatctaaaggcctgtaaagaagaggaatgcgaagatgccgagcaaccatcgcctaagcagcagtgctgaagtggcagtgtgcccatgtcgttagttttacttgtaagaaattgatgtgaagggaaaagttaccagagggtatagactatgaaatggtcagaattatgatgatagtagtgtagtgatgattatcttgttgttcagttctggtgttgtttccttctacgagaggctattacaccctccttgctcaaggaggtgctgatgttctttttctagatgatgattaaaccatccatccttgctttgtgctaaaccttgtcatattctctttgcattgaataaatccctcgtatcgtatcct

SEQ ID NO: 21082 - DNA, 1977 bp, Zea mays
  misc_feature (1141)..(1141): n is a, c, g, or t
  misc_feature (1383)..(1383): n is a, c, g, or t
  misc_feature (1436)..(1436): n is a, c, g, or t
  misc_feature (1439)..(1439): n is a, c, g, or t
  misc_feature (1467)..(1467): n is a, c, g, or t
  misc_feature (1749)..(1749): n is a, c, g, or t
gacttaactcaaacaaagttgacctcaactcctttgcttgatatcttattgctataatacttgagatacgactctcccaacgagtatttgacaatgatttcagagtaaaaatgggaacatgtttacacaaaacattccaccttttggttgaaccagcaaataacacatatatgcgttgaacaatcccaaaaaatgaaacagctttcccacaagattttgccatatcacaaagagtaagattaagactatggcaagcacatggcatatacaatgctcttggattaatatcaagcaaccgcttttgtaccccttgatgttttcctttcatattggaaccatcatcatagccttgaccccttatatcattaatatttaggcctaatgacttcatagaatcaagcaacacactaaaaagccccaaaccagatgtgtcatcgacattcaagaaccccaaaaagtattcctcaatatttatttttccattagacaaattaacacaacgaactaacaaagtcatttgttcttgatgactaatatcaggggtacaatctaggataacagagaaatatttggcctctttaacaatctttatgatagatcttgtaatattagaagacaaaagaactatcaactcattctgaatcttaggactgagataatggtaatgaatttctttgttctgaatacgcctaagatggtcttgcattaccaaatcaaactctgcaatcatctcaacacaggctaagaaatttccattactatcactataaagctgctcaatgcttcctctaaaagccaagttgcgtttaccaagaaatttcacaattgctattattcttagcaaaacttgtctcaaacgttctttctctttattgatttgcttttgcaagtctttatcaatagtttcctctttctgcattcgtgtcctcaattcattccacttgttcatgttctgaaaatgctcaacactattttcatgttctctaagctttgtactaatattcctccaatttctacatccattatgtgctagagaactcagactgttgctagtgctagactttaagatcttacaacaaaagcaaaaaactttatcaacgtgctttgaataaaccaaccattttctatcatataactctcnattgcttaactttctataataatgagcatatgaaaaatgtcttgaggcatcatctaaagggaacttgataccttcctctcttataggtcctttctcaattaatatgtctcttgctttattatcaagattatcccaatttcttggatcataaatgtcaggttgttcatcaacactaccaaactgtgcatgtgcatctgatgaattagacatattctcatggtcacttacattgttatcatcgncgttgatatcaacatgttcttcttctctagaattctcattggttggttcctcngtncccacgggaactattgccaacgcaaacncatcatttggattcgtcgaagcactagcattgctcttgaaaaacttgtcaatagctcctctctgtgagtctatgagatcatccacacgttttttccttttccttttttcacttccagatagatatcttctcgatgacatgattacacaaagcactgaaaataaaaaagatatatatcacaaattgaatgataatataagaatgattatacatatctaaataatacgattattattattaatcagtatcagttaccttaaatttgtcaattagattgcacccncgatgcgactcgtgctgtcgatgtcgtgcagagcgccctagcaggcgccaggcgatcgccgtgccgcgcgaggcgcgagcgcacagcgcagtgcgcagcagcaagccagcaacacgccaagtcgccaacaccgcgcaggaacagcggacagaataggctatcaggctaaacagcggccgagcggcgtgcggcgatcctgttcctgtcggcctgatcgagaacggcggg

SEQ ID NO: 21083 - DNA, 1901 bp, Zea mays
ggcggttcggccgctgttttttcgtgttgtctagccgaaaactcatctaaataccacatccttcgaataattattagtgttactgcttctacaacagatctaaaacttgatagacatacaagtgtagaaggctaagagctgacatggggaacaattgtaagttgcatacatcatgccacgttcttgtcagaacacagacagagaagcgttggcacacatgaaattgacatcagaatttcaaccatttcttctctttctcctttctagtaactgcactcgtcgctgaagcgtgggtagcttcagcatcagcgagtgccttccgagtctcttccagtttccttgaagctgcttcaaagaatgccttgtctttgcagttacggttcttcatctcttccagtttctcaactcgaatcctcagctccttcacttcctcaccgtatgcaaccaaggatcttctgtcttccttcttagcgagtccattggtctcaactgatgaaccctttctaactttggtggtcgaaccttcttggcttactagatggctgttgataaaattaaagacagatctctcagcttcttcagctttagcagccctggcctgttctgcaaacttcttctcacgcttccttttcccacccctactgcgctttttcccactgcctccgtcagcctcgcttgaagcaagtgcatgatcaagtgattgctttgggggtagtaccttaactggaattggatcaagcatgccttggccagacacaccaagccccatcccctctcggtaacccatttttgccatcattttggaggcaacacccctggtgtggtgctcccattttgcgaagatcatggtatctgtctgaatgccactaaaatttgtgaattctaaaaggccaagaccctgatgaacacttccgtcctcttgatcagcatcgtcactgaactcagattcttcgtcacttaagcttccttcatcttcgtcactcatgtcagcgtattccgagacagaaagagaatcacttggcagactcgcagaactcccatcatcttgaaaaacaacttggccaatcttcagattatcatcccatgactcaagctctgctctcctccaaaggccagagttatacccagaagttgccagtatgctggagcctaccaaggactgctcccacctagttggagtgaatcgcttcaaggctttagaaggcattacaataccatgagacatgcggcagttactaccaaatcgacatcgctgctgtaggaagaacttgcatatcgacatattttcagatgtaggtgtcagaaatgagatccttgcatcgcctgaaccttcaaagcctataatgcatccattataccagcgcccattgttgtgccggaatctacactttgatccaactgaaaaatcatgtgactccagtggttctggctcaacatcatctggatctaatgactcaatagcaacttcgggtgattgggatattgattccttatctggaaagatctcatctacttgcttcagtagcctagagcgcttcaaatggagaagaccctcctcggcatccttaatcgcagcaagaagctcctcatgaacctcgaggaggtcggcgttggaggggtcggcggcgagggcctcgtcgaccgcggcgagggaggaccgctgctcctgcagctgctgctccagctgccgctcaatggccgccgcctcgtcctcgccctcgcccgccataggccaccaactggatcggggcggcgaggcgatgggcgaagaatcgagtcgagagggttcttcctcctcccagcctcccaggctctcgccgcgggcgcggtaccgtttcttcctcctcgaccgtgaccgtgaatccgtgatggaaggtgaggtgagctcggccggcctcgag

SEQ ID NO: 21084 - DNA, 1208 bp, Zea mays
gcacgagctcaaacagacccctccacgcccctgccgggcgagtgaggccccaaagccgagcaaacaaaacgatatgccgctgccctgaaccgagaccaccaccgctccgccccgcctcgcctcgcctcgcgtcgtctcacctcacctcacctcgccgactagggttttgtaccgccgtggatctcgccgtccccgccatggacgtctcgcacgcgggatcctccgtcgccggcgaggctccgaccaccggggagcaccggatggggactaccatcgtcggggtctgctacgagggcggcgtcgtcctgggcgccgattccaggaccagcactggaatgtatgtagccaaccgtgcttcagacaagattactcaactgacagacaatgtgtatgtctgtcgctctggatctgctgctgatacacaagtcatttcggattatgtacgctatttcctccaccaacacacaatccagcttggacaaccagctaccgttaaagttgcagccaacttgattaggttgctagcttatcagaacaagaacatgttgcaagctggcatgattgttggaggatgggacaagtacgagggaggccaaattttctcagtccctctcggtggaacgatcttgaagcaaccatttgcaattggaggttcaggttccagttacctatatgctcttcttgatcatgaatggaaagagggaatgagtcaggaagaggcagagaaatttgtggtgaaggtagtttcccttgctatggcccgtgatggtgctagtggaggggttgtccgtacagttacaataaatgcggatggcgtgaagaggaacttttaccctggcgacaagctacccctgtggcacgacgagctggaaccccagaactcgttgcttgatattcttgctgctgggaaccctgatcccatggtgcagtgaactcgccctccacttactttgtgaacttttcactgtatctgacttgttcttgattatttctccttgaactatgtcagaccagagtaatttacgaattgttgttatcgcaccttaataaattcatgtttagctgggtgattggcgttttgagttaatggttactggtaagcgtgctactgctgtagttaagcctgtggcaagtattcaaattttcagtaatgaaaaaaaaaaaaaaaccagcaccgttctatctgctacaacaaaaagggcggccaa

SEQ ID NO: 21085 - DNA, 1128 bp, Zea mays
ttgggtaccgcccggccgggccgcccctttcttgcgggggaggccaaagccgagcaaacaaaacgatatgccgctgccctgaaccgagaccaccaccgctctgcctcgcctcgcctcacctcacctcacctcgccgactagggttttgtaccgccgtggatctcgccgtccccgccatggacgtctcgcacgcgggatcctccgtcgccggcgaggctccgacgaccggggagcaccggatggggactaccatcgtcggggtctgctacgagggcggcgtcgtcctgggcgccgattccaggaccagcactggaatgtatgtagccaaccgtgcttcagacaagattactcaactgacagacaatgtgtatgtctgtcgctctggatctgctgctgatacacaagtcatttcggattatgtacgctatttcctccaccaacacacaatccagcttggacaaccagctaccgttaaagttgcagccaacttgattaggttgctagcttatcagaacaagaacatgttgcaagctggcatgattgttggaggatgggacaagtacgagggaggccaaattttctcagtccctctcggtggaacgatcttgaagcaaccatttgcaattggaggttcaggttccagttacctatatgctcttcttgatcatgaatggaaagagggaatgagtcaggaagaggcagagaaatttgtggtgaaggtagtttcccttgctatggcccgtgatggtgctagtggaggggttgtccgtacagttacaataaatgcggatggcgtgaagaggaacttttaccctggcgacaagctacccctgtggcacgacgagctggaaccccagaactcgttgcttgatattcttgctgctgggaaccctgatcccatggtgcagtgaactcgccctccacttactttgtgaacttttcactgtatctgacttgttcttgattatttctccttgaactatgtcagaccagagtaatttacgaattgttgttatcgcaccttaataaattcatgtttagctgggtgattggcgttttgagttaatggttactggtaagcgtgctactgctgtagttaagcctgtggcaagtattcaaattttcagt

SEQ ID NO: 21086 - DNA, 1170 bp, Zea mays
accactgactcgtccggcccaactgaacaccgaacctaacaggaggtgcctcttctcttcagttcttctcagtttctttcttgtgagggaggccaaacgatacaggaatacgatacgccgctcgcctgaatcgagaccaccaccgctcccgctctgcctcacctcgccgactagagtttttgccgccgcggatctcgccgtccccgccatggatacgtcgggctcctccgcagccgccggcgacgccccgaccaccggggagcaccggatggggaccaccattgtcggggtctgctacgagggtggcgtcgtcctcggcgctgattccagaaccagcactggaatgtatgtagccaaccgtgcttcagacaagattacccaattgacagacaatgtgtacgtttgtcgctctggatctgctgctgatacacaagtcatttcggactatatacgttatttcctccaccaacacacaatccagcttggacaaccagctactgttaaagttgcagctaacttgattaggttgctagcttatcagaataagaacatgttgcaagctggcatgattgttggaggatgggataagtacgagggaggccaaattttctcagtccctcttggtggaacgatcttgaagcaaccatttgcaattggaggctcaggttccagttatctttatgcacttcttgatcatgaatggaaagagggaatgagccaggaagaggcagagaaatttgtggtgaaggtagtttcccttgctatggcccgtgatggtgctagcggaggggttgtccgtacagttacaataaatgcggatggcgtgaagaggaacttctaccctggcgacaagctacccctgtggcacgacgagctggagccccagaactcgttgcttgatattcttgctgccgggaaccctgatcccatggtgcagtgaatttgccctccacttccgttgtgaacttttcactgtacctgacttgttcttgatttcaaccgaagaaagaattggaacatttcctgtcgaactaatgtcgcgccagagtatttacatactgttgttatcacaccttagtaaattcatggttactactgctgtcgtcgttttatctggcgagtatgcgattttgtcagccgcctacttatatgcggtactgatgcatgagt

SEQ ID NO: 21087 - DNA, 1162 bp, Zea mays
cattgggtacctcgaggccggccgggatccgcacccaccctcggacacgcgaccccgccccgaagttcttcgcagtttctttcttgcgagggaggccaaacgaaaccaaacgatacaggaatacgatacgccgctcgcctgaatcgagaccaccaccgctcgcctgaatcgagaccaccaccgctcccgctctgcctcacctcgccgactagagttttttccgccgcagatctcgccgtccccgccatggacgcgtcgcacacgggctcctccgcagcctccggcgacgccccgaccaccggggagcaccggatggggaccaccattgtcggggtctgctacgagggtggcgtcgtcctcggcgctgattccaggaccagcactggaatgtatgtagccaaccgtgcttcagacaagattacccaattgacagacaatgtgtacgtttgtcgctctggatctgctgctgatacacaagtcatttcggactatgtacgttatttcctccaccaacacacaatccagcttggacaaccagctactgttaaagttgcagctaacttgattaggttgctagcttatcagaataagaacatgttgcaagctggcatgattgttggaggatgggataagtacgagggaggccaaattttctcagtccctcttggtggaacgatcttgaaacaaccatttgcaattggaggctcaggttccagttatctttatgcacttcttgatcatgaatggaaagagggaatgagccaggaagaggcagagaaatttgtggtgaaggtagtttcccttgctatggcccgtgatggtgctagcggaggggttgtccgtacagttacaataaatgcggatggcgtgaagaggaacttctacccgcgcgacaagctacccctgtggcacgacgagttgaagccccagaactcgttgcttaatattcttgctcccgggacccctgatcccatggtccagtgaatttccccccccctcccgttgtgacctctcccctgaccctgacttgttcttgattccacccaaagaaagaattggaccatttcctgtcgaactaatgtcgcgccagagtatttacatactgttgttatcacaccttagtaaattcatggttactactgctgtcgtcgttttaaaaacc

SEQ ID NO: 21088 - DNA, 525 bp, Zea mays
ttcccgcctcggcccccccatacgaaaccaaacgatacaggaatacgatacgccgctcgcctgaatctagaccaccaccgctcctgctctgcctcacctcgccgactagagtttttgccgccgcgaatctcgccgtccccgccatggacgcgtcgcacacgggctcctccgcagccgccggcgacgccccgaccaccggggagcaccggatggggaccaccattgtcggggtctgctacgagggtggcgtcgtcctcggcgctgattccaggaccagcactggaatgtatgtagccaaccgtgcttcagacaagattacccaattgacagacaatgtgtacgtttgtcgctctggatctgctgctgatacacaagtcatttcggactatgtacgttatttcctccaccaacacacaatccagcttggacaaccagctactggtaaagttgcagctaacttgattaggttgctagcttatcagaataagaacatgttgcaggctggcatggatggtggaggatggg

SEQ ID NO: 21089 - DNA, 4106 bp, Zea mays
cttttgcatatgctgtcactaaactttagccctgcactaaaacagaccctaacacgcccctttcttgcgagtgaggccaaagccgagcaaacaaaacgatatgccgctgccctgaaccgagaccaccaccgctttgcctcgcctcgcctcgcgtcgtctcacctcacctcacctcgccgattagggttttgtaccgccgtggatctcgccgtccccgccatggacgtctcgcacgcgggatcctccgtcgccggcgaggctccgaccaccggggagcaccggatggggactaccatcgtcggggtctgctacgagggcggcgtcgtcctgggcgccgattccaggaccagcactggtacgccctttcgctcgtatcgatctatgtatgccgcaggagatcctatcgcgggtaggggtagatttggcgaaggatggcgttccgggcctaggttttcgcttggatggcaagattggacgaattggtctatttatttggctgctagtcacttagttgcgactggagagattagaggaatttggatactagctgctattttgtcattattattggcgggcttcgaaaatttgccatgagacgcacaaatcatagtcacagatggaccgatagattataggcacagatgatataatagcaagcgcaaggacgcaacgatctgagccggggatgcccgttgagtcccccctgcagtatgtttaattcttcagatcattgatggatgagtttcagcctttatttctgaagaaaaaaaagaatagtccactctgagctgggcactgtatttcatatgattaaactaaaactgacaccccctattgcagttaatttttttttgccacattgaccgtgatcctagttctcataaaaatgtatgctcagacgagtaatccttttgattgacttatatcttcttgttactagaaaacatggctccttaagtccgtgaagagttgtagtagtaatagtccaggaaaatgcttttgctcctgtttccaccaaatagaattcgttattaagctgatgtagtctttattttctatttggccaagtgctaatatttttgtgttgcctgctccaactcaggaatgtatgtagccaaccgtgcttcagacaagattactcaactgacagacaatgtgtatgtctgtcgctctggatctgtaagcgccattgtcttctaatgatagtgttgaattatgatgtttgagtagaagcttttttcttactttgtcggtttgtccctttgacaagttatataaatggatattccttgacggtagacggcttatatcttactgtttgatctgaactagtcaaacaacaacctacaagctagtagttattctcttctcattgctgtttttataccaccttattttgttttgttttaatagaaagtaattcctccttttcatggtgccagagatgacacattcctttttgcaagtttttagttcacatgtaaaactcttgctattttaataccacaggctgctgatacacaagtcatttcggattatgtacgctatttcctccaccaacacacgtaagtttgctcttcatacacaacctaacattaatctcttgtttgataaatcaatatactgaatgatacttaagatctctttgataaatatgatggagctgatgctaaaattacccccttgtgcagaatccagcttggacaaccagctaccgttaaagttgcagccaacttgattaggttgctagcttatcagaacaaggtatgttccatagcattccagcacgtactgttaaaacacgcttcacttttctcactgataagcacctggtgtcggaattttatgttgaactcttgtttagctatgaaaatgaatgtttggtattaatattcagaacatgttgcaagctggcatgattgttggaggatgggacaagtacgagggaggccaaattttctcagtccctctcggtggaacgatcttgaagcaaccatttgcaattggaggtataattattttgcctcccctctttcaagtcagtatttaaatgctacttccattattctctttgctgtgacataccttctgtgccctggctagtgatctagtaattaaatcatttactgtttgagttgtacatggtagctgagtgtccatacttcatactctaaatctcattatgaaaaaacttgctttgctgagcaatacgactcattctattttcttgagtgcatgctacatcaggtattgtttctgacacttgttatgttctctgaattgcaggttcaggttccagttacctatatgctcttcttgatcatgaatggaaagagggaatgagtcaggaagaggcagaggtatgtctccaagttccttcttacttggatcttggcaatgagatattctctctagcatattagtatgactgaaggttattagttgtgtaataaaacgaatagagtacaacactagccccaattttcctaatatgtttctaatgttcatatatgcagaaatttgtggtgaaggtagtttcccttgctatggcccgtgatggtgctagtggaggggttgtccgtacagttacagtaagttctctctctattttttatgtaaattttcatgctcagttcccttagaaatattgaaacatagcagttagctaaactagttgggtgtcatggattgtcttatgttggttttggcacttacatctagcatgatgcttttggtagctttcaaagtgaaacttaaccagctgtaactgaaaagtcgtaactttggataagttaactcctttgtggtgcgatacattgattgtaccaatatgaattggaacggaggtatgggatctattggaatgtctttctcaatgctgacaacctggcagcctgctataacatttatactcttctgttacttgattcattcacttgcttacatcattcacccagtgaattctttcaatttgctgggatttcatgttcttgaggtttaacttgcaaaaaattattgttcggtctgtgaaaaagtgtgtttgtgttttgcctatacttatctcttactaccatttcctatgtttgcttgtgttctcttcctctgtggcatagacccttttttgtggttcaaaacaaactctcttggctacagttacaataaatgcggatggcgtgaagaggaacttttaccctggcgacaagctacccctgtggcacgacgagctggaaccccagaactcgttgcttgatattcttgctgctgggaaccctgatcccatggtgcagtgaactcgccctccacttactttgtgaacttttcactgtatctgacttgttcttgattatttctccttgaactatgtcagaccagagtaatttacgaattgttgttatcgcaccttaataaattcatgtttagctgggtgattggcgttttgagttaatggttactggtaagcgtgctactgctgtagttaagcctgtggcaagtattcaaattttcagtaatgaatcccccgtagcagccagcaccattctatctgctacaacagatcgcgctgtcttgctctacttaaggtgattccattctatcgatcgcttgctgatgctcgtcagctagaacgtagtttgattttcaacctattctataaaaaaattctaagaatatacgcgctgcagtaattaagtttgacagttgcatcgaggaacattgatccccggacccgttttcactcttacatagttgaagtaactgcacatgcagtcgagtaatgtacaccaagttagtgaaagaagcatttgtacagttttaaattccattgcgaaatgatttctgttttcgaccgggcctgtgcatccaataaacgcagcacctttcacccggccttgtttcccagtttctgtcacgggatataatacattgggttagggagcttgaaagagcgggcacccatggaagaccccagcaggtcgctccattggtcgccagagttgcctaggatcctgtaaccctcttgttccatctccttcctcttttctgatttgtagactgtcgctgttttcttgcggtcacctgctgccctgtaatgttgggaaagtcacatc

SEQ ID NO: 21090 - DNA, 2091 bp, Zea mays
tatacagaaatttgtggtgaaggtagtttcccttgctatggcccgtgatggtgctagcggaggggttgtccgtacagttacagtaagttctttatttttatgtaaatttttatgctcagttcccttcagaaatattgaaacatagcaatcacctaaactatttgcgtatcgtggattgtcttacgttatgttggttttggcacgtacacgtagcatcatgcttttgatagctttcaaagtgaaacttaatcagctttactgaaattcgtgatgtttgaacatttgaatccttgtgccatacattcatctgtccactaagaaaaaatgattgtatcaaaatgaattagaacgaaggtacaagatcaactggaatactcgatctcaatgctgctagactgctataccgtttaggtgtttaatcttctgttactttacttgattcgttcacttgcttgcagcatccccttattgaattatatctatttgctcaatttttattcaatacgtttactcagttttcattctatccatttgctcacctttcattttcttgagatttacctagcaaacaattactttcagtctggaagagtgcagtggcctgcaaactgtgtttgtgttttgcttatacttgcctcttactggcgtttccaatatttgtttgtgctctctgcggcatggacctttccttagttcagatttgcgtaccctcttggtcttggccgcagataaatgcggatggcgtgaagaggaacttctaccctggcgacaagctacccctgtggcacgacgagctggagccccagaactcgttgctcgatattcttgctgccgggaaccctgatcccatggtgcagtgaatttgccctccacttccgttgtgaacttttcactgtacctgacttgttcttgatttcaaccgaagaaagaattggaacatttcctgtcgaactaatgtcgcgccagagtatttacatactgttgttatcacaccttagtaaattcatggttactactgctgtcgtcgttttatctgacgagtatgcgattttgtcagccgcctacttatatgcggtactgatgcatgagtaacccctcgtagcagcacctttctgtttttgctctagttctaagaatatacgcgctacgagtctacaaccctgcacttgtcgactcaaggcatatccctggtggcctggtcaattattcgcatgttgtcgttaccgtcgaacattacaggcaatgtgtactacacgaagttggagaaaagcattttgtacagtttaattccattgcaaaattatttttcattttccatcatcagccgagggcctggtagaatgtgcatccagtaaacgcagagcacctttcacccgccctgttctccagtttctttctgtcacgggatatagtacattgggttagggagcttgaaagagcgagcgctcatggaagatcccagcaggtcgctccattggtcgccggagttgcctaggatcctgtaaccctcctgttccatttcgtccctcttctctgatttgtagactgtcgctgttttctcgcggtcacctgctgccctgtggtaccgggaaagagtgagagaggcacgcacatctcagggttccacaagatcctcattttttttatcaaaccaattaattatcctgaagaagtacaaggcaatgcagcacacaagatcgaggtgtatacggtatacctgagtatgagcttctcccagtcatggaacccctgcttgttgaggttctccaccgtgactcctcggtgcgcctcgcttctgcccgtgagcaggaaggtcttgaatcccagcccgcggacctcgttgtagagcttcaagctggaagggatggcggccgcctcgcccctttccacccactcgtcgaacttgtggtggtcgaacaactcggccctgcgggattatttaaatttgaaatcaagtgagaccaccttcaaattcccatggaggagcggggttttttttttgtgtgtggttgccgagacattggtaattttgctgatttatgggtttccccggaatatcattggacctacaaattataaacacagctggtg

SEQ ID NO: 21091 - DNA, 2522 bp, Zea mays
ctactagccaaacaatttcatgaagtagttttgattaatcatatataacatttcttgagaggttcggatcttaaatatttctaattttttttgaatcccaatcaaacacactaactctctttatggttgtgaatgtgttttctaggaatggattgcccaaagttgtctgttttttttccttgggtctagatcatcattgttgacccaagggagaaagcttgtacaactaatttttggttggcccaaaacttcatacatataagagatatatccaaaaaaacatcttggttcaatcttaaaattgatagatagttatacaagtatcaagtttgaccaacaatgattacattatgtgcaaatttgggatataaaacttatatcaatagatttgtttgtggctctaagatgatattacctctttagtagtaaatgactccctactataagagattacatgccaaatctattttacatgtcttttcctttggtgcgccagcagcagcagcaacccgtggccactgctgcaacatcccgctggaaccaacccgcggccggcagcgtcgcaccgccgacggcggcagtaggaaacatggctaccaccgtcacagacgagccggagttctcccgcggcagccaccaccaccaggccgtttctctgccgctgatgttcggaccgtttccgtaccagggcccgcggccgcaagtgctgaagcaggccatgttcgtgccgctgccgcgatacagcgggactgagagcatcggtggcgcaaccgtcgctgcagatgcaagagagtacggcaacgctgccggttcacttcttcagcccctgaaccttggcacaggaccacacggccacgacgagcttgcagccatgacggcgtacaccgagtccaatgatccaccggtggcagaggcagctaccaatcctaccatagaagaagtgctcaacaatggcgacagcttcagcacctacagcacctcgctcatggcacctaatcaggttcttgatgacatggcttcggatgtgaatgagctggcaatggcaggaggagcatttttcagcaacgacgacgcatcgtttacggcgcctcaggatctcgccgcggcgctagatggtggccagctagcaccaggagcattggacgccatcagtgcatcgctcatggagacggacgggaaccctggtctcgagctagaggcaatgttttctcctgatcagtacgagaacaccttgtttccgctggaagctctgctggggctggatgatgctcccgtgtacgaggacggccaagactaccggcagggtggcgggagtgccgacgacgaggctgcagggacctcgctgatcggcggcgctgatgacagtcttgacgtcctggatgattatttgttcatggacagcgctggggatttcaacgacgatgaacgtgactaattcctggagtgcagtatcagcagtacctgatgagctgagaataagagagggacgggatcatgagtttctgtttcctcaagtaaaccagctttgaataatgtatgtactctctacatttttaaatgtgcgatgttttttttaacagtaaggggattcccctatcattatgaaataggaatagagtattaataagaccctgagcatggccggacagggccggacggtccggcgtagcggcggttggctctaccccgcaacgagccaccgaagtctgcaccagggacaacagagaagtttggaccgtctgactttacgtgcgaaccgtccgactggaccattcgggtattacattggaccgttcatgatggagcatgtagagcaaaacacaaatttttaccagcaaccctcctactagcccccaactaatgtctctctaacacccacaacccctcagggttgtagaatgatctcacccacacatgggtacgagccttttttggtccccaaaaggacggaaatatctagcatgcaatgtggagcacctagggccaacattaatgccccacataacccaaaccgataagcaagggagcgacataatgatacaccagcaaccacacatatggaggcacgatggattaccaccgaccgccattgaaatggtaagagaggagatagctagggcattccgaaacaaacacaaagttaacatgccccatggggggcagtcttatctgaggccatatgatagccgattctactacgacccatatctgcagggaacaagaatacgcgaatttataaaatttttgggtgatcaaggcagcccagatagaggaattggccattaaggaggcatttcgcatacatttatttttatcatccctaatttgtactactttcgcatggtacgccacctaactctatttactctttggggagacttagagcagaaagatcatgaccattttttctccagagatcatgagttagacctgatcgatttagcagccctatgacaaagaaaatactgagatacaaaaagtgacctcagaattttctcattctttatctttaatatacgatg

SEQ ID NO: 21092 - DNA, 2345 bp, Zea mays
ttctgttagcaatttttgaacgaaactcactgaaattcagagttttttcgttttcgaactcccacgaaaatttgttttcgctgtaaatttcgaaaaattcggttcaccgttcaaaaagttctaaaaatcataaaaataaaaaaccgagtttttcaaccggatatcgttgctttttgtctgaaacaacgaaattaccgaagttgcaacaaaattcgtcgagaaaacatcgaatttcgttttaaatttaaaattctatattgagcggatttatgcgaattttggttcgaatttatacggttggtgtatttggttcaatgtacatggtggaatgtgagagaacagctataatatttggacgggagttacacagggataagatagataccggagtagtttttttttaacggtgtgattaaaaaatggaggtgacacgttgagtcaaaccaattaccaaatacggagtacatcctaacctactgccaatcccatggtcccactcccaggcacaacagccacccgcgaccccaagtcccgatcggccgccgatcccgatcccgaatccctccctggctccacagcacccctgctccacacacacggccgccagcaagccgccggccctaggccctaccgtcgcagcgtcgcctgcttgactatctgcctccagccctccagcaagacttcagtcgcctgccccagcctggctgccgccgccctccagcaaggcagcaaacgccggcctccggccgcccgtccctaggccagaggccacccctaggccgctaggcttccaccgccgacgcccacagaaaccgtaggcgccaccaggccaccacgagatccctgccgtgacggagaatggaggccgccgcggccgtcctccccacgctggtgccctccgggagcgcggtggtggtgctcctcgcctacctcgggtatctcgccgccgctggagccatcctcccagggaagctcgtcgacggagccctactcccggactcctctcgcctccactatcgctgcaacggtttgctctcgctcctgctgctgctgggactctcggcgttcggtgtctacatggggtggatgtctcccacggttgtagctgacatgggactcgaacttctgtcggtgacctttatttttagtgtcattgtctcttttgcactctacattgccggcatcaagtccggccacaaaagttcttctttgagaccacatgttagtgggagcttcatgcaagattggtggtttggagtgcaacttaatcctcattttatggaagttgacctcaaattcttctttgtgagggcaggaatgatggcatggttatttattaacctctctttgtttgcaaagagctactttgctggttcagccaatctttcggtcattctctaccaatttttttgtgcgtggtatatcattgattacttcgtccatgaagaattcatgacctcaacgtgggacattattgctgaaagactgggtttcatgctggtgtttggtgatctagttttcatccctttcaccttcactattcaggggtggtggcttttgaagaacaaagtagagctgtcccttttgtctggtctagctaacttatgcatctttcttattggctacctagtgttccgaggagctaacaagcaaaaacatgtgttcaagaaggaccccaaagctcctatatggggaaaacctcccaaagttgtcgggggaaagctactagcatctggttactggggcatcgcaaggcactgcaattatctcggagacctgctgctagcactttcgttcagcttgccctgtggagtgagttccgtggtcccatacttctaccccacgtacctgctcattctactggtcttgagggaaaggcgcgatgaggcgaggtgctcgcagaagtacagggagatctgggcagagtactgcaagctcgtgccgtggaggatcctgccttatgtgtactgaagagacggtagaaaccaaggcagctcatggccctgggccagctgtaaaccttattttgtttgcccttaaccagttggtgaatgttgatgtagcactcggtaaactgtgaccgtgcaaacttttgttattgttggtccatacatgtttggaatcgtgaatcagaccgcctcacttggtggcatattattccctttagcgcttgcttgggagctaggacccgagaggattgaaggggttaaaattttcttgttattcaatattgaatattaaggaaattttagtgactttaatcctctccggtatccttgctctcaaataagcccttagttatgtatcatctaaatattatgttaatgttcttcaaacaatagata

SEQ ID NO: 21093 - DNA, 1271 bp, Zea mays
ggtaccctcggacgcgtcggccgactctctatcccgttcccttccgtccctcgtcacgctcacgcagcacgctgtcgtcttgcggctctcgcccgtctccccacggagccccgaaaccaaagccgagccgagagcccgagccccgcccagcccgacctcatcttctcctcgtcggcttcacccctccaccacctccatggggtcgtcggaggccgacgaggaccagctcctcaagagcttcctcgcggaggtcagcgaggccgagcgggacaacgaagtgctcaggatacttggttgcttcaagttaaaccccttcgagcatcttaagttgtcttttgattcatcaccagatgaggtgaaaaagcaatataggaagttgtcattgctggtccatcctgataaatgcaagcatcctcaggcacaagaagcttttgcagctctggcgaaagcacaacagctcctgcttgatccacaggaaagaggctacattcttgaccaagttactgctgcaaaagaagaattgagggcaaagcggaaaaaggagctgaagaaagacagtgcgtccaagataaaatctcttgtagatgagggaaaatatgaagagcagtttgaacgatcggatggatttcagcagcaattaataattaaagtacgtgaaattttgaccgacaaagaatggcgtaggagaaaaatgcaaatgaggatatcagaggaagaaggaagacttaagaaggatgaggaggaaacaaaagagatgtggaagaggaagagagagcatgaagagaagtgggaggagaccagagacaagcgggtctccagctggagggatttcatgaagacaggaaagaagggacggaaaggtgaaatcaaacccccaaaactgaagactgaagatccgaacaaatcttacgtgcaaaggccagtaaagcgaaactgagtggaatgtcagcaatcaaagaacatccggtagcggcctttcatctcaccagattagagctgcaacccttcaatgttgtacttgtcctgaatgtggtaaggttcaattacgcccgctgggaaacagaacggaacagagcagattttacccgtattgctagctagagtgatttggtttgatgtactcatcatccgtctgaagattttactgggaaaaaaagtacaaacttttccgttggaaaagaacctaatgaagtgaatgttgacaggccgtctctttactgcttcattgcattttagtagcggccaaaaaaaaaaaaaaaaaaaaaaaaaaa

SEQ ID NO: 21094 - DNA, 1644 bp, Zea mays
  misc_feature (1613)..(1643): n is a, c, g, or t
aagctggagtaccgctgccgcacagactgcagcgcgtgcgcacagagtacgcaggcaggacgcgacgcagcgccgaagcaccaaggatggagcccgagattcagagcctgtgtccgagtacgacggccgtgctcctcctgctggccgcctgtctcgccgccgcggtggcagcgctcgacgctgcggactacgccaggccgccgctgcctgcaggcggaggcggccggcgcgtcctgttcgccaacgggctcgggctgacgccgcagatggggtggaacagctggaaccatttccagtgcgacatcaacgaggcggtcgtccggagcaccgctgatgcgctcgtcgccaccggacttgcaaaggctggctacacgtatgtcaacttagatgactgctgggcggattccgagagaaccaaagaggtagcacgagtgctgctacgtgaccttgtcggatacatggtcgctaaccccaagacattcccatccggaatcaaggccctggcagattacgttcacagcaaggggcttaagcttggcatctactcttccgctgggacaagaacttgcagcaacaggatgcctggatctctgggctacgaggagagggatgctaagatgtttgcgtcatggggcgttgactacctgaagtatgacaactgctacagagacggcacgcctgaaaccgtgaggtttgggcgcatgtcccgagcgctggtgaactctggccgcccaatcttctactcgctttgcgaatggggcttcatggaagttcccaaatggggcggcatgtacggcaacagctggaggaccaccggcgacatcaacgacacatggtcaggcatgctggacaacatcgacctgaacgacgcctacgcccggtacgccaagcccggcggctggaacgaccctgacatgctggaggtcgggaacggaggcatggcgtacaacgagtacgtcgtgcacttcagcctctgggccatcgccaaggctcccctggtcatcggctgcgacgtgacgagagtctccaatgagacgctgggaatcctctccaacgcggaggtcatcgcgatcagccaagatcggctgggtgtccaaggacagaaagtgagcaagtacggcaacgatctcgaggtatgggcagggcagctctcggggcacaggaaggcggtgttgctgctcaaccggggggccacgcgctccgcgtccatcaccgcggcatggccggacgtgggcatccgccgcggcgtcgccgtgcaggcgagggacgtctggaagcacgagacgctaccgggctggttcaccggcagcctcacggcggtggtcgggccgcactcgtgcaagctcttcgtcctcacgcccgttcctagctgacggcgccgctggagatctgtccatccaatatctgcccgtggatccagctagagttattaattgtatgatttcagatactgtaactgccttgtgactgctccgacaacaagagctcaccaccatctgtctaatgatttgacatggtgcaacgctcagtttggcttagatttgagatccgaacgtggtgaataaaataataaaatgacgtctcctgacttctttcaaaaaaaaaaaaaaaannnnnnnnnnnnnnnnnnnnnnnnnnnnnnnt

SEQ ID NO: 21095 - DNA, 1661 bp, Zea mays
aagctggagtaccgctgccgcacagactgcagcgcgtgcgcacagagtacgcaggcaggacgcgacgcagcgccgaagcaccaaggatggagcccgagattcagagcctgtgtccgagtacgacggccgtgctcctcctgctggccgcctgtctcgccgccgcggtggcagcgctcgacgctgcggactacgccaggccgccgctgcctgcaggcggaggcggccggcgcgtcctgttcgccaacgggctcgggctgacgccgcagatggggtggaacagctggaaccatttccagtgcgacatcaacgaggcggtcgtccggagcaccgctgatgcgctcgtcgccaccggacttgcaaaggctggctacacgtatgtcaacttagatgactgctgggcggattccgagagaaccaaagagggatacatggtcgctaaccccaagacattcccatccggaatcaaggccctggcagattacgttcacagcaaggggcttaagcttggcatctactcttccgctgggacaagaacttgcagcaacaggatgcctggatctctgggctacgaggagagggatgctaagatgtttgcgtcatggggcgttgactacctgaagtatgacaactgctacagagacggcacgcctgaaaccgtgaggtttgggcgcatgtcccgagcgctggtgaactctggccgcccaatcttctactcgctttgcgaatggggcttcatggaagttcccaaatggggcggcatgtacggcaacagctggaggaccaccggcgacatcaacgacacatggtcaggcatgctggacaacatcgacctgaacgacgcctacgcccggtacgccaagcccggcggctggaacgcagaccctgacatgctggaggtcgggaacggaggcatggcgtacaacgagtacgtcgtgcacttcagcctctgggccatcgccaaggctcccctggtcatcggctgcgacgtgacgagagtctccaatgagacgctggggatcctctccaacgcggaggtcatcgcgatcagccaagatcggctgggtgtccaaggacagaaagtgagcaagtacggcaacgatctcgaggtatgggcagggcagctctcggggcacaggaaggcggtgctgctgctcaaccggggggccacgcgctccgcgtccatcaccgcggcatggccggacgtgggcatccgccgcggcgtcgccgtgcaggcgagggacgtctggaagcacgagacgctaccgggctggttcaccggcagcctcacggcggtggtcgggccgcactcgtgcaagctcttcgtcctcacgcccgttcctagctgacggcgccgctggagatctgtccatccaatatctgcccgtggatccagctagagttattaattgtatgatttcagatactgtaactgccttgtgactgctccgacaacaagagctcaccaccatctgtctaatgatttgacatggtgcaacgctcagtttggcctagatttgagatccgaacgtggcgaataaaataataaaatgacgtctcctgacttcttttagccgtggaggcagactggttcacttatactgtaaaaacgccatttcttcgttcttcggtgaaagtaacgtgtaaacttcgcttacaaatct

SEQ ID NO: 21096 - DNA, 1836 bp, Zea mays
ttttttttttttttttcgtttttttttttttttttttttttttttttttttttggtttttttgtttgagattataatctatttagcagaatgtgatggtcacacatacttcacagaagattcaagtttgcaacatcacgaacgccaaatctacaaacacaacagaccaccgaggtctaagcacacatcacatactagacgagaaaatacaaacagagttttcgtgactgatggatcatcgaacagcctcacaagtcgcagggtaatagtatatctcaaagttcatacgcagggaaccttgattcagatggatcaaccatgtccaagaggaggtatgacatcccagctttcccttcaaacagtgaaaacgggcgatcaccaccatgcatggccccctcggctatcaactgatcagctttctccagaagaaagcaggcaaaagcctttgcccggtagaggtactcaacattaccggttagcctgtagagtgagagaaacgcataggcattcccgcttacaccgtggcatattccgactctcttcagaagccctcggttccagacaacctcagcagcctctgcagctgattgctcgaaataatcatcatggaagacctcatatgctttagcaagggtaagagcaacacctggggcaccatgacaccagtgcaccaagtgatctgattcattgccttcacttgagggataattgccactaggaaacttgttcttgatcatataccgcagggtgttctttacatcatcctgctcatctggtttcagttcggtgtgcattagcacgtgcatgattccagcaagaccatgcgcagccccccagtatttcttcccatgccattcgtacatcagagggctactccccttgcttgcaaaacctcttccctcattaataatgtccttcgccacagaattaatgtgatcgagagggatcgtcttctcgctgagatgcttattcaagaacaaacaagcccacagatagcctgcccttccatacagcaactcatttggaactttctcggtgattgttatctcatcaaaggagctcagatactgagtgaccctcagctgatcatcgcaatgcttggcaatcaccgccccaagagcgcagacacccgccctcccgcatatgaatgtcaagaacggcaggccccgcgatgcatcatcgcacgcgcggacgatatcagcggcgagggcgaggtccccgcggtctccagtgacctggaaggacttgaacagcagcagcgctgtcccgagagagcccgtgtagagcgtgtagtccgtcaccttccgtccggctttcacccacgtctcctcaaccaccttgtccttgaggcggcgcgcggcgcggacgaagtggtcggagagcctggtgtacggaagcgagagcaggccccgatgccctgcggggcggtgcccctcgccgtcggaggcctcagcctcggcgacgaagtcaggaaagtcattgggaatgaagcgatcagccatggactcgccgcgcaggccccgacgccgtttcgaggcgtggctggaggaggaggattcgcgaccggtgagccctcctgtcgccttcgtcttcgtcttatcgccagtcccaccgccgtttcccatgtctgacgcgtgctcgggttataaaaatgtttgcgagttagctggacgccccggcgctggctgcacgtctgtcgcgcgctccgagcaatgcgtggaacacgccgctgattccctgttcggctgttcctaacgaacggccgctaccatcctgctacgccactcagtgtccaaacttacaataacaaatcccgaccgccgcctgagcgccgcac

SEQ ID NO: 21097 - DNA, 1400 bp, Zea mays
aagacgaaaataccctctctgcctcttcgacgaatcgcaacggtttgttttccttcttccacgcgttgggaaggtgaggcggcggcgcgcgctagggaaaggtgtggcgacggcgtgcgatcggggaagggaacgcggcggcgcgtgcagggctacgcgacgccctctgcgcgtctccgtcaggaggaggcgtttccatcagccacctcgctccaagcacgctctgctcggctgcccctccggtttggccttgtgcaaatggacgcaagcaggtccaatttggctggtggctcgaatccatcacaatttgctaatgttgaatcttggaactttgatggatgttattacaacatcatggatgatgagaatttacaacataatgcagatgtgcatgaggttcaagggctgccctcagacgatgtcgaagtacacagtacaagtgcaacaaagaaagtagctaggagagcgaagaacttcagtcatcaagaggatgaggttatatgttctgcttggataaatggtagccaagatgcaataattggaatgaatcaaacgagtggtgggctggtggctattggaagcgttttgctgattactatgacaagtacaagcctgaaggatcacaaaggacacaaatagctatacaacacatgtggaagacaattcagaaggaagtgaacaagttttgtgcgtacttgtctaaaatagagcgtcgaaatgagagtgggaaagtggcagaagataggctgaagatgccatgaaaatgtttgagggattacaaaatcatcctttccaattcacacattgctggatattattgagaaatgagagaaagtggtgtgaaagctctactgtaacaagaccagggagggtcgtaaatgaagatcaaccctagaacatggtcccttctggtgaacctgaggttacaatacgtcccgaagtgactcatgcaagaggaagcgaggaaacaaaaacactgcacctactgattccactacttgtgttgaagtgcttgagtgtatgaccaagaaccgtgagcttgtcgaggttaaacgtgatgagcaatacagggagctacttgcacgcagggaccgtgagcttgatttgaaggaacaagagatggagttcaagatcatggctgtgaacattgacgacatgccggaggataagcgagcttactacctgaacctgcaacaaaggattatggagaagagtcacagaaacaacaatagttccacttagaatttaatgatgtttgacaatgaactttatggtggaatctttatctatgctatttaaattctgcaagttgtaatagtcaaaactatttgaaagataactatgtacctttttttggaaatttgttctcgatatttgactgaacaaaaaaaaaaaaaaaa

SEQ ID NO: 21098 - DNA, 963 bp, Zea mays
  misc_feature (2)..(2): n is a, c, g, or t
tntgagataaactgattattaattcgattgataatgtttaatcagtcgtattcctctatatttatagaggaggagggctgaacccgttacatacaaatctcccgagttaattccgcgaatatagacaacaactgtagcaagaaactcgaaactctaactgactgcgcgcgcggaccgtccagactcggggccggaccgttagcacggtcaatttgccatccaacacagagctctaaaaggttacaaaaataattttgttcctgtcaagtgtcaactactatcaagtatcaacctcaccatttggaaggaaaaaaacaggaaaccgaacatagatgagttcttgtcctacggagcatcgcattgtacactgcttggtacttgatcacttctagttgattacagagaaaccatggggaaaatgggcgcgcagtgcttcattagttggttcccgatgatgattaggatgagaaaccataaaaaaaatgaagcactcggcggtgaggctggggctggtgaaatcacatagaaacgaattgccaggaaatcacaaactgcaccgcacagctcgttgttcgttgcatagaagactcaaactttgtcagcggcatccagtgatgtgccgccctctgaactcctgactgcagccagcttctcagctaatctttgctccagtgcccgttgacccctctctctcctcctgtttgcctcaaacgaatctgaaccaggtaatggtgaggtgtctaatgtttctcccctggcatcagatcttccacaaagtaacctatggaatacagatgctattgggtcgagaaatggtcttacaaattcagggaagaagcttgagaaagagaactcctcacttggatcccctttcaggctggtctaaagtctcttttgaaagtaacggaggtagatccaactcatatacatgccaaacaacagaactgggaggtaagacataaa

SEQ ID NO: 21099 - DNA, 1640 bp, Zea mays
ggtaccggcccctcttcgagtttttttttttttttttgtcctgtctcagggccggaccgttagcacggtcaatttgccatccaacacagagctctaaaaggttacaaaaataattttgttcctgtcaagtgtcaactactatcaagtatcaacctcaccatttggaaggaaaaaaacaggaaaccgaacatagatgagttcttgtcctacggagcatcgcattgtacactgcttggtacttgatcacttctagttgattacagaaaaaccatggggaaaatggggcgcagtgcttcattagttggttcccgatgatgattaggatgagaaaccataaaaaaaatgaagcactcggcggtgaggctggggctggtgaaggtacatgaaacattcgcgtccgttcaatccttcaggaaatcacatagaaacaaattgccaggaaatcacaaactgcaccgcacagctcgttgttcgttgcatagaagactcaaactttgtcagcggcatccagtgatgtgccgccctctgaactcctgactgcagccagcttctcagctaatctttgctccagtgcccgttgacccctctctctcctcctgtttgcctcaaacgaatctgaaccaggtaatggtgaggtgtctaatgtttctcccctggcatcagatcttccacaaagtaacctatggaatacagatgctattgggtcgagaaatggtcttacaaattcagggaagaagcttgagaaagagaactcctcacttggatcccctttcaggctggtctcaagtctcttttgaaagtaacggaggtagatccaactcatatacatgccaaacaacagaactgggaggtaagacataaagtcgtatatgaagatgcttccaagaatggatatcaatgcaacaagagatggaatccactttgccttaatttttagcacaaaaagattaagctcttgatcaggtaaaagctgtttaatgcccaccaacaatcctgatagaaccccataaaatccagaaaaaggagtatagaggtagatctcttgctgagttatatagtacagcacaatagcagtcatgaaaacacaagcagaagttgaaaggttgacaataaaaatgaactttgataactcttttgaaccccatagaggttctaacaacttcccaaataaaagaaggccaatgatgctgacaaccatccctggaattgtttgctcgacatagcctgcagttatcaggttccaagcaaaagggatcgttcttccagggataagcgcgagataggtgacggcggacggaaacaactggactacaaggtgcacaatgagcaatatgacggcgaggcccttgcacagctttgtgtatcccctgaagaagcctccactcccggcaggaagcgagggcggcggaggcgagctaccgctcatcatagtggcggccgccgcccggcgagatccgccgcgctgctgggtttcttgctcgggatcgccgcggaaggaattagcggagtgcagagcaagcaaagcagtgggggtcggaactcggaagtcagggtgcgtttggacagagcagctgaggtgtgtttggttcacaaccagattcagtgcttcgattaggatgttctaggtaatggtctcgtgc

SEQ ID NO: 21100 - DNA, 1334 bp, Zea mays
cagacgattcaaggaataatcgaatatttgaatagttgacttttgaacagcatacattgcagtatacgaaagcttgacagccatttcagtggtccaaagtccatgccctttacaacagatacagattttcgactaattttacaaccttatgcctcaagatcatgtaaaaaccaaaattcctacgaggcaattcacaaagactccacgagggtacaaggatagaagcattgtctactcaaacttgtatgtattctggtggttcaaccatccaaggaaactctcaactcttcagatgttactacaaagctcaaccccgttaatcaatggcaattatgaggaaaccaactgagatatacatgaggaagacaggatatagggccagagcttttctccttgggttaacagcagcgctcatgaatggatacgcagcccaggagctccaagccaatgtgattgtcaccacgacaatcttaagtatgacattgtccttcagcatgcaaactagagcaccaacatccaatggaaataggcaatagccaagaagactcaggctttggaagaagatgatgtgcccccccagaagcagaacattcaaggtcagaattatagcaccagctgccaggaccgcgaatgcaacagcaaatacttcagacttcttcacggaagccgaccaggagagcgtgaggcctaggaagacgatgaagaagaagggaccccacaggtcccagtccctaagcgccttgccggggtcctcgcggtagggattggggaagacgacgagcttgagattgctgacgatgcgtgctaagtctcgcttgatggtgtcccatacaggctccgtgagcgtgttgggcggagacccaaacccgtcggcgccgatggggacggagacggacgcgggaacgggaacgggggagacggagatcgggatggaagcggcggggaaaggcggcttcgtggggacgggcgccggggccggagaggaggatacggggatggaggcccgcgtaggagacggtggccgcgcggggagcacggtggccggggatggcgcggcgtggatgaggctctcgatctcgtccatgtcggactgcgccgacgaggggtggagcgggatcgtgtcgccgtggttgtgcgacatggcggcgggcgtgcggaaagcgcgcgagcgcgccggcggcgaggggaggcggatctgagggggctgtgagagatctcgcgggacctggcgggcgggagggatgggcttgggggcgggtttgcgaattgcgggtttgccgagaaatttgctattttgcttttcgattaggatgttctaggtaatggtctcgtgc

SEQ ID NO: 21101 - DNA, 1975 bp, Zea mays
gtccaggaatggatcagaaattatttaagctgatcaaaacttatataaattagaaaaataaactgggctagaaattattttatgtttctattccgatagaaacgaacggcccctcgggcttatttagaaataagggtaagaggaaacttggctattcaatcaattttaaatactccctccgtttatttttagttgtcgctggatagttcaattttacactatccagcgacatctaaaacgaaacggagggagtaacaaacaagccgagctgcagccgggcgccttcgtagagaggacgcttgctcacagtattttctctgttcatgtaagcgcctttacacgagtccttgcaccgtacgtatgtagtaacacaatgcacctctcaacagcatatataacctcatttagggctagtttggtaaacccaatttttccaaaggattttcattttcctaaagaaaattagttcattttctcttgaaaaaataagaatcccatgcgaaaatagtgtttctaagggctagtttgagaaccccaattttccaaggggtttctatttttccaaggaaaattagtttattttcttatggaaaaatagaaatcccttaaaaaattgaggttcccaaactagcacttagtggtcaaaagttcagccctttaacacacgatgcacctctcagcaccccatttttctctgttttttctctcacacagtataagaagcttggcagtcaattcagtggtcaaaagttcagccctttacaacaggtatagattttcaactaattttacaaccttaagcctccggatcatgtaaagaccgaaatccccacgagacgattcagactacagggtagaagcattgtctactcaaacttgtatgttttctggtggttcaaccatccacgaggaaagtcacaactattcagatgttactaggaagcttgcccccccgttaatcaatggcaattatgaggaaaccaactgagatatacatgaggaagacaggatatagggccagagcttttctccttgggttaacagcagcactcatgaatggataggcagcccaggagctccatgccaatgtgattgtcaccacgacaatcttaagtatcacgttgtccttcagcatgcaaagtagagcaccaacgtccagtggaaacaggcaataaccaagaagactaaggctttggaagaagatgatgtgtccacccagaagcagaacattcaaggtcagaattatagccccagctgccaggacagcaaatgcaacagcaaatacttcagacttcttaacggaagctgaccaggagagcgtgaggccaaggaagacgatgaagaagaagggaccccacaggtcccagtccctgagcgccttgccggggtcctcgcggtagggattggggaagacgacgagcttgagattgctgacgatgcgtgctaagtctcgctttacggtgtcccataccggctctgtgagcgtgttgggtggaggtccaaacccgtcagcgccgatgggaacggagacggacgttagaacgggggagacagagacggagatcggaatggaggcggcggggagaggcggcttcgtggggacgggcgccggcgccaacgccggagaggaggatacgggaatggaggcccgcgtcggagacggtggccgcgcggggagaacggtggccggagatggcgcggcgtggatgaggctctcgatctcgtccatgtcggactgcgccgacgaggggtggagcgggatcgtgtcgccgtggttgtgcgacatggcggcggacgagcggaaaacacgcgagcgcgccggcgaggggaggcggatctggggggcggtgactccggtgagagatctcgcgggagggatgggtttggggggtggggaggttgtgcgggtttgcgcgtcgcgcctgcgcaccgagtgccgacctgcctgcagcgtctgagttgcgctagcgctagc

SEQ ID NO: 21102 - DNA, 1313 bp, Zea mays
ttttttttttttttttcgcagtatacgaaagcttgacagccatttcagtggtccaaagtccatgccctttacaacagatacagattttcgactaattttacaaccttatgcctcaagatcatgtaaaaaccagaattcctacgaggcaattcacaaagactccacgagggtacaaggatagaagcattgtctactcaaacttgtatgtattctggtggttcaaccatccaaggaaactctcaactcttcagatgttactacaaagctcaaccccgttaatcaatggcaattatgaggaaaccaactgagatatacatgaggaagacaggatatagggccagagcttttctccttgggttaacagcagcgctcatgaatggatacgcagcccaggagctccaagccaatgtgattgtcaccacgacaatcttaagtatgacattgtccttcagcatgcaaactagagcaccaacatccaatggaaataggcaatagccaagaagactcaggctttggaagaagatgatgtgcccccccagaagcagaacattcaaggtcagaattatagcaccagctgccaggaccgcgaatgcaacagcaaatacttcagacttcttcacggaagccgaccaggagagcgtgaggcctaggaagacgatgaagaagaagggaccccacaggtcccagtccctaagcgccttgccggggtcctcgcggtagggattggggaagacgacgagcttgagattgctgacgatgcgtgctaagtctcgcttgatggtgtcccataccggctccgtgagcgtgttgggcggagacccaaacccgtcggcgccgatggggacggagacggacgcgggaacgggaacgggggagacggagacggagattgggatggaagcggcggggaaaggcggcttcgtggggacgggcgacggggccggagaggaagaaacggggatggaggcccgcgtcggagacggtggccgcgcggggagcacggtggccggggatggcgcggcgtggatgaggctctcgatctcgtccatgtcggactgcgccgacgaggggtggagcgggatcgtgtcgccgtggttgtgcgacatggcggcgggcgtgcggaaagcgcgcgagcgcgccggcggcgaggggaggcggatctgagggggctgtgagagatctcgcgggacctggcgggcgggagggatgggcttgggggcgggtttgcgaattgcgggtgtgtgtcactgccgaccagcctagcgaggaccgaggagggagatgcgtcagccgtcaggtcacgtgagtgggtt

SEQ ID NO: 21103 - DNA, 758 bp, Zea mays
ttttttttttttttttttcgcatgcatgagcgtctgcctatgtatgtaccgtgattttaaaacatattcacctagtcacactaatacatatggcgtagcgagttgtgccgtgggccctgtcgcttgtctttttcatagaaacttatagccgaggatatgctgtcataaaacattagtttgtgattaaaaataaattttctactagttggcagtgatttcattaggtgcattgaacaagcctgcacttttgctacttgtcaacgatgacaggcacctgaaatggcgtcacaagattcgctgcttcagatgttcaacaccagaatgatgagaaaccgaaaattttgaaatttctccttttctgaatctcgaatcggtactgcataatccaacctatgattggtatttgatacaggaaggcctggataggactataggaggcctataaccaagagaaggacctgaagagcagaaaagatccatatatttctcgaatatgcaggaaaactagcagtcggagagacggagaccctagtcgactaaggaaatggcgcctcgaccgctggccttgtgcgcaccgccgaaaggccgctcgacggtggcgcgctcactcgttattgagcgcgcgcaccggtgatgggccccacgggcggtggcgccactcagccgtgatttcactgtcactgacgtagaagaggacagaggaagagagctgtgcacggaggagaaacaaatgacgggttttccccggccaggccggc

SEQ ID NO: 21104 - DNA, 2285 bp, Zea mays
aagacggtgcaaagaatgcccggggaagccggcgagctggagcgtggcggcagcttggaaccggtcgtcctcctccccattggctgccgcgccgcccgcccgcctcctaatttaatcccacccggcctccccgttcgccccgaccgcatccccccttaacctcccttcctcctcctcctcctgcggtcccaactcccatacttcggttcaggaggcaggcaggcaggaaggcaggttcgaggggggattggctccgctcctgctccattgcgcgcgatccggctcgttcttgtgatctatctagccgtttcttgggtcagtgctggaaggtcaaactgttggtggaaacctcaccggggtgcttcaacgaacgcgaaggtgtcgctgtcatttagcgcgtcttgattggatttgacctgttggcctggtggcgtgttgtcgttgattgagctcgaggatgatgaaatgggggctcagcagcggcacgcccgcggattcctactacgaggtacggtcagattgcacggacggtgtgcccaagagcaagttcaagatcaaggctggcaaaacattaagtgctcggaaatggcaggctgcatttagtcccgatggctgtcttgatattgcctcagtcctaagccggatacaaagaggaggtgtccatccgacagtcagaggagaggtctgggaattcttacttggttgtttcgatcccagaagtacctttgatgaaagggaagagatcaggcaaatacggaggatacaatatgacagatggaaggaagattgtcgacagatggattcgcatgttggtagcggtaaagttatcacagcaccacttatcactgaggatggcagacctattaaggatcctctggttttacttgaggctactgccgacaaggacacttcagaagttgctccatctaccagtataaatggaaatgaaattgatgaatctgcagaacgcattaccgataaacaaattatcgagtggaagctgacattgcatcaaattgggcttgacgttttacgcactgatcgtaccatggtattttatgagaacaaagaaaatctttccaaattatgggatattctagccgtgtatgcatggattgacaaagatgttggttactgccaaggaatgagtgatttatgctcaccaatgatagttctactaaaggatgaagcagatgccttttggtgctttgagaaattgatgcgtagattgcgaggaaatttcaaatgcacagatcaatctgtgggagtatccaaccaacttcaacatcttgcatctattattcaggttcttgacccaaagctacatgaccacctagaaactcttggcggaggtgactacctttttgcgttccgaatgttcatggtgctatttaggcgtgaagtatcatttggagactccttatacctctgggagatgatgtgggctctagaatacgaccctgacattttcttcgcaacatgcgaagaacaaggtgcagtacataaaaataaagtttctaaatccaaactgaaaggactgcgccattttggcaagtgggataaggacaaggataaggaagatgataagaatggggctgaggacggtgaagatggtccggttccgatttcagtcttcatggttgcaagtgtcctcaaggagaagagagaaaagctgttacaagaagccagaggactggatgatcttatcaggatattgaacgatgtaaatgggaacttagatgctaagaaagcttgcgctggagcattgaaacttcacaaaaaatacctgaaaaaggtacaagcaaagaaaccttaaacgtgccatggaacacacgtccccaatggggctatcgttaccatttcaacatacacgaccattttctacacacaactttgagtgaagatttatcggacacaggtggtaatcgtctgacatgtcctgagatacacggagactgatggtgccaggctagtgggttgagtacaggatgagcgcaaccggtagtgtgtatatcacgttctttgtactcaagaattttgtacagacagaaggcggtgcggatagcatgccttgcatacataataatttcaatacaggttgaaaacttgaaatcaacacaccttgcgacagaattcagcttcaagaaagttcttctgcacatattgtaaagctgtaaaagtgtacgatctaatgttttcattaatgtacacataccaagagaactaataagatgacctggcatgaggcgtgccctaaaaaaaaaaaaaaaaaaaaaaacagaaag

SEQ ID NO: 21105 - DNA, 2607 bp, Zea mays
gaccaacccaactcgtctcgtaccgtccaagacggggcaaagaatgcccggggaagccggcgagctggagcctggcggcagcttggcaccgatcgtcctccattcccgtcgctcccgacctcctcctaatttatcccgcccgggcacccccccagccgaccacatcccccccttaacctcccctcctcctcctcctgcggtcccaactcccatccttcggttcaggagggaggcaggcaggcaggaaggcaggttcgaggagggattggctccgctcctgctccattgcgcgtgatccggctcgttcttttgattgatctaggcgtttcttggattagtcctggaaggtcaaacggttgttggaagcctcgctgggtgcttcaacgaacgcgaaggtgttgctgtcatttagagcgtcttgattggatttgacctgttggcctggtggcgtgccgtcgttgattgagctcgaggatgatcaagtgggggctcagcagcggcacgcccgcggattcctactacgaggtccggtcagattgcacggacggtgtgcccaagagcaagttcaagattaaggctggcaaaacattaagtgctcggaaatggcaggctgcatttagtcctgatggctgtcttgatattgcctcagtcctaagcaggatacagagaggaggtgtccatccaacagtcagaggagaggtttgggaattcttacttggctgttttgatcccagaagtacctttgatgaaagggaagagatcaggcaaatacggaggatacagtatgccagatggaaggaagattgtcgacagatggattctcatgttggtagtggtaaagttatcacagcaccacttatcactgaggatggcagacctattaaggatcctctggttttacttgaggctacttctgacacgaacacttcaggagatgctccaactaccagcataaatggaaatgaagttgatgaatctgcagaacgcattaccgataagcaaattatcgagtggaagctgacattacatcaaattgggcttgacgtcctacggactgatcgcaccatggtattctatgagaacaaagaaaacctttccaaattatgggatattctagccgtgtatgcatggattgacaaagatgttggttactgccaaggaatgagtgatttgtgctcaccaatgatagttctactaaacgatgaagcagatgcattttggtgctttgagaaattgatgcgtagattgcgaggaaatttcagatgcacagatcaatctgtgggagttgccaaccaacttcaacaccttgcgtctattattcaggttcttgaccccaagctacatgaccacctagaaactcttggtggaggtgactacctttttgcgttccgtatgttcatggtgctttttaggcgtgaagtatcatttggagactccttatacctctgggagatgatgtgggctctggaatacgaccctgacattttcttcgcagcgtgtgaagaacaaggtgcagtaaataaaaacaaagtttctaaatccaaactgaaaggactgcgccattttggcaagtgggataataaggataaggacaaggataaggaagatgctaaaaatggggctgaggatggtgaagacggtcctgttccaatttctgttttcatggttgcaagtgtccttaaggaaaagagagaaaagctgttacaagaagctagaggactggacgatcttatcaggatattgaacgatgtaaatgggaacttagatgccaagaaagcttgtgctggagcattgaaacttcacaagaaatacctgaaaaaggtacaagaaaagaaaccttaaacgtgccatggaacacacctacccaatgggttattcttaccatttgaacatacacgaccattttctacacaccacttttgagtgaagatttacaggacaaaggtggtagacgactgacatgttctcagatatggtaccaggctagtgggttgagtacaggatgagtgcaaccggtagtttgtattgtattgtatctcacgttctttgtactcaagaattttgttggctgtacaggcagaaggcggtgcgggtagcatgccttgcgtacataattatttgaatacaagttgaaatgaacaccatcttacgactggagtgttaatgactttaaattttacactataaaatttaaggaccgaattagattaggtccgaactctatggccggctattgtctagcgagcactagttgatggtgatggaataagtcatgtggtctttgtgtggaggacaacaactctacaacagcatgtgtaggataacatggtagaggacaaaatctctgcagcagtcttttgctgtagtggggcagcaacacgcactgcaacagtgcagtgcacaacagcagcagtgcagtctttttgactgcactatggcagcagcaggcaagcagtacagtgtaacaggcagtgcagtgcacagtagcaacagtgcagtctttttgactgcgctgtggcagcagcagacaggcagttcagtgcagtctgttgactgcactttatcatctaaaggacagcacatatgtgctgcagtgtgtggtgtagt

SEQ ID NO: 21106 - DNA, 3504 bp, Zea mays
gtcattttcaacttagaatcacgaaattgattgtttcaactcttaaactttgtacattaggcttaatttcatctatgaactacacaattggtcaactccaggaccacccacaaacgatcatcactatagttgtttccaacaatttaccaatcctatctcacacctcacctcttctttcgaactttactcacctcttatttcgaacttttactctataaacaatgaaaaaaacagtattttacacggccatatccatatgtacgatctgttgacacagctttaggtagtactagtgtcctccgatgtcgaatcggataacacacctttgacaatattcatattttaatataaatatatttaaatatgctcgaatataaataatcagaatgttcgattataatcgaaacgactagcttcctccctcggccctattgtcaaccactctccctgacagtacggcgcgtataaaaaatgcatacgcttcgtcctttcagtctcgttaaaaattggagaaaaaaagcagaagaaaagagaggcgagagacttgaatgccatgccaatgccatacaatgcgctgcaggctgcagctagccagttctgaaccgaactgccaatcatgaagaaacaagacaagaggatagtccgacgagtgcagccggaaaaaaaggctggccgacgtgggccgcaccgcgcctggtcgcctgcccgggcaataatatctcccgccaggcagccaggccgccacgccacagattatgacgcctaggtcccgctcgcccctccacccatgggccatccgagcagtcaccagtgcttgcttctcccgtacttcttcccggtccccccaccgcagctgagctgcggaactccttactcaccgacacgtaggtcccacccgcttgtggccccgccaccagtgacccaaaccatcagagcatcctgtgcacggagcttcctcctcgaatgcgcactaatggtggtagtaataattgctcattagtttaatgagcagcaggtaggcactgtgctggctgtgctgtgctgtgcctccatcttccgattcccatcccccgtcgtcgcttgtttggtgctgtcttttcctttccgccgcggcaaaagtgaggagcgcgcgggcgagttgggggagacgaacccgtcataactccctcgcttaatcgcgtctcgtgctcctgcctcctgcgtatataaacgcggcaatcgcgacgcccggggaggcgttcgttctccttctccatcccacgcgcgcgcaggccaaggccggatcggcggcctctcagatctcgccggccgccgtgagacagagaccgaagggggggttgaccggtgctcgggaggaagatgtttagcgggacgcagcagaagtgcaaggtgtgcaccaagacggtgtacccgatggaccagctctccaccgacggcgtcgtcttccaccgctcctgcttcaagtgccagcactgcaagtctaccctctcagtacgttccctttgccttgcccatgctcttctctcttctaatgggtaggtggatggatctgtagggtgatgcaatgtagcatcgggtagtagatctgcgaattgccgcagcgaacagatctggtgcgagtttcctagtaccaggaaaaattctacgcccaggagaggtcatgactttgtccgtttcccattcgctaacttggtgaaagaggattgggcagggaatccatgcaaatggacacccttatctgatcttctacttaggacgacccgtcgatgtctaggcaaagataagctgcgctgccgggtctgacaatctccgtcttcatccttttcgcctttgacagctgagcaactattcctcgttcgaaggagtgccgtactgcaagacccatttcgagcagctgttcaaggagaccgggagttacaacaagagcttccaatcacagtcacgtacgctttcattcactaccgaaaccattggcatgcaaatacaagtttttgtgtttctgtgatctgatgctcgtggtgtacttctttcagctgcaaagattactccggaaaagttggcccctgagctggtgagttccagcatgtacgcgttcgtttttttgtctgattgtattttgaaatgaagaagtgacaagtttgtccaaaatctgctatccagaccagatcaccaagcaaagctgcaaggatgttttcaggaacacaagacaagtgtgcgacttgtggtaaaactgcgtatcctcttgagaaggtaattttgatcacattatgttgttgtacttttcattatttcctctcaaaattttgggatgtagcttgtggcatctaattcagtagttcatcaaggtcagtatttgctatggaacatctcagggtcaatcaccatgggttccaatggctttcacaactgaacaaatactcgtccccttctagtcatgttacccaggtcgtgctgacagcctaaattttgctccatttaataataaaaccaaatctttgttcaccttaattcgtctaattatcctttcttgattgccttgagttatcaaaactcttatgtggacagtggttctaatgcatggctgttaaaaacagggcaggtaacagtcgaggagaagtcctaccataagtcatgcttcaaagctcccacgggggctgcgcgattacaccttccaactatgcagccttggagggcatcctctactgcaaacaccatttctcccaacttttcaaggagaagggaagctacaaccacttgatcaagtgcgcgtccgtcaagcgcgctgctgaagcacagccagaacaaccggcctctgattcctcctcctgaccacgccatttaaacagtgggggtttggaggcgagagagttgggaagcctcctgtttctacttaaaaccgcgtgatgtatgttattccatctatgccccgaggatactagactactactctattttggtatcctctgctgtgctagctggatcatatcagcgaaccatggaattgctgtcattttcaatgaaactgttgtgcatcaagtagtgaaatcttcactgaaatcgggtatcttgcctttattgatcaatatattatctatgttgttttgttgtctttagtactatgcaatctcgtcgcgtaaatggtcaaactaaaaggttctttttggttgagttggttgagtgaactttcttttctctagatataggtcaaaaagcgacccatttttgggaggtttctttctcccagaaagggaaattgaagaagctatctcagacaagggttaaggctatctccagtaaactttatatgattgtgcaaaacactgtattgtaaattgcattgtctgtagagtgaaatttaaaataaagtatgcgataggttgaagactcatcatactcacaaagatttttgaagcacgagcataagcctaactacactattaatatctgacctatcatactctcacaaagattcttcaagcacgaacataaagccggctgtaaagt

SEQ ID NO: 21107 - DNA, 1269 bp, Zea mays
gggtacctcgaggccggccggggtgctggggtgccccggtgcctccatcttccgattcccatcgcttgtttgctgctgccttttcctttccgccgcggcaaaagtgaggagcgcgcgggcgagttgggggagacgaacccgtcataactccctcgcttaatcgcgtctcgtgctcctgcctcctgcgtatataaacgcggcaatcgggacgcccggggaggcgttcgttctccttctccatcccacgcgcgcgcaggccaaggccggatcggcggcctctcagatctcgccggccgccgtgagacagagaccgaagggggggttgaccggtgctcgggaggaagatgtttagcgggacgcagcagaagtgcaaggtgtgcaccaagacggtgtacccgatggaccagctctccaccgacggcgtcgtcttccaccgctcctgcttcaagtgccagcactgcaagtctaccctctcactgagcaactattcctcgttcgaaggagtgccgtactgcaagacccatttcgagcagctgttcaaggagaccgggagttacaacaagagcttccaatcacagtcacctgcaaagattactccggaaaagttggcccctgagctgaccagatcaccaagcaaagctgcaaggatgttttcaggaacacaagacaagtgtgcgacttgtggtaaaactgcgtatcctcttgagaaggtaacagtcgaagagaagtcctaccataagtcatgcttcaaatgctcccacgggggctgcgcgattacaccttccaactatgcagccttggagggcatcctctactgcaaacaccatttctcccaacttttcaaggagaagggaagctacaaccacttgatcaagtgcgcgtccgtcaagcgcgctgctgaagcacagccagaacaaccggcctctgattcctcctcctgaccacgccatttaaacagtgggggtttggaggcgagagagttgggaagcctcctgtttctacttaaaaccgcgtgatgtatgttattccatctatgccccgaggatactagactactactctattttggtatcctctgctgtgctagctggatcatatcagcgaaccatggaattgctgtcattttcaatgaaactgttgtgcatcaagtagtgaaatcttcactgaaatcgggtatcttgcctttattgatcaatatattatctatgttgttttgttgtctttaaaaaaaaaaaaaaaaaaaaacctcgcgactagttctcctcgtgc

SEQ ID NO: 21108 - DNA, 3117 bp, Zea mays
ttgtggattttgacttactatagatttaaactgactcaatcccaccgatgcacatggatgatccatatgcattggttaagattgagtcggtttaaatccatcgcaagtcaaaatccatctcaatctattcaagcttgtttggttggcttctttcaatagtctagttgtgtgagctaggaccgctggagtctggcttcggagatgcgactaatctactcttatctggaaagcctggcctaggctactttgaggatcgtgcgagcctggattcaaatctgcgtgcagtcaaccaaacataaagctagcacgcatagagcctggctcacagcaaccaaacaacagctacctacatcccacgatgcaaacatgcaggcaaccaaacagcagctatctacatcccacgatgcaaacatgcaagcaaccaaatagcagctatctacataccacaatacaaacatgcagacaaccaaacacgtcctatacattctaatctacataaaattagaataaccgaaggtctaatgaataattaatatgcaaaattacatatagatactcttttcctaaatacaccctcgctccgcccaccttctcccacccactgcctcgtattctattcccctgcctccccatctccgccggcccgcgccttctccatccagtcgacaccgcacgcgctcgcctcctcccgcggcgtcgccatagggttagggttccggcgacttccctcctttccgcgtcgcggcgaacgccttgggagacccgccccatgtcgtccgacccatcgccccacctcccctcgccggtggccccgccgggcgcggcggaggcggatccccatcacctgccccaacccgccgagccacacgaggtgatgcaccggacgagggccgtcgacttcctcgggcgacgcacgcccatcgtctaccagaacgacaacgggccctgcccgctcctcgccatctgtaacgtcctgctgctgaagaatgtgatcagtctgaaccctgacgctggcgaggtgtcgcagcagaagctgctctcgctcgtggccgagcgcctcatcgaccccaacattgccggacaggataaggacgaggagtatgtttgcaaccgggagcagaacatcgcggatgccattgatcttctcccgcgccttgcaacaggcattgacgtgaatgtgatgtttaggaagattgatgactttgagttcacccgagaacgtgctatatttgatcttcttgatatcccgctataccatggatggatagtggaccctcaggatactgaaactgctaccgctattggatcaaagtcctacaatgctcttgcttctggacttgctgaattcaagtcaggtaaaccaacagaagaaaacaaatatgtggaggaagaaactgttgattttgctgccgcaacaactgcagctttaaagattccatctcccagtgtttctcgtgggagatcgtttgatgaacatactctctcaaactcatcaactgtaccacataaaaggcgaggtgaccttgaggaagaagaggaactgatgagagtcctcaatctatctaaagctaaaagtggggatgtagaagtttcttttgacacttcacatagtcattcatcctccaatattgagacaccacaaaatgagagttttcagtcagaagcactcgagttggtggtggcgacaaaaaaagaggaatatggtaatcacgctacgagtgatcatgtctctatgctatcagtcacaaatgttgctattaatggcagcgaagttgtacccgaagaatcccaagaaaatttgatatctaaagaaccagaggacaatggaataaagaaccttcctcgaccccggccgggttccgtacccactccttatccgtctcatgaatcctttgctagcagtgaccaccaacctgctattcctacccttgttgaaggtgataaagaaacctgcaaagaacagttcgatgtacaaattcatggccagtctaatgatactgaggtcgcttgtgactcatcagttacaacttgtgaagctgttccagatcatgctacaacagaactggatgtgaaaagtgattctttagataattctcagtctctaccttcaagcattcaggaatgtgaaccaatataccaaggtgaagagcacatacttggcaccacaaatatggtgtatgaaaatcaagagccagtgtatgagggggaggtggttcttgctgagcaggctgacaagattggggaaagcagttcttctggggatgacaaggccacagaacatcaatgggaactgattgataattttctgcggaccactgctaaccagctgactgtctatggtctcttctgtttacaagagggacttaacgaaagtgagctttgtgtcttcttccgcaataaccactttaacaccatgttcaagtacaacggaagtctatatctcctagcaactgatcaaggttttataagccaaactgatttggtatggcaaaggttggatgaggtgaatggagatggcgtttttcttactagcaacttcacaccatttaatgctgaaactccaagaaatgattcatggaatgaacagcaagctatgacgagtactgctgattatcttgctcaatttgacaactccacttctggaaactctgatcttgagctagctatagcactccaacagcaagagtttgagcggcaaccacaaaggtttcaagctccaccgcagcagcagcagcaacaacagcaacaaccaccacctcatacgcagtaccagactcaatctggccgaccaggacttgttgttggtccaaggaggtccaacgccccacctccgtccagaagtgaatcgaagaaagagagatgcatcgtgatgtaaaaataccttcaacagaaatgtagaagaaaaagagagagaaggaactcattatactgtaaagaaatgttttcttctgcggaggcagtgtctgcgtttagtcaccttgagccatctcccatttgagtttttttttggttttactttctctgatgtatgtaaataacctaaacgaataaagtgtagaaacagatgctgtcaaagtgatggccccatgcaatgtgatttcattcatcgccccgtgc

SEQ ID NO: 21109 - DNA, 783 bp, Zea mays
gtcggccgcccgggcaggtacgtggaagctgaaactaaggcactaagcagcgtgccggatttttaaggtgtggggtgcgtagaatggtgttatgggatgctacagaagcatgttgttatgggatgatggattcacagtatttaagttgctcagatcatacagtatgctctaacaagcaattcagctgtcagaactttcttgctgcgactgcttcctcgactaaatccctttggtatgggaattaaatcgcatatggcagtttatgggcccatcacctattcagcatttcagatgattgtgcagtgttcacgtaagtcgcgctcttgttgaatccttccagcaccattatccgcaccgcctccaagcccctatgcaacgcaaaatcaagctcttgctgctctttcttgttaaaaggccggagaacgaaattggcaggatccatcttcccgggcggtcgtccaatgccaattcttaggcgtggaaaatcacggctctgtttcaaatggttgacgatgcttctcatcccattatgcccaccatggccaccctttggcagcagacgcagttttgcaaagggtaaatccagatcatcatacatcacaacgacttgactaagtggtatcttgaaatatgaaaccagctgcccgacagactcaccgcttgcattcataaaggtttgtggcttggcaagcataataggtgcatcaccaatgtggcctggtccataataaatcagttttagtgacgaatgctttcaagcatgcatggaattaaaaagaagta

SEQ ID NO: 21110 - DNA, 1344 bp, Zea mays
ggatggaaatatgatcggcatcctttatctgatgaatggaaatacatgtgatgaagcgtattctgatcggctttctctatctggagtctggaccgaaatatcccgtgctctaaacgggatggctgccaccaactgttgcaaacccaacaggagcaagatagtagtactgctgaactatgagagcagacaatatgcaagcatggataaaaacaaaaaagtacgtggaagctgaaactaaggcactaagcagcgtgccggatttgtttggtgtggggtacgtaaaatggtgttatgggatgctacagaagaatgttgttatgggatgatggattcacagtatttaagttgctcagatcatacagtatgctctaacaagcaattcagctgtcagaactttcttgccagggggggggggggcaccgaacaaacgatgcatcaagcgaagctgcgactgcttcctcgattaaatccctttggtatgggatttaaatcgcatatggcagtttatgggcccatcacctattcagcatttcagatgattgtgcagtgttcacgtaagtcgcgctcttgttgaatccttccagcaccattatccgcaccgcctccaagcccctatgcaacgcaaaatcaagctcttgctgctctttcttgttaaaaggccggagaacgaaattggcaggatccatcttcccgggcggtcgtccaatgccaattcttaggcgtggaaaatcacggctctgtttcaaatggttgacgatgcttctcatcccattatgcccaccatggccaccctttggcagcagacgcagttttgcaaagggtaaatccagatcatcatacatcacaacgacttgactaagtggtatcttgaaatatgaaaccagctgcccgacagactcaccgcttgcattcataaaggtttgtggcttggcaagcataataggtgcatcaccaatgtggccttttccaaccattgccttgaactgcatactgctcagagatataccctcagcttctgctataacatcgatcatctcgaatccaacgttgtggcgagttccctggtacacctttccggggttacccagccctacgaagagccacggcttccgcgagccgccgtcaccagcgcccgcggctgatgaagaagatgcccgacaggcgagggaggaggatgggacgcatcttgtccttgcgcggggttgtaagaaaagggaagagggaaggcgggacgccgaggcggcagatggcaaccgcatcgccgtcgctgccgccgtcgccgcagcgccgcagctcctcggagaatgatttggacctttgggatgccgcccccggcgctgggat

SEQ ID NO: 21111 - DNA, 1904 bp, Zea mays
cattgggtacctcgagccccgccggcaatcgctcgaggagagcgtcccacgacaacgatagatctcttgtctccaaattgcccgctgccccctggcgttcccctcccccgcgtcgtcgtctcttctctccccaaaaggatcccccaaaccctaccgccgatccgggcccagatcgccatggccgcccccaacagcaacgacgcggccagcgccagtggcaccggcccggctggtgaggaggacatctccatcgaggcgttggcgcggcgcgtgcaggagcacatgaccctcagttccaaccccgccgctcgccgccacaagttctgggaaacgcagcccgtcggccagttccgcgacgtcgccgacacatcgctaccggacggccccatcgagccgcccacgccactctccgaggtgcgcgccgacccctacccgctacccgccgccttcgagtggctcacctgcgacctcgatgacgacgcgctcctcgccgacctctactcgctgcttgcccacaactacgtcgaggacgacgagaacatgttccgcttcaactactctccggccttcctccgctgggcgctcaagccgccgtccttcttccgggcctggcacatcggcgttcgcgccaaggagtccaagaagctcgtcgccttcatctcgggcgtcccggcccgcatccgcgctcgggacgacgtcgtccgcatggccgagatcaacttcctctgcgtccacaagaagctccgatccaagcgcctggcgcccgtgctcatccgggaggtcacccgccgcgtccaccaggagaacatttggcaggctgcatacaccgcgggggtcgtcctcccaacccccatcaccacctgccgctactggcaccgatccctcaaccccaagaagcttatcgatgttggattctctcgccttggtccacgcatgacaatgagccgcacggtccggctatacaagctgcctgacgcgccgctcacccctgggttccgcagaatggaactgcgggatgttgctgcggtcacacggctgctgagggcttaccttgcgaggttcgtggtggcaccggattttgatgaggtggatgtggagcactggctgctgccgcaagaggatgtcgtggacagctaccttgtggagagccctgagacgcatgaggtcacggatttctgcagcttttacacgctgccctcgtcggtgctgaacaatgctaactatgcaacgctcaaagccgcatactcatattacaacgtctctaccaaaactgcattgcagcagctgatgaatgatgctctgattgttgccaagcagaagaattacgatgtgttcaatgctctcgatgtcatggagaatgagtcgttcctcaaggagctcaagtttggtcctggagatgggcagctccactattacctctacaactaccgtattcgcaatggcatcaagccctctgagcttggtcttgtgctactatagggcagtctaatcaggacagtcctgagtttacaccttcccttccgcagcaggtctcattgtgcaatcccagtggtttctcattttgcctactgtggtagtgattctccttgatatgattgccatggtcactgataggagtcccaagatgatttgcaaacaagggagactggaattagagatatcctttcctcaatttaaggttactgttcccattagtgacatttcgcgtgcatcgtccacaatgtgtatgctggcaccgattttaccgagaaattttgatgtgtattcgaagttgtttgtgtgctgttgtgctatgtctgcacatgtatggatgtcttgatgctagaactgctgccacagctccttcagccctacccaaattttgatggtttctttttattaaaaaaaaaaaaaaaaagtttgcc

SEQ ID NO: 21112 - DNA, 632 bp, Zea mays
tgctaactatgcaacgctcaaagccgcatactcatattacaacgtctctaccaaaactgcattgcagcagctgatgaatgatgctctgattgttgccaagcagaagaattacgatgtgttcaatgctctcgatgtcatggagaatgagtcgttcctcaaggagctcaagtttggtcctggagatgggcagctccactattacctctacaactaccgtgttcgcaatggcatcaagccctctgagcttggtcttgtgctactatagggcagtctaatcaggacagtcctgagtttacaccttcccttccgcagcaggtaatcgttgtgtcgctggcttagtatttgaattttatgattgctataggtgatgattcggttcccttaatgctgtaggtctcattgtgcaatcccagtggtttctcattttgccctctgtggtagtgattctccttgatatgattgccatggtcactgataggagtcccaagatgatttgcaaacaagggagactggaattagagatatcctttcctcaatttaaggttactgttcccattagtgacatttcgcggtgcatcgtccacaatgtgtatgctggcaccgattttaccgagaaattttgatgtgtttcg

SEQ ID NO: 21113 - DNA, 1862 bp, Zea mays
aacgcattttttttctgctggagtgctgatgagggcgcttcgctaattgcgaccctcgcggcccgccgggcggacaagacgagatctacccgctgccccctcgcaacgcattcccctcccccgcgtcgtcatctccccaaatccccccaaaccctaccgccgatccgggcccagatcgccatggccgcgcccaacagcaatgacgccgccagcgccagcggcaccggcccggctggcgaggaggacatctccatcgaggcgttggcgcggcgcgtgcaagagcacatgaccctcaactcgaaccccgccgctcgccgccacaagttctgggagacacagcccgtcggccagttccgtgacgccgccgacgcatcgctaccgaacggccccatcgagccgcccacgccactctccgaggtgcgcgccgacccctacccgctgcccgccgccttcgagtggctcacctgcgacctcgatgacgacgcgctcctcgccgacctctactcgttgctcgcccacaactacgtcgaggatgacgagaacatgttccgcttcaactactccccggccttcctccgctgggcgctcaagccgccgtccttcttccgggcctggcacatcggcgttcgcgccaaggagtccaagaagctcgtcgccttcatctcgggcgtccccgcccgcatccgcgcccgcgacgacgtcgtccgcatggccgagatcaactttctctgcgtccacaagaagctccgatccaagcgcctggcacccgtgctcatccgggaggtcacccgccgcgtccaccaggagaacatctggcaggctgcatacaccgcggggatcgtcctcccaacccccatcaccacctgccgctactggcaccgatccctcaaccccaagaagcttatcgatgttggattctctcgccttggtccgcgcatgactatgagccgcacggtccggctatacaagctgcctgatgcgccgctcacccctgggtttcgcaggatggagctgcgggatgtcgctgcagtcacacggctgctgagggcataccttgcgaggtttgtggtggcaccggattttgatgaggtagatgtagagcactggttgctgccccaagaggatgtggtggacagctaccttgtggagagccctgagacgcatgaggtcacggatttctgcagcttttacacactgccctcatcagtgttgaacaatgctaactatgcgacgctcaaagcggcatactcatattacaacgtttcaaccaaaactccattgcagcagctgatgaatgatgctcttattgttgccaaacggaagaattatgatgtgttcaatgctctcgatgtcatggagaatgagtcattcctcaaggagctcaagtttggtcctggagatgggcagctccactattacctctacaattaccgtattcgcaatggcatcaagccctctgagcttggtcttgtgctgttatagggcagtctaatcaggacagtcctgagtttacaccttccaggtctcactgtgcaatcccagtggtttcctcattttgtctattgtggtagtggtttctttgatatgattgccatgcccattgatgggagtccaagatgatttgcaaacaaggagactggaattagaaatcctttccttaatttaaggttattattcccattagtgacattttgtgtgcgtggtccacaacttgtatgctggcattgattttactgagaaattttgatacaacttgtgttatcgaagttgtttgtgtgctaaaaaaaaaaaaaaaaccatgtatggctgtatggatgtcttgatgctaggacatttgccatagctctttctgccctacccaa

SEQ ID NO: 21114 - DNA, 1082 bp, Zea mays
tttttttttttttttttttttttttttttctttttttttttttttttttttttttgggaacaacaacaacggaacatttttttcaaacttggcgtacaaacaaaaatccaaagtatttttcctgcacaacgtttcatttcacacacaaaaaaaagaccaacattttgacgactttgacgggacaactccagtcacccgacagctaggctttctacttgcgaacgccccactttgccatgcttcctctattatggtctcacatgcagcctgtaccttttggcacgtccatgtgcagtgcagctaagaacacacgatgaagagcttcttcatgagctccacggagggcagtctcttcttcccgacgtcaaccggcagagcttgtccgcacctcagtctccggctgagcaccataagctcctccagcgtcgtggccgcgctcctcggagggctccatggattgtcctcgtcattggccacctcccagctcttctctgaaggcgcccggggaaactggaactccttgtcgtgtgctgaagtatcgccactggagtggctgtagtcttccgactctgaaaacgagaaccagccgtcacgacggccggaggaggagccatctgcccacgctgcagcgccagaggcgtcgctgctgtctggaaaaccaaatgcttccagctcaaaaccaagcgagtattcctcctcgctctcgaccacaaacgggttcagcgagcgggaagatgctgaaaaggcaccgtgatccgggggcagcacatggaagggagatgcttcctgcagaggcttcccaggcttttcttcccactggaatggcacgctcacaacaagctttgtcggggccggggacgggcatgcaaacgctactggcactggcttggagatgacccagtccctcttcggggcaccgggcttcacctcccagagaaacgggactgaagtctgctgcttgacgcgttcccgagggttgaattcgggcagttcaagctccccatccatttttcagatatttggtttggactttggagatggaatttttgttgtgaagctcccgggcccggccggcccctcga

SEQ ID NO: 21115 - DNA, 928 bp, Zea mays
cgggagacacgtacacacaacctatcactgcaatttccaatcataaggttacttattagaacctccgccatcatggatgagctaatcttgtattactgaaaatagaaatggtgacatatattgaatatttcacacatgcatttctaggcgcatcatggtcatcaccaccatgaccacgaagatgattactgttgctcaatatgtgaagaaggctcacagtgtaacttttcataaggattgtggtctcaactcctaccctatatagcatagcttctcttttatttctctgacagtcacaaagtcagcagatttattcatggtatggctatagttttttaaagcaaataatgtaaaaaatgtcaaaaggcatgctgaaaacagaaaagagcatgagatgcagaggatgcaaacattgtataaaaccaaataatacacgatggtctagctcaggtcaggcctctggcagacccgatgaaccccatcatcctccacaggatctcctcaagcttggctaccattctcgcagtaagatttacaccttgcatgagctcttgaaagtatacattgaataaaacaactaaagtcagatgaacttctggtactatgggatcacgaaaaaaatcatcttctagaaatagcatatagataaaaggatcacggatggtaggaatctcacaaacaatgaagaatattatgaaatgtgcaataagattttagatgaaggctctagatgaagagtacttaacaagtcataattcgtcagctcgacagcaacgttggattttattataaagttgacatctttcttgcatagtaaaagcatgaggcagccaaattcgttgaattgatctcaatacttccaagacatagaaattggaacatgtgtcaactctcctctaacatatggtacatcaaaaacaaactcaaa

SEQ ID NO: 21116 - DNA, 903 bp, Zea mays
tttttttgggcggttttttttcctcttttttgttgcagcaccaaatttaagcgtgtaccatagtatgacgattaggcaagttacagcgaaaattgttatagaatagcatgacatgatcgaagtctattatcaggcgacctagttggggatagacagctaagcatgtgatatatacaaggcattgggaggtatactttggccgacacagtccacacaaccatgctcataagcgttacacaatcacaagtgcagcctaattctgtctacaaaagccaaccaaacattccatctacaaaagcgaccaagatgtccatccacagaagctaagccgtcatctgtcacgtgttcaaaccgcgggtttgttgaggcagcataggatccattttgtgaaaccgatcatgatatcgttgtcaacatgcttgtacatcctattagctttcttgatctgaatgtaggagacattgtagacattgccctcctttatcagaggtttgaaaacgtcagtgagtggagggtatatttgagcatgagcactgccagcctcctcgtcgatgaggaccatatgagcatggaaaagcttatactcatcctcgggatcataaatttttcacagacgggagacacgtacacacaaccgatcaccaccaatgctagaatctaaggctttccaaacgcagccatattctcaatcttggaagcgacgataatattttgccaggcagataggcagatgtgcagggatggtctaatcttgtattaccgaaacaaattaaattactgaatttaacatttaatctgaagaagaatgttggtagtctatgatcatccttaatgttgtcctctacgcacgactgcagcaccgcaccgagctacatgcttcttctccctccggccggacccggc

SEQ ID NO: 21117 - DNA, 913 bp, Zea mays
  misc_feature (828)..(828): n is a, c, g, or t
  misc_feature (831)..(831): n is a, c, g, or t
  misc_feature (852)..(852): n is a, c, g, or t
  misc_feature (866)..(866): n is a, c, g, or t
cccttttggagtttttttttttttttttttttttttttttttttttttttttttgactgaacataggccacattaaagttgcagcaccaaatttaagcgtgtaccatagtatgacgattagacaagttacagtggaaattgttatagaatagcatgacatgatcgaagtctattatcaggcgacctagttggggatagacagctaagcatgtgatatatacaaggcactgggagccatactttggccgacacagtccacacaaccatgctcataagcgttacacaagcacaagtgcagcctaattctgtctacaaaagccaaccaaacattccatctacaaaagcgaccaagatgtccatccacagaagctaatccgtcatctgtcacgtgttcaaaccgcgggtttgtcgaggcagcataggatccattttgtgaaaccgatcatgatatcgttgtcaacaggcttgtacatcccattagctttcttgatctgaatgtaggagacattgtagacattgccctcctttatcagaggtttgaaaacgtcagtgagtggagggtatatttgagcatgagcactgccagccccatattaaaatttctttgatctggtatgcagcttgcttcatgtagtaagcaggtcgcgtacctcctcgtcgatgaggaccatatgagcatggaaaagcttatactcatcctcgggatcataaaattttcacagacgggagacacgtacacacaacctatcactgcaatttccaatcataaggttacttattagaacctccgccatcatggccacgcgtccgcggacgcgtgggagaagnagntggagccagacaaagccatanccagcgatgccggntgatggtctacgacagggaattgacggagaaaggaggcaccgccgca

SEQ ID NO: 21118 - DNA, 800 bp, Zea mays
  misc_feature (46)..(46): n is a, c, g, or t
ggccgcttttttttttttttttttttgttgcagcaccaaatttaangcgtgtaccatagtatgacgattaggttttttttttttttttttgttatagaataacatgacatgatcgaagtctattatcacgcgacctagttggggatagacagctaagcaggtaatatatacaaggcaatgtgggaggcatactttggccgacacagcccacacaaccatgcacataaacgttacacaagcacaagtgcagtctgattctgtctacaaaagccaaccaaacattccttctacaaaagcgaccaagatgtccatccacagaagctaagtcatcatctgtcacgtgttcaaaccgtgggtttgtcgaggctggacaacgcagagcaatgcaaatcgaggacacgcgccagtatcaaccgaacgagaagagtatgtcataccgggtaatgaataacgaagaggccagggcacgacacaccaccagcagcgccagctttagcgcgcccgacggcgtactgcacatgcgcgccatgggttgtggccagaacggcgaggtcgctctgcagccgcaggttgccgctgcctaacgggcagagcagccccacgtggtccattgggtgctgggaagggaggacggtaggacagctatggttcgaatacacaacaagggaagtcgagacggcgaccggcaaacagcgtgaagcatcggcggcaccggcgggttgaatggcgcggcggcctacgtagctgactcgccagcgcgcccggctacgggagtgggacgacgcgttcaccccggccgg

SEQ ID NO: 21119 - DNA, 842 bp, Zea mays
cggccttaggggcctttttttttttttttttgactaaaccataatccccatttaaagttgcagcaccaaattaaagcgtgtaccgtatgacgattaggcaagttacagtagaaccagttatagaatagcatgacatgatcgaagtctattatcaggcgacctagttggggatagacagctaagcaggtgatatatacaaggcactgggaggcatactttggccgacacagtccacacaaccatgcacataaacgttacacaagcacaagtgcagcatgattctgtctacaaaagccaaccaaacattccatctacaaaagcgaccaagatgtccatccacagaagctaagccatcatctgtcacgtgttcaaaccacggatttgtcgaggcagcataggatccattttgtgaaaccgatcatgatatcgttgtcaacaggcttgtacatcctattagctttcttgatctgaatgtaggatacattgtagacattgctctcctttatcagaggtttgaaaacgtcagtgagtggagggtatatttgagcatgagcactgccagcctcctcatcgatgaggaccatatgagcatggaaaagcttatactcatcctcgggatcataaaattttaacagacgggagacacgtacacacaaccgatcactgcaatttccaatcataaggttactgattagaacctccgccatcagcgatggcggccgatggtctacgacagggaatcgacggagaaaggaggcaccgccgcaagcaccgcagaaaagggagatgtaaagcaactgaaatgagaaaggagtttaaaaggcatggggaaaggtatagat

SEQ ID NO: 21120 - DNA, 1014 bp, Zea mays
accacaacggcaactgcattattatccgtgttctacgctgtaaaaaaaacaaacaaacaaacttacaggaacaaatgggtctcccttcgtcacattattctacacccaaactaaaacaatattgtatgagtgcaacataatgactgctacccactaacccagccactccactgctgtctcaaagaagaaaaaagaatagagtaactacatttatcgacaattaaggatgcaaaataaaatagagagattggagtcatcgatctgagtaatcatatcaacaactgaccagtcaagctcctcacaaaccggcgtatattatatacaagatgaaaaggcacgccattaaaaataaataccaataacaatgggatcatcatgtcatgtaggggcgctgggtggtcacagggaccttcagtgtcgtcttgggatacacatcttccagcaccagttagcaggtccaggctctgcatcacttgcatttgctttgctttgcttgctctcacatgacatgcccatctgtgctgtcagtcagcctgtgtctgttttatgtcaggcaacagttctccatcattgctaaaaccacctgcctttcttcatggctttgagctccatcactaaccgctccctctgagcctccacctctgcatactgcaagctcatgttcagtaaccgttccttcatatctcttagctctccttccaattgcaaaatcctatcggtattgccctccttgccgtctcccccagcaggttgcccctcaggcatcggactcttctgttgagctctgtacatcttgttttcctccaatgcctctgcgagcttcgtttccaataactcaatttttgactgaatggctgcctggttatctcctccaatctcctgctttccaaggctctctttaacgtgggacatttgctcaaatcccttttccatagtttgaactcttctagtgagatcctcattttcctgctcaagagattgtatcttcctctggtactcactgtttgatctctt

SEQ ID NO: 21121 - DNA, 1244 bp, Zea mays
gacttgtgaatggactcggcgcgctacagcattatcgttatgatgtcgatgtggtcaggtcactgaatactcagctacacacagatttttttttttttttttgtaatgactgacaggctgttttgtgacattttaggtcactgcaaaaggtagtaccaagcctgctgcgatgatcaacagcatgtcgtccacataataatctagataatcaaggatatagtaacaccaaagttgccagggcttgtcaagcacacatctcctgtacaaaatctgcatgcagagtacgagcctcgtatatccatgcaagatgatatgtagcttcccagcctgataagagtcagctagtcctaccgcaaggcagataacctaaagtgctactgattgtcgtatccatccacttcaatctacttctgcaagcatgtgcccacaacctgtgaaatatgatctttaatcttcacgctgatggattcatccaacgccctctcggcaagctcgtacatcacgaaatgaccttccggtccagcaattttctccttcagcaagtacctttgctgcactaggtgttcgagcgcctgcttattgttgccaagaacaaggtgagcttcatcagtctcgttcaaacccacccgcttcaactgatgccagaggtcctcttcgggcattttgccaccagcaagatgaataatgccaatgacagcgaaagcgaagccggacagatgggcggcggccttgtcctcgacgtacttgctgtacacctcagggtctaacatgctgaccagaacatagctcttggcatccgcgttaaactgccgctgtgccggccggccagagcgcgtggccggcgcgcgggtcctttgtagctccctcatctcgtagccgaaggttgcggcgagcctctccttggcctcgttgatgacgagcgtgggcagcgcgcgctggcggtagttcttggtgatgatcccggtgagctcctcccgcttgatggggcagtcggagctctggtgcgtcttgaagagcacgtagcgcatcacctccgccaccagcttgtccttctcctccttagagatgtcgatctgggcgagctcatcgctggtcgccatcgggagagcgcggcgacgggtgttcttggcaggtgtcgccgccctaggatgcgtggaagaggagccgtcgcttggttggcggcgggaacgaatcgagggtcgaggggggtgtggaatttgcgcgcgcgcttgggcggattgggt

SEQ ID NO: 21122 - DNA, 1526 bp, Zea mays
gtgcatctttagaagaggagaaagagtcacttaaagctaaaatatcgaagctgcaaagcaacctaagaatgggccttgaaattgaacaacatttgcaaagaaatgcacgaatattagagaaaagacaggcactgtatgatggattcctgagaaatggattgtccgaacttcaaaggggctccgccgggcaaaaggctgaaattatgaaaatattggaagaagaatcgttgcggttgatgaaagttgttgcagagattcaggataaactaactgaaatttgtatcaacactgaagttagtgaccaccctgccgatgagattcaatgttgtgacagcagttgtaaagatgtgcatgttactaaagatatcagtcctagcacatgtcgtaagagtgattatcctgctgatcttaactccgtgtcgtttgatgaatctaaagcacttgcacaagccttacaggagaagatggaagcacttatgctcttctcacaggaacaagaaagatacctattagagaaacagagagacctgattgttatcgaggaactccagaagaacttatctcaagttaaagatgaaaaggtgaaggtcctgatggaattaacaaaactaaaagaacaatatttgctattgaagggctctgctgtcaaggaaggtcatgatactggtgattcatctaaactcattcctgggcatgaccaacaagggatgctgaagactatgctgaagaggacatctttaagacactggatgaggaaagaaagtaatactattggacatgggagctctgatggaaatgatcatacagtttgcaaagaacattcagtggatgttgcaagattaagagttgaaaatgctatgcttcttgaaggtgttggtactgttgagcatctcacttcttcagtgcatagactgcatattgtgcttttgaaggcttatgatgatatcaagtcagctgatcctttggagagtacctttgaagcgctcaacagtcttataactgaagcaaaccttatgaagacagctcttaatgtggttcttcctgtaagctggtccggggattcatcagatgcaattaaatatgaagctatgtgcgatccatctgattcacctaaatcgaagtctgggaaagtagacccgctctcttctgcaggcatggagatggtggagctactaatattggctgctgagattctcaaggagagctttctggtgaagaaataaggcctccatgtaaggacgagtatggctctccttgtttgtttagaagcatgcaatttaatccttaatttttttgggtgtatatacttaaactgattgctaaaagtgcactactagattatttcggatgtagagaaagagccgaatgtgcactgtaatttacggttcgctgctattgatgtgtcttgtgttggtagactaaaggatttaagagccatgtgtacaaaattcagtttacaagcaaagatcaaaggtggatggatgtttgatatgcaaaaaaaaaaaaaaaaactggtgcgggttcct

SEQ ID NO: 21123 - DNA, 1234 bp, Zea mays
ttttttttttttttttatttttttttttttttttttttttttttttttttttttttgatagaatactgaacgagtgagtgaagcatatcaacgtatcattactgcgtgcgaatgaagatacagtccatatcgaaagtctgacaccacaaactcatattactcgatacttggcactaaactcagccatatggtaaaatctcgatgaatttgctaatcttcgcagaagccggtgcatcaatcgaaaccaccactaagccagtagatctgtaggtacacgaagagggaagggcaagcaataagctactgctacaagactagatccacacaatttccagcttaatacgaacctgtcgagcccaagaaccctaccagatcttgccctccgccgcctcaaaccccagatccgggtccgccaaggaatgacagcagcccttgggccgcgctgctgccggggggcgcgttgggctcgtcgaggaagaggtcctccggcacccggaacgcgccgtgcgccgcgacgagggccccgccgacgagcagcccggagatgatgagcgacgcgacggaggtgaagaaaagcaggatgaaggacgcgccgacgagccccagcagcgtctcgcggtcggaaaaggttcggccgaagaggacaacaggctggtcggaggggcggaagaggtagaggaagcaccaggcggcgaggaggcccaggaggatgaggagcgagaaggggtgcgccaggagcgaggcccccagcgcgaaggcgaccacggcggcgtagttgacgcggaagtaagcgaggttgcgacgcaggcgggaggtggcgtcggagagagagtctggcttcgagaacgccgaacggtcgaggagctctccccacggccggcgatccgacagcgagcgccgcgccgagtcggagatccggctcaggaagagccggaaagccggcgtagcgatcggcgcatcggagcctccggcggcggccggggacgatccggacgcagggttggtcaccgggaggaggggcggcggcgtcggtgcggaggccatggcgtcggggattcagaaatcagaagggagcgcgtctgccgtgctacgggaaatggggaattggggtaaacctcgctgctgttgctcgcgctgtgttgttttgccttcacgagaacatgtggcctcgcctgcctgttttcgtggttgcctcattccggcgacgcggatgttctaggtaatggtctcgtgc

SEQ ID NO: 21124 - DNA, 1336 bp, Zea mays
gatcaaacaatgtatcatactccagtatgattttaaagagaagacatacaccatctaacaacatgtatgaggtaaaatcaatgcatcatcgcaggctacccctcagaactcatggtcagaagactcagaaattatcatgagtttccacaaacatataagtatagcaaaaagggccgcttttcgttctctgttcgaatgaagcatattaacgtatcatcaatgctcgcgaatgaagatacaatccatattgaaagtctgacaccacaaactcgtatacttggcactaagctccatatgttaaaatctcgatgaatttgctgatcttcgcagaagccggtgcatcaatcgaaaccagcactaagccagtagatctgtaggtacatgaagaggaacagggcaagcaataagctacagctacaagactagatccacacaatttccagcttaatacgaactagtcgagcccaaggaccctaccagatcttgccgtccgccgcctcaaaccccagatccgggtgcgccaaggaatgaaagcagcccttgggccgcgctgttgccgggggccgcgttgggctcgtcgaggaagaggtcctcgggcacgcggaacgcgccgtgcgccgcgacgagggccccgccgacgagcagcccggagatgatgagcgacgcgacggaggtgaagaacagcaggacgaaggacgcgcccacgagccccagcagcgtctcgcggtcggagaaggttcggccgaagagggcgacaggctggtcggacgcgcggaagaggtagaggaagcaccaggcggcgaggaggcccaggaggatgaggagcgagaaagggtgcgccagcagcgaggcccccagcgcgaaggcgaccacggcggcgtagttgacgcggaagtaggcgaggttgcggcgcagacgggaggtggcgtcggagagagagtccggcttcgagaacgccgaacggtcgaggagctctccccacggccggcgatcggacagcgagcgccgcgccgtgtcggagagccggctcagtaagagccggagagccggcgtagcgatcggcgcgtcggagcctccggcggcggccggggacgatccgggggcggggtttgtcaccgggaggaggggcggcggagtgggtgcagaggccatggcgaaggcagaaggacgcgcgtgctacggggacggggagatggggaatttggtgtgcgtggggggtggggatccttgctggctcgctgctgtttctgggccccgcccgccccggggcccccgtgcggtgttgttttgcggttttgatttcagtttccgtcccggccggcctcgaggtacccaa

SEQ ID NO: 21125 - DNA, 1216 bp, Zea mays
ctttttttttttttttttttaagttcaatgcatcacacatcactcttcagcactcatggtcagaaattatcacaagtttccacaagcatttatcaagtgtaggaaaaggaagtcccgttcgttttttttttttttgagtgaagcatatcaacgtatcattactgcgtgcgaatgaagatacagtccatatcgaaagtctgacaccacaaactcatattactcgatacttggcactaaactcagccatatggtaaaatctcgatgaatttgctaatcttcgcagaagccggtgcatcaatcgaaaccaccactaagccagtagatctgtcgagcccaagaaccctaccagatcttgccctccgccgcctcaaaccccagatccgggtccgccaaggaatgacagcagcccttgggccgcgctgctgccggggggcgcgttgggctcgtcgaggaagaggtcctccggcacccggaacgcgccgtgcgccgcgacgagggccccgccgacgagcagcccggagatgatgagcgacgcgacggaggtgaagaaaagcaggatgaaggacgcgccgacgagccccagcagcgtctcgcggtcggaaaaggttcggccgaagaggacaacaggctggtcggaggggcggaagaggtagaggaagcaccaggcggcgaggaggcccaggaggatgaggagcgagaaggggtgcgccaggagcgaggcccccagcgcgaaggcgaccacggcggcgtagttgacgcggaagtaagcgaggttgcgacgcaggcgggaggtggcgtcggagagagagtctggcttcgagaacgccgaacggtcgaggagctctccccacggccggcgatccgacagcgagcgccgcgccgagtcggagatccggctcaggaagagccggaaagccggcgtagcgatcggcgcatcggagcctccggcggcggccggggacgatccggacgcagggttggtcaccgggaggaggggcggcggcgtcggtgcggaggccatggcgtcggggattcagaaatcagaagggagcgcgtctgccgtgctacgggaaatggggaattggggtaaacctcgctgctgttgctcgcgccggtgtgaagccttgccttcacgagaacatgtggcctcgcctgccgagctttttgctgtgggcgcactgcacgggcgtgcttcgccacaattcgaacccgccgt

SEQ ID NO: 21126 - DNA, 1595 bp, Zea mays
gtaagttcataactccaaccaaaaaaccctcgtgtcaaaagatttcctgaagaaatccttgtgtgagtaaccataagataacagtatacagctataaccaaatttcagaatcgatttgcaggacatcagctgcaaaatcagcaactggtccgatcccactaaccatttattatatttctcgttttgatcttaaaatttcaacatttttccacttacatcaaaatctgatagagtgatctgaaacaaataaagaccagctcaaaatgattgccacaccagtgtttatttgtctgatagtgggattctacaacaatttttttaaagaatctaggacactgtcacaaaaatactaagtaactgattgttcattcttgcttaaaatcttatttcagacaacatcagcaattgacaagacaaatttcaagcaatatgagatgatcaaacaatttatcatactccagcatgacattaaagagaagacatacagcatctaacatgtatgaggtaagttcaatgcatcacacatcactcttcagcactcatggttcggtttttttatcacaagtttccacaagcatttatcaagtgtaggaaaaggaaatactaatagaatactgaacgagtgagtgaagcatatcaacgtatcattactgcgtgcgaatgaagatacagtccatatcgaaagtctgacaccacaaactcatattactcgatacttggcactaaactcagccatatggtaaaatctcgatgaatttgctaatcttcgcagaagccggtgcatcaatcgaaaccaccactaagccagtagatcagatcttgccctccgccgcctcaaaccccagatccgggtccgccaaggaatgacagcagcccttgggccgcgctgctgccggggggcgcgttgggctcgtcgaggaagaggtcctccggcacccggaacgcgccgtgcgccgcgacgagggccccgccgacgagcagcccggagatgatgagcgacgcgacggaggtgaagaaaagcaggatgaaggacgcgccgacgagccccagcagcgtctcgcggtcggaaaaggttcggccgaagaggacaacaggctggtcggaggggcggaagaggtagaggaagcaccaggcggcgaggaggcccaggaggatgaggagcgagaaggggtgcgccaggagcgaggcccccagcgcgaaggcgaccacggcggcgtagttgacgcggaagtaagcgaggttgcgacgcaggcgggaggtggcgtcggagagagagtctggcttcgagaacgccgaacggtcgaggagctctccccacggccggcgatccgacagcgagcgccgcgccgagtcggagatccggctcaggaagagccggaaagccggcgtagcgatcggcgcatcggagcctccggcggcggccggggacgatccggacgcagggttggtcaccgggaggaggggcggcggcgtcggtgcggaggccatggcgtcggggattcagaaatcagaagggagcgcgtctgccgtgctacgggaaatggggaattggggtaaaccctccccccccggccgggcctcgagggtacccaatg

SEQ ID NO: 21127 - DNA, 1234 bp, Zea mays
  misc_feature (1220)..(1220): n is a, c, g, or t
ggccgcttttttttttttttttttataaggcaaagctgaagcaatagtagatgatcaaacaatttatcatactccagtatgattttaaagagaagacggcccccttttttttttttttttggggtaaaatcaatgcatcatcgcaagccacccctcagaactcatggtcagaaattatcatgagtttccacaaacatataccaagtatagcaaaaagaaatactaatcgaacattgaacgaatgaagcatattaacgtatcatcaatgcttgcgaatgaagatacaatccatattgaaagtctgacaccacaaactcgtatacttggcactaaactcaaccatatgttaaaatctcgatgaatttgctgatcttcgcagaagccggtgcatcaatcgaaaccagcactaagccagtagatcagatcttgccgtccgccgcctcaaaccccagatccgggtgcgccaaggaatgaaagcagcccttgggccgcgctgttgccgggggccgcgttgggctcgtcgaggaagaggtcctcgggcacgcggaacgcgccgtgcgccgcgacgagggccccgccgacgagcagcccggagatgatgagcgacgcgacggaggtgaagaacagcaggacgaaggacgcgccgacgagccccagcagcgtctcgcggtcggagaaggctcggccgaagagggcgacaggctggtcggacgcgcggaagaggtagaggaagcaccaggcggcgaggaggcccaggaggatgaggagcgagaaagggtgcgccagcagcgaggcccccagcgcgaaggcgaccacggcggcgtagttgacgcggaagtaggcgaggttgcggcgcagacgggaggtggcgtcggagagagagtccggcttcgagaacgccgaacggtcgaggagctctccccacggccggcgatcggacagcgagcgccgcgccgtgtcggagagccggctcaggaagagccggaaagccggcgtagcgatcggcgcgtcggagcctccggcggcggccggggacgatccgggtgcggggtttgtcaccgggaggaggggcggcggagtgggtgcagaggccatggcgaaggcagaaggacgcgcgtgctacggggacggggagatggggaatttggtgtgcgtggggggtcgcggatccttgctggctcgctgctgtttgctggtgcctggtggctcccggccggctncgaggtacccaatg

SEQ ID NO: 21128 - DNA, 2406 bp, Zea mays
gtaaatatatcaatataaaaaatcgatataataaatccacaatataaaaaaatgacatagattacaagttcacaattcataatacatatatagtgtgtatatatatagagtatattatattatatttatttatttatattatatatagtgtatgtatatagtatatttacatattatatatatatatatatatatatatatatatatatatatatatatatatatatatatatatatatatatatatatatacatgttcgttacacacacatgcaagcaaccgtcgtagcggaaagaggagcatgaagaggagcatgcatatccatggatgagagggagcgtgctgcctggccggtggtgggtccctcacgcacgtcatgcaagacttaagtatggcagacagtcacaacgtgccttagtaccaccttggaaaatttgaatgagcaacacgagaggaatgttataaaatgagaccacgttgtccaattggtgaggcttgcctgctgtgacctgttggcttcatgggccgaccaattggtgcactaaggcttgcctactcagacctgttggcttcatgggccgatgggctttttttatttcggtaaaattccgagaaaaaaatcggtaaattccgattaaaatcggtaaccgaacaaaacggtcggtaaaatgacataccgatttcgataccgtttctgataaaaaattccgataccgattccgtttccgaataataccgttaccggtgaatttgatcgaaaaaaatcgaaaacggttttcggaattccgaaaaattccgaaaccgttttcatccctagtaaacatcgttaaaccaggtgtcacaagttgctagaaattgaggggcaattgtttgagagtaaccgtgctggagagtgggagaaataatcgaatggggtgggaggaaataaacagcgtcgccgcacagccacaagccaaaaagaggcggcgaccccacaaaacgtgagcgccctcgccgacgcgcgccacgccggatgccccggcgccaatccgcggcacccacctcacttcccccgctccccccgcctcggcctcccccactcgtgcgccgcggccttatcccaaagttgcattgcatccatcgtgcctgatctccctcccaataagcacgtctgtttctccccagctccaagccggacgacgcagcgtagcagcagagagccagagaccagagatggccgccctcgccgccgcctccacggccgccttcgccgcgaagccgcgcgcgcgcctctccgtggcctgctccgccgccaccggcgacagcagcagcgtgtcgctcgcgtcctccgtgaagacgttctccgccgcgctggcgctgtcgtcggtgctgctgtcctcggccgccacctcccctccgcccgcggccgccgacatcgcggggctgaccccgtgcaaggagtccaaggcgttcgcgaagcgcgagaagaactcgatcaagaagctcaccgcgtcgctgaagaagtacgcgcccgacagcgcccccgcgctcgccatcaacgccaccatcgagaagaccaagcgccggttcgagaactacggcaagttcgggctgctgtgcggcgccgacggcctgccgcacctcatcgtcagcggcgaccagcggcactggggcgagttcgtcaccccgggcctgctcttcctctacatcgccggctggatcgggtgggtcggcaggagctacctcatcgccatcagcggcgagaagaagcccgccatgagggagatcatcatcgacgtcgagctcgccacccgcctcctccccagggggttcatctggcccgtcgccgcctaccgcgagctcatcaacggggacctcgtcgtcgacgacaaggacatcggctactactagctgcgcttgttcacctgcttgcactgtgcatatatattgctgctgccgagctgggcgcttggatagtacgtggggaaacatggatggcttttggtgtaggagctgcatgctttgctagggctttctggcattgatggtaaccgatcatggaagatttagttaattaatgtgtgcctttgtggtcttttgcagctgggcgcttggatagtacgtggggtaacatggatggcttttggtgtaggagctgcatgctttgctagggctatctggtcatgtaggacatggaagctctgctgtactttaagagacttgatgaaacctttgtataactcaactgtacctctatctatcccttgtgtgtatttgagaacgatttcagagcatgtctggttcgggcgtctattagggcttgttcatttagctcttaatccatgtggattgagtcggattgaatgggtttgaatcacaaacaagtcaaacttctttttaattttttcccaatcccatccccaatc

SEQ ID NO: 21129 - DNA, 2384 bp, Zea mays
  misc_feature (72)..(72): n is a, c, g, or t
acaagcggaaaaggaggcggcgaccccacaaaatctgagcacgcgcgcccgacgcggccacggcggttgccnctgagccaatccgcggcgcccacctcactcctcgtatgcccggctcacccactagggcaccgcgcgcccccccttagcccgagcgcgtggccggccgggcccaaagctcccgcacaccctgcctgatccctcccaataagctccccagctccacgccggacgcagcagcagcagcagtagagatggccgccctcgccgcctcctccacggccgccttcgccgccaagccgcgcctcccacgcgcgcgcctcaccgtggcctgctccgccaccggcggcgacggcaacggcagcagcagcagtgtgtcgctcgcatcctccgtgaagacgttctcggccgcgctggctctgtcgtcggtgcttctctcctcggccgccacctcccctccccccgcggccgctgacatcgcggggctgaccccgtgcaaggagtccaaggcgttcgccaagcgcgagaagaactcgatcaagaagctcaccgcgtcgctcaagaagtacgcgcccgacagcgccccggccctcgccatcaacgccaccatcgagaagaccaagcggcggttcgagaactacggcaagttcggcctgctctgcggcgccgacggcctgccgcacctcatcgtcagcggcgaccagcggcactggggcgagttcgtcaccccgggcctgctcttcctctacatcgccgggtggatcgggtgggtcggcaggagctacctcatcgccatcagcggcgagaagaagcccgccatgagggagatcatcatcgacgtcgagctcgccacccgcctcctccccagggggttcatctggcccgtcgcggcctaccgcgagctcatcaacggagacctcgtcgtcgacgacaaggacatcggctactactagctgctgcacctgtgcttgcacatcgctgctggcgaggcaaggcccgatccatggctagcggctgttgaacaactctctcttgtttattgataacgaacagtgaaaagattaacgtgccttgtgttcctgtttcttctgcagttgggcagtcgtcgtacgtgggaaacatggcttttggtgtaggaggaaggaatggaagtggtctgttgtacttaaagaaactagatgaagaagtcttgtataactgaaacttcacccctctcttgtgtatgatgtattcaccttcgtcttgaaaattcttgagaacggtttcatcttgcgaaaaaaaaaaaaaaaaaggggcgggccgccgctcccgatgagataaataagagacaataagaattctttgctttcagtcagtattggcttgcttcttaatgtacacctagacctagctccaaaactacaaaagacataaaagggatgagtaagcgccaaccggtgactcatactctcgatgatgaccaatgactcgtactctcggtgatgaccaaagaacataacgaagcgctcaaaatgactagaaatgtgtttgcgagaaaaaactacaaaatcggaaaaaaaattgagcacttaactttaataaaaatcaagggaatgctcaaaccacaaatatatcaaccaactagtgatcacatgttttaaaaatatttctgaagcatacacatgtccaacgaaataaatcgatcacaaaatagacaccaaaacgtctaaaacagtgtttctcgatcatactacattcaacaatctgagtcaaagttatgcaaaatcgatctaaactgattctgattgaactgaaattttgcacacaacttcataagggagtttcaaatatatccaaaaatttgagctcaaagagatttaaacttcaaagtcagataaaaaatacaaatatatccaaaaaaaattggatcaaaagattggaaattcgtgttctaggtggatcagcttatagcacttggtagcaatgatcctaagaggtcctagcacgtttctctccaaagcccaaatgatcccaagaatgtagattcacaaaatcctgcaaaggaagaacttgaagcaaacgattttacacatagatttaacatacagatcacagcgtggttaaggccacactttttaaaaacatggatgcaacaagtccaaagcacctaaaggtctcctcacaaaggaaactagagagcagcagcgaaaaccacagtaaggctatctcaagcagatcccgtatcatatcatctacagttccgcgtcttctatttctcacgttttagcggagacaatgtaactggtaagaaaacttaaaatataggggtgcgccgtcggcaacagtcctcttgatccaaacaaaaataaaaaggctagacaaggtttgttcaccacctgcaggca

SEQ ID NO: 21130 - DNA, 1099 bp, Zea mays
tgggtaccctcgaggccggccgggccgggtctggtccgtcccaaaagctcccgcacaccctgcctgatccctcccaataagctccccagctccacgccggacgcagcagcagcagcagtagagatggccgccctcgccgcctcctccacggccgccttcgccgccaagccgcgcctcccacgcgcgcgcctcaccgtggcctgctccgccaccggcggcgacggcaacggcagcagcagcagtgtgtcgctcgcatcctccgtgaagacgttctcggccgcgctggctctgtcgtcggtgcttctctcctcggccgccacctcccctccccccgcggccgctgacatcgcggggctgaccccgtgcaaggagtccaaggcgttcgccaagcgcgagaagaactcgatcaagaagctcaccgcgtcgctcaagaagtacgcgcccgacagcgccccggccctcgccatcaacgccaccatcgagaagaccaagcggcggttcgagaactacggcaagttcggcctgctctgcggcgccgacggcctgccgcacctcatcgtcagcggcgaccagcggcactggggcgagttcgtcaccccgggcctgctcttcctctacatcgccgggtggatcgggtgggtcggcaggagctacctcatcgccatcagcggcgagaagaagcccgccatgagggagatcatcatcgacgtcgagctcgccacccgcctcctccccagggggttcatctggcccgtcgcggcctaccgcgagctcatcaacggagacctcgtcgtcgacgacaaggacatcggctactactagctgctgcacctgtgcttgcacatcgctgctggcgagttgggcagtcgtcgtacgtgggaaacatggcttttggtgtaggaggaaggaatggaagtggtctgttgtacttaaagaaactagatgaagaagtcttgtataactgaaacttcacccctctcttgtgtatgatgtattcaccttcgtcttgaaaattcttgagaacggtttcatcttgcataaaaaaaaaaaaaaaagaaagcgaagagatggccccgagggccggcctcgagggtcccaa

SEQ ID NO: 21131 - DNA, 1348 bp, Zea mays
ttttttttttttttttacttaaaccaaacacagtcgagacatcatattttctagttgtagttgaggaggtaagtgcttttcccgcaacgattctcgttatgagctgtgaagcccgtgcgcgggctcacggcatgacgtctcagtttaccgagaatgcttggaaaaaaaaatcagtacacggatatgtgaacaacgatatccaatcgaaaaatcaagtatttctgctgttcattagttacgtataccaaacaaaaacaaagtttccaagattcacaagtcgacgccattggtagttatttgagctgcctactgaaatctggtagatcaatgagttggatccttggtatagcctctgtttcttccctctctttctgtgtgttgtatccccatttcaccaggtagaggttccaattgtccagtgctggttctttgatcacattcttcagagtcgctagtcggtcctcgatgaaatgaagttttaggccttggtgctgcagcatttgctgcagctgctggagaactttaaccttcggaccagtgccaaggccatatatcctttcagagggaaagtctattccagccaattctttgagtagcgcttcagcaaatctactctgttttgttgtgactatgtatgcttcggagcttgaaagcttcaatgcatcagctgttccaggataaaacctgttagcacctatccagcccgaaaaatcattttcaatccagtcatctcttacacggccaaagagatctacaagagattccctatcttcttgccactcatccatgagagtgggcttcagttttgaccagttctccaatatttcttggatgctaagcccatctgcaactgatgattttcgaacagagtgtatctggatctcaacaagcaaccttacaagcaataagttttcatatcctgtttccaccactggacgaagggtgtacatctgctccactatccactcctccatggcggcgtcaacctgctcaaacagcgacggccacctcaccttcgcagccttgatggctgagagggagctctccccgcagctgtcgcacaagacgccgtcgaagtcgagggcgtacaggtcgccgcccatcgcggggcgcgaggtcctcgccttccttactcctctctcaactcttccgagaggcggaatggaccgaatgaaataggagcggacacctcgtatcggcaaggtggggcgaccgccccggctacccgcgtccggtagactccccacccacctctccagacggccaggggacggacgcacgccgacgagacgaacgccagccattgcgtgcgtggcgtgaggctgagatgaagaggcaggtgaatgaa

SEQ ID NO: 21132 - DNA, 3190 bp, Zea mays
atccccctgcagcttctcggctccttccttcccttctgctgtctctgccagcagatcgtatagcagtaatagctgcctgctcctacaggaaccctcactgtcgtccgatctgtgtagcgtacgtattgacctcagacggcgtacagtacagtagcgcatgtacattacatatgccgtatgccgatgcgtatagtaggcagcgcactctagtcatggaacgtaaccctcttgaatcttaacccccagcgtgttcaatctgttcttgaggtgacagcaacagcgctgccgctgcagtgctgcacacgggataatgacgggacagtcgggacttccgaaggcggaagaatcaggctcttcaacgtgctgcagacagacttctctcccgtagattctcactgcctgcgctgcgcctgcacactcctggtgcatcggatcggatgtagttttatcgggggtgtttggttacacccagctaaaatttagcctctgtcccatcgaatgtttgaacctccgttacgggtattaaatatagtcagattataaaactaatttatcagctgaagattaaaagacgagacgaatctagtccagttggttgagtctatatttcatactcctatttaaaagtcaaacgcttaatgtgacccgggctaaactttagctggcctgagactaaccgcagcgcaaccccctacgcagccccctcccattgcatgcggcgcgtagggggcaccctatagccgcagcggtgccccctacagcgtcccctacgtgtcggtccccttctctctccccccagatttagcgtgtcactgttcatcacccttaacactgtactgtgggtccacgagtaattgttagtagataaaaaattgatagttggtatagaaaatgatattttatagtggtagtggggtatagggggagtatttagggggaaccgctgcgggagatgaaaaaataggggggacaatagagagaaaaagtgatatagggggaaaaatttaggggtaacggttgcggatagtctaaaacccatggcaaacccggctccggcgagccggcgggcgacacgttaaccacggtggccggatgcgcgcgtgcccgtagcgaaactccgttgcacaaaaatagtttacctttgatacccttcaccctcctcgacgtcgcatctccctttccttttctcccactgcactgctgctccgctgccgctaccctttccctctcccttctcgtcctcggtcctccccaacccatggccacggccaccaccacccactgccccttctcccaccacgctatttatcgcggctgcacgactcctgcccatcaggcgccatagagacgcgtgggaccgaagccgccgatcaagcgctgctcggggcggagcagcggccggcggtggtgagtgctggcagacaggccggcaggtcaggcagagtgaccagctggtgagtcgaagcttgagcggggagctggactttggcgggttccggcgggctccggagcggagatggtgctggatctcaatgtagcgtcgccggcggactcgggcacgtcgagctcgtccgtcctcaactccgcggacggcggcttccggttcggcctgctcgggagccccgtcgacgacgacgactgctccggtgagatggcgcctggcgcgtccacggggttcatgacgcggcagctcttcccgtccccgaccccgccggccgagccggagccggagccggtggcggcgccggtgccggtgtggcagccgcagcgcgccgaggatctcggcatggcccagaggccggtggcgccagcgaagaagaccaggcgcgggcctaggtcgcggagctcgcagtacaggggcgtcaccttctacaggaggacgggccgctgggaatcgcacatctgggattgcgggaagcaagtctacctaggtggttttgacactgcgcacgcagccgcgagggcatacgatcgagctgcgatcaagttccgcggcctcgacgctgacatcaacttcagtctgagcgactacgaggatgatttgaagcagatgaggaattggaccaaggaggagttcgtgcacatactccggcgccagagcacggggttcgcgaggggaagctccaagtaccgtggcgtgacgctgcacaagtgcggccgctgggaagctaggatggggcaacttcttggcaagaagtacatctatcttgggctctttgacagcgaagttgaggcggcaagggcttatgacagggctgcccttcgcttcaatgggagggaagctgttactaactttgagcctagctcctacaatgcaggagataataacctgcgtgacaccgaaaccgaggcaattgatgatggtgatgccattgatttggatttgcggatttcacagcctaatgtgcaagaccccaaaagggacaataccttagctggcctccagccaacatgtgattcccctgaatcttcaaatacgatggcttctcagccaatgagctcatcatccccttggcccgggtatcaccaaaacccagcagtgtcatttcaccatcagcgcttgtactcgtcagcttgtcatggcttctttccgaaccaccaggtccaggaaaggccggtggagcgaaggcctgagctgggcgcccagccattcccctcatgggcatggcaagcgcagggctcccctcacgtgccgttgcaccactctgcagcatcatcaggattctctaccgccgccggggccaacggcggcatgcccctgccgtctcacccgccggcgcagttcccgactactacaaacccgttcttcttcccctagaccgcttttgacatgacagcttgctgttccggctcagctctcggcgtctgggatggcagctggtcttgcgtgtggcgtctagcagctctggtgatggaagaaagtgattgtgttttgtgtgtgtgtgtgtgagagagagagagagccataataagaagcgacatggctggtctccctctggtatgtgcctgttaggatatgggatatctccatgcatggattgtttccgagacagtagtagtattttgttgtagtcgaccatgcgtgtacatcagtataactggatctttgaagagctgagattttatgactcaacaagcattgacataatggcatgcactccaggaccactaagcaaaaaaaaaaaaaaaa

SEQ ID NO: 21133 - DNA, 1432 bp, Zea mays
tcgggaggctccactggagcacatctgcagctgcagccaggaaacgttttttttttttttttgttgacagaaccgccaaagaagaacacgatggtaatagcctagtaggtctttcctttgctgcattctttcgtgaacaggagacgccgcagatgctacgtagtagtaggccggtggttgggtcaagggaccaagtaccaaccacacaacactcaacagctactgcctatgagtaaagatgccatatccgtcttcgccgcaagtacattgaagatagtactcacagtcacagggagagggggtggaggagacaaggcaacacagtcaaagaactcgatagaaaccagagctcatcatcaggccacagtatacctatagacgtcgctggaagcaccaggatgattgatctgtacgagttcaggctctcatggcgttccaaggatccatcgctgggtcaagtattttgctgcgtgcgctagtaagcagaccgcgaaacagtgggctcttggaaactgcgagacaactctcagggctacaacgtttgatgagagaacaaacatctcaacaatgaatataacagatgacggaaactcccaaaccatcattgtgaaaagaaacaacttgaagtagcttgaaatgatgacagcgaacagaatatccctataccttataatatcgaaagataatttgagaaaaaatcgcactcccaggagtaacatgaatataaatacgatgtttcccaataatgcatcgccaacaacctcagtgcaattggaaactgttgagaaaatgctcctggaagaagccccaccagctctgtttcctttcgaaaaagatattctgaatgtgtcaagagcaatgtgtatcaaagtagaccggtaaagtattcccttgtcaacggatgatcccatgctcagcttattaaacagaacatggtggtacgcccttgtcttgtgcaggacgagatcaatcaagatgatcatgaactcgcactcgatgtagggatcagcaacagccttgcacttatcgcatttcatcaagcggatgttgcccggggagtactgcacgaagagcgtcttcacgcgcccgccgcagccaacgcagcgcggaccatcccctgtcgcctgcgcatcgctcatcggtgattccttccgccaccgcacagcctacctcgtgcagcccaggtccagtctccccctcaggcctcagcgcctccgccctatcccaccgggctccgccgttgagcttcggataggcacgacggagtggttgagacagtgtcggattccggtgcaggcgtcgtggtggtggcaggctggcggcggggcgtcgcccagacgccggcaggtgcgcagtggcggacggtcaggtcgcggtcgccggccgaaaagctacacgagaaggaaaggaaataggaaacaaaacaaaaggc

SEQ ID NO: 21134 - DNA, 1163 bp, Zea mays
tttgttgtggggagttgtgagagtggtttgttgtcagggggatggccatgtatgactacaacggaacatacctataatgtatcagcaccaagaagaataaattcagcagcatcattgccaatctccacaccaccaaaggcagagagagactgtccatcagcaaactcttctttcatcatccttgctatctgcatgactttagcaagtgctatagggtgcacagctcttgcagagtaacccccaggtgtagaatacccttcaacacaaggttccggacgcaatgtcttgagattaatccccattacactcataattgtgttaatcgcagaaactccttcacatccagacttaagagatattcttgcaggctgtgtaatgtctgtaatgttaggagtcatctttgcccaaacaggaaccagtggccttctcattaatccaaccacaaacttcctctagcaaatcacaatcttgccccacagcagcacccatttttctctctggcataccatgtggacatgagaaattaatttcaagagcatccactccagactcttcaacacgttcaataagctcatgccatgcagctttgttgtactcctccataattgaaccgataagtatcctgtcaggatactctttcttcaattgcttgaactcattcagcatggtctccagaggcctgtcactgatgagttcaatgttctgccagccaatgatgcgccccatggcagccccatttggttctgcccgaagctttgcataacgaggagtaacgttgataactttttcagcatccaatgacacagtcttggcgatgacggcgccccagccctcgtcgaaggcgcgcttcatgacggtgtagttggtgcccggtggccccgacccgatcacgaacgggttgggcatctgcagcccgttcacgcgcacggagaggtccggctcgccggcggaggccgtggcgcggacgtacgtcgcgcgctgccgcccggggagcagccggcgtcgctgcagcggcgaggcggccgtcgaagcgcgaagcgtcagcgattccatggtgcggtggtcttgttttgtttttttttttttttttgcgacggccgacgggctcctctgtttggtaagaatctgagggagtatccccccggccccgcccggcccccaat

SEQ ID NO: 21135 - DNA, 686 bp, Zea mays
aaacctcctgagaaaacctgtacgggattgaagtctccaagattttacaaggtcaagccctcagctcagtgctacaaattaatgttcacatgacaaatatatcgctcaatgtcacccgttgtcacgactttgtgtggattcatggcctgttctatagactgaaggcccaaggttcagaaccatgtacagatgaggactagatgcttggtgtgtggcatttctggtgcgcgtttattaaaaagatgaagttggagcatggtggagggaatggcccagatgcatcagttggataccatgctttcggtctccttgacgaacccatcacccgtccagtccttgtctgattgaaggcccttcttgatggccttcctctgcctgaccgcctcctgttgccggtgaaccagatctgtgtgcgtcgtgaaatacggaagcgaggcccctcgaaactcttcaattgatgaaaagttgtgctctctcatgaaatcctgtaactctgcgcaaagcttcttcacaaggggataaccatgaatcatcacaccggtgcatacctgtaccgcggccgcgcccacgcgaataaactcagcagcatcattgccagtctccacaccaccaatggcagagagagactgtccatcagcaaactcttctttcatcatccttgctatctgcccgccctatgcaagtgc

SEQ ID NO: 21136 - DNA, 1732 bp, Zea mays
ggccgctttttttttttttttttcctgctgaagctgaggccagcatgtcctcacacatcactcacgtataattataaactcctgagaaaacctgtgcgagattgaagtctccaagattttacaaggtcaagccctcagctcagtgctacaaattaatgttcacatgacaaatatatcgctcaatgtcacccgttgtcacgactttgtgtggattcatggcctgttctatagactgaaggcccaaggttcagaaccatgtacagatgaggactagatgcttggtgtgtggcatttctggtgcgcgtttattaaaaagatgaagttggagcatggtgtaaggaatggcccggtggggggtggcagagatgcatcagttggataccatgctttcggtctccttgacgaacccatcacccgtccattccttgtctgattgaaggcccttcttgatggccttcctctgcctgaccgcctcttgttgccggtgaaccagatctgtgtgcgtcgtgaaatacggaagcgaggcccctcgaaactcttcaattgatgaaaagttgtgctctctcatgaaatcctgtaactctgcgcaaagcttcttcacaaggggataaccatgaatcatcacaccggtacatacctgtactgtatcagcaccaagaagaataaactcagcagcatcattgccagtctccacaccaccaatggcagagagagactgtccatcagcaaactcttctttcatcatccttgctatctgcatgactttagcaagtgctatagggtgcacagctcttgcagaataacccccaggtgtagaatacccttcaacacaaggttccggacgcagtgttttgagattaatccccattacactcataattgtgttaattgcagaaactccttcacatccagacttaagagatattcttgcaggctgtgtaatgtctgtaatgttaggagtcatctttgcccaaacaggaacagtggccttctcattaatccaaccacaaacttcctctagcaaatcacaatcttgccccacagcggcacccatttttctctctggcatgccatgtggacatgagaaattaatttcaagagcatccactccagactcttcaacacgttcaataagctcatgccatgcagctttgttgtactcctccataattgaaccgataagtatcctgtcaggatactctttcttcaactgcttgaactcattcagcatggtctccagaggcctgtcactgatgagttcaatgttctgccagccaatgatgcgccccatggcagccccatttggttctgcccgaagctttgcataacgaggagtaacgttgataactttttcagcatccaatgacacagtcttggcgatgacggcgccccagccctcgtcgaaggcgcgcttcatgacggtgtagttggtgcccggtggccccgacccgatcacgaacgggttgggcatctgcagcccgttcacgcgcacggagaggtccggctcgccggcggaggccgtggcgcggacgtacgtcgcgcgctgccgcccggggagcagccggcgtcgctgcagcggcgaggcggccgtcgaagcgcgaagcgtcagcgattccatggtgcggtggtcttgttttgtttttttgcgacggccgacgggctcctctgttttggtaagaatctgagggagtatcaccccggccggccgccgagccccaccccccgatggagt

SEQ ID NO: 21137 - DNA, 2880 bp, Zea mays
attttaatataggatagagagagtatttttttaagacgagtggattgacatatttgatggaaatatatacattaaatattgtatggagatacacaaataatggggtgtttttttcttaacttgatcgatcagcctatattcatgtagccgaagctgggaagtggggatgtggaatacagccaccgacattttgttcacaatgtccgaaaaagggaaagaataactttttcctttgctcatttggcaaaaatacacgcaacactgactcctgtgcatcggctctgcaggcgggccctacaaatactccctgcctcccctgctttcttccacccaaatttgcttcccagatctgccgccgcacccccaacccgtggcaatcaatccccttcctcgcttcgcaaatggctcattccaacggcgcggccgccactgccactgccggcggcggcgacgtggacgacgagaccgccccggtgccgcgggccctcgcgccggcgcggaaggtggcgctgatcacgggcatcacggggcaggacgggagctacctcacggagctgctcctgtccaagggatacgaggtgcacggcctcatccgccgctcctccaacttcaacacgcagcggctggaccacatctaccacgacccgcacgcggtgccgtcggccccgcgtcccccgatgcggctccactacgccgacctctccgactcctcctccctccgccgcgcgctcgacgccatctcccccgacgaggtctacaacctcgccgcgcagtcgcacgtcgccgtctccttcgagatccccgactacaccgccgacgtcaccgccacgggggcgctccgcctcctcgaggccgtccgcctgtcgcgcaagcccatgcgctactaccaggccggctcctcggagatgttcggctccacgccgccgccgcagcgcgaggacacgcccttccacccgcgctcgccctacgccgccgccaaggtcgccgcgcactggtacaccgtcaactaccgcgaggcctacggcgtattcgcctgcaacggcgtgctcttcaaccacgagtccccgcgccgccggcgagaacttcgtcacgcgcaagatcacgcgcgccgtcggccgcatcaaggtcgggctgcagaccagggtcttcctcggcaacctctcggccgcccgggactgggggttcgcgggggactacgtcgaggcaatgtggctcatgctgcagcaggaacagccgggggattacgtcgtcgccactgaggagtcccacaccgtcgaggagttcctgcaggctgccttcggctacgccggcctcagctggaaggatcacgtggtcattgacaagaagtacttccggcctgcagaagtcgacagcctcaagggggacgccaccaaggcgaggaaggtgctcaagtggaagcccaaggttgggttccaggagctcgtggagatgatggtcgatcacgacattgagctcgccaagaaggagaaggtcctggtggatgctgggtaccgtgatcccaagcagcagccatagaaacatcacagttgcttcttgctctgttggggctcggattcagattgttcccctcatacatggtggttctcaggggtagaggttgaccgaagttactatcgatatttatcctggtaagaaataaggattgttgcagtatgatcttacagtgtgttcatttagttttctgactatgttatgtgctttaatcgaatgaatgaataatccgtgccaatttggtatttggaagaggatgatatgcctgcctgattgcagctgttgatgttaagagcaaaagtgtcctcctgatagcagctgcttcagtttgtattgttccacttcagctactcccacacttgttctgatacatggcagaaaagctgttgtagggacattttgtaagttgaatcagtggcaaatgcatccaacaacacttgcagttgaagaggggaacaaacaaaaggaaacaaaaaatagcacctaactctacctctacctgtgcagggagagcaattttaccattattatcaatggatttaccatgttggagtcacttgagttctcaatcttggtatgccgtgtcacttgagtcccccatcgtgcctcgcctcccctgtcacttgagtccccgaatgcttcaacgtgacacgtcacgtcgtcatctggtttggataaatccggtgttggatgattttgcttggatcggctaagttagatgatccgttttgctcattttctgagttcggtgacccaagttacacatcgtgtcaagttccagagccgttgctgcattttactctataatgtttatatctgtttttataggtttaattttataaaaaagtgtattcagtcacccccttgtgtggccatcggtaaggacaaaagacggtgagaagacaacatgatgaacaatgggagactaggacatctttgattggtgcctagtttgcatgtctaaccatagttaaagtacaaacttttgataaagtttgtcacaaaaatgagtcaacgacatgtagtacatggtgctttgaaagtggtgcatcattgttgttaatacgtgacaccatgataaagggtaccagagaaaaaaatacagaggtgtaggtctggaaccgctagcgctgacatgacaatatgcatacaacaatgtacggtgtagagaggtttagactcggtgtatatgtttatatgcaagtacgaacaaagcatatatacatagatcatgactgagctagcaaatgggaacaactcatgaatgctaataatcttccctggtgtctgtagtcgccgatcatcccgagatacgatgaggcgacaagaggggaaaatggaagccaatcaattttttgctgtcaaata

SEQ ID NO: 21138 - DNA, 2266 bp, Zea mays
  misc_feature (2130)..(2149): n is a, c, g, or t
  misc_feature (2153)..(2157): n is a, c, g, or t
  misc_feature (2159)..(2163): n is a, c, g, or t
atccccggtgcggcgcagcggttcctgcctcgtgcacgtctgtatacaccggcgcccccggcccccgccgcggaggaggggggaaggcagccagtcagccagaggagcctagagccagtcccgtcccgtccatcagccgccacaccacaaacacccaccactctgctctcgcccgcttgctttctctcccccgctccagcttatggcggaggcggcgccagcagccggcggcggcatcggggacatcctcgccacgagcgatcgggacttcctcgtccgcaactccggcgagcaggtgaagatcagcagcgttgaggcgagccctgtggccatctacttctccgcctcatggtgcccgccatgcaggaggttcacgcccaagcttattgaagtatacgaaaaactggcctcacagggcaagagcttcgaggtcgtctttgcttcggccgatcgcaatgaggaagctttcaatgaatactttgcaaagatgccatggttggctgtccctttttctgacagtgaaggccgtgaggcccttgatggccggttcaaggtctctggtatcccacaccttgtcatccttgatgcaaaaactggtgaagtttacactgaagatggtgttgaattcgtgagtgagtatggcgtggaggcttaccctttcacaccagatcggatcaatgaactgaaggaacaggaaaaggcagaaaaggagaatcaaactattcaaagcgtgcttggcacatctactcgagactatctcatttcaaacaagggagacaaggtacccatctctgagcttgaggggaagtatgttggtctttgctttgtggtggatggctttccaccactcgctgaattcactgaggtgcttgctaagatctatgagaaactcaaagaagtgggagagaaatttgaagttgtagctgtatccttggacagtgaagagtcatcatttaatgagagttttgcaaagatgccttggcttgcaattcctcaaggtgacattaagtgtcagacgctggttcgttactttgagcttagttctcttccaacactagttctgattggccctgatgggaagacactgaacaacaatgtcgccgacataattgacgaccatggttttgaggcatgggagggcttccccttcagtgctgagaagctggaaattcttgctgagaaggcaaagattaaagctgcatcacagaccttggagtccattctaatcagtggtcatttagactttgtcattggaaaagatggtgcaaaggttcctgtatcagaacttgttgggaagactgtccttgtttacttctcagcaaaatggtgcccaccatgccgtgccttcctgcccacacttgtcaaggagtacaacaagatcaaagagaagaacagtgattttgagatcgtcttcatctctagtgacgaggatcagagctcattcgatgattttttctctgaaatgccatggcttgctgtaccctgggaagatgaaaggaaagcatcgctgaagaaaaccttcaagatccgtggaatcccttcacttgtcgccatcggacctactgggcagacagtcagcagggacgcaaagtcccagctgatgatccacggtgctgatgctttcccattcaccgaggagagacttgaggagctacagaagaagctggatgagatggcgaaggggtggcctcagaagctgaagcatgagctgcatgacgagcacgaacttgtcctgctgcgccgtggtacgtaccgctgtgatggttgtgacgagatgggcagcagctggtcctacaggtgcgacgagtgtgactttgacctgcaccccaagtgcgcgttgggtgaggaaaagatgagtgaggaagcccctgctgggtatgtgtgcgagggaggcgtgtgcaggaaggcctaatctgaatgctgtgaaggatgacaataatcgtgagatggctgtgctttgatgtgaggtttttcggccgttgatgtttgtgtgttaataaatagtagttgcaggagcatatgtgtgtatgcaaaactatgtgagtattgtgtcagatcaaagtaatggttttgctgcatggtatttctggtcttaatcatatgatgttgttggcatttttttgccttatnnnnnnnnnnnnnnnnnnnnatannnnngnnnnncggccgttgatgtttgtgtgttaataaatagtagttgcaggagcatatgtgtgtatgcaaaactatgtgagtattgtgtcagatcaaagtaatggttttgctg

SEQ ID NO: 21139 - DNA, 1218 bp, Zea mays
ttgggtacctcgaggccagtagtcatcgacgtcgtcccgaccttcttttcaatcccgtctcggattcgttccgtctcagctaccgcgaccacgacgccgacgcgagagggcagggaacacagccactcgccgacgagaccccggcgcgcgcgagagaaagagaagagaggaggatcttttgttcgtgaaaaatattggaggcggagggaaggtgaaggagggggatcggagatgaacgtgttccggctggcgggggacatgacccacctcctcagcgtggtagtgctgctcctcaagatccataccatcaagtcctgcgcaggcatatctctgaagacacaggagctgtatgcacttgtttttgcagcacggtacctggacctgtttgttcattttgtgtctctgtataacactgtcatgaagctggtcttcttggcaagttctttctcgatagtttggtacatgaagcggcataagattgtgcggaggacatatgacaaggatcatgacacctttcgccattacgttttagtgttgccttgtcttcttctggctctcctcattaatgagaagtttacttttagagaggtgatgtgggcattctccatttatttggaagctgtcgcgatatttccacaacttgtgttgctacagcggacaaggaatattgacaacctgactggccaatatgtcttcttcttgggtgcctaccgtgtgctttatatccttaactggatttaccgatacttcactgagccccattttgtccactggataagttggatggcaggaatagtgcaaactctgttgtatgctgacttcttcttttattacataatgagctggaagaacaatgtgaagctagagctgccagcttaaggttgctgctcctgtccccaagatatagtagggtaatatatcagataggcaggccccatacacagcatgatcattgctatcgccaactgggttatgaaaaaagcattttagttgcgtggcttgtatcgccttgtatctctctgctattgttggaagaacaggaaagtcaggctcaccatgtaactttttacaataagctgcgtaagatcagcactagaaggttgtgaattgtgatcgtccttagggaattttgtgctgatgtaaccctttcggcaagtgattctcatacaatataatctcagactataattggtaattgtttcaaaaaaaaaaacaaaa

SEQ ID NO: 21140 - DNA, 3079 bp, Zea mays
  misc_feature (11)..(11): n is a, c, g, or t
  misc_feature (67)..(67): n is a, c, g, or t
  misc_feature (2866)..(2866): n is a, c, g, or t
  misc_feature (3061)..(3061): n is a, c, g, or t
atattacaatnctgctttttgcatcctctatcggctcatggtggataatctgtatctagttaccctnccacatctcagatttatcactctacatacatacacgatagcatacatacccccccctcgggcggcgcagccctcagggaatggattgatatacatatacagaactcttgcttgacctattggctaatttgatctgtttgacactctggacgagtaacagcgcgaccacccgcgatggagctcatcattatcttgccgggcttctgcggtgcgagaaccgaggcgggttcttcgtgcctgccctagcattcttggccgctttccttggcccggggcagtagaaaaatgatctggggcacctctcacacgtttcacttggagctcttctttccccaccatcttttccgcgatttatcatcatgggtgccggtgccaaccttattaaggtttaccttcgtctccttcagccgagatttgtagtcttttttccatgtttcaaagcggtccttgagcttccggagttcctcgtctgggttcgtatttgaaccaacctggccggacctgactgcgacaaggaagcccgcgtcgtcttcgaacacctgccgtctgtcttcaaactccttcgctaggtggttcacagcgtttactcgcctatccgagtttcctgctgaaactttagtttcagggttgtggttgtggttgcggtgcctcgacgccgtctctgcgccccccggcctccccgcgggcgccccgtcgccgccgtcgtactgggcatgtgttggagtaaaatcagtctgagcagttctagtagccacatcggcagcagctaggctcttcttagcagcaacaaggctcagctgcagagaagagagctgtctcttccacgcctcttccatagatttcattttggcctcatattctgaccatgtactctcatactgttccaattgctgtttcagcatcacattttcttcttccttgtccctcaatacagcctcagctttcgtaatccgaccctgaagctcagtgatgactggttcatgaggataatgcccattcattccatggcatattcttgactcagcattattcttccttgtttccccttgaactatgttgtgactggcctctgactccttttcattctgcaggcacttgtatttccttctagccaggcacccacgcatcacagactgaagaagaatgatatgattcagttgatcattaaacatgttagctgcaagtcgacgcctagtgtacttctgtattagaacagctgccctccatctcttgacaagattatcaaagtgtattcttgctctttcaccacgtataaatgattgcaaattcattgccactttcttgagtcgttgatatccctgacgagaatgcataccccggaagtgtttctgaatacggagggttccgtgaagcatctgtattttagtattttccagtgcagcaacctgtcctgtacggaaaaacaattttgtgtagccaacttgatacatttcagggggaatgttcaactgttgcaaaacagcaactgaaacactaagtgggtcttgagatgcaatcgaacgcaagagaagcagcccgtatctttcagcaaactgttggtgagtgatcctagttggatagcatgttcttgatatccggacaacttcaagcaccccacagcatttaagctggtgcaagataagatcatgctcgaataacctgggaagttgtttgctatttggttgaatgcatcgaataaaatgtggggttgtactctccaactgctgcatcagcttgaacagttgagccttaaatttcgtgacaacactttgtttctgtgtatccattactgaatgccatgacagacttgatttattctgagaatcagcaaccatgacagaggcaaaatgttttggaagttcacatttacatgatgatagtagttggattgattcagagtgcagtggatctctgttcttctccaggaacccagctgtatcatatgtcacctcccctgcataatggcaaatcttaaatgtgccttctttttcacctttgaagcaagagttaccacttaattgctgcctaagcttgttagcaaaggaaaagtctgttgcctttgggaaagtagactcttcatccaataatgacaatagccctagaggtttcttttcaaaaagagataagcaattagtgttatccacaaattccatgggggtccaatcaattccgtcttccaagtattcctcctgatgtagtttgaaaagatgtggggggggggggggggactagtgtgcgcttggcataatttatacaaaattgctcaaaaccattcttattgaaacactcaaacccataaatatccaaaatacttatggatctccatgtaaattgcctccctgttccaagtgagtggttaatttggtcaacaatccagtcaaataaattggcgtagattgacttcgctagtgcatctcttgcgtcaatggcctgagttaatgtcagctttttaacaatactgtcatttccagctcggatcttacgagtggacacggcagacactagttgatttgcagtgcagcctaatagctttgcagcagtagccaacccttcgtttgagacaacttccacatggttttcattatcaatcacagagaatgatatgtttcccagccacaagacagctgcaagcatagaaaataatttcatttggtcttccttagatatttgaattgtatccaatgcatccactagcactgtgaatttttttgaatcgtcaacaccattgattttcaagcaattactctgcttcaagtaattgtagtcacttgcgctttttagagacaacttttctgcagtnagcatgtgcatgcaacggaattagaaagcgagaaaaagagagggacatatagatgtagtaatacagacagaatgtggcacacaattttcttgacagaagcaccatttaaaacacttaaattgtaggtatgattacttttgagaagtggaggagctccagaacatagttgatagaaaatatggtaagatctctctncttgtgcccttgaaccac

SEQ ID NO: 21141 - DNA, 618 bp, Zea mays
  misc_feature (1)..(59): n is a, c, g, or t
  misc_feature (65)..(65): n is a, c, g, or t
  misc_feature (72)..(72): n is a, c, g, or t
  misc_feature (74)..(74): n is a, c, g, or t
  misc_feature (87)..(87): n is a, c, g, or t
  misc_feature (97)..(98): n is a, c, g, or t
  misc_feature (100)..(100): n is a, c, g, or t
  misc_feature (102)..(102): n is a, c, g, or t
  misc_feature (105)..(105): n is a, c, g, or t
nnnnnnnnnnnnnnnnnnnnnnnnnnnnnnnnnnnnnnnnnnnnnnnnnnnnnnnnnnngagggnttttttntntttttttttattntttcttagtnncnanttnattttcagagtaaaatgccttgcacatttcaacaatttccttactgtatgtacacatattacaatactgcttttttgcatctctattcgctcatggtggataatctgtatctagttacccttccacatctcagatttatcactctacatacatacacgatagcatacatacactgtcaactgacaactcagaactaatttaattgatatacatatacagaactcttgcttcacctattggctaatttgatctgtttgacactctggacgagtaacagcgccaccacccgccatggagctcatcattatcttgccgggcttctgcggtgcgagaaccgaggcgggttctttgtgcctgccctagcattcttggccgctttccttggcccggggcagtagaaaaatgatctggggcacctctcacacgtttcacttggagctcttctttccccaccatcttttccgcgatttatcatcatgggtgccggtgccaaccttattaaggtttaccttt

SEQ ID NO: 21142 - DNA, 1915 bp, Zea mays
  misc_feature (1872)..(1872): n is a, c, g, or t
  misc_feature (1881)..(1881): n is a, c, g, or t
  misc_feature (1891)..(1891): n is a, c, g, or t
cggacgcgtgggttcttttttcagagtaaaatgccttgcacatttcaacaatgttcccactgtacacatcttacagtactctgctttcgcatctcttcgctcatggtggataatctgcatttagttacccttccgacgcctcggatttatcactctacacacacgatgacataaatacactgtcaagtgacgactcagaactgactaatatacatgtacagaactctggcttcacctattggctactttgatcttttcgacactcgtgacatcagatgagtaacggcaccgccaccaacatgggagttcatcatctcaccaggcttttgggatgagagaagagcccgaggcagatccttctcgcctgccctggcattcctggccactttccttgacccagtgtcgttgcaaaatgttgtggagattctcttacacgtttcacttcgagctcttctttccccaccatcttttccgtgatttctcatcatgggtgccaaccttactaaggtttaccttcgtctccttcaaccgagatttgtagtcttttttccatgtcgcaaagcggtccttgagcttccggagttcctcatctgggttcatatttgaaccaatctgaccggacctgactgcaactaggaagcccgcatcgtcttcgaacacctgtcgtctgtcttcaaactcctttgctaggtggttcacagcattcactcgcctatccgagtttcctgctgaaactttagcttcagggttgtggttgtcgtgtttcgactcgatcacttcaggtgtacgagtcccggtggataatgtatcttcagagtcatactgcgcatgtgtaggagtacaatcagtccgagcggctctagtggccgcatcatcagcagctaggctcttcttagcgacaacaaggctcagctgcagagaagagagctgcctcttccatgcctcttccatagatttcattttggcctcatattccgaccatttcctctcatactgttccaattgctgtttgagcattacattttcctcctccttatcccgcaatgcagcctcagctttcgtgatacgaccctgaagctcagtgatgactggttcgtgaggataatgcccattcatttcatggcatattcttgactctgagttattcttccttgtgttcccttgaactatgctgtgactggcctttgactccttttcattctgcagacacttgtatttccttctggccaggaacccacgcgtcacggactgaagaagaatgatatgattcagttgatcattgaacatgttagctgcaagtcgacgcctagtgtgtttctgtatgagaacagctgccctccatctcttgacaagattatcaaagtgtattcttgttctttcaccacgtataaatgattgcaaattcatcgcccctttctttagtcgctgatatccccgccgagaatgcaaaccccggaactgtgtttgaatatggagggctccaagaagcatctgccttttagcattttccagtgcaacaacctgtcctgtacctcacccgccgccccgctcgccaacttgatacatttcagggggaatgttgaacttttgcaaaacagcaattgaaacactaagtggatcttgagatgcaatggaacgcaagagaagaaatctgtatctttcagcaaactgttggtgggtgatcctagttggatagcatgttcttgatatccgaacaacttcaaacacaccacagcatttaagctggtgcaaaacaagatcatgctcgaataacctgggatgatgtttgctatttggttgaatgcattggataaaatgtggggttgtactctccaactgctgcatcagcttgaacagttgagccttaaattnccatgacanacactttgtnttatgtgtatcctttaaccccggg

SEQ ID NO: 21143 - DNA, 3701 bp, Zea mays
cttttagatatttttattatttaaacgccatatgttgttatgggccgttcgtcgtgccgtgggccagcccggcacgattattaacctagtggactgttcctagccctcacttggagcccgtgggccgacacgacacgacctgctagctaatccgtatgggacctagtcgtgctcaggctgggttggcacggaccgcccatttgaacatctataatgtaacccctctccaagccttagcactccagactccgctcactgcgacaaaccagagccgcgcgcagcagatggcgtcgacgatcatggccgccaccacctcccgcgtcgtcgcggccgcaccgccgccaatggcagccccctccacgacgtcgccgccgcggccgccagcggccggatcaccatggtacgtaacgtacgcctggtcggtttcaaccagtccggtgatcaactaatataacgagagcgctcgcttccgcttccattgcagggcaacgagctgtggtacggcccggaccgagaccagacgccctcgtacctcacgggcgagttccccggcgactacggctgggacaccgcggggctgtccgcggacccggaggcgttcgccgttcgcgtcgcgcggaacagggcgctggaggtgatccacgggcggtgggcgatgctgggggcgctgggctgcgtcaccccggaggtgctccagagctgggtgcgcgtggacttcagggagccagtgtggtaagttcaaggccggcgcacagatcttctccgagggtgggctggactacctgggcaaccccaacctggtgcacgcgcagagcatcctcgccgtgctcggttcccaggtcgtcctcatggggctcgtcgagggcttccgcgtcaacggccacgacggcgacggcgacggcctctaccccggcggccagtacttcgaccccctcggcctcgccgacgatcccgtcaccttcgccgagctcaaggtcaaggagatcaagaacggccgccttgccatgttctctatgttcggcttcttcgtccaggccatcgtcaccggcaagggacccctcgagaacctgctcgaccaccttgacgaccccgtggccaacaacgcttgggtctacgccaccaagttcgcgccacggtcttgagctagcgggccacgtacggcgtgcccacattttagactagtcgtttgtgttgtgacattacattcgtacgatgaaagaatgcaaatattcgtgtgcttctctcagaactcaggacgtactggactagttttgatcttcattccatgcatgtatgctccgtttcagttgctaacagatttgtgtacatacatgtagttgtgttgtgtctacttttttttttttttgaaacacaagctatccgacagcacagcagtgcagaattcagagcctgacaattacaataggacattatgtccaaactcaggattcaactgctgtgcagtgtatgtacctcaaatgatttgtacataatactgcgtgttgctttctttttttcagagtaaaatgccttgcacatttcaacaatttccttactgtatgtacacatattacaatactgcttttttgcatctctattcgctcatggtggataatctgtatctagttacccttccacatctcagatttatcactctacatacatacacgatagcatacatacactgtcaactgaaaactcagaactaatttaattgatatacatgtacagaactcttgcttcacctattggctaatttgatctgtttgacactctggacgagtaacagcgccgccacccaccggcgatggagctcatcattatcttgccaggcttctgcggtgcgagaaccaaggcgggttcttcgtgtctgccctggcattcttggccgctttccttggcccggggcagtagaaaaatgatctggggcacctctcacacgtttcacttggagctcttctttccccaccatcttttccgcgatttatcatcatgggtgccggtgccaaccttattaaggtttaccttcgtctccttcagccgagatttgtagtcttttttccatgtttcaaagcggtccttgagcttccggagttcctcgtctgggttcgtatttgaaccaacctggccggacctgactgcgacaaggaagcccgcgtcgtcttcgaacacctgccgtctgtcttcaaactccttcgctaggtggttcacagcgtttactcgcctatccgagtttcctgctgaaactttagcttcagggttgtggttgtggttgcggtgcctcgactctgtcacttcgggtgtatgggtcccagtggacaacgtgtcttcagagtcgtactgggcatgtgttggagtaaaatccggccgcgcgggtctagtagccacatcggcagcagctaggctcttcttagcagcaacaaggctcagctgaaaggaacaaacaggatcacatccaaaggaacacgtcttctgaagaataatgaactgaagccacataattatataccactatcttctagcaaaatatttattttttctttcttttccctttttgcttatgcctcattttggtttttaactctagcctatcctaacttgtctgggtctaaaaggctattgctgttgttctgtgttttttaacgaatcggcttatctggcttctgcactagataggtacagtaaaactcaatatcagagcaattttctttacttcatataacacatcaagaaaaaatattgaatattttcgtatgtcatcccatgataaggttatgttgcagcctgtcattcctcaacagatgaattcatgttgcaagaatatcttgacccattcttcaaacttacaagcatacataaatataataaacataattacctgcagagaagagagctgtctcttccatgcctcttccatagatttcattttggcctcatattctgaccatttactctcatactgttccaattgctgtttcagcatcacattttcttcttccttgtccctcaatacagcctcagctttcgtaatccgaccctgaagttcagtgatgactggttcatgaggataatgcccattcattccctgccaatggatgccaatgttagggactacttgccttttacaactatgtatttgacagttaaacagattctataccttgtacaggaaaaaacttctcaagttcttcagaatatagttggatataacgataacagaaatttcagtaaacctagtaaccatgattatgcaaattccagatgaagattgcctagtagcagtagcaaatcggtttagattatatttacttctcattcagtactggatgaaatcaacatgcagctaccgcattagaagattggaacagataaaactgtagatatcttttgatataaaactcacatggcatattcttgactcagcattattcttccttgtttccccttgaactatgttgtgactggcctctgactccttttcattctgcaggcacttgtatttccttctagccaggcacccacgcatcactgcagtaacatatgacaacacatgattacatagatccagtactctagggtaatgttaatatgcccacttttatcatattaattaccagactgaagaagaatgatatgatccagttgatcattaaacatgttagctgcaagtcgacgcctagtgtacttctgtattagaacag

SEQ ID NO: 21144 - DNA, 2190 bp, Zea mays
ccttgaatagttggccaatttatacaatgacggtacgtcccctgtaggagggtgttcaccagcagatggattctacattaagggaagggcacaattcttctggcaaggggacaaagataaatttaaatatcatatggtaaaatagagaaatctgtgtttgcctaaagagtttgggggattagaatctggttggtagtagctttcgactgaactctggtcggtttcaagttcgtttctcttcttttgtgcgtttgctttcaagctggtatccccagcaggtgctggtgacgttatgtgctttctatagaaactggattcacatgtcaaaaaaataaaactgatgtgtaagtgtaaaggtctcaaaagatagtgcaaaatatggggcgatgcaatcacagttttcagagtaaaatgccttgcacatttcaacaatgttctcactgtacacatattacagtactctgctttcgcatctcttcgctcatggtggataatctgcatttagttacccttccacgcctcggatttatcactctacatacacgatgacataaacacactgtcaagtgatgactcagagctgactaatatacatgtacagaactctggcttcacctattgtctactttgatcttttcgacactcgtgacatcagatgagtaacggcactgccaccaacatgggagttcatcatctcaccaagcttttgggatcagaggcagattcttctcgcctgccctggcattcctggccactttccttgacccagtgtcgttgcaaaatgttgtggagattctcttacacgtttcacttcgagctcttctttccccaccatcttttccgtgatttctcatcatgggtgccaaccttactaaggtttaccttagtctccttcaaccgagatttgtagtcttttttccatgtcgcaaagcggtccttcagcttccggagttcctcgtctgggttcatatttgaaccaatctgaccggacctgactgcaactaggaagcccgcatcgtcttcgaacacctgtcgtctgtcttcaaactcctttgctaggtggttcacagcattcactcgcctatccgagtttcctgctgaaactttagcttcagggttgtggttgtcgtgtttcgactcgatcacttcaggtgtaggagtcccggtggataatgtgccttcagagtcatactgcgcatgtgtaggagtacaatcagtccgagctgctctagtggctgcatcatcagcagctaggctcttcttagcgccctcttggcccccctgaaaattcatgttgcaagaatatgttgatccattctttaaacatacaaacaaacataaaaaaaatcaacatagataattacctgcagagaagagagctgcctcttccatgcctcttccatacatttcattttggcttcatattctgaccatttcctctcatactgttccaattgctgtttgagcattacattttcctcctccttaccccgcaatgcagcctcagctttcgtgatacgaccctgaagctcagtgatgactggttcgtgaggataatgcccattcatttcctgacattggatggcaatgttaggaactgctaccttttacacctatgtattaaacagttgagcagattctatatcttgtacatggagaacttctcaagttctttagaatacggttggatattacaataaaagaaatatcagcaaacttagtaagtaaccatgcatatgcaaattctgtaaaaggatttctattagagtagcaaatctttcagattatatgtacttctcattcagtcctgaatgaaaccaatatgcagctagcacattaaaagatttgacagataaaagcataaataccatttgatataaaactcacatggcatattcttgactctgagttattcttccttgtgttcccttgaactatgttgtgactggccgttgactccttttcattctgcaggcacttgtatttccttctggccaggaacccacgcatcactgcagtaacatatgacaacacatcatcagatcgatgcactactctactctagggtaatgtcagtataccctcttttatcatataaattaccggactgaaggagaatgatatgattcagttgatcattgaacatgttagctgcaagtcgacgcctagtgtgcaaatgtatgagaacag

SEQ ID NO: 21145 - DNA, 5071 bp, Zea mays
gggcggtttgatcaggcgcgcgtgtgagatatgattttatggaagggacacattttgtggccggtacattttgttgattggtttcaggtctaaaaattatggtagacgtaaaaattggcatgcgatacaatggtggatggatcttcgggttctagcataaaaaccttcagtttttggcataaaaacccttagttccgagcgtaaatatcgagccaacatgaaagatgttggtattcatgatcgtaaaaatccttaagtttgagtatgaaatagtgttagatatagtgtaaatgttgattcactccgaatcaacaatccccacattcttgcagccaccataaatcaagggatttgattaggagagttagttatgtgaacggattaggtaatttggttttttccttggggtcatggataccataaatcaagggattcctttttcactatgcatacgaaaaatatggcacacgatatactgatggattcactctaggttcgatcataaaaaccttcggtttttagtgtaaaaaccctcagttttgataactttctgtgttgtatttatgattttaaaaatcctcaagtttgagtaaatagtgctagataaaaatataaatattgattcactttcaaccaacacggtcttgaaaacatgttcaaataggtaagaaaaatacataaaacttttctacgactagcgtaaattgttgtatgtatctaaatatagtgatacaagtaaacatttcatttatggctgcactagagaaaggacaatttatataaattgtcaaacttaacgtggtagtttttactctgaataccgatttgcaggatagttttttattgaatattttaaatggattttttaccttattgtgtatataacgaaaattttaacgtggcataccatgtagtgaaattctatatccgttactcctctaaagcctgttgcaccgagcaggaacaaaggataacatgttgcccaccaggtcgtaaaggacgtggaggttctgttgctggtagttgccgatgatggtcgtcaggccatctccggcgttgatagcaagacaggtgaagctgccgcctgcgtcctcgaactcaaacatgtagttctccctcggcagggccagcgttgcgccctcaaagtgcaacaccagctgtggcacgtcgggtttagctcgccgcggcaccgagaagcagagctgcgagagcgacgacgacgtggcgttgtccacgggcagcctgacctgagcagtgaacgcgtcgtgcacaagcttgtacacgtcctggggcagcattgtcatgccggtgccagagtcgatgatcgtgccgcccgtcccgtcctgcttcaacgcgaacgttgactccggaatcggcagcctcgtcgagccgacggttatgccctttagtgacaggtagtatagttccagagacgagaagttctgaaccagaggagtggactgcactacgccgccggcgtcgccgtaaaggttggccggaaggccgagcaggatggagctgggctccggccgcgttatgtcggtgaaacagtaggagaagttgtccactttgagctgcgacggcagggacagcgcgccgcgcccgaagccggcgatgccggtctcgttggactcgaaaatcccgttgttgaagagaccgcagccgaaggccaggtcgggtacggagacctggccgccggagccatcagcggccgcgaacgtgaaggtgtcggcgttgaggtggccggtggttatggagctgtcgccgtatgagtagacgtagacacaggtttggttcccccagctgtgcttgccgcaagacgaccaggcgaggttgtcacacatgggctggttgcaggggagcacgccgaacgtggaggagttggacaggtccaggtatgggagcgcctggctgaagcaggtggtggcggggcacggccggcactgcgtccagacgaggtcgctcccggtgtcgaggatgagctgcgcgggctgcggcggtgtgccgatggcgaggtgcaccaggtactccgtgtcggggacgccgttggcgtaaggccccgggtctacgcgggcgctccccgaggccgagagcagccgcgcggcgcgggccttgctgcgcgcggccatgcggtgcagcagctcccggcggctgaggctgaggccgccgtccgcgtggtgggcgtgcagcttcagggttgccgcgtcgcagcaagaaaaggtcagagcgagcagcggcagtaataagagaacaatattttccaacaagagttgtaggagagccatcttctgaagctgcttcatttgcactagccggccccctcccccgaccccgagcacaagtgtgttatctgctggttttttggagcggagatggaagctttcgttataaaagattttgtacttgcaccatttgagctgcgttttgcaaccttatataagagaaaagaaatggatatcgtcaacgatatacgtacaattttccttattccaatttccagcccacagtaaggtctttcacgcgcacaaatccagctaccgtgttgtttacgtgttctttctgctgtcgtccgatatgctctgtcaaacaaatgtacgtcgtcgtggaaaaggaaaggataataataatagaagagaaaggcagaacgcagatcgtgaccattcttcctaccacttggacagaggcagaaatggagaggaacaggtctaggctcgggagtgggtggaaccttaatgcagtgaaacatggaaattaccgattgacaacgtggagttatagctaccgggtcatctaatctaatctaaagtaacatctaatctaatctaaagtaacatcagtttgcaaggtttgtctcattgctgactgcaggctgcagctgtgcagccatccttggaactacggcacttcaatgtgcactaacaatcaatcttgagcaaatattcttatgctggttacagttacaaagttggaatttacttcgattcaggtcgattttcaaatggcagttggaatgggtttttttttccatttcaagccaattttcaaatagtaacggtgataactgcaactatgttaccgaaccggtgtacctttagactcatgaaagactacggatgttgcagatgttacaaagctacgccacattctttagacttgtacctgcagttcatggatcagcgtggttacttcagttgtgacaataaaatccggtgctggttattctgaaacaaagaccttgtctcacttggaaacatatattgcacttcgttttttctctgaaactttacatgttcacacacaacacaagaaacaattatggagttggtaaatactgttgctaaattgatgtccacagatacaaatgaacacagtaacattttaaagaaaaaaaaggcgtagtagttgctttaccttggtccgctgttggcagtagaattatgttagttacaagaagggtgtgtaaagatggttctagttctagacatcagcgtgtgtggtgagctgcccgttggaaacccgcagtagttgtaaaattggcccatatggtccatatcgcagcatcaacccttgctatatgtgcctgtgaaggggtgtagcatgtgcgcatggagggacgtaccgagaagtggttctgggcatctactgtgtatatgatgaacgcccatggtgaacgcccacatgatctttgcggcaaatgaaaagttgtagttggtgtgtttatttatttgcatgttccttttcaactcaatgcacgtggattggatgggtttaaatccagagcgattcaaaatctctactattagcaaggcctaaaaatttagaaaagtaaaaatcataatccttgtttttcaaacgtagcatggtgtgttgttccgctttgaccatacagttcccttgccttgcatttatgtatgaacaaacgtagcaactgaaacctgacccaagttatgcgtagcccctgtagaaataaatatgaccacacaaatatttggtgcagtatatatatgttgttacagtgcaatttctttttctcgaacactcagctgcgaataaaattacagtgtaaatcctcaaatccaaactatatagagtgaattctcctttcctgacagaactttcgctataaatgccaaagctccaacgatatctctattggatccgcaagactattatttaccgttttcaatgtatagataaaggaaaacaaaactagatcattgcctaaggacgctgttagagctgaagacgaaattttcctctcctgcaatcgtcgaggtaagccgtccagctgcccacccgttgtttataactctgtctgcgttctttgctggatcacctataacccgactaccctcgacaaccttgtcgaattctgggaggcctttctcctttcgctcctttctcctcctcctgtcctcgtctctttctttcctcaaccagctctccacagtcctctgaaatgcaaacgcaaatctgaatggccatgcggtactaaagcataatgtgaatgtccatgatgtgctaaagcatactgttctatatggatggacgatacttaccatgagagataactgactcatttctttcaccttttccaaaggcactgctaattgcagtttcccatgagcaatgtaaaccttgaaatacaaaaacaataatcatctaagtccacaattccacaagaaatacttgagcttataaacaacaagattcaatggagcttacaatgtgtgttggccaatcatcaagaccatcaaaaatatgtgtggcatagatgattgttgcacctctttcctcacattcctttttaagatacgttaacagatttgatcttgccagaacatcaagatcaactgtgatctcatcaagaagaagaacctgcattgcatttttttaattatagtgtgaatgatagcattatatcctttgagacatggaaaaggaaaacaaaccttgaatgacttaagaagtcccatgcaaatctggacacgtctcctctgaccatctgatgccttgtgcatgcgccaggggaggtcgatgtctaaaatctgaaacatggtagaatggtagt

SEQ ID NO: 21146 - DNA, 1270 bp, Zea mays
acagtgcaatttctttttctcgaacactcagctgcgaataaaattacagtgtgaatcctcaaatccaaactatatagagtgaattctcctttcctgacagaactttcgctataaatgccaaagctccaacgatatctctattggatccgcaagactattatttaccgttttcaatgtatagataaaggaaaacaaaactagatcattgcctaaggacgctgttagagctgaagacgaaattttcctctcctgcaatcgtcgaggttagccgtccagctgcccacccgttgtttataactctgtctgcgttctttgctggatcacctataacccgactaccctcgacaaccttgtcgaattctgggaggcctttctcctttcgctcctttctcctcctcctgtcctcgtctctttctttcctcaaccagctctccacagtcctcatgagagataactgactcatttctttcaccttttccaaaggcagtgctaattgcagtttcccatgagcaatgtaaacaatgtgtgttggccaatcatcaagaccatcaaaaatatgtgtggcatagatgattgttgcacctctttcctcacattcctttttaagatatgttaacagatttgatcttgcccggacatcaagatcaactgtgatctcatcaagaagaagaaccttgaatgacttaagaagtcccatgcaaatctggacacgtctcctctgaccatctgatgccttgtgcatgcgccaggtgaggtcgatgtctaaagtcttgataagctcgtctctcctctttggatcaacaccagcaacaccaaaaatcatcttctctgccgatatatccatctgaatgttcacctggtagccagcaaaggccacgtcgcgtctccactcaccgccgagataggagaggtcgccggaggaggtgagtgccgtgtcgtggaaggcggaccttcccaggacccgcaccatgctcggatccaccatgtgcttcccgcctagtatctttagtatcgtcgtcttgcctgcgccgttggagccgaggaggaggcatcgttggccggcgtcgagggagaagcagacgtcctcgatgagcggtggcgcgccgggtggcgggcggccgtcgatgccggggtaggtgaaggtgaggtggctgatctcaaccgttggcgccatcggagctggggccgctcgccgccgtgagcccgtggccgtggccggaagttggtctggttggtggacagacgaagcccaaccggcctcgcccgaccc

SEQ ID NO: 21147 - DNA, 2284 bp, Zea mays
aagcaaaatcatagaaatcttgttttaactcaaaaagagagagatcggattagtttttttttccctaaaatcatgctctacactacatcatacaagactgactactaatattgaacaagctaaataaatatgttctcagattccactaatgttacaagttacaacaacaagcacaccgtgcataaacatacagcaacttagaagatgctccaagtcctagccaacaaaggaaagggaaagaaaatgacttctaggttttcacgtctccttttggttgaccaagaagagatggtcggtagagtgaatggccttgtgccatctcaattctttcgcgtggatcatacattgtctcatctcttatagcctgaagaatcgaatcagcaggacggtccctcatgatcagaatcctatgtagtgcttttaggatcgggcacatctcaaccggcgcaacagatctgttggcttctggatgcatgacacttaagctatcctgactaagaagctcataaaacgcatcaactgcagagacaccctgaatggtcccttttcctttaatactgtcacccatttctaatgtcaattcacctttagctaacttctgcccataccatgcattacgacctttcaacaatgtgacataagtgtcagctaataagggtccagcaagtttttcaggttcttcttccagaaggtgtgtgatgtagatcatctcagatgtgcaaagtgcaaagtaaacagatttgctggttgcactctcgttggttagtgcagctaccataccagcaccaatagcatagacattttttaagccacccatgacttcatgagtgatgagatcactgttatcccacacaataaaatgaggctgcctcaaaaactttgcaaggggctttctccatttgtcagctccacaaatacgtgcatttgcatattctttgttgtaaatttcagaagcaatattaggtccgccaagataaagaatattctctgatggaactccagttgcattgctaatcatctgcgtgggagttatgatccgtgggagtggatccagcgaggcctcaattcctttggcgagggagatgatgatgggggcagtaatcctctccttccagtacctcctgatctccccgaacacctccctggtgtcggtggaaggcaggccgttgacgacaatgtcagcgtcccagacggcctcctgcaggttggtgacgaccttgagcgggcagagcggcgtgtcgatcatgttgaggcagaagccgtccctgagtatctcgtcggcgtagagcgtgcggtcgccgaggcgcgcctcgacgtacttgaggtaggcgcagcggcggatcaggcggcgcaggacgtcctcgcgcgcgttgatgacgtcgaagaggtgctcggcggtggcgcggtcgacggcgcggcccgggcggcgccagatgcggacctgcgccttgtcgcggaggtggccgtacgcgtcctgcagcagcgcgcagaagacgctgccccaggcgcccgccccgacgccgacgatccggagcgggtcgccgtccgccttccccagctgccgccgcagcaagtccagcttctcctccaccacggccccgttcgcatggccgtccggctggcccagcgcctccgccccgcccattgccctgatctcctccgcctcttcctctctcgccgaaagcaaggcaggctacataacccggtctgtctcgttcggcagaagaggagagacggggaaggctggattaagcgacggcagcaaagctataataactaactcggggagagagaaaggagcggacggcttttcttttggccgaaacgagctcggatcgacgcgaattcgggtgggtttggccgccgaatcgcagcgaggcgaagcgtcggccgcgacggccggagagcccgagggagtcggggcttgctgccggcccgccggccctgtcgcggttgccggttgggttggtgcgccagtacacgtcgcctcgggctctcgatcagctcggccagattggcgcctgctgcccagtgccccacgaggtagagagaacagtgacgcggtcgtgcgaaagcgagttgggccacgtacgggggagatgtggcattgtggcaggtaggtgagaagggggcggggcacgggcgggggttggtggtgtagagtgtagaccggttcgaggattttgaagcttcgatggatcacgatcaccatggtggatgacgtcggcagattctgacttgtgagcttcgcccagggcccaggcccagctaccggcgccagggg

SEQ ID NO: 21148 - DNA, 667 bp, Zea mays
  misc_feature (27)..(28): n is a, c, g, or t
ggccgcctttttttttttttttttccnnttttttttttttttctttggccgccgcttttccttttttttttggcgggccgcccttttttttttttttttttaacgataattttggagtccttgatatcaagaattgatacaattagaggctaagaacatgataacacatcgaaatcaaacagaaagaaaaagagggagagcaagaacatatcacggatgaccacacattattatggatttttggttttaaacaacattgctctcacttttctttcatatcttgttccaaatgcaatcggaccgacgtgcttggccttagttggtggagtcatcgtcgtcgtcctcattgcccgatagtccctcgacgccctggggaccaggtgcacctgccggtccgctaggtccatcggcaggtgcgtcagcagcgggggcgggggcatcggcggagggggcatcagcggactttgcctcggccatcggtgccacaaccatggcgacgaagaggagagcagcaacgacgaagacgacgctagcgcgagccatgggtatggtgtctttcttgggttggttgctagctgcttgacaagtttgacgcttggtgtctctatgcttgttgtggtgcggtcccggccggcctcgaggaacccaatcgcccataggagtcgta

SEQ ID NO: 21149 - DNA, 775 bp, Zea mays
  misc_feature (2)..(2): n is a, c, g, or t
gnccgcaattttttttttttttttgggataaattagtaccatatgattttcgatgataaataggccgcgaatttgtcttcttgctttctggggaacaagaagacatgtttttgtgtagtagaggaatgctgggaagcctaaaactaaggtgggcagcgatttttttttttttttttttgggtcttttttttttttttttttttttaacgataattttggagtccttgatatcaagaattgatacaattataggctaagaacatgataacacatcgaaatcaaacagaaagaaaaagagggagagcaagaacatatcacggatgaccacacattattatggacttttggttttaaacgacattgctctcacttttcttccatgtcttgttccaaatgcaaccggaccgacgtgcttggccttagttggtggagtcatcatcgtcgtcctcattgcccgatagaccctcgacgccctggggaccaggtgcacccgccggtccgctaggtccatcggcaggtgcgtcagcagcgggggcgggggcgtcggcggagggggcatcagcggactttgcctcggccatcggtgccacaaccatggcgacgaagaggagagtagcaatgacgaagacgacgctagcgcgagccatgggtatggtgtctagctttcttgggttggttgctagctgcttggcaagtttgacgcttggtgtctctatgcttgttgtggtgcggtcccggccgggccctcgaggaacccaatcgcccttaggagtgt

SEQ ID NO: 21150 - DNA, 2381 bp, Zea mays
ctttggatccagttactggtctctgtgaatagcatgactgaattttaacctccaggagcaggggagcacaatagatactcaagattgatatgagcaatctgaaaaaatggaagagcagaagaggaacagagggaagagataagactctaagagaaggattcagaaaccactcatccactgagacagtggggtgtgaaagaaattgagtgacgtcacaagacacatcggttggtcgtggatttgcttttccgaataacatagtacatactccctccattctaaattataagttaattttaacatttttagagggttaaagcatctcaagtctgactaaaattatagagagaattacaaagatctatgccatcaaatagttatagtataaaaatgtaattaataaagaacacagtgatacttagcttttttttttttttttttattttttttatataaatttggttaaatttgaattacttttgactcctcaaggaatgacttataataatttaggatggagggagtatttccatattactagagctcagactgacaaatttagactacagagttatcctaagaaattgagaaaccatatcaaaacataataactgaacaggtgcatactcaggcacttcctgacttaacactgacgctgcaacatgtctgacaccatgaacaactaaaaactcgacaccagatagataacaaaatcaagattcacctaccatgcttgagtaggtcatacaacatttgctggtaatcgatcatcagtgcacttaaataccataaaatagaattcttagatgatactcagctcagtccactgcatcactcagccaggtccatgagcgtcctggtcacttccttggtcaggtcgtggcgacgaagatgtaggttcatcagtgcacgcctctgcttcttgatcctctcgtccagtgtacgggccttgctgtcttcgatcatcccaaactcccgcttgaacaagcctgggtgtgccctctgaagcgccctcacctcctccgcaaggtatgggtacagctcacacatctcgtcaggctccctcccagcaccaccgttagccgacgccttggtaaccgccttggtaacaggcttggcattgctaacagaaggccagacgttcttgcagaggtcgaagagacggcgatcctgatccttgctcggtggcgcgcctttcttgaccgctttggcgtaccggctctgcaaactcctcaccttcctcttgagatcggagaggctgcagccactattgtcgagcttgccagcgagggcgtcggccagcacgtccgtttgaggcagcgcgccgtgctccaggcgttgcgcagcgagggcctccaggatgcggaagtcgtcgtcaatcgaccaggtgcgctggaacggcgcgctcggccgctttgcacccttagcctccacctcttgatttggagcgggcttcgtctgcggcatctcgtcgtccgcctccctatcctcttcttcgtcggaagcctcggaatcctcgccagtctgcggcggcggaggcgggttcttggtggcggaagaagggaccacgtggttggccttctcgtcctcttcgatatcctcctcttcgtcgtcttcatcctcatcggacgcttcgggttcctggaccttctgcggctcgtcatcttcatcgtcatactcatcctcgtcggacgcttcgggttcctggaccttctgcggcagcggagcaacgctcttgggagcgacgggaggcggtgagtgggcggtctccaaatcatcctcctcctcctcctcctcctcctcctcctcggagcccgaaccagaggcggtctcctcggaggaggcagccgggggcggaggcggcggaggtggagccgagcgcttgggggccatctccgccgctgcacctagggttagagatttggcaagctggtgaggcggcaccaagctagggttttccccggcccgcggttttgttcatttttttatatggggccgattaggatggtcgtccattggatttggcacaggagtgcgaatctgccgtccatttcctatgaaaacgcggacactgtctgcgactctgtcagccgttcgattcagggcgtcgaaacatcttcagttcagagttcagccatcaccaatcacagccatcaccaattcagaatctgaaatcagttgcacacgaagcaaccacagcactcacacaacaaaacctaaggccattgcctatcaattctcgcggacacactcatggttccagcagcattattctcggccgagttgcttcggaaacagcaggggaaaatcgcttgcttgatgcagcatggttgcaggatcgggaccggtcgggagccactcgctctggtcagcgctcaata

SEQ ID NO: 21151 - DNA, 986 bp, Zea mays
ttttttttttttttttttttttttttttttttttgtgctctcttgtctttggccgcccttttttttttttttttttttttttaaccaaacaaatatattattcacaaaatgtgcataagcaaagtactcgagcaattacaaccaagtgaaatcatttgagaggatacaaacaaatgaaatcattagtcccttgacaccccttgtctacaatacttacaacaaaccggatacagctggagcaactagataagttattctgaatttctaaactcattccttgtggaggtgacggtccatgatttcagataaagtttctaagaacatgttttcactggaccatgggagaacagcatcctctgcttcctgaatgatgacctcaatctcagagtccctattcacagtttccctgcatagtatgcgccctatgtcatagggcgtgaagccacgagatgcacctttcttcaaaagcattgtgctgatgcgcaggacacgagcacaccgtggaggcagctcccacccatggatcttgagaagcttgatgtcttcttcagcatcgagtgatttgatgtattcaatggtttcatcattgaatggctcacgggcttggggccagtagagccactcaaatgtacaatcttcaaactgcacagcatatggcgacgtaagtttctaatcagccatatgaaacaaataaggtgcaagcagatgaaccaaatacgtattgtaacagatattaaccaccttctctggcaagcagtaaccatgatcaattggaatcagcttgtagttgccaccttctctctccttgcacactagaatattcccagcatgacgatcagcattagctaacctaatatctagtactgctattttatgaacctccttgacaggaaaaggtcgaggacccatatcttcagtgcttccattgttgtccatgaacatctgcagtgaaccaatcttgaagttcttccccctatgcgaggttc

SEQ ID NO: 21152 - DNA, 843 bp, Zea mays
  misc_feature (99)..(99): n is a, c, g, or t
aaaatagaaatgaatcctgcagtgtgacccagatgagcagtgctgtgaccggctgccatgaaagcagatgggcaggaaggcagggtcttctggaattgnccccaagacgatcacacctgccgacgacatattcacagggtgacagctactaaggaaacccgagatttgtcaccagctgctatcactattatttacactaaatctacaaagtaagattctggaaactacaattcgtgcgccatggagacagaaatccaagagttcctcccttccaaatccaggacggaggaaaaccgggattgatgggattggggggaaagtgtcacagaacagtcatttcgacctgctgatggtccattcccaatcgcgtaacggatgctgcgagccgagagaggctacaaagcatcccgttgctgtcggcccctttttcctcgattggggggagcgcaccaaagggccggttccttcaaccctcagcccggatggggctgtagccccacggattccttccctcccggcacaaactcaccacgcccgaattagagaaataataacccgattgggggagcacaccaaagggccggatccttcaaccctcagcccggatggggctgcagccccacagatcccttccctcccagcacagaccacgcctgaattagagaaataataatatgtaggctttcaaatcccaaagtccccaacgcccgcttcttcttggtccgcggttcacgcagggaagagaacgagaacaagagaagttatggttggtttgtgtagtgcacagcaaggaagaagagagaaatggcaagaagagcccggccggcctcgaggtacccaatg

SEQ ID NO: 21153 - DNA, 851 bp, Zea mays
cagattccagcacgctcatgggcatgggtgacataccaggcacagcaaggaaaataagaatggaatcctgcagctgtgacccagacgagcagtgtggcgaccggctgccgttgaagcagataggcaggaaagcagggtcttttgggactggccccaagacgatcacaccagctgacgacatattcacacggtggctactaaggagaccggggcttccttaacagctgctaccactaatatttacactaaatttaaaagttagactccgtgggttacaaggcgggcgccatggagacggaaatccaagggcgccttccttcccgatccaggacggaggaaaccctcagatagagccgcacagaacagcaaccgagattataatcacatccagtgttcaaataaaatcgaattaggataaggggaaaagtggtgcagaaccgtcacttcgccctgctgatggttgaatccccaatggcgtaacggatccaaagacaacaaagcagcaatccttgccccttttcctcgattgggtggagcacacaacaaggccggttccttcaaccctcagcgcggatcgagctgcagccccatggattccttccctcccagcacaaaccacgcccgaattagagaaatggtatgtagtcttcccagccagaaagtcccaacgtcccttcggattcggtctttctccgcagttcaagcagagaagagaacaagagcggtcttgctccgcggttcaagcagagaagagggcaagtttatggttggtttgcagtgcactgcaaggaagaagagagcgagaaacggcaagaggagagagaaccgggagagaagaggacacaattttt

SEQ ID NO: 21154 - DNA, 3576 bp, Zea mays
ggtaccgggccccccctctagttttttttttttttggggctaaccaaacaaatatattattcacaaaatgtgcataagcaaagtactcgagcaattacaaccaagtgaaatcatttgagaggatacaaacaaatgaaatcattagtcccttgacaccccttgtctacaatacttacaacaaaccggatacagctggagcaactagataagttattctgaatttctaaactcattccttgtggaggtgacggtccatgatttcagataaagtttctaagaacatgttttcactggaccatgggagaacagcatcctctgcttcctgaatgatgacctcaatctcagagtccctattcacagtttccctgcatagtatgcgccctatgtcatagggcgtgaagccacgagatgcacctttcttcaaaagcattgtgctgatgcgcaggacacgagcacaccgtggaggcagctcccacccatggatcttgagaagcttgatgtcttcttcagcatcgagtgatttgatgtattcaatggtttcatcattgaatggctcacgggcttggggccagtagagccactcaaatgtacaatcttcaaacttctctggcaagcagtaaccatgatcaattggaatcagcttgtagttgccaccttctctctccttgcacactagaatattcccagcatgacgatcagcattagctaacctaatatctagtactgctattttatgaacctccttgacaggaaaaggtcgaggacccatatcttcagtgcttccattgttgtccatgaacatctgcagtgaaccaatcttgaagttcttccccctatgcgaggttcggaccaatgtggtgggaggcacaccagaaaacccaaaactgtgaccagatttactatcactaactggatggtcgagaatataagctgcaacctccctgaatgcacctccccctacaattgttcccctcttcatcccctcgccatcagtggacaaaggaagaccccttgggttgtttttggccatgggttcctcatcaataggcttaaacacagcaatattcttctgacctgttgcatctcgcatgaaatatacacctcctgaaccttcagctgacatcacaggcaggtgccctttctccagtccaactgtggttaaatttatcatcttaatcaattcaggtgacagcttcacattttggctaactattggttcaacaggagcaggcctaacctcaactgattttgtggagttcattgagcgaggttcattttgcaggttgcctttctcctgtggattgagaactgtaaccaaagtatctctatcaacttgctgtgtcagtacttttgctggtttgaggatgaacaaatgaattacagcatcatccctcttgctaatatcagctatcagctggtggtcctcaagctcctcgccatcatattcaagcttgtgatcctgaagattaccaatatcctcatcaccctctgctgcaagcttgttcttaagaaacttaacattgcggctctgatccacctgaaactgaaacttctttccagttgcagtctcaatattgatcacacggagatcagacagtcgaataacaagatgaagaacatttccctcagccagcccataatccttgactgggcagttatttcttgccagttcatgcccatccagcacaagccgctgcttcgtcgccacaaagcccttgaaccgctggatgcgcagcttcacggaggcaatggactcagattccagcacgctcatgggcatgggtgacataccaggcacagcaaggaaaataagaatggaatcctgcagctgtgacccagacgagcagtgtggcgaccggctgccgttgaagcagataggcaggaaagcagggtcttttgggactggccccaagacgatcacaccagctgacgacatattcacacggtggctactaaggagaccggggcttccttaacagctgctaccactaatatttacactaaatttaaaagttagactccgtgggttacaaggcgggcgccatggagacggaaatccaagggcgcccttccttcccgatccaggacggaggaaaccctcagatagagccgcacagaacagcaaccgagattataatcacatccagtgttcaaataaaatcgaatctgcacaaaaatggagagctttcagttaccttgatattcaattaacttgatacaaaacaaaacagatgacaggcgaaacggatgagaaggtgcatactaggataaggggaaaagtggtgcagaaccgtcacttcgccctgctgatggttgaatccccaatggcgtaacggatcctgcggcggagcgatgagtcaggaattcactcaaatccccagcaaatcgtaaccaagtctgtgaaattgctcaccaaagacaacaaagcagcaatccttgccccttttcctcgattgggtggagcacacaacaaggccggttccttcaaccctcagcgcggatcgagctgcagccccatggattccttccctcccagcacaaacctgcagtaccacatctcagatccgatcatcctaatcgattcaaactctgcagaaaaactaaattcaacagaagttacagcgaaaatggcaggattgactcgtgcgatcaagggagcggaggacgaaaagtaactcaccacgcccgaattagagaaatggtatgtagtcttcccagccagaaagtcccaacgtcccttcggattcggtctttctccgcagttcaagcagagaagagaacaagagcggtcttgctccgcggttcaagcagagaagagggcaagtttatggttggtttgcagtgcactgcaaggaagaagagagcgagaaacggcaagaggagagagaaaggagaaatgttgctgggggctggggctgctgttttttgtattcctgggctgcgccatcacttaacggacggccgtgacggtgtcgtgccgggcgcgtcgcaacttcggggaaagggtgcgaagtgtgacacgctcgggttcaaacttcgaagcaatctcgctgtcaagattataccgctaagctggacttgaaatgcatgtcagtgtgccacctgcgctaaaaatagtataattaactatatcaatttggagagcttcaaaatagcttgatgtagggtcgagtaaccggcactaagaatattagaattggctagatcaatctggagaggttctactgtgttacgtttaattatgataacgtctaaatcgcttgatgtagggtcgaatcattttttatgtcatttactggaatttacctttacctaggtcttatgtctatagtgattatcgcttattggaggagtcttgtcaggtcttatgtctatagtgattagcgcttattggaggagtcttgtcaggaacacgatataccccacacacccgagatgtattcataggattgtgtgattgctatatatggattgatattcccattaccccctccccaccctctccccgcaaatctcattcccacgtgcatctcacgtctagctaaaattaaattaaaaaaacacaaatgtggctcc

SEQ ID NO: 21155 - DNA, 2719 bp, Zea mays
aattcccgggtggacgagctgattatacggcggccgccctcctttttttttttttaatgtctaactgaacaaatatattattcacaaagtgtgctaagcaaagtactcgagcattacaaccgaaagaaacatttgagaggtacaaacaaatcaaattattagtctgttgatcagtgcttgtcaacaatagaaacaacaaaccggatacagctggaactggaacaactagatcagttattctgaatttctaaactcactccttgtcgaggtgacggtccatgatttcagatacagtttctaagaacatgttttcactggaccctgggagaacagcatcctctgcttcctgaatgatgtcctcaatctcagactccctattcacagtttccctgcatagaatgcgccctatgtcatatggtgtgaagccacgagctgcacctttcttcaaaagcatggtgctgatgcgcagaacacgagcgcatcgtgggggcagctcccacccatggaacttgagaagcttgatgtcttcttcagcatcaagtgatttgatgtattcaatggtttcatcactgaatggctcacgggcttggggccagtagagccactcaaatgtaacatcttcaaacttctctggcaagcaataaccatgatcaattggaatcagcttgtagttgccaccttctccctccttgcacactagaatattcccagcatgacgatcagcattagctaacctaatatctagtactgctattttgtgaacctccttgacaggaaaagatcgaggacccatatcttcagtgcttccattgttctccatgaacatctgcagtgaaccaatcttgaagctcttccccctatgtaaggttcggaccaatgtggtgggaggcacaccagaaaacccaacactgtgaccatatttactatcactaactggatggtcgagaatataagctgcaacctccctgaatgcaccttcccctacaattgttcccctcttcatcccctcgccgtctgtggacacaggaacgccccttgggttgtttttggccatgggttcctcatcaataggcttaaacacagcaacattcttctggcctgttgcatctcgcatgaaataaacacctcctgaaccttcagctgacatcacaggcaggtgccctttctccagtccagctatggttgaatttatcatcttcatcacttcacatgacagctttgcttttcggttaactattggttcaacaggggcaggcctaaccccaactgagtttgcggagttcactgagccagcttcattttgcaggttgcctttcccctgtggattgacaactgtaaccaaagtatctccatcaacttgttgtgtccatacctttgctggtttgcggatgaataaatgaatcacagcatcatccctcctgctaatatcagctatcagctggttgtcctcaagctcctcaccatcatattcaagcttgtgatcctcaagattaccaatatcctcatcaccctctgcttcaagcttattcttgagaaacttaacattgcggctctggtccacctgaaactgaaacttccttccagttgcagtctcaatgttaatcacacgtagatctgatagtcgaataacaagatgcagaacatttccctcggccagcccataatccttgactggggagttgtttcttgccagctcatgcccatccagcacaagcctctgcttcgtcgccacaaagcccttgaactgctggatgcgcagcttgacagatgcaatagactcagatcccagcacgctcatgggcatgggtggcatacccggcacagcaaggaaaataagaatggaatcctgcagttgtgacccagatgagcagtgctgtgaccggctgccattgaagcagatgggcaggaaggcagggtcttctggaactggccccaagacgatcacacctgccgacgacatattcacagggtgacagctactaaggaaacccgagattcgtcaccagctgctatcactattatttacactaaatctacaaagtaagattctggaaactacaatttgtgcgccatggagacagaaatccaagagttcctcccttccaaatccaggacggaggaaaacctaagaggcacagaacagcaaccgagattacagtcccatcttgtgttcaaataaaaatcaagtcaggattgatgggattgggggaaaagtgttacagaacagtcatttcgacctgctgatggtccaatcccaatcgcgtaacggatgctgcgagcctgcgacggtcgaaggcaacaaagcatccgttgcccccttttcctcgattggggggagcgcaccaaagggccggttccttcaaccctcagcccggatggggctgtaccccccccggccccccccctcccggcacaaaccacgcccgaattagagaaataataacccgattgggggagcacaccaaagggccggatccttcaaccctcagcccggatggggctgcagccccacagatcccttccctcccagcacagaccacgcctgaattagagaaataataatatgtaggctttcaaatcccaaagtccccaacgcccgcttcttcttggtccgcggttcacgcagggaagagaacgagaacaagagaagttatggttggtttgtgtagtgcacagcaaggaagaagagagaaatggcaagaagccaaacccggccggc

SEQ ID NO: 21156 - DNA, 5908 bp, Zea mays
  misc_feature (3731)..(3731): n is a, c, g, or t
cgttggcgcgaagtagccgttgctccgctggcacaccggacagtccggtgcgccaccggacagtccggtgaattatagcggagtggcctccagaattcccgaaggtgagcagttcggagttgaaattcctggtgcaccaaacactgtccggtggcacaccggacagtccagtgcgccagaccagggcacacttcggctgactttagctttctatatttaaatcctttttcggtctttttattggtttgttgtggacctttggcacctgtagaactcataacttagagcaaactagttagttcaattatttgtgttggacaattcaaccaccaaaatcaattagaaaaagtggaagctatttctctttcaataacaaaaccctcaaaacacccatgcatttagggtcctatcaatctctgatttgagttgacaaatgggcgaattggaagatgccagtattgcttgagtcgatacttgagagctacaacgtcgccgtcaccaaattcaaagatgttcactaccacatacttcgggacacgtagtttctgccaaataattctacttagcctgatccaagtgagagtgtagcaatgactctagatgatagatagagctacacccttcgatgtactattagttattatttagaacagcgacagagtctctaaaatataattttgaccaatatttttttaaatacaaataaacttttaatacattgatgtttttataaaagtacatgttaagataaatcggtgcatataaacattatatttcaaaactacataataaaatggttatttatagtcaaaattttataaatttaacttaaaatttgtccaaaacgacgactaacaggatacgtgaagaagtagttgctattgatagaaactcagctgaatttaactaattagtcagataaacaactagttagatatttagttaaaaattcgttaacttattagctttcttattttagcagtaattagttccggtaactagtaattagttccggtaactggccctggacacccaagtacccaacacccaatagtactccaaggctcgaatggtcgatggagagtgaattcgtggtgctcgcggaggtcggcccacgggatacatccctcacctacgtggcgatgatcgcgctactccagccgccacgtgtccccgaacccctcgttaaatccagcacagcgcatatccccatccgttcctgttcccctcggcgacgcagtacggcagtacgccacgccagtcccagttgcattgactcctccccggtccccacatcttgccgccaatggatgtcgacgggcccgcccccgccgacgcctctgccaggcccgccaccaacggcgaggccccctccggcgcccgcgaggtcgacgtcggcgaggaggacacgctcgccggcgtcctccgcagcttcgtcgacggcgtctggtacccggacgagcctctgctccggcggctccgggcggcgtcctgcgacgccgcgccgcgcctgaggggggcgtcccggaactccgcgcgggacctgcttgagtggaccaggcggggcagcggcctccgcgccatcctcgtcatctcggtgggcgcgcgcctccttgatccgtcacatgagcatgggttttcttgccctgtttactaaatctggctctatcttctttagtttattttctgtaggtgattgcgtagcggttaactgtgccatggtcactattgcaatgttggtttagatttgtgctttttagatctcaggggcaaggatgaaagtgggtatccgaattgttagacaaatttaatattttaaaatagataggtatggaattttatgttaatctttttttatgttatcaagcatattattacagataagaataaaattttgtataaattgttttatgtattatttgctccctcacaaccgaaaaggtgaaaaaatatctgaatttgtatcggaattttatatccttcatttgagaagatataaatttgaggtttaaattttatgaatctttacaagctcatagctaaaaaacgataataccattttgcatagcagattttatatactatttattcgcaatcaaagaaaaaagaaaaaaggttgatatttatccgttccatccctatcagggccatatatgattacgaatctgttggggaaagtgaagaatgtttgcgaatctgttgggggaagtgaagaataggctgaattgtaatccctctgtcctgaaacctaatagatttaggttttctctaaaccaaacaaccataagtttaactaaattaacaattacaaaataagtattaacatctacgacctcaaataggtaaactataaaaatagatttcatattccttctaaaaattagatttcatagggtagcagtgtttttaatagtactcatttaataacgttgtttctaaaaaacttatctgacttaggttagtttgactttagacaactcaaaattaactgcatttgaagtcgaagggagcatgttgtaagcagaaacgaaaacatggtgaattacttctgctagcaatagaacatggtagattgcttttgcgtgtagttttgatcccataaactcttacatgatacctcgtttttttatggcatccattttaaaaattcttgaaaattgacagtaaacaatttttctaattttatctttgtttgatctggcaggtcgggacaatcacgcttatagcattgactggccttctgaccttcatgttcttcctattggttgccactgctaatgcgatcattgtctcagtcttgatgtcactggccgctgccggaggattcttggccatcttctttgcttgcttggttgcagtgtatattggagcagtatcagttgctatctttgtcatttctgcgactgttatctcagcagttgttggaattttggttgctaccggtaaatcttttctattcccctctagaagtctgtagtgctgttgatatgttaatatgcaaccttgaggtataatataatccttaaagactacctgaatctccaacattatagaaggtgttatgcacttatgcgtctgaagttaatttagtcaatgttactatgatgaaactgtaacaaaagtttcttttttttttgaactgaatcatctcaacccgtacactttcctgtgcaatgaagttagatcggaaatcagaaaaaatagtagtgcttagtgcttacttcccatatggtgcctacattctcacctgagcatcagactcagaatagcgtcatgcactaaattgtttaagaacaattcagaatcaaatgagttgtccattgccattggttatatgcttaacagtaaattgtcaatagtcacgagctcttttgtcttaatattttaatatcttttactaacaatgatgattgatgaataacaatggaagaattaagaagttattgcgctatatggtttcagtaacagtgactatgcttcctaatccgttagcacgatcacgtctgtgctatgtaattttggtgattcattataaattgtgcttgttttctttgatattgtggtcgctactaattaggagaaccatgtagaggcagctatacattgaaactttggtgaattcttaataccgtttctggttttctctgacattctgtttttctgtaattacgagaaccatgcagtggcatgtaaaatagttcgtaaaaccttgagaaatctcattacgtttngttcaagaaacaagtgttaactgttaagtagaacttttgagttgaagagattccactgcaaaatggaaatcgttacattatgttcctccttcagtgctaggtcagcatctaagatgtgatgaaaagtatgaacttgcaaaactaaaaaaaattcgaaggtgttatcaggaaaaactatgaatgcaacagctaactttttaaaatatgtaggtgagctccatttactgcacatatcaaattgactttccaattttcaccttgtccttcccaaggaaagagtttcatttcttgtaaatcatttcctccacaggatttcctgaaaggctacatcgaattgacagtctagtacctcctcttgtcagtttcaccttttttactttaggagagtaataagtagtcaccactcaccacagcaccttctccaaaaattagtggagaataagtagacatcaaactagatcgcccgaataaaatggcatagctttaacaaaaaatagctgcagatacgattctcttgagaaaatgaagggatattatgatgcccaatatctagaaaggtaagcatggaaaatctgtttttgacaaagcagtttccttgcggcaagaataatctttttgagatttgttggggggaaaagcatatctttgccttctgtgtcttgaggacctgcttgtatcacgtgtgcattttgtgctaacgcatcctgctgcaggttgggttgggttcttctggatgatctggttcaccgcaaggaagagcatggtcctgacgaagcactccttcggcatgacgagctcggcaatccaatcgtattccgcgtcccggcaagtgaagcagaagcctgtcgactgaggctagttggttgcgtcctgtatgaagcggatatatctatctatgtgaatcacggttttgctgtttgtttgtttgtaagagtgtagaagacagcttgcttgttgcggcagctctgtttctctcggtgactaggtgtataatgctagctctgaactttggcagcatgtacgttcggcatggcggtcaatgctgttatttaaaggatagtgagcagatgttaatgtttatagcaaataaaagcatgttaatgtttattaaatttatcttgaatgaacttattatttctttattatttaggccttgtgactgtttcagctctagaaaaaatttagcggggttgatagagtatgttattagatattctagaaaaatagtggagatgtagttgtgaaccattggaatggatttaaataagttattttatttattatttatattttaaaatgtttttaaactatttaggcatcattattgttttagtttggcatcattattgttttagcttggttgaaaataagctcagccagcatcactattgtttgtctggttgaaaatgaattttgagtgttgttgaggtccatagacgctgtaatataaatcaacacgttatttatcgttgttgttcaataacctaattcgttttaacctgtatagcttcttcagtggagcgagtttttgagatattgctctcctcgtcatcgttatatcgatgtcagagatgtaggagcctaagaccgtgtagcatccatgattcttttgtctaaaaccccaactcacattagatagttgtttcttatacctctaggtataagaacaccctctctattatataataagggataaacttagggttactatacgcgaaagaacagaagaacataaaactgaaacagacatggtaatatttgtaaacctgtcaaacaggcaagacgattcgaccataacaatatagttttttgtcccaaacatattgtggtaagctagagatgaaacctacaagaaacaagtataggaaaaaaacatcaaaatggtaaaggtatggctgtagagttaaaggaaaataggtaaatagaaaaaaagcaaaaaacatggtttgagcatgttgatggctagtcccaaacgcacctatccatagcaaatttcttgaagatattccacttcttaagatatctcttaaccgcattatcctaaatcattttagtttgacctcaacctctttttacattagcgacctggttctaaactcctctacgcactggcgcctcagggagtctccttttgacatgttcaaactatctcaaccgatattgaaatcaatttctca

SEQ ID NO: 21157 - DNA, 1077 bp, Zea mays
aatccagcacagcgcataccccccggcgttcctgttcccctcggcgacgccagtacggcagtacgccacgccagtgcccagttgcattgactcctccccggtccccacatcttgccgccaatggatgtcgacgggcccgcccccgccgacgcctctgccaggcccgccaccaacggcgaggccccctccggcgcccgcgaggtcgacgtcggcgaggaggacacgctcgccggcgtcctccgcagcttcgtcgacggcgtctggtacccggacgagcctctgctccggcggctccgggcggcgtcctgcgacgccgcgccgcgcctgaggggggcgtcccggaactccgcgcgggacctgcttgagtggaccaggcggggcagcggcctccgcgccatcctcgtcatctcggtcgggacaatcacgcttatagcattgactggccttctgaccttcatgttcttcctattggttgccactgctaatgcgatcattgtctcagtcttgatgtcactggccgctgccggaggattcttggctatcttctttgcttgcttggttgcagtgtatattggagcagtatcagttgctatctttgtcatttctgcgactgtcatctcagcagttgttggaattttggttgctaccggttgggttgggttcttctggatgatctggttcaccgcaaggaagagcatggtcctgacgaagcactccttcggcatgacgagctcggcaatccaatcgtattccgcgtcccggcaagtgaagcagaagcctgtcgactgaggctagttggttgcgtcctgtatgaagcggatatatctatctatgtgaatcacggttttgctgtttgtttgtttgtaagagtgtagaagacagcttgcttgttgcggcagctctgtttctctcggtgactaggtgtataatgctagctctgaactttggcagcatgtacgttcggcatggcggtcaatgctgttatttaaaggatagtgagcagatgttaatgtttatagcaaataaaagcatgttaatgtttattaaatttatcttgaatgaacttattatttcttt

SEQ ID NO: 21158 - DNA, 1066 bp, Zea mays
attgggtccctcgaccgttcccctcgtcgacacctgcagtgccaagttgcatcgactcctccccggtcctccaccgcccgccgccgatggatgtggatgtggacgaggccaccgccacccctgcctccgcctctgccaagcccgcttccaacggcgaggccccctccggcgcccgcgaggtggatgtcggcgaggagtacacgctcgccggcgttctgcgcagcttcgtcgacggcgtctggtacccggacgagccgctgctccggcggctccgggcggcgtcctgcgaggccgcgccgcggctgaagggggcgtctcggaactcagcgcgggatctgctcgagtggacaaggcagggcagcggcctccgcgccatcctcgtcatctcggtcgggacaatcatgcctatagcattgactggccttttaatcttcatgttctttctgctaattgccactgctaatgcgatcatcgtctcagccctgatgtcactggccgctgctggcggattcttggctatcttctttgcttgcttggttgcagtgtatattggagcagtaggagttgctatctttgccatttctgccattgtcatctcatcagttgttggagttatgattactactggttgggttgggttcttctggatgatctggttcaccgcaaggaagagcatggacctgacgaagcattccatcagcatgacgagctcggcagtccaatcctattccgcgtcccgccaagtgaagcagaagcatgtcgactgaggctagttggttgcgtcttgcgtcctgtatgaagaagccctcgggtcgatctgggtgaattacggtagacgacatgcttgttttggcagttctgtttttcacggacactaggtgcataaatactagctctgaacttcggcagcgtgtacgtttgtcacggcggccaatgctgttctgtatggtatagtgatcagatgattgtacattgtgcaggtatgcagtatgtacatgccgattcatgagttgataataaaactatcactatattttttttccttaaaaaaaaaaaaaaaaaaaaa

SEQ ID NO: 21159 - DNA, 1126 bp, Zea mays
ttgcaacatcatgatgaagtcatatattaaacatggaatgcttgaagacgcgaaagacctgctccatgatattctgaattgcaggataaggagtaaagcggattctaatcttggggcctccgcccgccgggttactttcaatactttcatggaggcctgtgctgcagcaaaaaggtggaatgacttcgagtatgcgtttcgtgagatgttattgaatgggtaccatttcgatgagcgaagacaccttcggatggtacttgacgcttttaggcatgggaaggaacagctgttggatgatctatggcactacctgtgccgtcacagccgtgtcccgccctcccctgtcataatggaaagattctgcctaaaactgatgcagggagatacactggcggcgatctcctgcgtcagcagcttccatgagggcaagatatgcaacgtctcctccatgtcatggctcaatctgctgagccgcaatgcagataggctgaaggaggagcatgttaccaagttagctcatgaactcaacagcctcattagcttgaggagttcctctgatagcattagtcttagcctgtaccaaaaaattattagtagctgtacggcattcctctctggagccacagttgtagaaaaggcaccttctggccaataggtggtgttacagaaattataataaccacagttagtaaattctagtactccaaatcataattaccacgactgatggagtgtattgcattcaacgtttggttatcggtacaaagttagaaatggaaaattttcacgtaaggaattagttctttttttagtataatacaaaggctgatttgggagcataagcgataaagcttgctttgtttgattaattttttactggttactttcaaattcccaagtcataataccatgagcatcatttattgatctgtgactgtgactggcagttataaacaaagtttgttgcctattgcctctgggtgcagcatttgatattgtactgtgcctacttactagaagtgtttgattgtgatagaaatacagtataacaggatgccgaaaacacaaaggtcggtccctatatgcagccgtttgccagttctgttcctcaaaatatgattactcc

SEQ ID NO: 21160 - DNA, 1335 bp, Zea mays
ttttttttttttttttcgataatactgtaatatattatttcctctattttaaatcatactgtaagttattttattttttctgaatacttagcttttattatgtatctatctacacatagtatacatctaggtgcataataatgcattttaaaaaaataaaactaataatttggaatgaagggagtagcatatgagaacctttcgattaagtttagccacgaggcatcaatctcacaatctatacttccacaacaaagtaacccaacatgtagctgaaggcaggctcgaagctgctaacactctcttaactaagaagaaccagtcttgaaccagccaactcggcgtcagcctagttagcttggcttgcatccaagatatgcagtgattccccaagcagcttctgcgcttccactctcctctgctttatatcttcaattgcttccttgcggcgctgaatttggctctcaagcatgtgaatcaatgtggctcttgcctgatgaggtcgtagggaattgagaagatgatgcaagttcttgaatatgagtgtgatatcttccaccctacgagcatattgagatggtctctcaactaaaatatctgccagctccaaaatatgcaattgaagctctctgttgagggtccttagctcctttttgaagtcaatattggggccctttggataaagctgacggacattatgactctccaagcttggaatcacaacatctcctgtgtaatcaacacccaaagctttgaatggtccatcaattggtggtggaggttctggtgcagatgaaggatcctgctcaaaatttttgtacagtcggtaaaagggaggtggtggagggtaagatgatgatgtggccattgccatcctgaacaagaaaatggaaattgctgggtcacttcttgtcttcaccctgaaaacaagcacaaccaagccgaatggagtcaattatatcaatggagattggagacaagcgtgccggtgatggtgccaatcctggtgccaagagcagcccattctccgtgtccaaccggatcagcctgccagtcaccactgccagctacaggccagcagctgcatgcatgcacctggagtagatcttggagctgagatgcaaatgacggaggtcacgtgtcgacggcgaggggcaccccgtcagtagcgtatcgagggcgaggccagcggcggagatgagacgaggaaggccgtggtggcggtggtggtgaggcgagcgcggcggagacgaggacgccgtcgacggaggcgatggtggggcgactgggcgaggatgacttccaaatgcaggacagcaggagtttcttgtccgt

SEQ ID NO: 21161 - DNA, 1029 bp, Zea mays
  misc_feature (18)..(18): n is a, c, g, or t
  misc_feature (29)..(29): n is a, c, g, or t
ttaagacgagaaatcttnccatgggaaantagcatatagcatatattttccttttttttttcttttttttgaggaatcaatctcacaatatacacttccacaagaaagtaacccatgatgcagttgagtaccaatggaagtaagaaagtaatccaactttgctaacatagaccatagaagtaagaaaattcagttatcaaagctggaaataccacaagccacaacagatgataccacaacaatccagacacatcttgtcttctactaacactctttaactcatagaagaatcggtcttgaaccaactaacttgacggcgtcagcctagttagtttgacttccatccaagataagcagtgattccccaagcattttttgcgcttcctccctcctctgctttatatcttcaattgcttccttgcggtgccgaatttggctctcaagcatgtgaatcaatgtggcccttgcctgatgaggtcgtaaggaattgagaagatgatgtaagttcttgaatatgagcgtaatatcttctaccctacgagcatattgagatggtctctcaactaatatatctgccagctccaaaatatgcaattgaagctctctgttgagggtcctaagctccttcttgaagtcaatattgggaccctttggataaagctgacggacattatgactctccaagcttggaatcacaacatctcctgtgtaatcaacacccaaggctttgaatggttcatcaattggtggtggaggttctggtgcagatgagggatcttgctcaaattttttgtacaatcggtaaaatggaggaggtggagggtacgatgctgatgtggccattgccatcctgtcgactgtcgtaccggcaccgcagggaggtcgggaggagagcgcctttgccgccgggagatacgccgatgcggaaacgaatgggggcaggaaggtggtcgtctgatgctctgatgggcggatgggccgtccgaactcggatccgcccaggcggtctcggtcgtccgtttctaatcg

SEQ ID NO: 21162 - DNA, 1188 bp, Zea mays
gttgataaatgggattcttccatgcaggcatgcagcacattatctaagattgagaaagcaaaacatttgaatctctagtagataaaatttatctgatcatgagaatctatatataactaaacatggccttacttatctatattgattaatcgacaaattctacctaacaaaaataagacgggctcgcgtccctttttttttttttttttagcatataacaacctttcaattaagctggccacgaggcatcaatctcacaatatacacttccacaagaaagtaacccatgatgcagttgagtaccaatggaagtaagaaagtaatccaactttgctaacatagaccatagaagtaagaaaattcagttatcaaagctggaaataccacaagccacaacagatgataccacaacaatccagacacatcttgtcttctattctactaacacactaactcatagaagaatcggtcttgaaccaactaccttgacggcgtcagcctagttagtttgacttccatccaagataagcagtgattccccaagcaccttttgcgcttcctccctcctctgctttatatcttcaattgcttccttgcggtgccgaatttggctctcaagcatgtgaatcaatgtggcccttgcctgatgaggtcgtaaggaattgagaagatgatgtaagttcttgaatatgagcgtaatatcttctaccctacgagcatattgagatggtctctcaactaatatatctgccagctccaaaatatgcaattgaagctctctgttgagggtcctaagctccttcttgaagtcaatattgggaccctttggataaagctgacggacattatgactctccaagcttggaatcacaacatctcctgtgtaatcaacacccaaggctttgaatggttcgtcaattggtggtggaggttctggtgcagatgagggatcttgctcaaaatttttgtacaatcggtaaaatggaggaggtggagggtacgatgctgatgtggccattgccatcctgtcgactgtcgtaccggcaccgcagggaggtcgagagcgcctttgccggccgccgggagatacgccgatgcgaaaacgaatgggggcaggaaggtggtcgtctgatgctctgatgggccgtccgaactcggatccgcccaggcggtctcggtcgtccgttt

SEQ ID NO: 21163 - DNA, 3342 bp, Zea mays
  misc_feature (26)..(26): n is a, c, g, or t
ctcactatagggcgaattgggtaccngggcccccccctcgagttcaggctacgtcggcgcccccccccaagttagtgctgtttcaattagaaggattccaagggttccttcagacatgcctctgtatgatatactgaatgagtttcagaaaggaagtagtcatatggctgctgttgtgaaggctaaacccaaaactgaaccaccccttgacaaaactgaaccaaacagggaagcagttggaccaacacaattgactgttcccttgttatctaatgctgaagaaagtgcagacaatgtggttgtggatatcgaaagaccacataacaggcagattaatgggaacacagcatcaaacgcagtgcctaggtcatcagaggatattgaggatggtgaggtcgttggaatcatcacacttgaggatgtattcgaagaactcctacaggaggaaatcgtggacgagactgatgaatatgttgatgtccataaaaggatccgagtagctgctgctgctgccgcatcatcggttgcaagggctccatccgttaggagattaacgggccaaaaggctgcaaaccttcagggagcacagaatcgccaaggacagcaacctcctggaattctcaagaaacctactgagggtgattcaaacccatcaaaacaagtgaaccttatggaacctcttctggaaaaggggaggtaactctaatggaacctcttctggaaaagaggaactctaaaatgcattgcgcaacgtagggaaccatgctggaagagcctatggttcttgctatattgtagcaagaggtaaatagagatgaactcattgttgcaaattccaacatgagcgaccgagcgatgtggttttggtgtcattatggacattacattagtgttgaattctttggatccccctccctttttttttgtgttttgggcttcgaaagtagagtcgccatttttgaatgtcaccgctaaccgcagtagcaagttagcaactgctttatatatatgtgcttcaaattaaaaaaaaaaaaaaaaaaggaggggtgcataagatttttaaaaaaaatatcggaacggacatgcttggtgtgaaccagtataattctgttattaggaaaaggcttggagatttgaaaaggactgttccacgtagactagggtggttcacgagtcaaatgcatatttttgagctttcttcaaaattgataaatcttatttatcagggtctcttttgtatgagatcttactttaagctgagtcgaagtcgaaagtcacctaaaatcaacttatttttattttttttagaatgatatttttgaaacgagcgactggtttccagccctacttcgtgggacgcattggatgatacagtactagcttgcatcttacgcctggtcctaggaaacttgggttaccggatctttctgcattattttacggtgatgaaccaaacagaatcttcaattgagttgtaaatacaggaaacttgggccttggctgccaagaaaccttcagctattttcttaaacaaaaaaaagaggaaatcttcatctatgacgtcaagtttcctccactcggttcttggaagtgcctcgatactgactcgtccgtgcactacatataaggaacaccgaattcgacgcggcggcacattccgaattctgccacgggaaaccaacgcgatgcaatagcccaactgaaaccgagccaagcgcccaacaacctttccatccaaatataatgtagtcctggcacatctgaacccgaggcaaaactcagccgccggcacataaatccatcttgagttggccagacgcgttcctccggcgttgtgtcgatggcaccgtcggcgacgtgctggtgcggccactgcggcgctgtccgccgcctccgggcggagggcgagttcgcgtcctgcgcggtgtgcggcagggtgctcctggacctgcaggacgacgcggtggcggctccaccaccacggcagctgcggcgacgtcagaggagggctcgtgacggcgcggcggctcgtgacatcggcgcgaggcccgaacgcggagatatatcggacgctgaatccaccgtcaccagtaccggagaggatcgatggattgacgagaagtagcagcagcagattctctcaaacgcaatcgatcgattatatcgcttctactctcgtctgttaaaaaaacttgttttagtcttgttttacaatctataagtcatttttttttgttattccccaactttttttttactcttacccttctctgattgcattgttatctttccatctatatgccacctataattttagagacgagtaataattgaacgtaagatgagaatttatctacattctctctgcggaacatctctttattaatttattttcctaaataaagaaactatggttagttaaattttagtatacgtgtataaccctgcatcctcgagttacaagcatctttgtttgccacgctctttggcttcttggccaacatgtattcgcgtgtcttcgtccaactagatcatcgactcattcaccatcgtcttcgtagctccatcgatcgtgttgttctgttcatggatacataaatcagttagaccttgttctatttattcctattacatgtagtatgtagattgaagtggattgagtgtgattgatgtatattttaatttgctatagatttaatccgacaatcccacctaatctacaaggattaactacaaaacgaacaagccgttaatggccgaccatataattaagttcacatgtatttgcttcaaggaaggagatttcgctccaacacaatcggagagcaaatgattaccatcgtcatgacagaccttgccattgtaaatgtgtatatatattatcaatggaatgaaatattgaacctctcatgacgaccaaaacgaaatttatacaaaaaaatatgtaccatatcaaataaaaaaatctacttaatccactgtaaagcccaaatttagtagaaataaataaataaaataatatatcatgaaatcataaaataaatataaatatatatatatatatataataagtatggtaagaatttttgaagacctttgaaatctattaggattctctctttatattcaaacaataatattaaattagttaggtaactaataaattaataaagaaaagtgttggttacttgttctcaaatgctataagaacaaggcaacacaaatgttaatggtcaaagaccttcgtccttcgaagcattatcttccttaagatataatgatctttagacgaaggttatgaaggacaaaccttcataatctcaatatgtaataataaaaagc

SEQ ID NO: 21164 - DNA, 1927 bp, Zea mays
ggctggacctgcttatacggtgcctatgcccacgcatcgggctgtgggaggcgggctctgtttctgactcatcggccgagggcgatggcggcggcggcggggaaggcgcgggcgatgagcctggcggcggcggtgcgtgtggtggcggcgacggcgcggccggcatcgagcgcagccgcggcggcgggtgtgggtgcgatggcgttgatcgtgcagggcgaggacacagccttcgggtcgctggagtggtgggcgtacgcgggcatctccttcttcctcgtgctcttcgccgggatcatgtccgggctcacactggggctcatgtcgctcggcctcgtcgagctggagatcctccaacgcagcggcactgacgccgagaaggctcaggctgctgccatccttccagttgttcaaaagcaacaccagcttcttgtcaccctgttgttgtgtaatgctgctgccatggaggcacttcctatatttcttgacagaatgtttcatcctgttgttgctgtggtattgtcagtgacatttgttcttgcctttggagaggttataccgcaagcaatctgtaccagatatggcctagcagtgggtgctaactttgtatggctcgtacgcattctcatggtcatttgctatccaatttcttaccctattgggaaggtcctggactgtgctcttgggcacaatgagtctgcactttttaggcgagctcagttgaaagctctagtttcaatccatggcaaagaggctggcaagggcggagagcttacccatgatgagactacaatcataagtggagccttggacctgaccgaaaagactgctgcagaagctatgacacctattgagtcaactttctcactagatgtggattctaagttggattgggaagcgattgggaaaattcttgcccgtggtcatagtcgtgttcctgtatactcaagaaaccctaaaaacatcatcggtctcctattggtgaagagtcttttgactgttcgtgctgaaacggagacgccggttagtgctgtttcaattagaaggattccaagggttccttcagacatgcctttgtatgatatactcaatgagtttcagaaaggaagtagtcatatggctgctgttgtgaaggctaaacctaaaactgaaccaccgcctgacagaactgaaccaaatagggaagcagttgggccagcacagttgactgttaccttgttatctaatgctgaagaaagtgcagacaatgtggttgtggatatcgaaagaccacataacaggcagattaatgggatcccagcatctaacgcagtgcctaggtcatcagaggatattgaggatggtgaggtcgttggaatcatcacacttgaggatgtatttgaagaactcctacaggaggaaattgtggatgagactgatgaatatgttgatgtccataaaaggatccgagtagctgctgctgctgctgcatcatcggttgcaagggctccatccgttaggagattaacgggccaaaaggctgcaaaccttcagggagcacagaatcgccaaggacagcagcctcctggaattctcaagaaacctactgagggtgattcaaactcatcaaaacaagtgaaccttgtcgaacctcttcttgaaaagaggaggtaactctaaaaacgtagccgataaaacgcatggaatcaagccggaagagcctatggttcttgctattataacaagaggtaaatatagatgaactcgttgttgtaaattccaacaggagcttttggtgtcatggacattagtcatgaattctctctccccctctccccttctcccctctttggttatggactgcgaaagtagaatggccactcttgaatttatttatcaccgctcaccgcagtagcaactgcattatatatatgctccaaatccctag

SEQ ID NO: 21165 - DNA, 2454 bp, Zea mays
ctgcagggtggtgaagctccccacacaacgacaaatactattaacaaggaatgtaagttcgaaaacacaggtcctgaaaattatatcgcttgggaactatcactaaactctggttaagttgctaagaatgtaaggtgatccactcaatttatcactatcacttccttcgctaccaatgtacaatggtcttaaatagtgcaaaggttattttggggatctcatattagatggtgggggcacagaatatgggataatgctacacattctcacttgggaattaaaccttactctcgttaatctgcttttgctatccctatatcagtggccctgtactgttgggctgaacatattgcagtcatcatattgcagacacatgtgatgccagagttgtcatgagtaatgtttgcgatcaaggtagttaacaaatatgcatagttgtataaccatgcaactcgaatgtctctgccaatatgacaacatttttcattcgccccccagtgtcttatggcacaaaaagttttgtagtgttggccatcaattttgtctgattaggacccatttgttctctatagatttttggctgtaaaatagacatccttggccattatactgataagagtgtagagattacaattgtttcaattttcaaccatacttatacttgtcggaatcatctgatatatttttttatgacaagcttagaaaaattctaggcgtaggcatgcataaagtgagacctctttgtgaatttgattgttgcattaacattcactaacaagtcataagagttaaatatattttttccttgaagtcaggcagtccaactttcagtttcttagaattatttttcgttttgcacatactgcttaacaataacttactaatccatctttaccttgtattcttatgctgtccttttacaggcatccaacaggtacaccaaagtccaggtagtcctcaggtaaatgtatattttgagcatggttacctttgacctgataagcacttttcctgcaaggaatgggatattttccccttacagtacagattcttcttctcttttgttgttatgtcgcttcatttcatatgtgtctgattcaaagtcgacctgtatgtccactaaggctatctctagcagcttacccatccacatacccatattcaaactctattttacaaacagtgcagtctacagtgcaaaacagtgttttgagtgactatttaggtgaactgttggacatggtctaagaaaaaaggcttttgtattttttgggtatagatgtcgtgcaattatgctttcaactcaatgtccagttattgttcattaaaaaaaacctcgaactgtagggggtaagatagccccttcttattgtattaagaagaagaccttgtcacataggtcaagaaaaccctcgaacccctacgctccacccatacacaacggcaccgtagcccacgtgagaacgaccacgaccgagacgggccttagacctctgctttgaagtgggacaaacgaggtgattttttaactacgacctgaaattcgctcccatgagtcgaattcaggacctaaggagggctactcagaccacctaaccaactcagctagaggttctttcgcagctactgatcattgataagcactgaaacatgtttgctgcagtttattgcacatatgttacgtaagatcacatttgtgttgtctgctgcagatgtctgttatttccagttgcttcactgaaaattgttattatgtttgtaggttgtttggcaagacaacattgagcctgataatatgacatatgaggaactgttggatttgggtgaggcagttggaacccaaagccgtggtctctcccaagaacgcatttcatcgcttcctgtcacgaagtataagtgtggttttttttcaaggaagaaaacacgccgtgagaggtgtgtgatttgccaaatggagtacaggagaggaaatttgcagatgacacttccatgcaagcatgtataccatgccagctgcgtgacaagatggcttggcataaacaaggtatgccctgtttgctttgctgaagttcctggcgaggatcctgaggcaatgagtcaacagttatgaggccactgggaagttgttgcactttgaagctgagtactgcccccaatgaacgcatgatgtttgcttgaaggcagcttattgtccccactttataattgtgtattagcaccgtattaccaaatataggttattgttagatcagatgtatttagtgtttggttcagcgttttgtaacgtaatcaaatcaggaacagagagataccgttacttgcgtttggttggacgaggcccataatgcaaatctataactaaaaaaaaaaaaaaaaaaaagggtataaaaaaaaagaaaaaaaaaaaaaaaaaaaaaaaaaaaaaaaaaaaaaaactcgagaagggcgcggtcc

SEQ ID NO: 21166 - DNA, 936 bp, Zea mays
  misc_feature (9)..(9): n is a, c, g, or t
cgtactggncacgatgcatacaaactcatacaagtatggatactctggttctgggaactattacagttatgctcatgcctatgacattgacgattacatgcatagaactgatggtgggcgcagaacatgggataacactacacctgtaaacaatgtggattctgccaatgttgtcctgcagggtggtgaagctccccgcacagctgcaaatactactagtgaggattgcatccaacaggtacaccaaagtccaggtagtcctcaggttgtttggcaagacaacattgaccctgacaatatgacatatgaggaactcttggatttgggtgaggcagttggaacccagagccgtggtctctcccaagaatgcatttcgttgcttcccatcactaagtataagtgtggattcttttcaaggaagaaaacacgccgtgaaaggtgtgtgatttgccaaatggagtacaggagaggaaatttgcagattacgcttccatgcaagcatgtataccatgccagctgcgtgacaagatggcttagcataaacaaggtatgccctgtttgctttgctgaagttcctggcgaggattctcagaggcaatgattcatcagttgtgatgccactatgaagttgctgctctgggtactgcgcccccaatggacgcatgatttctgctttgaaggcagcttgttgtccccactttagaattgtgtattagcgccatattaccaaataggttattacttatcagatgtatttaggtagtgtttggtttcggaatatggtaggatggagtcactttgctcctaatttattgttgtttgaattgattttatgtaggacatagtaactctaaaattggaaaaactatgcttaaatactgaatcatctgactccccaaaatcttttggacggagacactaaaaaaaaaaaaaaaa

SEQ ID NO: 21167 - DNA, 1758 bp, Zea mays
  misc_feature (150)..(150): n is a, c, g, or t
  misc_feature (174)..(175): n is a, c, g, or t
  misc_feature (1604)..(1604): n is a, c, g, or t
  misc_feature (1608)..(1608): n is a, c, g, or t
  misc_feature (1736)..(1736): n is a, c, g, or t
aaaaaagcgtcgcggagccacgaccgacgacccctattttggcacgcccgtcccccgcttatacgccgcgccggcgaggtcgctgctccgaatcaccttcccttcctattccctctctctctctctctctctctctctctctctactctntctctctctctcccgcccgctccnnggcctcctcctctacccgccccacaaaccaaggccctccgctgtctgcacggcgacggcggtgcatgggcggcgggcgcgccgggacgacgacgacgacgaccgcgccgccatgaccaccaccaccacggccgcggccgcggtcgcgcagctctgcgccgggccacggcggcgcaagcaggcagcaggggctcggctcgacctgcgctgggcgcgcctgctccgcctcgccgtcgtcaccagggtgctccgcctcgcgcgcgaccagctgctcgcctgctcctcctgcgggggcggcaccgccgcccgccgccggtaccgccgcctcggcccgcccaccagcgccagcgccggtcccgtgctgtcacccgtcgacagggacgacgactgcgccgcggacgccgaggccgcggcccctcgcgacgcggccgacgacgaagacaacgttgtcagcctcaaggtcagcctgctcggcgactgccagattggcaagaccagcttcatggttaagtatgtgggagatgacggggaggagcagaacggcttgcagatgacgggcctgaatctcatggacaagacgatgcccgtcaggggagcaaggattgcctacagcatctgggatgtggcaggagaccaccagtccgtcgaccacgtcccaatcgcgtgcaaggacgccgtggcgatcctgtacatgttcgatctcacgagccgctgcacgcttaataacattgtagattggtacgggagggcgaggaaatggaataagacggctattccaatcctaatcgggacaaagtttgatgactttgctcagcttcctcttgagatgcaatgggccatcgttaaccaggccagagcatacgcaagagcgatgaaggcgaccctcttcttctcgagcgcgacgcacaacatcaacgtgaacaagatcttcaagttcatcacggccaagctcttcaacctcccgtggacggtggagcgcaacctcaccatcggcgagcccatcatagacttctgacgaccccttcctctaactagtaactcggcagcacacgcacgacgacccttggtatatatcatgggttgacagggtcgtgtctttcgatcctcttgccctgtgcgagccgccggagccatgaagtgaccgagcatgcccgtcgtcctcttcctcctggtggccggctgcagcaggcaagatgccctttgtaaatatagccataggtgacggtcccgcgtgcgtgcggccgtgcgggagcgtcgtcaaatgggaagaaaaccgcgaggtgtgactgtgatgtaacaccccgtctgtaacattcgccagagtatataggaaatccatgttaatataccctccattccaactgacaaaggcatgcgctggcgcctggcggcttgctgccggtgcagaacctcttctttctgctcacccnacgnagctgcgtgcttgcatgcgtcttgaggcgtgcaagcagttcaggttcctccgttcctgtagttggttatttgtacatctgtgagttatttgcacgacgagtcaatttatgctaccccgtcacaactcncaagctaaaaaaaaaaaaaaaa

SEQ ID NO: 21168 - DNA, 3046 bp, Zea mays
  misc_feature (997)..(997): n is a, c, g, or t
  misc_feature (1475)..(1475): n is a, c, g, or t
taaagactgctctgagcaaagagtactcacctgcacattgaagcaagtgggccttggtgttgatcggagcaatagtgaaggagagtagtagttgtaggcccaaacaacgtcttatgtagataggcgaaaactgaagtggtcaagtgtgttatgttagaaaaaaaacttggcaattgagcatgcatggtcaggtctccattttctttgtccatttgccaagtgcgcactcgggattggagtgtacgtcaatgttgtttgtgggccttggtctacaggaagtgtaccagacatgctaaaaagaatcgacagctacgttgcatctgtctgataagagtaaggaaggttgtactaaagttaatagttagttgactaagaagttgctagtgaaattagcgagctaataaataactagttaagagcatctctaacaaaaaaatcctatatttgagtcctaaaaatcaaaataggacatgatttaaaatgtttaggaccataaaaacatttacagctctaacaattaagtcttagatcatgttattagaaaatagatcatgttatttagaaaataaaagattagattagtgtattaaatgaggatagggctctagcatatggagtcctatatttaggacctgagataccgggttctataattgtttgatgaatttttttgaaatatgacctctgtcggagcatgtttttggtgtcagggtcttatatttcaaaataggacctcatttaaactcccattggagatgctctaactattagcaaatttgctaaaagtacctaatagctgaactattgctagattgttttgatatctccagttaattttagcagctagttattagctctagagaattcaaacggccctcttaggacttgtttagggttttagtgtttagggtttaggacctgagataccgggttctataattgtttgatgaatttttgtgaaatatgacctttgttggagcaggtttttggtgttggngtcttatatttcaaaataggacctcatttaagactcccattggagatgctctaactattagcaaatttgctaaaagtacctaatagctgaactattattagatcgttttgatatctccagttaattttagcagctagctattagctctagagaattcaaaccgccctcttaggacttgttttgataccattagctaaaacaaagtgactaaaatagtcactttaggaactaaatattcaaacataaagagctaaccgtaattaaatggtaaaaagtatcattttagtcattttagccctttctgtttagatctttaacttctaaagtgactaagctctagtcactttactttagatgatgggaccaaacaggcccttatttggcaaccgcctgaaaaaaacctgacccgaccaatactatggacaggcataagccatagttttttacccgcaacaatccatggctaggtacgctctangatttttaatccaaaacctgacgccaaagtaaaaaaaatcgatccaatccaaaaaaactcgatcagacgggttcgatagggtggcacgagtcaaccccacactaggcacaaatcagacgtgggccattgccgaacgacccggaaagaccagtttagcctttgcatttaggttaaaatgttttttttggaacggtaggctagagttgttgcttgcactacagcactgctgctgcacagcggagtgttgtgaagttccattcctatcggaaacaatctgtgcgcgttgattgctaaaagtgatctgtgttcctaacaggccaatggaccatccgtatccgcgccagcgccgacgcaagagcgatgaaggcgaccctcttcttctcgagcgcgacgcacaacatcaacgtgaacaagatcttcaagttcatcacggccaagctcttcgacctgccgtggacggtggagcgcaacctcaccatcggcgagcccatcatagacttctgacgacctcctccgctagctaagtaattagacagcacacacgacgatccttgttggtatcacgggttgacagggtcgtcgcctcctcttgccctgtgcgagtcgccggaggcatgaagttgaagtgaccgagcatgcccgtcgtcctcttcctcctgattgccgacagcagcaggcaggatgtcctctgtacataggtgacgtttccgcatgagggagcatcgtcaaaatggcaagaccgcgaggtgtgactgtagtagtgtaacacccgtctgtaacattcgccagactgtataggaatccatgttaattagagctagtttggcagccacatttttaaaagggatttccattttcctttcccttggaaaaatgtttgtcaaactaatccttaatataccctccgtttccgtgacaaaaaaaaaaaaaaaaatgggctcgcgcctgtctgccgtgcagggcttcagccgttccacttcgcttcagctcgcccgccgtagctgcatacgtctccaggtgtgcaaagttcaaggttcgtgtagttggtctctttgctgttgaaggcagtggactgcaattccactttgccatcttaatttggagttttggacgcaccacaataagcaaaactgctccatcagcaacaatagacctaaaagaacagcaacaataaatgaaaagtagctgtgaattagttcagtgtcgagtcagtttaggggtattttaatgcactagaactaatagttagtttggctaaaaactgttagtgaaattagctagctaaaaaatagctacctaactattaattaatttactaaaaataattaatagatggactattagctaggatgtttgtatgtctcaactaatttaaaccactaactattagctctagtgtattcaaacaccctcttaggctacttcatcataagttacttccttaatagcataccattatatttgttgattatatgcccaaatgtcaaccacctttattaatcatatatatccaaaaatcaattatatttattaattatatgtccaagagtccatcgttattgtaaggatgt

SEQ ID NO: 21169 - DNA, 943 bp, Zea mays
  misc_feature (879)..(883): n is a, c, g, or t
  misc_feature (904)..(904): n is a, c, g, or t
  misc_feature (910)..(918): n is a, c, g, or t
gtaagtttaatcttctcgttggatgttcgttcatctgcaggttaggaattcgccacgacggggaggaccagaacggcttgcagatgacgggcctgaatctcatggacaagatgatggccgtcaggggagctaagattgcctacagcatctgggatgtggcaggagaccaccagtccgtcgaccacatcccaatcgcgtgcaaggacgccgtggcgatcctgtacatgttcgatctcacgagccgctgcacgcttaataacatcgtagattggtacgagagggcgaggaaatggaataagacggctattccaatcctaatcgggacaaagttcgatgactttgcccagcttcctcttgaaatgcaatggaccattgttaaccaggccagagcatacgcaagagcgatgaaggcgaccctcttcttctcgagcgcgacgcacaacatcaacgtgaacaagatcttcaagttcatcacggccaagctcttcgacctgccgtggacggtggagcgcaacctcaccatcggcgagcccatcatagacttctgacgacctcctccgctagctaagtaattagacagcacacacgacgatccttgttggtatcacgggttgacagggtcgtcgcctcctcttgccctgtgcgagtcgccggaggcatgaagttgaagtgaccgagcatgcccgtcgtcctcttcctcctgattgccgacagcagcaggcaggatgtcctctgtacataggtgacgtttccgcatgagggagcatcgtcaaaatggcaagaccgcgaggtgtgactgtagtagtgtaacacccgtctgtaacattcgccagactgtataggaatccatgttaattagagctagtttggcagccacannnnnaaaagggatttccttttcctnttcccnnnnnnnnntgtttgtcaaactaatccttaatat

SEQ ID NO: 21170 - DNA, 5321 bp, Zea mays
ggtcagcatgtgaaagctaacttcctacaggcttttataaaacaccgtaggaagttatgtttattttctagagctaccagttgcctctcggaagttatttatttcctacggtttgttataaaagctgtaggaagttaaaaaaccgtaggaagtgtatgtttttggtgtagtgatggagacggacgccggagcccgacagcgcgcgcgtgcggtagttgggagaggagagaggtatggagtaaagaaagagaactctgtaaatggcgtctttcgagtccgtctctattttacggtcttcgatagagttggccgctgcaccagatattttactgcataacggactccatcccagtagcgtctcacgtgaagtcgatcactgcggctagtctcatgaggctccctatagattccctctaaacccctttgtcatcaaaccggtccgcatggcgatgaagcccagcgtactgtgtttggttgtgcgtgagttgtgttaacggatgagcttttctttctctgccaacgcagtttgcgcttccgagcgtgagtttctgaacatgcttaccgactgccgtacatgttctcttagacttggtttctatggactaatttttattctcttagttttattttagttttcgtatttggtaatctagagactaaaatataataaaatagatgtactaaaaattttagtcctagaaaccaaacacgaccctaaaaaaagtgaagctcttgtatgcaaatagtataattttccctctatcttgacatgacatgacataatgataaggagaaacgaatataggctttctgttgatatatagattctttgcctaaaatgccctcggaagttttacagcccgtattgtatgggcagtgggccaagacaaaaaaaggagaggttctaagttcttggaatatagttcggtcacaccgatccatgtgacgtcttcagacgaaggagtacacgataaataaagataaaatattatagaaaaaaaaatagaaacaggtggattaaagccgcagcagcggacaggaactatacgagtcaaaaccatgcaaaatcataacaaaagcaaaccggccgttagtaattaaaccactcatatctgatgtctgcttctacatcaagtaggcccactagtagggggtaattagctctaaatcttacaatataaaatctaaaattgaatcgaattaggaccgaactctgcttgaagtttcttttaaactataaaattaattaagagtccaaataaattgagaagaaacatttggatcttgagcaattaccacccataccactagtggttaattagaaaacaatatcatgtcagttcatggtatgaaatccactggataattgcgaatttgccacatatcctgatatccggtgggcacgagtggacggacgctccgagttggctagtggaataagataggcacctcaactattggtttggttgtggagccgcccgtatatctcaaaacgcgcatgggcaattggcaccagtccagtccgatcgcgcggccacgtttgcatgcacgcgttccttggatctctataggattttggctgaaaagctcgaaatttgacctgggatgcagctggcttttgaatcgtaatgcgttcggcccggcaagttccagcttcgcgatgggaggaagtactcgctcgctgcaggctcaccgttttatttgggcccaaactcagatttgcttactgtacaagcggcctgtgcgaatgggaagtacgcgccaaccattcccccttttttcccccttcgtcccgacccggtgaggccacctagcctgagtttttttgtatgcttgttagttctcatctcaatacatacgaattaggggagattagataagtttaaatctataacgagttaaaatctctactattttttaatctatccaatctatatgatctagtaggaataatagaacaaagccttataaacttttcatataagtgcgattagggataaaaacgaggcgggaaaatcttgtaccatcctttttcgaataccattttacccgttcgttttttgaattatctgggaaccgattataaccgatacaaaaacgatttagctagattttcgatcgttttcgtatttttcgtttacgagtcgtgatgataccgtttttttatataatataagatacatctagcgtataatttaagttacatatttttgttgtgttcaagtgaatgaataagagaaaaaacaaaagttgtaattagtctaaataatatgagtgatgtcgtgtattttaatatcttaaaaattagacaatatgttactttatcatgtatttggaaaactacacggtaacttccaatttgaagcaaatatgttcataagatatttgaagttccaattttttttatatcaatggcaactcgcgaatgcagcaagacatggcacacagaatatggcagcggtactatttgaacgcaatgcatagctacatccaaagcccaaataaacacagccaaagcacacgatgaaaggcagctaaccctcggtatgcacacatgctagagctcttggtatttgctaagtgtcaaagccagagtacacgccgctgcccctcaggagccgcttctcctcctcgacgtagttcttccccctgctggcttggccccggtccctcttccgcttctctttctgcgagaaggaggcgtccttctccttcctgtctttctccagcaacagctggttcggcggcgcgttctgcagcccgatgaacttctccccttcggttactgcggccctggtacgctcgcgttcctcgtaggactcgggtgcgtgtgcgtcctctttgccgtcgcggtctttcccagtggaccaggaccagttcggttcctccgctgccggacgaactgtcaagacggatgggccgccatggtatccgtgccggctcagagcgctgaaatccacaccggttttcttcttcttctttgacctggctgctgttcacagagctaagattaatgttaaaatgaaccgtaacgacaagatatcatactcagaacaagcgtcatctgttttttttttttttttgctagattggcacttgctattttagcaaatcaaagtgtgcaggcttacaccatggaaacaccaaaaccccccaactcataacggttgctactccagctttacggacgcaaacacgggatctacgtaagcatgatacaagggatctgaggcccagaggctagccaagtgctggccagaggtggtcagcctatggacctcttcagtggcccaaaccagggtctcagctctggcagggtggatgatagcgtccagacgccggtgctcatcatcgctcccaatcctttgctggtcccacttttttaagaggacattggtgaggtaatgcaagggttgctcatacagctgcttcagcgatccggcgagtcccagccacgatgtgaatgggattacagaatcacggtaagcaggaaccggaatgcgcttcatgtattgctgatacatttcggccctcctgatcagagcacctgcacgatcccattacctcattagaaagatcattccccaaggatctgtggcagctcgatccatgtctcagacgtgccaagttaagaaacaatagtctctttttctcaatggacatttttaaaatcaaagaatttagtcttattcgcaagaattgatttggctatagtagttacaaaaaaaagttgcaaccaaaaaaaataaatactaaagccatattttaaaaagcatcttccttggtagcacaaactattccttgggaaaatgcagaaacaaatttcttaaataaaccggataaccaaatacatgcattggctggtaaaccagcagctgcagcttaaagcaaaacattggaggtcaggaaaggcgagcctatttagtgccataacaatctgtaaaaaagaacaacaaacctaatctaccaaaaattccaagctgctgctgtattaatatgatgaccataagtttgggaaactcgaaactttcaactattccactcaaggacaagactatatgtaggataagctgacaacattccatggaaatcaagccaacatatcatagagttcactcaatcacatgaagactaccatgttcgaagagagctccggttatggtaattacattcctaaagtacttttgttcttccattttaaaatgaaacttgttgagcctatttttcagttgcacaccaacttttgtaaggcaaataaatatcaactaagaagtctatccaataacttgcttttgattattctctccatattaaatttgatttgacaagaccagattcatgaaccaataggcagtagtcttcatgtagggttccaatgcaaatatacgccttatgacctacgctgcatcatcgaaaaggtgaaacccagagacaagcatactcaaaaaccaggtgtcagctaaggtccaatccacaaacttcaacagtcacagtacatcaaccatatcaattcgtcacctagtcctatccacaagtgaaacacatagaaacaaagtcattagctctcaccttctgccgtcgaagcagctttggaggaattgggcagcccaaaggcattccaagcattccccttcccagcatcatcatcagaatccgagctaaggtcatcatcagaagatacgtcctgggattccttatgcagcaccaccctcttcacatctagtaaccagaaacatggtcagtgccactccattaggagataatcttcataaatgattcttcatgtatagttggttaatatcaataaatcctatagactatgttgcatcgattgtgaaagtgaaaactgaacaataagaactatgtgaccacacactaacaatcgaccagactactcatattcgactagactactcagaattgaccaatcaattatctcagggccagtggagcaagtaaaactttcaacagtcacagcacagtgaaccatcgatcaaccataccaaggcagcaaccggaacacgcatatgcaattagattagcagatctagagtcagcaaaccatcggagagctctcaccttcagcccctgcagcagctttagaggcgctcccgcccttatccttgccgcctaattgatcggaatcccagcccgaggagtccccggaagaaacgtcgaggggctcctgagacggcgccgccctcttcatatctgattctgatcccccacaaacgcggtcagcgccactcaatccgaagctcgcagagaacgcagaggggcagggggtttggggcctcacctatatgagagcggagaaacct

SEQ ID NO: 21171 - DNA, 1066 bp, Zea mays
tggtgtttttttttttttattttttttttttttttttcttgttttttttttttttttttttttttttttttttttggcacacagaatacggcagcggtactatttgaacgcaatgcatagctacgtccaaatcccaaagtaaaacacagccaaagcacacgatgaaaggcagctaaccctcggtatgcacacatgctagagctcttggtatttgctaagtgtcaaagccagagtacacgccgctgcccctcaggagccgcttctcctcctcgacgtagttcttccccctgctggcttggccccggtccctcttccgcttctctttctgcgagaaggaagcgtccttctccttcctgtctttctctagcaacagctggttcggcggcgcgttctgcagcccgatgaacttctccccttcggttactgcggccctggtacgctcgcgttcctcgtaggactcgggtgcgtcctctctgccgtcgcggtctttcccagtggaccaggaccagttcggttcctccgctgccggacgaactgtcaagacggatgggccgccgtggtatccgtgccggctcagagcactgaaatccacgccggttttcttcttctttgacctggcttctgccgtcgaagcagctttggaggaattgggcagcccaaaggcattccaagcattccccttcccagcatcatcatcagaatccgagctcaggtcatcatcagaagatacgtcctgggattctttatgcagcaccaccctcttcacatcttcagcccctgcagcagctttagaggcgctcccgcccttatccttgccgcctaattgatcggaatccgagcccgaggagtccccggaagaaacgtcgaggggctcctgagacggcgccgccctcttcatatctgattctatatgagagcggagaaacctcgctggatgggggttaggttgaggaaagaggacaaggcggaggacgcggtgggtgatcgccggcgccgtaaacgccgagtgtagctcgagctcgagtacccttggacggcttggaggcgttttgggcctgtcacgatg

SEQ ID NO: 21172 - DNA, 978 bp, Zea mays
ttttatttttttttttttttttttttgttttttttttttttttttttttttttttttttttggcacacagaatatggcagcggtactatttgaacgcaatgcatagctacgtccaaatcccaaagtaaacacagccaaagcacacgatgaaaggcagctaaccctcggtatgcacacatgctagagctcttggtatttgctaagtgtcaaagccagagtacacgccgctgcccctcaggagccgcttctcctcctcgacgtagttcttccccctgctggcttggccccggtccctcttccgcttctctttctgcgagaaggaagcgtccttctccttcctgtctttctctagcaacagctggttcggcggcgcgttctgcagcccgatgaacttctccccttcggttactgcggccctggtacgctcgcgttcctcgtaggactcgggtgcgtcctctctgccgtcgcggtctttcccagtggaccaggaccagttcggttcctccgctgccggacgaactgtcaagacggatgggccgccgtggtatccgtgccggctcagagcactgaaatccacgccggttttcttcttctttgacctggctgcttctgccgtcgaagcagctttggaggaattgggcagcccaaaggcattccaagcattccccttcccagcatcatcatcagaatccgagctcaggtcatcatcagaagatacgtcctgggattctttatgcagcaccaccctcttcacatcttcagcccctgcagcagctttagaggcgctcccgcccttatccttgccgcctaattgatcggaagagcccgaggagtccccggaagaaacgtcgaggggctcctgagacggcgccgccctcttcatatctgattctgatccccacaaacgcggtcagcgccactcaatccgaagctcgcagagaacgcagaggggcagggggtttggggcctcacctatat

SEQ ID NO: 21173 - DNA, 2965 bp, Zea mays
  misc_feature (2481)..(2481): n is a, c, g, or t
tgtgtcctaccatattcattataccaatcagagcattcaataaattaaagtgaccaatcagctagtctcctgtctcgaacatatagataaaacactgtgtcttcgtcaagatacatgtcttgagttttttttacatttagcccctggacacactcgaataaacaactcaagacactcattgtacatgctcttagcagtagtctagcacatgcaaaataaagttccattttattgcacatttctggctgttttttttttttttctatatttaatctttggcaaattttattgagttggattggaaaacatgaaacatacatgcatgctgcatgtgtatacagaaacttcacaccctgatgagcagctagccaaatgacatcgaccagccaatgatgaacatgtcgttttctctgcacacattaattacgaccgatcgacttaattggatcagttgacccttctgcagttggtgcggacttctcctctggacgggtccgtgagcggcttgatgttccccatgttgatcatggactgcgcgaagctcgcgaagaagtcgtcttggctggccgcgaactggtcgacgatgggcgccgtggtgccctgcgctaggggcgacgacttgagctcctggtcggagttgaggatgcctcggttcacctcgatgttggtgtagtagttgttgtcgaaggtgtccggggtcgtcgggtccaggtcgttcagggctgtggggtcgccgttcctggggcatctctgtgtcaggaaggctcggtaggaggcgtccagcgtcgggtcgggcatgttcgtcccgctgaagttgtagagccggtccgtgatgaacttgcattggacccggccgaacgtgtgccccccttcgcattgcaatattgcattatggtgttagtgaaaatacagtaattagctagtgtcatgtggtgataaatgtgtgcatgtagtacctgaaagggcgaccaggtcgacatcgttgagactgaggttgctgaacttctgctgaagtatggtgaggttgtcggtgggctctgggaggtccagggatccgttgaagtcggaggtcttgctgtccagcctgcccagaagcacaccccagctggggcctcccgactgcatgtgatgcgtatgcatggccgtgccatgtactgtaattagtacgtatatttaggattaattatgaataacattagcatttattggcgtccactgcatgcagcgtcgtcgttttgccatcttgtgactcctatctacgtgccccatgttgcatcagattcctatttatttgtttgtttctgcctgatgatcgggtgtcgtcgaaacatttctcacatgttctttgatccacatatatataatattgtattctaaataatcggctcatgttctgtcctttgatcaatataataagctcttaatcagactcagactaggacttctatactagtggagtatcaataatagaggtgtgtttcgatgcaaatatatatattacatgtaagaacataattaatatgtaatggtacttattacaataaacatttttcttttttataatcttgattaaacatgcatttatgcaattaaataatagttgaacgagatcacaaacatgtagtgtgtaattcaagtagctagctaggcatgcatgcaggaacgtgaacgtatatatatatatatatatatatatatatatatatatatatatatatatatatatatatatatatatatatatatatatatatataacaggaatagctaggtacggtaccagctcgactgagatctctgcggcgatggcgaggatgtcagcgcaggagacaacaccagggcaggcgctctccagggcagccttggcggcgtccaccaccccgaacccgcgcgctgagccgttgttgggcgccgacgtcttctccgacggcatccccgggacgctgtccagcagaagcgaggcgtcgcagccctacagtatatatggccggtatgttggtaaggttagctataggttaatttgtatggtggagctttcacgaatcaactctgacgaatctaatcgatctgagttatggagaacatgcacacacacacctggacgaagcagtcgtggaagtgcaggcggatgaggctggcgaagatgcgggtgtccgactgcactgcgtcgacgagcacctgcttcacgatgtcgtaggcgtccgggcaggtgctgtcatagtagtcctcgcacagtgcgccgtcgcgccatggaagcacgtcgtcgtcatcagggccaccgccaggaccacggcggcggcggtggcggaaggagacgacgacgaggaaaccatcgtcacaggccaggagcaccactgctagctaccctctactgtgtctcgtcgaatgtgagccactgcaggacacgacgtacgatgcgaccgagcactgtaaggcctccctttttataggctgataactcgctcaatagtacgtactttngcttgctgcaggcttcatatgaatgattgaggttgttagtgataggaatctattgcatgcgaccggccggcattcgccacacagctagcaggcagggtgctccgatcttggctaaagaaaacgtaactacctctggacgagcaatgatgtgtagcaagtgaaatgtgatgaccagaaatttaaaacaagatatgtgaatcacaacaggaaaacaccgaacatccgacggctgcgttatcttcgacggcttccaaacaaaccgtcagacttaaggtagtacatccgacggcctgtctgacagccgttggagattagcttatccgacggctgtcagagccagaccgtcggaattaagtgattttaatcccatggagctaaaactagtcgtttcattctacctccaatgccgccgctcattccgggcgccgcacatagtttatttccgacggctttaaccgtcgaaaatattctgttttactgtagt

SEQ ID NO: 21174 - DNA, 1490 bp, Zea mays
agtctcctgtctcgaacatatagataaaacattgtgtcttcgtcaagatacatgtcttgagttttttttacatttagcccctggacacactcgaataaacaactcaagacactcattgtacatgctcttagcagtagtctagcacatgcaaaataaagttccattttattgcacatttctggcggactttgagaacaaactatatttaatctttggcaaattttattgagttggattggaaaacatgaaacatacatgcatgctgcatgtgtatacagaaacttcacaccctgatgagcagctagccaaatgacatcgaccagccaatgatgaacatgtcgttttctctgcacacattaattacgaccgatcgacttaattggatcagttgacccttctgcagttggtgcggacttctcctctggacgggtccgtgagcggcttgatgttccccatgttgatcatggactgcgcgaagctcgcgaagaagtcgtcttggctggccgcgaactggtcgacgatgggcgccgtggtgccctgcgctaggggcgacgacttgagctcctggtcggagttgaggatgcctcggttcacctcgatgttggtgtagtagttgttgtcgaaggtgtccggggtcgtcgggtccaggtcgttcagggctgtggggtcgccgttcctggggcatctctgtgtcaggaaggctcggtaggaggcgtccagcgtcgggtcgggcatgttcgtcccgctgaagttgtagagccggtccgtgatgaacttgcattggacccggccgaacgtgtgcccccctgaaagggcgaccaggtcgacatcgttgaggctgaggttgctgaacttctgctgaagtatggtgaggttgtcggtgggctctgggaggtccagggatccgttgaagtcggaggtcttgctgtccagcctgcccagaagcacaccccagctggggcctcccgacagctcgactgagatctctgcggcgatggcgaggatgtcagcgcaggagacaacaccagggcaggcgctctccagcgcagccttggcggcgtccaccaccccgaacccgcgcgctgagccgttgttgggcgccgacgtcttctccgacggcatccctgggacgctgtccagcagaagcgaggcgtcgcagccctggacgaagcagtcgtggaagtgcaggcggatgaggctggcgaagatgcgggtgtccgactgcactgcgtcgacgagcacctggttcacgatgtcgtaggcgtccgggcaggtgctgtcatagtagtcctcgcacagctgcgccgtcgcgccatggaagcacgtcgtcgtcatcagggccaccgccaggaccacggcggcggcggcggcggcggtggcggaaggagacgacgacgaggaaaccatcgtcacaggccaggagcaccactgctagctaccctctactgtgtgtcgtcgaatgtgagccactgcaggacacgacgtacgat

SEQ ID NO: 21175 - DNA, 1379 bp, Zea mays
aacacaggcaaaataaagttccattttattgcacatttctggtggacttcgagaacaaactatatttaatttataatttggcaaattattgagttggattggaaaacaagaaacatacatgcatgctgcatgtgtacacagaaacttcacacgcaccctgatgagcagctagccaaatgacatcgaccagccaatgatgaacatgtcgtttctgtgcacacattaattattacgaccgatcgacttaattggatcagttgacccttctgcagttggtgcggacttctcctctggacgggtccgtgagcggcttgatgttccccatgttgatcatggactgcgcgaagctcgcgaagaagtcgtcttggctggccgcgaactggtcgacgatgggcgccgtggtgccctgcgctaggggcgacgacttgagctcctggtcggagttgaggatgcctcggttcacctcgatgttggtgtagtagttgttgtcgaaaggtgtccggggtcgtcgggtccaggtcgttcagggctgtggggtcgccgttcctggggcatctctgtgtcaggaaggctcggtaggaggcgtccagcgtcgggtcgggcatgttcgtcccgctgaagttgtagagccggtccgtgatgaacttgcattggacccggccgaacgtgtgcccccctgaaagggcgaccaggtcgacatcgttgagactgaggttgctgaacttctgctgaagtatggtgaggttgtcggtgggctctgggaggtccagggatccgttgaagtcggaggtcttgctgtccagcctgcccagaagcacaccccagctggggcctcccgacagctcgactgagatctctgcggcgatggcgaggatgtcagcgcaggagacaacaccagggcaggcgctttccagggcagccttggcggcgtccaccaccccgaacccgcgcgctgagccgttgttgggcgccgacgtcttctccgacggcatccccgggacgctgtccagcagaagcgaggcgtcgcagccctggacgaagcagtcgtggaagtgcaggcggatgaggctggcgaagatgcgggtgtccgactgcactgcgtcgacgagcacctgcttcacgatgtcgtaggcgtccgggcaggtgctgtcatagtagtcctcgcacagctgcgccgtcgcgccatggaagcacgtcgtcgtcatcagggccaccgccaggaccacggcggcggcggtggcggaaggagacgacgacgaggaaaccatcgtcacaggccaggagcaccactgctagctaccctctactgtgtctcgtcgaatgtgagccactgcaggacacgacgtacgatcccggcccggccggcctcgagggaccca

SEQ ID NO: 21176 - DNA, 3824 bp, Zea mays
tgtataacctgtatgtctagcagataaccaattgaaaatacaatctcagtcactgcaatctgcctctgaaacaaaaagacaataaggccatcaacaaatgatggaagatatagcaacagccatttcactaatttcgatgcagtcaataggcagcccatatatcttgttctatcatgtctttgtatctagaggatgtaagaatattactggtgagaaggctgctgttggagatggacgctggagacgaggagcgccgcgtccctcagccccaccgcagccacatgcactcgtgatggcatttcttccacgccacttgagtccgggctccgttctgggtggggatgaggggaaaggctggggtaggcagggttacagtccacatggggcttaaacaaacaatcagtcactcgtggggttacaaatgattttacataattttcaaggttttgcttgggtttctctgattcaatccgaccaatactttcatgaataaggttatacatgaatcactggcaaataattgagcagcagttcagtacaacaaaggtaatgattttcgtaggtatcaaggggaaacaactatgcatgtcacctggactgtggcagaagttgcaatgttcacctactagaatccagtgcaccactctttttaatgtacaagactatgctatcctcctagaaaggaaaaaacttcctctgcactgacccacctcaacccattgcatacttgagcgaatcaccagcaccctggaagaacaggcacgagagagcaaagtctgcaatgaagattccaaccaaggaaacaactacggcagatgttgtagactcgccaacacccttggctcctccatgggttgtaactccccaggcacagctcaccaccgcgataatggcaccaaacacttgagatttgagcaaagagctgatcaagtcccatggccgcagcgccctgcgcgccgactccaaaatgatgctgacgctgacgccaaacacagaatcggccaggaacgccgaggacgcgaggccgagcgcgaagctgatcaatgtcaagaccgggagcgcgagcacgcaggcgagcacgcgagggaccacgaggtagtcgacggggtgggcaccgaggacgcgtaaggtgtcggtctgctccgacacctgcatggtgccgagctcggcggcgaacgcggagccgacgcggcccgcggcgacgacggccgtgacgaccggcgagagctcgcgcgcgagcgcgagcgcgaggacgccgccgacggagcggtggaggccgaggcgggtgaactcgcgcacgaactggatggtgaaggccatgcccacgaaggcagcggtgaggagcgcgacccccgcgctcccgggacccaccctacggagctgcgccaggaggttgcggcggtggacgcggcccgtgaggacgcggtggaagacctggcccgcgaggagcagcgccgacagcccccgccagatcgcgcgcggcggggaccagttggcgagcagggaacccggggcggcgggggcgggcgaaggggacggtgggggaggagagctgttgctattgctggcggtggtgggcgtgagggacaggcgcgggacgggtaggcggcggcgagacggctgtaagcggaggaagtacgatttgcgggtggattggtggaggcgcgggtgcgtcgtggcggaggtggggcgtaggtggagcgcggcggcgaaagacatggctgcggtggtcggagatcggcttggcgccggcggtgactggagtgcgtgtgggtgggggtggggaaagagatggccagatggggaaacggcgtccccttccgtgcgcccaggggattattgtcgtgaagtcgtatactcagtaccgcaggctttgggccaggagcccacgagggaggctctactactctagtgtcaagcaggcaggcaggctgctgtgtggaacgtccgcttgctttatcatgggctcgcgcacgcccagttatgggctccaacagagaggccctgggcccaaataaacgcccacatgattcacagcctggctggctgcactcgagctagctggagtctctttaaccacactgaacgtcctgcgttccacttttcgcgtcactgaactgaaaccaaaccaaagcagcaagctgtacaaaaggcatctacgtactagtaggcttcagaattaaagagtacccctacttgctttcatgctcgtacgtacgtaacattagtaggtacgtgatccagtacgagtgtaccagtacatgatagcctgtgcggtacagtacacaccgctctcctgcttcctgtcctgtcctgtgtgctcagacttttagtttgcaacctgaaacaccgctactgggccgtcgttctcacacgctcgcctctagctggttcacgaacatggatgatcagatcagatcagatcatgggagcaaccaaccatggaggccggggatgtagagtcaggcaggcacatgccgctttttttacgctatatataattgccaatgccaaagtagagacacacactacggtgcgatatggccggtggtgcagtagagctcctagctagctacatgagcgagcaaaaaaaaactattagtcaccaagtcggttcatgcagacggggttggtgaaagggccaggctaatggacaagcaaaaaacaagcaaactgatttcaagggaaacgattctctctgtcttccttcccccagcttccctttttcagctcatcgttcacggccggagatgcttcctgcctctgcaatccgcagagtgcagtgctgtgaggctaccctgtttttgtgggatggatggtgcatgcagaagctatactctttaaaaacggtgccagttttgtgtctgtatttgtgtggaccgaccaaatgagctcatccgctgtgccatactctccaccattttaaggcttttctagtcctacagccatatttcgccgaaaggttttccaatgcaaggttagtttaaaaaccttatttttccaaatgattttttatcaaactagccctaacgtaaattagtttattttttatttttggaaaatagagttctgaaactagccctaacgtaaattagtttattttttatttttggaaaatagagttctgaaactagccctaactattttacttccatagtaaaaacagagtacaatgttacatcattaatttgttttgccttctctatcttgcatcaatccatcttatttggcatggcacgcagtggtactgaaactcaaatggacgaagcccctactggcacttaaaaaaaaaagaaactactccatgcagactagaggtcctaggtcacagccttaccaacccgagaaaagaggtgtccatgttccttttctaccagttgcaaatggaagcagtatcgccctactgatgttttcccccctttgtgccagaaatctgctgccccgtgctacagcagtactacagtgatacgctgatactttacttaagctaagaaagaaagaaacttttctgatagaggagttgtgacttatgacaagctaattaagcgtgtatttgaaagcagagtttcttcgtttctgattaaagacggatgtttagacagatgcaactacaatctacagagacaacaactgtagaagtaaagaacaggatgttacttgtagcaggtcgagactagaatgattatctaagccaagtatatcttttaatgtttatttcgatacgagtaaaatttgagcaaggttccttaagttagttgggagtgtcatatgggtcctggaagtctcaagtgtatttttttttattcataaagtaggtcagattt

SEQ ID NO: 21177 - DNA, 1425 bp, Zea mays
gatgggctcaccagcaggcagtggcttaggagcttgaagttgaccgggtccacccgattttttttttttttttttccagcaataccaacccgacaaggtaaaatactagtagaatattgtccagatacacaagtgactgggtacatagttaatatcgtagcaggtatacggtaactttctagggccaataaaccaagcatacaatacaattatgtttttcacttatgaagtaaagcaacggtcgttatgcaagaactatccacactagggtaactttggacgtggtccaggtagctgaacaccgcagcttcactagccggcaatccttctgagcctgagcccacagcaccaagcttcctttggttgaagttctctacctcctgcaccaactcatccttggttctgctgcatgatgtgatgaccaatataccaccacgggaaaccaagctatcaacggactgccaatacatcattctcttcacaggtccatcaggatggagcccaatcgcatcaagagtcccttcatccatgacaagttcaaatcttctctccaacttcgactccaaaacatcatcaaccaagaaattaatgtgctcaaacccatcaccgattgcaaggctacgagcaagctcaattgcactttcactatagtcaatcccagtcagatcagaaaacccctgcttcgcaagctgctgcaagagtctgccactcccagtcccaatgtcaagtacgctgcagctgggtaaatctctacttgagcacaaatttttggtccaacctacgcggatatccatgatatcagtgccaaaccagtcatcagcgtggctgcgttcatggaaatttgcaagatcctcagcgtaagcaccatcctgaaaattctgcaagcccagcaagggaggctcaacgtagctggagtcatggacatccttgtcgaagctgaagtcggaggaggggtggacggcaaccgtcgtggagggcgcggcaacagaggaggcggaggaggaggctaggaggacctcggcggtgtcggagtaacgctgatcgtcgtcgagggtgctgccgtagtcgctcttgatcgaccacgagtccgcggccaccgaccggtcgtcgtccgacgccatctctcctgggggcgcgacggggacccaagccccgccgctgaccatcctggaagggaagatctccgggtcctctggcggccatcgaatccctgccatggctctcgccgtcgcctcgccggaaccctagtcttctcgtgccgctcgcgtgctggttgtgccggaaggaggggaacgacgggtgcgaggcggtcagcgactcagcggaggggttggcctacgtgttggtgtctcgcttcgttggggtggcacggggggtactgggagcaagttttcgattaggatgttctaggtaatggtctcgtgc

SEQ ID NO: 21178 - DNA, 2965 bp, Zea mays
ttggccgcttttttttttttttttttttcagcaaagtaagtgcagaacatatttctcaagccaagggtttatacatgctatgaaatagttccgtgcaatagcaccaatgactgattggaatgtctgatcagcaaaaagggagaatatctacttctagctgatgaatagagaagcggggctggcaacaatgaacccaattgtctcaatccagttccatctcattatcttgtgtgctacttctgcatgaccaaatttttatcgtacgatcaagcgacacagtcacaatcttctgtccatctccactaatatccaaactagtaaccttcgactcatggcccaccaaacttttgattggtttgtaatcacgagctgaccacagggctgctttggtgtcataggaagaagtcgctaaataatacccttcttggggttcaaatttcacatgtgaaataatactcttatgagctggaatagaatacaacatttgccttttcctcaaatcccatatccgacagaaattgtcttcacttccagttgcaaccagataaccattaggagagaagctgactcctaggacaggtttcacatggcccttgagtgtaaagaacaatcttccagatctcagatcccatactcgagcatatgcatcaagaccacaagatgctgccaaagaaccatcagggtgaaagctaactccatatacacttctgctgtgcccctcttggagtagcagttccttgccagtattgatgtcccacaatctccaagtcttgtcaaagctagctgtaccaaggtactttccagatggatgaaaagcaaggcgagcaagacgatcaaggtggccatcaaaagacatcaaaagtgacccatctggtttccataattttgcagttctatcagctgaagctgttgctaagcagtcatcagcaggagagaagacaacatcagttgcacgttctgtgtgacctttcaaggttgcaaccttagttatttgtggcatgctccatactttgactattccactccaggaactacacaatgtggataagcaaatggttatttcctgaaaaggaagcaagagtacgagaacataatctaccatgttaaagctcaaaacaaatgtaaatatatgatagacatcataacatttaataagcaactagttgcacatgacactggtaacatagataagttgtttcccgccggctcgcggtcttatttctgtgcatacgaactgctaactgatttcaattaacggctcaaggtaaatatcgctgaacatggtcttattgctgttattttgataatactcaataccacgggggacagtacagatgtctaacttcagctttatgttctaccaaggtttgttaaaaaggggggaattatgtgcattgggtagggatacaagttccaaacgggaattttggattgataatatgttggtcattctctatccactagaagaaaagcaaacctgaatacctgatcctggcttcctagcagcccagtgacttcagatactaaaaatcgaaactacagctgacttagttagttcccaagtgatcagatggacagatgctgaattttttgaatgtcatatatgaacttactagttgcagttctcttgcggtgagaaactaatctcaattaagctcaagcaggactgcacagtgcataaatccatcataaataaattgactaaacatggacttccaacaaaaaaattgcagcaagggcaaacccaatgttggaggctcccacatgagtggggtctgggaaaaggataaaccgaggcaatcatttccccgcaaatgcagagaaactgcttcggacccacgacttgctgactcaatgagatagctctcgccactgatatggacttccaacaaaaaaattacagcaagggcaaacccaatgttggaggctcccacatgagtggggtctgggaaagggataaaccgtgacaatcctccttcccccacaaatgcagagaaactgcttggcacccacgacttgatgactcaatgagatagctctcgccgctgcaccagatcttcccttcaacaacaaaaaaaaaacacttctggcgtccagcgttgcttctcgcgtggaggaacagccagtgagcgggcgatcatctccaatctcactgcactcgagcacaaactccccggcctgcttgacgacgagttcggcctccgcctctggatcctcatcagggtcctcgtggcgtcgcttggccctctcgatcctggccttggcacggggcagcgagtaccgtgcaatgtcaaggcgcgccttgagaagctcctgcgagccctcggtgaagaaggggtactcgatctgctcctcctcctcctcctcgccgatgcgcgcggcctggtcgtcctcctgcgcgcggaggagacggtcgacctggccatcggcctcgagccggaccatgagggctcggaggcggtcgcggcgctccatctcgcgctcgccgaatagcgtgatgggctcgccgaggcggcggaggcgggcccgcacagcggagtcgttggtgggtacggccatggcgtaggcgcggcgccgctggaggagctcctgcaccgcgcgctcgtggcgctcccgcgcggcgcggtggtcgtcggagacttcgtactcggcctcgcctccgtccccagtggagggagtgggtgtggaggccatggaagcggcggcggctggggcgggggcgggcacgcggggcggagggacggggattggggcgattggcgggtggatggggacggggagcggggccatgggaggggtgagtgctggggcctggggcctggggttctccatgggcgagggctcccgcgcggagggggtttagggttagggttttgaggtgggaagccgtagcggtagcggtgatggtggcggtggcgaagggggtggtgcttgctgtgccgaagcccgaaggaggacgattgac

SEQ ID NO: 21179 - DNA, 603 bp, Zea mays
gtcggcgagggcgagaagcggcggcaggcaggcaggcaggcacagctcttagctctgccctgcagtgcgcgcgagcgcgacgggggtgctgtgctgccgcagcggcgggagaccatggcaacggtgccgttgccgtggccgagcgtgaggaggtcgctgcaggagggggccgccagcgcggcgtcgtacgcgcggcgagctccgcggcccgcggccacggtgaggtcggtggagacgctggtggtgatcgtggccgcgatcgtgctcgccgccgtgctggcgggcgtcctcgcgcgggtctgtggcgggcggcacgtcgtgccgagcgcccagtaccacgacgaggaaggctgggtggagaggcgctgccggagctgcctcgacagcgggctgccgccgccggagcagggggcgtccaagacgagcgaggccaaatagcgtcattgtgcattgtggtagtactacttgtagtgctagcctagtagcctgctgcgtactagtactgtgctgtgctgctgtagtattatagtaatactactagcgtttgtctaggcaattaattactgcaggcttcttatcagcgtattgtacacaggagtggta

SEQ ID NO: 21180 - DNA, 2329 bp, Zea mays
cggatataaggttattgatgacggtctgtctgacagccgtcagacgtagaatcttatgtccgacggttgtaggaagccgtcggacatagtcttatgtccaaccgcctttaaggaagccatcgaacattgcgtgaccgttggatctttatcggtttactattgtggctgatctgaactctaacatgccgatgacatccacggaaaaaatctagatcttcggcggaatttttaaataccaaatatatcttccattctgaaatgtatgatgtgtatcacgccacgccactagaaatcactcctacgtagatcgacctagaagtggaattgcccgacatgtccagtttccgtgcaatgatgagccgctgtcctcattcactatcaccaaccaggaatattgttgcattgaagtcgacaagcccaaatcacgtgcatcggagcggataactgtacactgtatggacgtgtcggtggcacggtctgaatgtacaccgttaatgggcacgtcttccccaggcggctcgccaccaggcaaacggttcacacgttcgaaccccatatggctgaacccaagtcaaataatggcggggcggacgcgacggcatcgatgatgctccacggccgcgtagccattgtcaccggtggtgccggcggcatcggctcggccgtgtcgaagcacctgtcgtcgctcggcgcgcgcgtcgtggtggggtacatcggcgacccggcacctgctctgacgctggtagccgccatcaactcctccgagcaccccggcgagagccagcagccgcgagccatcgcggtcgaggcggacgtgtccgacgcggcagccgtgaaggcgctgttcgacgcggccgccgcagccttcggcggggagctccacatcctggtaacgttggcggcggtgctggactactcctacccgccgctggcggagaccagcgaggcgacgttcgacgccgccttcagcgtcaacacacggggcaccttcctgtgctgccgcgaggcggccaggcggctggtgcgtgacggccgcggccgaatcgtgacgttctcttcgtcgggagttgggtctctgcgccctggctactcggcatacgcagcaagcaaggccgcggtggaggtgatgactaagatcctggcgcgcgagctgcgcggcacggggatcacggccaacgtggtggcgccagggtccacggggacacccatgatgtacaccggcaagacggaggatgacatggagcgatacatcgccgaggcgccgctgggccggctcggcatgcccgaggacatcgcgccgctcgtcagcttcctcgctagtgatgctggccactgggtcaacgcgcaggtcctgcgctgcaacggtggcaccatctagctagtactgcgtgcctactttttatggttgattagatgtattttcctcggagcataaatttaagcttgtggcgcagttatcgcttggcagttcattaatttatttaaagattgtgtcgtttattctattgtgtgtatttataatcaggctccatattattgttggatgtgttttggattacgtattgttattggatgtgaatcgttctcattcgtataaacaggatcacaagtctagctcatgtatgagacaagtatttctaaacaacattgttgggttgtaaccttgcccaaggttctctaactaataaatctcagttgtttttaattcgttttaggactagtttggaactcaattttctcatgcgattttcatttttccaagggaaaataaactaatttctcttgggaaaatagaaatcccttgaaaaaatggagttcccaaactagccctaagaaacaacaaagtgattttatcatatcctttgtaggataaaaaggcaaatggtagcttcggtattaatgcttagtgttggttacttgttttgttttctgaaaggtatcaaaacaagataatataattaaaatgtgggaccttaattaatcccttcagtttactttcagttgagtgataaattgatatgagaagcttattataatcaaaattctgaaaataataaaaggaataataaaaggaatgaacacgctaaaaaggaatagttactaacgcgctccttatattgtctctttttttgttataaatagatacagttataccttcgaagattcaggcagcagttcgaaggtaaagttttacacagtttcggaggaagagtgacttggtgtgatgcgagtacctaaactcctgtgtccgtgcatattgattgttcacatatttatagggatgacccgatgtacaactctatgtgaaattataattatagtctcgaat

SEQ ID NO: 21181 - DNA, 1688 bp, Zea mays
  misc_feature (378)..(378): n is a, c, g, or t
  misc_feature (452)..(452): n is a, c, g, or t
  misc_feature (465)..(465): n is a, c, g, or t
  misc_feature (531)..(531): n is a, c, g, or t
tttgccatttttttgcccagggggccatttaccctccctaaaagaaaaaaaaagttggggttcagggccgccttttttttttttttttttttttttttttttttttttttttttttttttttttttttttttttttttttttttttttttttttttttttttttttttaagaaactatttctccattattgaccctctttaaatgacgaatcccgaaccaccagttcactcacgcagaagatgacagacaacataccactagtgtacactgtacagacaccatgacccggccggcacagctaggatggtcccccctcctgctcactctaggtggtcatgcggccggagcgacatgaacatggccgcgtagtgtctganccgccggtccccgtcgtcgggtccgccagccaacggcggcgcggccatcgccgccaggtccgtcgatgcccggnccctatacctgcnccacgcgagctggatgttgacggcggcccacgtccgccagttggacgagtagtaccgcgccgtgcnctgagcttctcgttggcgaacttgtagcggaagtgctcggtgatgaaccgcagtccggcgcgtcgaggcagaacgcctgcgccgcctccacgcactcgaacgtggccgacgacgcggggagccggtccacgaaggggcggcgcaggcaccacgacagcagctcgtcgcctaggaagttgcccgcccctagcatgcacgttgccaccacgcccttggtcagcggctgcgtgctccggagcttgccctgcaggatgaacaccatgcgctgcacggggtcgccctctcggatcaccttctccccgctggagaacaccagtggccgcagccggtcgcagatgttatccaggatcagatcgtccatgccatggaacagcggaacctgcttcaccagctcgaggcagaggtagcgcttgatgtcccgcctcagtccttcaggcagatccttgatcatctccatctcctcgtctcccgtgacggcggcccagcgttcgcgctcatatttgcgcactctctgcctcagccgagacggcagctgcctccgtctcatccaccattccatgtctcggaaccgcagctgcatcttacgcttccttgccaggaccgcgtgcagaaatacctgtatgtttccgatcagcaatgtgaagagcatcaggccactgaggacattgattatgctgaatatcacctcaataccattgcttgttggggcaagatcgttaccaaaagtactgagtgtcatgaggccccaaaatataggatagagaattttgacagcaagcgaattgctcgatataacaggaagagcccccaaatagattccataagcaaacgaccctttaccacttaaacaagtagacacatttcgttgactaaaggaggtcatgttcgtatcacatgcaaacccattaacattcgaagaccaaggagggtgaaagcatatctccttcgaacaagctagtgatatcagatcacaactattgtttttcttgcattcttcctggaggcaggaagcaatgcgctggattgcaagaacataccagcacccacctgcaatatgagaagcaatgaaatacccgccggctcgtggaccaaatccccaccatatcgatccaaagatgtaacccgtcaccttctcggacgcgtggccggacgcgtgg

SEQ ID NO: 21182 - DNA, 3252 bp, Zea mays
  misc_feature (196)..(196): n is a, c, g, or t
ataagtttgtttttatgaaaggaaagtgttggcctctggtacgctggaatggacttgtccaggtacattccagtcgaagaggacaagtgatgaataggaattcatcagaaagcttattcaggggggaaaaaccgaaaaactcagcaatcctctagaaaaccatatcattctgaaaataagaataaaaaacaatatntcgagatataccatgccctgttatagacataggtgccagctgttattttgcttgtgcggtataaacagacaaaacagggaagttctgcatatacgaaccaatcggaggacattgccaaccaggagcaatatccatgatgattttaaccatgagcaataagctaccattagcaaacatcaatttgaaatgttacagcctaaggaatcacatgcccatcattaaccactatgttaccgcatcatattacaaatcacaactacaataaatcagccagattacccaaaggacaaaataagtaacatatagcaagtaacactgtgcttcgctttatcacgtgagacatgatgctcaaatctgcagcaattactgcaatgtcagaaacttatcgtagaaactagaaactatgttatcagaaaacaccaagacatcaaccccgtcatgtactaccaattttgcgccaactaatcttaaaaaaaacgtagcagaaatagtacagtccacccacacgtattgagctggtctcgtacctcgctcaagcaggatgtcgacgatttgagagttgccggagctcgcggcggagtggatcggcgcccacccctcctcgtcctgcgcattcagcacgctagccgcggcgtcaccaccgcactgggcaagcgcgagcaccacctaaacccagggaaacaccacaaagccgtcaaaaaaccataaacccactttccagtttccacccatcatattcgattctagagcgtagaatgccccttttcgtgcctggggatgcccggcagcggcggcgacgtggaggagggagcggccgtcctcgttgcgcagggagaggtcggcgggggcgagggaggcgaacgcggcggcgtcgccggactcagcggcgcggaagagctccttctctgacggtcgcctctcctcgccgccggcttcgtcgacgtccatcgctgcagccatccggactccggagttactcgtacttcgagttgtggctagagactagagttgattgcgctttcagtcgagtgaagcggcccctcttccaagaaagaagacgagcttgggcttcgcggttccttgctgtaaatgggccggtatgtggattctggattctgatgatgaccgcctaccagattggccgcgcccgcgcgattgaactgggccaatcatactcctgctgtcgccacgccgccgccgccgccgctaccttacgatcgcgtttctcgattttagtttgttttggagaggatgaacaggccaggcggtttctgaatctggtggtggagaacctggttggaatggacaccgacttcggcgacttgtacgtattctctgcgcgtctgaatctgtcctgccatcagccgctgcagccggggctgcaatttttattcttggtaaaagcaatccagaccaacgcggagaggcagtccggcagaagtaatttttattcttggtgaaaggaagacaattgaatcgggctaagaaactatttctccattattgaccttctttaaatgacaaatcccgaaccaccagttcactcacgcagaagatgacaacaacataccactagtgtacactgtacagacaccatgacccggccggcacagctaggatggtcccgtcccccctcctgatcactctaggtggtcatgcggccggagcgacatgaacatggccgcgtagtgtctgagccgccggtccccgtcgtcgggtccgcccgccaacggcggcgcggccatcgccgccaggtccgtcgatgcccgggccctatacctgcgccacgcgagctggatgttgacggcggcccacgtccgccagttggacgagtagtaccgcgccgtgcgcctgagcttctcgttggcgaacttgtagcggaagtgctcggtgatgaaccgcaggtccggcgcgtcgaggcagaacgcctgcgccgcctccacgcactcgaacgtggccgacgacgcggggagccggtccacgaaggggcggcgcaggcaccacgacagcagctcgtcgcctaggaagttgcccgcccctagcatgcacgttgccaccacgcccttggtcagcggctgcgtgctccggagcttgccctgcaggatgaacaccatgcgctgcacggggtcgccctctcggatcaccttctccccgctggagaacaccagtggccgcagccggtcgcagatgttatccaggatcagatcgtccatgccatggaacagcggaacctggcaagtggcaagggaaaaaattgtaacaatttcatcgccgcatcgaacattcatatgtaaaaaaacaagacagcgaaaatcccaagaacttcagttactttaatgactgtacctgcttaaccagctcgaggcagaggtagcgcttgatgtcccgcctcagtccttcaggcagatccttgatcatctccatctcctcgtctcccgtgacggcggcccagcgttcgcgctcatatttgcgcaccctctgcctcagccgagacggcagctgcctccgtctcatccaccattccatgtctcggaaccgcagctgcatcttccgcttccttgccaggaccgcgtgcagaaatacctgcggattcagtaagttgtggtttttagttggtgaaggggtgtgatacaatcacacagaagaacaaaaaaaattggcattgttttacctgtatgtttccgatcagcaatgtgaagagcatcaggccactgaggacattgattatgctgaatatcacctcaataccattgcttgttggggcaagatcgttaccaaaagtactgccaagcaattcaaggaattgtacaagtttatgaatatgcagcataaaaaaatacatgtgtatgcagcatggaacaagactaatttttttttgaagtggaactggggtatcagtttgatgccatgtttattcagataaacagtataagaaagagagaatattttgacttttgagaatatagcagattattaagacaatagtttcctagagagcagaccctgtgttggagagaatatagcagattattaagaagtgattacctgagtgtcat

SEQ ID NO: 21183 - DNA, 1352 bp, Zea mays
aaccaaatccaaattcaagtttgaattcaaaaagatgagatgtatgagatgcacctggctttgttccttaaagccgggtgtgacagtcaccgatctgttagctgatagcctgatacgccatcatgttctgttttttttttttttttgattggagaaccaaagcttagcttatgagatgttagtcacaatggttaaataaacccaacaagggcaaaattctagcagggtcaaatctgattctgtagagcccctttgtttacacaccagaacaagctttaacacctcgactcagcacagtttctcgtatcacactttccatcgtctttgagcagagcaccagatcatccttcgagcattgccttggctgcatcgatgagtgcaggtctgaagctgttcgatgctcggccaagggcagtgtagccttccttgtcctcgacatcaacatcagcaccatgtctaattagcagaagagcagcccctttgttctcacatataacagcatgcgtaagaggtgtttgtcctgtcttgtcaacagcatcaacttcagcaccttcctcaatgaggaattcacacagctccgcgtttccagtgcttgcagctctatgcaaaggtgtgcagccaaacttgtctttcttgttgacattagcaccatgggctattagtttttcagctatgttaagcctccctttactcgcagcataatgaagagcagttcgaccaccatcagtaaccaggttaacatcagcacctcgctcaagcaggatgtcgacgatttgagagttgccggagctcgcggcggagtggatcggcgcccacccctcctcgtcctgcgcattcagcacgctagccgcggcgtcaccaccgcactgggcaagcgcgagcaccacctggggatgcccggcagcggcggcgacgtggaggagggagcggccgtcctcgttgcgcagggagaggtcggcgggggcgagggaggcgaacgcggcggcgtcgccggactcagcggcgcggaagagctccttctctgacggtcgcctctcctcgccgccggcttcgtcgacgtccatcgctgcagccatccggactccggagttactcgtacttcgagttgtggctagagactagagttgattgcgctttcagtcgagtggagcggcccctcttccaagaaagaagacgagcttgggcttcgcggttccttgctgtaaatgggccggtatgtggagtctggattctgacgatgaccgcctaccagattggccgtgcgattgaactgggccaatcctactcctgctgtcgccacgccgccgccgccgctacttacgatcgcgtttctcgattttagtttgtttttt

SEQ ID NO: 21184 - DNA, 2462 bp, Zea mays
  misc_feature (1852)..(1852): n is a, c, g, or t
gaaaggcaattgaatccgctacgaaatatttctccattttattttttttttttttttgacaattcggaaccactaattcacttacgcaaaagatggcagcaatatactattacagtgcacactgtacagtcaccatgacgcggccggcacagctaggatggtccctcctgctcactctaggtggtcatgcggccgtagcgacatgaacatggccgcgtagtgtctgagccgccggtccccgtcgtcgggcccgcccaccaacggaggcgcggcctgcgccgccaggtccgccgacgtccgggccctgtacctgcgccacgcgagctggatgttgacggcggcccacgtccgccagttggacgagtagtaccgcgccgtgcgcttgagcttctcgttggcgaagttgtaccggaagtgctcggtgatgaaccgcaggtccggcgcgccgaggcagaacgcctgcgccgcctccacgcactcgaacgtggccgacgacgcggggagccggtccacgaaggcggcggcgcaggcaccacgacagcagctcgtcgcccaggaagctgcccgcgcccagcatgcacgtcgccaccacgcctttggtcagcggctgcgtgctccggagcttgccctgcaggatgaacaccatgcgctgcacggggtcgccctcccggatcaccttctccccgctggacaacaccagaggccgcagccggtcgcagatgttgtccaggatcaggtcgtccatgccatggaacagtggaacctgcttaactagctcaaggcacaggtagcgcttgatgtcccgcctcagcccttcaggcagatccttgatcatctccatctcctcgtctcccgtgacggcggcccagcgttcgcgctcgtatttgcgcaccctttgcctcagccgggacggtagttgcctccgcctcatccaccattccatgtccccggaaccgcagctgcatcttccgcttccttgccaggaccgcgtgcagaaatacctgtatgtttccgatcagcaacgtgaagagcataaggccactgaggacattgattatgctgaatatcacctcaataccattgcttgttggggcaagatcgttaccaaaagtactgagtgtcatgaggccccaaaatataggatacagtattttgacagcaagcgaattgctcgatataacaggaagagcccccaaatagattccataagcgaaggaaccttttccactcaagcaagtagacacattttgttggctaaaggaggtcatgttcgtatcgcacgcgaatccgttaacattcgatgaccacggagggtgaaaacatatctccttggaacaagctagcgatattagatcgcaactgttgtttctcttgcattcttcctggaggcaggaagcgatgcgctggatcgcaagaacataccagcacccacccgcaatcttcttgcattttcctcatgatgtgtatactatggtagaccttggggagaaattgaactatgaacatgagcagcagtattgtcatgataagcttaacctgctcctccctgattaactttggtataaccagccagaagataacctgcgggatggggaggatgacgaagaggtcgaagcagaggcccttgacggagcgtgcgtagtgcgcggcgacggcgcgggcgtcccacacgagcttgccgcacccgacgacgagggactcgcgggagacgtaggcgaggcggagctgcaggagcacgtgcgcgaggtgcgccacgtcggcgcaggtccgcagcgccgtgaccgcggaggcgagcccggcgtccatgtagaggcagggctggccggcgcggccgatggagagcgcgtagaanaagagcgggtccaccgccagcgcggcggcgcggcccagcaggatccagcggttccagcgctgcacgcgcctgctccgcgggtccagcacgggccccaacagccaccgcgccgcgtgccgctgccgcggcgccgccgccgcctgcgcctggcccttggaccggcacgagcgaggaccccgcgtcggcgtcccagtccggcgagtgcacctggtcgcacgtcgtggagtggaacgccggcaccccgggctgcgtgcacgcgtagcactccccgccggacggcccacccgccgacgaccgcccgctcattccgccgctgcctccggcctcctcgtcccgcgccacctggccagggctcccccggactccaccaccaccaccacacgctcgcgcgagaagcctcgcggggagggagcggcggaggaatgcgaggcgaggcatctcgtcccgaccacggcggggaccatgaaaaggcggctccgctagctaggcgcgcgcgccggcgcgatggagggaggcgcagtccagcagctagctagtgagcggcggagcggacagcggagctagcctgctgctggcgtcgcgctcggcgtgggatgtggtggatacagtg

SEQ ID NO: 21185 - DNA, 2433 bp, Zea mays
tgcagctgaggccgcaatggcgcggtcagatacaggccgacagaagtacttcagagttcggattcttgggggaaaaggcaattggatcccacctaagaaattatttctccattttattggtcttctttaaatgacaattcggaaccactaattcacttacgcaaaagctggcagcaatatactattacagtgcacactgtacagtcaccatgacgcggccggcacagctaggagcctaggatggtccctccctcctgctcatcagtgctcactctaggtggtcatgcggccgtagcgacatgaacatggccgcgtagtgtctgagccgccggtccccgtcgtcgggcccgcccaccaacggcggcgcggcctgcgccgccaggtccgccgacgtccgggccctgtacctgcgccacgcgagctggatgttgacggcggcccacgtccgccagttggacgagtagtaccgcgccgtgcgcttgagcttctcgttggcgaagttgtaccggaagtgctcggtgatgaaccgcaggtccggcgcgccgaggcagaacgcctgcgccgcctccacgcactcgaacgtggccgacgacgcggggagccggtccacgaaggggcggcgcaggcaccacgacagcagctcgtcgcccaggaagctgcccgcgcccagcatgcacgtcgccaccacgcctttggtcagcggctgcgtgctccggagcttgccctgcaggatgaacaccatgcgctgcacggggtcgccctcccggatcaccttctccccgctggacaacaccagaggccgcagccggtcgcagatgttgtccaggatcaggtcgtccatgccatggaacagtggaacctggcaagttaattttttttagcaatctcatggctcattcatcatgtaaaaaacattgaacatttactaaaagctcttgattttacctgcttaactagctcaaggcacaggtagcgcttgatgtcccgtctcagcccttcaggcagatccttgatcatctccatctcctcgtctcccgtgacggcggcccagcgttcacgctcgtatttgcgcaccctttgcctcagccgggacggcagctgtctacgcctcatccaccattccatgtcccggaaccgcagctgcatcttccgcttccttgccaggaccgcgtgcagaaatacctgcggattcagattcagtaagttgtaatttctggttagtgaatcggtgtggtacaagtacaatcacacagaagaggaaaaaaaacgacatcgttttacctgtatgtttccgatcagcaacgtgaagagcataaggccactgaggacattgattatgctgaatatcacctcaataccattgcttgttggggcaaggtcgggaccaaaagtactgccaagcaattcaaggaattgtataagttcatgagaaatgcagatttaaacacagtacgaaaacagcattaagaaaatgcaagtatgcatatgcatggaacaagactagatttttattcgaagtggaacggggtatcagatagctgttactatttattcagatcaacagtataagaaagaaagaaactttgaacatatagtaaaattattaaagcaatagtttcctagagagcatacactgtgttttgaaggcagattaaattaaatctgaaaagtgattacctgagtgtcatgaggccccaaaatataggatacagtattttgacagcaagcgaattgctcgatataacaggaagagcccccaaatagattccataagcgaaggaaccttttccactcaagcaagtagacacattttgttggctaaaggaggtcatgttcgtatcgcacgcgaatccgttaacattcgatgaccacggagggtgaaaacatatctccttggaacaagctagcgatattagatcgcaactgttgtttctcttgcattcttcctggaggcaggaagcgatgcgctggatcgcaagaacataccagcacccacccgcaatctggaaatggcagaggattgatgaatgatcgaattacccagattattcggtctgcattagtcttaagtctagtaccaattctaagccaatactaagccatcaacaactggatatcaatactacgagagcgacactgggattccatgtccagaagatttaacctatattttctacagtataattgactaatgaggaagggaatactcacatgagaagcaatgaaataggaaaatagatttaaaccaaatccccaccatatcgatccaaagatgtaacctgtcaccttctgcattttcctcatgatgtgtatactatggtagaccttggggagaaattgaaatatgaacatgagcagcagtattgtcatgataagcttaacctgctcctccctgattaactttggtataaccagccagaagataacctgcag

SEQ ID NO: 21186 - DNA, 1281 bp, Zea mays
ccccaaacgcctccctattaatctccccgcgttccccttccctcgcgccgccgctcccccctcccaaagctcgccccgctcccagctagggtttcctcttcccatccacagccgccggggcgccgccgacgaggacagcgccgccacgatgttggagttgcgtctggtgcaggggagcctcctcaagaaggtcttggaggcgatccgcgagctggtcacggacgccaacttcgactgctccgggaccgggttctcgctgcaggccatggactcgagccacgtcgcgctcgtcgcgctgctccttcgcgccgagggcttcgagcactaccgctgcgaccgcaacctctccatgggcatgaacctcaacaacatggccaagatgctccgctgcgctggcaacgaggacatcatcaccatcaaggccgacgacggctccgacaccgtcactttcatgttcgagtcgcccaagcaagataagatcgcggatttcgagatgaaactgatggacattgatagcgagcacctcggaatcccggattccgagtaccaggccatcgtccgcatgccttctgctgagtttatgaggatctgcaaagatcttagcagcatcggagacacagtcgtcatctcggtgactaaggagggcgtgaagttctccacatctggagaaattgggagtgcaaacattgtctgcaggcagaaccaaactattgacaagccagaagaggctaccattatagagatgcaggagccggtttccctgacctttgccctgcggtacatgaactccttcaccaaggcgtcttcactgtctgagcaagtcactatcagcctgtcgtccgagcttccagtggtggtcgagtacaagatcgctgagatgggttacattagattttacctggcccccaagatcgacgatgacgaggagatgaagccctgatggcctgtgacgacataatgctcgtgttgcctgctcttccttccagccgttgtttgcttagctactctttgcaagcgaagaagggatgtgatgtgtatctcttaggctagactgcttcagctagttttctgtgactgcttcatgaatccatggattactgatttactgggtttgtgctgtgtatgatgctgccatctggtctcccaacaaagaagggatgtggtgtgtgtctcttaggcctggttttcttttttcttggcataagtgtcatcattcatccagttctccttgtggcggtggcaaggaagttgaaaaagctgaacgtgatgtgtttgctgccc

SEQ ID NO: 21187 - DNA, 1223 bp, Zea mays
cctcgaaacgactccctattaatctccccacgttcccctcccggcccgctcccgccgccgctcgcccctcgcccctctcaaacctccgcgctcccgcccagctagggtttccccgatctcccctcctcctcaaccgccgccgtctccgagagcgccgccacgatgttggagctgcggcttgtgcaggggagcctcctcaagaaggtcctggaggcgatccgcgagctggtcaacgacgccaacttcgactgctccggcaccgggttctcgctgcaggccatggactcgagccacgtcgccctcgtcgcgctgctcctccgcgccgaggggttcgagcactaccgctgcgaccgcaacctctccatgggcatgaacctcaacaacatggccaagatgctccggtgcgccggtaacgacgacatcatcaccataaaggccgatgacggttctgacaccgtcacctttatgttcgagtcgcccaagcaagataagattgcggatttcgagatgaaactgatggatattgatagcgagcacctcggaatcccggattccgagtaccaggccatcgtccgcatgccttcttctgagtttatgaggatctgcaaggaccttagcagcatcggagacactgtcgttatctcggtaaccaaggagggcgtgaagttctccacatctggagaaattgggagtgcgaacattgtttgcaggcagaaccaaactattgacaagccagaagaggctaccattatagagatgcaagagccggtttccctgacctttgccctaaggtacatgaactcgttcaccaaggcgtcttcactgtccgaacaagtcacgatcagcctgtcgtccgagctaccagtggtggtcgagtacaagatcgctgagatgggttacattagattttacctggcgccaaagatcgaggacgatgaggagatgaagccatgattgccatcagtgctcgtgctgccgactttttctcgtcttccatccatggtttgcttattagctattatttgcacgcaaaggaaaaaaaagatgttatgttttatatcttaggccagactgctttagctacttatttgtgactgctgtgtgtccatggatttatagtgaatctagattagtgggcttgtgctttgtgcatgccgctgctgtctgcccatttttctattcagacatgaaattctttgttgggatcttgataagctgcatga

SEQ ID NO: 21188 - DNA, 942 bp, Zea mays
aaactcctttcccccctcccagttcccaactttacccccgcacacccggccgacggtagcgataaccttttttttttttttttttgcgaagcagatcaggagcatttatgacatcgcaatttgtctgccagagttagaaatgggcggtttcatagaggtactacacggttacagtatactaaagcactaatttcgttcggtgaatcgaacgctacttcatcccaaaagcaaacgacagcttaggccgcgacttgttcttgcccagcagcttcatctggttttgcctctgctgctcttcctccatttttttccgtttcatggcctcctctctttctttctgaagcctctccaactcctggtaccgctctagctctttctgctgctgttccaacgcttctttcatcaacgcctcttcagctttctttcgttcttcttcaagttttttttctagctcctcccgcttctttttttcttgttccactttcagcttggcttcatttaaagctgcatccttttccttctcaatctggattgctacctcctcatgtatcctctttcgtccttcctcaattcgacgatgtatttcatgtttgatttcatcacaatttagactctcctcaaccttcctcctaatagcttgttcaactctttttgccgtctccttctctaatagtctcagttcaacttccttttggcgcctgcagttgatatagcaagttaacgaaatgcactacctaaggcaagtcgtgaccaaagccgatatttgtttgttcaaactcttcaagaccataaaagcagcaaaaagcaaagcacatggtttaaaatctaaacagtatctatgatctactatgcctttccagcatagttgactacaagctaatgcatttcaggcatacctctagttcgttccagatccaaaaacgaattatcaaattttcgatt

SEQ ID NO: 21189 - DNA, 1284 bp, Zea mays
gcccccccttttaaattttgttttgttttttttttttttttttatacttactttttttttttttttttttttgttttttttttttttttttttttttttttttttttttttttttttttttacgaagcagatcaggagcatttatgacatcgcaatttgtctgccagagttagaaatgggcagtttcatacagaggtactacactacacggttacagtatactaaagcactaatttcgttcggtgaatcgaacgctacttcatcccaaaagcaaacgacagcttaggccgcgacttgttcttgcccagcagcttcatctggttttgcctctgctgctcttcctccatttttttccgtttcatggcctcctctctttctttctgaagcctctccaactcctggtaccgctctagctctttctgctgctgttccaacgcttctttcatcaacgcctcttcagctttctttcgttcttcttcaagttttttctctagctcctcccgcttctttttttcttgttccactttcagcttggcttcatttaaagctgcatccttttccttctcaatctggattgctacctcctcatgtatcctctttcgtccttcctcaattcgacgatgtatttcatgtttgatttcatcacaatttagactctcctcaaccttcctcctaatagcttgttcaactctttttgccgtctccttctctaatagtctcagttcaacttccttttggcgccttttcttttcttcttctagcctttgtgtatcaataacattcttattctctgccaacccaaggtgggaactctgagatgcagcgactggagagctagtgacactcggacttctctttcttctgtaacgcttttgtgatggagacggactcttgcgcctcctaggagacggagaacggctcttgtgccttcttggggaaggcaaagggctcctccttctatacgaggagcgatagggggacctgctacggatgggactggggcttcggtccctgcgccccctccggccgcggtaccgcgcgggagacggcgaccgccaacgtcggcgcggcggagaccgcgaccgcgacaggtcgcgtggcatcgtgcgcgacgcgatctagagcctcggcaggactcagaacgcccggatctggatgaatccggacgatcggagtcttggagaggggaggagtctggctttgctggctggaaaacgggaggacgcaagccaggtggagtcgccgccgccgcacgcgagcccggccggcctcgaggtacccaat

SEQ ID NO: 21190 - DNA, 980 bp, Zea mays
  misc_feature (38)..(65): n is a, c, g, or t
  misc_feature (925)..(929): n is a, c, g, or t
  misc_feature (933)..(947): n is a, c, g, or t
gcagtcctcccggtacggcaggttcgggttcggcggcnnnnnnnnnnnnnnnnnnnnnnnnnnnngatctctccgcgtcacgacgacgcggcagagaaagccaggaactccaaaggtgaaaggtccgagttcgggttcggacccccccccaccccgtgtatatgctcccaagttcggcacgcgacgcaactatcctctagagagagagaggaagcccgtcgttctggaagtttccacgctccgcgcctccgccccctggtctccgctccaatggcgccctcactcctcgccgccatgtccacctcgcccttcctagccagcagcggcagcagccgcaggccgctaggcgctgcccacacccgacgggctggactgcgcgtggccgcgcttaagtacgaccctgccaaggtggcgccgcagaacgaccgggttctcgtccgtcttgagcagatccctgagaaatctgctggcggtgtattgctaccaaaatctgctgttaagtttgagagatatctgatgggtgagattctatcgatcggtgctgaagtcagtgaagttgaggctgggaagaaggttctcttctcagacatcaatgcttatgaggtggagcttggtactgatgaagagaagcactgcttctgccgtgagtcagacttgttagctgtagttgaatgaattttaccatgaaaatttcggacttacctgggaatgctccaacggcatgaacttatcttgcccccactttgttgtatgccatttgaacgttcgttaattcagcttctagatgattgttagttaccgttgatttttggtcgccataaactggaattatgttaatgcccattttctttacagaggctcttgctcacgtttggaatacgaaactgtgctaaccgaaaaaaaaaaaaaaaacttacattgctcnnnnngggnnnnnnnnnnnnnnnaatcttgagacaacatcttaattatttctatca

SEQ ID NO: 21191 - DNA, 723 bp, Zea mays
ccggccgggccgggcccacccgtccggggacggcacgcgacgcaactatcctcgagagagagagagagagagaggaagcccgtcgttctggaagtttccacgctccgcgcctccgccccctggtctgagtggtctccgctccaatggcgccctcactcctcgccgccatgtccacctcgcccttcctagccagcagcggcagcagccgcaggccgctaggcgctgcccacacccgacgggctggactgcgcgtggccgcgcttaagtacgaccctgccaaggtggcgccgcagaacgaccgggttctcgtccgtcttgagcagatccctgagaaatctgctggcggtgtgttgctaccaaaatctgctgttaagtttgagagatatctgatgggtgagattctatcgatcggtgctgaagtcagtgaagttgaggctgggaagaaggttctcttctcagacatcaatgcttatgaggtggagcttggtaccgatgatgagaagcactgcttctgccgtgagtcagacttgttagctgtagttgaatgaattttaccatgaaaatttcggacttacctgggaattatcttgcccccactttggtgtatgccatttgaacgttcgtgaattcagcttctagaggctcttgctcacgttggaacacgaaactgtgaaccgaatttgaaatgcttacattgctcgtctgacgtttgtgcttctgaac

SEQ ID NO: 21192 - DNA, 4232 bp, Zea mays
  misc_feature (1525)..(1525): n is a, c, g, or t
ataagccacggcccacggacacgccgtccgtgggcctgacccctacggcatcgttcaggtcgacggcggagcggtggagcagcaggtggagcaaccggtggagcagccggtggagcagcgggcgctggagcaaccggtacgacgctgggaccgtgacggccgcggccacggcggagtggtggtgggacatggacggcggcgtggcccccccgacgcggcggagggacgcggacgacggcagcgcgtcgttctacgggttcgtgcggtggctcacgggggcatactagtaaatacggtcgtacggtgctagcatagtagcatccatgaaagcggtggactgcggcggcggcggccggtgttcccgaaagttccctcctcgtcgtcttttcggcatgcgagcttgcttttgtttcggttttggggccggctgggtggatttcgaggacggagaggcggatttcaaaactagtacgttctacttccgaattggagaatgtcggcccgggaagaatgaggaatgaatttgtgagacttgtaggcgggtgcacatctgtctctcgcccaatcaaagaaaatggtagaaattccgggggggagggggatttcgctgcatttttcttttgacttggtcgaaatttgcagcacgctggtgctcatcgttggcgtatatacgtacaatttgtatgcggtagcgtggaccgtccattttgcatatagtagcaaataaattagcgaaggtagcacataattcgtcagcctcctatcctatcgcctggtatggttaccccaattctcatgctacatctatatatatatactttgatttgagattgtttacgctgcttgattatggttggtgcacacgatgcacgtgtgcatctatgtcaatcacatcctgtccttatcatgcactcgtcactagtagtagagagttgaagggcgtgccattgtactggagcgccactgtgcggagatcgaagagtgtacgtcgtggagcaggacgggctccagcaccagcagaacgcagtgcacactgcacatgggatagaggagggaggtttaaaagatgggtggtccatgagactacattacgcacaaacctacaagaaactcccctctcctcctagtcctatctggtccctccccgctggaaaaggactccactgtcccgttgcaccgtactggcccatgtccccgctaataacactattattctcacgcatgcctccgtgcgcttcgctatcccagtcgttagcgcaagtaattaaccaaatggtgattgatctagcatactatactactacgcctctggcttgacctgccttgtctgtctcgcgtacggcgttgctgctgggaacggagggcggagtcggagtgttgagaagctggaacggagtggacgaccgagacgatggggaggcatagggcagagccagagccagagcgacgagcagctcgtgtcgcttctggtggtggtggaaggctccgtccttgctctgaacctctgaactgtacctactacatncttcagagccaaggattgggggcttgccatgcatgtggtacggcattgcccggctgccgtggcccgtgccctgtgaaagcaagtgctgtttctcatgcattggcctctctgcgactctgcctgccactgccatgcccatgcctctcctgcagctacatacactcctcgcgttccaaaaggaatgcaatgcaattgtgtcatgtctagttaataagtttaaccaatcatcgatacaaaaaaaattaaataagtactattaaatcgatcacgaaatttcactagaaaatattgaccgttataaccgacgcaaaatccgtagctgcatccgttccaaaaaacaagtgtctttctcgcttaccgacgagtcacgtacttctgatttaaactgaatgtgcagaagaaaaatattaatgcttgcagtatataattagcgtctttaaaatagacagttgaatattttttttattaaatttgtttaagggtataaatattgccagtaatttctatagacctagttagacttaaaaatgttttaactcgtgcgggtaacatgacagatttatttttggtacggacgggctgtaagaaggcacggagaacgccatgtatagagttcgaccctttttactctaaaaatctcttcattgcggccttttggtctatgacgtgattgggtggcaggtgatgtggttgactggttgtatatgctgtggtggcggtgaaaataaatgatataagatatatgatatttgatataaagtaaatatgaatgtgaataattatggtatatgatagagagtcttactggcaagaacaaaatattccttttcaagtaaaaatttagagtaatataagtgtggatagcatgatacctaacttgtttcctcacggcctagggggacaagggcaagagacaaggccaaaagaaagaaaggaaagagagcaaaaggcctgcttctcgactctgcaatttcctctttatctccttttcttttccaattttaactttcctttcgttccagctgatccatatatacggtcccccgccgggcttttgaagtttgagcagctgaattttcgtgaccccacgccacgcagccacgctgctggagttcagtgatccagtcgagtcaaaaaaaaaaaaacttgacgtgtcgatgaacgtaaacaaatttgttgtggtcattgaccgatggcaaacactttgatgcaaactctgctctgcggctcaattctgtactgtaccaacgcgaacggcagcagctagcgcacctcggtgaacatgatggaagactggtcgtcctatcttcttccgtcggatacatgctgctctcttgggtccgcccacgccttcctcgcctcggcgctgcgcttcgtcatgcatgccgcgcgcagtgcccccctgccctccgctagctgagctaggcgctctttatttgcatcatcacgtacgcacacgcaaccgtcgtgcagatatgcaacgccaagccacgccacgcaccgcgcctactactggaaatcacgagacgcatcacacgcacattgccgactgccgactgcggcggagtcgttccgcgagcccggcccatgcagcggccgccgggagcccgggaccttgacaagcagcaggaatcgccggagaagtcaacgtacatgaggagctagcaggagagcatatacctgcacctcgtttcccagaaattgacgaacgagctaagattcaacgactaacaacactcttgcggaatgcagaccaaggtgatgagaggcgcagcgcaaccaagaaaacttgcgtcgttccacgcccattgttctacggagcacaattagacatcacatcagtcaggcccattgttctatcaggccagcaccaattataatggggccgaaacgaaacgatgtcggtgctaaagcccctccacctccttacgatttcagcccatttcgagataagggcaccccaaaaaattatgggaccatcgagaaggaatccacccttgactccaacagccaacagcagataaggaaacgcacgcgccgcgccgccccgatcaagccattcgtccctgtggaagtttccacactcccttcccttcccttgtacccactccaatggcgccctccctcctggccgccgtctccgcctcgcccttcctcctacccggcagcagcggcatcagccgcaggccactgggcgctgccccaacccgccgggccggactgcgcgtggccgcgcttaagtacgaccctgctaaggtggcaccgcagaacgaccgggtgctcgtccgtcttcagcagatccctgagaaatctgctggtggtgtattgctaccgaaatctgctgttaagtttgagaggtatctgatgggtgagattctatcggttggtgctgatgttagtgaagttgaggctgggaagaaggttctcttctcagacatcaatgcttacgaggtggaccttgatacggatgagaagcactgcttctgccgggagtcagatttgttagctgtagttgaatgaattttaccatgaaaattacagacttacttgcccatgctccaactgcatggacttatcttgcacctactttgttgtacttgaactcggcttctagatgagtgttagttatcattgtattttggccgcaataaaaaaaaaaaaaaacaagccgccgcctctttacaaaaaaaaaaaaaaaaaagcggcc

SEQ ID NO: 21193 - DNA, 849 bp, Zea mays
cctcgaggccggccggggcaaaaactacaagggacggcacgcgacgcaactatcctcgagagagagagagagagagagagagaggaagcccgtcgttctggaagtttccacgctccgcgcctccgccccctggtctgagtggtctccgctccaatggcgccctcactcctcgccgccatgtccacctcgcccttcctagccagcagcggcagcagccgcaggccgctaggcgctgcccacacccgacgggctggactgcgcgtggccgcgcttaagtacgaccctgccaaggtggcgccgcagaacgaccgggttttcgtccgtcttgagcagatccctgagaaatctgctggcggtgtattgctaccaaaatctgctgttaagtttgagagatatctgatgggtgagattctatcgatcggtgctgaagtcagtgaagttgaggctgggaaaaaggtttttttttcagacatcaatgcttatgaggtggagcttggtactgatgaagagaagcactgcttttgccgtgagtcagacttgttagctgtagttgaatgaattttaccatgaaaatttcggacttacctgggaatgctccaacggcatgaacttatcttgcccccactttgttgtatgccatttgaacgttcgttaattcagcttttagatgattgttagttaccgttgatttttggtcgccataaacgggaattatgttaatgcccattttctttacagaggctcttgctcacgtttggaatacgaaacggtgctgaaccgaacttgaaatgttaaaaaaaaaaaaaaaaaaaaaccaaaaaaaaaaaaaccgaaaaaaaaaaaaaaaaa

SEQ ID NO: 21194 - DNA, 864 bp, Zea mays
actggggctcgcgcgctcgcgcccggccggggtgcaaaaacagataagggacggcacgcgacgcaactatcctcgagagagagagagagagagagagagaggaagcccgtcgttctggaagtttccacgctccgcgcctccgccccctggtctgagtggtctccgctccaatggcgccctcactcctcgccgccatgtccacctcgcccttcctagccagcagcggcagcagccgcaggccgctaggcgctgcccacacccgacgggctggactgcgcgtggccgcgcttaagtacgaccctgccaaggtggcgccgcagaacgaccgggttctcgtccgtcttgagcagatccctgagaaatctgctggcggtgtgttgctaccaaaatctgctgttaagtttgagagatatctgatgggtgagattctatcgatcggtgctgaagtcagtgaagttgaggctgggaagaaggttctcttctcagacatcaatgcttatgaggtggagcttggtaccgatgatgagaagcactgcttctgccgtgagtcagacttgttagctgtagttgaatgaattttaccatgaaaatttcggacttacctgggaattatcttgcccccactttggtgtatgccatttgaacgttcgtgaattcagcttctaggtgattgttagttaccgttgatttttggtcgctataaactggaattgtgttaatgcccattttctttacagaggctcttgctcacgttggaacacgaaactgtgaaccgaatttgaaatgcttacattgctcatctgacgtttgtgcttctgaacaaaaaaaaaaaaacatcttacttctttctaaaaccccaaaaac

SEQ ID NO: 21195 - DNA, 829 bp, Zea mays
  misc_feature (515)..(515): n is a, c, g, or t
  misc_feature (529)..(529): n is a, c, g, or t
  misc_feature (536)..(536): n is a, c, g, or t
  misc_feature (549)..(549): n is a, c, g, or t
  misc_feature (561)..(561): n is a, c, g, or t
  misc_feature (563)..(563): n is a, c, g, or t
  misc_feature (569)..(569): n is a, c, g, or t
  misc_feature (591)..(592): n is a, c, g, or t
  misc_feature (602)..(602): n is a, c, g, or t
  misc_feature (619)..(619): n is a, c, g, or t
  misc_feature (641)..(641): n is a, c, g, or t
acacttataagccacggcccacggacaagccgtcctccacccgcgctcgccaccacaccagcaggaggcagagcgcgcgggcggctgggacaagtacacgttgatggcatctaccgccatcccgtccccgccgcctccggcagtgccggagcggagagtgccgctggtgccgcggctggcggacgatggcggcggggacggaaggggtgacgcgcgagggagtagcgcgggaggtggcgggagcgggagcggcagcgtggcgggcatctcgccgagcatcctcgtcatcgcagtcatcgtggtggtgatgctgctcgcgtcgctgtgcatccactactttatccgccacctctgccgccacgtgggcccagcggggtcctcctcctcctcctcctctttgtcccggcaggctccgccgctcccgctcgtggcgcgccccgcggcgggggcgtccgtggcgcccgctgacggccagggcggaggagggaaggcggcggccgcggcggaggcagagncggagcggctcatngcgcgcntgccgcagttcangctgtcctcgtngntggccnccgtgcccaagtcgtcgcgcgnntgcgccgtgngccagaccgcgttccgngacgacgacgggctccgcctcntgcccgcctgccgccacgccttccactcccgctgcgtggacccgtggcttcgcgccaacccgtcctgcccgctgtgccgcgcctccatcgcgctgccccacccgccgctcacggacctcctccgtgtggagctcggcagcgtcagcagccgccgctccaacccggacgctgcggccgccgccgtccgc

SEQ ID NO: 21196 - DNA, 2175 bp, Zea mays
  misc_feature (298)..(303): n is a, c, g, or t
cggaaataatttccgggttgttgaggttccttgtaggctgccgcccttttttttttttttttgttttctacgattgaattactacatttacacaaatccttcctgaacagacggtacattgcacagtaacacgtacacctgatgatatatctgatagaaacgcagaaggtgcaaaacagcctgacatcaactaaagtcattttagtagcttgatatgttgctacagtttacgtctaaaacacaagggacaatctatataatattctatactctttgttgaacttctgaactcaactannnnnngttacagaaaaggtctctttttttttttttttttaccatctatattatataatctagcttaaataaattgagagttaaacaaacaatatagattattaggtgaattatataatccagatatctagattatgataatctataagcaggtcaataggtgcttatataatccacgagctggattatataatcttggaaggaaacaaacggggctttagtcctagatccagcgttaggctataaccaaacagctccagattgtccttattaatatcaacagaattaaggagttgtgccattgaaatctccacccagcggagatgttttgtgcgtcgacagtgtacactgagccagtcttgtcatcctcaattttaatgctcgaggagcagttgtagtctgtccatccaataacttctttttccaagtcataaactactagtttgtttgagaggaccaagtctcctaagaggagcatatctttcccatctttagtctgtacaccaccatccaggaatcccatacagtataaatcattcctgttctggaaaaggtaatcatctgggtaaacattcagtgtaaggtctccctcaaaactaaaggtgattacgggaaatccatcatctatacttccagaaaattgaaaacacacgaagtcttgataattatgtaagggcagatcttggtacttatcaaagaccgcagccaacaaagtcctataaacttccctcggaagatatgccagtgttgtcccactgtcaatgatagtgcctttactgtcaccagaatcaaaagtacttgttggaagctgaagtgtagcaccaccaacagaaattccttgcagattgacattgtagtgtgtcacgttgggcaccaacggcgtcgtctttactttgggctgtaccacattcccgatagcgaagatgccaccaccacgcacagtgtccaagcagtgagcaaaaatcttcctcactctacgagcagcagccaactgcgatagcatcgacgaatccgactggccgaacccaagaatcccatcaagggcctggttcgaggatcccaaatccccaccaagctgagcaccacacccaaaggtgatgctggcgttggacgtggtggtctggccgttgccggacacctggttgtactgcacgaagtctgtgacgtagaagccggtggttgtgctcccatctccgtaggtgatcctgaactggcacggcgacgacgtcgaggggcacgtggggggcacgccgcccgcgctgttggcaacgcagaactcctgctcgcaccccaccgtggtcccgctcccagccggatcgtactgcgtcagctctatcccgagtccgcttctggtggggcagccatcgcagcggatgcagttgacccagaggatatcgctgccggtgtccacctgcacgtagtagcccttgggcggcgagccgatctcgatccgggtgtagtacaggccggtatctgtggggagcccgacgccgccgagggccaagtcgacggcgccaaggagccggccgtggcggttggcgtcatgcctccgcagcgccgcgaggtgctccgccacaccccgtcctccgtggcgcgggaacttgcggcgcacctggaagacgccggtggcggacgcgcaccccaccgacagcgcaaagaggaggacgaggagcaccgagaagaagctggaagcgcggggcgccggtgccatcgatctgatcgggctatgggtttgcttagcccggaggacactccagagtccagacagctagccggggtatgtgtatcggtgtatccgcgttcggcgatgacgccggccgaaaaggaggaaaagatgaggaggccaagtgaaaattcccggcccggccggcctcgagg

SEQ ID NO: 21197 - DNA, 743 bp, Zea mays
cccgcgggtcccgcggcgcgcccggccgcagattggcggcagcaaagcaacacgcgcctcgatcctcctcgcccctccggcctctcctcccctccctgcacccgcacctgcggagagcgccgcaagctagctgcagaggagcgagacagtagcaggaggaggacgagaggaagaagagatggcgggctgtgatggagccaagtcgtcggcgtccatggaggaagaggcatgcgcggagaagaagtacggagggatcgcacccaagaagcccttgatatccaaggaccacgagcgcgcctacttcgattctgcggactgggtgctgggcaagcaagccgcgaacagcagcagcagcacgaggaccgcagccgcggtcgagtctctgaagcccaagctgaagagaacgccgcaccaccagctgccgcctcgtaagcccacctgcgcttccagttgagacgcatggccacgcgtcgcagctgctggaggaggagctcggtcagagtcaaggactgaggatgccgacgagctcgagctcggataaatgttttagctggtccggaatcgtagggacgacgacgagccagaaagatccgaatccgagatgccgtctggcttcttggcgagcagcgcctgttattgtgtgccataaagaacggatcaattaattatcaattgtctggctgaattctgacaaaaaaaaaaaaaaaaagagccccaccaaaaaaaaaaaaaaaaaagcggcc

SEQ ID NO: 21198 - DNA, 738 bp, Zea mays
agccgtcgtgggcgcgggaccaaccttagccgcggatccggtcgccgaccatctcgccgttagtccaagtgcgccactgcacaagcaaaagcagtgccccatgtcctccccttcttccttgcaaatttaggagatggagtcctccttctcctcgtcggaggagaactgtccgctgtcgtgactgacgttggggaggtcggcctcattcttgatggggcgcagacctgggcgtcgcgcagccgcctctcccacgtggcgacgttgcgggagcagtgcgggagacgacatcaggagtgcggaaggtggaggggaatcaaccactgcattggtgtagattggcgggcaacctgtccgggctgccatcgtcggacggcgaccaaatctaggcagcgcgggtgttggtggcctccaacgaggcctctcctcgactgacgtggtggacgcgacagccatcgagcgcaaggtggagataatggtgttctcgaggatcctcgcgtcgcgcagcacacatagttaatctaatctcgggacacgcggaccgttcgagcccaagggccggaccgtccgctcattttggtgtccaacacacccgtacgttcgttcggtcgattaagcacttttacattatggctaattaggattaaaggggatgcgtaactgctaatcttctggagacttcttattatctttagatgagatcaccaccggcttttattcttcaacagggctcattgagtt

SEQ ID NO: 21199 - DNA, 1641 bp, Zea mays
gtaccgggccccccctcgagttttaagagagctgtattttctttatatctttctttgaaaaagtaaccaattaactgcacagttcatgttcactacagaaacaacgcgcagcgttgccgcaagaccacaatcgttgcaatagtagcttaccgggccatcaggaacagatcacaaactcaattggtacaagatgctccgctatgctttcttgttcctccttcgcgtcaaccggccacacggcatgcaaatcggtccaagcctacagggacgagctggacctggtgttggtgtggctgatggtgaaggactccagcttggacaaatccggcacccagcaggacagctccgacgttcctgtcacgaacatcaaggatcctggagaccaccttacccgcggcggtttcacatctgtgctttcccagcatgcaacctttccgctctcaacgttccaagcatagacactaccatcaccggagccagatacgatatggtttccctcgggacagaacgatgcctccagtgtcgaattggttaatattggcttcgcgcgaaacgatgcaatgctgttgccttcaaaagaatctagcacatgaacacgcccagctttagtggttaacagaatccgcctgccatcaccgctgaactgtacgacatgggcttccgaatcatcagtgccgacagagaaggtcgcaaaaggccccattccgaatttccgagtatcaaacatccttatgcggccaccataggcgacagcaaataccatgccctgggcgtcgtacgaaactgtaggcctcctttgcgcgcgcagtaagccctgcggtttttcagcccgatggtcccataagagaatggtacgatcaagcgaacatgagagaaagttttcttttccagagcaaagtgcgatgcagacaaccctatcaaggtgacctttataatatctaataaaccggttatcattcattgagagcagacgcagagattcatcccagccattgttcgatgaatataagacaatagatgggttatcagtgaagcacacaagtccaaccccatattttttgctattaatagtattcaaacacactgcatcttgggtatcgtataaacggattgattcatcatcgctagctgtcacgagatagttggtagccttgctgtgaaagtccatagaacaaattctgccattgtagtctcggcagtctcttaagcatctcgttcgtgatctccatgctcaacccttgggccaggtgccggccgactgccgacccagtaaacggcacgggtgaacacatgtacacccgatgtttttttgcaaaaagaaaaagggaaaaaaaacccacccgaccgagtggacacaatactacatacaccacatttgtagtttggaacaaatccgaataaaacaaacagttagggtttggtgctaggcttcgtagagcaggaagggaagagatggggcggtcgtacatggtggtggtggtgtgttagtcgacggcgaagggccccgcgaagcacatggaggctggagcgtagggcggcgcggcggtcgtcgagccgtcgccgagggagagagaacgcggggcggggtgaacggcgccacggcggtggaggcgggctgtccgccgttgtttttcctgagcc

SEQ ID NO: 21200 - DNA, 1670 bp, Zea mays
tttttttttttttttttaataagagagctgtattttctttatatctttctttgaaaaagtaaccaattaactgcccagttcatgttcactacagaaacaacgcgcagcgttgccgcaagaccacgatcgttgcaagagtagctttaccgggccatcaggaaaagaatccaaccatcacaactcattcgtacaagatgctccgctatgctttcttgttcctcctgctcttgatggagtcgcgtcaaccagccacacggcatgcaaatcggtccaagcctacagggacgagctggacctggcgttggtgtggctgatggtgaaggactccagcttggacaaatccggcacccagcaggacagctccgacgttcctgtcacgaacatcaaggatcctggagaccaccttacccgcggcggtttcacatctgtgctttcccagcatgcaacctgatgacccaaaaagtgaccatacctcagccaaacagatgtgtggtatataacatcatcataataatatatacgctgcttcggtatcaatatcacatgttcttcctctgcacctttccgctctcaacgttccaagcatagacactaccatcaccggagccagaaacgatatggtttccctcgggacagaacgatgcctccagtgtcgaattggttaatatgggcttcgcgcgaaacgatgcaatgctgttgccttcaaaagaatctagcacatgaacacgcccagctttagtggttaacagaatccgcctgccatcaccgctgaactgtacgacatgggcttccgaatcatcagtgccgacagagaaggtcgcaaaaggccccattccgaatttccgaatatcaaacatctttatgcggccaccataggcgacagcaaataccatgccctgggcgtcgtacgaaactgtaggcctcctttgcgcgcgcagtaagccctgcggtttttcagcccgatggtcccataagagaatggtacgatcaagcgaacatgagagaaaattttcttttccagagcaaagtgcgatgcagacaaccactgcatcttgggtatcgtataaacggattgattcatcatcgctagctgtcacgagatagttggtagccttgctgtgaaagtccatagaacaaattctgccattgtagtctcggcagtctcttaagcatctcgttcgtgatctccatgctcaacccttgggccaggtgccgggctgccggccgactgccgacccagtaaacggcacgggtgtacacatgtacacccgatgttttttttttgcaaaaagaaaaaaaggggaaaaagaggaaagttagttgacacaatactacatacaccacatttgtagttggaacaaatccgaataaaacaaacagttagggtttggtgctaggcttcgtagagcaggaagggaagagaaccctatgctggtggtggtgtgttagtcgacggcgaagggccccgcgaagcacatgaaggctggagcgtaggccggcgcggcggtcgtcgagccgtcaccgagggagagagaacgcggggcggggtgaacggcgccacggcggtggaggcgggctgtccgccgttgtttttcctgagccgtgcttttcatggcccttcctttctccacgcaactgtttttctagtttggtgcatttccccccccgaa

SEQ ID NO: 21201 - DNA, 1847 bp, Zea mays
  misc_feature (18)..(18): n is a, c, g, or t
ttttttttttttttttgnttttttttttttttttaaataagagagctgtattttctttatatctttctttgaaaaagtaaccaattaactgcccagttcatgttcactacagaaacaacgcgcagcgttgccgcaagaccacgatcgttgcaagagtagctttaccgggccatcaggaaaagaatccaaccatcacaactcattcgtacaagatgctccgctatgctttcttgttcctcctgctcttgatggagtcgcgtcaaccagccacacggcatgcaaatcggtccaagcctacagggacgagctggacctggcgttggtgtggctgatggtgaaggactccagcttggacaaatccggcacccagcaggacagctccgacgttcctgtcacgaacatcaaggatcctggagaccaccttacccgcggcggtttcacatctgtgctttcccagcatgcaacctttccgctctcaacgttccaagcatagacactaccatcaccggagccagatacgatatggtttccctcgggacagaacgatgcctccagtgtcgaattggttaatattggcttcgcgcgaaacgatgcaatgctgttgccttcaaaagaatctagcacatgaacacgcccagctttagtggttaacagaatccgcctgccatcaccgctgaactgtacgacatgggcattccgaatttccgaatatcaaacatctttatgcggccaccataggcgacagcaaataccatgccctgggcgtcgtacgaaactgtaggcctcctttgcgcgcgcagtaagccctgcggtttttcagcccgatggtcccataagagaatggtacgatcaagcgaacatgagagaaaattttcttttccagagcaaagtgcgatgcagacaaccctatcaaaggtgacctttataatatctaataaaccggttatcattcattgagagcagacgcagagattcatcccagccattgttcgatgaatataagacaatagatgggttatcagtgaagcacacaagtccaaccccatattttttgctattaatagtattcaaacacactgcatcttgggtatcgtataaacggattgattcatcatcgctagctgtcacgagatagttggtagccttgctgtgaaagtccatagaacaaattctgccattatagccttgaaagaccaaccctatcttcatgctcttgaccacctcatcagtgatctccatgctcaccctaggtggacttgtcatggcagcaaccagcaaaccctccaaaaagctttatgacaataagcagcgactagtcaatcaggtaccagggatatggccttggcaactgaagaacgtagtctcggcagtctcttaagcatctcgttcgtgatctccatgctcaacccttgggccaggtgccgggctgccggccgactgccgacccagtaaacggcacgggtgtacacatgtacacccgatgtttttttttgcaaaaagaaaaaaaggggaaaaagaggaaagttagttgacacaatactacatacaccacatttgtagttggaacaaatccgaataaaacaaacagttagggtttggtgctaggcttcgtagagcaggaagggaagagaaccctatgctggtggtggtgtgttagtcgacggcgaagggccccgcgaagcacatgaaggctggagcgtaggccggcgcggcggtcgtcgagccgtcaccgagggagagagaacgcggggcggggtgaacggcgccacggcggtggaggcgggctgtccgccgtttttttcctgagccgtgcttttcatggcccttcctttctccaccccggccgg

SEQ ID NO: 21202 - DNA, 1501 bp, Zea mays
  misc_feature (22)..(26): n is a, c, g, or t
  misc_feature (29)..(33): n is a, c, g, or t
ttttttttttttttttatcccnnnnngcnnnnngactagaaacttttctgataaataaatgtgtgtgcagtctaactcaggccgtttcgaagattattggtccatggtaacgaaagcacttattcgctaatcaatataatgagcccgacttgctaaactttaagaaggaaatgaagagataaatacatctatacacatggctaagctcctaacaatttcttcagctccttcttgttaacctttcccatggcattccgaggaagagaatcccacaagtatagtcttgttggaatcttgtatggagcaagcttatctttcgaccaacttgttaatgcttccaaggttagcgctggctttgagtcctgtccagcctttttctttgcatcctccttaggcacaattattgcacatataacctccccataggcttcatcaggcaagccaaggacagcacattccagtacagcatcatgctctaacagtactgcctcaatttctaatgctgacagcttgtaaccgccaaatttcataatgtcggcatttgtgcgtcccaaaattatgaagtatccttcctcatctacagttactgtatcacctgtcttgaagaatcctccatcaatgaaagattctgcggtgacctctggtcttttccaatactccttgaaaagagatggacttctaatgcagagctcgccaactccagttgtagtttcagccccgtcctccataatgatcttggcctcaatgcgtggaagaggtttaccaactgtaccttcttttcggataccatgcaatggattagacagtgccatgacaaactcagtcataccatagcgttccaaaagacgatggcctgtcacttcctcccacctcttcataagtggggaaggaagagctgatgatccacacatcattaacctcagatgctttgcagcgtaagaagaggccgacttttgatcaggatccatactatcatacccttgcagcagacgtgtatacatggttggaactccagtaaatactgtaatggcctctgtacttttactcgcatcgttgggatatgattctcgccatctctgccatatcccgcttacactgaattttggtataaactcaaccactgatcctgaataaaggggcgcaaatagagcattgaaaagcccatgcacatggtgcagcgggagacagtgcagaaattggtcttcacttcgatatccccacgcttcagatagaatctgaacctgagaaagaatgccctcctgggttttaaataatccttttggtttacccagtgtgccaattgtgttaagggttagggccaggttattccctttggatttctttgaaactgttgtttccagttattaaattggggattgttgaattgccttcatggcttaaagtttcttgaggattgatttttgaggttttattattgccggttggaggattggaccattagccggacctttttacagttgtctcgacgcgtgctcgaccc

SEQ ID NO: 21203 - DNA, 1552 bp, Zea mays
tgtggatttgaggggaggtcgggaagctagaaagtactgtactacattgcgttgtagtagtttgaacaggcctctgaagtcatgagaccaccaagctgagggaaccggcaaccggtcggctcaacgctctgttttggtcatcatccatgacaagaactggccaacaaacttgatcacgctagctagattgtgggggtccaagccttcctcccttcttttctaaatcattattattttttttcgactaattgttagtgatacaacaaagacctccaaactcaatacatcggtctaacaagcacaaaattcgatcaaatctgtatttaaaacttccatataagtatagtagcatagacattttgtttcagacgatcctaataatggagcaacaatatcaagtgcttgactgcagctgcagagggctcagaggctgcatgccgtgtcgatgtggtgccacctagaccacccgccgaagtagctgttccagacgccttcggcgagccgatccacgcgcatcgccgtgagctcctcctccagcgcggcgccgcgccgctgggcgtgaccggcgccgacgaagcccgccgcgcagggcgccagcgtgccggcgaacacgacctcctcgccgtcctcgtccacgcctcgcctcgcggacctgcggatgaagcatcccacctggacgctgccgagcctgtcgccgtacgcgctggtgttggcctcgccgatcacctgtagcagcccggcctcggccttcccctcgccgtccacgaccacggcctctacagcctccttggccgcgctccgctccacggcggcgaacaggcacgctgccgtgcagcagagggaggtggaggccacgagtggcaggaagaaggccgcggctcgcgggaacgccgcggcggcgcagacgagcgcggccacggcggctgccgtcgtcgacgaagagccggacgcgccggcgagggagcggcggcacgcccgcagctgcagctcaacggcgcggagcttgtcgtggagcactccgcgcagagcgtggcagctggcggcggcgagtctgggagcagccatggctgtgctgctgtgtgctgtgcctgtgcttgataggagagtttgcgagcgaactgatggtgcggcgaattaagctagccgtgggcgcgtggttggcctatggacgatggagaagaacatattctcgtggtgcacactaatgtgacatgtcggctcgtgcatggcgtaatcgcctagcttttgcgaatggaggacggggacgggggttggggttggacgaccggcaaagaatcttgtgacttgtgcagttgtgctcgtgtgtcatagcacaacacaatcgctttttactccgtgctattatttattattattgaatgttatcatttattattggatgataggagtgcaaagtgaagttaagctatgaaccgcacttagaccatctccaagactaggacctaaaataggaggggaaaattacttatgtgtcatcaaaatttatactcattccttgtgtgttattgaccggcatatatggaattttttg

SEQ ID NO: 21204 - DNA, 1871 bp, Zea mays
gcacgagaccattacctagaacatcctaatcgaaaacttttaatttcatttcctctcttttgacgacggaaacgaggcacgatcacacgctgaacgcttccgccccgccgccaccttccccgctctcctccctccgctcgcctccgcttccgttccgcgccctgcccccggaaggcaagcaaagccctcgctacttgcggagcgtcgttggtcaaaccctagcacacgtacgagcaggccagccccgcccgctcccattcccaggccctcatccatggcggcgctctccgtgcccctccacgccgccgccggatcccgcgccgccgcggccgaccccgtcaaggttccgtgcgtgaggagcactggttcagcccatttcggccgcgccttcccctccgtcgcggtctcctctttggctgcgaggcacatcgagccgatgagagcgatagctacacaggcgccccctgccgtgccacaatatttgagtggcgagaagacaaagatcggcatcaacggctttgggcggattggcaggttggtcctgcgaattgcaactagcagagacgatattgaagttgtggctgtgaatgaccctttcgttgatgctaagtacatggcctatatgttcaagtatgactctactcatggcccgtttaaaggttctatttgtgttgtggatgattcaaccctggagatcaatgggaagaaggtcacaattacaagcaaaagagatcctgcagagattccatggggtaactttggggctgaatatgttgttgaatcttctggtgtctttacaacgactgataaagcatcagcacacttaaagggtggtgctaagaaagtggtgatatctgcaccatcagcagatgctcccatgtttgtagttggagttaatgagaatagctatgattcgaagatgaatgttgtttctaatgcaagttgcaccaccaactgccttgctccacttgccaaggttgtacatgaggaatttggcatcgtggagggccttatgacaactgttcatgccacaacagccacccagaagaccgttgatggtccttcaatgaaggattggagaggaggacgtggtgctggccaaaacataattcctagctccactggtgcagcaaaggctgttggaaaagttctgcctgagctgaatggaaagctcactggcatggccttccgagttccaacaccaaatgtctctgttgtggacttgacatgccggattgagaaaaacgcctcctatgatgatgtgaaagcagccatcaaggcggcatcagagggtgcactcaaaggtattcttggctacacagacgaggacgttgtttccaatgattttgttggtgattctaggtcaagcatctttgatgccaaggctggtatcggactgagctcttctttcatgaagcttgtgtcttggtatgacaacgagtggggctacagcaaccgggttctggatctgatcgcccacatggctctcgtcagtgccgccgccaagctctgatgtccgtactcgtttctccagtagtagcttagaaaaaaagactgcaattttgacggccattttctgttagctgttgtttggaataagatcaaatgctggaacacttcgaactcgcgcgagactggactcagatccatggcctgtattttagttgtagaagtgggcaaatttgcaccgtagtaccctggcatggttatatgcggaattgttgattgatgagtcgttgtacggtttgtcgacttgatgatatgttgatgtgggagcccctgaatgaggcggtattaatggaaatataggatggcaatggcaatccgtcgacttgcaccctatttttctttgtttgaaaaaactcgagagt

SEQ ID NO: 21205 - DNA, 1737 bp, Zea mays
ccacgcgtccgtttttttattacattttcctcttcctttttattcggtcgacccccgggcgcccgcagacacgcttccgcggcgccaccaccttccgccctccgctgcccgctcgcctccgcgcccgaaaggcaaagcctcctcgctcctgccccgccccctcctcgcggcgtcggtcaaaccctagcacaccgtacgcgcaggcccgcccgctcccattccccacctccacccatggcggcgctctccgcgcccctccgcgccgtcgccgccggatcccgcgtcgccgcgtccgaccccgtcaaggtctcgtgcgtgaggagcactggctcagctcacttcggctgcgccttcccctacatcagggcctcctcttcggctgcgaggaacctcgagccgctgagggcgatagccacgcaggcgccccctgccatgccacaatattcgagtggggagaagacaaagattggcatcaacgggtttgggcggattggcaggttggtcctgcgaattgcaaccagcagagatgatattgaagttgtggctgtgaatgaccctttcattgatgctaagtacatggcctatatgttcaagtatgattccactcatggcccgtttaaaggttctattcgtgtcgtggatgattcaaccctcgagatcaatgggaagaaggtcacaattacaagcaaaagagatcctgcagagattccatggggtaactttggggctgaatatgttgttgaatcttctggtgtcttcacgacgactgataaagcatcagcacacttaaagggtggtgcaaagaaagtggtgatatctgcaccatcagctgatgctcccatgtttgtagttggagttaatgagaatagctatgatccaaagatgaatgttgtttctaatgcaagttgcactaccaactgccttgctccacttgccaaggttgtccatgaggaatttggcatcgtggagggccttatgacaactgttcatgcaacaacagctacccagaagaccgtcgatggtccttcgatgaaggattggagaggaggacgtggtgctgcccaaaacataattcccagctccactggtgcagcaaaggctgttggaaaagtcctgcctgagctgaatggaaaactcactggtatggccttccgagttccaacaccaaatgtctctgttgtggatttgacatgccggattgagaaaagcgcctcctatgatgatgtgaaagcagccatcaagacggcatcagagggtgcactcaaaggtattcttggctacacagacgaggatgttgtttccaatgattttgttggtgattcaaggtcaagcatctttgatgccaaggctggtattggactgagctcttccttcatgaagctcgtgtcttggtatgacaacgagtggggctacagcaaccgggttctggatctgatcgctcacatggctcttgtgagcgccaagcactgatgttcgtactcgttcctccagtaccagtagtagcctagataagaggctgcagttttgacggccattttcttttagctgttgtttggaataaaagaccaaatgttggaacacttggaactcgcgcaaaactggaatccgattcatgacctgtgttttagttgtagagggggcaaatttgcatcgtactatatgcgggattgttgatcggatgtcgtatggttcaaaaaaaaaaaaaaaaaaaacgccccgagggctgctcgggtgatc

SEQ ID NO: 21206 - DNA, 1638 bp, Zea mays
tagttttagcacttcttggcttaggaatctatccgccacttctgattcggggcggagcagttcaaagaacaccaaaaaaaatacatattaatgacttcgacaatttccattatcatgcacaaccaagtccagtacctgcatcaatattgcaattagctggctcagcatatttgctgagagctaccgcttgggagcactatgggagtgctccaatggtacgaatgaatgttctagtttatgcaacctgctttgcggatgctgcaagttcatcagagttatcactagcatatgttaagctaattcaacaactggcggtgttcaaaggatattcagctgcattctgtgctctaaagcttgctgaaaagaagttcccatcctcaacaagtttacacatccagcttctaggaatgcagattctacatgagcgcgcacttcatcgagggcatctaaaagtcgcgcaacaaatctgtgatgagtttggggtgttatcatctgctgtttctggagtagacattgagctaaagacagaatttagtgtacggcgtgctcgcactctccttgccgcaaaacagtttagccaggccgcagctgtggccaattctcttttctctacgtgctacaagtacaacatgcaggttgagaatgcaagtgttcttttattacttgctgaaatacataaaaaatcggacaatgcggtccttgggcttccttatgcgttggccagccaatcattctgcaaatcattcaacttggatctgcttgaagcctcagctacacttactctcgctgagttgtggctggatcttggatcaagccatgcaaagaaggcactgagtcttgtctaccagagccttcccatgattcttggtcatggtgggcttgagctgcgtgctcgagctcacgttgttttagcaaagtgccatttatccgatctgaaattctcagttctcgaagatcctgaagctgttttggatcctctgaaccaagccactgaagacctgcaagcattggagtaccacgagatggcagcagaggcgtactatctgaaggcaatggcatacaaccatctcggcaagcttgatgagagggaggaagccgcggctcgtttcaaggatcacgtcactgcccttgagaccccgcataacgaagaggactcgcttaagtactgagacccaagaccatttgttattggcaagcatgccccactgccagagactaaagagggcgtggtggccttctggacccgcatggtggcactggcaggctacaatgctacactgaggcgaatggcgtttgctgccatgcggaggcactgccactgactgtgggcggaccggcggacggcggtgactgaaggagacgggcagccggtgaggtcaatgtgctagttgggtcagcgtggtatggtctcatccatggaccatggtgttcattagagcgagacgaagacatcagattgagacttgatgttcttactctgttcttatcgacttctctgctctgttactggggagttccgaattgctaactcagacagacagtgctgacaatgtgtttgtgtttgaatgtaaacagcccaccaccagaaaaatagaagattgatctgtattttcccttggaaaataagaaaaaaaaaaa

SEQ ID NO: 21207 - DNA, 1861 bp, Zea mays
gcacgagaccattacctagaacatcctaatcgaaaatcatttcctctcttttgacgacggaaacgaggcacgatcacacgctgaacgcttccgccccgccgccaccttccccgctctcctccctccgctcgcctccgcttccgttccgcgccctgcccccggaaggcaagcaaagccctcgctacttgcggagcgtcgttggtcaaaccctagcacacgtacgagcaggccagccccgcccgctcccattcccaggccctcatccatggcggcgctctccgtgcccctccacgccgccgccggatcccgcgccgccgcggccgaccccgtcaaggttccgtgcgtgaggagcactggttcagcccatttcggccgcgccttcccctccgtcgcggtctcctctttggctgcgaggcacatcgagccgatgagagcgatagctacacaggcgccccctgccgtgccacaatatttgagtggcgagaagacaaagatcggcatcaacggctttgggcggattggcaggttggtcctgcgaattgcaactagcagagacgatattgaagttgtggctgtgaatgaccctttcgttgatgctaagtacatggcctatatgttcaagtatgactctactcatggcccgtttaaaggttctatttgtgttgtggatgattcaaccctggagatcaatgggaagaaggtcacaattacaagcaaaagagatcctgcagagattccatggggtaactttggggctgaatatgttgttgaatcttctggtgtctttacaacgactgataaagcatcagcacacttaaagggtggtgctaagaaagtggtgatatctgcaccatcagcagatgctcccatgtttgtagttggagttaatgagaatagctatgattcgaagatgaatgttgtttctaatgcaagttgcaccaccaactgccttgctccacttgccaaggttgtacatgaggaatttggcatcgtggagggccttatgacaactgttcatgccacaacagccacccagaagaccgttgatggtccttcaatgaaggattggagagaggacgtggtgctggccaaaacataattcctagctccactggtgcagcaaaggctgttggaaaagttctgcctgagctgaatggaaagctcactggcatggccttccgagttccaacaccaaatgtctctgttgtggacttgacatgccggattgagaaaaacgcctcctatgatgatgtgaaagcagccatcaaggcggcatcagagggtgcactcaaaggaattcttggctacacagacgaggacgttgtttccaatgattttgttggtgattctaggtcaagcatctttgatgccaaggctggtatcggactgagctcttctttcatgaagctcgtgtcttggtatgacaacgagtggggctacagcaaccgggttctggatctgatcgcccacatggccctcgtcagcgccgccgccaagctctgacgtccgtgctcgttcctccagtagtagcctaggagaaaggctgcaattttgacggccattttctgttagctgttgtctggaataaagatcaaatgctggaacacttcgaactcgcgcgagactggactcagatccatggcctgtattttagttgtagaagggggcaaatttgcaccgtagtaccatggcatggttatacgcggaattgttgattgatgagtcgttgtacggtttgtcgacttgatgatatgttgatgtgggagcccctgaatgaggcggtattaatggaaatatataggatggcaatggctatccgtcaacttgcaccctaaaaaaaaaaaaaaaaaaaaaaaaaaaa

SEQ ID NO: 21208 - DNA, 3332 bp, Zea mays
  misc_feature (2)..(2): n is a, c, g, or t
  misc_feature (4)..(4): n is a, c, g, or t
  misc_feature (8)..(8): n is a, c, g, or t
  misc_feature (13)..(13): n is a, c, g, or t
  misc_feature (1106)..(1106): n is a, c, g, or t
  misc_feature (1633)..(1633): n is a, c, g, or t
  misc_feature (2685)..(2685): n is a, c, g, or t
tntntttnttttntctagaaattgttccatccaccccccccgtccggttttttttttttttttcttaataagaatcatgccacctttcatattcaaagtgtgatgttccaactgaattcttaacataccaagcattacacacatccgtgccactggtttccacctcatcctcatggaatggggacgtgaacacattgtggaatcgacattttacttacaggttatgacttgacttcaacagctgctgtgtcggagctgacagtgacgcatgggaaccaatatcttcgcttgccatccctgtggccatcgtcgatcatagcaagcccctccttcagcaaagtttcaagagcatcaatcgcacgcccagtagaccatgagaattccttttcaacttgttccaccgtgacatagccatcagcctgagctagcccaagtatcccactgtggtctttatttaattcggtaggaactgaacgcacaagctttctcctcccaacagaaattacttcaaaaccactaccaaggacttttagcttgcttatagcacgcaaacagtcatcttcagataatgattcaagagtagcttttctcttctgaccgagcagtttgcggagatctagtaagtcaatcaagccaccattatgtgatctggtaccaatgcatatgtcaactatctgaacccctgccacgatacgcatcaacggtaagcataccagattttacttccatgaccagaagaacactcaagaaaacttgaagtgagtatgccaaccaagttcatagtagaagtcaccaatccctagaagttctgcccagactcctttattagatgccaatggatctactccgacttttgcgcacatctcatggaactgctgtctgaatactgggtttttacggatgtcactctgcaatagcacaatatgaacatgtaacattaccaaacagaatcagagcgcactgccatttaatctttgcgcttttcggtgacttaataaggccatatcaaaggaaactacttatttcttcagggttcttctttccattgaccttttctgtgagaatgtggattgttgactgaattgatattatatataagttactcnatgacttattagcaaactaacacttaaaatctatgggttgtcatatttgattgcttcatctttcagttatgtattgtttctgttaacacttggcattggatctaaaagggtaatgtttaatataatagcagtagctgagcatctacatattttctaaggacaaccatttaatttatagttaaggaagcagataatacatgcaagcataaataatgttttttgaatgaatattggcaggagagctgctcattcatttagcagatgagtctaaaacagagagtttacaaaagctcatggattctcccaatcccaggcaggccatgaggtttagcattgatcttacacttaattacataaaagatgggtaatcccaatctatatcatcatccaagaagccagcggataacttgctattttaagcatataacaattaagtgtcattaggctttctttcttctttggacattcaactagatataggagagtggatcaccttatgcttgcgagcgaattcctcgagctgtgancggaacgtcgcaagctgctccttcatgacatcggtcctcaccttggccacattctccccgaccagccggaattggtcctgaaagttcccagcaatactctcatatcatcctccaagagcacagatctcttattcagaagaagcataagaactgcacgtacacgagtagccgccgcattctgcaagccagcgatcccaggcctcctcctcatgcttcccggcagtggccacagaagcgcggacgacgagctcgaggcaccgagatggcgcgagctggggcggagatggagggcgagctccgggccgtcagggagggcgagggaggcccaagagcagccagaaacggcctgatggggcgtgggggagagaagatcggctggggcggtgctccttcggccgggaagaggaggcggcggcgctggagagggtgggaggccgggcgggcgccagcggaacacgccgcacgccgggggattgcgcggaccgggtccgcgcccggcgggcggcggcaacggaagtgcactcgggtcttcgggatggatgtctgggggctctcggcgtattgggaatttgctattttattagacttatctattttaccaccagatccataaattatagatataaatggtctcacaagtcatagacagagtgtcacataataacagagagcccacgttaaagcgctatgagacgacttatttacgtgtcggtaggttaatagacacaattctatactcaccagatagaagcgtactgcgtacagaattgtgctggttgttaacaaactaagttaggatgtcgggtcaactattaaaaaatccaaatgaattgatccaagtcgagatgagccagccacgaaccaagcgagacgacaagtttaacatcaagttaaggtgagcaattattttaatggttcccttcaatgctttactttctatttttatatgagttacacatacagatgacatcgagtgattagtttgcacgagaatagtgttgtcgattgcccaaaaacattttagaagccaagtatgcccatttttattctcntttataaaatgtaattgcacacgggcatggtttatcaacttcatgtcaaggcaactaatagacagcaggcataagttgtatcaaaagcttagtggctggtaacatttgcacatttcagttcaactgtgttctctgcaatagttttccttgaaccatagtatgtggtagggtggtaaatcggtgcatcagataaatattgcatgatagtttatgatcatgagattccaaataaacaccagtaacctgctgaaacatttctattggaatgtcatgcagccagtcaataatgtggccagttatgatgatgaccacaggaaagctttgagaggaccactctatgccaggatctgtgaataccaatattctgacaggcaaaggtgacagcaatagaggaaaatgcattaatcaactattttaagaaatgtttgggtacattttttaataaaattattagacaaacaacctgctcagtctgacatttggaaatagttgttttttgtttcatccttgtcaattgtgcttcattagaaaaacatgcattaacatgtctacattcattgatactgaaaatatatagtagtcatctaaattctaaacttaatggttttgtgagtactttgttatagactagatcaccttgagcgaca

SEQ ID NO: 21209 - DNA, 1262 bp, Zea mays
tttttttttttttttttttttttcaaaaaaagaaacctgaattctaataagaattatgccacctttcatattcaaagtgtgatgttccaactgaattcttaacataccaagcattacacacatccgtgccactggtttccacctcatcctcatggaatggggacgtgaacacattgtggaatcgacattttacttacaggttatgacttgacttcaacagctgctgtgtcggagctgacagtgacgcatgggaaccaatatcttcgcttgccatccctgtggccatcgtcgatcatagcaagcccctccttcagcaaagtttcaagagcatcaatcgcacgcccagtagaccatgagaattccttttcaacttgttccaccgtgacatagccatcagcctgagctagcccaagtatcccactgtggtctttatttaattcggtaggaactgaacgcacaagctttctcctcccaacagaaattacttcaaaaccactaccaaggacttttagcttgcttatagcacgcaaacagtcatcttcagataatgattcaagagtagttttcctcttctgaccgagcagtttgcggagatctagtaagtcaatcaagccaccattatgtgatctggtaccaatgcatatgtcaactatctgaaccccaagttcatagtagaagtcaccaatccctagaagttctgcccagactcctttattagatgccaatggatctactccgacttttgcgcacatctcatggaactgctgtctgaatactgggtttttacggatgtcactcttatgcttgcgagcgaattcctcgagctgtgaccggaacgtcgcaagctgctccttcatgacatcggtcctcaccttggccacattctccccgaccagccggaattggtcacgagtagccgccgcattctgcaagccagcgatcccaggcctcctcctcatgcttcccggcggtgaccacagaagcgaggacgacgagctcgaggcaccgagatggcgcgagctggggcggagatggagggcgagctcggggccgtcagggagggcgagggaggcccaagagcagccagaaacggcctgatggggcgtgggggagagaagatcggctggggcggtgctccttcggccgggaagaggaggcggcggcgctggagagggtgggaggccgggcgggcaccagcggaacacgccgcacgccgaggaatttgtcaaaacgggtccgttgcccggctcgaggtcccaatg

SEQ ID NO: 21210 - DNA, 3273 bp, Zea mays
acctacctgaatacgtcatccctaagtgttccgcttcctctgtcgtccggcctccaactccatcgaaggggctagggagaggagggaacccgaaccacagcaggccggcgcaatggcggcgccgccaaaggcgtggaaggcggagtatgccaagtctgggcgggcctcgtgcaagtcatgccggtcccctatcgccaaggaccagctccgtcttggcaagatggttcaggcgtcacagttcgacggcttcatgccgatgtggaaccatgccagcgttgacgatgttgaagggatagatgcacttagatgggatgatcaagagaagatacgaaactacgttgggagtgcctcagctggtacaagttctacagctgctcctcctgagaaatgtacaattgagattgctccatctgcccgtacttcatgtagacgatgcagtgaaaagattacaaaaggatcggtccgtctttcagctaagcttgagagtgaaggtcccaagggtataccatggtatcatgccaactgtttctttgaggtatccccgtctgcaactgttgagaagttctcaggctgggatactttgtccgatgaggataagagaaccatgctcgatcttgttaaaaaagatgttggcaacaatgaacaaaataagggttccaagcgcaagaaaagtgaaaatgatattgatagctacaaatccgccaggttagatgaaagtacatctgaaggtacagtgcgaaacaaagggcaacttgtagacccacgtggttccaatactagttcagctgatatccaactaaagcttaaggagcaaagtgacacactttggaagttaaaggatggacttaagactcatgtatcggctgctgaattaagggatatgcttgaggctaatgggcaggatacatcaggaccagaaaggcacctattggatcgctgtgcggatggaatgatatttggagcgctgggtccttgcccagtctgtgctaatggcatgtactattataatggtcagtaccaatgcagtggtaatgtgtcagagtggtccaagtgtacatactctgccacagaacctgtccgcgttaagaagaagtggcaaattccacatggaacaaagaatgattaccttatgaagtggttcaaatctcaaaaggttaagaaaccagagagggttcttccaccaatgtcacctgagaaatctggaagtaaagcaactcagagaacatcattgctgtcttctaaagggttggataaattaaggttttctgttgtaggacaatcaaaagaagcagcaaatgagtggattgagaagctcaaacttgctggtgccaacttctatgccagggttgtcaaagatattgattgtttaattgcatgtggtgagctcgacaatgaaaatgctgaagtcaggaaagcaaggaggctgaagataccaattgtaagggagggttacattggagaatgtgttaaaaagaacaaaatgctgccatttgatttgtataaactagagaatgccttagagtcctcaaaaggcagtactgtcactgttaaagttaagggccgaagtgctgttcatgagtcctctggtttgcaagatactgctcacattcttgaagatgggaaaagcatatacaatgcaaccttaaacatgtctgacctggcactaggtgtgaacagctactatgtactccagatcattgaacaggatgatgggtctgagtgctacgtatttcgtaagtggggacgggttgggagtgagaaaattggagggcaaaaactggaggagatgtcaaaaactgaggcaatcaaggaattcaaaagattatttcttgagaagactggaaactcatgggaagcttgggaatgtaaaaccaattttcggaagcagcctgggagattttacccacttgatgttgattatggtgttaagaaagcaccaaaacggaaagatatcagtgaaatgaaaagttctcttgctcctcaattgctagaactcatgaagatgcttttcaatgtggagacatatagagctgctatgatggaatttgaaattaatatgtcagaaatgcctcttgggaagctaagcaaggaaaatattgagaaaggatttgaagcattaactgagatacagaatttattgaaggacaccgctgatcaagcactggctgttagagaaagcttaattgttgctgcgagcaatcgctttttcactcttatcccttctattcatcctcatattatacgggatgaggatgatttgatgatcaaagcgaaaatgcttgaagctctgcaggatattgaaattgcttcaaagatagttggcttcgatagcgacagtgatgaatctcttgatgataaatatatgaaacttcactgtgacatcaccccgctggctcacgatagtgaagattacaagttaattgagcagtatctcctcaacacacatgctcctactcacaaggactggtcgctggaactggaggaagttttttcacttgatcgagatggagaacttaataagtactcaagatataaaaataatctgcataacaagatgctattatggcacggttcaaggttgacgaattttgtgggaattcttagtcaagggctaagaattgcacctcctgaggcacctgttactggctatatgttcggcaaaggcctctactttgcagatctagtaagcaagagcgcacaatactgttatgtggataggaataatcctgtaggtttgatgcttctttctgaggttgctttaggagacatgtatgaactaaagaaagccacgtccatggacaaacctccaagagggaagcattcgaccaagggattaggcaaaaccgtgccactggagtcagagtttgtgaagtggagggatgatgtcgtagttccctgcggcaagccggtgccatcatcaattaggagctctgaactcatgtacaatgagtacatcgtctacaacacatcccaggtgaagatgcagttcttgctgaaggtgcgtttccatcacaagaggtagctgggagactaggcagaggtagagttggaagctagagaagcagagttaggcgatgcctcttttggtattattagtaagcctggcatgtatttatgggtgctcgcgcttgatccattttggtaagtgttgcttgggcatcagcgcgaatagcaccaaccacccacttttacctaatgacgtgttactgtataaatctatcaggagtaatttatatattaggtggactggacctcttggtcgcgtgctatttt

SEQ ID NO: 21211 - DNA, 3326 bp, Zea mays
ccacgcgtccgccaccttcggcttcctctgtcgtccggcctccaactccatcgaaggggctagggagaggagggaacccgaaccacagcaggccggcgcatggcggcgccgccaaaggcgtggaaggcggagtatgccaagtctgggcgggcctcgtgcaagtcatgccggtcccctatcgccaaggaccagctccgtcttggcaagatggttcaggcgtcacagttcgacggcttcatgccgatgtggaaccatgccaggtgcatcttcagcaagaagaaccagataaaatccgttgacgatgttgaagggatagatgcacttagatgggatgatcaagagaagatacgaaactacgttgggagtgcctcagctggtacaagttctacagctgctcctcctgagaaatgtacaattgagattgctccatctgcccgtacttcatgtagacgatgcagtgaaaagattacaaaaggatcggtccgtctttcagctaagcttgagagtgaaggtcccaagggtataccatggtatcatgccaactgtttctttgaggtatccccgtctgcaactgttgagaagttctcaggctgggatactttgtccgatgaggataagagaaccatgctcgatcttgttaaaaaagatgttggcaacaatgaacaaaataagggttccaagcgcaagaaaagtgaaaatgatattgatagctacaaatccgccaggttagatgaaagtacatctgaaggtacagtgcgaaacaaagggcaacttgtagacccacgtggttccaatactagttcagctgatatccaactaaagcttaaggagcaaagtgacacactttggaagttaaaggatggacttaagactcatgtatcggctgctgaattaagggatatgcttgaggctaatgggcaggatacatcaggaccagaaaggcacctattggatcgctgtgcggatggaatgctatttggagcgctgggtccttgcccagtctgtgctaatggcatgtactattataatggtcagtaccaatgcagtggtaatgtgtcagagtggtccaagtgtacatactctgccacagaacctgtccgcgttaagaagaagtggcaaattccacatggaacaaagaatgattaccttatgaagtggttcaaatctcaaaaggttaagaaaccagagagggttcttccaccaatgtcacctgagaaatctggaagtaaagcaactcagagaacatcattgctgtcttctaaagggttggataaattaaggttttctgttgtaggacaatcaaaagaagcagcaaatgagtggattgagaagctcaaacttgctggtgccaacttctatgccagggttgtcaaagatattgattgtttaattgcatgtggtgagctcgacaatgaaaatgctgaagtcaggaaagcaaggaggctgaagataccaattgtaagggagggttacattggagaatgtgttaaaaagaacaaaatgctgccatttgatttgtataaactagagaatgccttagagtcctcaaaaggcagtactgtcactgttaaagttaagggccgaagtgctgttcatgagtcctctggtttgcaagatactgctcacattcttgaagatgggaaaagcatatacaatgcaaccttaaacatgtctgacctggcactaggtgtgaacagctactatgtactccagatcattgaacaggatgatgggtctgagtgctacgtatttcgtaagtggggacgggttgggagtgagaaaattggagggcaaaaactggaggagatgtcaaaaactgaggcaatcaaggaattcaaaagattatttcttgagaagactggaaactcatgggaagcttgggaatgtaaaaccaattttcggaagcagcctgggagattttacccacttgatgttgattatggtgttaagaaagcaccaaaacggaaagatatcagtgaaatgaaaagttctcttgctcctcaattgctagaactcatgaagatgcttttcaatgtggagacatatagagctgctatgatggaatttgaaattaatatgtcagaaatgcctcttgggaagctaagcaaggaaaatattgagaaaggatttgaagcattaactgagatacagaatttattgaaggacaccgctgatcaagcactggctgttagagaaagcttaattgttgctgcgagcaatcgctttttcactcttatcccttctattcatcctcatattatacgggatgaggatgatttgatgatcaaagcgaaaatgcttgaagctctgcaggatattgaaattgcttcaaagatagttggcttcgatagcgacagtgatgaatctcttgatgataaatatatgaaacttcactgtgacatcaccccgctggctcacgatagtgaagattacaagttaattgagcagtatctcctcaacacacatgctcctactcacaaggactggtcgctggaactggaggaagttttttcacttgatcgagatggagaacttaataagtactcaagatataaaaataatctgcataacaagatgctattatggcacggttcaaggttgacgaattttgtgggaattcttagtcaagggctaagaattgcacctcctgaggcacctgttactggctatatgttcggcaaaggcctctactttgcagatctagtaagcaagagcgcacaatactgttatgtggataggaataatcctgtaggtttgatgcttctttctgaggttgctttaggagacatgtatgaactaaagaaagccacgtccatggacaaacctccaagagggaagcattcgaccaagggattaggcaaaaccgtgccactggagtcagagtttgtgaagtggagggatgatgtcgtagttccctgcggcaagccggtgccatcatcaattaggagctctgaactcatgtacaatgagtacatcgtctacaacacatcccaggtgaagatgcagttcttgctgaaggtgcgtttccatcacaagaggtagctgggagactaggcaagtagagttggaaggtagagaagcagagttaggcgatgcctcttttggtattattagtaagcctggcatgtatttatgggtgctcgcgcttgatccattttggtaagtgttgcttgggcatcagcgcgaatagcaccaatcacacacttttacctaatgacgttttactgtataaatctaccaggagtgagtaatttatatattagcgggactggacctcttggtcgcgtgctcttgtcacagtgaagtttcatatatttcgacgcgaa

SEQ ID NO: 21212 - DNA, 994 bp, Zea mays
gacttggcccggcccatccagtataagacagaagaggacggtcgacggtgggaaagaggagccggtccaagaagcagggcacggcaccagacgcgtccatggaccccaccggcgtcgacggcgattccgcggcggcgaggggaagcggaggcggaggggggacaggggccggccggtgggcggttggcgcggtgtgcgggggcctggtctactaccactgcgcggtacggcgagccagcgcggtgtcccttgcagcagacgtgctcctcgtccttctctgctcgctctccatcctcggcctcctcttccgccacctccacatctcggtgcctgtggatcctcttgaatggcagatctctcaggagatggcaaatagcatagttgcatccttagccaatacagtaggagctgctgagtctgtattaagggtggctgcaactggacatgacaagaagctgtttttcaaggtggtttctacattgtattttctagcagctttgggaagggtggtgtcaggcgctgccgttgcatatgctgccctatgcatcttctgcctctacatgtttgcacaaagcaccgatctgtttgatcagctcccttcttgggtccctgtgggtagggattctttgggcggtactcaggataccgcgtgattttctacatgtacatggattgcagagttttttcttctcttccactgtctgtatatggtcttgcaggctaatagcttgaacccagtattacaactgtacccagtgtatctctgcccccacggtattacaactgtacccagtgtttagcaatggagtaatgatctttgtatatatatatgacacgtttgcaacttgctagatgccagtgatgcaccttgtatgttttcggagctcattgcagatctctctggcttgacatggttgttggtcgtgagattttgtgatggtgtgttttgcctgtaatctaaatatctaataaagatctgtctttcatcacgtaa

SEQ ID NO: 21213 - DNA, 1014 bp, Zea mays
ttcgacttggcccggcccatccagtagaagactagaagaggacggtgggaaagaggggtccaagaagcagggcacggcaccagacgcgcccatggaccccaccggcgtcgacggcgattccgcggcggcgagggggagcggaggcggaggcggaggggggacaggggccggccggtgggcggttggcgcggtgtgtggggggctggtctactaccactgcgcggtacggcgagccagcgcggtgtcccttgcagcagacgtgctcctcgtcctcctctgctcgctctccatcctcggcctcctcttccgccacctccacatctcggtgcctgtggatcctcttgaatggcagatctctcaggagatggcaaatagcatagttgcatctttagccaatacagtaggagctgctgagtctgtattaagggtggctgcaactggacatgacaagaagctgtttttcaaggtggtttctacattgtattttctagcagctttgggaagggtggtgtcaggcgctgccgttgcgtatgctgccctatgcatcttctgcctctacatgtttgcacaaagcaccgatctgtttgatcagctcccttcttgggtccctgtgggtagggattctttgggcggtactcaggataccgcgtgattttccacatgtacatggattgcagagtttttcttctcttccactgtctgtatatggtcttgcaggctaatagcttgaactatagcatctatctctgcccccacggtattacaactgtacccagtgtttagcaatggagtaatgatctttgtatatatatatatatatatatgacacgtttgcaacttgcgaggtgccagtgatgcaccctgtatgttttcggagctcattgcagatctctctggcttgacatggttgttggtcgtgagattttgtgatggtgtgttttgcctgtaatctaaatatcaaataaagatccatctttcatcacgtaatacatgctcatgccggccgaagcgttt

SEQ ID NO: 21214 - DNA, 824 bp, Zea mays
aacttttcaaaggggcagtaggttttctatattctttcttttgttcctatctgcaaaaacacaagaatccaatttctcttgtcccgagaggggagatgtaaaacaagtgaagcaggggtcttactttataatattgttagagcattaagtccaaaccactgtaacatgagtacacgaaaagtatcttggtagagacatatggtctccccctctcgttatataaagtcctactattaaatcagttgcgtgattaagcagctttgtttgaataattaagcaactctaatttgttttttttttctgggtaggaaatggcaaggctcatcaatcagggcacagtatacctacacgtctctagaagcaccagaacggtccatccaaagattagtgccgcttgaagctcgaggatgatctagacaagtaggcagagatccatcgctgggtcaagtattttgctgcatgcgctagtaagcagaccacgaaacaatgggcttttggaaactgcggaacaacaagacagttactaatgtatatatgcatcccactgactagaaaacaaacatttcaacgatgaatataacagatgatggaaactcccaaaccatcattgcgaaaagaaacaacttgaagtagcatgaaacgatgacagcaaacagaatgtacctataccatttcacttgttaaatccctgaagcgccttggcgactctcgacctcagtcggtcaagctttccgctcgccctggtctccgccacccgctgcctcttcagcttcgcctccagtcgcgccgccgtgtcatcaccgatgcgcccgaatgccctcttc

SEQ ID NO: 21215 - DNA, 1692 bp, Zea mays
ttttttttttttttttatcacagcgggaaaatttattttgcttctgaaatcctgttcttagcacagacaatggtagtgcaaaacaaactcaatgccagccattgacatttcaaattctttgcagttgatagtgccctcaaacttgccagagaatctgataacatttcaaccatgaaacaatgcgaaggaaccaatcctattgtgtctttctacgccaacccatgtagcaacagaaagaagatgaagaaatcaccatttcacttgttaaatccctgaagcgccttggcgactctcgacctcagccggtcaagctttccgctcgccctggtctccgccatccgctgcctcttcagcttcgcctccagccgcgccgccgtgtcgtcaccgatgcgcccgaatgccctcttcagcgccccgtagccgcacctcgcaccaatcgcctccacctccgcggagaggcaagggtacagctcggccagatcgtcgaaccctcttgggtcattgcgcgcgtcgggcacacgggtcttcttctctatcctccccctgcgcgttccctcccagatgagcttggagagcctgtagatggtgacgtcgctgtccttcgccgggatcgtgccgcgtttgaggcggataacagtgttgtcgtaccggttgcggagcgcgcacagccgcctggtgatctgcgcggcgctgaggcggtcccccgcgctgaggcggccccgcaccgcggcggcgaggtcgtctgccaggggaagtcgcccgtgcttctgccggtgcgacgcgacggtctcgaggatcgcgatctcgtcggaggccggccacgagcgcacgggtgggcggggtttcttgaaaatgatgggctcggactctgaagagccgtccgagagcagcgaggaggcggcggagtcatcggattcaggaggagagtcgaagaacgtcgaaggtgatggcggggaatcaagatgttcgtcggagccgatggtcgtgctgccgtccgaggacgtagacgagggatgctcctccgatgtcatcggcggcggcggcgagagttggtttgagtattttgtttcgtttgggcttgaaccagggacctgcagtcggggccttgtacctggactcctccgtgtcgtccttccccctgcggcaggggcagcggcggccagcaagacggccaaggcggatgcggcgcccaacgccaccacctcgctgggattgtcgcctctggccacccacagcccacggcgaaaacctagaaaatgactagctccgcaaagctacctaggacacggtttcatcgcatcatcatggaaagaagaacgcagcggaggcgagggaagaggaaccttggcccgcatcgcgtcggcgcaggtggggcgcgcgctcgagctccctgtccctgattgcggcggctgagtactggcgagttggagacggtcctgatgctgcggccactcgtctcgcctctggttcatagaatcatagatccaggggtcctagttgaaatcggaaaccctagccgtgatgctctcgtggacggctgatctctgccggtgcggggagtttggagcggatgattagggcttcgttcgtggcctcgtgggctccgtatccgaacaggtcggactgggaggtgctcgtaattacgtgccgggacatttttcgattaggatgttctaggtaatggtctcgtgc

SEQ ID NO: 21216 - DNA, 2585 bp, Zea mays
  misc_feature (2561)..(2561): n is a, c, g, or t
ggtacacgccccccccccccgcttttttttttttttttttttgctttgcttttcgatacccaattgaatacctattaaattgttgggaaagtttgcttccaaattacaggattgcagcaaacgttcagtacataaaggcgatatcgcataagagcattgcactatctaaagtttgccctgctctaaagcatgtactctaaaaacataacagatattcctgcaattatgcaaagggtctgacaagaagcacaggcaataagaaatcttgttaacaactgatatctaaagcaagagagtactatgctgactacactaaagtgcacatcgacagaaaacaggctattggttatgtcagaagggactaaaagcaccaggttccttcatggattgatgttgcattcccgaaggaaagattggtcataatccagatacttggaccagtagctccggaacttgggtagaccaatctccaaccagggcttcatgttgccattgtaatgtatgactgcagcatgctcaatgtctctgctgttaacatggggattgtaacctagaccaagaacatgccatgaccggctgaggggaaatgtcttgttccagaatgtgaccaaacccggagggagagtaccaagtttccagagtgatctatcttcattaagcttctgccacgagtgataaatttcagttatgttctgccgcctccattcagccaggtcaaacacattcattccaaaagcccaaacacaagcatgtgggtcaaaactcttggtgataatgggatttgaaaaattcaggtatcgatcatagcgatggaaactctctccacaagtctcaacagcaccgtttaccttccccttcatgttgattgaccaaaggccagccagatccttctttactacgatgtcatcatcaagaaagaccatcttgtcaagctttggataaatctcaggtaggtaaaagcggagatgattgaggattgacaggtactttgggtttcgatattttaggtttgaatctgagtttgcacgattcgttccaaagtagtaatcaatcatggattgggacccaagatgtttgagtactggactgtagctgtcatttagccatgtaaactcctcaatattctgtacttcaattgttgctttccccggaggattagagaggaaccacattctcattggagcataattcagtttgtcagttactatgtggataacatgatcagaaggatgcttagcatttaacactgttgagttaacaacaaccgctgttgctagtatgttatccgagaacaacgcataatgatacagttttgggttaatgagattttgttggtttgggaactgctgccgaacaggatccaatgaaaagtattcgttagctagtctcagggggaggcagtgaagacctttaggaagggttttagctgcaagttgtgtcagaaaaacagtctgttttttgtgtgcatgcagctgctcctctgctgaatgaagcatagctcgaagcttttttacaataatagaacaatcatcctgcatctgttttcccttaatcagcatctgctccagtgctttaaccttttcatgtgcattctttggtagatcagagtccttggatgcatcaccaagcaccttttgaacttcccgtatcctctgccgtaggtctttaagatattgagaactcgctctaatggatccaagaccaaggtataccttcgccttgattaactgatccttgatatttcggatccgcatatcaggtagaacagcggttttagttttaccgtctgttctagctgattgggagttctccgcaacaacctttgcaggtgtctgtttaggcatagtgtcctgtgaactttcctcagaagaagattgctgcagagatccaatgtttttctcctgctcatctgaaacacctgctcccttcaccaagccaccatcctgtgcttccagcgtaattacttgctcaatcacttcattatctttcgatgatgtaccatcatcagcaaccgtgacttcagagagcacacggctcttgtgcgcacctacctttggcaatcgcaattcttggctcttagattcagtcagctcctctgagaagacaatgtcgacaggttctttcaaggagctcactgtttccagaggaagcgcattcagcttatctgcctcgacgccacggccctgattcgtgatttctccagggaaaacccgcggtatagagttaagcgccacggagaggcggctagtgtagagcgcgagcggggaaagcaccgtgaggccgaggaggagcagcagcagcaccaacctccttctcgtcctcaccatgtcggagaatggttttcctcggtgagttttgtctggaacctgggatcccctcagtccctcactgcagatattcttcctccattcctgggcagacgaaatggatgcggccgcgtacaaacagagtagctgagaggggaggcgcaggcggaggtgccccggttgcttcgtgtgcttctcgcagaagaccaggacgcccggcgatgcgcaaaggagtcgaggaagtaggtccgcccngagatacaattcttctgggatgtt

SEQ ID NO: 21217 - DNA, 2009 bp, Zea mays
ctgcttgtattttgtctctatgaattgtagcttcagcaatccgaacaactgcagcagttacggctgccagccaaccgacgaccaggttatatatgcactagacattattgtgcaaatgttggaaactgtttcccccaccttatcaaataaaaggtttttgttatccgtatccacttgcgcattagtagtggtggagagatcgtgaggactcatggctatcgacgtcgaccacaacaggcggctagaggaatggtacaatagctccgcgaggccttggatctataatcgagcgccgcccgggcaggtacgcgggcgggtgctccaaacaactgcactagacatctcaattaattagctaatgagcaagcggctgagctgcactcaagacaaactaccatggatcagtcaaacattagcaacaagcacatgacgatgacaaccctaatgctcctcctctgtgtcatagccattgcagattgcatttgccacgccgcagtggcagcccgggtggagccatccaccaccgtcggcagaactacaggaggagacgaggcgatgatgatggcgaggtacctcggccgcgaccacgcttatcgccggaagtacaaggacgacgccgagaaagcacaccgtttccaggtattcaaggcgaacgcggagtttattgacaggtctaacgctggaggaaagaagaagtacgtcctagggaccaaccagttcgccgacctgaccagcaaagagttcgcggccatgtacaccggtttgaggaaaccggcggcggtgccttccggggccaagcagatccctgcagctggttccaagtaccagaattttacgcgcctagatgatgatgtccaggttgattggaggcagcagggtgctgtcactcctgtcaagaaccaaggccaatgtggtaaagttaactgctccgtctacgtctatcattattaactattgagtaactggctaatggcatctaaatgagatcaatatttgcaggctgttgctgggcgttctctgcagtaggtgccatggaaggtttgatcatgataacgacaggaaacctggtctccctgtcggagcagcagattctagactgcgacgagtcagacgggaaccagggctgcaacggtggctacatggacaacgccttccagtacgtcatcaacaatggcggcgtcaccactgaggacgcctacccttactctgcagtccaagggacgtgccaaaacgtccagccagccgccaccatcagcggcttccaggacctgcccagcggcgacgagaacgcgctcgccaacgcagtcgccaaccagccggtgtctgttggcgtcgacggcggatcgagtcctttccagttttaccagggtggcatatacgacggggatggctgtggcacggacatgaaccatgcagtgacggcgatcggctacggcgccgatgaccagggaacccagtactggatcctcaagaactcctggggcacaggatggggtgagaacggtttcatgcagctacagatgggcgtcggcgcctgtggtatctccacgatggcctcctacccaactccatgaacacaaatcttcagataaagcgtagtatataccagtccatgcatatgactgcagaataaagcatggaagattaattacatgcgtgcatcaaggcatgctacgtactgtattaaaacttcggtactggccagatatatacacaaaggtagaatgtttgtgtgataatatagtaatgcttgtacgaatgcaaagaacatgacctttcaataataaataagattaggctacactaaaaaaaaaaaaagcggccctgtttgttttagattataatataatgagattatataatctagtgtaaataatctgacagataaccaaacatctagattataggtttaaattatataatctaatatccaatatataataatctcataatctcttcaagagtagcttatttcagtggccagtcaaattcccatttctttctctctc

SEQ ID NO: 21218 - DNA, 1443 bp, Zea mays
gggtacctcgaggccggccgggccccgggacgggtgctccaaacaactgcactagacatctcaattaattagctaatgagcaagcggctgagctgcactcaagacaaactaccatggatcagtcaaacattagcaacaagcacatgacgatgacaaccctaatgctcctcctctgtgtcatagccattgcagattgcatttgccacgccgcagtggcagcccgggtggagccatccaccaccgtcggcagaactacaggaggagacgaggcgatgatgatggcgaggtacaagaagtggatggcgcagtatcgccggaagtacaaggacgacgccgagaaagcacaccgtttccaggtattcaaggcgaacgcggagtttattgacaggtctaacgctggaggaaagaagaagtacgtcctagggaccaaccagttcgccgacctgaccagcaaagagttcgcggccatgtacaccggtttgaggaaaccggcggcggtgccttccggggccaagcagatccctgcagctggttccaagtaccagaattttacgcgcctagatgatgatgtccaggttgattggaggcagcagggtgctgtcactcctgtcaagaaccaaggccaatgtggctgttgctgggcgttctctgcagtaggtgccatggaaggtttgatcatgataacgacaggaaacctggtctccctgtcggagcagcagattctagactgcgacgagtcagacgggaaccagggctgcaacggtggctacatggacaacgccttccagtacgtcatcaacaatggcggcgtcaccactgaggacgcctacccttactctgcagtccaagggacgtgccaaaacgtccagccagccgccaccatcagcggcttccaggacctgcccagcggcgacgagaacgcgctcgccaacgcagtcgccaaccagccggtgtctgttggcgtcgacggcggatcgagtcctttccagttttaccagggtggcatatacgacggggatggctgtggcacggacatgaaccatgcagtgacggcgatcggctacggcgccgatgaccagggaacccagtactggatcctcaagaactcctggggcacaggatggggtgagaacggtttcatgcagctacagatgggcgtcggcgcctgtggtatctccacgatggcctcctacccaactccatgaacacaaatcttcagataaagcatagtatatatcagtccatgcgtatgactgcagaataaagcatggaagattaattacatgcgtgcatcaaggcatgctacgtactgtattaaaacttcggtactggccagatatatgtacaaaggtagaatgttcgtgtgataatataaaagttcgtaatgcttgtacgaatgcaaagaacatgacctttcaataataaataagattaggctatacc

SEQ ID NO: 21219 - DNA, 1505 bp, Zea mays
aatacactttaacccacctgaaattggaataaacaaagtgtatcgaagcgaacggggccgacttctccgaatcgcatcccctcccccactcaagcagccaaaccctagattgggcaagatgctcggcggcctgtacggcgacctcccgccgccgtcgtcggccggcgatgaagacaaggcctccacggcttccgtttggtccagcgccaccaagatggcgcctcccaccctccgcaagccgtccaccaccttcgccccacccccatctattctccggaaccagcacctgcgcccgcccaaagccacctacatccccgctccccccgtcgttgccgccgaacccgccccggccacctccttccagcccgcgttcgtcgctgtccagtccaccgtgctggaggagtacgaccctgccaggcccaacgactacgaggactaccggaaggacaagctccggcgcgccaaggaggctgagctgaacaaggagcttgagaggcggcgccgcgaggagcaagatcgggagagggaacgcgagcagcgggagagggaggcccgcgagcgcgaggagaaggactaccaatccagggcctcctccctcaacatatccggcgaggaggcgtggaagaggagggcagcgatgagcggtagcggttctgctgctagaaccccatcgtccccacctcacggtgatggcttcgccattgggagctcatcttctgctgggttgggtgtgggtgccggcggacagatgactgctgcccagaggatgatggccaagatgggatggaaggaaggtcaggggcttggcaagcaagagcagggcatcaccgcgccactagtggccaagaagaccgataggaggggaggagttattgttgacgagagcagttctaggcccccagaaaagaagccgagatctgtcaactttgatgggcaaccaacacgagttttgctgctccgcaacatggttggtcctggtgaggttgacgatgagctggaagatgaggtggcatcggagtgtgccaagtatgggacggtttctcgggtgctgatatttgagatcacacaggcagacttcccagctgatgaggctgtaaggatattcatacagtttgagcgggcggaagaagcaacaaaggcaatgattgatctgcaagggcggttctttggcgggcgtgtggtgcaggcaaccttctttgacgaggaaaggtttgggaggaacgaactggctccgatgccaggggaagtgccagggtttttcgactaaagaaagaagttttcatgtggtatcagataagtggtgggttgtgaacttgtgattctttcttttaatcgagatgaactagaacatacagtcaggcaatttacttgctttgtagtgctagtgcagtgtactggaaatattatggatataaattatggtttttgagctgtgcctcctgctgctgaaaaaaaaaaaaaaaaaaacatgagcattttgaccgctttagcatgctttgtcgtgc

SEQ ID NO: 21220 - DNA, 1855 bp, Zea mays
  misc_feature (5)..(5): n is a, c, g, or t
ctggnactccaccgcggtggcggccgcccttttttttttttttttgaaactcagaagtctatcatctttaacaaaactagacaaattaagtgtacttattgatttgccacctatctatttttaatttgagcgcatacttccagtaataggagcttataatgagataaagaatcattgccatgctgccatgactgttgccatctatctgcaccaataccctcctgcttttccttcgaaataattttggcacctgccccccaccctttccccttccaacgccaacctatgcatattttttttttttttttgtatatagctgtcactaattatttgcttgcaaagttgcatgcatgcatatatatgagtataggtgccacacatacacacggcctcaattaatcattctctcttctgcacctgatccagcatgcatgtcttagaagagaccactggaaacctattatcatatccatctcgtacatcttttcccttgcaaaacatccttcgattgctttgggccgcatcatgacttcttgctttccgtctcagcaggctacttagcttgctactaaaactggacgatcatcaccatcggaatgtgcctccaaatgtagggtgccagaactccggtgtctcggccgccaccgtgtatgtgctcgctactgggacaaggcacaggccccggctccgcaggtctgcttgcttcgtgtcgccgttatccttggaatcctcagagcccttgtgctggaattgcttcatggggatcccatttttcaagtagggagagctcagtgacgcaacttggtcgtgaaggaatttgatgtattcgatggcctcgtgaagaaccgatgcggtatcagtctttccaaaaggcgagacgagttgctggagcgcagtgattctgtcccctagcttctctttccgcaccttaaaagtcggtagcggcgatggcgcctcgatccgtggccttttcgcggcggcaggcggctcggagacgcttttcctcgtcgccgccggtggtggagagcagtcgtccttcgccgacggagagttagcgttggagctgcggctattgggcttagccgcctgcagggcctgcaagagaaggtgagacggcagcgggccaccgaaaggcaggtaactgctgccggacaagtactgcatcggagcgccgacgccgacgctgacgccgtcgccttgcgtaggcgtaggcgtagacgcgggcaccgaggtcctgagcagctgggaaaactgcatcgatgccgcgccggcgtcgtagctgaccgaggattcgctgtctccgtacatcaaaatgttgtgcacggccgccgtggcgtcgaatagagcttgagcttgcgatggctccgtatcgccgtacggcgacggcgctagctgcgcctggtcggccaagaagccggcacccatgtccatgtggtccctgattaatggatcgttcgtcgcggagggttcttggagcacggcttggaagctggcatcgctcctcccgctcaagaaggtttgcgtccagtccaggtgtggatcaccgagcgaggaggcggcatcagacaaaggctgatgggtggagcttctataagggtcctggaaggttacggagctcgtcgactcaacggctgcggtggggaaggtgctgccgcaggccaccctgcccgtgaccgtgagcggcggtggcgcggcggccgagcacgccgacgtgccgtgactcctgtgagaggcactgccccaccactgttcggccatggatcggacggagcgacggaaaatctccctggctcttcaattcttgcggtgcttgcttcgctcgaggtgtgtggcagaaaggtgggttgaacgggcg

SEQ ID NO: 21221 - DNA, 853 bp, Zea mays
cccagcgtccgccaggggggaagcaaggatatcccgcatggatgtgattatgaaggccattgggaagaagctagaccgctacaagaacccatggttagagttgaaaattcagtacggccaaaataaagggaagttctataacgaggaatgtgaccgctttatgctttgcatggtgcacaaacttggatatggaaactgggatgaactgaaagctgccttccgtatgtctcccttgtttcgatttgattggtttgtgaagtccagaactacccaagagttggctaggcggtgtgatacccttatccgactggttgagaaagaaaatcaagaatatgatgagcaagagaggcaagcaaggaaggagaaaaggcttgctaagaacatgactccaacaaagcgagctgcactaaagaattcagagggtgagaatactccaccgagttcattcaagagacgacggcagtcccttatggacgactatgtgggctcgggaaagcgtaagagaggctgaccacgtttggcatcctcccttactcgccaggacatgccgtctctacaatgataagaccctgccgcgcagtagtgcttagttcctcttgcacgtgagtcgaatacctgactagcgtaatttatgcaatgatgacataggttagttattaatcctaaatggagcatgtatgtgcatgctgtgttagtgtcgtagatctggacaactgttgctgcccagctgacacagatgcctttcgctgcaatgcttccggtcctgcattttgccgcaactgattttgcaaccaaggctaaacccaacgcgggcagtagtaactgttgcactcaggatccacgtacaaaaaaa

SEQ ID NO: 21222 - DNA, 3780 bp, Zea mays
gaaaaatcccctccgcctctcgtgaatccaccgcgtccaagcttcattcctccgcactcgaaatccaaagcgccccgccccgccccgccccgacccaaaccctaatcctgcatttcctttcccgccaccgcccgccccaatggcgaagccggtgaagtatgacgacgaggaggagatctcctcctcctccgccgaggaggacgatgaccagtccgccgccgccgcctccggatctggtgaggaaggggatgacgatgaggagggtgctgcggcgctgcccacggaggaggaggaagctgagggcgaggggcagcaagaggaggaggtcgacgaggaagagatcgaagccgtcactaccggcgctggagctgaggacggagaggacgccagtgccgctaccgccgctgaaggcgaagaggagtcccagtccaccgaggacgacgaatccgtcgcaagggacaaggacaacggcgacgagactgatgcagtggttgggaagcgtgagaaaacaaggctaaaagaactccagaagatgaagaagcagaaaatccaggaaatactggatactcaaaacgctgccattgatgctgacatgaacaataaagggaagggacggttgaaataccttcttcagcagacagaaatatttgctcactttgcaaaaggaagtcagtcgaatgagaagaagcctcgggggaggggacgtcatgcctcaaagatgactgaagaagaggaagacgaagaatacctcaaagaggaagaagatgcccttgctggtgcagggggtacacgtttagtttcacagccttcatgcatcaagggaaagatgcgtgattaccagttggctggacttaattggcttatacgattgtatgagaatggtatcaatgggatattagctgatgagatgggtcttgggaaaacacttcaaactatttcattgctgggctatctgcatgagttcagaggtatagctggtcctcacatggttgttgcgccaaagtccactcttggcaactggatgaaggaaatccaacgtttttgccctatcttacgtgccgtgaagtttttggggaacccagaagagcggaaccatataagggacaatttgctacagcctgggaaatttgatgtgtgtgtgactagttttgaaatggcaatcaaagaaaaatctgcgttgaggcgcttcagctggcgctacataatcattgatgaagctcaccggataaaaaatgaaaattctcttctatcaaagactatgaggatttacaacactaattatcgtctcctcatcacaggcactccactccagaataatctccatgagctctgggctctcctcaatttcttgctacctgaaatatttagctctgcggagacctttgatgaatggtttcaaatatctggggaaaatgatcaacaggaggtggtgcagcagcttcataaggttcttcgcccattccttcttaggaggctcaagtctgatgtagaaaagggcctacctccaaagaaggaaacaattcttaaagttggaatgtctcagatgcaaaagcagtactatcgtgctctgcttcagaaggatttggaggttattaatgccggtggtgaacgcaagcgattgcttaacattgccatgcagctgcgcaagtgctgcaaccatccatatttgttccaaggagctgaacctggcccaccctacacaactggtgaacatctagttgagaatgcaggaaaaatggttctactagataaattgctgcccaagctaaaggagcgtgattccagagtccttattttttcacagatgaccaggcttttggatatcttggaagattatcttatgtataggggttatcagtattgtcgaattgacggaaatacaggtggagaagatcgtgatgcatccattgaagccttcaatagtccaggaagtgagaagtttgttttcttactttcaactagggcaggtggccttggtatcaacttggccactgctgatgttgtggttctctatgacagcgattggaatccccaagctgatctgcaagctcaggaccgtgcacatagaataggtcaaaagaaagaagttcaagtgttccgcttttgcactgagtacactattgaggaaaaggtgattgagagagcatataagaagctagcattggatgctttggttattcagcaaggacgattggcagagcagaaaactgtcaataaggatgatcttctgcaaatggtgcggtttggtgctgaaatggttttcagttctaaggacagcacaataactgatgaggacattgaccgtattatagctaaaggagaggagacaacagcagaacttgatgcgaaaatgaaaaagttcactgaggatgccatcaaatttaagatggatgataatgctgaattgtatgacttcgatgatgagaaggatgaaaacaaggttgatttcaagaaacttgttagtgataactggattgagccacctagaagagaaaggaagagaaactactctgagtctgactactttaagcaagcacttcgccaaggtgcaccagcaaagcctagggaaccaaggattccaagaatgccgcacttacatgatttccagtttttcaataaccaaaggctaaatgaattgtatgaaaaggaagtgcggtaccttatgcaagcgaaccagaagaaagataccattgatggtgaagacgaagatcagttggagcctttgacagcagaggagcaggaagagaaggaacaattattagaggagggttttgcgtcatggacaaggagagacttcaacacatttattcgtgcatgtgagaaatatggtcgcaatgatattaaaagtatatcatctgaaatggagggtaagacagaagaggaagttcaacgttatgctagagttttcaaggagagatacaaggaactgagtgattatgatagaattataaaaaatattgaaaggggggaagcaaggatatcccgcaaggatgagattatgaaggccattgggaagaagctagaccgctacaagaacccatggttagagttgaaaattcagtacggccaaaataaagggaagttctataacgaggaatgtgaccgctttatgctttgcatggtgcacaaacttggatatggaaactgggatgaactgaaagctgccttccgtatgtctcccttgtttcgatttgattggtttgtgaagtccagaactacccaagagttggctaggcggtgtgatacccttatccgactggttgagaaagaaaatcaagaatatgatgagcaagagaggcaagcaaggaaggagaaaaggcttgctaagaacatgactccaacaaagcgagctgcactaaagaattcagagggtgagaatactccaccgagttcattcaagagacgacggcagtcccttatggacgactatgtgggctcgggaaagcgtaagagaggctgaccacgtttggcatcctcccttagacatgccgtctctacaatgattttaataccctgccgcgcagtagtgcttagttcctcttgcacgtgagtcgaatacctcaagggcatgtgactagcgtaatttatgcaatgatgacataggttagttattaatcctaaatgaagcatgtatgcgcatgctgtgttagtgtcgtagatctggactttgcaattgcaactgttgctgcccagctgacacagatccctttcgctgcaatgcggtcctgcattttgccgccactgattttgcacccgagaaaaaaaaaaaaaaaagcggcc

SEQ ID NO: 21223 - DNA, 1926 bp, Zea mays
acgcgggtctatgacagcgattggaatccacaagctgatctgcaagctcaggaccgtgcacataggataggtcaaaagaaagaagttcaagtgttccgcttttgcactgagtacacaatcgaggaaaaggtgattgagagagcatataagaagctagcattggatgctttagttattcagcaaggacgattggcagagcagaaaactgtcaataaggatgaccttctgcaaatggtgcggtttggtgctgaaatggttttcagttctaaggacagcacaataactgatgaggacattgaccgtattatagctaaaggagaggagacaacagctgaacttgatgcaaaaatgaaaaagttcacagaggacgccattaaatttaagatggatgataatgccgaactgtatgattttgatgatgagaaggatgaaaacaaggttgatttcaagaaactcgttagtgataactggatcgagccacctagaagagaaaggaagagaaactactctgagtctgattactttaagcaagcgcttcgccaaggtgcaccaacgaagcctagggagccaaggattccaagaatgccgcacttgcatgatttccagtttttcaataaccaaaggctaaatgaattgtacgaaaaggaagtgcggtacctcatgcaagcaaaccagaagaaagataccattgatggtgaagacgaagatcaattggagcctttaacagcagaggagcaggaagagaaggagcagttattagaagagggttttgcatcatggacaaggagagacttcaacacatttattcgtgcatgtgagaaatatggtcgcaatgatattaaaagtatatcctctgaaatggagggtaagacagaagaggaagttcaacgctatgctaaagttttcaaggagagatacaaggagctgactgattatgatagaatataaaaaatattgaaaggggggaagcaagaatatcccgcaaggatgagattatgaaggctattgggaagaagttagaccgctacaagaacccatggttagagttgaaaattcaatatggccaaaataaagggaagttctataatgaggaatgtgaccgctttatgctttgcatggtgcacaaacttggatatgggaactgggatgaactgaaagctgccttccgtatgtctcccttgttccgatttgattggtttgtgaagtccagaactacccaagagttggctaggcggtgtgatactcttatcagactggttgaaaaggaaaatcaagaatatgatgagcaagagaggcaggcaaggaaggagaaaaggcttgctaagaatacgactccaacaaagagagcagcactaaggaattcagagggtgagagtgctccgttgagctcattcaagaggcgacggcagtctcttatggacgattatgtgggctcgggaaggcgaaagagagggtgatgtgatgtttgacatcctgcctttggagctctcagcgagatgcagtctctgcaatgctttaagcccgtccgtgctgtgcttagtttcttgtgcacgtgagttgaatgcctcaagggctggtgactttgtagtgtaagttatgcaacgatgacatagattagttattataaatcctaaatgaggtatgtatgcgcatgctgtattgtagtgctgtagattcggacttcgcaattgcaactgttgctacacttttggtcagtgatgatgcctttcgctgcaacagttgaggctccagttcaatatttgaagataaatccggtcccttctgtctagggatggccatgggtacctgatacccgttcggtaaaaaccgtattagagcacatgtgatggcgatttgttatacccctcggctattttattgatcatttgtttgttctttcttgccatatatatgttctttcttgcc

SEQ ID NO: 21224 - DNA, 1631 bp, Zea mays
tgggtaccccgtggccccggccgaaaaaagaaaaggtctaattactcgcctctcttgctcgccaacgccagtggccagaggcccagagcttcgtcaaagacacgccgaaaagagggggaggcgactcggccgaggtccggttccgaactccggtcctccgatttgcgcgtccggatctaccagccatggcatcatcttcggacccgtggatgaaggagtacaatgaagcatccagacttgctgatgacatcagttccatgattgctgatagagggtcccttccacaatcaggcccagaaattatgcggcatacttcagccatccggagaaaaataactattcttgggactagactggatagcttggagtcgttgcttggcagaattcctccaaagtcaatcactgacaaggagatgcataagcgccaagacatgttttccagtttgaagtctaaagcaaagcagatggcgacaagtttcaacatgtcaaactttgctaacagggaggatctgcttggtcagagtaaaaaggcagatgacatgagcagagttgctgggttagataaccaagggattgttgtccttcagaggcaaattatgaaagagcaagatgagggtcttgagaaactggaagagacagtgctgagcacaaagcatattgcattagcagtcaatgaagaacttaccctgcacacaagattgatagatgaccttgaagatcatgttgatgttacaaattcacgtcttcagcgcgtgcaaaagaggcttgcaattctgagcaagcgcaccaaaggtggctgctcatgtatgtgcctgcttctatctgttgtcgccatcgtgattcttgcagtcatagtttggcttctcgtcaagtatctgtaaaggaaagaaagaagcagccggcctaccctgcagacctcactcgaaatgacccttatgtgtgcagccttcgcttaaaaagtcccttctgtgttactaccattgaaatgtgcatccctttgaaaataatatatatacggtggtttcatcttccctttcgtgagtggaatggttatggagtaatgtacattacatcgaatttgacacatacatgatcatcatctgcatcttgtgtatggtgtttgtcagtttgcagtgacaagtgtggatttattctgtgccgtaagcacttcatccctcggctaccgttcttgtgcagcgagtaaattcagctaataggtggtttggatctattcattttgaagaaattagaatgtacttaataataaagtaacttatttagcttgaatttgacattccactacttttcaaagtttatatataagtctatcttaaatttatgggaacttttcaaagtttatatataagtctatcttaaattcatgggttgaggacaggaaagggttttatgtatcagtataatatgtttctaatatgtaatttatatgtttttcagctcactcctctatagtaaaaaaatgtagcatataaatattttcaataattatatatatatatatattttgcgtaaaactattttagcttaatttaattgattgatatatgcctaaattactattattagaatgtaatttaatttcaaggatacaaacgaggcctaaaagttatctg

SEQ ID NO: 21225 - DNA, 1158 bp, Zea mays
ctgggcggtacaggccggcggaaaaggcaattattgcctctctttcttgctcgccacagcttcgtcaaagacacgcggaaaagaagaggaagggggaggcgactcgaccgaggcccggtttcgatctctggtcctccgattgcgtccagatctaccagcaatggcatcatcttcggacccatggatgaaggaatacaatgaagcatccagacttgctgatgacatcagttccatgattgccgacagagggtctcttccacaatcaggcccagaaattatgcggcatacttcagccattcggagaaaaataactattcttggtactagactggatagcttggagtcattgtttggcagaattcctccaaagtcaatcactgacaaggagatgcataaacgccaagacatgctttccagtttgaagtctaaagccaagcagatggcgacaagtttcaacatgtcaaacttcgctaacagggaggatctgcttggtcaaagtaaaatgccagatgacatgagcagagttgctgggttagataaccaaggaattgttggccttcagaggcaaattatgaaagagcaagatgagggtctcgagaagctggaagagacagtgctgagcacgaagcatattgcattagcagtcaatgaagaacttaccctgcacacaagattgatagatgaccttgaagatcatgttgatgttacaaattcacgtcttcagcgtgtgcaaaagaggcttgcaattctgaacaagcgcaccaaaggtggttgctcatgcacgtgtctgctcctatctgtcgttgccattgtgattcttgcagtcattgtttggcttctcgtcaagtatctataaagaaaagaaagaagcagccggctaccctgcggacctctctcgaaatgctcacctgcagccttcgcttgaaaagttccttctgtgttactccataaaatgtgcagccctttaaaattaatatgtatacacggtggtttcatcttcccttccatgagtggaatggttatggctatgtacattacatagaatttggtacgtacatgatcatcatctgcatgactgcattttgtgtatggcgtttgtcagtttgcaatgacagggtgttgatttattaaaaaaaaaaaaaaaaactcacacaaaac

SEQ ID NO: 21226 - DNA, 1038 bp, Zea mays
aaaacgaggtgggctccgcgttcccctttacctgcgtcatgcactcacggcaacgctggccagaggccagagcttcgtcaaagacacgccgaaaagagggggaggcgactcggccgaggtccggttccgaactccggtcctccgatttgcgcgtccggatctaccagccatggcatcatcttcggacccgtggatgaaggagtacaatgaagcatccagacttgctgatgacatcagttccatgattgctgatagagggtcccttccacaatcaggcccagaaattatgcggcatacttcagccatccggagaaaaataactattcttgggactagactggatagcttggagtcgttgcttggcagaattcctccaaagtcaatcactgacaaggagatgcataagcgccaagacatgctttccagtttgaagtctaaagccaagcagatggcgacaagtttcaacatgtcaaacttcactaacagggaggatctgcttggtcaaagtaaaaagccagatgacatgagcagagttgctgggttagataaccaaggaattgttggccttcagaggcaaattatgaaaggatgaccttgaagatcatgttgatgttacaaattcacgtcttcagcgtgtgcaaaagaggcttgcaattctgaacaagcgcaccaaaggtggctgctcatgcacgtgcctgctcctatctgtcgttgccattgtgattcttgcagtcatcgtttggcttctcgtcaagtatctgtaaagaaaagaaagaagcagccggctaccctgcggacctctctcgaaatgctcacctgcagccttcgcttgaaaggttccttctgtgttactccataaaatgtgcagccctttaaaattaatatgtatacacggtggtttcatcttcccttcatgagtggaatggttatggctatgtacattacatagaatttggtacgtacatgatcatcatctgcatgactgcattttgtatatggcgtttgtcagtttggcatgacaggggggtggtttatccc

SEQ ID NO: 21227 - DNA, 1143 bp, Zea mays
aatattgcctctctttcttgcccgccccagcctcgtcaaagacacgcggaaaagaagaggaagggggaggcgactcgaccgaggccggcgactcgaccgaggcccggtttcaatctccggtcctccgattgcgtccagatctaccagcaatggcatcatcttcggacccatggatgaaggaatacaatgaagcatccagacttgctgatgacatcagttccatgattgccgacagagggtctcttccacagtcaggcccagaaattatgcggcatacttcagccattcggagaaaaataactattcttgggactagactggatagcttggagtcattgcttggcagaattcctccaaagtcaatcactgacaaggagatgcataaacgccaagacatgctttccagtttgaagtctaaagccaagcagatggcgacaagtttcaacatgtcaaacttcactaacagggaggatctgcttggtcaaagtaaaaagccagatgacatgagcagagttgctgggttagataaccaaggaattgttggccttcagaggcaaattatgaaagagcaagatgagggtctcgagaagctggaagagacagtgctgagcacgaagcatattgcattagcagtcaacgaagaacttaccctgcacacaagattgatagatgaccttgaagatcatgttgatgttacaaattcacgtcttcagcgtgtgcaaaagaggcttgcaattctgaacaagcgcaccaaaggtggctgctcatgcacgtgcctgctcctatctgtcgttgccattgtgattcttgcagtcatcgtttggcttctcgtcaagtatctgtaaagaaaagaaagaagcagccggctaccctgcggacctctctcgaaatgctcacctgcagccttcgcttgaaaagttccttctgtgttactccataaaatgtgcagccctttaaaattaatatgtatacacggtggtttcatcttcccttccatgagtggaatggttatggctatgtacattacatagaatttggtacgtacatgatcatcatctgcatgactgcattttgtgtatggcgtttgtcagttcgcaatgacagggtgttgatttattctaagaaaaaaaaaaaaaagcggcc

SEQ ID NO: 21228 - DNA, 2939 bp, Zea mays
  misc_feature (12)..(12): n is a, c, g, or t
  misc_feature (125)..(126): n is a, c, g, or t
  misc_feature (148)..(148): n is a, c, g, or t
  misc_feature (156)..(157): n is a, c, g, or t
cggccgcgtggngaaattgcaagtagatattgttacccttaagatgaaaagtgaaattagaaagcatgttagaagaagccagagcttcctgggacactcttgctgattcaatatcaagccttacnntcttcctattgatcagcctttntgaggggnncctatggaaaagtttagccagattgcccaatacatccaggaatctcaagttgctaagagttctcttgaaaatgagctacacaaagcaaatgagcaaattaccttacatgctagcaggcattctgacgccctttccaccataaacatgttagaacatgagttgagtaaactaaaagatcatatttcttccatttctgaagaaaaacgtcaaatgcagttaaatacttctgctgtacaggaggagttggagaaaacaaacgaggaactggcaatcaatttcaggaaccttgaaagtgccaacaccaccattaattcactacaagatgcactatcacaggctagatcaaatatttttattcttgctgctgaaaagaatgaagctgaagctaaatatgaaacagaaataaatgctcttaatgctgagctaaccaaatgtttggaggagttggataaaactcatgggcacttacaaagtcattcaacagaatatcatggttaccttgagaagcttggcatgtttatgatggatgatagtctcttgtctctgatagctgaagaatatggaaagacattcaacagcttgagagatatgtgtcttatagtcaagagtatgcatgagcagctttctgtgaagagttttcagaatgattcaattgtggaggattcagaactctcatcacttttatctcttccggactatgagagctttgttagagaaagattggtcaagaacataaatagaaaagggaatattgatgacacttcatccttctctactattgttgaacagttgagcaaccaaactgaatacctttctagttttttaaaagatttgtcaacctacatgaatagcaatattattgtggtgcttcgttctctgcaactagtgagcgacaccctggcccatactctagaagagcatgacatgttgaaggttgaattggggaacaaggatgctcataacagagctcaagaatctgaagtgctttctctacaaaaagatctgagagcaatgtcatcaaaatgtatttattgcgtccaacaaattgaaattgtttttgacgatatggttgatcttggatatgcaatagacttggctacaggcagctcaagcatagggtctgaactagaggtaactgtgtctgatctgaagaatgaggataccagtgattatagtaaggtggctgatactttgcttgctacaattgacacacttaagtccaagtctgaaaaattatctaccattaaggggcttgtgataacttcattggatgacttcaaaatgaagctgaaacaagctgaagcagctgctgaaactgcttcacatgagcatcagttgtctgttgaaagggtatgcatgctggagaaagaactcaaaatattacaggatgagtgcaacagaatggaactaaatatgcaagagtataaggaaagggagggtgcattgaaggcaagggagttagagttgctatcagttgagcacactcaaatttcagcagacagaggtttaactgacaatgcaatttcaaaagatcaaatggaagctcttgttgagaagataagtaagttaaatatgctgtcaggcgagtcaaatgtgcagagggaagaggctacaagtccgcttgacaaactttttgttgtcattgatgaattcagtgcacttcaacatgaggttgagaccttaagatatgaaaatgaagatttacagttaaatattgaatcctatacccgtgaaattgaacagctaagagaggtctccagaaatagtgatctaactaatagggagttggaatccaaaggaagtgagcttcttgaggtagctgttagtatggagcgaatgattcagcggttaggatatcttggaggaaaagatgtactagaagataacaaacctgctagcacacaagctctcgtatcgaagctggaaaagctaataatagcttcaagtactgaatctgggaattctaaatccataatacaggagctgggagcaaagctgcagtcaagggaaaaggcagttgatgagctatcaacaaaagttaagatgctcgaggatttgtgccatgcacaactttctcagccagaacctagtaaagacagatcatttgaagcatcttcctcaacaattgggtcagatatgtctgatattgaagatgcaggaccagtgggcaagacaacatcagtttcatctgtttctacagctgcacatgctagaacaatgcggaaggggtcagcggatcatcttgttgtcaacattggttcagagtcagaacgattgattgctgcacaagattcagatgacaaggggcgtataaaatcgctccatacatctggcttcattccagctcagggaaagcacatcgctgatagggtcgatgccttctgggtctcggggagccaaattctgatgaaccggccacgagcaaggctagggcttatgttgtactggctggctgtgcacctatggttgatgggcagcatcttgtgacaccgcttctcaataccgagacccatctcatagcataattgtacaatagcacgtattagcagtttcttcttccattcatacaatacatggtagatgttagaaataccatttttttcattgtcttcctcctgctgagatttgcacttgagcagtatgtgttgaatttttgcacacaagatgtaacgcgcagaaaaaataacgttgtcattctttggtatagtgaagaggtggtagttgtagtcggggacccggtggccctgatcacctgatgggccccatcatcattcgttgtttg

SEQ ID NO: 21229 - DNA, 1772 bp, Zea mays
  misc_feature (1738)..(1739): n is a, c, g, or t
ttttttttttttttttggctcaagctcagctcaaccatatcgcgcagctgcatgccggccaggtgcatcctagcacgcccaaaaatagaccagacatgggggagaagaagaggatgcattacaagtagtagataatcacgcttggatgtgatgtctctcatcttggaaagccagtggcaatgcctgcttcagcttttaaaatggtcgtgctctgctgtctcctcagccacgcacagcatcaaatgccgatcacaggtcgtgctcgggcttgtccacgccgtcgccgccgcccatctgaggttgtgcggccgccgccggacgagctgcggggacgaggcggcggcggcggccttgtcgtcatcggcgtcggggctcgcccgggccaccagcagcctcgagatgctgccgcggcagaacgggcaggccggcgacggcggcgtcagcgtcgccgggttcggcttgctgtggcagcacagcgccagcgtgcacgccgcgcacatctggtgcccgcagtcctgcacctcgatgctgcacgcctgctcgaagcagatgcagcacagctccgcgtcgctggcctccgaggacgcttcgtcaatggcatcgtgctcgcaaggcgaagtaggcgatggctgcgaatacttggtgatgcccttgaggatcttctcctccctctccctattggcgtccatcagtgccgcttccaggagagccttcgcctccgggtccagctcgctgatgaacttgagcggggaaggccacaccatgggctccgccgccgacgggttcagcagcgccgcgcacgccccgtggttgcgcttcagcgccacggcgtaaggaatcctccctgctgagtccctctggagacgatccgcgccccaggcgagcagtttccggatgcagtccaggttcccgcttcgagcggccagatgcagcgacgtgctgccggggaacccgtaggagccggtgagggcggagacaatggcgccgttctccagcagcacctgcacgcaggcggggcggccctgcctggcggcgaggtgcagcggcgtggcgccgcggtcgtccctgacgttgacgaaccgggcgaaaccccatgagtcggccaccggcgtggtccgcgccgccgcgaggatggcccgcaggcagtcgacgtggccgaagtaggacgcgtggtgcaggcaggtccgcccgtgcagggagtcgaacatcaggatattggcgccggcctgccaggagcttccgcgcgcagtcgatcttgccgtgcatcgccgcgagcatcagcggcgtctgcttgtgccggttcacggcgtccggcggcaccccgtgatccaagatcatggacatcacctcgaggtggccattcgcggcggtgatgtgcagcgcggagaggcggtcgtagagcgtggcgcggcgggcgagggaggggtcggcggcgaggagcgcgtccagggcgtcgaggtccccgacctgcgccgcgcggaagtagttgtgctcgtcgcccgtgcgagcgcagctgacgccgtgccccatggctgcccgagctgccggcggcttgcttggtactctctctttatttttttttgtcttttttggggtaacagaggcgagctagcggctgctccggcccgactccacccgccggcggcgaagtgggggaggtaggtgccggccgaggcagcgtgaatcccggccggccccccgggggccccaatgttttttttttttttttttttttttnnggatttttttccccggccggcctcgaggtaccc

SEQ ID NO: 21230 - DNA, 4100 bp, Zea mays
caagcgaagttcctactccgtagatataatcgtggtttgttagggggttatctataaatctatatgagcttatggtgaaagagtttaattgttaactgtcaactatagttggatcataatctaacaaataaagtatctcacttgcacgcttgtacataagatatgattacatatttggtgttgcgctttgtatacctattagacgcttgatgtatcggtgtgtgtatgtcgtggcgatgatgtttctggcaggtgagcagctggtgcctaccagggtgaccctgaacaggtcagcagctggcctgtaggcacgcatgcccatgcccaagaccgtttattttttttattttgaaaaaaaaaattatgccaggaccgttgttctgatttccttcccaagtgaaaccgtcattttcgtttcgttttcaccacctgagtcaatggctggggatttgtgtgtgtatatacacacaagcaggggctacaaagtctccaacagctcgtggaatttcggaagaatcaagagtttttattgtagactagtctttgcaggtaaactgtggctctgtcaaagctgcagactggggccgagattggtcttcttcctttctaacccaaagcaccggttctaactaacaacttgaaccaccagattagctagaagcttgacagagacaccggtaccgtgactgtgaggtggcagcggcatttgtattatatcagacgatcaagtgtgcggtgtgcctagatattttgattagttagacagattaggttagactagagttagagcgcgtacaactaccgcgcataaaccaccacaggctggcaaaatatcttcccggccacacgggggctggcctggccgccgctgcagctgcggcacttggtcaatgacacgccatctcggactggaaacgcgtccatgacaaaacgcttgcccccctagctagtcaaaccagacgacgtacgccctgcgttttccttttttttttttggtcccttgcttgcagtcgtcgtcttcgcgaaactcggctgcgtgtgtgaactgcaacaagaacgaattcctcttccttttcttttttcaaacttcaaatcgagttgttttaccgtacatatcctttgttttaccggacctgctgcagacagagtaatcactgctctgagcgcctctctggcagagtgtgacgaccgccgctcctcggcaggtggcaccacagcacagccggacggccgtggcccctccaggccggcagggaggtcacggagtcctgcctgtgaaccggagacggtgaggccgcagcagctagagcgcccccgcggtgcacgttgcagggccttcctccgggcacggcaggcggcagcggcgcagagccccagagcaagagcgacagattcaccaccggaccagggacgaggaggaccactgtgcccgctatctcccgagccctgcctatgggtatggagcgcaagggttggggacggacgccatggcagtggcagcaggcgacaggtcggccaggccgaacctgacttgaatccatcatccattgcgctgcagtgccagtgccagtgcagtgcatcgttgcaacaaacatcacacgccgtggcaagaggtcacatcccgtggccgtggcaggccatcgttacagcaagccagctccgtcgccgtcactggcagccacatacagttcacgactgtgcgatactgcgatgccatgaacggagccacagttcaccacagctctctccaggccgacagcttttacacacacacaccaccgatggtgttttacatgtctgtgactcaaactcggctcaaccattggaaccataccacagctgcgtgggcacgaaggaatggaaatggaatctagtactatatactatagccggtcggtgacaatggaatacggcaatggccaggtgaacaaatcctggcacgcccaagaataggattgacagacagggacatggggagaagaagaagaaaaggatgcggttattttcgcagcaagcagtcacgcttggcttggattcgattggatgtccgcaaatggccccgcgctcggctccacatgcgcaggatccaatgccgatcacgggtcgtgctcgggcttgtccacgccgcagccgtcgctgtcggccatcgtccggctcgacccgcgcccgatcttggagaaggaaccggccacggcggacgacagccccttgaagctgctgctgccgccgtcgctgaggttgtgcgaccgccgggaccgccgccggacgagctgcggggaggaggcagccgctgccgcagccgctgccgccgacttctcggtgtctgcgtcgtcgctgcttgcccgggccaccagcagcagccgcgagatgctgccgcggcagaacgggcaggctggcgacggcagcgctagcgtcaccgggtcgggcttgctgtggcagcacagcgcgagcgtgcacggcgcgcacatctggtgcccgcagtcctgcacctccatcgtgcacgcctggtcgaagcagatgcagcacagctccgcgtcgctggcgctggcctgtgagggcgcgtcgtcgatagcgcaaaatgggcgatgatgcatcaggtcccacatttgtcagcggtcacaaagcatacatctgaggacgcgtcgtcgatggcgtcggcgtcggcggcgtcgctcgcgtggtcccaggtgggaggatgcggagagtgcttggtgcccctgaggatcttctcctccctctccctgttggcttccgtcagcgccgcttcaaggagcgccttggcctccggctccagctcgctgatgaacttgaacggggacggccacaccatgggctccgccgccgacgggttcagcagcgccgcgcacgcctcgtggttgcgcttcagcgccacggcgtaagggatcctcctgccaacacacgtcccattcgccatgagatctagtggggaagaatacgatccatcatccatcgagtggttgatgacggattgctcaacgtgggacccatattgttcgcgtgttttctcagacccacacccaccacatgtaatctttggcatgtagagtagagtacactgaaataagatctgcagagacagagatgtggtgctcaccctgctgaatccctccggagacgatccgctccccaggcgagcagcttccgggtgcaatccaggctcccgctgcgagcggcgaggtgcagcgacgtgctaccaggaaacctgcagcggcgtacagtaccgcggtgcccctgcagccaagaggagcaggagactttactaccgtacccgtatgagccggtcaaagcggagacgatggcaccgttctccagcagcgcctgcacgcagccggggcggccctgcctggcggcgaggtggagcggcgtggcgccgtggtcgtctctcacgttgacgaaccgagcgaaacccctgccaggcttgcacagcagcgagtgagtcgtcgccggggggggcgaggggacggacggcagggcacgcgaggtaggtagggcccgaaagtgaagtgaaggtatcacgctcaccatgagttggccaccggcgtggtccgcgccgccgtgaggatggcctgcaggcagccgacgtggccgaagtaggacgcgtggtgcaggcaggtccgcccgtgctgggagtcgaacatgaggatctggcaggcacagatcggacagcgaagcggttagttgtttgtagctggtcactcgtactcgctcggaagaagaagaggaggaggagatttccgctcacattggcgccggcctgcaggagcttcagcacgcagtcggtcttgccgtgcatcgccgcgagcatcagcggcgtctggacagagaaaaacaagcatagcaagccggtagagagatgagattttttaccttgttgatttgattgaagagggtaagaaaaaaaataggtgagatttttgctgctggtagcccacgagagatccttgcgagcggcaaagggcggaaagaaaggaagaaagaaagaaaaaaaagcgtcgatgggacgggatccagcacctgcttgtgccgattcaccacgtccggcggcaccccgtgatccaagaccattgacagcacctgca

SEQ ID NO: 21231 - DNA, 2053 bp, Zea mays
  misc_feature (13)..(48): n is a, c, g, or t
  misc_feature (155)..(156): n is a, c, g, or t
  misc_feature (217)..(286): n is a, c, g, or t
ctctagcacagtnnnnnnnnnnnnnnnnnnnnnnnnnnnnnnnnnnnnatgcatctgctgcctgtggggtgagcagcgctcggacgacactggcacacaataactgcggctgctctgagccttgctccatgcaccgctcctgcgtgcatcacggnncacggaccattggctggctgccaccggtctttcggccatggccggagcaccgctcacggannnnnnnnnnnnnnnnnnnnnnnnnnnnnnnnnnnnnnnnnnnnnnnnnnnnnnnnnnnnnnnnnnnnnntctgtgtcttttttacaagtccagtgcacatcgccggttccactctgcgtgttctctcgaccgacagttttacacacatgtcggtggctcaagctcagctcaaccatatcgcgccggccaggtccatcctagcacgcccaaaaatagaccagacatgggggagaagaagaggatgcattacaagtactccagtagataatcacgcttggatgtgatgtctctcatcttggaaagccagtggcaatgcctgcttcagcttttaaaatggtcgtgctctgctgtctgctcagccacgcacagcatcaaatgccgatcacaggtcgtgctcgggcttgtccacgccgtcgccgccgcccatctgaggttgtgcgaccgccgccggacgagctgcggggacgaggcggcggcggccttgtcgtcgtcatcggcgtcggggctcgcccgggccaccagcagcctcgagatgctgccgcggcagaacgggcaggccggcgacggcggcgtcagcgtcgccgggttcggcttgctgtggcagcacagcgccagcgtgcacgccgcgcacatctggtgcccgcagtcctgcacctcgatgctgcacgcctgctcgaagcagatgcagcacagctccccgtcgctggcctccaaggacgcttcgtcaatggcatcgtgctcgcaaggcgaagtaggcgatggctgcgaatacttggtgatgcccttgaggatcttctcctccctctccctattggcgtccatcagtgccgcttccaggagagccttcgcctccgggtccagctcgctgatgaacttgagcggggaaggccacaccatgggctccgccgccgacgggttcagcagcgccgcgcacgccgcgtggttgcgcttcagcgccacggcgtaaggaatcctccctgctgagtccctctggagacgatccgcgccccaggcgagcagtttccggatgcagtccaggttcccgcttcgagcggccagatgcagcgacgtgctcccggggaacccgtaggagccggtgagggcggagacaatggcgccgttctccagcagcacctgcacgcaggcggagcggccctgcctggcggcgaggtgcagcggcgtggcgccgcggtcgtccctgacgttgacgaaccgggcgaaaccccatgagtcggccaccggcgtggtccgcgccgccgcgaggatggcccgcaggcagtcgacgtggccgaagtaggacgcgtggtgcaggcaggtccgcccgtgcagggagtcgaacatcaggatattggcgccggcctccaggagcttccgcgcgcagtcgatcttgccgtgcatcgccgcgaggatcagcggcgtctgcttgtgccggttcacggcgtccggcggcaccccgtgatccaagatcatggacatcacctcgaggtggccattcgcggcggtgatgtgcagcgcggagaggcggtcgtagagcgtggcgcggcgggcgagggaggggtcggcggcgaggagcgcgtccagggcgtcgaggtccccgacctgcgccgcgcggaagtagttgtgctcgtcgcccgtgcgagcgcagctgacgccgtgccccatggctgcccgagctgccggcggcttgcttggtactctctctttatttttttttgtcttttttggggtaacagaggcgagctagcggctgctccggcccgactccacccgccggcgacgaagtgggggaggtagctccgtcttgaacagcgtccggccggcctcgaggtacccaat

SEQ ID NO: 21232 - DNA, 1154 bp, Zea mays
cggccgccctttttttttttttttacaagtaagtccactgcacatcgccggttccactctgcgtgttctctcgaccgacagtttttctctcttgtcggtggctcaagctcagctcaaccatatcgcgcagctgcatgccggccaggtccatcctagcacgcccaaaaatagaccagacatgggggagaagaagaggatgcattacaagtagtagataatcacgcttggatgtgatgtctctcatcttggaaagccagtggcaatgcctgcttcagcttttaaaatggtcgtgctctgctgtctgctcagccacgcacatcatcaaatgccgatcacaggtcgtgctcgggcttgtccacgccgtcgccgccgcccagctgaggttgtgcgatcgccgccggacgagctgcggggacgaggcggcggccttgtcgtcgtcatcggcgtcggggctcgcccgggccaccagcagcctcgagatgctgccgcggcagaacgggcaggccggcgacggcggcgtcagcgtcgccgggttcggcttgctgtggcagcacagcgccagcgtgcacgccccgcccacctggtgcccgcagtcctccacctcgatgctgcacgcctgctcgaagcagatgcagcacagctccgcgtcgctggcctgtcatgagtcagcacagatgaaggaagggtcggtgggtgatgcatccgttcctcatttaccagcaacgcaccaccagatgatgacgatgatgatcaaggttcattggattgtcacaaagcactgaatgaacacgcgtacctccgaggacgcttcgtcaatggcatcgtgctcgcaaggcgaagtaggcgatggctgcgaatacttggtgatgcccttgaggatcttctcctccctctccctattggcgtccatcagtgccgcttccaggagagccttcgcctccgggtccagctcgctgatgaacttgagcggggaaggccacaccatgggctccgccgccgacgggttcagcagcgccgcgcacgccccgtggttgcgcttcagcgccacggagtaaggaatcctcctgcagggacccaagaccatccatccattcattcgatccaacaaaagcgcacttcgacaacgacgtcgggactcgggacgcggtcgacag

SEQ ID NO: 21233 - DNA, 1976 bp, Zea mays
ctcgtgccggcttctcgtgccgttttttttttttttttttctttttttttttttttttttttttttttttttttttttttggaaatggaatctagtactatatactatagccggtcggtgacaatggaatacggcaatggccaggtgaacaaatcctggcacgcccaagaataggattgacagacagggacatggggagaagaagaagaaaaggatgcggttattttcgcagcaagcagtcacgcttggcttggattcgattggatgtccgcaatggccccgcgctcggctccacatgcgcaggatccaatgccgatcacgggtcgtgctcgggcttgtccacgccgcagccgtcgctgtcggccatcgtccggctcgacccgcgcccgatcttggagaaggaaccggccacggcggacgacagccccttgaagctgctgctgccgccgtcgctgaggttgtgcgaccgccgggaccgccgccggacgagctgcggggaggaggcagccgctgccgctgccgctgccgccgacttctcggtgtccgcgtcgtcgctgcttgcccgggccaccagcagcagccgcgagatgctgccgcggcagaacgggcaggctggcgacggcagcgctagcgtcaccgggtcgggcttgctgtggcagcacagcgcgagcgtgcacggcgcgcacatctggtgcccgcagtcctgcacctccatcgtgcacgcctggtcgaagcagatgcagcacagctccgcgtcgctggcgctggcatctgaggacgcgtcgtcgatggcgtcggcgtcggcggcgtcgctcgcgtggtcccaggtgggaggatgcggagagtgcttggtgcccctgaggatcttctcctccctctccctgttggcttccgtcagcgccgcttcaaggagcgccttggcctccggctccagctcgctgatgaacttgaacggggacggccacaccatgggctccgccgccgacgggttcagcagcgccgcgcacgcctcgtggttgcgcttcagcgccacggcgtaagggatcctccctgctgaatccctccggagacgatccgctccccaggcgagcagcttccgggtgcaatccaggctcccgctgcgagcggcgaggtgcagcgacgtgctaccaggaaacccgtatgagccggtcaaagcggagacgatggcaccgttctccagcagcgcctgcacgcagccggggcggccctgcctggcggcgaggtggagcggcgtggcgccgtggtcgtctctcacgttgacgaaccgagcgaaaccccatgagttggccaccggcgtggtccgcgccgccgtgaggatggcctgcaggcagccgacgtggccgaagtaggacgcgtggtgcaggcaggtccgcccgtgctgggagtcgaacatgaggatattggcgccggcctgaaggagcttcagcacgcagtcggtcttgccgtgcatcgccgcgagcatcagcggcgtctgcttgtgccgattcaccacgtccggcggcaccccgtgatccaagaccattgacagcacctcgaggcggccatttgcggcggcgatgtggagcgcggagaggcggtcgtagagcgtggcgcggcgggcgagagaggggtcggcgtcgaggagcgcgtccagggcctcgaggtccccgacctgcgccgcgcggaagtagtcgtgctcgtcgccggtgcgggcgcagctgacgccgtgccccatggctgccgagccgccggtcgctcgctctctctctgttttttttctttttctttatagggggttaggggggtaacagaggagagcggctgctccagcccgactccacccgccggcggcgaggtggggaggggggaggtaggtgccgggtccagacgcagcgccgagggcagcgtgggatggggcccggccggcggggagccacccaatggatcgaccccggccggcctcgaggtacccaatg

SEQ ID NO: 21234 - DNA, 2488 bp, Zea mays
  misc_feature (2455)..(2464): n is a, c, g, or t
gacccccgggttcgccgtagttcaccagagttcacacaaaaatcacaagcaagcagtcgcgtgtgtagctcgcaacaatggcgacgaaccccggcctcttcaccgagtggccgtggaagaagctcggcaacttcaagtacctgctgctggcgccgtgggtggcgcacggcggctaccaagcggcgaccaaggggtggagggcggccgacctggggtacgtggccatcctcccgtcgctgctcctccgggcgctgcacaaccaggcgtggatcaccgcgtcccgcctgcagagcgcgcgcggccggcggcaggtcgtggaccgcggcatcgagttcgagcaggtggaccgcgagcgcaactgggacgaccagatcctgctcagcggcatcctcctgtacctgggctccacctacctgccggggggccagcacctgccgctgtggcgcgcggacggcgccgcgctcatcgccctgctgcacgccggcccccgtcgagctcgtctactactggctgcaccgcgcgctgcaccaccacttcctctactcccgctaccactcccaccaccacgcctccatcgtcaccgagccaatcacctccgtcatccatccatttgctgagctcgtggcgtatgaactattgttctcaatcccattgattgtgtgcaccttgaacggaactgcttcaattattgcatttgagatttacgtgatctacatcgacttcatgaacaacatgggccactgcaactttgaattggtgcccaattggctcttcaaatggttccctcctctcaagtacctcatgtacacaccctcgtttcattctcttcaccacactcagttcaggacaaactactccctgttcatgccattctatgactacatatataacaccatggacaagtcatcggacacgttgtatgagaagtcactcaagggaaaagaagaaacggcagatgtggttcaccttacccaccttaccagcctgcactccatctatcacatgaggcccgggtttgcagaatatgcttctagaccttacactgccaagtggtatgtgcggatgatgtggccgatgtcatggctctccatggttctgacatggtcatatggttcttcatttactgttgagaggaacgtcatgaagaaactcaaaatgcaatcatgggtcatcccaagatacagtttccattatggattgacttgggagaaggaagcaatcaatagcctcgttgagaaggcaatatgtgaagctgacaagaaaggagctaaagttgttaccctcggactccttaaccaggcacataacctcaacagaaatggagaactttatcttcagaagtacccaaagttgggagtaagactcgtagatggcaccagcttagctgctgcagtagttgtgaatagtgttcctcaaggcacagatcaagttgttctcgcagggaatatttccaaagttgctcgtgctgttgctgcagcattgtgtaggaagaatatcaaggtagtaatgaccaacaagcaggattatcattttcttaagcctaacatggcagaagatgcagctgagaaccttttgttttcaaagacaactactgcaaaggtgtggttaattggggatcgtctagatgcttctgagcagtttaaggcacagaaagggacccagtttatcccatattcacagtttccaccaagaatggcacgcaaggacacctgcacctactcgacaactcctgcaatggttgtgcctaaaacactacagaatgtgcactcctgtgagaattggctgccaaggagggtcatgagtgcatggcgcattgctggaatggttcatgcattggagggatggaacgagcatgagtgtggggacatcgtgctagacatggagaaagtgtggtctggtgctcttctgcatggtttccgccctgtggctcaagtttgattctccggttgcaaatgcaaggcagcacaataagttcttgaaagttataacataatgctcacgagaactatgctacatacatattagtatgttggtgttctgtacttctgtttctccatgctctgcctcttatcacttaagacatctgctatctatgaagttaagatgaactcatgtagtgtaaaaaccattctgcagaagcagggtgaacaatagcatctctacaatggtaagaggggatgggatgtagtatataagtgagtctgatctactgctagatgtttactactttattccccccctacgctcaaagatcaacgatgaattaattatgcgtcgatatttctccatgcatcaagccatatttcaacaaggaaaagtatgagaaatgctattccttctccatgtagagatgtggatgaaagatctgcttcaatgcttcattttgttcatgatccagagaaagtagagatgtcatgtaagatgtaacagtggcccatattgcccatggcgaaannnnnnnnnncgtggccaacatatgctctgctgg

SEQ ID NO: 21235 - DNA, 2500 bp, Zea mays
ctcgaggcccgttggttacctccgggccggccggcagttagtagttcaccagagttcacacaaaaatcacaagcaagcagtcgcgtgtgtagctcgcaacaatggcgacgaaccccggcctcttcaccgagtggccgtggaagaagctcggcaacttcaagtacctgctgctggcgccgtgggtggcgcacggcggctacctagcggcgaccaaggggtggagggcggccgacctggggtacgtggccatcctcccgtcgctgctcctccgggcgctgcacaaccaggcgtggatcaccgcgtcccgcctgcagagcgcgcgcggccggcggcaggtcgtggaccgcggcatcgagttcgagcaggtggaccgcgagcgcaactgggacgaccagatcctgctcagcggcatcctcctgtacctgggctccacctacctgccggggggccagcacctgccgctgtggcgcgcggacggcgccgcgctcatcgcgctgctgcacgccggccccgtcgagctcgtctactactggctgcaccgcgcgctgcaccaccacttcctctactcccgctaccactcccaccaccacgcctccatcgtcaccgagccaatcacctccgtcatccatccatttgctgagctcgtggcgtatgaactattgttctcaatcccattgattgtgtgcaccttgaacggaactgcttcaattattgcatttgagatttacgtgatctacatcgacttcatgaacaacatgggccactgcaactttgaattggtgcccaattggctcttcaaatggttccctcctctcaagtatctcatgtacacaccctcgtttcattctcttcaccacactcagttcaggacaaactactccctgttcatgccattctatgactacatatataacaccatggacaagtcatcggacacgttgtatgagaagtcactcaagggaaaagaagaaacggcagatgtggttcaccttacccaccttaccagcctgcactccatctatcatatgaggcccgggtttgcagaatatgcttctagaccttacactgccaagtggtatgtgcggatgatgtggccgatgtcatggctctccatggttctgacatggtcatatggttcttcatttactgttgagaggaacgtcatgaagaaactcaaaatgcaatcatgggtcatcccaagatacagtttccattatggattgagttgggagaaggaagcaatcaatagcctcgttgagaaggcaatatgtgaagctgacaagaaaggagctaaagttgttaccctcggactccttaaccaggcacataacctcaacagaaatggagaactttatcttcagaagtgcccaaagttgggagtaagactcgtagatggcaccagcttagctgctgcagtagttgtgaatagtgttcctcaaggcacagatcaagttgttctcgcagggaatatttccaaagttgctcgtgctgttgccgcagcattgtgtaggaagaatatcaaggtagtaatgaccaacaagcaggattaccattttcttaagcctaacatggcagaagatgcagctgagaaccttttgttttcaaagacaactactgcaaaggtgtggttaattggggatggtctagatgcttctgagcagtttaaggcacagaaagggacccagtttatcccatattcacagtttccaccaagaatggcacgcaaggacacctgcacctactcgacaactcctgcaatggttgtacctaaaacactacagaatgtgcactcctgtgagaattggctgccaaggagggtcatgagtgcatggcgcattgctggaatggttcatgcattggagggatggaacgagcatgagtgtggggacatcgtgctagacatggagaaaatgtggtctggtgctcttctgcatggtttccgccctgtggctcaagtttgattctccagttgcaaatgcaaggcagcacaataagttattgaaagttataacataatgctcgcgagaactatgctacatacatatcagtatgttggtgttctgtacttctgtttgtccatgctctgcctcttatcacttaagacatctgctatctatgaagttaagatgaactcatgtagtgtaaaaaccattctgcagaagcagggtgaaaaatagcatctctacaatggtaagaggggatgggatgtagtatataagtgagtctgatctactgctagatgtttactactttattcacaccctacgctcaaagatcaacgatgaattaattatgcgtcgatatttctccatgcatcaatgcatatttcaacaaggaaaagtatgagaaatgctattcattctcccatgtagagatgtggatgaaagatctgcttcaatgcttcattttgttcatgatccagagaaagtagagatgtcatgtaagatgtaacagtggcccatattgcccatgacgaaaggcaataaaacgtgaccaacat

SEQ ID NO: 21236 - DNA, 1353 bp, Zea mays
gtgaaggctacttgattatagcatgattcgttaaactgtaaccggaaccagcgaattacaccacctgaagtccagaaaggagcaaccagcatgcaaagctgtttgtacgcgagatgcatgcaagggacggatagacagtataataacaaccggaaattcacgtcgatcagctagtcactgcctttgcagggtaatcgaacggcagtggctgcacgtcgtcactgagcgaactggcgtgcctgaaaccgtacgccctcagcacctggtcgtcggcgaagttgagcgcgcggcgcatgccctggtcgcagctgtccccggagtagtgctcgttgcgctgcccactgcacggctgacaccccgtgaagtgcgtcacgaacgggcggcgccacccgtgcaccccggtctccgccagcccggccccgcccagggcggcgttccttgccaccgcgtactccgcgtgctccctctccgcgtgccgcctccgcagcgcggcagctcccggccgccgctccatcgcctcgtacctctccgtcatgttggcgagccgccccacgatctccatccagtagccctcgaagtagtagccgctctccaggaacaccttgtcccgccaccggctgccctcctgcagcagcatgtacacgagcgcggactggtcgtccgactcgtcgaacaccttgtccttgaacgtggacttgagcacggcgccccagtgctggtagtccggggagtcgggacccatggcggcccacgcgtccatgaagtcgagcgaccactggcagttccggatgaggaacacgccggcgttgaggctggtccaggagctggcctcgaacacgaggctcggccagccgtggacgacgaggttgtgggcgcggtaccggcgcagcgggaggcggaagtccatgtcggtgagcacggcgtcggagtcgacccaccacacccactccgcctccgggtgcgccaccatggcggcgcggatcaccggtatcttggcccagtaccggtccatcgacggccgcagccgcgccctggggtacagcagctgcacgcccgggcgccggcggtagtcggccttgttcttgagcagccgcatcagcgtgtggtctccgcccggggaccggcacggcgtcggctgcgagccggacaccatgaggacgcgccccttctcgccaccgccggcgaactccgggtgcgcgcgcagccacccggcgcgcttctcgtcccaccccgtgatgggccggtccacggtgtacgccagcgccgggtcgtcgtagaacgtgtgggcggcggcaccaccaccaccgccggcggcgtccaaggatgatgagccagagccagaggatgggactg

SEQ ID NO: 21237 - DNA, 1833 bp, Zea mays
  misc_feature (1822)..(1822): n is a, c, g, or t
tagcgtggtcgcggccgaggtactttttttttttttttttttttgcccacatcatattgtaaaattatctttttggcttgttttcaaaacatccttctcggttctcaaggtgtgtaattatcatgtgatagtttatcacttattctgaatttacaacacatattacactttcagacttcatcatatacaggaaaggcactacgtcaactcaatagcatcacaacgcagtataaaccaacaaaaactattagtatccaaaaaataattgcaaataaacaagttgaaatgaaaccttatgatccattaagattttggatttcaactttcaaagtttggagcttacgctcgacagcagatagctcaccctgaacgccctgtaaccaatctatttttcgctgacatgcttcctggtaaggtttgctgataacctcaacgaagcggattaggttattagcactctgtgagatatccttttggatagcttcatcaacttttcgagagagttcatcagcagccttgttaatcttgtctattgcatgcttccgccgaccagggaaacttgataaaacaaaaaaaccgccagctgagcaaagagcaagggcaagaagatcttcaagggtagttgacaaaacagatgtcaacagagaagctgacagtccagcaatacctagccctccaaatgttccaaaagccaattctcgaatttcctcttcaaaatctttggcggcagcactggcattgaagccttccagtgcctttatggtgagtttctccccttcattaacaagcccatttggatctaacagagccctttcttccggagcaaccagtgcatcccatctttcacagaaacactccaaatatacatttgcttcgcgggtattgctagaactcaaccatgtcgagtagtcacctagtaaattcacagcatcatcaagggttggactcagaatatcattctgaacaaatgatgtggctctcatggaactgcctgtttttcctttgatcgtgtatgcaaaaataaggtcaatatttgacagctgaagtgtagattccatgagtgtaactgctcgaccttttgctctctcaatgagagacgaaatctggttctgccaggacctgctatcagacttaagtttgatggcataattgtttgcaccataaacaagatccttgatggatgctaagtcttcaacagccttttcatattctagtttcaccagcctttgacacgaagttaacaatcgatctgcaatgcctattggtgtttcaagtttcaggccgccctcctttcttttccattgttccgttgaactatctaagaaactcagtaagtaatcctcaagttcaaaaaatttgctgcttctccatctaggatcattatacatagcttcggttgaatgctttccatcactgtttttggaatatgaaagtttggcttccagagcagagcgtgaagatacaggaaacagtgtgacatcctctgcggtaagcaatttcattgcattttccttgacaaatgcagtagcttcttcaagctcattgctgttccgatagaggtccaatttatttagaataaatacaactttcttcttccactgctggacatactgaagaaatccaacctcactttcagttaatggtctatctgatgataggacaaagagcaccaaatcagctcgtggcacgtattcttcagtgagtcgttgctgcctctgaagaaaacatttgttccaggtgtatcaactagattcatttcctttaaaattggaacagataaatagcacatgaattgaccatctggatgcctctcacatcgttncaaagttttca

SEQ ID NO: 21238 - DNA, 1002 bp, Zea mays
tttttttttttttttttctagtagaaccgatccgttaaaataataataaaaaaaacaaaaccgttgcctgccattgagtccgacccactcgctttcttacacagccacacaggcaagcattcagaaacgacaaaaaaaaaaaacgttgcttgttattgattactgaaattaacgtaaccgaatcagcccttcttcccctgcgccgccagctggtaaaagagggatccgtcgtacacggccctgacggtgtccttgggcaggcgcccgtccttgtccttggccagcttgtacagcatctcccactccgacttggctcccagccatcctgcgacgtccatcttctcccggttatccttgagcatctcgtcgagctcgtctttcgtcagggcgttcggtacggtcttggcgtgcttggtgaacatctcgtccagcttcgcgggaacgaaccttccttgagcgtcgtaggcgcctgtgtcgcttccatgtttgcccttctgaatgttctctacgtagatatccatgcttgaggagttggaattgtcaggtctggtcttgggcccgagggcgccgtttatgaacgcggcgctggctttggccgtgacatcgccgactccgacgtcccgcagaccttggtaggtctcgtcgaaggtgatgatgccgtcgtggttgcggtcgaagaacgccacgtgcttctgcagctccgtcatgccgttgccgcctgccggggcgacgcccgcagccgccgcgccgtgatcaccatgcccacccaaggacaccgccaggagcagcaggaggaggagaggcgcggcggcagcccccgagcgcgaccgcggccattgccgtcgtcgtcggccgtccatcgcctccgcctagctgtgcgtccgtacgtcctctcgcgcgctggctggccggctgctcgtcctgaatcggaggtgtgcgttgcgcgcctcgatcggttattcagttataggacgggctcccgcgccgggccaaataaggttt

SEQ ID NO: 21239 - DNA, 6667 bp, Zea mays
ctgcagaacacagctccagatgcggtctcaacacattctccattattttatcatttcttcttcctgcgttttgaggcacctgaatactttgctgttttatgtacatgcatgcctgattgccttcccaccttctgaacccgaaagaaaatggccgaggagtgaggagaagaaggttcctattggggggaatccctgggaagagattcagtggccaaggggtggattcagtattcagagcaagtcatgtagatagacaaatataaacacaacactctcttgactggctggtactggcacttgccatggtgagtaccgcccagcagtactcggtttagtggtacacatttccaagttaattaaatgggtggttagacagcaaggatccaaaatgtggcaagctttcataacatggtctagaaaaagggcaagttgcaccacattgcatagctaaaaaaaataaattgaaattacaggccaccaggattgatgtgagaggatccacaccatacatcttggccttactggtgaggatctaagtcaaacacatcaacaccccgggaggcgaccaaactactgtaggcgttccataataactccctaaccatcagaagactagctagacacttcggcgacggcacactggatagagtagaactcgcttgcttcacctttcatcgtccggtcagttaccaagcagagaaggatctcaaaagtgaaaccaacaaacaggccgggatccagtgtaggtagtagaggaggttaacccagttcagtctccgggctgtcctgggggcatctgatcagctccagtatgttcaccacctcacccatgtctggcctgttagacggaacctgggaagtgcagaccagaccgagcttcatgatcggaacggcctcctccagcggaaacttgccgcagagcctctcgtcgacgcactcttccaccttgccttcgtccagagccgccctcaccacatcgcagagcacgaccacgtcgtcctccatgtactccacgggcgtcctccctgtcaggatctcgaggataaggacgccgaacccgtacacgtcgcatttctccgtgatcttcacggtcctgcacgcaaactctggagccatgtatccaagcgcgctctgcaccttgctacttaagacgtagcggtccagcattggaagcagcttcgctagcccataatctcctacctttgcctcgcctgatccgtcgagcaggatgttgcttgatttcagattgtagtggataatatcatgcctgtggagatgagcaaggcttctcgctataccgaggactatgtcaaacctctccttccatggcaggcagtttgtggtggatgactcatgcaattgtttgtgcaggttgcccccggagacaaactcataaatgagaagctgaagcgacggcgtccagtaatatccctttagcgcaactaggttgcgatggcgtagcttacccagcatcttcacttctctctcaaattcaacttgagatttaaccaagcttgacacagtgagcttcttgatggcaacaggttgtccatctcgaagagtggtcttgtagacagtgccaaaaccaccacgcccaagctcgcagtccttgttcagaagagcatgggtgctggcactgaactctggatttcctcctccaaacatgacaagcttccctgcgttcatgtcggttgttggcgactggctgagatatccatctgagagttccaggacagcaccagaatgagatccaggggcacgcactcgaaggttaagaacagtgatggtaatgacaccaacagcaattagaacagcagcaccaattgcaacaagggccgagatgctgagtatggttttcttatgatggcgaccaccatcaggcacaagctcggttggtgatattggatcggaagaagtgtttgggttcagcacgattggttttggtagcacaccaggacaagatgaattgagcttcgcgccacaaaggccaggattatccgacacacaagatagggggatggtgtcaaagaagctaccgggagggagatccccagagagctggttatgtgaaacattgaattgcaagaggtgggggagattagaaagctgctttggtagaacaccagtaagcttgttctgagaaagatccacaatctcgagattggtaaggttagatagtgtttccggaatcactcctgttaaactgttatgagaaagatccctgcaagagatagtaaccaagtgagcatataccagagaatgtgggggtttagcatgtaaagctccaaacatttatccatccactggattggatcagaaagaagtgcttaaacttacagtgatgcgagggcagagcaattgccaatctgagctgggatgttgccagtcaggaagttcttccccagcctcaactccttcaatgactcccctccttttgaagctggaatgcacccatttagccggttggcagtaaaatcaagaacctccagtgacttcatctccaaaatgctggccggaatacttccatacattgagttccatgacatgttcaatgactgcaagttctgcagcctcgagatttccgatggtataactccagagaaggcattgtttgacaagtccactccttgaagcactgaagaagcatttgcaggcacttttaggtccccgctcaatgtgttctgcgacaccgacacccattgcacactggaactgagaacccaggtaggcagtgcacccgtaagagaattccagctgacatcaacatgcatcaggctcttgcatccaccaattgattcaggtaaggctccggtgaacccattccctgacaacctcagctccctcagtgacatcaacccaccaatagaccccgggatctcgccagacaacctgttccccgacaaatccagcatttccaggcttgtcatttctccaaaccatgtcgggacactcccagtgaactcatttgagctcaaatcaaggtatgtgcaggtggagagcctcctcagggactcaggtaagttgccggacagcgagttggacccaagatccactgacctgagcagcgggcagtccccaatgtcgtccgggaggctaccagtgagacggttgcctcgcaggttaagctcccgaaggttaaacatcctgctgataccgatcgggaggtcgccggtgacggcattgcccgagatgtccagcgtgcgcagcgcgttgagggaccaaatgtcgctgggcagcgcgccgtccaggcggttggaggagaggttgagcgacgcgagcgtggcgcacgcggcgacgtcccgcgggatcccgccggagaaggcgttgttggcgagcgggccgtcgcggagggagcggcaccggccgaagagcccctccgggacggcgccggcgaatgcgttggcgctgaggtccagcgtctggagcgccgggaggcgggcgaggtcggcggggacgtcgccggagaggttgttgcgggcgagggagagcgactggagcgcctcgaggcggaggaggccccggccgagcttgccggagaggccgaagccggcgagggagagcgcggagacgcggccggtgcgcgcgtcgcaggtgacgccgtcccaggcgcagggccgctcgtcgtcctcgctccacgtcgcgaggcggccgtcggggtccgacacgtcggccttgaacacgatcagccccagcacgtcgtcgcccagccccgcccccgccacgccgcccttggcctccgccgccgccgcgagggcggcgaggtgggcgagaacgagcagcgcgagaggccgcattgctcggcgagacttgggcgaaggacaaggaggcggcggcgcaattaaacgctcagggctgatgcaggaagacgaacgaaccggtgggatgaacggatgagactccgcgggtttgggctcacttaaatctgtgcgtgacgacctcgaagcttcaaatggttctctctcttccttcctgcgtagtactgaagatacaaatgtgagtgtactgagctctagatatgggctccaggaacaaccttgtggtagcagatgtgggtgagtacctgccgagccaggatgcacccgtctacgtcgctgccgccggtgccgactcgccggaaaacttcattgaagaatgcaggcagggagaggggaggaggggcgagagtgggagccgggagggaccgagggaggcagggagcaacggagagtgggctgaggctggaccgctgcgagggagaaagagcgaggagtggaagggagaaacaaaaaataaagatgttccagggtagggccagagctgatcggacggtgacgaacaggttcaccgcacgaccgagggatgggatgggatgggatgggccgcgagggatggttggtggctccgggatgggccattgggccgtgtgcatggaccggggccgagggagtgccccgtgccgtgcgttgggttcctcctcgaaactcgcgtggggccgcgtggttcgaggccgcagagcgcacgggaccggtccgggccgggcgagtcagcgagtagaagtaggaccgggcgaccggcgcggctagactcgtcggtgcttttgaggcaggtgcgcctgcgcgcccatgcgctgcgtcgggtttgcgagtcttccttcttccatggccgcaggatcaggacaatagaggcgactatttttttctacgaatacagaaccgattaatttacgacgatgctaaaactacctagaatttttaaagtgtctcttatgacagtccatttacttgaaacacaaaagggtttgtaataatactataataattgacgattcaatatattttggggtgggcaaaaaacaccaaacaccaaaaaccataccgaaccaaacaccatacaccaaaatttacggtttattcggtttttgtatttggtgcggtatggattttagctctatttggtatttggtatggttttcaatatttagacaccaaaaataccaaaataccgaaacgtagcaaaacaacgtcttaaaccttagactcatatcattataatttttaagaactagtatgtgttagttgctcttattcaacactaatttgtttatgcaattttattaagtactagttgatgaattatcagtatgttctttatgtgattttacgtttgcagtttcaaactgctagttgtttgatgattgtaaaaataccaaacaccgaactgaacatcaaattctgcggtttttttttcatttgtgaacaaaaagtttggttttcattttccaagcaccaaacttttttgacaccagataaagcgcaccgaataaaccaatagaacggaatgcccgtccctgttatttctggaacgaggcagaacaaagtggttagcgtgaccacaaagctttggctttggctttggctttgaatgactggtgcagtgcagaccatgctatttgcaagcgcactcccagattttactatactccactccactccacattagtcacgggaactagtctcttttaaaagttgaaagaactgtgcatgcacgggtttgcacgatgaacacgtaccggcgtacaccgctggccttatttagataaagagggattaaagtggattgaagtgtattttaaggattgaaaggaaatttagttcatattacatttcaatacatcatataccaccttaatccacttcaatgtctctttttctaaacaacgtctgaactgggcgcgccagccgttcatacaccggcgctgctgcacgctaccgccgtcgctggccgaatgaaaaagcccgcaacgcagagctcgagcaccgcgcacggcaaccacttgatggttgatggctggctgccccgtccaactccaaccgcgcggcgcgcgggaagggaattgatggccgctgcgccgcctgtcccggcgcgctgctgcccccgcaggacaggggggcatcacatcaggggcgttttgattgctgccatcaatacgcattcattgcgccccgccgtgcatgcgtggacggggccccgccgtcgtcctcgttccctccgcatccaccgcgtccgcagcggcagcgaggagcagtcagtctgtgacggtgacggtgacggcgacgagcgggtcggacaacaaagcaggcaggcaggcaggcaggaagctgttgcctgggagaatgggaccgcctggcctgtggtgtgactggtacgtcctgccctacgatgcgagtacgagagagcctatgaatggggaggtggccatgaacggtcgaatctcacttttcatcgaccgtcaggtagaggtagtgggctagtggccatggatttgtacttgcccggaattcatgtggcccaaggggagtgaatttatcgttgtcactcacacaaagaagttttcttcttcaaactggagcaggattgcacttggacggaccttcatggctcgtaaaatgatgtctctctgatctatcgtgagccattatacactacagtatccgcttgatatccggtggctgcctataacttatatatcgaataagagacgaccataatccacgagaatattaatggatctttagcttgaaagattattagagcagccccatctctaaatcatagatttagaaagttgctaaataactttgggggttaaaaaatggtgagttctccgatagcctctaaatagagaaag

SEQ ID NO: 21240 - DNA, 963 bp, Zea mays
gggatggtgctttctacggttccaaaaatcgatattggtgtgtttgatgcctttaagaggaaatttcaatgtgcaaccttacagctggattttccgccgcccgcccccccccccctgacttattctgctgaggatgaagcaaaaatcgaaaggcctgtgatgatacacagggcaatcctaggttctgttgaaaggatgtttgccattcttttggagcattacaatggcaaatggcccttatggctaagccctcgccaggccattgtttgttcagtatcttctggttcagtggaatatgcgaaacaggttcttgccatgctacatgaagctgatttccatgttgatattgatgtgagtgacaggacaatacaaaagaaggtacgggaagcccaggtagctcaattcaactacattcttgtcgtaggcgcacaggaggccgagactggaaatgtctgcgttagggtaagagataatgccgacctggccacaatgagcgttgatggcctcatcacacgtttgagggaggaaatcgtagccttcaaatgattttgatgctgcataatttcctagcacttcgcaatcattgactgttcatttgtgattttgattgagttttcagggaacagtactgagttcctccaaggctccaagtgtattcttgttggtacggttggaagctactaagggcatatttagaagcacctagtttttaataaactggtttataaaaattgagatggttccaaacatatcggtttatatcccggatttgtagtttttcggttattcccaatacacatggattggatgagattggaaaaaattgagaagaagtttgacttgcttgggatttaaacccatccaatcccactcaatccacatggattgagagctaaccgaacaagtccttatagaaactggatttctagcttcttaaaaattaagaagctagtctttgttagt

SEQ ID NO: 21241 - DNA, 2543 bp, Zea mays
gggtacccttgccggccgtgacgggcgattgataaaaacctagaggcgaccggctagcgccatatcccgcgccgccgccgccgccgccaacgcttaatgctagtgttcctccggcgaggcctcttgctcgtccggcagcccaccacccgcgtccttgccaaaccgtctctccgccctgcttgtctcttcgtccaccacttcgccgtcgacacgatgggtgagggttctgctgctggtaaggacgcgaaggggaaggggaaggggaagaccaaggccgccgccgcggattcggccctggtcgttcgcgacgactcctacctagaggcggtcactcagaagaggattcgcttcttcgaggagatccaggcaaggcaagccgtcgagcggctgaatatcggcggcgaagttatcaaggtaactttgcctgatggcgctatcaaggagggtaagaaatggataacaaccccaatggatattgctaaggagatatcaagtggatttgcagctagttgtttgatagctcaagtggacgaaacactctgggacatggggaggccactcgaaggtgattgtaaattgcaaatgttcaagtttgataccaatgaaggtcgtgacaccttctggcactcaagtgctcatattcttggagaatctattgagagagcatatggatgcaagctgtgtattgggccttgcaccacaagaggggagggtttctactatgatgcttactacaatgatcagacattgaatgaggagcactttggtatcattgaaaaccaagctaaaaaggctgttgcggaaaagcaaccgtttgaacgcattgaggtcagcagggcagaagctcttgaaatgtttgctgagaatgaattcaaggttgaaatcattaatgagttgcctgaggacaagaccattactgtatacaggtgtggtcctttagttgacctatgccgtgggccacacatcccaaatacttcctttgtcaaagctttcgcttgtctgaaggcttcatcatcatattggagaggaaaagttgaccgcgaaagcctgcagagagtatatggaatttctttccctgattctcgacgtctcacggaatataaacattttctagaggaagctaagaaacgtgatcataggatattagggaaagcacaggaactcttctttttccatgaacttagccctggaagctgcttcttccttccacatggtgccaggatatataacaaactgatggacttcatgcgacaacagtacagagatagaggataccaagaggtgttgagcccaaatatttacaatatgcaactatgggaaacttctggacacgccgcaaactataaggagaacatgtttgtttttgagatcgagaaacaggaatttggacttaagccaatgaattgtccaggacactgtctaatgtttgctaatagggttcggtcgtacagagagttgcctcttcgcatggctgattttggagtgcttcatagaaatgagcttagtggtgctcttacaggtttgacacgtgttagaagattccagcaggatgatgctcatatcttctgcagagaagaccaaatcaaggatgaagttaaggctgttttggaattcatcaattatgtttatgagatatttggcttcaaatatgagttggagttgtctacgagaccagagaagtatctaggtgaagttgaaacttggaacaaagctgaacaacaattgacagaagctttaaatgagtttgggaagccatggaagattaatgaaggggatggtgctttctacggcccaaaaattgatattggtgtgtttgatgcccttaagaggaaatttcagtgtgcaaccctacagctggattttcagctgcccattcggttcaagctggcttattctgctgaggatgaagccaaaattgaaaggcctgtgatgatacacagggcaatcctaggttcggttgaaaggatgcttgccattcttttggagcattacaatggtaaatggcccttatggctaagccctcgccaggccattgtttgctcggtatcttctggttcagtggaatatgcgaaacaggttcttgccactctacatgaagctggttttcatgttgatattgacgcgagtgacaggacaatacaaaagaaggtacgggaagctcaactggcccaattcaactacattcttgtcgtaggtgcacaagaggccgagactggaaatatatgcgttagggtaagagacaatgctgacctggtcacaacgagtgtagatggcttcatcacacgtttgagggaggaaatcgcagccttcaaatgattttgatgctgcataatttcctactactcgtttgtgattttgacgagtttttagtgaccagcatcgagttcctcgtgttactgttcttgtttgtatgaagctaaaaggttgtctttttgttattaattacagatgcgaagttaaatactgccgctagtaaaaaaatatgcttgttgacttccagtgattaaaaaaaaaaaaactcagggggggccccgggtacccaa

SEQ ID NO: 21242 - DNA, 1567 bp, Zea mays
  misc_feature (46)..(46): n is a, c, g, or t
  misc_feature (48)..(48): n is a, c, g, or t
ggttttttttttacaaaaaaaaataattttttttaggggggggggnanaaaaattttttccttcctcccccaccccaaaggggggggccacactttttgtgggaaaaggggagaaatctttggcgggggcccttttttttttttatttcccccccccttgggaaaaaaagggggggatttttcccaaaagggggattaaattttgggttacccccccgggttttttcccccacccccggcgtgtttaaaaaccccggcccaaggaacccccgctaaatccccccccctttttggggggaaatttgggttccgggcccccccccccccgtgggggtcgccggcgagatgcctttttttttttttttttcttttttgtttagagctacggtgattgcaggctatcccacttctcaaaataaacactccatgaagctcataaccattatcaggacatcgccacaatagaagggcgaaatttgacatcacattgtcaaaatattatgtccagaccctcaaaactacagatttgtgttcagtggaaccacaaatctcatctacgaaaataagcaggcatcaactaaatctgggttttgctgaaattcctaacgatggccatcaccgaagggccggagtcatgttccatagctgcgatctccagcatccccaaggcctgggattatgaaacctttctcgtttacaatttgatccatggctcctgtatacacacaaatccttgggaatctttgattgagcttcttgagggcaggaggggcagcaacagctgatataatttttatctgactgatttcagctccacgttccataaccagatcaactgctgcagtgactgttccaccagttgctagcataggatccacaatgaggattttacatcctttcgggaatctatcaggtagcttatttaagtaaacagaggccatcagtgttgtctcatcccgggccatacctaaatggaaagttctagttgaaggcaaaattgatgttgcgagatctgcaagtgcaagccctgctctaagaataggtacaatcattattggctccatctcactgacagattcaacaacctcagtgcccacaggtgactggatctgccgtgttactgtcggcaaccaatctcgtgttgcctcatagattagcaatctccctagctcccccattgcactcctgaaggcgtgggaaggggtggagcgatcgcggagtactgagacccagtggctgatcagcggatgcaccggcaccaccaccttgaaatcgtccatggatacggcggccgcctgtccgttgttacagttctccatcctcagcacgagattgggacctttgctggaggcctatggggtttaaagagaataaattaatcggtgaaagaaagcggcagggcggcgggatggatgtgcaggatgggagggcggcggggaagcagggatggatatgggcgaggtcggcgtgacggccgtgctgcaattgtgctgcgcgtgttgttgcgcaggacgggaaggcggcggagaagcggggatacgggggaggtcggcgtgctgcaattgtt

SEQ ID NO: 21243 - DNA, 1500 bp, Zea mays
gtagaagctaaggcgcgagtgataggagggttttggttcagagaggagcggggcaatggcgggtggtcgtggctcgtcggcggcgaggctagcgctgctactggtggtggtggtggcggcggtggcgggcggcgccgtggcggggggcaaggtggtgcacgtggaggaggcgcaccggcggagcatgctggccaatggcctcggctcggcccctcccatggggtggaacagctggaaccatttccagtgcgacggcaacggcgaggtggtcatcagggagaccgcggacgcgctcgtgtcgaccggactcgccgctctcggctacagatacgtcaacatcgatgattgctgggcagagccacaacgtgacgctaagggcaacctggtggccaactccgggacctccccgcccgccggcaaggcgctggcggactacgtccacggcaaggggctcaagctcgggatctactccgacgccgggttccagacctgcgccaaggcccagcccgggtccctcgggcacgaggagctggacgccaagaccttcgcggcatggggggtggattacctcaagtacgacaactgcaacaacggcgacctgaagccgctggagaggtacccggagatgagcagagcactgatgaaggtggggcggccgatctacttctcgctctgcgaatggggcgacatgcacccggcgacgtggggcgcgacctacggcaacagctggaggaccaccaacgacatcgccgacacctgggacagcatgatcgccacggcggaccagaacgaggtgtggtcggagtacgcgcgccccggcggatggaacgatccggacatgctggaggtgggcaacgggggcatgaccaacagcgagtacgtcgtgcacttcagcctctgggcgatctccaaggcgcctctcatcatcggctgcgacgtcaggcacatgtcgcgggagacgtacgccatcctggccaacaaggaggtgatcgccgtcaaccaagatccgctcggcgtgcaggggaagaaggtgcggatggagggcagcagcgagatctgggccgcgccgctctccgagtaccggacggcggtgctgctcctgaaccggcacgccaaggacgaggccaccatcgccgcgcactgggacgacatcggcctccccgccggcacgcccgtcgaggccagggacctgtggctgcacgagacgttggacgccacgttcacggacaagatgagcttcgacgtcgcgccgcactcgtgcaggatgctcgtcctcaagcccaggatccagatccagtgaactacaccaccgctgccgcatgggcgcgcgtacgtgcggccctcacgacgtcaccacgcgtcgattcatttgtactgcaggctactaattgcagacacgtggaatcaaaatcaccaagaatggttcttgttccttgtaaaaaaaaaaaaaaaattccaaatctccaaaacttatagtaattagtgaaggaatccaagcct

SEQ ID NO: 21244 - DNA, 1705 bp, Zea mays
cagcagcattgttgcaacggagcatgtgagaccatgaaaagttatttatgaagatcacaagaaagctattgtcaccactcaaaagagaaagctacattgttacaaagcatcgctaatttctggtctacctgaatacatattgatctaattgtttacattttttttgtcaaatgctccaacaagataagcgtattttacaagaggaagaaaagtttcagagagggctttcttagagtacaagtgttacaccggtccgtctttgtagactaagaatgcactggtcttgcagtaacggcatgctagccccttgccagaggaggtcgggggagagaaagcaaactgtgaaatccccaaagtcctgccttcgcagaaggttttccttgcaacgtccattagttttgaggcaattcgttttcttctgcacgatggtgccacccagatggctcgaaatccacaaagcgcaggaacagcttccgtttcgcaaagtatggcaccagggtcctggcactcttctttgttcttgaccgaacgactgtgccgccttatgatttccctcttgaaactaatactgccgaactctaatgtatgaccattttttcctcgctcagtactactaactggcaaatcattagggcttccttccgtggagcttgggataactctatgtcctgtttttatcggttcagtgacaaggcaccccacgatcctttgtgcagatatgtatagatacaccttgcaaagcttatgcaggagtttcccttcaccaaatcccagctccttctccaccactgtgatcacctctctgaccttacttttcgacatacaagagttctcgtcagttgcaagaacaacccgatcaccgccctcggacctcgctatcactgtctcttttttccaacccttgaaagggactccctcggagtagctcttgtggtacgccctgtgaaccttttcgtcttcgtcgttccctcgggcgtacatcatgccgcacacggagcacgtgtggaggacgaaatcaggctgccctagctccagatggagctgcgcgtagttcctcttcttgctgacgagcccatcgagcctgcagccattggccttccgcttcgcctccgtcgccgcgccgacgtttccctgcccgttcccctcaccgtcgccactaatcggatctgggtccgtctcctgccgctcgaagaacgcgctgatcttgggctgcatcgtcccgcttcgccttccccacgagttctcttccttctcccgtttgtcgttcctgccgctcgaagaacgcgctgatacccagcgagacgtcgttcaccgacgagcaacgacggcggcccgggcgggacggcgggtggcggacacgcacgcgtggagctttgctgcggcgccgcgccacgcgcagacctggggaaggccgacgagaggctagttctctggtgagctgctacgggcgggcggggccgaaccggcgaggggcagttcgcgccaccgtggacagcctgtcggggccgaagtggacgactcggggcgaccgccgcgctgcaacttaggccacaccgcctcagcttaagggccgtcggatgattcggccggtgcggcaggcgggcgggcgccgggcggcagtggccgaggggcgaggttgagtggatgacggtgacggaggcggcgggcgcaggcaggtgcgctacgggctgcggctggtcggtct

SEQ ID NO: 21245 - DNA, 3700 bp, Zea mays
gatgcatataagaaagtttgttttatgtaggagaagacgctcctggaaggccgaccgaagttgattttgacggtcttcacgtcggtttccttatggctcagagtggttttggtggtggaatggtttctatggttgtttgtggctggctggctggctggtcaacctgaaattgacgggattggggcaccgaggctatgtaatcgttgatgaggtcagccggtgttactgttgctctcccgattgagccggatttattctccctgttctattatggtcaaacaacgcggcggcgctggattatttgttccttctcgttgacggcaaccagccagatgagtttgataaaatcttcatcgcatcaggcaaggcaacggtggtagcgaactagagtagttattctctctgccaaactgagccgaaccgagcaacaatggtaatggtatgtacatcccacaaaagtacaaaacggtgtgaaacaaaagcggcagcggcggtggggggaactctctctcagctacaaaattgctggccgtgtaagcacagccgtactagacggaacaccatcagcgccaatatttacacagccacagcacagaaacacaggctggcgctggcctctacagatagaagcgtctactggtcagactcgagccatctcctcagcttgcagagtgcctctggcgacaagctcttgcggcacctgatccttccagccggcacctgctccgagggcgtagccgagcccccggcgaggtcggggacaaagcagacaacgatcacggtgaggttgtcgaaggtctcgagcctcttcgcctccatggcgagctcctgggcactccgcccggggtcatcgtgcctccggaggcccttgcggaccgtgctcaccgcgtgctggctgctcatcacatcccatatcccatcgcagccgatgatgaggaactcgtcgtcttccgtcagggtggtccagtggatctctggctctgcgataaggggcgacggagagccttggggcagcttcatgtcccagtcccctaaagcccgggtcacagagagtacgccgttgaggtacccatcttcgatgtatccaccgcactcgataaccctttgacgctctgcgtcgtatgtcggcctgtgatcctttgacacctccaccgctgtccctttcctacacaggacggcgcggcagtccccagcgtttgctaccaacagcggccggcaagataggaaccaaagattagattggtttttatcacatcacagcactgaaacaaccattatgatctgtagagaactgggttctgtttttaaattacctcccaaggaccaatgctgtcagcgctgtggtgccagaagaacggttgatgactgaatcatcagcaagtgcaaggtcagcccgcaagaaagctctgcggaccgaatcctcaacagattcagcaaatattttatcctcttgtgatgcttgagggaagtcagcatcttcaaagaacaacctcattgcatgtgtttgcatgtaggctgctgcatctgaacccccatgaccgtcaaacacctaaatagatgttaaaagtacaaccaattcaatagggttcagaaactcagattataaatttatgatcgtaataagcctaacatcattcaaagtacataccccgtagaacgcgctaggcgcagagaccatcaacagtgagccaagatgaccagaaagatcatcaattctaatatgctcatcttccatgaaccgcctaggtccaatatcagcaaagctaccagatcgaatgatagggacaaactgcagttgttctgcagatacactactcccagcattagaagatctcttcaactcctgcgccaagcagaaaattgttagctatgctgccgtcttgtagttatatacataatgcgacaagcctaaaatttggttctctgatatgtgtagttaacacaacatcataaaagttctgttttttttaaaattatgatccgccaactatgacactgttagctatgctgctgtcttgtagtcatatacataatgtgataaacctaaattttggttatctgatatgtgtagttaacacaaaacacatcctaaagttatcttttgtttttttaattatgatccacccaactatgacatattcaattgaccaaacaactattctttttctttctgaatgataacaatcaattgattaggcagcacaataaaccaattccgaagaccaagccagcaaatacgtcatgagatggcgaattagacagcttcagcaataattttaggagaaggctatgtgctaagcatttaaaatatgcaacttatcaatatgtatcctacacaaatggatatgaacaaacagaaacagcaaccaaaaataataataaaaggaaagaaaaccctgtccctggaaatttaagttaattcatgcaattcactatattatcgacttgtcgtactcaagaaatcagagcaaataatactctttgtgtggtccaagtaaaatttgactaaaccgcaacaataatccaatagaagctgaaaccgaaaactcaccagatcgggcacctctacggcaacctccaacagcgccttcggcgacgtcgctggctgcacctgcccaggcgccacggcaaccacctcctccatgacatcgacgctcttaacgacgcaccggtggagcggcggctccagcagcggcacgacctgatgcatgacctcagccccggctcccatctccgcctctaatccgctgaacaaccgattttttcccaacaagaaatcctcccaaaaatcactcgcttttttcgcaccctgtgaccacaagaactcccgatccgattccaactctcttcttggcctcaaaattcctccaccgcaaacagatcgatccgagcaccggcggctaatctcgacgagaagcgcgcaaatctcctaaaggagcggcctttcgacaatcaaagaaaaagaggacccgaaagaaactctcccctctttttttttcgtgttcttaagaaaacgcaacacggagcactgacctgacccgatccgaacaagaaagaagttccggccggcccggcgccggaagcagagaggtgtttattatttattcgcgcgtggggtaagacgcgagaggacggcggctgccggtgggcgacgcggctctgtgaccggcaggtggctgttgcgggggcggagcctaggtaccgtgcgcgggcaggagtacagggctaccgccacgcgtgcgcggggggagggtggtcgccggcctcgttttggctagggcagaataagcgatgatgcgtgcttttcacacctttggcgtgtgggaaacggagaccagagagcccgttttggttttccttttatcaattattactaacaataaaacaacatatagattatttatctgaatttccagagagcccgttttaggaaacttagtttcttagtaatttccaggttcattatctgaatttgacggaattacatggactagtggatgttgttttgatagttatttaggcagccattgaaattgaatgtactagagctaatagctaatggttaaaaatttgatagcggaattaactagataactattaggtgttgtttgtatccttcgttttaaaggaattggaacttacttaatatggtagcatatttagtttggaatttaacattccaccactttccatagtttag

SEQ ID NO: 21246 - DNA, 2377 bp, Zea mays
aaaaagagaacccccccccaaaccggggggaaaatctttttgggggccccccccccaccagtgggcctccccccccccgaagccttggggggggggacccaaagggggggtgggggtccccctttttaaaagggtttttggggggacccccgggggcccgggaaaacccccaaaaaaaaatttttcaccaaaaccccattttccccttaggccctttcccaaaaaaagggtttaaaaaaaaggcccctcccaaggggggggaaaccttaaaccccttttttttgggggggccgccccccccggggggggggccccccaaaaccccaaatttccccttttttgggggttttttggttgggaaaaataaaccccttggggccacccaaatccggggggggttttttccccgggggaaactccccccccaaggggggcttcccccccccggggggtattttttttttttttttttttttttttttttttttttttttttttttttttttttttttttttttttttttttttttttttttttttgtttttttcttcttcgcttttttttttttttttttggtagcgaactagagtagttattctctctgccaaactgagccgaaccgagcaacaatggtaatggtatgtacatcccacaaaagtacaaaacggtgtgaaacaaaagcggcagcggcggtggggggaactctctctcagctacaaaattgctggccgtgtaagcacagccgtactagacggaacaccatcagcgccaatatttacacagccacagcacagaaacacaggctggcgctggcctctacagatagaagcgtctactggtcagactcgagccatctcctcagcttgcagagtgcctctggcgacaagctcttgcggcacctgatccttccagccggcacctgctccgagggcgtagccgagcccccggcgaggtcggggacaaagcagacaacgatcacggtgaggttgtcgaaggtctcgagcctcttcgcctccatggcgagctcctgggcactccgcccggggtcatcgtgcctccggaggcccttgcggaccgtgctcaccgcgtgctggctgctcatcacatcccatatcccatcgcagccgatgatgaggaactcgtcgtcttccgtcagggtggtccagtggatctctggctctgcgataaggggcgacggagagccttggggcagcttcatgtcccagtcccctaaagcccgggtcacagagagtacgccgttgaggtacccatcttcgatgtatccaccgcactcgataaccctttgacgctctgcgtcgtatgtcggcctgtgatcctttgacacctccaccgctgtccctttcctacacaggacggcgcggcagtccccagcgtttgctaccaacagttgcctcccaaggaccaatgctgtcagcgctgtggtgccagaagaacggttgatgactgaatcatcagcaagtgcaaggtcagcccgcaagaaagctctgcggaccgaatcctcaacagattcagcaaatattttatcctcttgtgatgcttgagggaagtcagcatcttcaaagaacaacctcattgcatgtgttttcatgtaggctgctgcatctgaacccccatgaccgtcaaacaccccgtagaacgcgctaggcgcagagaccatcaacagtgagccaagatgaccagaaagatcatcaattctaatatgctcatcttccatgaaccgcctaggtccaatatcagcaaagctaccagatcgaatgatagggacaaactgcagttgttctgcagatacactactcccagcattagaagatctcttcaactccagatcgggcacctctacggcaacctccaacagcgccttcggcgacgtcgctggctgcacctgcccaggcgccacggcaaccacctcctccatgacatcgacgctcttaacgacgcaccggtggagcggcggctccagcagcggcacgacctgatgcatgacctcagccccggctcccatctccgcctctaatccgctgaacaaccgattttttcccaacaagaaatcctcccaaaaatcactcgcttttttcgcaccctgtgaccacaagaactcccgatccgattccaactctcttcttggcctcaaaattcctccaccgcaaacagatcgatccgagcaccggcggctaatctcgacgagaagcgcgcaaatctcctaaaggagcggcctttcgacaatcaaagaaaaagaggacccgaaagaaactctcccctctttttttttcgtgttcttaagaaaacgcaacacggagcactgacctgacccgatccgaacaagaaagaagtcccggccggcctcgaggtacccaa

SEQ ID NO: 21247 - DNA, 1141 bp, Zea mays
  misc_feature (1127)..(1127): n is a, c, g, or t
tttttttttttttgggccccgggccccccctcttttttttttttttttttttttctggggatcacataaccctgatctcattaataaatggaggtaccatcacaaccatgtacaaaaatgcataggaattctaggccacacgccatggcacataagacagcatctttcaattgaggttatctttgcaattcctttccatgaattcatgctcgctctcttgcagagttccaggttctgacttgtggtgattgttgtcagataaggtcgatccggccaccctctatgagtcccttgacggacttgtaccgaagaacatacaagtcatcagcaaccaggtccacaacctcctctccaatgtcatctagctggaatgcacctacgtcgcccttggtcttacagaagacgaaggtgtcaagctgaggctccggcaccatgtcatcctcagtgctcgacagcgactgcctggaaaccgagtcatacccgtacgggagcttcgacagcaccgactgctccagatgcttctccatgatctccgcgcaactcttggcaaaccggcgctcctgctgggacagccggctgaggaggtcttcggagcgggagatgtgcatcgtgtacttctcgatcttctgcaggcggaggcggaggtaggagcggaggaggaagagcgtgcggtcgaggtccatctggtagagcgagaccaccaggtcgtcgacgccactgtcggcgaagtcgtccagcgtatcctcgaggagctgggtctgctcgcggacgcgagagacgaggggcgagtcgaagcggaggatctccggcgcggccttctcgttgcgccacgcccgcttgagcagctcgacgtccgtggtggccgcctcggccgcggacgccgccgccgagtcgtcagcgtcccaggaagacatctccgcgtctatccgtctaggttgggcctcggctctcgctactcagcggggaagagcgggagcggtgtctggcgggaagtttttttcgattaggatgttctaggtaatggtctcgtgcgaattcctgcagcccgggggatccactagttctagagcggccgccaccgcggtggagctccagcttttgttccctttagtgagggttaattgcgngcttggcgtagcat

SEQ ID NO: 21248 - DNA, 3383 bp, Zea mays
ttctacatcgggtcaataattcaagctatatcttcaaatggcacatattcttgttctttgtattgcatcctatcaaggtagattaaattctattttggggattatttattatttacttgctttggtcatgtcataataagtgaccaaaggagaagattgtaaggaaaatcgtcgaagactcatttaaagtaaggttctagtgtttcatgggcaacataattatttggactaacattattcgctagtgttttttatatagttcaacggatgcatacgtggacttgcattggattgaggcaaagtggtgatctagatgattaacacctcaagctagacattagaatacatgttaaagacctactaaaacatgcaagagttcaatgtaacaagatggaagaagttcatacaaatacacgcaaagaaataaagaaaaaaaaaacgtacgcatgctactcgacagcaacttaaccaccttatcttcttcctcttgatcttcattataactttctgacatgatagagagcacagattactatggtgctcattgttaattaacgtcttctttttagcggggggaagtgtgtgtggttgtattagttttgtagtacccactagtctgctgaacaaagtacgtacattacatgcatgcctatatatctttaaaagtttggcaaggaaatgctgcattgagagtcgcgcgcacatgcgtccacactagctagctagctatgtgtcatttgttttcctcgtcacaactcacaaggaatcgatggttaacctaagatttcaacttgcacttatccgaatatgaaaaggaaaaggatggcggctagtacgtacctttccaactggcctagctagtgaagaaattaactgcatatgcatgtcacgttgcaaacaacatgtttatgtcactggtagacagcaacatggtcaaaaaaacatgtgggggagccggtgtgtgttacctttaatcaccacctaccaccattgaactagagatccatcttttctagtccaaatgcaagacgatgatgcgatcgatgcaactatatatataaaatggaaaaggtggacggattattagatgggccgatgcaatgcatgcacaatataatgcctccatccgcgcgcctatatatatgatcaatatgactcgatcgtggaagacacacaccaccactgcacgcaccacccatcactgcagtactgcaaatgaagtgcaaaatggccagcagtagtagagtagtagcagccgccgccgtccttgtagccttttgcgccgccgccctctcgtcggccacggtgaccgtgaacgagcccatcgtcaacggcctctcctggagcttctacgacgcgtcctgcccgtccgtcgagggcatcgtgcgctggcacgtcgccgacgccctccgccgcgacatcggcatcgccgccggcctcatccgcatcttcttccacgactgcttcccgcaggtacgtgcgtacgtgcatgactgcatgtgtacgtcgttcttcgttcggtgattattgatgatgagaatgagattgacaccgtaccaatctatactgtacatgcatatagggctgcgacgcgtccgtcctcctgtctggttccaacagcgagcagaagcagggacccaaccagacgctccgtcccgaggcgctcaagctcatcgacgacatccgcgccgccgtccacgccgcctgcggccccaaggtgtcctgcgccgacatcaccacgctcgccacccgggacgccgtcgtcgcggtaagcacacgacgcccatgcatcgcggcagggacgtacacgtacatacgtcccacgtactataatataattaaccagctgacaacacaacaaaacaatgcatatgcagtccgggggtcccttcttcgaggtgcctctcggccgccgcgacgggctatcgccggcgtccagcgaccaggtcttcacgctgccgggccccgacttcgacgtgcccacgctgctcgccgcgttcaagaaccggagcctggacacggcggacctcgtggcgctctccggggcgcacaccgtgggtcgtggccactgctcctccttcaccagccgcctcccgcccaacgccgacgacggcaccatggacccggcgttccgccggacgctcgcggccaagtgcgccaaggacgccagcgcggcgcaggtgctggacgtgcgcacccccaacgccttcgacaacaagtactacttcgacctcatcgccaagcaggggctcttcaagtcggaccagggcctcatcaacgaccagaccaccaaacgcgccgccacgcgcttcgcgctcaaccaggccgccttcttcgaccagttcgccaggtccatggtcaagatgagccagatggacgtgctcacgggcaacgccggagaggtccgcctcaactgcgcagtgcgcaacgccgcccgcgtcgtctcagcagaccagctcgagaccgccgccggcgacgaggggctcgcggccgacgcgtgattagaattttgttttacaataaatgggtggcgagcgcgagttgcgagtagaacgagagccaagagctgactgttgtggtgtgtggctcatggaagcctgtcttttgctgttgcttctccagttctccttgtcctatctgtacggcgcgtgcactactctctccttatattttttttcttcatttctcgtgaaaaaggcacttcatttaccacatgaaagatttccaagcctttacatacgaagggacacggaaattcttgcggcattcggactccactacgaccatgggaaatgcctctcacacacccttcataaatataggacacgacccgaccgtggtatccaatcctttatctctctatccttttttgcattttctttgccctgtaaatagcgattacatgtcccactcccaacgaggccacgagtgtctcgtggaggatgaagcagtccccttctttacacgagaaagctagcgtccagctttccactgctggaattaatagatatattatagaggtccagccaaatttagaatttgactctaagtggtctatattaataagacattacaggatgtttagttttctgactaaagtttaattagtccatgtcatattggatatttgaatgtcaattttgagtattaaatattatagtctaattataaaactcagtcttggttcacactcaaactcagtcccaaatgcatcttttttgaaatctctcgatccaaagcctctaaggtgttcaaaaatatttctaaggacaactgaactagtaatagcccacctcatccaagatttgccctattttgcctctgtttgagctacaagttgagttggattctacaaattggcacttattatgaacctacaattg

SEQ ID NO: 21249 - DNA, 1308 bp, Zea mays
agatccctcgacctcgagatccattgtggtggaatttgttcacaaattatatgcaatcgcaagcgagcagaatggcgaggtccagtggtagtagaccagtggccctcgtgctgctggcgctgtgcgccgccgccctctcgtcggccacggtgaccgtgaatgagcccatcgccaatggcctctcctggagcttctacgacgtttcctgcccgtcggtggagggcatcgtgcgctggcacgtcgccgaggccctccgccgcgacatcggcatcgccgcggggctcatccgcatcttcttccacgactgcttcccgcagggctgcgacgcgtccgtcctcctgtctggttccaacagcgagcagatcgaggtacccaaccagacgctgcgtcccgaggcgctcaagctcatcgacgacatccgcgccgccgtccacgccgtctgcgggcccacggtgtcctgcgccgacatcaccacgctcgccaccagggacgccgtcgtcgcgtccggcggccccttcttcgaggttcctctcgggcggcgcgacggtctggcgccggcgtcaagcgacctggtgggcaccctgccggcgcccttcttcgacgtgccgacgctgatcgagtcgttcaagaaccggagcctggacaaggcggacctggtggcgctgtccggcgcgcacacggtgggccgcggccactgcgtttccttcagcgaccggctgccgcccaacgcggacgatggcaccatggacccggcgttccggcagaggctgacggccaagtgcgccagcgaccccagcgggaacgtggtgacccaggtgctggacgtgcgcacgcccaacgccttcgacaacaagtactacttcgaccttatcgccaagcaggggctcttcaagtcggaccagggcctcatcaaccacccggacaccaagcgcgcggccacccgcttcgcgctcaaccaggccgccttcttcgaccagttcgccaggtccatggtgaagatgagccagatggacatcctcaccggcagcgcgggagagatccgccgcaactgctccgtgcgcaacaccgccctcggagatgtctcatcgtcagcccagctcgagaccaccgccggcgacgaggggctcgcggccgacgcgtgaaatgatgattagctgctgttgtttttctctggtctccttctgttcaaataaggcttgctgcatcattggtatagtttgcattcttctacccatcaatatggtatatcttcttgtgtcagccctgtgattaccatgcagaccaacgcgtgagcatctatatgcctta

SEQ ID NO: 21250 - DNA, 2779 bp, Zea mays
gtgtgtggtgtgggtgctagaattttatttgatttcctaaaagcagagtaataattctcgttccaaaaaaaaaaaaaaaaggaaatgttgcgagtgaatgaacagtgagcttgactttgggactcgcaaggaagtatgaagccatgctggctggctgacctgatgctggtcaagctagattaacgactatatacctgcgctggcagtgctatagaagatgagaactgcacgtggcaatgcaagtggcaggtattatatatcatctctatctcatccaaatctcatcttcctaattaacaaactcggatgatttaaaacttatcatgaatttttcaaacgaaagggaaaaggcatgcagctagctagctttccaaccgggccgggtcagtggagtgtacagctacacaacatcgttagagaaatgcatcaacttgttgcatgacaaattaaagaaaccgaagcaatgcaagaatggtcagcttgagtgagcaagagatagatagataggtggtatataatactccctccgtactcattcaaataaatgatattaaatatagatatacctacaaattatattcatacattaactaatgaatatatgtttaatctaaaataaattatattacgagagagggtgtagtatttaatactaccttcgttttcgaatatttgtcacccactagttcaatttttaaatagaacgtaacaaataaaaaaactgagggaatataacagtgatcgaataattagtaggtgggtgtgcagtgtatgtggaacgaagctgcaacgaagttgcatataattaagcatatgatatgggcagcagatcgaagacttactacaccatgtctggatgaggattgtgagaagtgagatccaacagcaacagatcgagcatataaatatataacgcatactacaacaccttgtctcttgccgggctgttcacaaattatatgcaatcgcaagcgagcagaatggcgaggtccagtggtagtagaccagtggccctcgtgctgctggcgctgtgcgcgccgccctctcgtcggccacggtgaccgtgaatgagcccatcgccaatggcctctcctggagcttctacgacgtttcctgcccgtcggtggagggcatcgtgcgctggcacgtcgccgaggccctccgccgcgacatcggcatcgccgcggggctcatccgcatcttcttccacgactgcttcccgcaggtaataacgacccaccggccggccctgctagctatctaacgtacgtacgactacgttgatgctgacgaacacagtgccatgtcggtttaatcgatcagggctgcgacgcgtccgtcctcctgtctggttccaacagcgagcagatcgaggtacccaaccagacgctgcgtcccgaggcgctcaagctcatcgacgacatccgcgccgccgtccacgccgtctgcgggcccacggtgtcctgcgccgacatcaccacgctcgccaccagggacgccgtcgtcgcggtaagtcgatcaccttgcatcgagtagactgtctcgtacttgggagtctactagctagtgtgtacgtcgtcgtccgatcacaccctatatatatatatatctggccttccagtccggcggccccttcttcgaggttcctctcgggcggcgcgacggtctggcgccggcgtcaagcgacctggtgggcaccctgccggcgcccttcttcgacgtgccgacgctgatcgagtcgttcaagaaccggagcctggacaaggcggacctggtggcgctgtccggcgcgcacacggtgggccgcggccactgcgtctccttcagcgaccggctgccgcccaacgcggacgacggcaccatggacccggcgttccggcagaggctgacggctaagtgcgccagcgaccccagcgggaacgtggtgacccaggtgctggacgtgcgcacgcccaacgccttcgacaacaagtactacttcgacctcatcgccaagcaggggctcttcaagtcggaccagggcctcatcaaccacccggacaccaagcgcgcggccacccgcttcgcgctcaaccaggccgccttcttcgaccagttcgccaggtccatggtgaagatgagccagatggacatcctcaccggcagcgcgggagagatccgccgcaactgctccgtgcgcaacaccgccctcggagatgtctcatcgtcagcccaccagctcgagaccaccgccggcgacgaggggctcgcggccgacgcgtgaaatgatgattagctgctgttgttttttctctggtctccttcgattctgttgaaataaggcttgctgcatcatcggtatagtttgcattcttctacccatcaatatggtatatcttcctgtgtcagccccgtgattaccatgcagaccaacgcgtgagcatctatatgtcttaacaatatcagcagcaaagcatgcatttgatgtgttcatttgaaacacaaagtctagacacacaaaaacaggatggggagaaacaagcagcagttcaatgagctaagccaacataagctaatggtggagtggtcaatgtccgatgatgaagtgccatctcctttgtgattacgtacatgtccatttcctgtgctggcacagacgctatcacgctaaccatatcgaacatgaactaagcaccaaagtgactggcattacaacatcaaacctgatgaaaagaatggaacagatagtattagaaaccaatttagcaaacagagaagagaaaatggaatgcaaaaaatg

SEQ ID NO: 21251 - DNA, 1350 bp, Zea mays
ccgcgcccccgcccccgcggccggtccctggctcggctggtcacaaattatatgcaatcgcaagcgagcagaatggcgaggtccagtggtagtagaccagtggccctcgtgctgctggcgctgtgcgccgccgccctctcgtcggccacggtgaccgtgaatgagcccatcgccaatggcctctcctggagcttctacgacgtttcctgcccgtcggtggagggcatcgtgcgctggcacgtcgccgaggccctccgccgcgacatcggcatcgccgcggggctcatccgcatcttcttccacgactgcttcccgcagggctgcgacgcgtccgtcctcctgtctggttccaacagcgagcagatcgaggtacccaaccagacgctgcgtcccgaggcgctcaagctcatcgacgacatccgcgccgccgtccacgccgtctgcgggcccacggtgtcctgcgccgacatcaccacgctcgccaccagggacgccgtcgtcgcgtccggcggccccttcttcgaggttcctctcgggcggcgcgacggtctggcgccggcgtcaagcgacctggtgggcaccctgccggcgcccttcttcgacgtgccgacgctgatcgagtcgttcaagaaccggagcctggacaaggcggacctggtggcgctgtccggcgcgcacacggtgggccgcggccactgcgtctccttcagcgaccggctgccgcccaacgcggacgacggcaccatggacccggcgttccggcagaggctgacggctaagtgcgccagcgaccccagcgggaacgtggtgacccaggtgctggacgtgcgcacgcccaacgccttcgacaacaagtactacttcgacctcatcgccaagcaggggctcttcaagtcggaccagggcctcatcaaccacccggacaccaagcgcgcggccacccgcttcgcgctcaaccaggccgccttcttcgaccagttcgccaggtccatggtgaagatgagccagatggacatcctcaccggcagcgcgggagagatccgccgcaactgctccgtgcgcaacaccgccctcggagatgtctcatcgtcagcccaccagctcgagaccaccgccggcgacgaggggctcgcggccgacgcgtgaaatgatgattagctgctgttgttttttctctggtctccttcgattctgttgaaataaggcttgctgcatcatcggtatagtttgcattcttctacccatcaatatggtatatcttcctgtgtcagccccgtgattaccatgcagaccaacgcgtgagcatctatatgtcttaacaatatcagcagcaaagcatgcatttgatgt

SEQ ID NO: 21252 - DNA, 9475 bp, Zea mays
  misc_feature (7097)..(7097): n is a, c, g, or t
  misc_feature (7100)..(7100): n is a, c, g, or t
  misc_feature (7207)..(7207): n is a, c, g, or t
  misc_feature (7341)..(7341): n is a, c, g, or t
  misc_feature (9271)..(9271): n is a, c, g, or t
caccaacaataagaataaaaaatttactatccccgtctcaatttataatgtgcttgatttttttactaaatttgattggttcgtcttaataaagaagtctataaaaaataaaaaatccaatggcgtacttaaagttaaataatatcgcaataaaaattaataataattataaatttttttaataagatgtaccgatcaaacatatgataaaaaatatcaaagaacacatagattggtcccgatatcgagggtaacaagtggtattgtgggtatttttattaaacttgaacttggtaaagtatactttggaatgatctattaatttgttgaatatagagtatagatttagcggattagttaaaatctcaatctgattccgtgtaccaagatctggtcaaacgggcccatgaacccaccgttagccgaccgcgacactgatgcacccaaccatcccacattcccacgtcggggaagagcggggcaatgccgtcatttccgcgggcgaacgttgtggataagactagaggcccaagcccatgcgcccatgccgtcacacctcctactctgacctccgggtcgccccgtccgtgtccgttccttcttcctcgccgctcagacacgcacacgcatatccagcttgccatatttgtaccaccgctcctccttccgtgcccgagacccacctcggcgttcttatccccagaaacttcggcaaaagtgatcgatccgtctcccactcccaccccgaccgaccgaccgccgaacgaacccgacacacctcgtcgcgtcgcggcgcttctcttctcttcatgcgctatcgccgccgtttccacctctgcgacgcccacagataggcaggaggaggacgaggaggcgatgccttcgctctcctgccacaacctcctcgacctcgccgctgccgacgaggtgcccctgccgtcgccgacgccgctccgcctcccgcgcgtcatgtccgtcgcgtccccggcctcgcccacctcgccgtccccgcccgccccgccgcgccgcgtcatcgtctcccaccgtctgccgctccgcgcgtcgccggacccttccgcgcccttcggattcaggttctccgtcgacgctggcaccgtcgcgtaccagctccgctcggggctgcccaccaacgcgcccgtcctccacatcggcaccctcccagcggccgcggcggaggccgcctcagatgagttgtccaactacctgctggccaatttctcgtgcctgcccggtgtaccttcccaccgacctccaccaccgcttctaccacggattctgcaagcactacctctggccgctcctccactacctcctcccgctgacgccgtcctcgctcggtggcctccctttccagcgaacgctctaccactccttcctctcggccaacagggcgttcgccgaccgcctcaccgaggtgctgtcccccgacgaggacctcgtctggatccacgattaccacctcctcgcgctcccgaccttcctccgcaagcgcttcccgcgcgccaaggtcggattcttcctccactcacctttcccctcgtcggagatcttccgtacgatccccgtgcgggatgacctcgtccgcgcactcctcaacgccgacctcgtcggcttccacaccttcgactacgcgcgccacttcctgtccgcggtgctcgcggctgctcggcctcgactaccagtccaagcgcgggtacatcggcatcgagtattacggccgcaccgtgactgtcaagatactccccgttgggatcgacatggggcagctcagatcggtggtctcggcgccggagacggaggacgcggtgcggcgggtgacagaggcgtacaaggggaggcgcctcatggtaggcgtccacgacggtcgatctgttcaaggggatcgggctcaagttcctggcgtcggagcagctgctcgtggagcaccgggagctccgcggccgcgccgtgctggtgcagatcgccaaccctgcccgcagcgaagggcgcgacgtgcaaggcgtgcaggacgaggccagggccatcagcgcccgggtcaatgcgcgcttcggcacccccgggtacacgccgatcgtgctcatcgacggcccggtgacgccgcaggagaaggccgcctactacgcggccgccgagtgctgcgtgctgagcgccgtgcgcgacgggctcaaccggatcccgtacatctatacggtgtgccggcaggagagcaccgcgctcggagacgacgcgcccaagcggagcgccatcgtgctctctgagttcgtcggttgttccccgtccctcagcggcgcgatccgcgtgaacccgtggagcgtggagtccgtggcggaggccatgaacgccgcgctgcggatgccggaggccgagcagcggctgcggcacgagaagcactacaagtacgtgagcacccacgacgtcgcctactgggcgcggtccttcgactcggacctgcagcgcgcctgcaaggaccatttctcgcgccggcattgggggatcgggttcggcatgagcttcaaggtggtggcccttggcccgaacttccggcggctctccgtggagcacattgtcccttcgtatcggaggacggagaatcggctgattctcctggactacgacggcaccgtgatgccagagaattcgatcgaccggacgccgagcagtgaggtcatctctgtgctgaatcgtctgtgcgaggaccccaagaacagagtgttcatcgtgagcgggcgtgggaaggacgagctgagtaggtggttcgccccctgcgagaagctgggcatcgcggcggagcacggttacttcacaaggtaaaaatctaaatcttcgtacaatgttccaccggcgaagttctgctggtagttcgttttggtaccacctttgctttgcttggatttgggttcttattactgctccagattcgggccacagaatagaatggttacgaattaagcaatggtacccgcaaatcctaggaggagcgttcatattcctgatgcgttggtcagtcacttttggttacaactagtcccaccgtccgtccacacacaaagaagaatgcaattgtcgttttcgttttttaaggagtctgaagagtctgaacttcaactttgactaatttattcgtataaaaaggtaccaacgttcataatataaaataattataattatattagttatagaatatgtttttaaaataagtttatttgaagtaaacatttattataaaaattactcaaacttgtgcatttcttccgccgacggagttaagtccagagagcattcctgttcctaacttgtaatgtagtaggccgatacgtgacaacgtctcaccgactcttttgtctgcaggtggagcagggacgcgccatgtggaggcctcagcattggccgccgacctggactggaagaacaccgcggagccggtgatgcggctgtacacggaggcaacggacggctcctacatcgagcacaaggagagcggcatggtctggcaccacgacgaggcggatccggacttcggttcctgccaggccaaggagctgctcgaccatctcgagaacgtgctggccaacgaacccgtggtggtgaagagaggccagcacatcgtggaggtgaacccccaggtgagtcatgagcggcgagccagcccagacgcgtgcatgctttttttttctctgctcattaaattattccatacctactgctcgtcggttgttcaattcaaaatttcccggacgtgtatgaaacgtgccgaccgagtagacgtagctttcaaaccaaaaggcatcggataaggattgatctaatccagtccagtcctcatccactatgcatgcctgcgacaatctgttccctctgcgcaaatagcgacggggaaatccgcgagaactgcggcccgcctctgtggatgtggtctcttttttttttgggtgtgcccatccatccgaaagcaacctgccacactgccgaaccatccatttgtctcgttgtccgcaaccacttggaaatttctgggattagcggcggaggagagcaaataacaacgggctcaaaaaaatatcttggtgctgtggtgcagggcatcagcaaaggcgtggtggtggacagcctgctgtcgtccatggtgaggacggggaagccgccggacttcgtgctgtgcatcggcgacgaccggtcggacgaggacatgttcgagagcatcgtgtgcccggcctccagcagcggcggcgtgaggctcccggccagcagcgaggtgttcgcgtgcacggtgggcaagaagccgagcatggccaagtactacctggacgacacggtggacgtggtcaagatgctggacggcctggccagcgcgccgtcgccgccgcgacggcccgggccggcggcggcggtgcagctccgggtctcgttcgaaggctcgctctgagggggggaagggaagtaaaacacacagcgctagcggtaaacagcaaacgtcgagcaaagaaaaataaccagtgatgatgaacaggattcagacaggtgtggcgtaggattagctgcagttacaggatcgacagttttttttttttttgggtttcttcttctacattgctaccccccaaaatcgttcgtgcctgtatatatgccgttaatgataatgtgcgaagaatgtttggaccacctttgtatatggtagtagctgacgatgacgatgatatcatcagaaggaagaaaaaaaaaaggaagagaagttgattcattcactccggcttccttcctcggctcgcggtcgcgttcgttcagtcacgcttttcacctttctgcattatacattccgggttggttctggtgctccttatccaacccctatctatccatcccctatgcggcgcttgatggcaacaggagtcatgctgccatgtccgtctctcgggccgctgcggccgtccttttttttctttctcgtcacccacacccaggccccaggccggcaacagctaagcagcaacagcaggctgtacttgatgtggtacacgcgagacagacgtgatgtcagttaaaggccacagcgcaagcgcgctggcgggtgatgcatcatttcacctcgccggcaagatgactggccaacaggcaaaccgtgtcggtaacggtacttggcactacctccaccactcggtgcaggctttcagagaagaagaaagttaagtgttatttggtttaacagatgtaacgtaaatattaacggtaataattaataatcgattaccagcggtaacaagtttagatacgtggatattaatttattttgtggtatctgattataattggacttaaacaaatatgatttaacggttatcagctacaaatatgtgaaccgtagatggacccaaatgcttacggaagagaaacatctaaaatgctaccacctggaaattaacttctaagcatcatcccaaagctgtcgtagttgctgtgcagattttccacagccgtggcctggcgttggcacgacggcaatactactagcaagactggaaggtttatacgaaccttccgttggtcggagggagcaaactctcagtctcggcaatgcgcactactactaactaaaacccggaagctgggataacataattaaaaggaacacacaccagcgcacgcacgacgagctttcctattttgttttcttttcttttcgcccacaccacatccatctccccaccgattcgaattcgatgcaccactcgcggtcgtggccggcgtgcgcggcgcgtgtcgattccgttccgtgtgaaagaacatcggatgggcccgggcgcggcgggcggcggacagacacagtccatgctcgcacgtttgcgccaatacattgacatggtgacagagtcaacgttttttcttgaaagatgttgaaccacaaccatgttgagtcctatcatcctcctcctacaaccttcgctgctcttccaatccaccccgaccacgttgttgtggtcattctgcgcagatattttttctcactcactctctctctctctgatctgacgtgacgaccgtaccttatcgcgttatctgatgcatgtctggtcgtctgatcacgatctatctaataatgcacgtgctgctgctccatcagctaccactacgctagcgggttacgtttggagacgtgacaagttaggtaagtactccctccggtgcagtaaaggaaatcatcctgcgtgtgatcgagcgtgcataaaagaagtcgtagcgctcgtgggtcttggctttggacgtcgctgtccctgagtaattgcatcggaaaaaaatgtgcttaagagaaatcgagtttgagacctccagtatagaatgccgcctcgggaggtgctgcagcaaccaatcgagcttgattgttttagtgacgttaatgcacttatacccctattttatgagggcaaacagggaaaactctatgataattaatcacttcttggtatgcacaatcatgttctaaacgactacctttactgcactggagggagtacatgactatgcaagtcgctttggagttccaagatgcatgcatatccgttttttatcgggaccgaacgaacgaagctggagggaggcggcaaggcacatgcacgtgaccaatgtatgtatgtacgtctaggtctaggcctagctgctcgaatcattgggccggccgacgacggcgacgaatatatcgtccttttgtaataagacgagagaaagaaaaaaacccccggcgaatatgctcgctttccttccttcgtccgctccattctctgctgcatgtaccatatatgccgccattaggcaggaaggatcaacgatcagcacatgcgctcccacttggacaatgcgccggcgcgggagggacagatggagctagatagagtcgaggtcaggagctcgctcgcttcttgtccagtgcaatgcaagtgtgcaacgtacgtgacatatgacatctatatcgcacccaagaaatccgatcgagaagatccatccgggcgcccggacagaggacacgacagtacatgctttacttcttcttgttcttgtgtgcgctaaacaattggctctagacagtntcnatcggctggtacgtggtggtgatccgcaagcatgtgccgcatctcgtcaaaaaagcctggaccacggacgaggacgacgaccgaccgttccgccacgcacgcgcggngtctttatccgcgcgcgcgggcgaggatctgaggggccgggggatatgctgcgcggtatgcccggcccgcgcggctggagctgaggccggccggccggacgcggacggcgacgtacggccgccacgatccgtcntagtcgaagcgagcatggacggcaggctaagaaaaggggttagataggctgcaagttgattcctctcgtactgtctcttctagtggacgatcggaagagcatattcgttgccaaaagaaaggaaaaaaaaaggtgtgcgtggcttattgcttccatatccatacccttgcatggtgtgcgttgcgtactattttttttttccccccgagaggaagatgatgccttctcgcttattggcaagcgacaaaaaggctaataatcgtcgacccgtaagcgtgcagctggacgtaaacagtccatcgtctatcattttatttggactagagacaggtttaaataaactaataagcaaatcgtaaatgcggttctcccttcgccataaaaaaaaacaacagctataacacaccttttgttccttgtacgttttattattattatggaagcaaaaaaatgttctagccttttgcagtttcctgcatacaactatttaattagaaaaaaacagaaaacggtttatgatttagaatggacgtaaatgtgctgtaagaatccttctacatgaaaaaaaaactacatgcttttaattttattagtatgtggtatgtgaccatttataatcttgagagttggaacaagtgggggtatggtgccatgccagggcactccagcttggcaactactacagagctgcctaatgggctctcaggattaacctaccaacgataaacggagagctgagcaataggcggggggctcaggcccatttgcagcgtacagacctaatcaatgaatataggcccttagattgaggagggcccacataggcatgtcgaggcccagtctatgaggtcctccattgccatgcagtccaaaccaataaataccatctcgcgatcccgtcccacggcccggcccaaataaatacctggccctagttctaaggatttttttttttttgcccaagctctgcaaaaagcatggggggttaatcatgggtaaaacgtgggttagatgcgtttgacttgattcgctgcgcctggcgtgcttgcatcaaccaccgcttttgctcaaaagtggaatagttaacaaagcgagacgccgagatctatctattcttcacccagcagtaggaagtgcattaactgtccgttggaacagtctgtgacggtgtgacctgatcacctgaaggactccaccgtttctgattgccactagtggtggtgatgggaaaaaacagctcaccagcgtccatgaactttggttcggatgatgacagggacagaacaccttgtcattggttgagccactggaccagttctcctgctgactgactgaccccgtttcaatcgcacgcataaaaggcaattaattactacctgaaatcctgaaatgaagcccagcttacaatcacaagtgtgttctacttgcactaggagtacctttgaatcatttgatccaggaaaaggaaatcaggattttgcctgttaaaatgtatatactggcactcagaatagcagaggagagaatctctgttgagagctgagcgagtgtatttgtttggtcccggagcgagttgagatggagcaactaaaagcagctcagtttgggagattttgggagagccagatggttcgttatttaagcataattttactttttattgtcactctatcttaccaattcaatcagcaataaattataagcgaagcttcctacgcttgcgttgccgcttctgaagaggagaaagccatcctgccagaattccacacacaagcaggagggagcacgcccatggtgcactgatgctggtgcgcgcggcatgcaacgctcacatcacatgcccgtcgccgtcaccgcgagccagcgaaccaaccagccaaccgacgatccgatgcgcggatgcaaccaaacctccttttctccatgcgtncaggtgcagagcagcggctcctttcttttttttatagaataggaggggcgaggccctactgaaattttattaaaacttaaaaagcgaccgagttaggaacaaacaaaaagaaaaattacaagaaaataaattacagaaggaactagctgccggttacaattgccaaagatgtagccatttaggaattgccgagtcgaatctgcc

SEQ ID NO: 21253 - DNA, 7419 bp, Zea mays
  misc_feature (5188)..(5188): n is a, c, g, or t
  misc_feature (5607)..(5607): n is a, c, g, or t
  misc_feature (6940)..(6940): n is a, c, g, or t
cattgggacctcgagccgggcgggcccctcggccgttcttatccccagaagcttccgatcgtctcccacacccgaccgcctgccaacccgacacactcgtcgcgtcgcggagcttctctcctcgcctcttcatgcgccatcgccgccgcctccacctctgcgacgcccacagataggcaggaggaggagggggcgatgccttcgatctcctgccacaatctcctcgacctcgccgcggccgacgaggtgcctctgccgtcgcccacgccgctccgcctcccgcgcgtcatgtccgtcgcgtccccggcctcgcccacctcgccgcccgcgcccgccccgccgcgccgcgtcatcgtctcccaccgcctgccgctccgcgcgtcgccggacccggcggcgcccttcgggttcgccttctccgtcgacgccggcaccgtcgcttaccagcttcgctcggggctgcccgccaacgcgcccgtcctccacatcggcaccctcccagccgccgcggccgaagccgcctcagaggagctgtccgactacctgctagccaatttctcgtgcctgcccgtgtacctccccaccgacctccaccaccgcttctaccacggattctgcaagcactacctctggccgctcctccattacctcctcccgctgacgccgtcgtcgctcggcggcctgccgttccagcggacgctctaccactccttcctctcggcgaacagggccttcgccgaccgactcaccgaggtgctgtgccccgacgaggacctcgtctggatccacgactaccacctcctcgcgctcccgaccttcctccgcaagcgcttcccgcgagccaaggtcggattcttcctccactcacctttcccctcgtcggagatcttccgcaccatccccgtgcgggatgacctcgtccgcgccctcctcaacgccgacctcgtcggcttccacaccttcgactacgcgcggcacttcctgaccgcctgctcgcggctgctcggactcgactaccagtccaagcgcggctacatcggcatcgagtactacggccgcaccgtcacggtcaagattctccccgtcgggatcgacatgggccagctcagatcggtggtctcggcgccggagacggaggatgcggtgcggcgggtgaccgaggcgtacaagggacggcgcctcatggtcggcgtcgacgacgtcgatctgttcaaggggatcgggctcaagttcctggcgatggagcagcttctcgtggagcaccgggagctccgcggccacgccgtgctcgtgcagatcgccaaccctgcgcgcagcgaggggcgcgacgtgcagggcgtgcaggacgaggccagggccatcagcgcccgggtcaatgcgcgcttcggcacccccgggtacacgccgatcgtgctcatcgacgccccggtgacgccgcaggagaaggccgcctactacgcggctgccgagtgctgcgtcgtcagcgccgtccgcgacgggctcaaccggatcccctacatctacacggtgtgccggcaggagagcaccgcgctcggagacgactcgcccaagcggagcgtcatcgtgctctcggagttcgtcggttgctccccgtccctgagcggcgcgatccgcgtcaacccgtggagcgtggagtccgtggcggaggccatgaacgccgcgctgcggatgccggaggccgagcagcggctgcggcacgagaagcactacaagtacgtgagcacccacgacgtcgcctactgggcgcggtccttcgactcggacctgcagcgcgcctgcaaggaccatttctcgcgccggcattgggggatcggcttcggcatgagtttcaaggtggtggcccttggcccgaatttccggcgcctctccgtggagcacattgtcccgtcgtatcggaggacggataaccggctgattctcctggactacgacggcaccgtgatgccggagaactccatcgacaggacgccgagcagtgaggtcatctctgtgttgaatcgtctgtgcgaggaccccaagaacagagtgttcatcgtaagcggacgggggaaggacgagctgagcaggtggttcgccccctgcgagaagctgggcatcgccgcggagcacggttacctcacaaggtaaagaaggaaaaatcttactagtacctcggccgcgaccacgctatctgctagtagttggtaccacgtttgctttgcttggatttgggttcttactgttccagattcggtccatagaatagaattattacgaattaagcaatggtactcgtacgactgcaatccgcacatttaaggaaaacatttcactgaccgacatgtctagattccgagctagtgcaatgcctactgtagatcattgctagcagtagcagtagtgccaatcacttttgtttacagcttacaaaagagcattcctgttgggctgttcctaacgtgcagtagggtggtacgatgaccggtcaccgactcttgtggctgcaggtggagcagggacgcgccatgggatacctccgggttggccgccgacttcgactggaagaagaccgcggagccggtgatgcagctgtacacggaggcaacagatggctcctacatcgagcacaaggagagcgccatcgtgtggcaccaccacgaggcggatccggacttcggttcctgccaggccaaggaactgctcgaccatctcgagaacgtgctggccaacgagcccgtggtggtgaagagaggccagcacatcgtcgaggttaacccccaggtgagcggcgagccggatgcgtgtcttttttttctctttctgctcattaatttattccatagctgctgctgttcgttggctgttcgttcagttcacttttttttttctggatgtgtatgaatcatgcccaccgactagacgtagctgtcaaacaaaaaatgcatcggataaggatcgatccgatccaatccaatccactacacgcatggctgggacaatctgtatcttctgcacaaatagaatgtgaatcagcatggaccattcccgtgtggcctgggaaatccacggtctttttaattgtgccccccctcccccctccgaaagcaacctgccacgcaactgaaccatcatccatttgtccgcaatcacaattgggaaattcctgggactggcgagagagggggagagcagcaaatggcataaataacacgcgtgaaaatatctccgtgctgtcgtgcagggcatcagcaaaggcgtggtagtggacagcctcctgtcgtcgatggtgaggacggggaagccgccggacttcgtgctgtgcatcggcgacgaccggtcggacgaggacatgttcgagagcatcgtgtgcccggcctccaacagcggcgtgaagctgccggccagcagcgaggtgttcgcgtgcacggtgggcaagaagccgagcatggccaggtactacctggacgacacggtggacgtggtcaagatgctggacggcctggccagcgcgccgtcgcagcagcggcccaggccggcggtgcagctgcgggtctcgttcgaaggctcgctctgagggggaagaggagaacacacagcgctagtagcagcagtaaacagcaaacatcgagcaaggataaccagtggtgatgaacacaacgagattcagcagacggcgtggtgtaggattgattagctgcagtttacaggatcgacattttttttgctttcttctacattactaccccaaatctttcgtgcctgtatatgcccgcatggtaatatgcaaagaataacgtttcgaccaccaaccaaaccaccattgtacatgtagttgacgatgacgacgagatcagaaaaggagaagtggggaaaatgattctttcactctgcctgcttgcttgccctgttggcagtcccattcagtcacgctttttttccctccatcctgctgcattacacagtcccggcctggtatggataggataggagcctgatccggctctggtgctccttatccacccctatcccctcttgacggcaacaggaacctggccgccagccatgtcaaaaacgaagggaggccaggctgtagcttgcagttcatatcacaaggacatgtttatcgctagcgagctttccgcacgcctgagcctgaggcagacgtttcctaggactgggggaaggattatgtaacaaggcacctagggtttttactggtccggttgctgccatgattgaggccgtcttttctttcctctcgttgccagccacaccccaggcccgggcaacagcttcgaggtcgctcgctcgttcgtcctcccgtttccagcagcaggctgtacctgatgtggtacacgcgagaccgtgatgtcagttaaaggccacagcgcgcgcggcgggtgatccatcatttcattcacctcgccaggcaagcggctttaggcacacccctgtcgcttcgtagctagagagaaggtggtggcaatggttgtctgaccctaactaaagcccggagatgctgggataagaagcacgcaccatcggctgcgcacgccgagctttcatgttcttttcgccaaccccatctcccgtcgattctaggatctgacagccttatctcgttatctcatgtctggtccgacgtcggaaacgacacggcagcggcatcagtaaaccaggctggacacgtttggttatgcgtcatattactaatatttttttttctgattcgaatacgaatatggaaaccttcagataaagatacagatacaaattatcttggttacggatacgaatatttatatattgaatacggaacgagtcagatgcagataccttcagttacaaatatttttttaatataaagacacattatttattcagtggccgacgtaggaccaaaatttatagagctaaaacaccacattacaaaatcaagcaagacaaaaaaactacgatggcacaaaattcaaattccatgtctaacaatatagcatacaagttcaaagaatatgaacaaaaaaagctaacatacaactaaatttttcttgcccgaatcaaaaccgtgcgtacattgtcgaatgccaatctcctcaaagggtggggcaccgagaaagaggcggggtcagacgacatctctagctgagagcccgagctcgctggttcgtcaagctccccagtcgtcgangctggatcgcatcgtcgcgacgagcgaggtctacctatgagcgagacggtgtcgtgacgattaccagtggggcgaggacgttgggaagaggggcagggttaagcgacatcgtgcgtcgggaaggaggcgacggtgtcatgaacgaggcattagggcagattggctccggcggcgtcataaatgggatctgatgaatagatgcgagaactaaaccaaagaggagggaagttgagagaactagtcagggcaattttatggtttccttttctttgtatcagaccctttcactctgatatcagttgttctttctccaccttctccttctccacctccattaactggagttgtttcttgcacgaccacagctagagtgtttgtagcaacaagggatgctctagtgcttgcgcgcccactgccanttgcagatgccatcctacatccaaaaggttcaatgaaaaagctagtgttatagccagtttaacaacaattaatcaacacatcatgaatcttaatattaaatcattttggcagcatagacacatgactagtgcacttgaaagtttatatcaacattactacatcaaaaagactcactcaccactcaccagtactacgcgagggagcggcctgccgcctgtggctatccgattgagatggtgaagtgccgagaaggcaaggaaccgaggactgcggtcgtcgactcgtcgtcgccgagcctgtcgtttgtgtgtcggtacgtggctaccggctggagctgcccacctaccatcaccgctagggctggaaacgagccgagcctggctcggcttgacgcggctcagtgcagttgcgagccaagctaggctcggctcggtcatgttgcgagcctaacctagaggctcggctcggtaacggctcacgaggcggctcgagccagcttgcgagactcacactaaatcacgtttagagtataaactatttattttttattatatataggataaaaaattatgtataatatatttttagactacaatataagtgtatcacctatcaagttttcaagaaattgaataaaatagttcaaaacataataataataataataataataataataatatggtataatagtatacttaacgttgttagctcggctcgcgagctggaccgagccggttcgacttcgctcgtagttctgacgagctgcaaaaccaggctcggctcaggctcgttttggctcgcgagtcggctcgagccgagcctcaccaacccgacctggctcgtcaagcctgagccaaatttccacccatagtcgttgccggcttctaggtctagggtttggaattgcggttgtgtctgtgtggtgcgactgcgagtatgcgtgcgggtgcgcggtgcgcttgctagcttccacacacatctaaggccatgtacaaccctgacacggtgtttcagttttcaagtacaagagatagttaacatactatatgatacaactttgagacactaaaccataagtgcagttaagaaacaatattcatggggagtcgtgtagagacaggttcttcgtgaagagcccatctcttgtatttttaaaattaaggcatgtacaatggtgtttaatatagaggctcttgacgtgtctaaaggggtatacgcataaaaatttgtggagtcgtctctccatgaagagacatctctggttcgtaacccaagtagtaataaacgtattcatttccttgtacgaatatgtcgtatgttatatcgatntgatgctctatatacatattgacttatgcatttattaatagactatatttatggacactccattgtataatagaatattttaattgtctcttgtgcttggagaactattttggtacctctccactatacatgccattagaccccataagagaccccacattaaaatggggttgtagatgccctaacgatcgatgtgtccacgcgccgggtctgctctgtctatctccactggacatgatcctacaccaacctagctaatatctaccatatgaaggtaatatcaatgtgttgtttggttcacgaaatgtaacgtaaatgataatggcaatgattcacacttggtatgataataaatttgaataaaccgttagcaattttcttgtgtggtatctaattacgattagatttaaactaacatggtttaacgttgtctgttatccatttcgttataaatttgtgaaccaaacgacttcaagtgt

SEQ ID NO: 21254 - DNA, 2758 bp, Zea mays
cgggcgcgggcggcgaggtgggcgaggccggggacgcgacggacatgacgcgcgggaggcggagcggcgtgggcgacggcagaggcacctcgtcggccgcgcccgccccgccgcgccgcgtcatcgtctcccaccgcctgccgctccgcgcgtcgccggacccggcggcgcccttcgggttcgccttctccgtcgacgccggcaccgtcgcgtaccagctccgctcggggctgcccgccaacgcgcccgtcctccacatcggcaccctcccagccgccgcggccgaagccgcctcagaggagctgtccgactacctgctagccaatttctcgtgcctgcccgtgtacctccccaccgacctccaccaccgcttctaccacggattctgcaagcactacctctggccgctcctccattacctcctcccgctgacgccgtcgtcgctcggcggcctgccgttccagcggacgctctaccactccttcctctcggcgaacagggccttcgccgaccgcctcaccgaggtgctgtgccccgacgaggacctcgtctggatccacgactaccacctcctcgcgctcccgaccttcctccgcaagcgcttcccgcgagccaaaggtcggattcttccatccactcacctttcccctcgtcggagatcttccgcaccatccccgtgcgggatgaccttcgtccgcgccctcctcaaccccgacctcgtcggcttccacaccttcgactacgcgcggcacttcctgaccgcgtgctcgcggctgctcggactcgactaccagtccaagcgcggctacatcggcatcgagtactacggccgcaccgtcacggtcaagattctccccgtcgggatcgacatgggccagctcagatcggtggtctcggcgccggagacggaggatgcggtgcggcgggtgaccgaggcgtacaaggggcggcgcctcatggtcggcgtcgacgacgtcgatctgttcaaggggatcgggctcaagttcctggcgatggagcagctgctcgtggagcaccgggagctccgcggccacgccgtgctcgtgcagatcgccaaccctgcgcgcagcgaggggcgcgacgtgcagggcgtgcaggacgaggccagggccatcagcgcccgggtcaatgcgcgcttcggcacccccgggtacacgccgatcgtgctcatcgacgccccggtgacgccgcaggagaaggctgcctactacgcggctgccgagtgctgcgtcgtcagcgccgtccgcgacgggctcaaccggatcccctacatctacacggtgtgccggcaggagagcaccgcgctcggagacgactcgcccaagcggagcgtcatcgtgctctcggagttcgtcggttgctccccgtccctgagcggcgcgatccgcgtcaacccgtggagcgtggagtccgtggcggaggccatgaacgccgcgctgcggatgccggaggccgagcagcggctgcggcacgagaagcactacaagtacgtgagcacccacgacgtcgcctactgggcgcggtccttcgactcggacctgcagcgcgcctgcaaggaccatttctcgcgccggcattgggggatcggcttcggcatgagtttcaaggtggtggcccttggcccgaatttccggcgcctctccgtggagcacattgtcccgtcgtatcggaggacggataaccggctgattctcctggactacgacggcaccgtgatgccggagaactccatcgacaggacgccgagcagtgaggtcatctctgtgttgaatcgtctgtgcgaggaccccaagaacagagtgttcatcgtaagcggacgggggaaggacgagctgagcaggtggttcgccccctgcgagaagctgggcatcgccgcggagcacggttacctcacaaggtggagcagggacgcgccatgggatacctccgggttggccgccgacttcgactggaagaagaccgcggagccggtgatgcagctgtacacggaggcaacagatggctcctacatcgagcacaaggagagcgccatcgtgtggcaccaccacgaggcggatccggacttcggttcctgccaggccaaggaactgctcgaccatctcgagaacgtgctggccaacgagcccgtggtggtgaagagaggccagcacatcgtcgaggttaacccccagggcatcagcaaaggcgtggtagtggacagcctcctgtcgtcgatggtgaggacggggaagccgccggacttcgtgctgtgcatcggcgacgaccggtcggacgaggacatgttcgagagcatcgtgtgcccggcctccaacagcggcgtgaagctgccggccagcagcgaggtgttcgcgtgcacggtgggcaagaagccgagcatggccaggtactacctggacgacacggtggacgtggtcaagatgctggacggcctggccagcgcgccgtcgcagcagcggtccaggccggcggtgcagctgcgggtctcgttcgaaggctcgctctgagggggaagaggagaacacacagcgctagtagcagcagtaaacagcaaacatcgagcaaggataaccagtggtgatgaacacaacgagattcagcagacggcgtggtgtaggggtgattagctgcagtttacaggatcgacattttttttgctttcttctacattactaccccaaatctttcgtgcctgtatatgcccgcatggtaatatgcaaagaataacgtttcgaccacc

SEQ ID NO: 21255 - DNA, 2283 bp, Zea mays
gccgtgctggtgcagatcgccaaccctgcccgcagcgaagggcgcgacgtgcaaggcgtgcaggacgaggccagggccatcagcgcccgggtcaatgcgcgcttcggcacccccgggtacacgccgatcgtgctcatcgacggcccggtgacgccgcaggagaaggccgcctactacgcggccgccgagtgctgcgtgctgagcgccgtgcgcgacgggctcaaccggatcccgtacatctatacggtgtgccggcaggagagcaccgcgctcggagacgacgcgcccaagcggagcgccatcgtgctctctgagttcgtcggttgttccccgtccctcagcggcgcgatccgcgtgaacccgtggagcgtggagtccgtggcggaggccatgaacgccgcgctgcggatgccggaggccgagcagcggctgcggcacgagaagcactacaagtacgtgagcacccacgacgtcctcatatgggcgcggtccttcgactcggacctgcagcgcgcctgcaaggaccatttctcgcgccggcattgggggatcgggttcggcatgagcttcaaggtggtggcccttggcccgaacttccggcggctctccgtggagcacattgtcccttcgtatcggaggacggagaatcggctgattctcctggactacgacggcaccgtgatgccagagaattcgatcgaccggacgccgagcagtgaggtcatctctgtgctgaatcgtctgtgcgaggaccccaagaacagagtgttcatcgtgagcgggcgtgggaaggacgagctgagtaggtggttcgccccctgcgagaagctgggcatcgcggcggagcacggttacttcacaaggtggagcagggacgcgccatgggaggcctcagcattggccgccgacctggactggaagaacaccgcggagccggtgatgcggctgtacacggaggcaacggacggctcctacatcgagcacaaggagagcggcatggtctggcaccacgacgaggcggatccggacttcggttcctgccaggccaaggagctgctcgaccatctcgagaacgtgctggccaacgaacccgtggtggtgaagagaggccagcacatcgtggaggtgaacccccagggcatcagcaaaggcgtggtggtggacagcctgctgtcttccatggtgaggacggggaagccgccggacttcgtgctgtgcatcggcgacgaccggtcggacgaggacatgttcgagagcatcgtgtgcccggcctccagcagcggcggcgtgaggctcccggccagcagcgaggtgttcgcgtgcacggtgggcaagaagccgagcatggccaagtactacctggacgacacggtggacgtggtcaagatgctggacggcctggccagcgcgccgtcgccgccgcgacggcccgggccggcggcggcggtgcagctccgggtctcgttcgaaggctcgctctgagggggggaagggaagtaaaacacacagcgctagcggtaaacagcaaacgtcgagcaaagaaaaataaccagtgatgatgaacaggattcagacaggtgtggcgtaggattagctgcagttacaggatcgacagttttttttttggtttcttcttctacattgctacccccaaaatcgttcgtgcctgtatatatgccgttaatgataatgtgcgaagaatgtttggaccacctttgtatatggtagtagctgacgatgacgatgatatcatcagaaggaagaaaaaaaaaaggaagagaagttgattcattcactccggcttccttcctcggttggcagtctcgttcgttcagtcacgcttttcacctttctgcattatacattccgggttggttctggtgctccttatccaacccctatctatccatcccctatgcggcgcttgatggcaacaggagtcatgctgccatgtccgtctctcgggccgctgcggccgtccttttttttctttctcgtcacccacacccaggccccaggccggcaacagctaagcagcaacagcaggctgtacttgatgtggtacacgcgagacagacgtgatgtcagttaaaggccacagcgcaagcgcgctggcgggtgatgcatcatttcacctcgccggcaagatgactggccaacaggcaaaccgtgtcggtaacggtacttggcactacctccaccactcggtgcaggctttcagagaagaagaaagttaagtgttatttggtttaacagatggtaacgtaaatattaacggtaata

SEQ ID NO: 21256 - DNA, 1369 bp, Zea mays
gtgaaccaacataacagttcggtgacccacacagtactacatattttgctagctctttaagtcattaagggctagtttggaaactatattttctcaagagattccagcagaaaaaagaatgctgcactgacttttgaacggttgactatggtcaaaattcagcgagaaataaagaacacaaggatcaatgagttactgctaagtttatgaactttccacctacaacacacgttcagagattgtggaacaagaccccgggttcacactcgtaccttggacgcggcttccttgatctgttcaatcgtgaacaccccaaagaagctgtcgtctatgactccgttgattacagcataggcaacatcatccacgctcacagggggtgcaaggattaggtcagaggcaggcagcgagctcaacggcttggtgaagttttcgacagaggagagcaacttctccaatggttgtccgacagcgtcgagtggtacctcgaagccatttactttccttttaccgtaaatgaagcctggcctcaacacgacacccgaggctgggtatttggaaaggacttcagattctgcctttctcttgccagtgaagtaacccgatgtaagaagaaaggatggaaggttgtagtcatggacggagattaaaatgaattttgggactccattttcttttgcagcatttactgctatgacatttgcctcaccatttatccttttcatttgttcttcattgccaaaccctccaagggtagacacaacagcagtagccccaaccaatacttcatcccatcttgcatagaaaacatctcctggcagccaattgacttgatcaacccagggatcagagtaagatggtcttcctgacctgctgaagctcacaacctcaatgcctttggatacagcagctctgcaaatcgcagaaccaacgaatccacttcctcctaacaccacaatcttctccgtcttaacatcagcgacaatatctatcggagtggaagagtagtcttctctcacatccgatgcggcgaacctacacttggtacggagcctagagaatggggccgctggagccgtccgaaccgccggcgccgctgctaccgcggccacgcatcggggaggcggaaggggtgaattcgccagcgccggcggccggacgaggatcggcgagggggccatgggtttctccgctcgatggacctgggctggcggaggtgtgagcgcgagggcgcaacggcagcggcgagccgggaacggccggcaggtggtggtgcagagcgtgtccgcgtgggcagtgtggggctgcttcgcgtttccggtccggtggcgtggggtgtggcgctgctccggccgggccggaccccgtg

SEQ ID NO: 21257 - DNA, 1950 bp, Zea mays
gccattttttggccgctccggtctctacctactagcgtggcgcccacccgtgctaggatatggaatcgcacgtgcaagtgttgcaagattttattgatcagacccgatagcaatccacatggcaccacggtagtcatctttctcccccacacattttaatagaacggcttaacgagacaacctctcgtacgtgtaggcgtatgcatgcgcgagcctataattaacggcttgcacgtgcgtgacgacgtcacgccgccatccgcgcgagcgcctcgcctgcgcgctcgccggtggacagccggagcctccggtagtcgtcgtagttgaacggcttgtaccgacgcgggtggcccgcgtcgaccaacgcctccggggcgctcacgcggtcgtccttgggcgcgagcaggaacatggcgatggagatgcgcggcacgggcgcgcccacgcgtccgacgttgtggagcctcccgttgctccacgcctgggaaacgaaacgagacgctcggcgtcgtcagaaaaaaagctaggctagggagcgaggcgtgtcgtgtcgtgtggcgagtggtataccgtgccgacgtcgccgatgttgacgaggaaggagccggcgacggggtccacgggcacgaactcaccggcggcggggtccagcacctcgaggccgccgacgcactcgtcctcctggagcacggtgaggaagcccgagtccgtgtgggtctgcacgccggaggagcccaccgtctcctgcgtgtagttgtacctgttgatgcggaactggcacggccagtcctggaacgagtgctcctccaggcccagccccaggctggtggccagctcgccggcgacgccgacgatcacgtcgtgcatcttctccgcgtaggtcttgacggtctccctgcgcgcgggattgcgttactaccggagtatttgctccgatcctcgggaggaaaggggagcaaaggactaggaaaaggcgcgttttttctgcgcgggcacgtgcgcgtgcgtgagcgtgaccaacctgactttgggcggcgcgtcgaggcgcgcgcagaaggcgtcgacgtcggcgggcgcggcggcgtcgaggagcccgaaggcctcgtagagcgggttggcggggcagggcgcgacgtagccgctgccggggatgacgtcggcgttgcggcgcttggcgtcgtcggggaggtcgaagagcgcgcgcacggcggccttcatgtcggccaggagccccgcgggcgcgccgtggccggtcacccgaaagcagcccaggcgctcgcacgcgtcgcgcagccgcgccgactcgtcgggcgacgagccggcgaggcgcaggtcgatcaccgggatctccgccatcgccgctgccccgcgccggccgggttcgcttgcgttggttggtggggggcggcggacgggattggcctctcgcttggtggcgggtcccggggccgtatttagaggcgtgcacgagcagccagcgtgcgctggcgccgcttgtcggacggacggcaccgagacttgtggcgccaagcgacgggctggcctccatgtaccatgtcgccggtttggtgagacaagagcccggcccgcctgcgcactggaaaggaatggctctccgggaggaaaaggctcggtccaatcgcacaccctttctgttacggccgattctggcacagcctcctgtttgtctctttagaggacaggcaaggcagcgatatctgatgggtcgcccggcttggagacatcgagatcgggtagagcagacaagtgaggaagggtcgccatcgctgaatgctgtcagctgtctgtccattgacctagcgcccaaaaaaatctgctttgctgcgcgcagaacgtaattttggtaatgcaattctgttctgaaattatcatcaccttctgttttcaagtttcaggtcaccatcttcatgttgggaccgtccaaatggc

SEQ ID NO: 21258 - DNA, 1211 bp, Zea mays
tgtttttttttttttttttttgaatcgcacgttgcaagtgttgcaagattttattgatcagacccgatagcaatccacatggcaccacggtagtcatctttctcccccacacattttaatagaacggcttaacgagacaacctctcgtacgtgtaggcgtatgcatgcgcgagcctataattaacggcttgcacgtgcgtgacgacgtcacgccgccatccgcgcgagcgcctcgcctgcgcgctcgccggtggacagccggagcctccggtagtcgtcgtagttgaacggcttgtaccgacgcgggtggcccgcgtcgaccaacgcctccggggcgctcacgcggtcgtccttgggcgcgagcaggaacatggcgatggagatgcgcggcacgggcgcgacgcaccgcacccggtgcttcacgttgtggagcctcccgttgctccacgccgtgccgacgtcgccgatgttgacgaggaaggagccggcgacggggtccacgggcacgaactcgccggtggcggggtccagcacctcgaggccgccgacgcactcgtcctcctggagcacggtgaggaagcccgagtccgtgtgggtctgcacgccggaggagcccaccgtctcctgcgtgtagttgtacctgttgatgcggaactggcacggccagtcctggaacgagtgctcctccaggcccagccccaggctggtggccagctcgccggcgacgccgacgatcacgtcgtgcatcttctccgcgtaggtcttgacggtctccctgactttgggcggcgcgtcgaggcgcgcgcagaaggcgtcgacgtcggcgggcgcggcggcgtcgaggagcccgaaggcctcgtagagcgggttggcggggcagggcgcgacgtagccgctgccggggatgacgtcggcgttgcggcgcttggcgtcgtcggggaggtcgaagagcgcgcgcacggcggccttcatgtcggccaggagccccgcgggcgcgccgtggccggtcacccggaagcagcccaggcgctcgcacgcgtcgcgcagccgcgccgactcgtcgggcgacgagccggcgaggcgcaggtcgatcaccgggatctccgccatcgccgctgccccgcgccggccgggttcgcttgcgttggttggtggggggcggcggacgggattagcctccccccgcggggttcccggtaacggtctcgtgc

SEQ ID NO: 21259 - DNA, 1196 bp, Zea mays
ttttttttttttttttgtttaaaccatatgttgactgtgatattaaaattattttttattttatggcttttgaatatgattgtgcggtgaacgcacgggcatggtaaataactaacggcttgtctcggcttccaatccaatttgcagctccagccacgtcacgccgccatccgtgcgagcgcctcgcctgcgtgctcgccggtggacagtctgagcctccgatagtcgttgtagttgaacaccttgtacctgcgcgggtggtccgcgtccacgaacgccgccggtgcgctcacgctgttgtccttgggtgcgagcaggaacatggcgatggagatgcgcggcacgggtgcgacgcaccgcacccggtgcttcacgttgtgcagcctccccttgctccacgccgtgccgacgtcgccgatgtttacgaggaaggagcccgcgacggggtccacgggcacgaactcgccggtgcccgggtccaggacctcgaggccgcctacacactcgtcctcatggagcacggtgaggaagcccgagtccgtgtgggtctgcacgccggaggagcccaccgtctcccgcgtgtagttgtacctgttgatgcggaactggcacggccagtcctggaacgagtgctcctcgactagccccaggctagacgccagctcgccggcgacgccaacgatcacatcgtgcatcttctccgcgtaggccttgacggtctccctgatgttgggcggcgcgtcgaggagcgcgcaaaaggcgtcgacgtcggtgggcacggcggcgtcgaggagcccgaaggcctcgtagagcgggttggtcgggctgggggcgacgtagccgctgccggtgatgacgtcggcgttgcggcgcttggcgtcgtcggggaggtcgaagagcgcgctcacggcggccttcatctctgccaggagcaccgagggcacgccgtggccggtcacccggaagcccaggcgctcgcacgcggctcgcagccgcgcggactcctcggccgccgagcgggcgacgcgcaggtcgatcacagggatctccgccatccccgcttcggtcggctcgctgtagtatcccccaggagcggcggccgggatggattcgaggctgtatagactttagaggcgtgcccggaacgtttcgattaggatgttctaggtaatggtctcgtgccgaggtacccaatg

SEQ ID NO: 21260 - DNA, 3588 bp, Zea mays
gccggccgggttctcgccagcgcaaaggcctcgtccgtctccgtttccgtctccctccccgcgccacctcactcgttcgccgcctccgccggcgcccgtgcgccatctccactccagcgcgctctacgccgatcgagctgccaggaggttgtggatttcatgtccgtgatctaggcgccttacttggactcaggtatgggttctgctgctactgagggcaatgacaccttgctgggcaatggagttgttgggattcttgctgagacttgtaatatgtgggaaagaagggcgccgttaactccttcccattgtgcccgccttctgctaggaggaggcaagaacggacctcgagtaaaccggattattgtgcagccaagcacaaggaggatccatcatgacgctcagtatgaggatgcaggatgcgagatttcagaagacctgtcagaatgcggccttatcataggcatcaaacaacccaagctgcagatgattctttcagatagagcgtacgctttcttttcacacacacacaaagcccaaaaagagaatatgccactgttagacaagatccttgaagaaagggtgtccttgtttgattatgagctaattgttggagatgatgggaaaagatcactagcatttgggaaatttgctggtagagctggactgatagatttcttacatggtctcggacagcgatatttgagccttggatactcgactccatttctctctctgggacaatctcatatgtatccttcgctcgctgcagccaaggctgcagtcattgtcgttgcagaagagatagcaacatttggacttccatccggaatttgtccgatagtgtttgtgttcactggagttggaaacgtctctcagggtgcgcaggagatattcaagttattgccccatacctttgttgatgctgagaagcttcccgaaatttttcaggccaggaatctgtctaagcaatctcagtcgaccaagagagtatttcaactttatggttgtgttgtgacctctagagacatggtttctcacaaggatcccaccagacaatttgacaaaggtgactattatgctcatccagaacactacacccctgtttttcatgaaagaattgctccatatgcatctgtcatcgtaaactgtatgtattgggagaagaggtttccaccattactaaatatggatcagttacagcaattgatggagactggttgtcctttagtcggcgtttgtgacataacttgtgatattggaggttccattgaatttatcaacaagagtacatcaatagagaggcctttctttcggtatgatccttctaagaattcataccatgatgatatggaaggtgccggagtggtctgcttggctgttgacattctccctacagaattctctaaagaggcctcccaacattttggaaacatactatctagacttgttgctagtttggcctcagtgaagcaaccggcagaacttccttcctacttgagaagagcttgcattgcacatgctggcagattaactcctttgtatgaatatatccctaggatgagaaatactatgatagatttggcacccgcaaaaacaaatccattgcctgacaagaagtatagcaccctggtatctctcagtgggcacctatttgataagttccttataaatgaagctttggacatcattgagacagctggaggttcatttcacttggttagatgtgaagttggacaaagcacggatgatatgtcatactcagagcttgaagtaggagcagatgatactgccacattggataaaattattgattccttgacttctttagctaatgaacatggtggagatcacgatgccgggcaagaaattgaattagctctgaagataggaaaagtcaatgagtatgaaactgacgtcacaattgataaaggagggccaaagattttaattcttggagctggaagagtctgtcggccagctgctgagtttctggcatcttacccagacatatgtacctatggtgttgatgaccatgatgcagatcaaattcatgttatcgtggcatctttgtatcaaaaagatgcagaagagacagttgatggtattgaaaatacaactgctacccagcttgatgttgctgatattggaagcctttcagatcttgtttctcaggttgaggttgtaattagcttgctgcctgctagttttcatgctgccattgcaggagtatgcatagagttgaagaagcacatggtaacggcaagctatgttgatgaatccatgtcaaacttgagccaagctgccaaagatgcaggtgtaactatactttgtgaaatgggcctagatcctggcatagatcacttgatgtcaatgaagatgattgatgaagctcatgcacgaaagggaaaaataaaggcatttacatcttactgtggtggattgccatctccagctgcagcaaacaatccgcttgcctataaattcagttggaacccagctggtgcactccggtcagggaaaaatcctgcagtctacaaatttcttggtgagacgatccatgtagatggtcataacttgtatgaatcagcaaagaggctcagactacgagagcttccagcttttgctctggaacacttgccaaatcggaattccttgatatatggtgacctttatggtatctccaaagaagcatccaccatatatagggctactcttcgttacgaaggttttagtgagattatggtaaccctttccaaaactgggttctttgatgctgcaaatcatccactgctgcaagatactagtcgtccaacatataagggtttccttgatgaactactgaataatatctccacaattaacacggacttagatattgaagcctctggtggatacgatgatgacctgattgccagactgttgaagctcgggtgttgcaaaaataaggaaatagctgttaagacagtcaaaaccatcaagttcttgggactacatgaagagactcaaatacctaagggttgttcgagcccatttgatgtgatttgccagcgaatggaacagaggatggcctatggccacaatgagcaagacatggtactgctccaccacgaagtcgaggtggaatacccggacgggcaacccgccgaaaagcaccaagcgacgctactggagttcgggaaggttgaaaatggcaggtccaccactgccatggcgctgaccgtcggcattccagcagcaataggggccctgctattgctaaagaataaggtccagacgaaaggagtgatcaggcctctgcaaccggaaatctacgttccagcattggagatcttggagtcgtcgggcatcaagctggttgagaaagtggagacttgaaagttccctgatacacagataaagatagtatgatatagcagggcacatgtatcttttgtattaactccgttctggaatatatatttgtgaactaaaacgtgacaaataaaagaaataaaaagaacggaagtagtatattgtaaaaaaaaaaaaaaaaacctatatgtatatatgacctatcgatatcaaataatgccgatcagttagttg

SEQ ID NO: 21261 - DNA, 929 bp, Zea mays
cgtcaggagagaaacagaagacatcttgatcatgtgtgatgctcccccaatcccgaacctgggatccggttatcttcatcgaatttcgatagtgttcgcccaataatcgagatggcttgttcatacggatttggtgtgttgctaatgtgatgtagactgcgtccatggaaagagaatttgcctgtccactcgttgctctttgtgaaatcaatgccaacaataagatttgatgattcaagtcctgcttgagctagagcgtcagtaacctggtccaccgagtgatactcgtcggcgatccgcgagtaccggcgatccagctgccgcggcttcgcagcctgcggcgccggagcagcaacggcgacggcggcgggcttgtcccggtacggcgcggcgtaccctcctccctgctgtggcaccggcgcgccgtagtagccggtgcctgggtcctgttggtaccctcctccctgttgtggcaccggcgcgccgtagtagccggtgcttgggtcctgctggtagtaccctcctcctccggcgccccactgcgccgacggctgctgctgaaaggagcgcgaccgccgcccgtggctgctcccgtcccgcttgctgtggctctgcctctgccccatggctctcggtggacgggtgggtcgctcggtcggtccgtccgtcaaatggatcccgcgtgcggcgggggaaggaacaccgaacacgaagcagcagcaaccgccctccctggggctatttctgcaggagtataggcggcggcgaaggtgtgggaaagcggctaagcgacgtcagccgccgcctcgcggtattgtaaggagaggggaggggagtttcgggtatgcttcctccggcgaccgtcccgtttggtgtggatttggcggaggcagcttttccagtttccacgctggcctgcagcgctgcgc

SEQ ID NO: 21262 - DNA, 887 bp, Zea mays
  misc_feature (126)..(126): n is a, c, g, or t
atgatgtggtccagctagcgcaaatgtgtacaagtttcctatatcgatcaagagctctttcaaatccattgcatgtctccgtcagggagagaaacagaagacgtctgatcccatgtgtgatgcatnctccaaatcgaaaacatggaatcaaattgtcttcatcaaatttcgatagtgttcgcccaataatcgagatggcttgttcgtacggatttggtgtgttgctaatgtgatgtagactacgtccatggaaagagaatttgcctgtccacttcgttgctctttgtgaaatcaacgccaacaataagatttgatgattcaagtcctgcttgagctagagcatcagtaacctggtccaccgagtgatagtcgtcggcaatccgcgagtaccgccggtccagctgccgcggcttcgcgacttgcggcgccggagcagcggcggtgggctggtactggtacgccgggggcaggtaaggcgcggcgtaccctcctccctgttgtggcaccggcgcgccgcagtagccggcgttcgggtcctgggcgtagtacccccctcctccggcgccccactgcgccgacggctgctgctggaaggagcgccggccgtggccgctcccgtcctgcgcgctgtggttttgccccatggctggctctcggtgtgtgtgggtcggtcgatcggtcaaatggatcccgtgtgcggcgggcgaaggaacacgaagaagcagcaaccgccttcgctctggggctatttctgcaggagtataggcggcggcgaaggagaccgaatgtgtgaaagcggctacgcggacgcggccgccgccgcgcgagatcgtaataagaagaggcgaggggaggtgactcaggtgagtttcccaggcccggccggc

SEQ ID NO: 21263 - DNA, 3942 bp, Zea mays
  misc_feature (452)..(452): n is a, c, g, or t
  misc_feature (2158)..(2158): n is a, c, g, or t
  misc_feature (2366)..(2366): n is a, c, g, or t
  misc_feature (3026)..(3026): n is a, c, g, or t
gaatgctagtgtaatggcaaacttacctaatatgatattgcatatctagaattttttatgaccaagacacataacactctgacattcaagacccatttctgattcagaagaggagctcctgaactcatccatctcaccatttccatgcatcttgatccacgggagaaggtggtgttgaggactacggttccttcttcccgctcaatttgaaatcaggttccatatatctatatatgtcactcgggctgggacgtggtattgggcccaaatatataagactggcccatacacaagttggcgcgtatcctcattcattctaggggggtcacatggcgatacatcgctgttcggcggcggtattcttgaatccttttggtactggcaataccatagaccataccttgttcaagaaccaaaaatattttttaccacggataataaatcgctgctantttcgaattgcgagctggctcggcaaacattttggcaggtaccgcaggaaaaacaggtgaaaggcatgctgcatcgcgtgaagggctgctaaaataattcccttacggcagagttgcagttttccagctctcggaaacgcctgctaacaaaagatagagccgttccaaaagatacagctgcttatcaattggcgtgattagccagttgtccatagtgatagagatcgcccccttttttctggtcccacggaaattgcatttggcttcaagtgcaaccttctgcatttggcttctcataccgtcttctctctctttttcctttttttctgaaaaagaatatttttagggttaatttagaaacttcattttttcaagaaattcctattttctaaaaaaaataaattaattttttaaagaaaaataaaaatcccttaaaaaaacatgttcccaaactagtacttatagtggaactgcattttggcattttattacgctgttcgctgtacctccctatataaaaagaaaacagaaactacggtgagccgaaagttgattaacacgcatttcatcgtcagcagaacaaaactcacacgatccaccatctgctgttttttttttcgcaaagcaatggtgatctgatttattctcaagaggaagacctcactgacgtattgcatgaagaattattttaacgtttgcaaggaccaaaagaaaaagtaggccacactgcctaagaggaagacacgcctgcagtccacgtcgagatgccgagaggctttgttttttgtgccacagctagtttcctcgtctacttggaagctcacggtaccgctaagaacatcagactcctcacaacaaaactgtcctagattttgttacgatgcacacgttagctactcaacaagcggctacaatctctcgtagaaaaggagcgtggcctccgcgcgcaggacatcctcctctggaacttctgacacgtagccgtctgagatgtaaaaccaccgcttgccaaggcctgcaacaggtttgcctggatcatcagggtcaggattcgacgcgactctcctgtagactgcgtagtgccctcctccacacttcccgtagtgctccacgacggccgcgagaccgtataacttgctccttgatagctgcggtgatgatgatgaactactggacacgtcagcattagcctgcatatggcgagcggtcagattattcagttgccggtagtaaaaatttataattggagtataaccaaccacgtgaatcgagtggccactattgttcgctgcttcctccttacacggctggcttggtaagtaccctccagtaggtaagacgtctgctcacctgcatattcagttgccggtatagatggagagcttgctggccatctctttgcgcattcattgctaaaggtccagcactcgacgcgcctcccgtaaacggggacagattgagaagcaaagggaaagaaatatgtccctgcggccgaagcactgatcaaccggtgcgctaattatattgtgtggtagaggttaccactgtgtcacatatagcagcgggcttacctgatgtttgatgggctcgccgtcaagaccgactgaagcgcgtagaaaatgaatgcacagaatctggaagaggacatattggtggaggtgttacttaattttatgacagttgatgtgagtctcaacgagtacttnaattttggataccttcgggcactgactgataatcagctgctttgttgctcgtgaagatgatgaacatggcagtgactccagggggaacatatccctgcaactgcaagtgccatagtcgacacaggattgaagctttgctaaccttttcttgtaacagttatcaatgtagctgtcatactcaacattgcaaagggcgcaatagaatttncagtgcagtgataattaatacaaagttgaacataattacctcatcaacttctgatctaagagaaagatatttggcagcaatgatgtgccaacaccggtcacaacgatagttgtcaagatgctccaccacagtgaagtactttaggcaatccaccaagctacacccactggtctagtgtcatgacataggataaatgtaacaaacaaaaataccattaatgagcataaaatggacagcgaatgaataattttttttaaaaaaaacttgaatcatccaatgaaatttaggaaggttgacgcggatatacaatatctccatttgcattaaggactggcgaaagaggcaagcagtggaaattctcgaagtccaatgacagctgtgagatatgtaacaagggagaacattaaaattaacaaaacaggagtattttaagctaactgtcaaaatgcgcaaaataacttattggcaatatgaaaatagcatcacttgttgttggctaaattacttccataataataattctttaattttaccacggctaggaaaggtaggggcatgcactggacatcgtgtcaatatctatgtatccagtggtatatccggaacaaaatgcattcatatatgaaagacaacagtaggttacttttttataagccacanttcaacagtgacagaataagaagcataggaaattaggaatctaccacagaagaacagtttctgcaagacaatctcgggccccctgtcccatcaaaggggccaaataggttttgtttccagcgcttgcattcaggcaggttaccttccctttgcttgtatactttggagtcagaaagggtgatgtctgccagagaactcctatgtggtacataacaatgggcaaattcatccctcaatgagatcagaagatggagaaaagcttctgaagcatcctataaggaaaattagttcttatgatgactgcacatctaatgcaatactaaaaaatgaaaacaagatagagaagtaaatattatacctgctgtctggtcagattgaagtgaccaacatacaaactcaaagcatgcattactccatgtggattcaacacagtcctttcatctcgaactatgcttaagtctgcaacatgcaaagctcaagtacaataataacaatttgtgagcatgtaacaaaaaagcatttataatcaaatggcggacatcaagaatagagtgccatgcagttatattttgcaggacatgaccaatgtcagaagaataaagcgaaaaagataaaaagaagtcccattcagtggttttatatagaagcaagaacatattatgtggagcaaagaatccaagcaatgcaaataacaaggacctatcaattcccaagaaaatcggagcataggagaaaacactgtcaaaaaatttataggttgcatggattccaccaccggtgaatgcattatgttgcatatgcagcggaggaccccacatgatatttgaacttataagccatgtactgtattataggggttcacatacagctcaaaaattctcaatagaagcccccacccccctgaaattgcctgcag

SEQ ID NO: 21264 - DNA, 1410 bp, Zea mays
gcaaaacaatggtgatctgatttattctcaagaggaagacctcactgaagtattgcatgaagaattattttaacgtttgcaaggacccaaaaaaaaagtaggccacactgcctaagacacgcctgcagtccacgtcgagatgccgagaggctttgtttttttgtgccacagctagtttcctcgtctacttggaagctcacggtaccgctaagaacatcagactcctcacaacaaaactgtcctaggttttgttacgatgcacacgttagctactcaacaagcggctacaatctctcgtagaaaaggagcgtggcctccgcgcgcaggacatcctcctctggaacttctgacacgtagccgtctgagatgtaaaaccaccgcttgccaaggcctgcaacaggtttgcctggatcatcagggtcaggattcgacgcgactctcctgtagactgcgtagtgccctcctccacacttcccgtagtgctccacgacggccgcgagaccgtataacttgctccttgatagctgcggtgatgatgatgaactactggacacgtcagcattagcctgcatattcagttgccggtatagatggagagcttgctggccatctctttgcgcattcattgctaaaggtccagcactcgacgcgcctccggtaaacggggacagattgagaagcaaagggaaagaaatatgtccctgatgtttgatgggctcgccgtcaagaccgactgaagcgcgtagaaaatgaatgcacagaatcttcgggcactgactgataatcagctgctttgttgctcgtgaagatgatgaacatggcagtgactccagggggaacatatccctgcaactgcaagtgccatagtcgacacaggattgaagcttgctaaccttttcctcatcaacttctgatctaagagaaagatatttggcagcaatgatgtgccaacaccggtcacaacgatagttgtcaagatgctccaccacagtgaagtactttaggcaatccaccaagctacacccactggtaatatctccatttgcattaaggactggcgaaagaggcaagcagtggaaattctcgaagtccaatgacagcacagaagaacagtttctgcaagacaatatgctgccaactgtcccatcaaaggggccaaataggttttgtttccagcgcttgcattcaggcaggttaccttccctttgcttgtatactttggagtcagaaagggtgatgtctgccagagaactcctatgtggtacataacaatgggcaaattcatccctcaatgagatcagaagatggagaaaagcttctgaagcatcctgctgtctggtcagattgaagtgaccaacatacaaactcaaagcatgcattactccatgtggattcaaaacagtcctttca

SEQ ID NO: 21265 - DNA, 1745 bp, Zea mays
  misc_feature (66)..(67): n is a, c, g, or t
cgcctgcggtaccggtccggaattaattcccgggtcgacgagctcactagtcggcggccgcccttnntttttttttttttaagcatggataactaaggttctgtattcgtatcacatgttaactcagtaccaccattccacacggtggataaaatgtacagtcgaaactctaatggtagatgaatgaggaaaattagaatgaaagaatatgtcaggtacataagctatcacgtgacacaacgcaattagtactaggtaacagaattgcgggcgaggctgcttcattctattgtaagcttcatacggcactcccatgccttagaaagaagcagtgcttttctgctagctgcagaattgagcggccaaaatttcaagcaggaccatgctcagaccttattcttctctcttggaggtatcttcagcaaatgcttcatggtgtcatatgcggtgaaaccaatggccactgaaggcaccaccttgatgtaattgaggctcaagccagcaaataattgtttccaaccctgtgtttgtttaatggacacaagaccctggaatgtgcccgttattcgtggggcaccaaattgttcatgttgttgctgattttgaacctgcatctgcctcctgacaacatctaatggatatgtcagagtctgtccaaataaaccagcagcagcaccacatgacagcttcaatgttacagaacttctgtaatcttctggtacatgtaccttcagcccttcatatatgtagaacttaagaccagcataaggaagtatccccatgagtgttggacctacacctcggtaaagagcccgcactccaccttctgagtaaacacatctaaagacatcaatgattcctccatatgctggctggggacttccccttttcaaagctctgctgagttcatctgaactattgacctgaaaggcaagcttagtccgggccaaatccaagggataagtacacaatacagcagttccccctgatgctgaaccggctaaaagatctactaaaggccctgttcccagtgagggacagttattcaaaatccaacaccggtaccgctcatatgccatgaaatgtaatgcagcataaggaacaattctcatcacactggcaccatttcctttgtaaaaccccatgactccatcaagttgtctcagtttcttcaatgatttgagaactccaagagacccaaactcatttgttctggtctgcagcaatatcttgacgcgctcgagcggcgcgatggcggttttggagaaggcgccggcgacgccgccggcgatcatctccttggcaaagacaggcatgaggtcgagcgcgcagaggtcgacccgggccgccgtcacggccgccgagccctgcgaaggggtccccatcccgccgccgcgctcctctcatccaaatcaaacacccccgcgcgggaatctgcggaagtccgaagggatccaaccaggcaggacgcgcgccgcgaccggcggacagtcacgccgcggcaccaaacgccgacgaatttgaccgtggcaacggggcgatggtctgcgcgggcggcttgcgggtttctcttttcttgcgcgggttttccgacagggcggccacaaagcccatagagggacgactaatatgcgggagcccggccggcctcgaggtccccgacctaaattgccagagaagcatgagatgggaaacctttttcagtttcacgcgctgctggaaccgactcaactctaggtcgtctc

SEQ ID NO: 21266 - DNA, 1714 bp, Zea mays
tcctctagagcggccgcccttttttttttttttttttggtccgtttttttttttttttttttttttttggcataacacgattataatttcagcatgttcggtgcatccaacttcacacattagtttacagctggagattttgtcaagggtccagattataacagtcagtcagtcaccttaggcattgttcggttgcgtctggataaaggagattgagggggattaaatcaatttctattcaattttgactagaaggaatttaatcccctccaaccttctttgatccagaagcaaccgaacaagctcttatgagaactacaaaattcaaattggacataaaggtttgaccagacctactgccatggcactttagtttgtttgtactgatagctcatcctccaggtagttgtactcaaatgtgaagtcattcttgattctttggcaccatcctgagccatcctcagtgacatggaaatcaaagtatacatatgatccccgctcatactcatcagtcgtgacctgtggctccacatgccgctggaaccaggtattgtacctccggtgaaatctccatgattgcttcttcagttctctagcagccaagtattgttgatatgtgttctgttggtagtagaacgcaaagaacagcatgtcggtagctaatgtgtcgctaccaattctttcccaaaaggtgggattcgatacaattgatgcctgaacttgggggtagctagcaggggtaactgcagggtgccgcggaatgtaagttttagcacgctcagagtccttgggctgtggaagcttgtggaatgcagcttcaagcatttgcagataataattctgatcatgaccagaactaccagaagttccagtaaggttatctccgattgtaccaagatcagatacacttcttcggccgataacaccaacaccagatgatggcattccaggttgcaattttcgattaggatgttctaggtaatggtctcgtgcgctgagtgttttctgctgcaggtgctgaaggattcgaatatggaatctttgtgtcatcttcacttgtttgtttatttgctcctgttgttgcggaagattccacaccaacatcttcagccaaaatttgttgatcttcactttttatatgccccgcgtctgatccttgaactccaagcccaagattcacttgggaagatatagaggaactctgtgaattaaactgttgtagaaggggatttggctgtggtgttggaaattgcttctgatttatgccagttatatgggaaacattcagaaggctgccaccttgctgctgtacttgctgcagtctctgtatgtacttctccctgtgatcagcagaaatctcaggccttccacggtactgattagtttcaatttgattttgaaatgcagcagcagcttgaggtctccattgaaccccagaaacaactggaggagaaaatactcttccaccaagaatagggttttcatttgtgttagcagaatcagagccgattgcatcattagtcctggccccccgctggggttgaactttactaccaagaggcataaccaacgatccatttcctgaaactggaccaatagttatgggagctgtacctaatgcctgactagttgttcctcgagttatgcccctgccaattccaatttcagtagcaccacatggtcgccgggggggaccccccgcctttccaccaga

SEQ ID NO: 21267 - DNA, 3073 bp, Zea mays
atatctaaaaatttagccttaaataaggaataaaaaacagttattcatgtgccttagccttaaacatgaacaaacgaaaaacagttatgccctgaaacttattttgtgcttttgttgggggttttaactccactgtagctttagaactaagctgacttaattgttgctgctaaagcagatgagaacgacaatatacagcggagtcaaatatatttgactggcacaacccgattctaatttcagcatgttcggtgcatcagaacctacaaggaatgctctccaacttcaccattagtttacagctggagaattttacaagagtccagattataagtcagtcacctcatgagaactacaaaattcacaatggacagaatggtttgattagacctacagcccactttagtttgtttgtactgatagctcatcctccaagaagttgtactcgaatgtgaagtcattcttgattctttggcaccatcctgagccatcctcggtgacatggaaatcaaagtatacatatgatccccgctcatactcatcagtcgtaacctgtggctccacatgccgctggaaccaggtattgtacctccggtgaaatctccacgattgcttcttcaattctctagcagccatgtattgttgatatgtgttctgctggtaatagaacgcaaagaatagcatgtcggtagctaatgtgtcgctaccaattctttcccagaaggagggatgagatacaattgatggctgaacttggggatagctagcaggggtaactgcagggtgccgcgggatgtaagttttagcacgctcagagtcctttggttgtggaagcttgtggaatgcagcttctagcatttgcaggttataaagctgatcatgaccagaactagcagaagttccagtaaggttatctccgattgcaccaagatcagatacacttcttcggccgataacaccaacaccagatgatgacattccaggttgcaaaggctgcccaggtgatggatcagtatccctaggcagctgattgctttctgctgcaggtgctgaaggattcgaatatggaatctttgtgtcatcttcacttgtttgtttatttgctcctgttgttgcagaagattccacaccatcttcagccaaaagttgttcttcttcttcactttttatatgcccagcatctgttccttgaactccaagattcacttgggaagatatagaggaactctgtgaattaaactgttgtagaaggggatttggctgctgtgttggaaattgcttctgatttatgccagttatatgagaaacgttcagaaggctgccaccttgctgctgtacttgctgcagtctttgtatgtacttctccctgtgatcagcagaaatctcaggccttccacgaaaatgactaatttcactttgattttgaaatgcagcagcacctagaggtctccattgaaccccagaaacaactggaggagaaaatactcttccaccgagaatagggctttcatttgtgttagcagattcagagctaattgcatcattagtcctgggaacctgctggggttgaactttactaccaagaggcataaccaactgctgagaaagaccaccactgttaatcttctcgtcagtgttcaatatatttcttttggacaagtcatttattccaggaagtgcactaaccgatccatttcctgggactggaccaatagttatgggagctgtacctaatgcctgactagttgttcctcgagctatgcccctgccaattccaatttcagtaatagcaggagatggtcgtcgtggaggaaaactcatgctttcatcatccttcaaggtgatagataagtttgcaggaattgaggtaaccgtagatgtattctcaggagcacttcgtggaatagcagaagaaagtattgtagccactgtggtgggaacaattggtcgcacaggggaactaattgtttctgcaagtacagaaatagctgcactaccagtactgacagcaattggcacagctggtattgaaggtccagaatttccaccttttggaggtggtgtttgtggcacagattcactattgctttcttgggaagctgtgtcctctgtttgatcttgtgatgtactttgtgaaggagctgttgatactgtaggctgagtaagtgaagttgcaatcgaactctttgtactcgaaactgcagtagtcggaacagaagcaacacccttgacaagactagaaggagcaagtgaaaccatgtcttcaagtgcttcaaccttctccataggcaatgtgctatagaggtcctcaacatcactgaattcatcaaagtcttcctgattacgttcaacataatcatcaagaaaatctttaacatcattgacttgctcaggactcaactcatcattatccaaaagtctcaagattgactccaatttctttatatgagctttatgtctcgtaatagacttctctaaatgtaccaatcgaggcggtctttgttttccctttttaattgaaagtccttcaatctctgcttcgaagttatcaatctggctttccaaatcactaaccacattattaagccagtctcttgtttcagctttggccttttctttgggatctgtttttggttgctgacctaacccttcttttgagaaggccttagtttttgtttccttctcacatactttaaatcgttccatctctcgttcaatctgctttcgggcatccatcagagccttcttgtccttgatctcgctagactggatccacgtcttgatctggtccctgtagcgctgtagcttcttgatctccttcttgaggtctgcctcgaacttctccttctggttcgcattctcggtgtcgtagaccttgttccagatgctgtcgaagacgtcgacgccctcctggaccttcttaaggacgcggtcgatctcgccctgcagcttccggctggcgcccatggctgcgacgtggatgtctcacgctcaggcgcggctagggtttacgattggggcggcagggggagtggtgccggccggggaggggaaacagacgatgatttggacc

SEQ ID NO: 21268 - DNA, 3455 bp, Zea mays
ggtttctttctttttttctttttcttttgttattgggtcttctatagaccttttctctatttgcttaatatataatgggtgcagttctcctacgtgtttcgagaaaaagttcccacttatggttttgcaaggaccatagcatctgtgtatatatatcgtgttttccaaatctcagtggcaaacaaaatcctaaaaattacaaatattttgtatattgctttaaagaaaaaaacatggaacatgttccttgatgtttatgtatttatagttcctcgcatacttccctttcaataatatacacattataagcattattgacagtactgagaagcttttgcctattttaaggataagtcaagctgtagcaaaattataactgtaattacccctgctcccaaatttcaaaaggaatttgcgtagaattccaaacaaagtaacaatcgaactgattttataactgtttggtaacttcagctttgcatgttagtttgtttttctaattagctaaactcaaacatctgacgcggttggaagaaacaaactgagcacacagccaaaaccgtttcatgagcagatgcgtgcaaataaaagtttgaggacatgtacaaaagtttttttttctctcgaacagtgcaaaagcttgatataccgaatatggaatctttgtgtcatcttcacttgtttgtttatttgctcctgttgttgcggaagattccacaccaacatcttcagccaaaatttgttgatcttcactttttatatgccccgcgtctgatccttgaactccaagcccaagattcacttgggaagatatagaggaactctgtgaattaaactgttgtagaaggggatttggctgcggtgttggaaattgcttctgatttatgccagttatatgggaaacattcagaaggctgccaccttgctgctgtacttgctgcagtctctgtatgtacttctccctgtgatcagcagaaatctcaggccttccacgatactgattctggaaatacagcgagaaaaaatgtcatataggcaaacaagtatttgtgagcccaatgaggaattatcaaatcaaaattcaaaataaatgttctttcagtagaaaagcatcagttatttggattattcggatgcccacaaacagaagcattgaacacaggaacattaacaattcacacaaaaccaagaacgaattcagaataaccttacacatgtttgatcaactccagtaaaaaaacgatattttgaacaaagttgacttgaaaactaaattgatacctcctttctttttatattgcttccatttatcacaaaaacctgcatgcactgactattctatcatatgtctccagtgtactggaattggggtagcttggtaattcttgttccctcattcacttgatttcataccattaactattgttcccgttcctactaatacaccctataattttaaccgagggagaaatattccagaacatcacttaaaattggctggatggagcatttgctattaataaatcagattaaatgaagaaggccaattggactatataaaaaggacagacccagtactggcagctcccatgagtggaatctggggaagaaataaccgaggtaaaccttacccccgcatttttttagagaggctgggtcaaacacaggaccttgggctcaccgggaaggcatctcaccaatacgccaggcagttgaactatataataaaataaattaactgaagagatacatacagtttcactttgattttgaaatgcagcagcagcttgaggtctccattgaaccccagaaacaactggaggagaaaatactcttccaccaagaatagggttttcatttgtgttagcagaatcagagccgattgcatcattagtcctgggaacctgctggggttgaactttactaccaagaggcataaccaactgctgagaaagaccaccactgttaatcttctcgtcagtgttcaatatatttattttggacaagtcatttattgcaggaagtgcactaaccgatacatttcctgagactggaccaatagttatgggagctgtacctaatgcctgactagttgttcctcgagttatgcccctgccaattccaatttcagtaatagcaggagatggtcgccgtggaggaacactcatgctttcatcatccttcaaagtggtagataagtttgcaggaattgaggtaacagcaagtgtattctcaggagcacttcgtggaatagcagaagaaagcactgcggctgctgtggcgggtacagttagtcgcacaggggaactaattgtttctgcaggtacagaaacagccgcactaccagtactgacaacaatgggcacagctggtactgaaggtccagggtttccaccttttggaggtggtgtttgtggcgtagattcaggattgctttcttgggaagctgtctcctctgtttgatcctgtgatgtactttgtgaagaagctgttgatactgtaggctgagtaggtgaagttgcaacagaactctttgtgctcaaaactgcagtagtcgaaacaggagcaacacccttcacaagactagaaggagcaagtgaaaccatgtcttcaagtgcttcaaccttctccatgggcaatgtgctatagaggtcctcaacatcactgaattcatcgaagtcttcctgattacgttcaacatagtcatccagaaaatctttaacatcattgacttgctcaggcggacgcgtggcgttatccaaaagccgcaagattgactccaaatttctttatatgagctttatgtctcgtaatagacgtctctctaaatgtaccaatcgaggcggtctttgctttccctttttaattgaaagcccttcaatctctgcttcgaagttatcaatctggctttccaaatcgctaaccacattattaagccagtctcttgtttcagctttggccttttctttgggatctgtttttggttgctgacctaacccttcttttgagaaggccttagtttttgtttccttctcacatactttaaatcgttccatctctcgttcaatctgctttcgagcatccatcagagccttcttgtccttgatctcgctggactgaatccacgtcttgatctggtccctgtaccgctgcagcttcttgatctccttcttgaggtccgcctcgaacttctccttctggttggcattctcagtgtcgtagaccttattccagatgctgtcaaagacatcgacgccctcctggaccttcttcaggacgcggtcgatctcgccctgcagcttccggctggcgcccatggctgcgacaggggtgcccctcaggctagggtttacggtttgccgtggggagcaaaggagcagagcggaggagagtgctcagagtggagactgggaagggggcaagggggaaagagcaacggatttgggacgggtttc

SEQ ID NO: 21269 - DNA, 2391 bp, Zea mays
  misc_feature (516)..(516): n is a, c, g, or t
tcgtagcgtagcacggctatttactagtttcctataaagctttatcgattctgatggaagtgtttcagaaatccaaatacagatatactctggatcgtttgtggaacaaaaatagttgaacctatctagaatcgagtaccacaccaagtcaatggttcatgaatgagaaagaaaattctgtcgagcttacataccgcatacaattgatgatactttctcaatggttgagtgaagcagttgtatgatgagatggggtggtgcggcgtgcgttgaagttccaatctaaccagctgttgttggtattgttgttgttttgcccgatcaatgttcatccttcttttaaatttaatcctagctctcgtttttttttgaaaaaaaaaacaagaagaaagaaagagcacgtacaaagtgcagattttttcctactcaaacatttgtcgccgccgttcttttaaccatgagatgacggaagatattttgtgattctgatacggcgcacaaagttcaaagatcatngaggtccatctctactctacatagaccgttctgggatgatggtcacaaaagcagtttgtttttgccccgtgatgagctgcctcgtgtcgacgaactttggctagttgttcgataatgcagctcttcgctgtttcttttgaatcctttctttcggtattctaaggacatgcggtgatgtgcttgtggaaggtacgaaagaagagatacaactatagacatgtgcagaagcaaaagcaactacttcccagcataaagagtgtatttcctcggtctcaaaatataagtcattccaaaattctcaaatagtcaaagcttttaaaatttaatcaaaaatataacgagaatcataaagatttatgatacagaatagatatagtataaaaatatatttaatgaagaatctaatggtatatatttgatatcttaaatgttattactttattgtatacatttaatcaaatttgaaaaaacttttactctctaaaaatattggatattagaatgacttatattttaaaacggagggaatatattgtagcatcctccaataccatcactctgtgcggtgattcttctccagaaagtgaggacaactaaataattgaatcgaaaaaatcataactttagggatccatttaatgttaccatatgcggcggcttattaatctacacctttaatcatatatgggcttgttcattttgtaatcaatacatgtggattaggtagtattgcgtaggtttaaattttacaagtcaaaatatttcataatttttttcaatcacattcaatccatatggaatagaaataaccgatgaaactagagaccctcgtcatccgactgaaatacccagaatttgcaaaagcaaaaacaatcagaactcgagtactgaacgagatcagagataaagcagctgatgatcccatagataaatctcaacaatgcatcatgtatagtgccgatagtgggacatttcctaatgcccgatgatatactgcaatctcgtgttattgtgacaggccaccgcaccaagaggccaaattaattagaaagatcccgggcaggccaagcgtcatatgctccacaccagcggccgcccccctctcgtttttttgacacatttctagagaatttttatggaaaaagattatcggtgctctttacttacatcactattgaaaattggacatctcagcatccgagcgaatgtaaaattaacccagttgtgttatagttgcatttctgttttacctaaagtcttcacttcaaatttagcttgggctgaggctagaaactgttctagctaatcaatgttaatacaaaatttagctggaaccgccaacgaacgagccctaaagcattagatcgatatactccatatacatacactggtttgcatgcgatcatctcctatgaagcttacatatcctcctccttttgaagtagctacgtgatgtcgtgatgcgccccttaacactactaagagatcatctgggcagtggtgtataatcatccaagttacttattgcaccttttcatgaggctggcagctaaggcagcaccttttcatgaggccagcattctcttctccctgtcaaccttccaccattggatgaattattactgtgctgttgcctcaaacttttgaagcatatcacaatgtggtgtctggtatgacaagccccattggcgacgctgcagctcgaccctacaattctgtgtgattatggaataataatccctctcaacatgccgctccactgttgctcgctcagtgctttggtgtggatactgctcctcaaaattagacatcttgacatagtatggaactccacggggggtttggaacttacccacgcgaccgcccacgcgaccg

SEQ ID NO: 21270 - DNA, 1983 bp, Zea mays
acagtaaattcatattcataaagaagttactagcaaaatcgagttgatggtacaaagatggaaatttgtaaggcgattgatgcctaacaagtaacagtgaacaatcttgcaacaatgcctaatcaaaggctgggctgattggcctaattctctaacctcaagtaggtacaatctccggagaagacggcaggaagcgaacgaggatggtcccgatggctatgcatagcagtacaaactggaccgagaagaacaaggaggctctgctagctctggcctgcagcttcagaacttctgaaatctcagacagctccttgcattgcgagtctagtttatccaccatatcctccagcatcatcgccctgttctcggcatgccgcaatttggtttctaaggatttgtgatccgtcagaaaggatttctgtgcctcgttaagagcaaattgattcttggccaggagtttccaatcgtgcgaagctcttgtcaggataaaacactgaatctctgcctccatcttctccaagagcagttggtctgcatcagactgtaaagacagcagatcatcgttacatgctatggtatcatgtggttgtacttggctgagtgcatctagttcaagtatttttgaatctcgctccttgatgagcatggtggcttcttccagcttccactcgagcatctttatcttctcatttaactcttctacaggtgagctgctccattctatttcactttggtgaattgtggaatcttcatcagtttctttcctgatttccacaaacttttggatctcattctcaagcgcttcttgtgccgactgaagcagtgccatcgactcaacatacggatccaagtatgaatgagtctctccattctcaaacttgcccacactcgcttcatcaaaggtatgattgttggaaccagtgtcacagttccccaatatccctactacactcccattctccttgcagacacctcctgtagcataccgcaggcctgcacttggagattcgtcgtcactttgttgaccatcagggaatagaaccttgtgaacaccgttgcttgtgacgtcggtaatagatcgccgcgcatgagcagcgttagagcttcggaggttggactcgacgctggagcgagaattgtctgcttcagccgtggaggaggcgccgcgcacacgtgcagcacggatgctcttgccgtgagcagcgctgggggcgcgggatcgcgccctgtcgcgctcccggccgaagccgacagacgagaagtcgtggcgcggcgcgctggcggccgtggaagacttgctggtgcggtcatcgctgttgtccgaatcggcgccgccggctcccaccgagaaaccggtggtggcaatcaggtggcccagattcgggtccaacctagtcagcgtcggcggcggaggtggggacgcctccagcggcacgaagcttgacttcacggacgcgaccgagctctccacctcctctgcagccgcgtcctgctttcccttgggcttgtcgtcggcaggaccgtaacgacgcttgtggagctgcgctgccaagtcctcacccgcgctagctccagcactgttaccgagcccggggctcaccggagacccctcgtggtgctgctcgcgcgggatacgacgccaccggcggagcccgcggccctttgtgaccggttcggctggccgtgtctgaggcgccggcgcggccaccggcgactcgcccaccgactcgccgacgctgttggcgccggaatccatgccgcctgccaccggaattgacaaccttggccgcggctttagaagccggatgggatgagttgccacatcggagggcgagaggcacgagtccttgggatcggggcgagcccttggtggggggatcggaattccccagctcgggcctagcctggaactggagatccagggagtggaaggcgagaggaaacagacagtatcagactatcagtaaacaaacctgccggggg

SEQ ID NO: 21271 - DNA, 3572 bp, Zea mays
ctaaggtgacgatagtaaaaaaaaccacgcttgtggtttttcctgtttcttttttagccatttttacagtaaattcatattcataagaagttactagcaaaatcgagttgatggtacaaagacgaaaatttgtaaggcgattgatgcctaacaagtaacagtgaacaatattgcaacaatgcctaatcaaaggctgggctgattggcctaattctctaacctcaagtaggtacaatctccggagaaggcggcaggaagcgaacgaggatggtcccgatggctatgcatagcagtataaactggaccgagcagaacaaggaggctctgctagctctggcctgcagcttcagaacttctgaaatctcagacagctccttgcattgcgagtctagtttatccaccatatcctccagcatcatcgccctgttctcggcatgccgcaatttggtttctaaggatttgtgatccgtcagaagggatttctgtgcctcgttaagagcaaattgattcttggccaggagtttccaatcgtgcgaagctcttgtcaggataaaacactgaatctctgcctccatcttctccaagagcagttggtctgcatcagactgtaaagacagcagatcatcgttacatgctatggtatcatgtggttgtacttggctgagtgcatctagttcaagtatttttgaatctcgctccttgatgagcatggtggcttcttccagcttccactcgagcatctttatcttctcatttaactcttctacaggtgagctgctccattctatttcactttggtgaattgtggaatcttcatcagtttctttcctgatttccacaaacttttggatctctgcaatatatatacaaggaagcagtcaatggaaaacacttgactgggccaaaagaagattttcttaggacaaaaaacatgttttgtaggaaaagctaaataaggtttaagaagatcatgaaaatatatagagtagttatgaccgtgaagcagatgttaactagcacaccgaaatttatggtagaaacatagtatttctcagaagaagcaaaataagcatggaaaaaatgctaactgaatacaacaacgaatgctccaattccaagttataaagcatgtaaaattactcattttcagctgaaaattctaaagtacacaagtatatatatatatgatagcacaggaaaattctggcaggtgttacacaatcaacaattgaggtagataattacagtagactattagactttgtattcttggggaaaaaacatgatcttggaagttggaactgcttgatggctatgatatgtcaattgagatggcaaaaggtcaaagctactgcatttgttttagaaacaagcatgccatactttggctttacaggtaaaatagtgtttaaataaaaaagcaaacaaggaccatgtggcaggatgttcttagattaactcttctagtggagcaaactcattcaaacagtggtgttctgctgaagtaaccaccatcggcatgaaggaagcatgagagtggcatgaaataagttcatcaaaagattattctataaacccaagcattcctgtatcggttgcccctcttccaccaatgatttctcatttaattgcccatttcgttccagcaaatagagtgcccacatcataaacctaaattaattaacctcgctgcgaagatccagtgcattaggttatctccaacagattctctatcgcattccatatttcaaacttcactctgcaaacagtgtcaaaaagtgtcatctacagttccgtgtcccctattttacactacccgccagagacagtcttacccgtaacctagcaaactgtaagatcaaagatgcttgcatgtctgtcaaaagtagtaatgaacaattatgacactctgcaacgagcataccaagcaactatgttcaaaatcatgagacactctgcaacgagcagaattccgaaatggtttaatcgtctctaataagcaagatttgaatgaattgaaattttgcaaggtaaggtgttccaaaccataccattctcaagcgcttcttgtgccgactgaagcagtgccatcgactcaacatacggatccaagtatgaatgagtctctccattctcaaacttgcccacactcgcttcatcaaaggtatgattgttggaaccagtgtcacagttccccaatatccctactacactcccattctccttgcagacacctcctgtagcataccgcaggccagcacttggaggttcgtcgtcactttgttgaccatcagggaatagaaccttgtgaacaccgttgcttgtgacgtcggtaatagatcgccgcgcatgagcagcgttagagcttcggaggttggactcgacgctggagcgagaatggtctgcttcagccgtggaggaggcgccgcgcacacgtgcagcacggatgctcttgccgtgagcagcgctgggggcgcgggatcgcgccctgtcgcgctcccggccgaagccgacagacgagaagtcgtggcgcggcgcgctggcggccgtggaagacttgctggtgcggtcatcgctgttgtccgaatcggcgccgccggctcccaccgagaaaccggtggtggcaatcaggtggcccagattcgggtccaacctagtcagcgtcggcggcggaggtggggacacctccagcggcacgaagcttgacttcacggacgcgaccgagctctccacctcctctgcagccgcgtcctgctttcccttgggcttgtcgtcggcaggaccgtaacgacgcttgtggagctgcgctgccaagtcctcacccgcgctagcaccagcactgttaccgagcccggggctcaccggagacccctcgtggtgctgctcgcgcgggatacgacgccaccggcggagcccgcggccctttgtgaccggttcggctggccgtgtctgaggcgccggcgcgggcaccggcgactcgcccaccgactcgccgacgctgttggcgccggaatccatgccgcctgccaccggaattgacaaccttggccgcggctttagaagccggatgggatgagttgccacatcggaggacgagaggcacgagtccttgggatcggggcgagcccttggtggggggatcggaattccccagctcgggcctagcctggaactggagatccagggagtggaaggcgagaggaaacagacagtatcagtaaacttacccggcgagccccgggggttcctgttccctataggcggcccgtttgtgagcatgtgataggtaagactttgttcggtaatctattatttacctcaatatatatgtattgagctggattagtgtgtaagttagtttaatttacacttcaattgtcacacccgggttttaggggcaccaagacccgggcgcgaacataatcaccaggtgtgctgcgactaagtctcaaacatatgatgaatcatgacacagggtcgaatgtcatatctttactaaatatcaggagttctatacaaaataaataaataattacattataagaagacaacggtccagcaacccaaagttg

SEQ ID NO: 21272 - DNA, 2235 bp, Zea mays
  misc_feature (16)..(18): n is a, c, g, or t
ccgccctttttttttnnnagttttttttttttttttttccctgttgtggagtaaactcgtattcataaagaaattactagcaaaatcgagttgatggtacaaaaaacgaaaatctgtaaggcgattgatgccctaataagttacagtaaacaaccgttcaacaacgcctacataaaggctgactggcataattctctaacctcaagtaggtacaatctccggagaagaggacaggaagcgaacgaggagggtcccaatggctatgcacagcagcacaaactggatcgagcagaacaaagaggccctgctagctccggcctgcagcttcagaacttctgaagtctcagacagcgccttgcattgcgactctagtttatccaccatctcctccagcatcatcgccctgttctcggcgtgcctcagtttagtttctagggatttgtgatccgacagaagggatttctgtgcctcgttaagagcaaattgatccattgtcaggagtttccagtcctgagaagctcttgtaaggataaagcactgaatctctgcttccatcttctccaggaacagccggtctacatcagactgtagggacagcggatagttgttacatgctactgtattctgtggttgtacatggctgagtgcatctagttcaagtatttctgaatcccgctcattgatgagcatggtggcctcttccagtttcaattcgagcatctttatcttctcatttagttcttctacaggtgagctgctccattcgatttcactttggtgagctgtggaatcttcgtcagtttctttcctgatttccacaaacttttggatctcattctcaagcgcttcttgtgccgactgaagtaacgccatcgactcaccatacagatccaaacctgaatgagtccctccattctcaaacttgcccacgctcgcttcatcaaaggtatgatggttggagtcggagtcacagttccccaatctcccttctatactcccattctccttgtagaaacgtcctgtaccataccgcatgtccccacttggaggttcatcgtcactttgatgaccatcagggaacagaatcttgtgaacaccgttgcttgtgacgccagcactagatcgccgcgcatgagcagcgttagagctccggaggttggactcgacgctggagcgagaattccccgcttcagcaggggaagaggcaacacgcatagtggcgccgcgcacacgtgcagcacggatgcccttgccgtgagcagcgccgggggcgcgggaccgcgccctgtcgcgctcccggccgaagccgacggacgagaagtcgtggcgcggcgcgctggcggccgtggacaacttgctggtgcggtcgtcgctgttgtccgaatcggcgccgccggcgcccaccgagaaaccagcggtggcaatcaggtggcctagattcgggtccaacctagtcggcgccggcggtggggacgcctccagcggcacgaagctggactccacggacgcgaccgagctctcgacctcctctgctgcagccgggtcctgctttcccttgggctcgtcggcggcaggaccgtaacgacgcttgtggagctgcgccgccaagtcctcacccgcgctagctccaacgccggtatcggccccggggctccccggagacccctcgtggtgctgctcgcgcgggatacggcgccaccggcggagcccgcgacccttggtgaccggctcggccggccgtgtctgcggctccggcgccagcgccagcgacggcgactcgcccaccgactcgccgatgctgttggcgccggaatccatgccgccggccaccggaattgacctcaggggccgcggctttagaagccggatgggatgagttgccgcatcggaggcaggagtccttgggatcggcgggagcgcttggtgggggctcttgggatcggaattccccagttcgggccttgcctggagctggagatccaggagtggaaggtgagaggaaacagaaggtgtcagtaaacaaaccagaaaatgctggggttttgcctactcttatctgtgctcgtggtgtactggtgttcgctgtacgtggccagttctgtgtgggacccttgtcctagctggcgggcgctacaaagtacacactagccggcgtcatgcagaatgcgggccatcacctcaccgttcaccggtcaccggtcaccgccttaccggcggggggctgacggctgttac

SEQ ID NO: 21273 - DNA, 2765 bp, Zea mays
ccgagcgtcttttaagactttagatagcccaataatgtttttgcgagttcatgacttgcaagttgcaaacaacacataaagcatcatgacagatctctcagcataaaccaccaaggtgacgagattccctttcgaacattataccgaccatagaaaaaaaaaactacacatgtggcatttccagaatccagagaacccagaagtggagtaaactcgtattcataaagaaattactagcaaaatcgagttgatggtacaaaaaacgaaaatctgtaaggcgattgatgccctaataagttacagtaaacaaccgttcaacaacttctacacaaaggctgactggcataattccctaacctcaagtaggtacaatctccggagaagaggacaggaagcgaacgaggagggtcccaatggctatgcacagcagcacaaactggatcgagcagaacaaagaggccctgctagctccggcctgcagcttcagaacttctgaagtctcagacagcgccttgcattgcgactctagtttatccaccatctcctccagcatcatcgccctgttctcggcgtgcctcagtttagtttctagggatttgtgatccgacagaagggatttctgtgcctcgttaagagcaaattgatccatcgtcaggagtttccagtcctgagaagctcttgtaaggataaagcactgaatctctgcttccatcttctccaggaacagccggtctacatcagactgtagggacagcggatagttgttacatgctactgtattctgtggttgtacatggctgagtgcatctagttcaagtatttctgaatcccgctcattgatgagcatggtggcctcttccagtttcaattcgagcatctttatcttctcatttagttcttctacaggtgagctgctccattcgatttcactttggtgagctgtggaatcttcgtcagtttctttcctgatttccacaaacttttggatctctgcaatatatatagaaggaaacggtcaatggaaaacacttgactgggccaaagaagattttcttaggacccaaaaaccaagtttttttctaggaaaagcaagataaggtttcagaatatcgtaaaaatatatagatgagttatgaccatgcagcagacgatatgttagcacgccaaattaacagtgcaaacatagtactgtattttttaagaagcaaaataagcacaaaaatgctagctgaatacaatgacgaatactgcacttccaagaagttacagcccgggcgagccaattagtcattttcagctgaaaattctaaagtgcatgagtacatcacagcacaggattgctcctgcccctgtgtctcacatccaccaattgcggtagacaattcgagcggacttcgtattcttgggggaaaaccatgaattttgaactgctctgacgagcttatgatattgtcaaccaaaatgaaaaaggtcaaaagttactgcatttgttttagaaacaagcatgctctcaccttgaccagatcatcttacagctaaaacactgttaaaaaataattaaggaccatttggcagtatgttcttagccaaactcttctagtggagcaaacacactcaaacactcgtgtctattgaattaacgaccagtccgtatgaaagaagcaagagagtcgcatgaaataagttcatcaaaatattatcctacaaggccaaacaatcctttactggttgccccccttcaatcaatgatctcacattcacaacaattgccattttcataatttcattccagcaaatagagtaggccacatcataaacctgaactaattaatctcattgagaagatacagggcgtcacccctaacctagcaaaccaaaagatcaatgatgcctgcatgtccaacaaaagtagtaatgaaaaaatatgacacttggaccacaacaatcaacttctctcttcaaaaccatgagattcaatcgtctctaatgggcaaggcttgaaaaaattgaaaagttcgcaagttaagttggtagtgagaaatccgaacaataccattctcaagcgcttcttgtgccgactgaagcaacgccatcgactcaccatacagatccaaacctgaatgagtctctccattctcaaacttgcccacgctcgcttcatcgaaggtatgatggttggagtcggagtcacagttccccaatctcccttctatactcccattctccttgtagaaacgtcctgtaccataccgcatgtccccacttggaggttcatcgtcactttgatgaccatcagggaacagaatcttgtgaacaccgttgcttgtgacgccagcactagatcgccgcgcatgagcagcgttagagctccggaggttggactcgacgctggagcgagaattccccgcttcagcaggggaagaggcaacacgcatagtggcgccgcgcacacgtgcagcacggatgcccttgccgtgagcagcgccgggggcgcgggaccgcgccctatcgcgctcccggccgaagccgacggacgagaagtcgtggcgcggcgcgctggcggccgtggacaacttgctggtgcggtcgtcgctgttgtccgaatcggcgccgccggcgcccaccgagaaaccagcggtggcaatcaggtggcctagattcgggtccaacctagtcggcgccggcggtggggacgcctccagcggcacgaagctggactccacggacgcaacggagctctcgacctcctctgctgcaggcatgca

SEQ ID NO: 21274 - DNA, 6394 bp, Zea mays
taactcatattttagaccaattttgtgttgtttgaattaagttttgcaggatcacctatttaccctctctaggtactctcacaaaggtagaccctacgacgtcaccaaaacaatatgccgacgttcacatcaaacatatatgcataattcacacataaaacgttagccattattggtgaaacttattattatcatttcatcttgtgtaaataagatcgaacgcaatattgttaggcgacgacaatacatcttttcgagttgatgaagaccggcgattatgtgattaggcaccaaggaggcgaaatcattcccttcatcatcccatttaccaaccaatgtgacaatgacaaggttattttttaaagaggaaaaaaatctctttgtttataaagagcaagaaaggtcattgaagttttgaaataaacaatacaagaacaaacaaatttctgcttgaagcacacgggctggccttgcgcggatccctatgacagatttgactgcgttcggaaccagctagctgctgaccccgtccggtagtgcgtgcgactactgcttattggttggtagtacaacaattcggagcaaagcgtcttgaggaatcccttgaaaaaattcgcagaatcacagcatcgcgagctccctgacgttgacggggttgacgaaggtctggttgccggcgaagatcgtctgcgcggcgatggccgagacggcctgcgagggatggttggcgtcccagaacaggtactcgtcgcggtcggcgcacaccggcgccgtctcgttgcacgcgagcgccgccccgaacgggccaccgccgcagcacgcggcctccaggtccgtgaagtctgcaggcaggtacacacagtggagcaaacggtacatgcatcatcagatcgatcagaagaagaaaaagaagaagaagagaaatgaccggtgatcatctgccgaaatcaaccggcacgcattcgcgtaggggggaaggaaggacgaattgaaggagagatggcttactccaggcctcggtccgcgggttttggaagacgaaggagaccatcgcgtaggcgtcggcgagggagtaggccatgccgggcagctggtccctgcgcgcctgcagcatccccgcgagcatcgggtaggagctgagcgacaggtcgttgagcgggtcgaagcagccctgcgttcccagctgcttcagccggcgcagcctctgcgacgggatgcaccccagcggcgggatgctgatgacgctgaacttcctcgcgcccatttcgtacagcgactgcgtgcaggtttgtgaaagtgcagaagcagaatttattctagccggcctgaggaggatctggcgattgatgacgagtgcggcttgtagtgagcagtacgtagtacgcaccatgatgtagtgcttgtaggcatcgaccagggcacccaagaacgcttcgtcgtcgtcgtcgtcggcacgggacgacgcggagtactcgaacatgtcgttgctgccggtgctgatgaaaaagatggacttgcggaggagagcggcggtcttcctctgacccgagagcttgaccatgcggtcaacaacccccgagaagtgctccagctggacggacatggggatcacctcgccaaactgcacaaaacacgtacgcgacgcgcgaggggttttttttccagagacatgggttagcttagctagcttcgttctgtggtcaagcaaggacgagtgcagtgcagtgcgtgcgtgtgtaccagtactctgccggtcgagtccaagagcccggaccctgccgacgcgaagctgatgcccttgcacatgtgagaccggatgcccttctccgacagggagaggtaagccggcgggctcttggtgaagccgaggcctcgagctgtgttcgatcaccgccatgcgcaaccagtcagtcagtgaccacagaaacacacagtacacagatcgttgctgagctctcctctggcagttcggttcgtcgtacctagcaggtctgccgtgttgaagccgttactgaaccgcccggtcggcttggacccggggaagtcgatgccgtactgcgggtagttggctctggccccggcggtgacgttgaggcagttgttgttgcccacgtccaccgtggagtcgccgaacacgaacgccgcggggacaagccgcgagtgcctgctggcctccgcgttcgttgccacgagcacgagcaggcacacggtggccaccagcacggatagggggcccgtccgccggttggccatcggatcggtcgctgtggcttttgcttgctgttgctggtgtgctctcgtcgggtttttttttttcctttcaggtggtgactggtgactgactggtgagggggtttatatgcaccgtgacaggatgcacatggttccatcagcgtagcgttagcatcgacgagctcgccaatacgctgtttccgttctggaacggaattgtcaatgttgttaacgttctgtggaatcatctggatgatgccgttttcatccaaattccaaactgctaaggtccgagaatgtgtcgtataaaaaggctgaaataaaaaaaaaattgtgcgagtgttgtttgaacaggtccacatggcctagctagaccggtagcgcctagggaggcaacaagcgacgacgtcgcgacagatgcacagctgctgcagcttaggacagatcagctgggaccaagaacggcatgcgttggtggcctgcaggaatgtaccgacatgcttagagcctgcgctcggatccaaagggcgtgagcgtgacgctctcactggctcctacaccaggtatttctgggcgcgctctccggaatttttagtcgaggacgcgtaaaaaaagattcagttaaagttgtccaggagaggtgtagacgatgtcacgtacacggtacttccgttcctctgctgctcctggctgctcatcccttcacagtccaaactacgccggcggcgtcggtcatcatcatctaaaccaaaccacggtcgagaaacatacagcgaacacagcagccatgcacgcatccgtcgtcctctacacaccaacgaccatattcaccacagtccgcagcagagaacagagacacgtccctacgtcctcgtgctagctctagctgtgctagctagcaccggtcgtcttcggccagctgcctgaagttcatcggcgcggcgaagtggagcgagccgttgtagatggcggcggcggcgatcttggaggcggcgtgcgtggggtgcagcaggtcccagaacaggtactggtgccggttgtcgcacagcgtcgcgttgggcgtgcacccggacttgccgttgaaccggcccgacccgcagcacgcgttcgtcacgtccttgaaccctgcaccgtaaccccggccagctaagttattatctgcaggtgaaagcgtcgtcgtgcgtgtctgtcgagctagctagggagaggcacacgtgtatgtacgtacgtacgtacccagcctttgagggtgcttcatgatgctctgcacgacggcgtgggagctcccgacggagtacctgagcccctggaagctcacgccgaggccgtgcatggccgccctgacgccctcgttgaacccgcgcgccagctcgttgagcacgtcgatgcaggcgcccagcgggtgcaggctcctcgggtaggggcagcacccgaccggcgggacgtcgatcacggcgaacttccgagccccgagcacgtacagagcctgaacgaccaccacaccaccaccaacacgtttaatgatccgaggtttctctgctgcatgcgtggtggtttcagaggcggcgttgaggcaacctactttaccttcacatggttctggtacagcgcgacgaggttggcgacgaaccgccgcttgtcggcgtccgacggcgtgctgttccgcgcgaagaaggcgaacaggtcgttgccgccggtgctgacgaggaacagggaccgcgacagcagggcgtcggcagcagcagacccgttgccgacgcgcgacgagatgttgcgccgcacggaggcgaactgctccacctgcttgctcagcgggatgatggagctcccctgcacatgaacagagagtgatgtgatccacgcgcagtgtgtgttgtcatctttgctcgcggtagtcgacgtgctccggtctggtcactcacacgggtgagggtggcttacccgtcgtgtcgaggatgcctgatcctgcagaggcgaagttcactcccaggagacctcggaagacctgcctgttggtcttgttggccacggcgaggaacggcggggggctgcgcttgaagcccatgttcacggctgatggagttgaacgaaacactttttagtttttttagcaccgccaggagatggacatgttcccagcacaattctccagcttgtgattgtgcatgtacaaggcagattcattggtagagctgctacgtactactagtaatttatgggttcaattttttttactagatgcgaaaaaaatttgctacagcccggctacaaaccaagatgtttacagcccctcacaaaaaggagaatagaccccacctgcaggtcaataacacaactctctggtttgcagctaggttgcagtaaatttttttccgcaaatatggactatggggctgtttgctgcctagattatataatttagcgtaataaacaatcagattatataatctagaagctagattatgataatctcatacgttattctttctctccccaaatcgcacaacaccacgcacaacacttcttctctccctgctactcgtctgaacagacaacgggattggtggctcacatcctgttcacggccgtcgcgtagctgtaccttagcggcggactaagatattgttatctttggtcctgtttggcacagcttattttcagcttcttcacaaatttaagcagaagttcaaccaaacagctaacttctgcagcagcttatcagtttagctgcttatcagaatacagtaaaaacagccaacaagcaaaaggtgcttttcaccagcttatcagataagctgctttttcagcagctgtgccaaacagagcctttgtgtatcagataacaataatctgtatatatataatttggactaccaaatagctacatataaattataatcttcatagattataatctaaattatataatttagattataatttagattatataatctataagctgaaaaaaacctatgtatttgaggtacgagcatagctgacgtcttttttgtgtgcgtctatatccgtgttctgctgaaaatatgaacattatacacaatcttctattttccgcattcacttttgtttaggaaacattatgctagcaacagactcagagccgtgcggcccggtgttggtgatgggctaatgactaaacgtctaaactttcgcttggattcaggggctttttgacgatgtgctccggcaaggggcgcatcatctttcgggttaggacgtgcgtctgtcacctttcgagttagaatgttttattcgaaatgtgaaggagatgaccagacagagacagatagcgaatgtgagtcaattaaaaaaattcaattcgacgatggctttttttagtcatcagagttatacgtaccgactctatggaccacaaaaataattaagaacttttttaaaaaaataacggaagcaaattcagcggcaatcaaactccaattttcctgtttcacgaaaagcaactgagcaactcaaaaatggaattagcagaaaaagaagaggacttcaaccgcgagcattccaagcgctgaactgatcaagcaatgattagtcagaggtgatctaaataattcgatctgtattgtttgagaggtgacctgtgacaaataagaaaacgaggttgctgctgcaagtcaactgcctgtgaagatcgacctctgttaccttgccgctcgggttcagatctgaatcaggacgcctgatcaaactgcaactagtaaactgagaaacaaaactggacccccgtacagaccggccgggctgcaggttatacatcggatgaagcgttggtgttgatcagtacaccgtatggttccatgcccaacagaaatcattctggggatttagagaagaagctggggatcgagcgatccgaacaagcatcacgtgcaaaacaacagaaaaaaaagggttcctagaagggcgagtttttaatatgaatttcagaggatagaaaagtcagtcatatacaaatcacctcagcttcttgtatataatggtctatcagactcgatatagtttttgatgagttattgagttatgaagcaactatatctttatatagcggaaacacaacggtgatgacaagtctttcgtcatggaagtgaagaacgtgacacaaacttgttttttcttttcggcc

SEQ ID NO: 21275 - DNA, 1644 bp, Zea mays
ttttttttttttttttgttttttttttttaaaaaaagattcagttaaagttgtccaggagaggtgtagacgatgtcacgtacacggtacacccgtacctctgcagcagcatgatgtaaattcgttcacagtccaaactacgccggcggcgtcggtcatcatcatctaaaccaaaccacggtcgagaaacatacagcgaacacagcagccatgcacgcatccgtcgtcctctacacaccaacgaccatattcaccacagtccgcagcagagaacagagacacgtccctacgtcctcgtgctagctctagctgtgctagctagctagcaccggtcgtcttcggccagctgcctgaagttcatcggcgcggcgaagtggagcgagccgttgtagatggcggcggcggcgatcttggaggcggcgtgcgtggggtgcagcaggtcccagaacaggtactggtgtcggttgtcgcacagcgtcgcgttgggcgtgcacccggacttgccgttgaaccggcccgacccgcagcacgcgttcgtcacgtccttgaaccccagcctttgagggtgcttcatgatgctctgcacgacggcgtgggagctcccgacggagtacctgagcccctggaagctcacgccgaggccgtgcatggccgccctgacgccctcgttgaacccgcgcgccagctcgttgagcacgtcgatgcaggcgcccagcgggtgcaggctcctcgggtaggggcagcacccgaccggcgggacgtcgatcacggcgaacttccgagccccgagcacgtacagagccttcacatggttctggtacagcgcgacgaggttggcgacgaaccgccgcttgtcggcgtccgacggcgtgctgttccgcgcgaagaaggcgaacaggtcgttgccgccggtgctgacgaggaacagggaccgcgacagcagggcgtcggcagcagcagacccgttgccgacgcgcgacgagatgttgcgccgcacggcggcgaactgctccacctgcttgctcagcgggatgatggagctccccgtcgtgtcgaggatgcctgatcctgcagaggcgaagttcactcccaggagacctcggaagacctgcctgttggtcttgttggccacggcgaggaacggcggggggctgcgcttgaagcccatgttcacggccaagaagtcgacgccgttgaacccgttgctgaacctgccggtggggcgcgccgtggggaagtcgacgccgttgtgggggaagttggcacgcggcacttcggcgccgcccggcaagtagttgttggtgcccacgtccgccgtggagtcgccgaacacgtacatcgccggcaccttgctgctactccctgccgccgcggcgcaggcggccgctgcagcgcctagcagaacgtgcaggactaggacgacgacgggcgcggtggccatggccggcctgccgggctgtgatcgccggactctagctcggcgtagcccgtagtgcgcagctagcaagctagctagtgagtgagtgggggactggggggcgggcggtggcagtggcaccctcgctggtcgctgctcggctttgggaaagaaagggtcagccgagatggatcggcacggctcggcgctttaaagagagagagagat

SEQ ID NO: 21276 - DNA, 1504 bp, Zea mays
catgtcatctcatcacatcacagtccaaactacgccggcggcgtcggtcatcatcatctaaaccaaaccacggtcgagaaacatacagcgaacacagcagccatgcacatccatcgtcctctacacaccaacgaccatattcaccacagtccgcagcagagaacagagacacgtccctacgaactcgtgctagctctagctgtgctagctagcaccggtcgtcttcggccagctgcctgaagttcatcggcgcggcgaagtggagcgagccgttgtatatggcggcggcggcgatcttggaggcggcgtgcgtggggtgcagcaggtcccagaacaggtactggtgccggttgtcgcacagcgtcgcgttgggcgtgcacccggacttgccgttgaaccggcccgacccgcagcacgcggtcgtcacgtccttgaaccccagcctttgagggtgcttcatgatgctctgcacgacggcgtgggagctcccgacggagtacctgagcccctggaagctcacgccgaggccgtgcatggccgccctgacgcccttgttgaacccgcgcgccagctcgttgagcacgtcgatgcaggcgcccagcgggtgaaggctcctcgggtaggggcagcacccgaccggcgggacgtcgatcacggcgaacttccgagccccgagcacgtacagagccttcacatggttctggtacagcgcgacgaggttggcgacgaaccgccgcttgtcggcgtccgacggcgtgctgttccgcgcgaagaaggcgaacaggtcgttgccgccggtgctgacgaggaacagggaccgcgacagcagggcgtcggcagcagcagacccgttgccgacgcgcgacgagatgttgcgccgcacggcggcgaactgctccacctgcttgctcagcgggatgatggagctccccgtcgtgtcgaggatgcctgatcctgcagaggcgaagttcactcccaggagacctcggaagacctgcctgttggtcttgttggccacggcgaggaacggcggggggctgcgcttgaagcccatgttcacggccaagaagtcgacgccgttgtacccgttgctgaacctgccggtggggcgcgccgtggggaagtcgacgccgttgtgggggaagttggcccgcggcacgtcggcgccgcccggcaagtagttgttggtgcccacgtccgccgtggagtcgccgaacacgtacatcgccggcaccttgctgctactccctcccgccgcggcgcaggcggccgcagcagcgagtagcagaacatgcaggacgactaggacgggcacggtggccatggccggcctgccgggctgtgatcgccggactcgtagtgcgcagctagctagctagctagtgagtgggggtactggggggcgggcggtggcaccctcgctggtcgctgctcggctttgggaaagaaagggtctgccgagatggatcggcacggctcggcgctttaaagagagagagagatt

SEQ ID NO: 21277 - DNA, 701 bp, Zea mays
ttttttttttttttttgagaagctgctttcatatcatacatgatacatcaagccataaacaaaccatgtgccttctcatttctttaagaaccatcacaaaaacaacagcaacctctaccaatgtaatagaatgcaagcgaagcaagcatacatttgctgataaatttgctcctggtctaaaaacatcgcagcaaccgaaacaggaaagaaagaaaattagcagggaccatatttgaatcagatcattagcggcatgatgcaacactcgcgttgcgcacaaggtaatctggaaatgctctgaatggttggtttgttggttcttgccttcacttcttgtgcgccctgtagtctggggagttgtggggcaatggggacaatggatgccttgaagaatctgcacagccgaaatcaagagccctgccagctgtgttgccatccctcaagctagacgacttgcgcttgttcttggtggatgtactggcagatttctttctttcagaccggcgctgtcgctccttctccaacaaactcagcagccttttgatctcttcatcaagagccctgttgtcctcactcagtgtcacgacctctgcctccgccgtatcaagattcatcttcagaatctccttttccttatgtagctcttgcacttgcaccatcaatgctgccaaatctgagttctggtttaggcgtgcgcggag

SEQ ID NO: 21278 - DNA, 702 bp, Zea mays
atggctgatggggaatgtcgtagccatcaaaataccagaggcaaccacaaatctgcatttctgtatgtacttgagatcaatggtatccatatctgcaccactatttttcataaatccacagtgaaccttcatggtagagttcagtttaaagctctcctccctctgtttccagttttggtgccctccaaacagcggtgaaggatctttgtcctgcttgtcaacggttatatatgacaacttcttcacgattgtgttgggagtcctctttgggatggcaatagcatttggatcattcgcaacaggtatcgggcagcggtggagtggtttcgatgagagccccatcgagtccaacaccgagaaaactttactgtccttttcacaaagggctgagaggaacgcgacgggggagctgcagggccggaggtggaaggcgagtgcgacgagcccaagcatggcccaggcgatggccgacacgagcaccagccgcacggcgcccctgcgggacaccacccgcaccgccgccgcatgcgccttcaacgccgcttccgtgacgatgccgccgcctctgcttcgtctcgccattcctcctccacctcctcctcctccgccgccgccgccgtgctcccgtttcaggcctacggctttggggcctgttgggggggaggccactgtgacagtgtgagagcccaaaacaaactactt

SEQ ID NO: 21279 - DNA, 2291 bp, Zea mays
cggccattctctagagtggacctgcagctgtttcaagtggagggatttctgaacttgcatccggggaaggctgctgctttgcagattgagtcttgtgttccacttccacctcgagttggcccttgtgattcccggcgggatcatctgtatatacgtccgtgaacatagctgcaactggctgactcacgtgtagggccgtggggccagctgcggctatggtgtggccccacacgtcaggcgccagacgtaaatgtaaaggaaacgcgcgtcctgtgattctggtgtaggaacatttggtaggtcacagaatgctgatgtgatgtgattgtatcaggggaaaggcaaacgattcattaaaattaaggaagtgcatgatgcgttggcgctgatcattttcaggtgctatggttgttttgtgtgtgacgacttctaatgctgttttgatatccctatactagacctgacgagtcatggtggggcgggggtgagaaatccttctgttgtacctccgtagatgagtgttgtacagaactggaagcaacaaactccaagcgtcagcctacataatctacgccaaacaaacaaacaaacagtggagttctactctgtacaaccatgaacgaatcaaagatcacaggatcggcaggctaggctgggagctttgtggtctttgacagcctagccttatcctgccggcgaagttcttcttacagcagggagttccacggagctgaggtccgcagggtacggagtccacagccccaaccctcctctactctccctcagccccttctccacgatctcgtcgaccgttttggcccactcgaccttagacgagtgctccctcgtgtgcctgtgcaggacgaacagcgagttgtactcgcagttggggaacatgaagagctcgagagcgtcgccgagcctgcgcgccacgtagccgaagctgatctggtcgcgtggggtgaagaggttcacctcgttgaaccagaggcagctgaacaggttggtcgtcgctgtgtgttcccggatcagcacggctccctccggcacatcgccaggcatctgcttcttcggcaggcatctttttcttcgggctccaaggctccatcccctcgtaatagtacatcttcatctgaagatcaaccaaagggcgggcgtagcgcttccgtcgcttgatcgcgtcgccctcctcgtagatgctcctatgatgcttgtggacagccaccgcgaatgtgtattttccacgccagaggtacctctcgagaataagcagcggatcaactatgagctccattttcccgtcaatccaaatgctataccaagcttgagggaatagtctgtgcgtcaagatcttgggtattttcccgttccttctaggttcgtcgaatgggaggcggtgcactgttagaagtcgccatatgccaacccatttccctccagcgctgtcgatcttgacggtggtgttcttttggataaaatcaagagatacttcgtccaccaccatcaggaagcagaacagcttctgagaccggcggctgatattggatggctggtgagggatgtcgtaaccatcgaaaataccagaggcaaccacgaatttgcatttctgtatgtacttgacatcaatgatatccatatctgcaccactatttttcataaatccgcagtgaaccttcatggtagagttcagtttaaagctctcctccctctgtttccagttttgacgtcctccaaacagcggtgagggatctttatcctgtttgtcaacagttatatatgccaacttcttcacaattgtgttgggagtcctctttggtatgacaacaacatttggatcatccgcaacaggtatcgggcagcggtggagtggtttggatgagagccccatcgagtccaacacagagagaactttactgtcttttttgcaaagagctgagaggaatgcgacgcgggagctgcatggccggaggtggaaggcgagcgcgacgagcccgagcatggcccaggcggtggccgacacgagcaccagccgcacggcgcccctgcgggacaccatccgcatcgccgccgcgtccgccttcgacgccgcgtccgtgacgctgccgctgcctctgcttcgcctcgccattccctccgccggccgccgcgccgccccgtgcgaggcgagggcgtgggtgacgtcaggcctacgccttatagggacgccaccgtgactgagtgtgcaggcaagctaactccattccacctggagatggagttggtgcgccggcccgagggacccatttacaatt

SEQ ID NO: 21280 - DNA, 1630 bp, Zea mays
gcacagaaccggctggaagcatcttgctctttttattagcctacggtacccccggggttcagttaccacagaatctacaggaattacatgatctcgtctgattaagcgagaaaagaaaagggggggaaatcagtagtgttctactttttacaaccatgaacgaatagaagaccaaaaaatcccagcctagcctgccggtgaagtcctttttacagcagggacttccacggagctgagatctgcaggatacggagtccatagccctaatcctcctctactctccttcagtcccttcttcacaatctcatcggttgttttggcccactcgactttagaggagtgttctctcgtgtgtccgtgcaggatgaacagcgaattgtattcgcagttggggaacatgaagaacttaagagcgcctccgagcctatgcaccacgtagccaaagctgatctgatcacgcggcgtgaaaagattgacctcgttgaaccagaggcagctgaagagatcggtcatcgtcgtatgttcccggatcagcactgctccctccggcacatcactaggcatctttttctttgggctccaaggctccatcccctcataatagtataatttcatctgaagatcaaccaaaggacgagcatatcgcttccgccgtttgattgcatcaccctcttcatagatgctcctatgatgcttatgggcagctactgcaaatgtgttttttccacgccagagatatctctcgagaataagaagtgggtcaactatgagctccattttcccatcaatccaaatgctataccaagcttcaggaaacagcctatgtgttaaaatctttggtatctttccattccttctaggttcgtcaaatgggaggcgatgtacccttataagtcgccatataccaacccatttccccccagcactgtcaatcttgacacttgcgttcttttgaacaaaatcaagagatacttcatctaccaccatcaggaagcagaacaacttctgagaccgatgactaatattggatggctgatggggaatgtcgtagccatcaaaaataccagaggcaaccacaaatctgcatttctgtatgtacttgagatcaatggtatccatatctgcaccactatttttcataaatccacagtgaaccttcatggtagagttcagtttaaagctctcctccctctgtttccagttttggtgccctccaaacagcggtgaaggatctttgtcctgcttgtcaaccgttatatatgacaacttcttcacgattgtgttgggagtcctctttgggatggcaatagcatttggatcattcgcaacaggtatcgggcagcggtggagtggtttcgatgagagccccatcgagtccaacaccgagaaaactttactgtccttttcacaaagggctgagaggaacgcgacgggggagctgcagggccggaggtggaaggcgagtgcgacgagcccgagccccgcccggccgcgggccgccccgagcaccagccgcacggcgcccctgcgggacaccacccgcaccgccgccgcgtgcgccttcaacgccgcttccgtgacgatgccgccgcctaagaccgaaccgaaccattagctttttttttttttc

SEQ ID NO: 21281 - DNA, 2030 bp, Zea mays
atgcatggtaacattcaatataccagcagcctgattgaaagatcggcgaagctactaaaaccaccatgttacccctgctacccctgcaggcaagaatgcagtatccagctttatttcgtcaggaatcaggcgaggtgtacataccaccgacagcctgtaacgtagcatccaccctatacgcttttattctgtaacatggacgtctttggagacactatagacaagtagtgccatgattacgtatacaaaagtccggaggcgaagccatactttatagttcacgtcatttacaactcatttcggctttcttttgttcatgttccgcggcttattcgctttattcgaaaactgctcccccacaaccagtggccggcccctttcagccatgttcctccggtcttgcagcaaaacgcttgccttcttggtctctcggttcatcatctgccaagcgtttctagcctcaggccagatttcagaactcaacccaagttgcccatgcagatgtacttgagctccaagtattcgtcgacgccgtacttcgatccttctctcccaagaccagactgctttactccgccaaatggtgccacctctgttgaaataatcccctcgtttaccccaactaagccgtattcaagagattcggatacacgccatgaacgaggtatgctcttggtaaatatgtatgcagctaagcctgcgtttgtatcgttggccatatggactgcttcttcctcagttttgaatggtataaggggtgcaactggaccaaaaacttcttctctgaaaagaagcatatcattgctgacattccctactacagttggctcataaaatgacatccccaggctgtgtcttctaccacctagcatgacatttgctccctttgaagtcgcgtcatttatgaacttctccaccttttgaacagcagcttcgttaatcagaggaccctgagatgtactctcttctagcccattcccaaccttcaaactctgaacagccttgatgaatgcagatgcaaacttttcgtagataccttcttgcaccaatatcctgtttgcacaaacacatgtctgtccactgttacggaacttggcagcaagactgcctttaacagcaacatcaatgtctgcatcatcaaaaacaatgcaaggtgcattcccaccaagttccaaagagacctttttcacagtatttgcagattcagccatcagttttttgccaacagctgttgatccagtgaacgtaatctttctgacctgtgtactctgcagtaatgcatcacctatctcaggagcattgcccatcacaacatttagtgcacctgctggtattccagcttgaagagcaagatctgctgcagctaatgatgtcagaggtgttaactctgatggcttgacaacaacagtgcagccacaggccaaagctggtccaacctttcgggttatcattgctaatggaaaattccatggtgtaatagctccaactaccccaacaggctgcttcagaaccaacaatctgcgatcagataaagttggaggaattatatcaccatatatgcgctttgcttcctctgcaaaatattctatgaaacttgcaccataattgacctcaccaagggcttctttcataggtttcccctgctccagtgtcatgagaagtgcaagctcttccttgtgtgaaataattagatcgtaccattttcttagtgccttgcctctctcacttgcagtgagtttactccaagaatagaatgtactgtgagcagaagcaatagcatcagatgtttctctgctgcccataaaggacacgtttgcaaggacctcaccagttgctggattttgcacctcgatggtcttgccatcgtatgcgtcgacccactgtccggcgatgagcccctgcgtcttgagcagacccgcggcgcggatcttctccatcgcggcgctcgcgtccgcgctcatctgcacacccaaattatatcaaacccgcgaccaacaaagcgaacgaaggcaccgcacctcgagccgaat

SEQ ID NO: 21282 - DNA, 1180 bp, Zea mays
ttttttttttttttttgtctcaatgaattatggatcctttggcctaattacatcatttgacatcctaaaaagtgcctcgagcacttcactgaacttgtgactaatggtttccaaagagtacccaaacttgttcctaagttgtctaaatgactgcggttcaccacatgcccaaaggaacattgctaagacctccttcgttgacacacctcgactagcaatgaggtcgtaatcattaactaacgaatcatgtagtcgacgaaacacgatacaacgcatgcggaacatatcgtaaccatagttgggttctctcccactaattctagatcatcttcttcaagctcatctgaaaatgaagctgcatcccttggttgacctcctagaattaaggtagttttattagtgcacacaattggcccaaacatgatccggagatccccctcgttttctagtggttgattcttgaacattagacagcctcattttgctttgcccactagtcattcatagcacttattgatcctgtgtgaggatccctcccgaggcctgttgccctctcattcagtgtcttccattgtgtgtacatgcttttgagggtgtcccacttatttttcatttggtctctagtgtaggttcgaccaatgcgtttcttgaacttccttggttaactcggttgtggagggacaccaacttgaactggatctttggagaagtacctatgctggaaagtatgaaaggggatctctcggtgtacatcggctggaatccgatgaactcgatccgaaaacttcaattcactacgacaaatcatggataacaaatgctaactatcgatgaagtttgaagggatcagaatcgtcgtgaagaacttagaatctcgttgtcgtcattgagaagaatcccagctccgcctagaaggcgagacaggagcgatgcgaggcagcggggaccaaagaaaccctagcgtggcgagagccaaggactggacagatgcccagctagcccagctttctacggaagcccgcttctatcggaccgttgcgggggtggcttcggtgggaagcctggtggctgaagcgacggtagaagagaatccaaacaggccgtatacaggttcgaaggtgaagccatactttatagttccacgccatttacatctcatttcactttttttatttatgct

SEQ ID NO: 21283 - DNA, 5003 bp, Zea mays
ttgcatgcctgcagcatatgctccctggtagcatcactgaccatagcattcaaagcctccatgacaaggataaacagcatggggggcaaaggatcgccttgccgaagacccctatgatgcagaatgtattccccaggctcgccattgacaaggatccgtgtagaggaagtgcaaagcaacagactaataaggttgcaccagcttcgaccaaaacccaagtgttgtaacatgtcaagcaggaatggccaggatatcgagtcaaaggccttggaaatatccaacttcagcaggatgtgaggctcttttgagtggtgtaatgatctggtaagttgctgcaccagtaggatattgtcttgtatactccttcctttgataaaggcactttggttgatagagaccatacttggcaggtggggtgccaaccgagctgctagcactttggtcaccaacttagcaaagctgtgaacaaggcttattggcctgtaatccttgaccagcagggcatccaccttcttaggcaggagggtgataaaagccgtgttgaggagtttgagtttggagacatgcccacattgcacagcaagcaaagcacccatcatatcctccttgatgatatcccagcaaaccttataaaaacgacctgtgaaaccatctggcccaggagccttgtccaaaggcagatcttttacaactgaccaaacctcctccatagaaaaaacaagctcaagatcccccaaatcatgttgttgaatgcccaggctgtgcaggtccagggtgtagtccctatgttcagctgtacctagcaggttatcataaaaatccaaggctgcttgctgtttttcttcctgtgaggtgacaatacgttcctcaacctggaattttgcaataaagttctttttcttgcggtagcgggcttgctgatgaaagaaagaagtatttgcatcaccctcttgtagatacaaaatgcgagagcgaagcctcgcaatagtgcgctccaatgatgccaatccgaggcaatgcagtttcaatttttttctaagccattcctccccgggtgagagcactctattgtccctggcaatctcaaggcggtgcagaatttccttagcagtagcaagttgcagctttacattaccaaccttgtgatggctccatttttgcagccccttgctaagtcgctgcagttttaagaatataccctcaacagggcaagcagtggagaccggagcattccagctatggctgacagcctcaaggaaacccggcaatttgggccagtaactttcaaagtgaaaacgcctcttcttatgggtttggacattaaggctgagaataagaggacaatggtccgacacccccgaggatgcactttgcaggagcgaattaggaaagaaatcttcccaatcattgcaacagaacaccctatcaagtcgtacaagagttggagaagacctttcatttgaccatgtaaatttgcgaccatgcagtggaatttccttaagaaggcagtcatcaagaaaccttcgaaatctgcccatcaaagctctattcaggttagcattatttttgtcagcagcttgatagatcatgttaaaatccccagtcaacagccaaggaccactgcagagggttctgaaatcaagaagctcctgaaggaattgaattttcctctcatcttcctgcgggccataaacaccagtgaaccaccaattcataccatccatcccagcaaactgaactaaaaccgagaaattatcaatacgagaggagatgacttgacaaactgctcccttccaggcaattagaatgccaccacgagtaccaacagcaggcagggtcaagaacttatcaaaatctgaaccacacacagataggagcagatgggaagaaaacgacgccactttagtctcttggaggcaaataatatcagctttggaggatagaattgtgtctcttacataatctcgcctagccttattattaaggccacgggcattccatacaagaatgtttgatagattcattgaaaaacaaataaacacgaccaaggacagcaggaattaacagcctgccaggagaactgggctgctggaatcatcaaatcgctcagcctgccagccaaaaatagcagcaagtgcagcaagatgagagtccgtcaggcgcccctcgaacagcttaaaatagttgtcttgagcttttttatcaatggcttcttccgtggctgcgagacccaaactcctgatgactttcttttgggcttcagtgatgatcggacctggagaacaaggcttgacaccagccaccctcctactccgacgaggcacaacaacaacagtcttactgcttctaatcttgccaaccggcatgggcagcagctgtaccactggcttgatgattttctccaggtcattgaaagaaacaacaggcgcatccggcgcagaacatttcttagagtgacgctttcgcctaaaatatacctgaaggttggaagggaggccacctctgcgattaatggcagcatcctgcggctcaacagacctatgcctctcaacagggtgaggaataccctggttagacacaatgtctggaaccacagcagcaccaagtctatcctcttcccaagtaagcagaggtaaattcgcggaaggaatagaggtgacagctatagaatcctcagtactgggcgccagctgctccacggtccctggctcatcaacagggtccaagggaccctggatatgctcagggcccggagccatggcccccaacatagcagtagtagacatgacagcctcaaccggaggagacaataataataaggcctcagatggagtccatgggacttccacatccaaggcctgaagaaccgcaaggtgatggtccgcgctcgcctgaggtggggaggaaccaagcactgaatatgcccgaacagcagccaagtcttcttccctaggctgaaccgcagaccctgggcctagacgttgaagagcagatcgtctgcccttatgcaaaccgtcatccgtagaaccccctcggccatcacggtcccctggtggcgaacgcgaacggaaacgcctcctctgacgtgtggaaccattcatatctgatgggatttggatggggtcagggacagcacgtggtccatccaacaccttaatctgaacacgataggcaagagatagcctctcagcgcatggtcctattcccagcggttcggtaattcagagatctctagaatgagggattgaggccaaatcataacaccaaccataacaacgaaagacatccaaattcttgagttgtaaagtatcatcatgcacctcctggacccaagcaaaaggatttaaaagttgttggacagtggtcagttcccaggcatgtattggaatgccacgtagctcaaattccacggggataggcaaacttgcactcgaagacccaaagaacttggaccactttttacaatgcagggagaaagcgcctgcacgaatagtgttccatctcactgtcaactggtcagcaaactgcagggagggaagcatgagtaggaaatgtccatgagccagtttcctcagaattagcgaatcagaactgacttcaagcttttgagcaaccgcatctgcaatatcagcatctgacacaggcacatcactgaccacaaagatagatactgcgaacttcaagtcctcctctgctttttccatcaaactgttccaaccaatcacacaaggttgctgatgatgcgctgacccagtttcagtcagaggggcctcgtcatttccgggttgatcagattgcatccaacccggatcagaaccacccctagaagatgacttgcgcttccgatggcgcctgcgtcgcgggcgaggcgggagggtgcccagcgaagccgacctagccgcagctccaacctccctgggtggagaatcagaaccatgtgcatccactccccctgctatcatcatgtgatgtgctggacccttctcaatgcctggaggggagattctacgccagatacagaccttcttcttgcatgaaaggggcacagaaggctgaagtctcttccagaccgggacccgaggcatctgatactgcggaacacgatcagcgatcgttggctcaactgtcgaaagtctgttccaaaccgttcctctcaacagccgtcgatgtacaggaaccttcctgtcagctttcacaggcccggggcagtagtaggagcgatgaccaactgtcttgcaacgaaaacaccttggctcaaggtggcagaaagcagcgaggtgattatccgcgaagcaattgaaacagcgacctttcaagtcttttggcaccgggcgacgtgcccgcagtgcacgaaggcgacgcttcttcgccttccttgattcaactctggtccacccaccaagtgctgtctccggcgcactctccaacccacgaaaccggcgatgttgatgctcgtgatgagggttcaacgtcccggtctcaagtggggagggctccctcggagacgaagcagtctgtgctggaacaagcggaacccgcgggtgaagcagagtatcacggaacagaggccggccagcccaagaacgtggctgcagaccgtcgtcaggggaacccgccgcactctcactccatctctggaacttggaccgtccctgggtggcggaggatgacgattccgaggaaggggaggaaggggcagatggtgaggcgacctggcggagggaagcagcggcggcgccggatatggtgtggacggtggccggagtgggatggcgggcagccgatcgtccctgggtggcggaggttgacgattccggggaaggggagaaaggggcagatggtgagacgacctggcggagggaagcagcggcggcgccgtttatggagtgtacggcggccggagttgggtggtaggcaaccggaccgttgggaggcgcggtgctgtgggcagtggaggggtcgcgcgcgagaaacaaaagggtcgtgcgcatgacccgaggagg

SEQ ID NO: 21284 - DNA, 1987 bp, Zea mays
ctcgagtttttttttccctttttttttttttttttttttttttgaagagaatccattctggccgtttactggttcgaaggtgaagccatactttatagttccacgccatttacatctcatttccacttcttttatttaatgctccgcggcttattcgatttattctaaaactgctctcccacagccatcatgaccgatcttgcagctaaacgcaactcacgcccttctaagcacgcctggtttctccgttcatcatctgccgagtgtttcgagctagaggccgacttcaggactcaacccaagttgcccatgcagatgtacttgagctccaagtactcgtcaatgccgtacttcgatccttctctccctagaccagactgctttactccgccaaatggcgccacctccgttgaaataatcccctcgtttaccccaactaagccgtactcaagagattcagatacacgccatgaacgaggtatgctcttggtaaaaatgtatgcagctaagcctgcgtttgtatcgttggccatatggactgcttcttcctcagttttgaacggtataaggggtgcaactggaccaaaaacttcttctctgaaaagaagcatatcgttgctgacattccctactacagttggctcataaaatgacattcccaggctgtgtcttttaccacctagcatgacatttgctccctttgaagttgcgtcatttatgaacttctccaccttttgaacagcagcttcgttaatcagaggaccctgagatgtactctcttctagaccgttaccgaccttcaaactctgaacagcctggatgaatgcttttgcaaacttttcgtagataccttcttgcaccaatatcctgtttgcacaaacacatgtctgtccactgttacggaacttggcagcaagactgcctttaacagcaacatcaatgtccgcatcatcgaaaacaatgcaaggtgcattcccaccaagttccaaggagacctttttcacagtatttgcagatccagccatcagttttttgccaacagctgttgatccagtgaatgtaatctttctgacctgtgtactctgcagcaacgcatcacctatctcagcagcattacccatcacaacattcaatgcacccgctggtattcccgcttgaagagcaagatctgctgcagctaatgctgtcagaggtgtgaactccgatggcttgacaacaacagtacagccacaggccaaagctggtccaaccttccgggttatcattgctaatggaaaattccatggtgtaatagctccaactaccccaacaggctgcttcaaaaccaacaatctgcgatcagataaagttgggggaatgatgtcaccatatatacgctttgcttcctctgcaaaatattctatgaaacttgcaccataattgacctcaccaagggcttctttcataggtttcccctgctccagtgtcatgagaagtgcaagctcttccttgtgtgaaataattagatcgtaccattttcttagtgccttgctcctctcacttgcagtgaatttactccaagaatagaatgtactgtgagcagaagcaatagcatcagatgtttctctgctgcccatacaggacacgtttgccaggacctcaccagttgctggattttgcacctcaatggtctttccgtcgtaggcgtccacccactgcccagcgataagcccctgcgtcctgagcagcccggcggcgcggatcttctccatcgcggcgcccgcgtccgcgctcatgtggcggagggagacgactcggaacgaagaggctgcggcggcggggatgtggcgagcgccgagcgccaccgcgcgtcgcatagccatcatcgccatcgccatttagaacctggtatcgactatcgagacgggggggaggccggatgggggtgcgattgggatctaggaagtacgcgactcgtgccggcggcggacgccggagggaagggccc

SEQ ID NO: 21285 - DNA, 1138 bp, Zea mays
  misc_feature (1131)..(1131): n is a, c, g, or t
ttttttttttttttcgggcaataacttcacatttcttctgttttcaattaatttcacttcccatggctcagtttacaacaaggcatgccccttttttgttttaatccagttgcctagatcacccaaagttttcatataaaaacaccaggtacaatgtcatccaatgttctcataagcttgacaggaataatatattacaattgcttaatataaggatgctgccatgtttcatgatacatccatggtacaccattgtgctcagaaaatataacgcttgagaacctagagcttctgcattaagcgattaatccgagtcaaataatgaactccacaggcctaatcataaaggccttcttgctcccaagcgtccacaagcaaatctaccatttcgccaagaggtatcggttgggagaatggcttattgcttcctagcagactttcatacgttgtgttccaactcaactttggttctcgaggctgttgagatctagagtggcgttttttgcttccaacccactgttgtctggtctggttccagagcataagaccttgattcataaactcattcgggttgctgcaacttcctgacgcatgctgatcgctggactgagccaacgtgctgatcgaagacatgctcctctgcgattggatcccgctgttctccatctcatgcgcactcgtgctccaaaagtcctccgagaggctagccttccttactgatcgcccctggatcctcaaccgcttggaaggctcgtctactgctattattggagttggcttagcacagcatccaaagcaacctcccatgcaagcgacgaggcggcgcacccaggtggagagggtcctgcagctcagcagcatagcatccgggcccggtgcgcgggggccggtgccgcgtcggagggggaggccggcggtgaagcgaaccctagccccccggcccctagggcgagaggggagacgggacggggagggaggaatcggaatgggattctgccgtggaccgggtgtcaggctcggggtcggggaggggggtaggaatctactaggagccggagggaggattcagctgaggcagcggccgcgttcgttacctgcccatgctgccacttgacatgatgatgctgagtncccggcc

SEQ ID NO: 21286 - DNA, 1084 bp, Zea mays
ggccgcttttttttttttttgttgtcttgtttgtctgcaacatagaaatggtattacccgaaattacttgacatcgttgcacgaagactgacaaatgcaagcaaggcacaccatgcccaagcccaacgcgcaataatctatgatgtgcagtcttttacagggagcatatcaaacttgggggcaactgagctcatctgggctgctatttcttccgagctctctacgccgccttgcgtttgtgcagatgtccaagcacggttccttgagggctttgtcagtatcaagaggtggaggcggcaccccgaagttgaactggcagctatagtcttcaaaatttggctccatgtacaaatcaacacccatgtgatctttgaagaaagtctgagttggcagtttgcatgtgttgatgcaaatgccaaggcacttgctctcttccaggtacttgcatttctcaacgaacaccccacttgaccatgattttccatcaggcagagtgactgaattaactgagcatgagcccatcaaccattgacatgaaattgctgtcgccctagcaagcatcatagcggctagttggccattagcaattggcgctaaaagagctttgtaaagaacaagcaagagaggtggaaacagtgactgtagtactcggacagcagcctgctcagtctccaaagcactctttcccttgaccatgagacggtttgctacctccattagtccagcatacccaggcttttcagaatcccatccaacctccttcaccatcttgctccggaagaaggcgaggaggaggtcgtccgcgaaagagggccggtactccccgcccttccccggcggcaccgccgctgcatcgacctgtggcgaggagcagcggaaccggcggcttggccggcgaccgagctggagatacgagggcaggcacgaggagcaggaggccgcgcaagaaggcgggccgcgggaggcgagggggaggccgcgttcgcgagcggcggcgccatggacaccggagaaggacaaccgctcccacccggccgcccacgcgtccgccgggggtagggagaacgccccggccggcctcgag

SEQ ID NO: 21287 - DNA, 6113 bp, Zea mays
  misc_feature (659)..(659): n is a, c, g, or t
  misc_feature (1516)..(1516): n is a, c, g, or t
  misc_feature (4556)..(4556): n is a, c, g, or t
cgcctttgttcggtttctttttgttctagcatcgtccaacattcacacgtagcatgtttgtccctgcgccctctgatgaatagaccagctcaaagttagaacaaccatggatggatcggttcgtgattttaaaagttagagcatccatgaatgaataactttggtctctgtaatttgtttatcttgttaggtttaatttaagttgtgatacttgtgagagatttttagatgggggaacaaagggaaaaatgcttgtgcccttgtcttgtctcttctttgctgatcgcgtcgctgatgtttcctagctctaactacatgcagtcactctcgaccagcgccgaggatggagcggaatggctggtgaagaagttgaagggcaagatgcagaagccactggtggacctgcttagcacaacctccctgtgggtatgttcccatgcgagacgaccaactacgaattcccgctgtctctaagctatggtttgacgtcacggtgtcaggtatgctaggcgaggtcacctcacgtggaggtggacaggatcaagaccaaggtgctcgtctcggctagcgtcaccattgtcaaggccgccgctgccaaggtctacttcactacgaggatcaagtggtcgtgcaacgggatgcctatgatgtcgtcaggngcggcatcaccgtcgacgagtttgctgcacaccaagatggacaaatggttgctttcagttgcaggaataaatctacagtcattagctacctgggagatctgtgtgcactgtacatcatgtgttttgtgcttcgttgtgagaatgtgtaacacacagaaggattcagaatgtgtgcccattgcatatgatatatgtctcgaatacagtacatccgaagcagagctcgagttagctcaaacaatctatcagattttaaactgaagagtggcaagctattgctccatatatatgcggtggactggaattgcgtgatgtgtgctgacagatttggctaagacaaaaaagaatgcttagtttttttggtttcaacgtagatcatctttaccactttatgtaaaaattagataaaattactactttatgcaaaaattaggtacaattacacataaatagtagtcatctttaccactttatgcaaaaattagataaaattactactttatgcaaaaagtaggtacaattacacataaatagtggtttggacctttattggctttacatccacacccatctaaccaacagaacatatatatttttgtgttttgttaaaacaaagtctatcaataggtagtggtttgaatatttgtttgttgtacgtccacattcatctaaccaacagaactcacatattttcgtgatttgttaaaataaagtctaattatttgatatatagaaaccataacaacgcatgggcacttagctataataagattacatatttatctcgccaatataatagttttacggtgatattttgtcacatggattttacatattataataatatttatcgtttngtatctatattttatactatctttttacttccgtagcaacgcacgggcatggacctagtatttatttgaaggatctaaagcttgagtaaactcaagatgctgtcatcactactaccttcgtcccgtttttttaaacaaatttctatattctcttcattccaatttttagataatagaactagatctgccttatctcttgtcacctaaagaatcatagcatttattacaaaaatgtcacccacacaaatatcttactcaaaaaataattttaagaatatgaggctgtccaaagaagcaaaaagattcattgccacctcctctggcacctaaagaatccattgtatctccctgatgatgtgtgcaaagaaaaacgaaaaataatggttttaactacataatgtatatcatctaaaaataacgaagatagtacaaacctttgttacgttttgacgaggatgatgaccgccatcggtgccatcgatgcgggtgtccacgtcgctagtcacgccagcagcgccaaccatgcctctggtcatgctggccacgcacacgaagccacaagccacgacatcaacgctgaaatcaggcattagttgagtcgattcggctgcaatcaattggggattaggaggagggaaaggggagaatcgatttgtgcagtcaaatccatgtgatcggactccgaaggtgcatccatggtggacactagggctccacgcaaggaagatgcgttcaggagaaagaagaagatgcgttggggaggaaataacacagggaaaagaaacattattttctttataacgagcgtcattggttggtaattaacactaaacttcatgtttacatttgaaaacaatttttgtggagtgcctttttttgatgctccgccaaaatggtgttcaccctagctccatgtttgtttaaacagagttgctagagtttataccgtttggtaaggaaatcgtggagcggagcatcaaaaatatggagtggaatttgtctcaaacatccccccttaatacagagcatgtatctggccgctagaaatttcaatcttgattgagtagatttactacaccataggtttatatcacatcaataatagcaaatcctggagcggagcatcaaatcttaattcagcgaacaaagaagaaagatgttacctagtagttcaacaaggccaaagacttgtatgattgatggagagttgatgcagattggatccataatgacgttaggatagaacagtgatgatgaagtgtttgggtaacgacactgtcgcgcatctcaaattcgaacctcaaacactctcgtcggtaatggatgcgtgagacctgttcccgtaacgtaaacacagaaacaaagaaaacaatggtagaaaatctttttcttgcgttatcttttattcattagttattataaagggctacatatttattggagaaaaagatagaaccccacactagcctatataacacctcgcagggtttttttttataacaaggacaagcatctgctcgagcaagagggcacaaaaacgatcgccatttctcacggcacggcatccaaacagctatctagcggcgtcggcgagcatccaaaattagatacagagacgcacgacaggtcgacgaaggagccagagccacgcttccgcggaagaggccattgggggagcgcacggccagacacgttcacgtcgccgatccgcatcactgacaagtccggcggtcaattgggcgccaacaatgcctgactttcacgtggccctgggcccactaacagtgacatacagcttgtcctttactccctacctcgctcagctcttcctctacactcctcttcccactgtccctctctcccctttctgcatcagtgtttggtctcatctctttttcttgcattttttttgtttttgcattcgagtccaaacgcaaccaggtactgatctcgactgggttcctaaagactactgctactgctaaaatattcgcgcgagaattgacgaaagagggctacgtaaaactccattttacaaaatttgcagaaaagcccccgcctctcgctccgaattctttattcctccaccgctcggcccagatcccgagtctacgctgcgctgcatctacctcctcctcggttcagttccagtgttccgtgggctcggtccaccacgccatcggcggcggctgctccacggagaagaacccgccgcagggctcatcgtcgtccaggagccccgtctcgtcctcctccaccttcaggaaactcccgtggaagaacacgccgccatggttcgccgccacggcgccgggcgcgtcaagaagagtaccccgtacctccggcaccggcgcctccgccacgggcgggtccgcgtcgttcagcaccgcgctggagtcactctcggacgaccccacccctacggggggaggcccgtccgaggccgccggctccgccttgaccgacgtgaagctcgccgctgcctcctcgtccccgagcttcgccttgagctccttgatctaggagaaattcaggcagccaaccgagttagggtcaggccggcggtcagccattgcgcgcgtcatcgtgctcgtccagcagcttgtataacggcataacgtcgacaactacctcggcgaggagggcgtccttgtcgcggcgcagcgcgtcgtggtcgtgccgcagcgcgtcgtaggactggcggagcgcggagtagtcgcgctccagctgcttggtcttccagcgggcgcggcggttctggaaccagacggcgacctggcgcggctgcaggccgaggtcgcgcgccagccgcgccttgcgctccggctccagcttgttctccacctcgaagctccgctccagcgcgcgcacctgctcggagctcaggcgccgcttcttctccccgccgccgccgcacgccatcatctcctcgtccgcgtccgcgtctgcgtccgcctccatcccgaccacgccgtaaccatcatctgggaacacgcaagaggactcaatcctccgcacgcgttccgccacgacatcaccncccccaaatacaatggattcccgcaggaaaaacaaaacaggacgcgctggcaatcatcgttcggattggtcatcgcagccagagggggactggcgccgcgtggccgcttcatgtcgtgttcgatcgagtgaaattcggaggccaccgcaggactaccttatagcgaggacaggatcaatgagctggggggagagcgccgacctgctcgtctctgttccctgccgtgacccatggccaacaccatgcaccttcgtcggacgatacagttctctactacaattgcaaaatttccagtggattcctcgcgatccaagaaagctctgggactgagagacaagacagtgtgtggagtgaggcctctgtgtctctccccctctctttcttttttggtttgctttcagttcccgcaatacggtccgctgtcctctgtgcgttaataaagggcgtgagcgagagagaggggggcgacggggagctcgggtccgggaactcggttaggttaggtcacgccggcagtgcggtcaagccgcaaccatggttaaccttgcaagcatccctcgcggctcagttcagaaggaagcaaatcatacacgagagagtaagttgtgcctggattcgatcagggggacgacacttgaattgaatcttgctaggattaagaactttcaagttatggaagtatattttctaaaattaatttcatgtttacgctgaagatgtagtttctactatacttttttcccgggaaacaagcccactgcattgcctgacaacgtggttccactctgaaaatacggaaaactttggctctttaatactaactccgttctcaaatatttatcgtccgctaatttattttaaactttggctcttctttcacgttcgaaccaagttgccaacatcaccgtcacccctgtttttcttttattgctagcgctaggtgctagccgagtaacggacaccattcctaacgctacaacggaaacgagacggtggtcaagctcaggtcacgcccatgaagccaagttgaacagatcgacgaaccaaagccggaggaagcaggtaggctgcgtaggtagcaggcaggcaggcacggcagctggcggccggggccggcgtcagcgaaccgcgccccacccagccacaggtgcgggcgcgggacagcgtgagcgcgaggcgatcagcgcctgtactggcctgctgggttggcggggcctgttttttaatattattttagtttttttaagaattcatatttataatatttctgaaccagataaactagtttgttttttaattctgagctcagcgttgtagcttatagcgtctagcccaacgataaagataaaaattggtgtaactagcgacatgggctagagctcgacgtgcgacaccgtaattatggcgccaagcttttgatttagttagctctggatacttattgtgtcttacccactgaaattttatcataaaaattataaatgtttacatgacttagatataataaaaattctagtgtctaagtgggtgtttgtttgggattataatctacccaga

SEQ ID NO: 21288 - DNA, 1280 bp, Zea mays
  misc_feature (1)..(70): n is a, c, g, or t
  misc_feature (72)..(73): n is a, c, g, or t
  misc_feature (76)..(123): n is a, c, g, or t
  misc_feature (125)..(126): n is a, c, g, or t
  misc_feature (128)..(132): n is a, c, g, or t
  misc_feature (134)..(147): n is a, c, g, or t
  misc_feature (152)..(158): n is a, c, g, or t
  misc_feature (160)..(164): n is a, c, g, or t
  misc_feature (166)..(167): n is a, c, g, or t
  misc_feature (171)..(171): n is a, c, g, or t
  misc_feature (173)..(174): n is a, c, g, or t
  misc_feature (177)..(178): n is a, c, g, or t
  misc_feature (180)..(181): n is a, c, g, or t
  misc_feature (184)..(187): n is a, c, g, or t
  misc_feature (189)..(191): n is a, c, g, or t
  misc_feature (195)..(195): n is a, c, g, or t
  misc_feature (197)..(198): n is a, c, g, or t
  misc_feature (200)..(200): n is a, c, g, or t
  misc_feature (202)..(202): n is a, c, g, or t
  misc_feature (209)..(209): n is a, c, g, or t
  misc_feature (215)..(217): n is a, c, g, or t
  misc_feature (219)..(219): n is a, c, g, or t
  misc_feature (223)..(223): n is a, c, g, or t
  misc_feature (226)..(226): n is a, c, g, or t
  misc_feature (228)..(228): n is a, c, g, or t
  misc_feature (231)..(231): n is a, c, g, or t
  misc_feature (234)..(234): n is a, c, g, or t
  misc_feature (237)..(237): n is a, c, g, or t
  misc_feature (353)..(353): n is a, c, g, or t
nnnnnnnnnnnnnnnnnnnnnnnnnnnnnnnnnnnnnnnnnnnnnnnnnnnnnnnnnnnnnnnnnnnnnnannaannnnnnnnnnnnnnnnnnnnnnnnnnnnnnnnnnnnnnnnnnnnnnnncnnannnnnannnnnnnnnnnnnngcatnnnnnnncnnnnngnntcantnncanngnnccnnnngnnnggtncnncncnccatcgncggcgnnngntccncgnanaanaanccnccgcagggctcatcgtcgtccaggagccccgtctcgtcctcctccaccttcaggaaactcccgtggaagaacacgccgccatggttcgccgccacggcgccgggcgcgtcaagaanagtaccccgtacctccggcaccggcgcctccgccacgggcgggtccgcgtcgttcagcaccgcgctggagtcactctcggacgaccccacccctacggggggaggcccgtccgaggccgccggctccgccttgaccgacgtgaagctcgccgctgcctcctcgtccccgagcttcgccttgagctccttgatctcggcgaggagggcgtccttgtcgcggcgcagcgcgtcgtggtcgtgccgcagcgcgtcgtaggactggcggagcgcggagtagtcgcgctccagctgcttggtcttccagcgggcgcggcggttctggaaccagacggcgacctggcgcggctgcaggccgaggtcgcgcgccagccgcgccttgcgctccggctccagcttgttctccacctcgaagctccgctccagcgcgcgcacctgctcggagctcaggcgccgcttcttctccccgccgccgccgcacgccatcatctcctcgtccgcgtccgcgtctgcgtccgcctccatcccgaccacgccgtaaccatcatcgttcggattggtcatcgcagccagagggggactggcgccgcgtggccgcttcatgtcgtgttcgatcgagtgaaattcggaggccaccgcaggactaccttatagcgaggacaggatcaatgagctggggggagagcgccgacctgctcgtctctgttccctgccgtgacccatggccaacaccatgcaccttcgtcggacgatacagttctctactacaattgcaaaatttccagtggattcctcgcgatccaagaaagctctgggactgagagacaagacagtgtgtggagtgaggcctctgtgtctctccccctctctttcttttttggtttgctttcagttcccgcaataccccggccggcctcgaggtacccaatg

SEQ ID NO: 21289 - DNA, 1916 bp, Zea mays
cgacggcatatatagtatggagttatcgacaatactacctcggcgaggagggcgtccttgtcgcggcggagcgcgtcgtggtcgagccgaagcgcgtcgtaggagcggcgcagcgcggcgtagtcgcgctccagctgcttggtcttccagcgggcgcggcggttctggaaccagacggcgacctggcggggctgcaggccgaggtcgcgcgccagccgcgccttgcgctccggctccagcttgttctccacctcgaagctccgctccagcgcgcgcacctgctcggcgctcaggcgccgcttcttctccccgccgccgccgccgccgaacgccatcatctcctcgtccacgtccacgtccacgtccgcctccatcccgagcacgccgtagccgtcatctgggaacacgcacgcacaaggactcagatcttcattccgcacgcattcccgccacgacatcacccacccccagagaaggccagaacaatggattcctgcaaaggggaataacccaccacgccgtagccgtcatcttcctgatgattgggcatcgcagacagggagggagtagcgccgcgtggccgcttcatgtcgagagttggatcaagtggaattcggagggcaccgcgggactatctttacagcgagagcagggtcaatgagcgcctccattgctgcctccctgctgctcgtctctgttccctgccgtggcgcatggccaaggccaacacaccgtgcaaccacttcggccgatacagttctctgcaactgcaaactccccgagtggtttcctcgcgatccaagaaagcgctgggactggaagacgactgagagtgtggaggagtgaggcctctgtctccgaccgtctcccactctcccctctctctgttttctttttttcctttttcctttctgggtttgctctcagcatgcagttcccacaatcagttcccacaatactgtgtgctgtcctctgtgccttaataaagggcgtgcgtgggcgagggagacaggggggcgaaagggagggagctcgggttaggttaggtcacgccacgccggtagtgcggtcaagaggcaaccatggttaaccatccatacagccactatgtatgttgatcgcatgagagaataatactactaatagttaccactgttgcctgaaaatgctcgctgcagctttcctttttgtcaccgtgtgctggagatacgtgcgtgctacggtgctagccgagcaacggacaccagctagtaaaccctaccgcggaaacgaggcggtggttaagctcaggtcacgcgcccatgaagccaggttgaacagatggacgaaccagagccggatgaagcaggtaggctcctgcgtaggcagacaggcaagggccggggctggcgtcaccgtcaccgaaccgaacacatgttcctcacatatgcctaccatccatcctcagttcctcatgctcgccggccggcgcaggagctctgcatgcactcctgctcctgttctatggccaagaggagctatagcagcatccttcgaggtcgtcgaggggtaaaaatatcgtcgagcccagcacatgttttttttccagcaaccacacgatatcctgcgcccccatttccgcagaacagcgacccgagtcgttctcatctcaacccggcgccggtgcgagaaaggcgaccgcggctttcggtgccctttgttttttgttcagtactagcaagcacccggccgcatattctaacctccccccaaatccccagcgaatcctctggacgcagaatatgcccaggttttcaaatcccgaaatccgtccccctacggcctaacgaaaacgacgcgccgcgaaagctgggactcctacagtagcttggacgctccattggcctggcctcgtgtagtcgtgtcgttgcgaattc

SEQ ID NO: 21290 - DNA, 1927 bp, Zea mays
  misc_feature (3)..(5): n is a, c, g, or t
  misc_feature (25)..(25): n is a, c, g, or t
ctnnntttttttttgttgagccatnagcattgactatggggggattttatttagggccaagcccacattaatccaacagataaccgttgaacacattccacaatctgacggcaccgctgccgattccctccgggccgcggcgctgttttgtcgttgggctttcttttttttttttttagataatcgaagtaatcatccagcagccttggctagcatccaaatcagatacttacaggggagcacgctttcgcggaagaggccatggcccattggggggagggagcgagcgcactgctcggccagacacgttcacgtcgcccatccgcgtcgctggcaagtccggccgtcaatgggcaccaacagtgcctgactttcacgtggcactgggcccactaacagtgacatacaggttgtcctttactcctgcctcgctcagctcagctccgctcttcctctaaatcctctacgcaattctgcactggagtccaaacgcaacccaggcgctgagcttgactgggttccgacccagactactactactgtctactgctaatacgctcgagaattgacaaaaagtagggctaggtaaaaccccgttttacaaaatttgcagaaaagccccttctttatcgctccgaattcctctattcggttattcctccaccgctcgtccgagatcccgattctactacgctgcactgccgcgtccacctcggttcagttccagtgttccgcgggctcgttccaccacgccatcgccggcggctgctccacggcgaagaacccgccgcacggcccgtcgtcgtctaaaaggcccgtctcgtcctcctccaccttcaggaaactcccgtggaagaacaccccgccatggttcgccgccgctgcgccggcaacggggccagccggcgcgacaagaagggtgccctgcacctcgggcgccggcgccggcgcctccgccacgggcgggtccgcgtcgttcagcaccgcgctggagtcactgatctcggacgaccccacccccgcgggggccggcccgtccgaggccgccggctccgccttgaccgacgtgaagctcgccgctgcgtcctcgtcgtcccccagcttcgccttgagctccctgatctcggcgaggagggcgtccttgtcgcggcggagcgcgtcgtggtcgagccgaagcgcgtcgtaggagcggcgcagcgcggcgtagtcgcgctccagctgcttggtcttccagcgggcgcggcggttctggaaccagacggcgacctggcggggctgcaggccgaggtcgcgcgccagccgcgccttgcgctccggctccagcttgttctccacctcgaagctccgctccagcgcgcgcacctgctcggcgctcaggcgccgcttcttctccccgccgccgccgccgccgaacgccatcatctcctcgtccacgtccacgtccacgtccgcctccatcccgaccacgccgtagccgtcatcttcctgatgattgggcatcgcagacagggagggagtagcgccgcgtggccgcttcatgtcgagagttggatcaagtggaattcggagggcaccgcgggactatctttacagcgagagcagggtcaatgagcgcctccattgctgcctccctgctgctcgtctctgttccctgccgtggcgcatggccaaggccaacacaccgtgcaaccacttcggccgatacagttctctgcaactgcaaactccccgagtggtttcctcgcgatccaagaaagcgctgggactggaagacgactgagagtgtggaggagtgaggcctctgtctccgaccgtctcccactctcccctctctctgttttctttttttcctttttcctttctgggtttgctctcagcatgcagttcccacaatttgattaggatgttctaggtaatggtctcgtgc

SEQ ID NO: 21291 - DNA, 1152 bp, Zea mays
cccctcctcgagtttttttttttttttttttttttttctgtgtttgggctcatctctttttcttgcatttttttttgcattcgagtccaaacgcaaccaggtactgatctcgactgggttcctaaagactactgctactgctaaaatattcgcgcgagaattgacgaaagagggctacgtaaaactccattttacaaaatttgcagaaaagcccccgcctctcgctccgaattctttattcctccaccgctcggcccagatcccgagtctacgctgcgctgcatctacctccgcctcggttcagttccagtgttccgtgggctcggtccaccacgccatcggcggcggctgctccacggagaagaacccgccgcagggctcatcgtcgtccaggagccccgtctcgtcctcctccaccttcaggaaactcccgtggaagaacacgccgccatggttcgccgccacggcgccgggcgcgtcaagaagagtaccccgtacctccggcaccggcgcctccgccacgggcgggtccgcgtcgttcagcaccgcgctggagtcactctcggacgaccccacccctacggggggaggcccgtccgaggccgccggctccgccttgaccgacgtgaagctcgccgctgcctcctcgtccccgagcttcgccttgagctccttgatctcggcgaggagggcgtccttgtcgcggcgcagcgcgtcgtggtcgtgccgcagcgcgtcgtaggactggcggagcgcggagtagtcgcgctccagctgcttggtcttccagcgggcgcggcggttctggaaccagacggcgacctggcgcggctgcaggccgaggtcgcgcgccagccgcgccttgcgctccggctccagcttgttctccacctcgaagctccgctccagcgcgcgcacctgctcggagctcaggcgccgcttcttctccccgccgccgccgcacgccatcatctcctcgtccgcgtccgcgtccgcgtccgcctccatcccgaccacgccgtaaccatcatcgttcggattggtcatcgcagccagagggggactggcgccgcgtgaccgcttcatgtcccggacgcgtgggcggacgcgtgggcggacgcgtgggcggacgcgtgggcgccacgcgtgggt

SEQ ID NO: 21292 - DNA, 1602 bp, Zea mays
gtttttccatcttgaccaggaagaaatggtctgacacgacaataaaccctgatattgccttttagttcctgtacctcattaaatagcttctgattttcagcaagaaccttatggtaattgtcagcagcatctaccaagcctttcaactcacgtccaatgctagatatttcatctctccatttcatttgaagggcaaacatttcctgcttaatggactgagatgatatccttatgtccttaatggacaatttctgattatccataaaactctggaaaatgtttgccttcctggtccaaagttgagatttcagttgggaaacagattcaatttcttcgactttcttttctgattgcattaaaagaaactcagcctccttaagtctcatagccaagtgttcctccatctgcctggcttctgtttcctttctctcgtggtactgttcatgcatcctactcaagacctgtatttcttgctgaagggaagcaattgtattttctgcattctccttttcttgcatcagccgaaccatgtcttgttcacctagttttcttttctcatcaagttttgatttttctacctcaactagctcaagtcgatctactgtcatctcattttcttcatttgtgccatttactaaggtctcgagtgctttaatttttgaacgatacttgtcttcccgggtcttgatgatgctattttgatttcttatgtgatccgcttggatagcaatgcggtgctcaatctcttgaacaacattccttagcaagtaaccaccacgatgtggtatttctcctcttttcctctcaatgctctcatctagaatgccattaacaactctaagaagtgattgagtaggggcattatctatacttcttggatgcatcatctctgaaactttggcagcaggaagatcagtgtaggagcctcgcttaagttggaaagcatcatggaccttttgtccagaatgaagaatacttctttgttgagacttaggatcccagtggcctttccatctttcctcgcccagatcttctcccgggtgtcataaccgaaattacaggctcatcagattcttcaaggtccagtttccttctaaggggtgttttagcagcattggtcgtaatggtttgacgcaatcctggagtcacattatcctttagagccaaaagacactcgaccacagaagccactgacccctcctccagatccttgacactgaagcctggcagccccatctccgcaacaaaatagaggaacttcttcacgttcgacctctgatcccatgcattaccaccccacatttcctcctgaatgccgggcattagtttctctgcaatgtaacatagtgccgtgccatcaatgaggtactcccgcagctcctcgtctgaggaatccagcggcaagtcgaactccggcagcaactcagcgagccaatctatcacctcaccccgccggttggctgcatgggactcgtactcgtcttccaccttccccatgcctcagtgcctcaccgcgcacgcgcacttgcaagcacgggagtgaaatgctggccgatctgggcccagatcgaaaggtccgcgcggggcagctcgggtccgccc

SEQ ID NO: 21293 - DNA, 1593 bp, Zea mays
gggaagcaaaaaaatggttggaagagaaaaggcagggactgggcgtaaaacctgaagacaatggatcatgcacattaaatacagatatatttagttctcgtgatgactctgacaagggttctccagttgatttggcgaatagctcgcattggatcatctggagattctgctgttgcttctaaattatggaattatggttccaattccagattatttgagaatgacacttccatattctcattgggcaccgatgagaaagttggagatcctaccaaaactcataatggctctgagaaagttgcagcaacagaaccactcggtagatgctccttacttattacaccaactgaagatagaactgatggtattactgagcctgtggaccttgcaaagaataatgagaatgcaccccaagaataccaagctgcatctgaaattatccctgataaagttgcagagggtaatgatgtgtcttccacaggaattactaaggatactactggccatagtgcagatggtaaagctctcacttcagaaccgcatataggggaaacacatgtcaactcagcttcagaatccataccaaatgacgcagctcccccaacccagagcaaaatgaatgggtcgaccaagaaatcattagtcaatggtgttttggatcaaccaaatgccaactcagggctagaatcttcgggaaatgattatcctagctacactaactcgagcagtgctgtgccacccgcgagtaccgagttaattgggtctgcagctgctgttatagatgttgattctgctgagaatggcccaggtacgaaaccagaacaaccggctaagggagcctcgagagcatcgaaatccaaggttgttccacgaggacagaagagggtgttgcgaagcgcaacaagaggaagagcgacgtaggggcattgctgcgctacattgttgtgtactaatatatgttgacggcccagaagggcaacatgatccctaggttaactagagctagcgccgactggtcgtttccacgtacgatgcactgcgcatcagcctgtatccatgttgtattatcgtagggcttgtaatgaccacatgccctggttagagttgatcattaggaccagtagctgcttgatttgtgtctcggtgatctagctttgggtagtttgtgcagttggaaggagacagtttgttggttgtattgtattgcagcgcacagctagcaagtgttgttgtagccatcaggtacgtgttgtgtagtgaatccaggtccagggacagagctgttcctctgtatggtggaccctgaccctttgttttgtgccatggggcctttctgtgttgtgcttacatgagctggagctgctttatttttctttttttatacgattaatacgctgctgatgagtctttttttttgtgcttgtattacacatgtcgggctttctatctatgcctgtcgttgctgctcctgtttctatagacgattgaagaatggaagcgacagtgcgttgggttctgacggaggaaggaccgaagtggcatcccccgatggatgtcacgtcatgtcaatgcaggatgaaccggaagtcttgc

SEQ ID NO: 21294 - DNA, 2090 bp, Zea mays
ttctcagcaatgtcattcttctacactagcaagtaccatgtccacatctgcaaatacaacaatgccaaccatacagagcagatttccaggcttacaccaagaacaagtttgcatgggagcggggtgcccagatgccacttgcgagtacccaaagcacgcagcgctggtgtggcaaaccaagcacagcatccgttggaacctgacaacaattttgtatacatcatccgaacctggcgggagcttaagctcgtcggccacttcatcaatttgtcacccaaacaaacacacacaagacagcagcagcagccgcagggacctggtacgctaccagggatgaaacaatagcagcaagcttgtgcttaggatttatacattacagaatgatccagggccttacccggagcagcacacgtggcaacaaacacacgggggttcacttggagacatcgccaacacaccatagttcctccttttctttttatcattttttgggttaatgtgtaccgctccaggcaacattgttgctagcttccgtggtgcgcgcattagccatttgcaccgccgacgcttcgattgcgtctcctctctgaacccagcttgactgcctcgagtgcataccagatcggccttccacgaactctgctggaaggtctctgctcagatctggggatgcatgagctaccctgccctctttctcatcgaacatgaccccaagccctgcttccaagtccctgatatcagccgccgtccttggctcgtcccaaggtgctactggcttcctgtccatttcaagatctccaatgggcttgcccatgctggggctcatgaaacccctggactgtgagcgcgtttgctgcagcccttgccccgctgtcacccttgcccggaaattgttcttcgaaggggggatagcagtgcagaatatctctagaaaattgttcagaacacctttgttatatgggttatcgcgccgatcatagcgatatctgaaattctcatatgttgtctggttagtgctcatcaggtataaatggaagacagataaaccacccacaaaccatacacagagaaaacagtagataatcagagcaactgatgctggtgtcttcagcaaggccttccaaactgacgattgctcagcagctctaatcttgatcacatacacccaacagaaggcaaatacatagaggcagagcaatgtcgtcgagaatacaaacatatagaagaaccgataattacgcagtcctatgcactggccgacccatggacagtgatgatcaaaccgttccacacagttattgcaaatggaacagtgtgagcatcgaggtggtcggtacagcatgcaagtatcacagtatttgacccgtacactgatcccatttacaagtacttcctttgtgcgaggcaaacgaaattgttgtggagtctgaacacccgtgtcgttgatcccatcaatggattcaggttcaggaggatgagaattccggggtattataccaggatctctaccagaggtacaaagaagcaacgtcaaatcataaatagtgaagacaaccactactaccatcactgagattccccagctatcggggaaatcatttatgagatgccttgcaacaaacagacagaagacaaccactggtgcgatgatgaggatcatagtgagaaacacagatctcacatcaggcccaaatatgaatcttccctgcaagaagaattcgttgcttccccgccagacctggtaaagcctaggctgctcgccggcgccgccggtgggcggcggcggcggcatgtacatcccgacggcgcaggggagggggggcaggtgccccagatcaagctcctccgcccccctcctcctctacggccgactgacacccagccaggcaggcaggcagccctcccccgagcgaggcctccccgacgtcacggcgaggagtagcgctgccgcggaggtgcggcggcgtgggacgcgacgcgggacggggaggaatgaaggagaggagaaaggtgggtgggagagcctgggaggggagagaggtcaccgggttaggtcgcgggcggtcggctctcgacccccgccgccctcg

SEQ ID NO: 21295 - DNA, 2039 bp, Zea mays
  misc_feature (12)..(12): n is a, c, g, or t
ctactaaagggnaacaaaagtcatgttttttttttttttttggcaaaccaagcacagcattcgtcgcaacctgctaataatatagttatatacatatacattatccagacctggcgggagcttaggctcgtcggctacttcattttgttgagaacacacacccaaacagacaagcaagcaaaacaaaacaagccaaaccaaaaaaaaaacaaccacagcagggatctggtgatctaccaggcatgagactacagcagcaagcttgtgtttcggattacaaaatgatccagggccttgccctggcacacgtggtaataaacacatggcagttcacttcgagacgacatcaccaccagcacccacctcgagacacaaccgaaacacaccgtagttcctctcctttttttcccccgcctttttgtcaggctaacgtgtgccactccaggggacatggttgctatcttcggcggtatggacagtagccatttgcaccgccgacgcttcactcgcatcgcctcctctctgaacccaacttgactgcctcgagtgcatgccagttcgcccttccacaaactctgctgggagatctctgctcagatctggggatgcgtgggctactctgccctctttctcgtcaaacatgcccccgaaacctgcttccaagtccctgatatcagctgccgtccttggctcgtcccaaggtactactggcttcctgcccatctcaagctctccgatggttggcttgcccatgctggggctcatgaaacccctagactgtgagcgcgtttgctgcagcccttgctctactgtcacccttgcccggaaattgttcttcgaaggggggatagcggtgcagaatatctctagaaaattgttcagagtacctctgttatatggattatcgcgccggtcatagcgatacctgaaattctcgtatgttgtctggttagtgcccatcaggtacaaatggaagacagataaaccacccacaaaccatacacaaagaaaacagtagataatcagaacaattgatgctggtgtcttcaacaaggccttccagattgacaagtgctcagctgctctaatcttgatcacatacacccaacagaaggcaaatacatacaggcagagcaatgttgtcgaggatacaaacatatagaagaaccgataattacgcagtcctatgcactggccgacccatggacagtgatgatcaaaccgttccacacagttattgcaaatggaacagtgtgagcatcgaggtggtcggtacaacatgcaagtatcacagtattttacccgtacactgatcccatttacaacaacttcctttgtgcgaggcaaacgaaattgttgtggagtctgaacacctgtatcattgatcccatcaatggattcaggttcaggaggatgagtattccgaggtattataccaggatctctaccagaggtacaaagaagcagcgtcaaatcataaacagtgaagacaaccactactaccatcactgagattccccagctatcggggaaatcatttatgagatgccttgcgacgaacacacagaagacaaccactggtgcgatgatgaggaacatagtgagaaacacagatctcacatcaggcccaaatatgaatcttccctgcaagaagaattcgttgcttccccgccagacctggtaaaccctaggctgctcgccggcgccgccggtgggcggcggcggcacgtacatcccgacggcgcagggggcaggtggcccggatcaagctcctacaccctcctcctctacggccgattgccacccaagcagccaggcgggggtgcggcggcgtgggacggggaggagggagggagaggggaaaggtgggtgggagagcctggggtctgggaggggagctagcctagggaggtctccgggttaggtcgcggtcgcggtcgcgggtggtgggctctctcctctcctcctcccgtccgtcctccacctcctcgctctgggagtttggctttgggacgtgcgcgcttgtcgtctcccgtctc

SEQ ID NO: 21296 - DNA, 2281 bp, Zea mays
ggttacttaatacaaccgccagtgtaaatacatcatttccactgacggtttagttaagtgaaccgccagtgtatatatatttacactgccggtttgttaaggcgggcccgcctgttttttcactggcgtgctataactgaaaccgtgagtataaatttatgcgtgccgccaccttagagctcttttctactagtgttagtggggtatgtttttattttttgataaggttggacctttgtctagtgcttcggtcactgcattgacttaaacatcttgttattcttattatcaatatatcttggcagacctcctgccttaaaaaaaagagtaacacaaagaccggcttgactgatataggccccacatcatacgcttgcaataatgcgtcttttctaagcagtagtatttgtttcgccagacatatatccacttgtcggagtgatcagtcattttctgtccttgtagagcattatttaggagccagaacccgcttgtattgcacgcaaagttttaaatctccagctgtttttgaagggaaatagcttttgctttcgtacacaatttagccgctatctctcgctatagccctatttagctcgctattagctgtttgaggacaaaggacatcaagcactaaatactatagctggttatttaaaacactgattgcacgtctatataaagagataatgtagcccagattgcccacccatcccacccacgcgtccgagcagtatcagcgtatcatatggagctcagccccaacaacagcacggaccagagcttgctcgatgcgcagctcgagctctggcacaccaccttcgcgttcatgaagtccatggcgctcaagtccgcaatacacctccgaattgccgatgccatccacctccatggcggtgccgccagcctatcccagatactaagcaaggtccatctccacccgtccagagtttccagcctccgtcgcctgatgcgcgtgctaacaaccaccaatgtcttcggcacccagcagccggctggtggcagtgacgacgacagtgagcccgtctacactctcactccagtgtctcgcctcctcatcgcctcacagtcgtcgcagctggcccagactccgttggcggccatggtgctcgatccaaccatcgtctcccccttcttcgagctcgccgcgtggttccagcacgagctcccagacccgtgcatcttcaagcacacgcacggccgaggcatctgggagttgaccaaagatgacgcgaccttcgacgccctagtcaacgacgggttggcttccgacagccagctcatcgtcgacgttgccatcaagcagagcgcagaggtcttccaggggataagctcgctcgtcgacgtcggtgggggcatcggtgcggcggcccaagccatctcaaaggcgttcccgcacgtcaagtgtagcgtgctggaccttgcccacgtcgttgcgaaggctccaactcacacggacgtgcaatttatcgctggcgacatgtttgagagcattccaccagcagacgccgtactgttgaaggtacgttctcttctagtactattattcagtgattaagtctccagcaaaatttggtgctcatcaactctattatcttttgagcattccatctcaaaaaggtgttcatcaaattttgttttttttcttccagtcggtcttgcatgattgggaccatgacgactgcgtgaagatactgaagaattgcaaaaaggctattcctccaagagaagccggtggaaaggtgataataataaacatggtagttggagctgggccatctgacatgaagcacaaagagatgcaggccatattcgatgtctatatcatgttcatcaatggcatggaacgagatgagcaggagtggagcaagattttctccgaagctggatatagcgattacagaataataccggtcttaggtgttcggtctataatcgaggtctatccataaccatttgtgtaagatggttcatatatagtggcatggatcggagcttgtgtggtgtggacatgtaatctaaataagtgggtaccccgctgtgatgctgatctatatcgtgctctctgtcgagatatctattcagtaaacgtatattctatatgcacctaaaaaaaaaagtgtactttataaacctatgttctttggtttgtttctcaaactcactgctcgaatccggctcttgaccgagtgcaatttattaaacactcggcaaagcattctttgtcaagtgccactctcgccgaactaaggctctcacc

SEQ ID NO: 21297 - DNA, 1382 bp, Zea mays
gggtacctcgaggccggccgggatcccaaagagagaaagtagcagtatcagcgtatcatatggagctcagccccaacaacagcacggaccagagcttgctcgatgcgcagctcgagctctggcacaccaccttcgcgttcatgaagtccatggcgctcaagtccgcaatacacctccgaattgccgatgccatccacctccatggcggtgccgccagcctatcccagatactaagcaaggtccatctccacccgtccagagtttccagcctccgtcgcctgatgcgcgtgctaacaaccaccaatgtcttcggcacccagcagccggctggtggcagtgacgacgacagtgagcccgtctacactctcactccagtgtctcgcctcctcatcgcctcacagtcgtcgcagctggcccagactccgttggcggccatggtgctcgatccaaccatcgtctcccccttcttcgagctcgccgcgtggttccagcacgagctcccagacccgtgcatcttcaagcacacgcacggccgaggcatctgggagttgaccaaagatgacgcgaccttcgacgccctagtcaacgacgggttggcttccgacagccagctcatcgtcgacgttgccatcaagcagagcgcagaggtcttccaggggataagctcgctcgtcgacgtcggtgggggcatcggtgcggcggcccaagccatctcaaaggcgttcccgcacgtcaagtgtagcgtgctggaccttgcccacgtcgttgcgaaggctccaactcacacggacgtgcaatttatcgctggcgacatgtttgagagcattccaccagcagacgccgtactgttgaagtcggtcttgcatgattgggaccatgacgactgcgtgaagatactgaagaattgcaaaaaggctattcctccaagagaagccggtggaaaggtgataataataaacatggtagttggagctgggccatctgacatgaagcacaaagagatgcaggccatattcgatgtctatatcatgttcatcaatggcatggaacgagatgagcaggagtggagcaagattttctccgaagctggatatagcgattacagaataataccggtcttaggtgttcggtctataatcgaggtctatccataaccatttgtgtaagatggttcatatatagtggcatggatcggagcttgtgtggtgtggacatgtaatctaaataagtgggtaccccgctgtgatgctgatctatatcgtgctctctgtcgagatatctattcagtaaacgtatattctatatgcacctatatgaagccgtgtactttataaacctatgttcttgggttggttcccaaaaaaaaaaaaaaaaaaaaaaaa

SEQ ID NO: 21298 - DNA, 820 bp, Zea mays
tgggaccctcgaggccggccgggccgggacccatcccaaagagagaaagtagcagtatcagcgtatcatggagctcagccccaacaacagcacggagcagagcttgctcgatgcgcagctcgagctctggcacaccaccttcgcgttcatgaagtccatggcgctcaagtccgcaatacacctccgaattgccgatgccatccacctccatggcggtgccgccagcctatcccagatactaagcaaggtccatctccacccgtccagagtttccagcctccgtcgcctgatgcgcgtgctaacaaccaccaatgtcttcggcacccagcagcctcactccagtgagcccgtctacactctcactccagtgtctcgcctcctcatcggctcacagtcgtcgcagctggcccagactccgttggcggccatggtgctcgatccaaccatcgtctcccccttcttcgagctcgccgcgtggttccagcacgagctcccagacccgtgcatcttcaagcacacgcacggccgaggcatatgggagttgaccaaagatgacgcgaccttcgacgccctagtcaacgacgggttggcttccgacagccagctcatcgtcgacgttgccatcaagcagagcgcagaggtcttccaggggataagctcgctcgtcgacgtcggtgggggcatcggtgcggcggcccaagccatctcaaaggcgttcccgcacgtcaagtgtagcgtgctggaccttgcccacgtcgttgcgaggctccaactcacacggacgtgcaatttatcgctggcgacatgtttgagagcattc

SEQ ID NO: 21299 - DNA, 3054 bp, Zea mays
  misc_feature (9)..(9): n is a, c, g, or t
ctatagggncgaatgggtaccgggcccccccctcgaagtgtcgaacggatcgataagcgttttttttttttttttggattttggggcaatagcattaaagaggtttagaaaaagtttgcttattaatacatggtaatttacaccctcaatgatgtatgtgaaatggaaaattaagtgatgtatatataagccagaccgtctgatgcccctataaccgctatacagactagaagcaaagcctcagcacaaggtatactcgcaatcaagaaggcgggtcaggatctcctggcagcatggacgcctctccggttctgcccagcaatctgctatcaagcttccaagaggcccatctggtatttccagtcttgccccatcattcgcaacagagtaaacgatctgaacaggtggaattccttcccaaggtctacaaagagtgcaaagctcccacatgatgaccccgaagctgaagatatcacatttttctgtgaatggctcgttgcgaatgagctcaggagccatccactctggagttcccgcagatgagttgtcattcattgcagaatttgacattactcgagagagcccaaaatcacatatcttgactgtccagtatttgttaacgaggcaatttgcactcttgaggtcccggtgaacaatctttagccggtgcatgcacatgagacccctacagatatcacggagcatctttaacctcctcttccaatggagcttagttttctgtgtttttgagtgaatcaaactatacaaagaacccacttccatgtactcagtgactagggataagtgaggaggcttcatacatgcaccaagaaagagtatgacattggggtgtcgaagtcggctaagtattgatatctcgttgcagaaatctttcatattctctgttgtcaaatcctgctccagaaatacttttatagctacatctgttccgttccaaaggccacggaagacttccccaaaaaaccctactcccacacgaatgccaacagtgatctctgaaaactcaatgcaccattcctcataaggcaataaaggcttgttcagaaatggtgaagactgcaacacctcattccaggtcgccatcagatcggcttctgtatagtcagatgggctcctgaggccaagaatacctgacctattgggcgacgaaggcaatgacacagctttctgactattaaattgccttctcaaaccctccagtgcactcggtcgtcttgtggatgcttcatcatcattggagtcaccagcaggttcatgtttcattgaatcatttgaggatccaagactaccatccttctgctcccttgaaaggcgattttgtctcatgctttcactcattgctcgaactgctctcacaatatcatcactgatttcaggagtaatattagtacttctccgtgctctatgtgtatttgatgttgatgcgccatctgaccttgacactgctacagcaccaccatattgtttatcacccagcattgagcgcccacgaactctggacagtggatgctctggacttgagcttgcagttctttgatgttcatccacaactttatcgcggctgcgaccacagaaggcatttgcaacattcggctcactatgagatgaacaactcattttaccctccatagaatttgtcgatttgagcatgatgtttcttagtgagaggactttgaaggatctattgccatcatcttgctcttgcctttgagcacatagaggactatttggttcaagaggagaatcacaggaatcatagtcggctgaatcactttctccagttgcagacatatgggatgtgacaacagctttggatgaaaatggaactagttgtcctggaaaacgcatcaggtcaactagaaactccgcagatttcagaatgaccacaacagacatatgtttggatgaattatcatatccatgaggttcttcatttggaatgcccaccagcagtttagaatctataccaactgagtcagcaaggactttaaataatatagctttgggcctgcaagatccatgtcttatctgtcccagcaattgaactcctcgattttctaataaattggaaagatcttcagaggatgttcttgcaggactgagatgtgggtttggtcggttgtagaagtcaaaaaccaaacctgcaattttttttatcattgcagcaggatttgaattcaatccttttaccagtgctgtgcataactgctttaaagcagatagctttttatctctttctatgtccacaaggataatctcagccttaaatccttctattccaagagaataaaggtcatcaggagaaggtatggtatcaaaatgctccttgagtctcttttccggaataatggaataaaaaccattgggtattggacctgaaagggatccgctagaccataatgtctgagcagcctgcaatgaatgaccaacttccctagaatcaagggaagaatatgcagaatcaaaattcctttcctgtttagtcaggggcagggactggaacttctgctccaaatgggagggccaattccggtctgaagggtgtgtctgggatcttccttcatctcctggcagatcatccatctccaaaatatggtgaaatagagaatcattttgcttcaattatcatccttcaaggccactctacgtttaaatgaacaaggaaacagattgaacatattatcctgtggctcgagcggcgaggctcgccgcgtgatccccggagggaacccaatccggcgccgcgggatacgagggcaccttggtgcgtcgcgagcgaggcggccgggatggtgcggtggtgggagcgcggcgaggcgagatcgaggcgtgtgactgaggcgaaggaggtgggcaaggggatctcgtgatgtgattaattggcccaggtgggggagcgggggttgcttgcttttaattgtggggttagggattcgttcacgaggcgcgcgagatgcgagaacgacttgctgcctcctctgggctctggcgtagaacgggcgaatggcgaaggagcctgataccggacgagag

SEQ ID NO: 21300 - DNA, 2019 bp, Zea mays
ttttttttttttttttcaacaaacccaagcggtgaggcttgcagttccaaatcggtatattcatgcaggttctagatggtttttgtacaacacatgccattttagctcaagtgtttgaagcctttatcagattcctgtagagaacaaatcttatatacaagtctttcatgaacaggattgaacaaaaaaaagtagagtcctgtgttcgaaagaagaagaaaaaaaggagaggcctcatggatccttcagactactcaaaaagatatagaaattttatgaccttattggttgtcacatagaaggctcatatcttccggacaagaacttgagcaccgaactgaggctggagggtgaacaccagcatcggtgcatgagcataagacgccgaaacggtgaacgcaaaccgctgaagggtcattgcaagcgccaccttggcctcgaccattgcaagattctggccaacgcagattgtagggccgatcccaaaggggaagtaagcacctaggtgatagctgctgccatctgcaaaccttgatggattaaactcctctgcatccatgccccagacttcatggtcacgatggatgtgaatgatagggaagtccagccgtgtgccagccgggatgtctagtttacccagcttgatatccctagtggcagtccgattgataaatgtagctggaggatacagcctgagggtttcttttaacaccatagttacaatcttgagatcgctcaggttttctgcattagggtgctcatgctttccgcacactttaagaacctcatcacgggccttgacctgccactcttgatgcaacgcaagaagaagtgttgcccatgtcaacaggttcgctgttgtttccttcccagcaaagtaaaacgtcttgcactcatggattatctcttcgattcccattttgtattcactcccagctttgctggctgatagcattaaccccagcaaattttttgagtcctcacattttgttccattgatttcgatcaatttgcgcagggagcattggatttcctggtttaacctctgcctttttcggttcttctttgttggtacaaacctgaagccaggaatataaacagtcctcattgcaagaagagcaagttgcatctgttcctcctgcaattggaaaattcgtttcccctcctcgtagcctgcttccaaatgccacacaggaaatgacatccgcactcaaagtgtggaatgctttatggacatcgatctcaaactcagtgcggctcccaccttcggcctcccacttatccagaacaggtgatgccgcagctgctatttctggtatccaagccttcaccctctccatgttaaacgccggcgaaatcacgcggcggtggcgcgcccacgtctccccggagagcccgacgagcccctcgccgatgagctgcctggcgagcgggttgttgccgcccgaggccgccttatcaaagccccccgtggagtcggtcatcacggccttcacgagctccgtgtcggagatcaccagccgcggccggggcccgaaccagtacacgaacggccggccgtaccgcgccagccagaccgcgtactgcggcgtggcgcgggcgacgacgccgttgtggcggaaggaggagaggggcgcggacctggcggcggctagcaggtcgcggtagtcggctgcgttaccggagaccaggcttcgtggtggccaccggattccctgccgccggaagcggcgttccaggcggaacgggacccacaggaaggagtggagcaagcggagcacgtactgggcggccacgaggagggcggcgaagaggagagcggaagtgagagcggccattgcttgctagtgctatgctactccggttactctgcagacttgagacttagttttagttacttgcaacggggaatcggctacgatagtcgatagagcaaggaggagacgcatcgcattgactttgtcggggatactgggtcggatttttcgattaggatgttctaggtaatggtctcggtgc

SEQ ID NO: 21301 - DNA, 2759 bp, Zea mays
  misc_feature (7)..(11): n is a, c, g, or t
gtggatnnnnnggccgcttttttgctcttttttaacgaagaaaataatttatttgaagctataacacagagtattgtggtacagacaagactctggtaacgaaatagaacacgcaaaatccgcttcagctttaggcaaactgaaaaatctaacatagggtgaatgtatctctagtcagcatgtaaatacagttatacaaatacaactgaacctgaagcaacattgctacaacacagagtatacagtataggttgcgtagtctccgaagttccagaattgactaatatggttagttccatcacccaatttagctatctgatgattatcttcagaaagcatgttccagttgctcttccaatttagacattttcatcaccatgagactgctcataaggtcgtgtttcttgaggatagaatggagacataaataagcttgacatatcccagttttcatcagatgccagtgtatgattgtcatattctggagttatcccttctgtgcaggcctgataatatcctgaattcagagaccatgaaggcctataaggttcaagttgatcgtaaggcatgtgcacataggactgtgtctcatatgattgtcttgaactctccagattatcaccatcattttggttgttgtacatcgagaaattctcatagtactccagcttgtgagaagaaactgtttctggaggctcaacatgaatatgcagcgattgttcaccaaaatgctgattgtagctaaaaataggttgagacgaaattttattgtcttcatcatacgagaagaattcctggaattgtggttcctcctctttgtagacatcctggtaggtctgattaggaaaccaggtagtctcatcgggaacagcgtgaaaactgtagggctgttcataagatcgatcatatgaagtgtaggaaggctgttcataagatcgatcatatgaagtgtaggtaggctgttcataagatcgatcatacgaagtataggtaggttgctcataagatcgatcggttgaagtgtatgtaggttgctcataagaatgtgtttcctcttcggtgtcaccataccaagacgatctgttgttctgaaactgcagttcgccggcgtcgtgccactggacagtcccgacggccggcggcgcctcctcgactgcgacggagtcctcgacgccccccttccggttggcgtagacggggaccccgagggagtcgactccgatgtggcgctccccgtagccgtcggagtggccgaagaggtagtccagcccccgcatgcactgcctccagtagtcacgggcgcggacgcgggcgcacgtggagcggcagtgcggccccggcggcggcggcaggaacggccagccgcggaacacctccggcgtggggtacatgggcaggtgacgcggcgcgtccccgtagtcgtacggcttgggccagtagtacggttccgccgcgggggccggggccggggccggtggcgagctcggcttagggggctgtggcgctggcgccggagcgggtgcgggtgcgggcggctgagggagcggaggccgcggcacctgcggggcggtgggtgcaggcgtcgcggcgggagaggcgacggggtagcaggtggcgagggagggcgggagaggcgagccgtaggtggcggtgatgtcgtatccgcccgcgtaggggtgcgggttgtagtcgtcgaactcgtcgtcgtctaggtagtcgccggtggcagcggcgggcgccattgttggttgcgggggttggtgggtgacgaggaggggagctggggagtggaggggcagctgcaggaggaggcggcggctgtatcgggctaccggctggtggcatgttaacctcgcgccacttgggggtgatggtgacgtgagagcgagaggcgtaggaagaggacggaggccaccgccacgcccacgcctgccacttccattattgcgctgtgggatcggcatcgtgcgtccataattttgcgctatcaaaaatttcacgctcaaaccaaacaatagttttcttcagagttttatcaggtcaagaatagctcacatcacttgaacatggatcacgtttgatatcgaaagattcactactttggatggcgacattttcttgtcttatatgacgtttgatttttagaaactaacttttagtcactctattttattctattttagacactaaattattaaatacagaagcttaaataaaattttagtttttgtatttaacaatttaaatttagaaatttaaatggagggattaaaaactagtccataaaaatcgtataagacctcccatagataaaaaaacaagtatctaaaaaatgtaataataaataggactcaattagcctagcgaaataaattgtctaaacataatgttaacttaaactataaaaagttgttaaatttggttatggatagtgtctacggagttaatccgagctagttcgagaatttcattttttttccaaatgatttctatttcgtcagagaaaaataaaatattttttcttgagaaaattgaaaccttttcgaaaaaatatggagtcttaataaatattttgtaccagtgttttttttttctctcgaagggactctacatgaacaacgccgatggcaacaaacggtagcgaacagagctcgatcgtaacctaggcaaatttcattgagccaaggcaaatttaattaaacgaattaaattgtgtgttttgaagcatgttctacaatagtagaaacataagactgcag

SEQ ID NO: 21302 - DNA, 1190 bp, Zea mays
ttgggaccctcgaggccggccattgggtacctcgggcccgccgggaccccgcgtcccaccaacttccattccctaccgcccgcccaccccactccactccgctcctcccactcgagccatcatggccctcgcctcccgcgccgccgcagccgccgtggcgtgcgtcctcctggcgctcgccgcctccgccgcgggggcgggctccaactcccctgcaccggcgccggcggtggactgtatctcccaggccgccagcctgatcgactgcatcgactacgtccagaaggggagcagcgcgcgccgtccgtccgctgcctgctgcggcgaggtcaagaccgcagtggccagccccgtcatcgtgggctgcctctgctccctcgccggctccaactccagtaacctgggctttcccatcgacatgaagcgcgtgctggcgctccccggcgcgtgcggcgcgtccaacgccgccttcagcaagtgcaacatttccgcgctttccccaaccgaagcacctgcaccgtccgccgccggggggtcatcgagcggtggcgcggcggcatcttcaccgcgcgccgcggcggcgagctctcctccgatgacggcgaccgccctgttggctgccgtggcggctcccctgctcgcctactactgctgctacctcttctgagggtttccttctgctgctgctgccgtctaggctgagtgacctatttctatgtatgtgacgattcaagttaacttgtggagcgcggctgcgcgtgcgtttgtgcttgtgcagtcgccactgttgctgtgttcttgcgatactcttgtcacttgagaggtggtgttgtatggactggtttagctggcctcccccgtgcttccatcgacccgcttcgcgcttcatgtttactacttgcgatactgttgttacttgtgattgatgatgataaaagccacggcctgtgttactactgctgtaacaagtccgacagaagaaccatccaatgcaggcccacgaaggggatccaggctgcgccggcctagtactcggcttagggagtttgtgtgagttgtaattgagatataagggaatattgattagggaaaaggcatcagacttgtaataagaattctggacagactgtcgctctgcctatctactctgccatctgctctaaaaaaaaaaaagcaaaaaaaaaaaaaaa

SEQ ID NO: 21303 - DNA, 3977 bp, Zea mays
cccctaaaactgtgttttgtatgtctgtttgcactagagtagtggatttagtttcaaaacaagtaaagtaaaccgttggagagagaaaacgagagggggaggcaaaagatgtgagaaattgttgttacaggatgttttcgtcgtaggtgaagctcttttaatattttttattagttatagatagacgtagatatgtagaatgtagagagatagagagagaggagagataatagaagtcgagaacaagttaacacgggaaagcacaaagcacccatgattccagttcatgccaacctcgccgccgtggaccgttgccatctgtgcatctggattccataaaggcacgcgtgccctgacctctccacaccccgcgtcccaccaacttccattccctaccgcccgcccaccccactccactccgctcctcccactcgagccatcatggccctcgcctcccgcgccgccgcagccgccgtggcgtgcgtcctcctggcgctcgccgcctccgccgcgggggcgggctccaactcccctgcaccggcgccggcggtggactgtatctcccaggccgccagcctgatcgactgcatcgactacgtccagaaggggagcagcgcgcgccgtccgtccgctgcctgctgcggcgaggtcaagaccgcagtggccagccccgtcatcgtgggctgcctctgctccctcgccggctccaactccagtaacctgggctttcccatcgacatgaagcgcgtgctggcgctccccggcgcgtgcggcgcgtccaacgccgccttcagcaagtgcaacagtgagcaccacccgagcctttcctcatccttgcttctccccgagcagtttccctcttaaattccgtcatatctcatcatgtgtccccccccccccacccccccaaaaaaaaaaaaacttagtactgtgccatctcctccaaaaaatttccttacacctcgagaacccatgcctaaatcacgggtttcttttcttcggattttaccgctcctttgatttctcttagaaggattttatgtagtgtagataaaggtccctttttttgataagttagtttggttttcccttttgctactctaagcaatttcgatatgatctaacagttccactcttttgcttgcagtttccgcgcttcccccaaccgaaggtaactctatgcctcactatcagtttcactgtcttttcttttacgtccgtctaatctctgtgtaacgacatgcgcctttattacactctatgatttttaggaacaatcggcacatattagtacttagattatgctctatgaatttttgcagtgttacgcctgtttagaactttagatcttcaagtatgaacagaacaaatatatgctagaactgtacaataacttcaactgggaaaaaacaagatctgaattttttagctgtccgttttccaagaataaagtttttgtttttttaaaaaaaatggaagaaaaaacagaattcttagctgtcacaagagtataaatgtgttttgtctttcttctgctagaaaagaagctgatgagctgtaacacgctcaaaacatctccacatgcatgtgtggtgttccgctcctttggcataactatgggtccgcaacatttttgtttgccagcaaagaatcctcagctgttatttccaatcacctttgtatctttgcgagtgattgcatggcatgtgcgctacaaaacaatatagacagaattatgtataggagtgaagagaagaaacctgtatgctagccaacggttcggtttctttaaccatcgcctgattcagttgagctgtagaaagcgatagagtgtggtcagctgatcgttctgttgaagtttgaaatagatctaggcatgatcggtacgaccgagtgtgttagaggggtgaccctgcagctcatctgaatcagacgattttattaccttcagcagaggagtgactgagagcaaggctaatagaagaattaactaaaaggcttcgtactcttgccatagccaataataatacccgatacatatagtgagcttattcttctatgactcttaagttagagagagtcatcatttagattgacagaaaaaaaagaaagagtcatctttaactcacgcaagcaagctctttctccccctagaattctagggagccataagcactcactttcttctctccctctatgttcccacctaggattttggtgacatagagctgtttgaagcctgcctagttagcctcgttatgatggcactattattattaggccatctcgagcatgtaaaatatattgaccagagtttaaagtagagagttgaatatagagtttgaaataaagagtgagatatgagatgggtaaggattctgttgttggagataacttgctactctaggtttagcattccaacatgaaacatttcatcgcctgtccttcagtactagaccatgggtcgccgtgcaaaagtatcattacttaattcctggagacctgcagccgtttctctggcacagttgtcacgggcacagtctgactggcaagtcacgggagtactcggccagcattttttttcttctctttaatgcctgtggaataatgtatgttgactacactacacacctttggcaaaactagtggatggactggagtggttttgttcgttcgtggaaccatcctgaaatgggcgttcagtaatacagttgctgttatgatccaactgtaataaagctgtggtgggttctgagtttctgaccaccaagctgttgtcattcgcagcacctgcaccgtccgccgccggggggtcatcgagcggtggcgcggcggcatcttcaccgcgcgccgcggcggcgagctctcctccgatgacggcgaccgccctgttggctgccgtggcggctcccctgctcgcctactactgctgctacctcttctgagggtttccttctgctgctgctgccgtctaggctgagtgacctatttctatgtatgtgacgattcaagttaacttgtggagcgcggctgcgcgtgcgtttgtgcttgtgcagtcgccactgttgctgtgttcttgcgatactcttgtcacttgagaggtggtgttgtatggactggtttagctggctcccccgtgcttccatcgacccgcttcgcgcttcatgtttactacttgcgatactgttgttacttgtgattgatgatgataaaagccacggcctgtgttactactgctgtaacaagtccgacagaagaaccatccaatgcaggcccacgaaggggatccaggctgcgccggcctagtactcggcttagggagtttgtgtgagttgtaattgagatataagggaatattgattagggaaaaggcatcagacttgtaataagaattctggacagactgtcgctctgcctatctactctgccatctgctcttcttcctgtccaagtcttcttcctccctcctagcatctcctaacaattggtatcaaagccctcgttccggtctggagcagcaccaccgttactatactcgtcgacagaaggggttgggagccatggatcccaacctcaagtccatgttcgaggagatgatgagattgatgcggacggaagtttccaaggaaatcgccaagggtttcgctgaccatgacgcaattctgaatcagagattcactgatttatctgtggctgaggagaaccgcaacgttcgcatccaagccctggaggaagctgccactgaatttgatcgatccttcactgcatggaagccggagatcgaatcttcggtgtctgacatccgcctggagatctccaaactcaacaagttcttcgagcgcgatgcgcgcgtcaactccgcatcccagccgggtgttctcggcaccgagtcggctccttcgcgacaacctgccggatcacgcgctgatgggccaatcggccaccgcactgacaatcatacccgggatgatgagtct

SEQ ID NO: 21304 - DNA, 1844 bp, Zea mays
tttttttttttttttttttgtcccaaagcatccttttgcttgttattaaaacaatgaaacgaaatgaccatatcgatattgcatttgggcaatatatcaaaaaaaaaagagccaccggattcatgctaaatcggttacttacacaagagctactctcgtcgctacggttgaaaacaagtaaagaagattaagaagagtaaaaacgtacatcgattctgtacaaatctggctgtggtgctgcatctctacagagtcagttgcttatcggacaggaaggcgctaggttcacaaaacagaaaccttggcgtgactcgcgaggtgcctgtatgcaggcatgcagtgcagctaagctactgtcggtgcgtgcagctaagctaccgtcgattttggtggtgtgatcccgtgctccaagtaatatgctttctcagcatcagtcaaccttgtttggaacatcccccattctttacgacagcgtgctctaaccccttcccatggtgcttttccattctctgccttgccctggttaccaagcgaagggatgacttgatgaacaatccactgggagtcaaccactccaattttctcatgggctggctccacacatttcctaagagcaaaatcaaggccccatccatggaccaagtcgttctgaatcatatgccatacacagcgccatgcatcccttgagaatacagttgccataatttcaacaaacgctgcacatggtggcaggtgagggtcgctacaccagccaggtctctcctcagttactttgtggacttcctgatcacctcttcgtttagtcatttgccatgtcaaacctttatcgggctccaaaccaggctgagagatctcaagcccatgcttcctaacaagcttaatgtacgcctctgcattaaaatgttcgacaccaagatcttcatcccagataaatatgtagtcgtagcgggcaacaatgtcaggatgtagaaatcgtttggcataccaccatttggtctgctttgtgacactcacatggacggccctttttgaccactcaaattcatcccactcagttgtccgaccatcataatggaacaacataattgtgaagttatctgaaaactttttcaccgctgcatcaatgtttgccttttgagagtatcccactgtaaatgtaacaaggtatcttggtttggtagtaagatcctcactaggttcaccccacaatctccggagataaaggtctgtttcagacactacaatgcccggtggaagcctttcagcacctttagggtttgttggaacataaatcttaggaatttcatcagagttagaagctgaattgttcttcttatgagtagctgcagacgtccatgcatgattcaataatgtttgggttgtgatgccagagtttctgtcctcgatataggagataatgctggaagggaagtgaagctttgttatattaacggtagggaaggaaatgccaaacaagtaccctagcataacaccaataactgctgagaatatgattcgcatgccctcatttgatctctgtgcactgctgcggcctaaaatcccaggttttgccatgagatatccgagtgttatctttttgtggcaaaggaactcgctggcagaatggtactggcactataatgactgaagcacttgtgtctgttggtggtgtttgtcgccggtgaaggcctggtggtgcgtggtggcggcggcggcggcggcgatcacccagtcgtcgccacgagagcgcgtacgcgtggggagcggagcaagaaagaacaaggcagtggcgcaggggtaaaacccagaacgggtccggtgcggttgcgcggccggcctcgagg

SEQ ID NO: 21305 - DNA, 2409 bp, Zea mays
taacatcttacataggaagccattctaaatttagttatgtgaagcaacctcaaccctgcatgatccaccaacgtctatcacctcattcatgaagaagtcgagcaaccactctcggacatttgctatctaatcaagcaatagctagaccaatatcatgatccaaactttgcctcagtatatcccgagacaagtgctccagtagaccaggcatattttgtttataggtggatacattatttagttccttgatactactttgttattatcatgtgaatctaaaaggctactgtaatttttcaataaatgtttgcaagttatgttgctcgatatctgaccataccgaacatcctcaaacgatgccctcataccgaacatcctcaaacgatgctcgatatattttcaatagcttctgtttatatactaccataccgaacatcctctcatctctactaccaacctaaccatccctaacgatacatcacacctggccaccccatgatccccaaaggaactaaagttttaaaaaaactgattctatacgataagcaacccaaggtatgctgcaactatgcaagatagtatccacgtaaaatgcaatacatcagagtaatatggatgatgattatacctccacacatttcctaagagcaaaatcaaggccccatccatggaccaagtcgttctgcacaaaacaatatgtaagaatacaggcttcaaatgaagttaagagaacagtaggagataccactccccacctgaatcatatgccatacacagcgccatgcatcccttgagaatacagttgccataatttcaacaaacctgcatatcagattacatgtgaaaaacagaaatttcgataagaaaataatctaataaatgattgcactcctacgctgcacatggtggcaggtgagggtcgctacaccagccaggtctctcctcagttactctgtgaaaaagcaaaataccattccagaaaccaatatagctgtgtgtggctactaaacaatggtaaagcaatattaattcaggagctcacttgtggacttcctgatcacctcttcgtttagtcatttgccatgtcaaacctttatcgggctccaaaccaggctgagagatctcaagcccatgcttcctaacaagcttaatgtacctgaagaagatactttgagaattgagattatctttcttgagggaacaccattaaaaaaacaaataaggatgtgctgctgcttacgcctctgcattaaaatgttcgacaccaagatcttcatcccagataaatatgtagtcgtagcgggcaacaatgtcaggatgtagaaatcgtttggcataccaccttgggtaaacgagaaataagtttgcaacctttgatggacaaatgcatagagactgaggggcccctttggaacgcagaaatttcataggaattgtttaggaaattcacaggatgacaggaaccggttcatttccataaaaacacaagaatggaggggggcggcatcctgcattctaatgggggcctgatcattgcaaacacacaaaagaacaactcaccatttggtttgctttgtgacactcacatggacggccctttttgaccactcaaattcatcccactcagttgtccgagacgagttcttgctaagtaatcagtgggagggaattcaaatatttttcttgcaaggcatttcttattgcttcaaagggacttagccaacatgttggacttgtatagtctggatttactaaagaatatatatgtagcatacagttcacacacaaaggaattaccggcagatgaagaggacgagacgggacggagaggcggcagatccagcaagatggagaggcggcacatctagcaagacggagaggcggcaaatccagcaagccaccatggcgaaaccccaacatcctctgggttcttcgtgggagctgggcggtcgcgtccagcctcatcttggcatccctggcctccacctcgagtgcacggatggcggcgtcgagcatatcccatgagcgcttcctagacgtggtggtctcgggctcggcgacgcggcgctccgcctcctcgcgtgcagcggtcgcggcatcgctaacggagtcatttgcgcaacacgtggcgacgaggaggacctgtgcgatggtcaggcgctgaagaggagggcacgtcaaaaatcgacagcagtcctcatgaccagtggcggaggacgccagaaaatttaggtgttgttgtcgcaacgaaggaaaaaattatgacacaatttaaaaaaattatgacatagtttaaaacaatttgtagcaagatcacaacaagctttgtactcttcaattcttcgtacatgaataataaaagttcttatctaatcttttatagtcttgcaatcatcaaaagaaaattca

SEQ ID NO: 21306 - DNA, 989 bp, Zea mays
gcaatcaaacgatctacggagaacaagtcgtcgatcgacagccgtgctcatcgtaggcgcggcggcatccgggcatggacaggtgcggcggcggcgccatggcgtcgtacctggtggcagtcgtcctgctcgttgcgctcttcgcgtcgtctgcaaaatgtcgtcctgagccactcgacggcggcggcaacgttaacggcaatggcacggcgccgccagtcaacggcggcggcccgggccccggccccggcgccgtactgaagctgcagttctgcatccagaggaactgcgtgtacgaaggccgtggcaacgccccgtgcttctgctgcggggccttgaagcccaaccagtgctacgaaacgagggacgggtgcagcggcaactgcgtgtagcggtgtagccgccgccgccggcgagggcgagtgatgggagatcgatcgatcggtccgtcgatctcagccgccgccgccgccatcgaatgactaaacaaacaacgaactgcgtgttttttgtttttctgtcttgaagaataataaccatggtaaattgcgctgttatagtgctctatgatcttctctgatgtaccagcacccttgcgttcaatcaaatgctaccatgcatgccgacgttgcgattgggaaaatcgtcatgcactagtgttttgctctcgcttgatgcatgcgctgtcgtcgatctagagtgaacaaggagagagggtgaagataccttaagggtgcatactaatgatttataatttttttagataatgggatagagtgttcccagcctacatcacgaagatgacggcttgtcacaccaacacaagaccaacagatccaactcaaagagccacaagcggcgatacaaaccccaaacgcagttgggtggacaacaaaaagtaaaaacaacgctcacagagcgatcctattactaaactgccacccatgaaaagcgaagatctgcatcaccgtcgtctcaagcttcctgca

SEQ ID NO: 21307 - DNA, 2734 bp, Zea mays
tgccctttagaaatgaatacaatttatacaaggtctgtctcttttaaaattgatgtgtcatctagcaaccataccaattgctatgaaagagttaatatggatattaaatttagttagcgaccaaaggtaaagaacaaagtggaggcttgaaagataagccactaatatcttccatagtatcatttgtactatttataaatgctacatagagtccaaaataatcctggtaatccttgatattagattcagtgtaggttgggtgctcatgtgacagggactgacaagcgacaacattgtagaacccaaaacagaacttgaattgtgtacagtagacaagtaaagattgccctgagcaaagagtactcacctgcacattgaagcaagtgggcttggtgttgatgggagcatagtaatgaatattagtaattgtaggcccaatcaatgtctttctggccgaggtgaagggaggttccagggatttatttggttttgcttaactattgttaagaagctttagaagcatttctatcagtggcactgaaagaccagaagtttagtctttgcatctaggctagagttttttaaacgatagggtaaagctattgcttgtagtacaacactgctcgtatttcagtgtgcaggtctgctagaaggcggagatgcattttatcggtctctatatttttatccacttatcttcattttttgattttttgttttaggctctcttcttcttggacctaaagcagttagaggtgccctttctagaataacttttggtctttccgttagtgaggtcagtcatcctttagttttatcttattgtatggtttattaatccatcatcattgaatatttgaatgtcctatttatattaatttgatttgtcgtatccttcacataaataggtgttataacctaaattttgcattgtgatgtctctactaccaacacctattttcttagaaggctacttggtagtaatttttgtactagctacaagaaacccactttatgcaataaatatccattatttgagtgtgaatgtttgtcactgaacaatcaataacgccttcatatgaaactaacctttctctaatgtgaacagtgcaatgttgagggcggggtctcgcttccacgggacctttagggctggtttggtgcacatggaattggaggggatccatgggggagtaattcccttcttatttaaatttgaatagggaggggattcctcccacatggatccccttcaattccctgtccaccaaatcagctcttagggaggatatgcgtgcgttctcgaacgttctggtggcctagaaatacacgtttcccaggccggcaacgtcgacgccgacgcggtcacgccttttttttcagccgactagttcacgtgctcgacgacggcgagcgtctgtctaggtgcgtacaggacggcaggcgctcaatacgtccacccacagtttcaatttgctcagttaaagtatttaaatcgattcagcgactgtttctgttgtatcgatccgatgctgtacaaacacatttatttctgtatttattaaatagactaatatacacttcattgtataatagagtctcttaattgtattttgtagttagagaactatttcgatgtctctcccactatgcatacccccactatacatacccttaatcacagcacaaatcagcacaaatgtacacctataaatatgacgcacggacggcctcgtttctctcccgcccagcactcctcggcctctcactcccatcctcccgcgcttagaaaaccagggccaccaagggctgtggcgtgccattcagtccggccacgcactcaagcaatcatcgttctttcgaaacgcaacagcaagaagaacaaccacgcacatcgccgttccatcgattcatgggtcgcctcggcaccgcgacgacgctggtggccctcgcggcctgcctcctctactgctctgcttcgtcggcgacgctggcctacgccggcgctgcgccgacggaccttggggcgctgcggccgacgtgcgacgggacgcttgggcagtgcgcggtggggagcgacgaggagcaggaggtgggcggcagcgacgcgttcctgcggcgggcgctggcgcagcggcagcccaccaaccggtacatcagctacgcggcgctgcgcgcggatcaggtgccgtgcaaccagcgcggccgctcttactacagcaactgcgcgtcgcagaagcccgccaacccctaccgccgcggatgctccgccatcacccgatgcgcacgcaacaccaactgacccatccgatttatcattcctagctaaattctcatccatgacggttgacggcgtgaccgtatgatttgaggattatatataaatatattgggcgcatccaagagatccagccatggcagatgtggatccatccattgacgtgcaggtccatccagaggtagaggaggaagacagggaacacatgtccaagtgttgtttggattgacatggatgtttccacttttttgtgttaatttatctttttgtgatgaatgatcgacgtctacgtatgtaccataagtactagtagttccattattgttttgattttttatggcttttgcaaaaaaaaaaaaaaaaagtgcttttatgaccggtttgtactgaaataactggattccacaaaggagtctggactagcttctgacgaaaaaaaaaaaaaaaaaagcggcc

SEQ ID NO: 21308 - DNA, 917 bp, Zea mays
gccggccgggccgggacgcacccacaaggttgagagctgagactgatctgtgccatccgtccgttcccgcgagcgagagaggccggccgcagcatatggcgtccgccgcccaccggtccatggggtctgccctcctgtccctcaacctcatcatgtacgtcgtcgtcgcggtcatcgctggctgggccatcaactacagcatcgacgagagcaggaactcgctgaagggcgcgacgccgccggtgcgcctgttcccgatctacttccccatcggcaacctggcgacggggttcttcgtcatcttcgcgctcgtcacgggcgtcgtcggcatctccacctcgctcgccggcctgcacgaggtcagccaggggtacccggccagcatgatgtccgccgccgcgtccgcccttgtcacctggaccctcaccgtcctcgccatggggctagcgtgcaaggagatcagcctcagcgtgaggcccgggagcctgcgcaccttggaggcgttcaccatcatcctgaccgccacgcagctgctctgcgccgtgtcgctccacgccggcgcgcacgcggtcatcctggagacgcctatcggcggcagagtctagctgaggtgcgcgatgacagctagcatgcgccatcttggcagagtgatcggtgttgtgtcgctttacaggtgccgtgtgtgtgctttctgggtacctaaaattcgtgtgagcctcattcatttgtaaaaaaatatgtcgtggactcataagtggtggtaaactatcggcgattcttcccatactactgcaagtcaaaattattgcgctttgcacagttccattatatgtactaagtgtctgtttgttttagcttatagattatataatcttgattatttactctagctagaataaaaaaaaaaaaaaaaaaaa

SEQ ID NO: 21309 - DNA, 754 bp, Zea mays
atgcaatcaaacgatctacggagaacaagtcgtcgatccacagccgtgctcgtacgtcgtaggcggcggcatccgggcatggacaggtgcggcggcggcgccatggcgtcgtacctggtggcagtcgtcctgctcgttgcgctcttcgcgtcgtctgcaaaatgtcgtcctgagccactcgacggcggcggcaacgttaacggcaatggcacggcgccgccagtcaacggcggcggccccggcgccgtactgaagctgcagttctgcatccagaggaactgcgtgtacgaaggccgtggcaacgccccgtgcttctgctgcggggccttgaagcccaaccagtgctacgaaacgagggaccggtgcagcggcaactgcgtgtagcggtgtagccgcgccgccgctgcccgccggcgagggcgagcgatgggagtccatcgatctcagccgccgccgccgccatcgaatgactaaacaaacaacgaactgcgtgttttttgtttttctgtcttgaagaataaccttggtaaattgcgctgttatagtgctatatatgatcttctctgatgtacaagcgccccttgcgttcaacaatcaaatgatatcatgcatgccgatgttgcgattgggaaaattgtcatgcactagcgttttgctctcgcttgatgcatgcgctgtcgtcgatcgagtgaataggggagacactacaccaaaaatataaacttactacggttttacaaaaaaaaaaaaaaaa

SEQ ID NO: 21310 - DNA, 5021 bp, Zea mays
  misc_feature (4540)..(4540): n is a, c, g, or t
  misc_feature (4969)..(4969): n is a, c, g, or t
  misc_feature (4980)..(4980): n is a, c, g, or t
tctcatgcattcagttcatagatgcatagacgcttttcacaacctctggccagatgaacatgtccatcgacgttttttttttttttttacacaaatatagatgcgatgtatgttttcctttgctataataagctactgaatccatatttaagcgtaaatgcctctactgcaacttgtagactccgagaaacggcgacatgacagagccaatccagatgctgccgttcctctccgccacttcgctgacggacctgaacaccctccgaagatccccgtggacgctggccatctccaccaccctcccgtcctcctcgctcagccgcagcgcgatgacctgccgcccgaggcggctgagcagcgacgaggcgcgctggacgtggcgcggcggcagcgccagcaccaggcgccggagccaggggtaggagatgcagtactgggcgagcttgcccctcctggcgtggagccccacccagaagccgccccgggggctcatcctgatgttgtccgggaaccacggcagccgcgccacctcctccagcagcgccggcgccttgggagccgtcgggcggagccagtaccggaggatcctccccgtggtggtctccgccaggagcaggtgcgtgccgtcgctgctcatcgcgaggccgttggggaacgccaggccgtcggccagcacctccaccccaccgccgcccctcgggtcgtaccgcagcagccgccccgtcgtgtcgccggacacgacgatgcgcaggaactcccgcctctggaacctcgtgctcgtctcggtgaagtagacggcgccggtgcccgggtccacctcgacgccgttggcgaagctgaaggcgcgcgcgccctgccaccactccggcgccaccggcctcgacgccttgccgccgcccgggcccggcgcgaccacgcgcaggccgtggtaggcgtcggccacgtagagctcccccgtgtcggggttgaacttgaggcccaacggcgcccgcactcgtgctcgctttcctccgcggatggcccggcctggcggtttgttttgcacacaattgcacacgtactcatgcagtttttcaagaaacaatgacggctatatttcccgtttaacctaatttattctatatatggctaaacgtccacgcaaaaaggctacatccatttctagggtctaaggatttagatgcatacatacgggtagttattagttggagctaaaaattagaggacgtttcaagcaccagacctaatagttagttgactaaaaaaattgttagtgaaattagctaactaaccaactactacattccttcacaaatatacgacatcgttgacttttttcaaaaaaaaaatggccactcgtcttgttcaaaatatttattaaaaatataaaaattttaagtcaaacatagactaccttaaataataaaaaaagtcacaacaaaataaatgataactcttatttttttattaaaatgagtggttaatttttttaaaaaaagtcaacggtgtcatatatttgtgaacggaaggagtattagataattttttttaattagactgtacttaatatttataactaacatgactaaaaattattgacctgcatccaaacacccccaaatagaaggggaataagatgtcgcgatcagcagtgctttatacatgcgccattttcgtgagctcgacggcccgcgcgcatggcgtgcaacagagagctcccacgatggacggggacaggagacaagagacaacatgacatccccaaccaataacctgcgcgttggttcctatcagtttcaccattacttggacggcggcgggcggcacacaaccgtcagccttgaaccgtacgcagagctctctggttggttggggacgagcagagtctctcgcgagaagctagctaccacaacaacatacatgggcacatggcggcgcgtggaacgaacggacggtggtcacgcggagaggacggcggcagcgaaacttacaggtctgcgcgcggagcaggagtgctcggcccagcgccgctccgccggcacccaagcacccggccgtccgacacgcccgtgaacgggggccgccctcaccgccgtcaccgtacccaccggcgaacacgaggctctctggccccgcggcgccgtccagcggcagcagctcagcgtcgccgatctccagcagcctgacgtcgccgctcgagtccagcgacggcagcacttgttctccttcctctgctctgctctgctaccttcacttcgccacttgaatgccctgccatgtgtgtgagcgtgtctcccagcctcgctccacgttttagctgcgctcctccatggcggccggccggcgcacggcgttcgccatcgagggcacaatcatacgccgtacaaaccgtggggtgtccacggtgagtccagagtccagacgaaccgagcaccgtcctggtagctgttgacgcatggccggccgcctgttccagactctggcgatgcgtggtgcctgccgcggatgcgacgacgacgggcgatggggatcgcgcgcgtgaggacataggcgatggggattgcggtgcttggccggacgcgggaggagccgtcgcggccactgctcggtgctccgttcgctcggcgcgagtgcaacgacaggcttgcaccggcacggcaccgtctggcctgctctgctagtgctagctgctgcaccacaccacacgaccacaccacacgtgacgacgcatgcagcttgcatgggacgcggacgcggtgatgggcgtcaatggataggtcgaccgtcgacgtcgcactcgcacccacccggcgggccctgacacggcgcaccgaaccaaagcctgcggtgcgcaggcgatcgaccaagaccaaagcgggagcatagcagaaagcagatcatgatcgcgaggaagaagaaccggattgcacatgcgcgcgtcatgcatgcaaggaaaaccagactgctgccgcggcggtcctgcagttcgggcgcgcaggaggccgagtgctcttcccagcgccgctcgccggggacccaccggaggacgcggccgtccgacacgcccgcgtacgggccgccgccggccgggtcgaacgccaggctctcgggccccgcggcgccggcgtccacggggaccaactcgacacggccttccccgccgccaatctccagcaccgcgacgtcgcgcagcgcgtccggggaggacaggagcgcggcgaccatcgccgccgccgccaccgcaacgacggccgcgcccgcgagcacggccatcttcatccgctaggcgcgtgcaccgagcccggccgatcggtgctccgctcctccgtccagcggcaagcgcgagtgcgtgcgacgccgatgccgcgctgcgtgctatacacgtatggtcgcgtggcgtggcgtccacagaaactcgatgagggttcagaggttttcgggaggggaggggagggggagccgaaacggaagcggccccggggcgtgagcgcgacgacgtcgtgctcgttttcctccacggatggcccggactggcggtttgttggcgtgtcgatcgggagcgtgtcgcggtggtggcggcgtgtgggccgtggcgcaggcgccgttcctcctcccgtgcggaaaacgcgggcagaggacgccatcgtgcccggcccgggcctggcgacccgcacgggaaagcagatagcctagtaggcccacgtcgtacgaccaccagcgtggactggcctactaccgtcacatatctccatgtcagttcaaaatttatttgattatataatctgatagattataatttcaaataaacatcaagtactaacccatcgctaaataataatacagtatcatatctccttttttaaaaagaaaacaccgctcaagtacaacacaacgcaagagacaagattttatttggcacatgtcaacttcatcgatggttggcggagcgatagagaggccacacgcacagcctagccacctatcccaacactctattagatgccatgtttcatgcacatatgttttttaaacaaaaacgtttacaggtactccctccgctcataaatatatgataccgttaacttttttaagaaaaaactttgatcactagtcttattttaaaaaataataagttattatttatttttggtattatttttgttggggacatatctggtgcacatagaagactggtgcacatgatacacatattaaataatcatcactcattttagatctaacgtctctagttgattattcaatttacaaataacaccttccaccactacacaccaccacgttgaagggtgtctttagtaaaatgtaccaaacaactagagacgttaaatctaaaatgaatggtgacgatttaatatgtgcatcaatgttccatgtgcaccagatatgttgccttatttgtttcatcacttaaagtagtttgatcttgacttaaaattttatgtttttgaataaatattttgaataaaacgagtggtcaaagtttttttttaaagtcaacaatgttatatatttgtaaacngagatagtacaaagcatatacaatcggatatgatgcacacgtatatatgagctccctctgagtgaagaatggtttctatcatatacggtatatttcttctctatgaagtgtatttgaaaaggtatatatttttttcacgtgagcttagagatacgatttatacatagtttgtaaagcgtgatgaaatttacatctttagtgctagtttggaaacctcatttttccgagagatttctatttttcaagaaaaattagtttatttttccctaggaaaatatgaatgacttgggaaaatgaagttatgaaacaaacctttatagtttttttttatgtacggttgttttggtactaaatcaattgatacgattatgtttttttattagagcaattatctgtatgccactttaatgttattatcccgtaccttantttccgtcacnattgtctaatccctcatatattgccaggatataattttgcc

SEQ ID NO: 21311 - DNA, 4466 bp, Zea mays
gacgggatgtcgatcatgaaggggaagctctacattcatttcacggtggagttccctgactctctggtactggagcagtgcaaggctctcgagtcggtacttccaccaaagctttcgtccaatctgatagacatggagatagatgaatgtgaggagacaaccatgcattaatgtgaacatcatcgaggaatagatgcgcaggaatcaggctcatgctgctcaggaggtgtgtgggaggataacgagatgtgcagtgctcttcaagtgtgcacagtgtgcaaatgcgtctatggactatatggttctttggtttttactgttcgctgaggtgcaaagtaggaagaaaatacggccctaaccttgcaagcggggaatgtatcgtttttggtgcaattgaaatatgtgttcttttttatgcactaacattttgttgaatattttatataccgttgcaacgcacgggcatctacctagtaacctatatataagtataggtgcatctccctaatggtgtttctaggttttcatggggcagcaggtcatctttgttggacttcatcgtgaatttatcattgtgatccaatgctctagctctttactgtgattaaaccaggctttccaattttaaatattaagattttttttgtcatctctggaattaccaaattttgtgaaatccggtcgaaattttagaggcagacatgaagtatgtcttttttctttttttttttgtccttctctaaagatcaacacggtttaggattactcatctgttgactagaggaataaaataaacaatagcctaaaattatatatttacagtaaaaacacatgtactagtgtgatacaaaatttcactttttttcttcaagccactaccgaaattgctgaatttcgtgaaattttgaaccctgacgtaaacacatatttctgctccatttgtttttgaaccatatggttagttccattccatcccaatctacattatgtaaacatttacatcaaacacgaaaaggtgaaaacaatctgcttgctactgcgcatatatgctaatcttcagaagctaggaacaacagttcgctgggtatgatgcatggtttgcaccagtccagatccatagtggcaaggccttgccatggagctcaaaaacaaccttttgacctcttcagaggcatctcttgtaagcaaacacatcatgtactccatcaccaaagactcacatggcaaggtgatcctgccgtcatcaccagcgaagccgaactcctcctgcgacatgctcaggagctcaccgaagagagccgttccgaggaacaccaacgggacctcaaaccgccgaccatcagccgagtacatggcacagtggcctttgccagccaccgacgaagtgctgcatgacgacccgtcagtttctttcacaggtgtcgatgcgagcctcttcctcgcgagggccgccattcttcgccacctactacttgacatctgaacaagtctcttggcactcatcatggctggtggctgattggcttcttctcctttcttcgtctctggaactctagggctccttttgtatcaggtcaggtgttgttgagctagttgattgagtgttcgtgcgaccggggcggcctcggggatggtctcgtgcggatgaagagaagcatgctgttactcaagtgcagctttcaactcaggctggcaagggacaaggacatgagatcagaacatgcaatgttgcaagaaaaagcagcctgattttgattggatttgaattctatggacatatgctggccacttgttggagccactagtagcagtgtcaatgtcggaccataccgacacaacgcgagtgcttgggtaccacaatttgctgccatactgaccaatgaccaaccttgtcaaagaagcatgcttcataaagaccatgtgtaaagtgggtccattgcgtcagtaccaattcattctgtgcttgggcagtgaaatatcgaaatttctgggtagctagtatgccctatttaaacttataaattggatccccagctcaggaaaatgttctgacaattgttcatgcccagagtatctgaacgacacaacaatgtggccgacacttcatatcacttcttcaattggcggtctattggattatcagcatctcatgtgaactacattttcgttgttttttttcttacatgaacctacaagattgcaactaggcaactaactgataatgacaggcacgttcatggcgcccatatcagcgaagtttccgcagtctcgacacttgcacccccaaacggaaagggattccgacatggacttcggttgtcaatatcggactgtgctacgtctagccgaactagtctggccctctcaattcatgttgctcccgttccacatggccatggggtcctcgtgccccttccccactaaaccgctcagcatggctgcataggatgtgctcaatccaagcagagaaagggctctcaaatcaaatgtatgcacatactgcatccatgtcctcatgaccttgtcccttgccaataatcccactcgacaagattccttactctttgattcagctatatattcagggtcaagacttctccaaacaccaccactcagcagctccacaaacaaagcatagcaaaggatgccgagcagttgacgatcattgcgtccccatggcagacctgacaaaccatgttgaagctgtagaactgacaactccagcctgcagaattgcaaatgttaagtaaaacgttctgtttacagcctaagacaagacctaatacagtgaaagtggtgatatccagtaagtccaagtaaacacttaagcaaagaatacaatattgcatgaagatttgcattatggaagtaaaaggacatcacccaagaatgattcatgactacggctggaaatgtccaggaaaaattaaccacaacatgtatgcatggctgtacccattgaaaaatgcacacgtataccacaaaaccattgccacatgctatgacataaataaagcaaccatcttcaggaactgagacatggagctgtcgacctgcatgatttgcagtaatgaaacactcttcaccaacacatagcatgtaaatccaagaacagagtacacaccgaagcagtgaagtgaaccctgcatctgcctgggaatcaagtctcctgactgttgaaccaacatgccatgtccccattgagggattggtgctgaatttttagttaattgtaatcaaataggtgttagcaaaaaagaaggtagggcctgaatcatttagaaataattgcttttgagtgaacctaaccggcttatctctgaaccacttcaaacaggacactgaaacagatatgagcagctaggccataaaagcagaacccaggatgattgcactatgtctcagcccaattcagcagctagtactgtagtacatatctcattgcccaaccactagtccactatctttgccttcaaagtggagtaagtgatggcccagcaaatcagatctgaatctcaagtgtcaacatctgcagctagcaatgcacgtacccagctcatggccatgtcccctgacaatcagtctgagaagagcacaactgcactcaagacatggaccatttcttcacctatatatacaggagctagcaaccaagacaccatcactacaatcacagccacaaactaaacatttccaagcactagcctgagaatcaagaagaaccaagcagcaaccatgatcaatcccaagaagctcgctcagttggcgaggaagtggcaaagggtaaaaatagccaccaaagacgacgacagatgctgcaccatttcaccaattgcaggcaggggccactgcaccgtgtacacagtggatgggagcaggttcgaggtcccattagcgtacctccgctcagtggtcttcagtgagcttttgaggatggctgcggaggagtttggtttcacaggtaatggcaggatcactctgccttgtgatgcagctgtggtgtagtatatgatatgcttgctccagagaaatgcatcagaggaagttgagaaggcattcttgagctctgtagtgatgccttgtcagcaatcaagctatccaacgccaccggtggtgctgcatcagcaatttgcagtttgtagctcctaaagatatccaggaatttgcagcaattagtgtgtagtactctaatacaaatagaatgaaaattgtatttatttatcttagagaactagtggctgtcatttgttgatgccattttttaaaaaaatataacaggtgctctgtagtaatgccttggtcttatttttcattgccgttctttcttcaaaagttatattaaattagcagacaaatgatgagtaggtgtagatgcagaaatgtatgcttacaaaagtgttattgtaaaagtttcccataaaaaaaaaaaaaaaaagaaatgaaaaggcaatggcctggctccatgc

SEQ ID NO: 21312 - DNA, 2335 bp, Zea mays
  misc_feature (466)..(466): n is a, c, g, or t
  misc_feature (509)..(509): n is a, c, g, or t
tacaatatttgccgtatactactccgtagtccgtatatgtaatcagcatatgagggagggagatatcctcagaaatgagaacgcattacatcttgtcaaagaattgcagtccgctcgcagacgcccttccctactcccaatattcatggctcaaaagtggggacctgagcggaggcgccccatgttgcctggtacagtgcacgctgcggtaggctcctgtaagatcttcctccctcttcctcttgagatacgacatgatgtcctccacgtgcgatttgatgcgtagatacacctcgttcgcgctcttcctatctctgagcaaggctgcccatccctttcatctcaatcggctgcccgaacaggtagtagaatcggccaggcacttttgggagaagagctggcaggtacatgtcctggttcccatcctctccttttacgctgtccctcgatcgttgtagtccagaanccaactcgagaaacgtcgtcttcttccaacaacacccaaaggngtatgacagttacaccaaagcgcgccgccatccttacgaattctggctgatctggccagaacaacttatactcttcacccttcctgtgcagagcttcccgaacgccgccggggtagagcagaacaaattggttcctctggaacaacctgtacatattgatcggggtcaccggcagtccaccgtacatagaaacagtgtcgaaacgggacgtctcctggcgcgacgactcgaactttttcccaaacaggaacgggtgcgccatgccgcggacgactgtcctcttctccctcaggaactcctcgtacagaggactcagctcgatgcccatgagcgcgtggtagcccacgaacaagaccgggcctttgtcagggacaccggcaagcccgcggacgattttcccatccttcagggtggacatcatgactgggctcagtgcaaggtggaacagcctgtgatccacatcaaatgtttgcctgaattcacttagagtaggcgggagataatcggttacagaatccctttgccttccacgccgatacatgttcgctccttttatgacagttaacaggttgacgccatcctccagcagtagtgtatggccattgtccttgaagtatcgaactctgcagtttttcagtgccttgaagagtcgatccgcttcttctccgcttggtagaagattgtccttaccactggcaagaagtagaacctcggcttgcacggcatggagacgagaatttgcataggctgctcctgccttgagaagtttgagcttccatagaagagtatcccttggtataatatcagacagttctgaaagcaaaggaagcattgatgtgagactgtctgacaatttctgcagagtttctggaggagataggttgttttcaatgctaactgcagccatcttcagtgggtcacccatgacaaaactgagaagatacggcactgtagcatgaaactcgcttggcactgattccagtagaggcaatactggctgcaatggagtctttgcaaatgatgtagctgggtttactagtatgagcccggccggcctcgagggacccaatgaatctgcggattacgagctgccactgccagtgccagggatccgccaaatgaatctccgacaagatatatcggtctgtccggggataaatcatgctcgtgcttgatcaaattttcaacgatttgtactagtccttcaaatggtgtacgatcattgactggtatatgcaagcaccgaacctcgaacactttgcccaaagacttgtggtgcaggatgagtcccgtgccgacgccatccattcctggcaagaagagcagcagcggcgcttggtccacggccgggtggccgcactcgacgggagagaaccagcgcggcggcccaccgtcgtcccggcacaggaccttggccgccgcgaagtagtccttgacggtcacggagccgaagccgtcgtcgtagaggacccccagccccctctcctgctcctccttcaccggcagtccctcgttgtccttatcctcctgcaccttctccttcctctccaccgcggcctctgcagacccgttcactgtcaccgtcactgccgccgaccccgcccgggtgctcgcgcggagggcgaaccgcgcctggagtcgggcgctgcggcgtcccgcgccgacagcgaccgggggaggacggagcgccgctacgggcatggccgaggttgggcgggaagaaggaagaaggcgctgctgggtgggttcgaggagaaacgaggacgaagcaggggaagggagtaaagcgtagctgcgtagggatcaggaaagtggaccccggccgg

SEQ ID NO: 21313 - DNA, 5320 bp, Zea mays
actatttcagctctaaaaaatttggtaaaatgatgaagcagatcattaaatgctctagaaaatcataaagctagagctgtaagtctttagaagacatttagataatttattttgtttattatttcgattaaaaatatttgttaaaactatttaaatctgtattctaaactatagctccacactgaagctggaacctggagcagtttcaaattcccttttgtgtgcttaaaaataactatccatatgcttaaccttgactgacggtttctgttggattttaacattaacctaacgagtgttcgacgttgttgttgttggcagattgacagtaaactgcaagtgctaaaaaacaaatttacagatctgtcatgtcttattgatctctattcccgactcataacgagataaatggacaagcaagagcaattatcaggtccttgacttttgttgatctaagataacattcaagatccttccaggcacataaattttcttcctgatgccttttccatcaagatatttggagagtttctcatccgaggctgcagttcgaaaagcatcatcctcagagcacgctttgtcaacaaggattgtacccctggtctttccattgatttggacagggagtacaagctttgattcctccaggtactcactttttgcctctggaaactgttcataggccaatgattgtggatgtccgaggcgaaaccaaagctcctcagccaagtgtggcgcgaagggtgaaagcagcagaacaaaggattcaataacagattttggctgggtttcccacttgtatgcagcattcagaaactccatcattgcagatattgcagtgttaaatcttgtttcctgaatttcctccgtgacccttgcaatacatctgtgaagaactcgaagctgatccaaggttggtgcacccgcggcaggcatggttccatcagtatatgatccatcagataattgtggaccagctatgagtctccacgttcgtccaagaaagcggaggcacaccttcgattgccctcagatgctccagtgtcttgtaatctcgtataagtaccgatatatctcagtcaacttagtatgagatgtacatcatctgtagatatttatacacacctcaatgcccccatgaacatttcgtgcgagcgcagagaatcagcgccatattctgaaacagcatcatcagggttgatgacattccctcgacttttactcatcttgcaggcacgagcattcagacgaatgtttggagtatccttcagaccataatgatctccaacgtttgtaaccttgtctggagcgactttttcttggtagcaatcaatcaaacctgagtctgagtctgcagaaacccatctgccttcattgtctctatatgcagtatactcgatctattacagcatttattagcaacaataaaatcattcatgaacatgtagaaattctggtagacacttgtggcacctacttctcctagtatcaatccttgatttatcaggcacttgaagggctctttagtggagactacacccatgtcataaagaacctatgaaacatcacttagttagaataaaggccatacaacaatgtatgttagaacaagggagaacacccttgaaatccagacattaaccactggtccccatattttctaagagcaacgaattttggctaacaggagatagaatttctgatggatattgtatagctttaaaaatagccaattcaggagttcgtgatattatccaaaacttcatgcaccaaaaatcctattcatcataaatcagcaaaattaaaagtaaaaaacacagcccaagggaagagaatcctaaaggcattgcttgataagttgagaaaaggcacctcaaagctggctcttacccatatgggaacaccggtaccacacccatactttttgggatcatacagcaaggggacttttttttgtgagaaccagggtttgagcccttgtttgtagcctcacaactggaaggcttaccaccatgctacaagcatgttctaggcaaaatcatagtaatgcaaacatggtagcacttgcaacaagatatcaacaaattaagctacaaggtttgtgtgggacaagaaaaatagctaattccatcacctttaatggaactatagaagggcaaaaacttatattcaaacattaaaaaaaaataccttgtgccaaaatcttgcataaagcaagtgcaagacagaatgttcagcaccaccaacgtagatgtcaactggaccccaatacctgtgtgatatgaaaaacagaatacagttagttccaccatgtagcacaccccttatgagagatgacacacgaaacaaggatgcacctttctttagccttatctacccatagactgcagtttttggtgatccatgaacctcaaatagtacctgaaatgatgatttcatgaccctaaagatgtaagggttcaccagccactcgcaacaccagaaaggatatgtttcaataatgtgggagtaattttccaaatgatagtttgatgttagaatttgatgcattcttccatgagacaataaggctcctattatatattagaaaaaatctccaaatgcccaacaattagaatatgataaaagttaccagcaagatccagcccattgtggcatggtgcttgtttctcttctcgcaggcttcccagatgaagggtcaatggttctaacctgcaaaggaagtaaaaacggttaaatagtaaatagatgtgctcaggatgtgcaagagtaaaaaaatgataaatgcaagttttgccaacagaaaaggggtgaactcaagtgggctaactaaatttcatgacactgataggcagatgtttcttgtagtttcaaacaatcaatgttcatgtcaaccaattgtctttctagcatgctaaggctaccttcagcagcttacccattccccacacccatattcaaactcctctgtgcaaaaaaaaatacagtctacagtacaaaacagtgttttgggtgactatatgggtgaactgctagacaccgtctaactaaaaggaatagtgatgaacaactcaatgcagtccaaaaaacagatatgaatgtttggggacttgtgtcctctaatgcagttttgggattcacacaatatagtcacaattttgtattcctattttcttgccttcaaaatatgtttgccacttaccacccttcttctatatcaaaaacagtccagcctctatgccccccttcccatttgacattacgatttcttccattatggttattttagattaacaatatattgccattgtacagtaatgtatcgaacagcttgtagtcatacccaatttgttgctttggtcaaaggtggctccccagtaccagttggagtgaaatcatccaattcaggaagggtcaagggcaagtcatcttctgtaagaggaaccatttcattggtatcatcaaggtagctcacagggaaaggttcaccccaatagcgctgtctggcaaaaagccaatctcgaagcttgtagtttacctgatgtttggttctcctcaattaaattctgatgaaagcagtatgcataacattatatgatgaagcaggaagaaagcacctttttctttccaaaaccattattctctatccactcagtaactttcttagcagcatcttgggaaagcattccgttaatattcagtccagatgaagaactagatgaattaatcatgatgccatcatcttcatatgcctccactggatcacaattaccattcggtggacttacaaccttaatgattggaagttcatatttcacagcaaattcatggtcgcgagaatcatgtgcaggcactgccatgatagccccagtgccatagctgcttcgaggcagacagattagaatgcccaaccagtttggaatcaatagtagcaagcattttttaaaaaagaatctcagatgtttattaaatataaaggtaattccaatagcttgtttgtcaattttatgagtagcaacaatattctgccaggtgatcagatccctaactaggaagcaaaatttagttgatggtaaaaaaagaaccataaatccaaaattataatgtatgtatatggagaactgaattaagcaaactatagtaagacgcttgcctttaatattacataagagcatagaatattgcatagatgtaaaaaataggttctctaccaaactacaataaaaagtgtaaagtaattactaaatcgatgtagaaacttaggtactctagcaaactactctagagtttctagcatttggtctttcagaaataaaatgaacaaaacaatgataatgcacaacacaacatcagaatacacaaggaagtaaggaacatatgttgacaaaccttcctagaacataatctgccacccatattggaatgatttccccggttgctgggttcttagcataagaaccactgaaaaccccagttttttccttctgaagttcagtcctttctagttcactctttcttgctgaaagttctctgtattcctctacctgccacttctgattagtccatagtatacttcattttttatgatattaaggaaaaggaacatacatgtgctcgttgttcctcagatgttagagatgacagtaaaacatgctcaggtgccacaacaagatatctgcaggtcgactcgagagcatctttatattgtccatctgggtccataaactgtagtaatatgcaaaaagacaaaagaaaggagaaaccaagtacacacgttgcaccaaaaatcgtgtcaggcctcgttgtgtaaaccaataaagtggcacccaggtcatgtccttcctggtcaactgcagaaaaaataagctcagcaccttttgatctccctatccagtttctttgcatttccttgatactctcgggccaatcaagatcattcaaatcttcaagaagacgatcagcataagatgttatccttagcatccactggcgcattggctatacagcaggggagaaaatggatagtcacaatatgacttttctgcatataggtacttactacttagcaatgatgcattgaaacaaacaagttccgcagattctaaagcatacctttcgtataacaggatagccaccacgttcgctcacaccatctactacttcttcattcgccaggacagttccaagagcagggcaccaattgacaggtacctcagcctgattgtaagatatcaatgccagcctaaaaatcattgaaaaccaaaaatgcaacactaagaacataaaaacagaaccctaaagatgaacagtacaaaatagt

SEQ ID NO: 21314 - DNA, 2378 bp, Zea mays
aataagcccgctaaaaaactcatacctatgacggatataaaattttgaccaaacccatacccatcgggtttcgggtaccaaacgggtttcccatacccactaatgtcaacataaaaaataattcatcatgtaaatgacaatcaatacattaataaactagcataaaaggaacaaatgataactaattttagactaaaatttgttacataaagtttattttaattagaacatattcaattaataatattataagacatatttataaggaatgttgattttaaggcgggttttaaaaacacatgggtttgcggatatgagtaatggaagaataaatccatgcccacgtacgcgttggatttttatttgaacccattaacaaacttatgaatacagaaattgactcaaacttatactctaatagagaaaatctcaccagatttcgggtagcgggtaccccttgccatctctaagcgggacgaacgaaccccgaatcattattcagtacccaccccgatacccgatggcgctcgccacgctgctggcgcccctcacggcgggccgcttcggccgcgtgctggcgcttacgagcggcggcgcgccaactgcgtccgccgcgcaccgcgttctccacctcctcctccgcacctccccgccgcccccgctcccgcgcctcgtcgccatcgcgcgctggtctcgcgcccacttccgcgcgccgctcccgctccggctccacgcgctcctcctggcccgtctcgcctccgacggcagcctccactctctcctccgctccgagctccacgtcctcgccgcggggcgcctccactcgcccgcgtccatcctccgcgccctccccgcttcgtccggcccgctcgtcgccgacatgctcgtcctcgcgctcgcccgggcctcccagccgctggccgcgtacgaggcattcctcctcgccggcgccgactgcccgcgctaccgcccttcggccttctccgtgaacgccctgctcgccgccctcgtccgcgccgaccgggtcgacctcgccgaccgggcgttcagggcggcgctgcggcggcgcgtgtcgccggacttgttcacctttaacatcgtcatctccgggttctgcaagactgggcagctccgcaaggccggtgacgtcgccaagaacatcagtgcgtggggggtggcgccctcggtcgccacctacaacaccctcatcgacggttactgcaaacgcggacaagttggaaaaatgtaccatgtcgatgcgctgttgaaagagatgatccaagctggaatttctcctgacgtggtcacattcaatgtgctgattaatgggtattgtaaggagcccaacattacagctgcaatcaaggtcttccaggagatgagacagcaggggattcctgcgaatgtggtgacatacaattcacttgtttcagggctctgcagagaggggaaggtggaggacagcatcaagctggtggaagagatggaggagctggggttggcatgcatattgtctaccatgaacagtgtgctgaacgggttttgcaagaaaggcatgatggtggaagctgagggttgggttgatggcattgcacagaggggcatgaaacccaatgtgattacttacaataccttggtcgatggataccggcggcttggaaaaatgaaggaggcagcggcagccaaggacgctatggcagggaaggggattagtccaaatgttaaaacttataattgcttgataacagggtttaccactagtagggattggagaagtgtttcagggcttctcaatgagatgaaggagaaaggtgtgaaagcagatgttgtcacttataatgtgctcattggtgcgctgtgttgcaagggtgaggtccggaaagcagtaaagctcttggatgagatggtggaggttggtttggagccaaaacatatgacgtacaataccattataaatgggttctgtgagaagggggacgctcagggtgcccatgaaattaggcttaggatggagaaacgtaagaagcgggcaaatgtggtcacatacaatgtgtttctcaagtacttctgcaagatggggaagatggacgaggctaatgtggtactgaatgagatgttagagaaaggtctagttccaaataggatcacttatgaaataataaactcaggcatgatagaaaaaggttatgtgcctgatataagtggatatgctgcagatgtttctaaaaacttgacatcttcctgaaggatttgttcttgtaatgtgccaatatagctggtgacttgtgtgagagcttgattttattttgatggaatgtttgcttgctagtggtgggctgtgatgggatactgttggataggattgatttattttgcgc

SEQ ID NO: 21315 - DNA, 3812 bp, Zea mays
tttccattttgagcttgttatagaaaacaaactaatcgtatgagtggctatgtttggggagaaggtctcttgccaaagtccatgttaacaaaaaccattgtttaaatcgactttcaaaactcaagcatatggtaagagctttgaggcaaacgaagctagaagacatcattgaaggaaatgtgtttcaagaacatgtgaagctgccctaaaaaaagtaaatagaataaggaggttagaaagaagagaaagcatatacaaaatgcctctgttgtaaaaagatataattgtatctctcgtctcgaagacccattgtgtagtataaaggacattctcgtaacttcacgcaaaaatgtatactggtctaaccctataaatagggaaacaataccactagtagatttggcatttgtaatctagcgcatgtagcagcttctcccgatagagcatacaaaggtacatcggtggggtttgtatttatactaatgtgtatgatgttgaatattttcactgccatgtataaaaggatgtgtgatatgcatgtatctgctaagtaaaaaatcttgcttcgggtaataagaaataactttacacttgggctcatcaacgacccaccatgctaacgcttcgttgtaaagcttcatttatttttatgtgctcccaatgaaccattcaaagaggagaatgatatataactttgacattttgccctattaggtttctttcaagaatctcgataggtccccaacaattaaatcacccacactcctgaaacaaaaaaaactgacgacattttttaaaattttgttgtctttttctcactctgcggtaaagatagattaacaaagctcatacgtcgaccaccagtaatgcacaattgcggcagctagtcagctagagattaaataattagctatgcaacatcttcacatgcataggctaggaataaacgataaacaattgcggcagcaaatgaaaaggccaagacaggtcaccaggttgaatccggcaccgctaacagatcacaattttgagatccgagttgaggaagggagatgaaaacaaaaggaaaaaatttaggtgatcatactcaaactagtgacatggcaagttcaacatatttagaaaagtaatatattgagaactctttgaggagatgcttttttcttcttttattatttaaagacttaggtagtacaattatacataactaaggtactgtaaaggaccttaagccgccaccattatgcctgcaagagcatggccctctccccgtgccacatacaccccaacacctagctaggaaaataggatatagagaatggatgagacaaaagagataggcctcgtacctagatctggccccttctaccggctctggcacgggtttgggttggaatcattccaagcaaagacaatcagctcatcgtggggttcgaaccccggcatgggtctcaatccacaggaggcgaggtttcagactcgatccacatcgttccaaaccgggtgttcaatggctgaaccaacatgagctcaccattacattagatggctggaactgtgttccatgaaaggacattgttgatattgtgtttagtctcatatgtagtgcaaaccaaacataaaactatatgtacccatcgtccaatacacacaaccaacgaagaaataatacaacagtatcatgcggcctaaccaaaaaaccaattgtgcaatagcctatcccgcgttgcccctaatacgatgcaaatgcaaatcttgtacgagcacccaatgtcaggacatttaccacaactaggactgtgaccactcactactgcttgtagaataaataaactaaatcaggccaacaaaactcaagttttttttttttttttttttttttttttttttttttatctgcagcaattgagctaaaacagttgtctaaaccaagggtttggttgtcccgtactccaatgtacagacctaaaattacatgccaagaattaacgacagggttctaacaaaattgatgtcctatatctatggcgaaatgtcaaacaacatgcttctaacaaaacagatgtcctatacctgttggcaaaatggcaaacaacaggcttctaccaaaatagatgtccacccctcaccgcacgtgctgctagaaccacaaattttacagcattctcacagcaagggcatactcgtgcaagaactacaactgtggttctaaaccaactgcggacctaaatcaggaacgttacaacagaccaaccagtccacactacacgctgccacgcatgctcagtaggtgttctgcgggttgaatcgcctcctggcatcacgcttatagtacggtgtgtcatcaatggtcctcctcacgtactccatgaaaggctggggtgtacgaggagagaactgaccattagccggggatgcaggatcagccatggctgcgggatcggctgctggtgctcgtgctggtgtggatgctgtcatgctccctgatggtgcctgtctgataggtctctgcagcaacttaatgaaaagtgcaacagtgactattgtcacaatgatgcatgtgagcataacagcagttgtggttaggccccatgatgatggtgactctgcctcctctcctgtatcgtagctgacttcaacttcttcagtttgacctgtgcatgggtaatacgcaaatagtaacttccacagtattgcaattacctctgggatattaaacgaattatatactgcatatgatgaatgatttggattttgatgaaccaaacaagagatattaactgtaggtgatcagcttactacaagtattaaacaaagcagattaaatagcataccagtggcaggaagaacgatagtaaccttgtcagagaacgatagcctttttagcgcttcaacctacaaaagtaaagtcccaggttgccagcattaaatattgataaaaaagaaatgaaaccaaagaaaatgctgcattgtcagttgtgactcacccggtaaacaactcgactaagaacaccattgttctcatttgtgtcaacacgactgactctgagtaaatctttagcattccagaacaactcaatatctagaacagcataaacaataacttgactatcagttaaagcacaagcctaatacaagggtccaagttcacacaaacaattatctttctcataccagtatttccatcgatagtaatgacactatgattgcaacttggagtcagatttaactgcatgagtagacactttgtagttagagtgaataaaaaggcttcatgcaatgagcaacgagcaagggagagggagaaggcacctactttcccaggttcttttatgtaaaaccctttgacaaaaagagcatgtgcagatccggtcacctttgggtcttcctttagatttgcacgaactaaaatgtgtaaagttccttcattagggtccaacttcacgggcaacagttgtgcaggtgaatatggatgaaacaggcagtaggatttctttgtggcatgctcagtccatggctcaacaaacctaaaggaaacaacaaaatgagatttcaacttaattattcaggagttaagagcatctccagcatttcccaatacctccctctatccccataaaactgtctggggacaactatgcttttttcttactcagcagttccccaatgcctctccttttttgtggtcaccaatatttccctcatctcccctcaagtaaaggggcagctgtatctcccccaaataccatggggcccaccccaactatcacttttcagccatctttcctcttacactcctgcaggcatgcaag

SEQ ID NO: 21316 - DNA, 2002 bp, Zea mays
ccgcccgcccccaatcctccgcactctgtaaccccgcccgcgatggaggccgcaaccgccgccacggcggcgatgatgtggttccggaagggcctgcgcgtgcacgacaacccggcgctggacgcggcccgccgacacggggccggcgctgcatccgcgcggctgtacccggtgttcgtgctcgatccgcgctaccttcgcccggatgccgtcgcggcgtccccaggttccgcgcgcgccggggtcgcccgcatccgcttcctcctcgagagcctcagcgacctcgacgctcgtctccgccgcctagggtcccgcctcctcctcctgcgcgcccgcgacgacgtcgccgacgctgtctgcgcggccctaaaggactggaacattggcaagctgtgcttcgagtccgataccgagccgtacgcgctggcccgcgataagaaggtcacggattttgcattggcgtccggcatcgaggtgctcacgcccgtcagccacaccctcttcgacccagaagaaattataaagaagaacggtggtcggccgcctttgacatatcaatcctttgtctccattgctggggagccgccagctcccgccatggaggaatactccgagctcccaccgctaggagacacaggggaatacgagctgttgccggtgcctacggtggaggagcttgggtacggcgatatcagccaggaggagattccaccattccatggcggagagacagaagctctgaggagaatgaaagaatcgcttcaaaataaggaatgggttgccaaatttgagaaaccaaagggtgacccctctgcctttgtgaaaccttcaacaactgttttgtcaccatatctaaagtttgggtgcctgtcttccagatatttttaccactgcattcaggatgtgcacaggagcgtcagaaaccatacaaaaccacctgtttcattgacaggacagttgctgtggcgagacttcttttacacagtgtcttatggaacacctaattttgatcgaatgaaagggaacaaaatatgcaagcagattccgtggagcgagaacgaagatctatttgttgcatggagagatggccagacaggatatccgtggatcgatgctatcatgattcagctgaggaactggggttggatgcatcacctcgcacgccattctgttgcttgtttcttgactcgcggtgatatgtttatccactgggaaaaaggacgtgatgtgtttgaaaggctactgatagattctgactgggccattaacaacggcaactggctgtggctctcttgctcatccttcttctaccagtaccacagaatttactcccctattacattcgggaagaagtatgatcctaacgggaactacattaggcatttcatcccagtgctgaaagacatgccaagggagtacatttacgagccttggactgctcccactagcatccagaagaaagccaattgtattattggcaaagactacccaaaaccagtggttgatcatgagactgcaagcaaagagtgtagaaagaggatgggagaagcttatgcgtcgagtcgcgttgatgccaaacctagcaaagggaagacgttgaactcacgccgaaaaatgctacatggtgaccgagacacgtctaactcaaccattgctaagcgactgaagaggaatagccgagctgagtgatgcgcagctcctcccgtgacaactttacactacttgttccatcttcagcattttttttattttcagttgtgttacctgcatctgtcatatgtagctcgtctgacattttaccaaagtagtctgaccgtaaggaaatgacttgagcccgtagctagtgtgatatcctacactgaaggatatatctgtaatatatgctcatgtaataacaggtgtaataataataactgctgcccatgtactctaggtcttatttggaaggtgtgtgcagcaaatgaacagttcaagtcaatccattaaagcaggtggtttggat

SEQ ID NO: 21317 - DNA, 3060 bp, Zea mays
ccttgcagcaactcgcgttggaggttgccgtgatgcagccatgggcgatgtcgtattcattggatgtgtacaacaacacgtcgatagcagatgaatagtgattctctagatgcatcggttttaacataaactctaaattttagcgcattctatagcgttctttgtatgatgtcctctaaatttaacgtacatattaatttagcgggttttgttggagatagcttaaggttgcaaattagtgctagtggcgaatttatggagcaaagcccgcaaaaaatgctacgcggacggacaacacttggcggcggacatacacactgtccggcttttcgcaggtctactgttgctggcggctgcactgattatcgcgaacactagtggctagctttcccagtcccaaggcttttttccggcgatgcccaccccacccaacaggcagagccctcgtgcaggcaggcactcgatggctgctgctgaaagcttgcaatatttaaccggcgtagcactagcagtggcaaccacgaccacgatcgccgacgaccaaacctacctagtactagcggctactggctactgctacgcctacgcctcagggttctctatgctcagctctcccgcgcgggcgcgcacgaaaatggagcagatcgactagtaaaaagccgcgcgcctttcgctgtcgcaggaagatgctctggtgtcccatttgctttgtccctgtctgaacagtggacagtcgggggaacaggaacaccatgggcacgcatggcgctcggaccgtggagtggatagagagtggccattgcccgttgtcgattgcattgctactactcatccatccatttggtacggttctgttacacgcgcacgagctgacgagcacatacacacacacacacaccgcctgtcgacgacgagagcgcgactgagatcacatgacggagcaggcgttgacgtcgtcgtcgttgaacatgttgctgacggggtcggcgccgcggtggggctcgtggagctgtccgtgcttgtcgccgttgtagccgtggcggtagtagttgtaggtgcggcggtacgactcctcgtcgtggaagtagtccttggcgcaggtgaagtgcatcggcaggtccgggttgggccagaactccgccttcttccccgcgcgccggacctccttgagcacccggtggcggtccacgtaccccgtcaccgtcaccttctccatctccacgtccacctccacggagtccaccccgcgcagcctcgtcaccgcgtgcttcaccacgcgctcgcagcccgagcagcacatgcgcaccttcagctccaccgtctgacgaccaaagagcatgggtagggtgcagaggagaggagtcatcagtcatacatgtatgagaaaaaggctcttcgttctctgtccctctttatttattttttttcttttctatccctttctcgctttcttttcaggaagcatgctctgcatgcagaggtcgtcgctgttctcaacaggagcgccagcgcccgcatccgccaacggtcaccgtatgcgccaagaattcgaacaagaagaataaaaatggtggcggacacagaagaaatatgtgcatgtcacgtcgcactcgcgtagccaagtcgccgtgctcgcatgcgtgtctactacctaccctgccgcccgacgaaagaacagggcaccgcaaagcagacagacgacagaaagaagcagaggcagaggcaacggacgacgcgcacctgcagcgacagcggcctgctgctccggcccatggccctgcgcccggcgaaggtgccctcgtggtagtgcagggtgctggcgctcgtcgggtggctgctgtagtagtaggcgccgccgcggtggtggccggcggatgacgggtagaagcagcagagcaggaagttggtcagcgacgacgacaccgacgacatggctggctggctggctacttatacggcggctaacctctcccgcgcgcctgggaaggaaggaagctagctgcccctctctgcgggttcacccacccttggttgccccgccgcgccgtgcacacgcctgcctgggctttctttgcttgcgttgcgaggtcgggatggatggcgttggacgctggaggagtcgagtgccctctcgcctctgcccactgccgctgcttttattctctcgccgccgctgctgccgcgccctactctttttattctttttccgccctcgtattggtgcttgaattctgggagggaaaagagggggccctggtctgctcacctagcttgccggtccgccggccggtacacatgttctgccacgtctgccgtggactactagtgctaccgagcactagtagttgctaatcatcatcgtctgttgatgttcatagggattttgaaacgccgaaagctagactaccgccagctattatgtttaggatgtccagaaaagtatctaaaaaataaatgaaaaacaagggtattcaaactgtggttgataagttaaggagacagtacttacaccactaaactaactactcttctctaatcttagagtgtgtcgtggtctatatgggctatccactgagtctgtccctgtaggctaagagaaagattacgcgagacgtgtgtttgttgttttgctgctggcaaagacatgcaataaaaaatttatcgaatataatatggccaaataaaaaggtcgtacaaccatctaacattttagaaataaaaagtataaaatgttagaatataacataagtaaattgttcacctcttactataaggttaagattttgggttaagctggttggtgcattcaacttaatatggtatcagagggacacaagtcgaattctggttagcacaattaaataaaataattggtgttcgctcctatattccacgtcagagacctaaaagaggctcgacatgagcgggagtgttagaatataatataagtgaattgtccacctcctcccatcaacttaagatttaggttgaactggttggtgcatgcaacttaatataaaagtcatgacatcttaaaaataaaaggtattaaaaatagca

SEQ ID NO: 21318 - DNA, 973 bp, Zea mays
tttttttttttttttttatgcccgttgtcgattgcattgctactactcatccatccatttggtacggttctgttacacgcgcacgagctgacgagcgcacgcacacacacacacacaccgcctgtcgacgacgagagcgcgactgagatcacatgacggagcaggcgttgacgtcgtcgtcgttgaacatgttgctgacggggtcggcgccgcggtggggctcgtggagctgtccgtgcttgtcgccgttgtagccgtggcggtagtagttgtaggtgcggcggtacgactcctcgtcgtggaagtagtccttggcgcaggtgaagtgcatcggcaggtccgggttgggccagaactccgccttcttccccgcgcgccggacctccttgagcacccggtggcggtccacgtaccccgtcaccgtcaccttctccatctccacgtccacctccacggagtccaccccgcgcagcctcgtcaccgcgtgcttcaccacgcgctcgcagcccgagcagcacatgcgcaccttcagctccaccgtctgcagcgacagcggcctgctgctccggcccatggccctgcgcccggcgaaggtgccctcgtggtagtgcagggtgctggcgctcgtcgggtggctgctgtagtagtaggcgccgccgcggtggtggccggcggatgacgggtagaagcagcagagcaggaagttggacagcgacgacgacaccgacgacatggctggctggctgtctacttatacggcggctaacctctcccgcgcgcctgggaaggaaggaagctagctgcccctctctgcgggttcacccacccttggttgccccgccgcgccgtgcacacgcctgcctgggctttctttgcttgcgttgcgaggtcggggatggatggcgttggacgctggaggagtcgagtgccctctcgcctctgcccactgccgctgcttttttcctctcgcccc

SEQ ID NO: 21319 - DNA, 1582 bp, Zea mays
aataaatttttttttttttttttactcaacgaaaacaataccgctctccatgaaaaattctcaacaactgtatttccccctaatggcctcctctggtaagcctttagagaagttcccgtggatccaatcaaataattatttggttacccttcactttctagcgggagtagtggtgcagaacttaacaccacaagattatgttgttacataaactctgctgctttgcagagcagaccaacaagtctcaagccactataaaaggcatacgaggtcagacatactgaaccccatcaccctcaatcacctctccaatgcgataagcaggattggatccatgggtgtcttcaataattctgtctgctgactctcgacttaccacaagaaccattccaatgcccatattgaatgttcgccgcatctctgcgtcatcaatgtttccagcctgttgaaggcaactgaagattggaggtatttcccatgacccagtaaaaatttttgccccgcatccggaggggaatactcttgggatattgtcagtaaagccaccaccagtgatgtgggctagtcctttcacaccacctttgctaataatctcaagcacctgcttaacatagatgaaggttggtgccattagagcttcaccaaccgtagttgttatgccatcatttcttgggagctgatcatccaaagaaagtccacttttctccagtactcttctaacaagagagaacccgttagaatgaacaccactggaaggaagacctataagtacatctcccttaacaatgctttttccatcaatgactttattcttcttcacaacacccacagcaaaaccacttagatcatattcaccctctgcatagaaaccaggcatttctgctgtctcccctcctaggagagcacaatctgattgttcgcacccatccctaatccccttgataaccttctctgcaagatcaacatcaagcttgctcgttgcatagtaatctaggaagaacaatggttttgcacctagagttacaatgtcattgacgctcattgccaccaggtcaatgccgattgtatcatgaataccagtttcgaaagcaagcttcagctttgtccccaccccatcggtgctagcaacaagataatcgtcattgtagggaaagagaccgccgaagccgccaatcccgggtgccatcctggcgatgcggcgcacgagctcggcgccggcgtctatgtccacgcctgcatccttatatgttagtcccccctgcccgccagagctagtgctcgagcaggacacggacgcgcggcgaatccccgcagcaccctgccagacgtcgacgcgctgcgtccgtggacgaccccaacaagccgcgcgggtggtggcggcggcagccggagagcctgtcggcgctcggagaaggtggaggagacggtcagttgccatgggtatgggaggggatgcttgtcgagaggaggcggtggagatggtggcgagtggcgacggcgccgaaagcggatgcctcctctctaggcgcgaggggaggtgtcgtgagggtatacgagcccggccggcctcgaggtacccaat

SEQ ID NO: 21320 - DNA, 1549 bp, Zea mays
  misc_feature (1414)..(1414): n is a, c, g, or t
ttttttttttttttttttttttttttttagcatggaacatacaaattctttgaatgcaattagctggaactacaatctttgccccgtttatattttgatacccttgcactgtgctagcttacaacttttgctacaataatatggccactagcttaggcaacgctgaagaaatttaatggtacctatttcaggcttggttgttagacgctcataagtgtttctggagcatgtctctgaaccagtaggctgacgccttggggtgtcgttcgagcttgggcgtgctgaagtcgacgtagacgattccaaacttggacgtgtaacctgactgccactcgaagttgtcgaggagagaccaagcgaagtagccagccacgtcggcgccgtcatcgatggctttcctcagctcagcgaggtagcctttgtagaattgcacccttgtggtgtcgtgcaggtactggccacgagtcaagtttcctggctgatccattccgttctcggttatgaaaactgttggatttccatacttgtgcttcagatagttcacacaaccgtacatcccttctgggacgatgtaaagccactttgaattcgcctgtggtccgatcggtttgccgttccgttctaaaacatattgaacctgccaatcagctgagtagctagtaggcttctgctggagcagtttctggcccttcacgtagctagcggtgtattgattgatcccaatgtaatccgctgagcccttgaccaacttagcttgctccggagtaaacttgggcagcctctctttcacaatatcttgcattatctgtggataatgtccatttattaatggatcagcaaaccaaccaacatggaaatcccttgctctttgagccgctgcttggtcttcggttgagtttgtgagagcttcataccaattgaagtccagaactattccaacctttcctttctgagcagcctgatacttgttacggtatcttgacacagcagcagcatgtgacaagagaaaattatgagcaacgatataaggttccgttgctgaattcccaccagcagagcatttggtacacctttgaggaggaatcgacccagcgtcataaccaagtagtgctactatcctcggctcattgaatgtaaaccaatgctttacacggtcgccaaaagtcttaaaacagaagtcggcatagtctgtgaacagtttcgccatcttggcatttaaccaccctccatacttgttctgaagcgcaagagggagatcggaatggtaaagattggcgtacggtgtaatgcctttccgaagcaggtagtttatcagattgttgtaataggcaacaccttctggattgactcttccctcgccatctgggaagatcctggaccatgagatgggaaaccggtaggcatcaaaattcanaacttttcatgaggtcgacatcttcctgaaaatgttgcatgacaaaaggaccaagtacaagtctaacagactttcttttcctccaaaagtttttcaccagcataaaacctagatagtatggactctagcattgtc

SEQ ID NO: 21321 - DNA, 1229 bp, Zea mays
ccgggccccccctcgagttttttttttttttttttttttttttttttttttttttttttttttatccaacctaatgaacctctcactgcccaaagtcggttagtaacaccatgtcaggttctatacaaaaaaaaaatcaatagaaagccttgacatgattcattgagcacaagcgtaagctaaactatctggagacccctcggtcaaaagtaaaaaagaatcggtgcgctacacgaactactaaatgactgcctcatatgcccccatattacaggatacaagcacatatgcgctacacgaactacatttcgaatatctcaaactgtgagtgtaactgccatggtatggtatggaacctgagtgaaaatgcaaggccgccatgctggtgacacgtgcaaaattgattcaaaacatatatacctgcggacctgccatggcatggaacctgagtgaagatgcaagaccacggtgagtgcttcctcaaagaatatggccatcagggcgaccaacttctgagcatgccatttagtgagggctcccgtttgtgtagaaaccatccgggttatgtgcctccatctcagcaagcatcacggattttgccctctggtacctattccttttcgctgatattgctgatatggaggtcaaatcttgagggaagtcaaaatcatagtcatatggcccccttctgatgcacagtatgtagaccactataagtatgacgagcagaacaaacccaaacgatgctccaagtgcaattttgccagttttgttcaaccctcctttctcccagaataatgcacaagcaggtaaggtaggcacgccacacaaacctttattacctgagaggtctatcacgccaccatgcacgccaattgagtaaagtctttctggaacttgcccatcgagttgattgttgtttagtaatgcagtctgtaacttggatgaacctatggttccaggaatgcttccagtaaactcatttgatgaaatatccagtgacacaagtgaaggttgacctaaaccaggtggtaagcttccagtcagtgaattatagctcaaattcaagcttaccaagtctttaagatgacttatttcatcggtgatgtaaccttttagtccttgactcgccagatccagttgtgttatcacaagccctttgtcaccgcgatggcaagtaactccctcccatgcatcccatgccctcggtgcacaagggtcaccattcc

SEQ ID NO: 21322 - DNA, 3795 bp, Zea mays
  misc_feature (40)..(40): n is a, c, g, or t
gctgttatcatctctaccataactggtgatttgatcaaanagcagctttctaattttcaggccgtggtttttactgatatgagcatagaaaagcccgcgcggccggatgattactgccatagccaccagccgccaattgctttcattaagtcggaagtttgtggcctttttggcagtgttttctgtgattttggtcctgcgtttactgttttggatgtcgatggtgaggagccacatacaggaattgtggcatcaatcagcaatgacaacccagcacttgtttcttgtgtggatgatgagcgtctggagttccaggatggtgatctagttgttttctctgaagtgcatggaatgaccgaacttaatgatggaaaaccaagaaagattaagaatgcaagaccttattcttttactctagaagaagacaccacctcatatggcacttatattagaggtggtattgtcactcaggtgaagccaccgaaggttcttaaattcaaaaccttgaaggaggcaatcaaggagccaggagaatttctcatgagtgatttctccaagttcgaccgcccacctcttttgcatttggccttccaagctttggacaagtttaggactgaattgacacgattccctattgctgggtcagctgatgatgcacagaagctgatagatcttgctattggtattaatgaaactctgggtgagagtaagcttgaagaaattgacaagaagctcttgcagcatttcgcaagtggttccagggctgttttgaatcctatgtctgcaatgtttggtggtattgtaggtcaggaggttgttaaagcatgctcagggaaattccatccactttaccagttcttctacttcgattctgtggaatctctgccagttgaaccgttggagcctagtgatctgaagccagagaacagtagatatgatgcacaaattagtgtctttggggctcagcttcaaaagaaactggagcagtcaaaaatcttcatggttggttctggggctcttggatgtgaattcttgaagaaccttgcgttaatgggtatttcttgcagtcaaaacgggaagctgactgtgacagatgatgatgttatagagaaaagcaatctcagtcgccagtttctcttccgtgactggaacattggacagcccaagtccacagttgctgcaactgctgctatgacaattaatcccgagcttcatgtggaggcccttcagaacagagcaagccctgatactgaaaatgtgtttaatgatgccttttgggagagcttagatgctgttgttaatgcattggacaatgtcacggcaaggatgtacattgactccagatgtgtatatttccagaagccacttcttgaatcaggtactctgggtgccaagtgcaacacacagatggtcattcctcacctaacagagaactatggggcatccagagatccaccagaaaagcaggcacctatgtgcactgtacattcgtttcctcacaacattgatcactgcctgacatgggctagatctgagtttgaaggtctacttgagaagactcccactgaagtaaacgctttcctgtcgaaccctggtggatatgcaacggcagcaagaactgctggtgatgcacaggctagggaccaacttgagcgagttattgaatgccttgagacagacaagtgtgagacattccaagattgcattacctgggcccggctgaagtttgaggattatttctccaaccgtgtaaagcagctgacattcacttttcctgaagatgcaatgactagctctggtgctcctttctggtccgctcctaagcggttcccgcgacctctggagttctcatcttctgactcaagtcatcttagcttcttgttggctgcttctatattaagggcagaaacatttggaatacccatacctgattgggcgaaaaacccaaagaaactagctgaagctgtggacaaggtcattgttccggatttccatccaaagcagggtgttaagatagagatagatgagaaggctactagcctatcctctgcatctgttgatgatgctgctgtcattgaagagcttattgcaaagctggaagcaatttctaaaacattgccaccaggattccatatgaaccctatacagtttgagaaggatgatgataccaatttccacatggacttgatcgctggctttgccaacatgcgggctaggaattacagcattcctgaagttgacaaattgaaggcaaagttcatagctggaagaatcatcccagccatcgccacctcaactgcaatggccaccggccttgtctgcctggagctttacaaagtccttgctggtgggcacaaggttgaagactaccggaacacatttgcgaacctggcgatccccctcttctccatggcggagcctgtgccacccaagaccatcaagcaccaagacatgtcctggaccgtgtgggaccgctggacggtaactggcaacatgacgctgagggagctcctggagtggctgaaggagaagggcttgaatgcgtacagcatatcatgcgggacctcgatgctgtacaactccatgttcccgagacacaaggagcggctggacaagaaggtggttgatgtggccagggaggtggccaagttggaggtgccttcctaccgccgccatctggacgttgttgtggcctgtgaggacgacgacgacaatgacgtcgacatcccgctcgtgtcaatttacttccggtaaagagggacacactgcccgtttatatacatgaatcttgtgcgatgtttgtcagaaggatcgtgtctataagttgcgcatgcaacctccaggactaggctttgcttaaacgcatgctgatggatttcccgagctgggtagagctggctgggaatcgtcgctgagatttgggttcaccgttatggaattcttggaatgacagttactgcaaggcactgttgctgccaagtgttgttgtctttgtacttgggatcttcgatgcgtgcatgtgccggtgttatgcttgcgattttttcagtgatgtacatgtgccgtgctctctttagatttcggtgactacagaaatgttagaggggttgggttgcacttgcacgagggtgctcgtgcatcgatctttatgtgtggacggcaatggatatgatggtgagtgatgactacgggttgggtggtcgtactggctgcctgtagctgtagcacgtttgggttgtctgccgtggacaagcacaagctgagctgtcgttcgatgcacatgcgattgtttctaaactactaccaaaaactttgatatgtaatgggtgcaacagtgtttggccagataaagccatgactactacataggaggacctgaagcctgaaggtgaacattaaaataaaatgtcaggaacacaaaaaaaattggtaaaaaataaaaaagccatgtctactaactacataggaggacctgaagcatgaaggtaaacattaaaataaaatgttaggaacaaaaacaaaaaaatggtaaaaagtaaaatatcaccaggggtgttgcgagaatcgaactcgcgacctctcgcacccgaagcgagaatcatgccactagaccaaacacccaagtctggtttgtttggatccgtaccatgctaaatgataaatgacccgaatcatgtaactttcacgccactgctgctagtctaaacacctgtttaaaacatctaaacattgcgcacgtagttggctattcaatccgttaaaacatgtaccagtccattagctacgcagtgtggt

SEQ ID NO: 21323 - DNA, 854 bp, Zea mays
  misc_feature (10)..(10): n is a, c, g, or t
ccggtccggnccccccgcgcccccgtcgtcctcgaaaccctaggccagaccacagctgaagccgagcggagttctgctcgccgcccatcgaatccagcttctccaagtccaaggcaccgccgcgacccccatcgtccgcacgacctggatctgacgcgcctccccctgccgccgccgccctccgcctcgtaccttctcgcggcgaccgccgtgctcggactcctcggcggccttctactctacatgcttccccggaagcggggggtcgacgccggcgaggtccaggacttgcacaacaaggccccccgcaccgccgccaccgtcccagtccaggacaaggacaagcaccaggaggaggttgcggaaatggccggcagggcgcccgagatcgatgaggacctccacagccgccagctcgccgtctacgggcgcgagactatgaagcgccttttcggctctaacgtcctcgtctctggactccagggactaggcgctgagatcgcaaaaaaccttgtcctcgcgggtgtcaagtctgtaaccttgcatgatgatggcaaagtcgagctatgggacttgtcaagcaatttcttcctctcagagaaggatattgggcaaaaccgtgctcaagcttgtgttccaaagctacaggagcttaacaatgctgtcatcatctctaccataactggtgatttaaccaaggagcagctttctaactttcaggctgtggtcttcactgatatcagcatagaaaaagcagttgagtttgatgattactgtcatagccaccagccaccaattgctttcattaagtcagaagtttgtgggcctttttggcagtgttttctgtgattttg

SEQ ID NO: 21324 - DNA, 3048 bp, Zea mays
  misc_feature (445)..(445): n is a, c, g, or t
ggaacaactttctaactcggacgcgtgggctttactgatatcagcatagaaaaagcagttgagtatgatgaatactgtcatagccaccagccgccaattgctttcattaagtccgaagtttgtggcctttttggcagtgttttctgtgactttggtcctgagttcactgttttggatgtcgatggcgaggaaccacatacaggaattgtggcatcaatcagcaacgacaatccagcacttgtttcttgtgtggatgatgaacgtctggagttccaggatggtgatctagttgttttctccgaagtgcatggaatgaccgaactcaatgatggaaaaccaagaaagattaagaatgcaaggccttattcttttactctagaagaagacaccacctcatatggcacttactttagaggtggtattgtcacacaggtgaagccaccanaaggttcttaaattcaaaaccttgaaggatgcaatcaaggagccaggagaacttctcatgagtgagggctccaagtttgaccggccacctcttctacgtttggccttccaagctttggacaagtttaggtctgagttggcacgatttcctattgctgggtcagatgatgatgcacagaagctgatagatcttgctattagtattaacgaaactcttggtgatagtaagcttgaagaaattgacaagaagctcctgcagcatttcgccagtggttccagggctgttttgaatcctatggctgcaatgtttggcggtattgtaggtcaggaggttgttaaagcatgctcagggaaattccatccactttaccagttcttctacttcgattctgtcgaatctctgccagttgaaccgttggagcctagtgatttgaagccagagaacagtagacatgatgcacaaattagtgtctttggggctcagcttcaaaagaaactggagcagtcaaaaatcttcatggttggttctggggctcttggatgtgaatttttgaagaaccttgcgttaatgggtatttcttgcagtcaaaatgggaagctgactgtgacagatgatgatgttatagagaaaagcaatctcagtcgccagtttctcttccgtgactggaacattggacagcccaagtccacagttgctgcaactgccgctatggcaattaatcccgagcttcatgtggaggcccttcagaacagagcaagtcctgagactgaaaatgtgtttaatgatgccttttgggagagcttggatgctgttgttaatgcattggacaatgtcactgcaagaatgtacattgactctagatgtgtatatttccagaagccacttcttgaatcaggtactctgggtgccaagtgcaacacacagatggtcattcctcacctaacagaaaactatggggcatccagagatccaccagaaaagcaggcacctatgtgcactgtacattcatttcctcacaatattgatcactgcctgacttgggccagatctgagttcgagggtctacttgagaagactcccactgaagtaaatgcttttctgtcgaaccctggtggatatgcaaccgcagcaagaactgctggtgatgcacaggctagagaccaacttgagcgagttattgaatgccttgagacagacaagtgtgagacattccaagattgtattacctgggcccggttgaagtttgaggattatttctccaaccgtgtaaagcagctgacattcacttttcctgaagacgcaatgactagctctggtgctcctttctggtctgctcctaagcggttcccgcgaccactggagttctcatcttctgactcaagtcaccttaacttcttgttggctgcttctatattaagggcagagacatttggaatacccatacctggttgggcgaaaaacccaaagaaactagctgaagctgtggacaaggtcattgttccggatttccatccaaaagagggtgttaagatagagacagatgagaaggctactagcctatcctctgcgtctgttgatgatgctgccgtcattgaagagcttattgcaaagctgcaagcaatttctaaaacattgtcaccaggattccgtatgaaccctatacagtttgagaaggatgatgataccaatttccatatggacttgattgctggttttgctaacatgcgggccaggaactacagcatccctgaagttgacaagttgaaggcgaagttcatagcgggaagaatcatcccggccatcgccacctcaactgcgatggccaccggccttgtctgcctggagctttacaaggtccttgctggtgggcacaaggttgaagactaccggaacacatttgcgaacctcgcaatccccctcttctccatggcggagcctgtgccgcccaagaccatgaagcaccaagacatgtcctggaccgtgtgggaccggtggaccgtaactggcaacatgacgctgagggagctcctggagtggctgaaggagaaggggttgaacgcgtacagcatatcctgcgggacctcgctgctgtacaactccatgttcccgagacacaaggagcggctggacaagaaggtggtggatgtggccagggaggtggccaaggtggaggtgccttcctaccgccgccatctggacgttgtggtggcctgtgaggatgacgatgacaatgacgtcgacatcccgcttgtgtctatttacttccggtaaagaggagggtgtcgctacctgtttacatgaaacctgtctgtgcgacgtttgtcagaaggatcgagtctataagttgcgcatgcaaccgagaactaggctgtgttcaatggaaacacatacttggttgtgttcaatgtaaacacatattgatgagtctataagttggctgggaatcgtcgccgagatttgggttcaccgttatggaattcttggagcatataaaacatcgtgatagttattgcatgtcaatgtcactgctagatgttgttgtcctcatgcatgtatcggtgtgacttattgtgcttgggtgcatttgcttcaatgcatgtccg

SEQ ID NO: 21325 - DNA, 2358 bp, Zea mays
gcacgagaagaagctcctgcagcatttcgccagtggttccagggctgttttgaatcctatggctgcaatgtttggcggtattgtaggtcaggaggttgttaaagcatgctcagggaaattccatccactttaccagttcttctactttgattctgtcgaatctctgccagttgaaccgttggagcctagtgatttgaagccagagaacagtagacatgatgcacaaattagtgtctttggggctcagcttcaaaagaaactggagcagtcaaaaatcttcatggttggttctggggctcttggatgtgaattcttgaagaaccttgcgttaatgggtatttcttgcagtcaaaatgggaagctgactgtgacagatgatgatgttatagagaaaagcaatctcagtcgccagtttctctttcgtgactggaacatcggacagcccaagtccacagttgctgcaactgctgctatggcaattaatcctaagcttcatgtggaggcccttcagaatagagcaagtcctgagactgaaaatgtgtttaatgatgccttttgggagagtttggatgttgtcgttaatgcattggacaatgtcactgcaagaatgtacattgattccagatgtgtatattttcagaaaccacttcttgaatcgggtactcttggtgccaagtgcaacacacagatggtcattcctcacctaacagaaaactatggggcatccagggatccaccagaaaagcaggcacctatgtgcactgtacattcatttcctcacaatattgatcactgccttacgtgggccaggtctgagtttgagggtctacttgagaagactcccactgaagtaaatgctttcctgtcgaaccctggtggatatgcaaccgcagcaagaactgctggtgatgcacaggctagggatcaacttgagcgagttattgaatgccttgagacagacaagtgtgagacattccaagattgtattacctgggcccggcttaagtttgaggattatttctccaaccgtgtaaagcagctgacattcactttccccgaagatgcaatgactagctcgggtgctcctttctggtctgctcctaagcggttcccgcgacctctggagttctcgtcttccgactcaagtcaccttaacttcttgttggctgcatccgtattaagggcagagacatttggaatacccatacctgattgggctaagaacccaaagaaactggctgaagctgtggacaaggtcattgttccggatttccaaccaaaacagggtgttaagatagagacagacgagaaggctactagcctatcctctgcgtctgttgatgatgctgctgtcattgaagagcttattgcaaagctggaagcaatttttaaaacattgccaccaagattccatatgaaccctatacagtttgagaaggatgatgataccaatttccatatggacttgatcgctggttttgccaacatgcgggctaggaactacagcatccctgaagttgacaagttgaaggcgaagttcatagcgggaagaatcatcccagccatcgccacctcaactgcaatggccactggccttgtctgcctggagctttacaaagtcctcgctggtgggcacaaggtcgaagactaccggaacacatttgcaaacctggcaatccccctcttctccatggcggaacctgtgccacccaagaccattaagcaccaagacatgtcgtggactgtctgggaccgctggaccataaccggcaacatcacgctgagggggctcctggggtggctcaaggagaagggcttgaacgcctacagcatatcctgtgggacctcgctgctgtacaactccatgttccccaggcacaaggaccggctggacaagaaggtggtggatgtggccagggaggtggccaaggtggaggtgccatcataccgccgccatctggacgttgtggtggcctgtgaggatgacgacgacaatgatgtcgacgtcccacttgtgtccatttactttcggtaaagaggggctcacggcccgtttacatgttgatcctgtgcgatatttgtcaatgtttgtctcagaaggatcaagtgtataatttgcgatagcaaccgtgaactagattgtgtttaagcacatactgatgatttcctgtgctgccatctggttagacttggctgggaattgtcgctgagatttggaccactgttatggaattcttaagcataacattatgatagctgttgcatgatactgtcgtcgctaaaaaaaaaaaaaaaaaaaaatcaaggcgggtactgctgtgactcgtattctggttgcgatttcagagatgtactcag

SEQ ID NO: 21326 - DNA, 725 bp, Zea mays
aattcggcacgaggcgaatccaggctcctccaaggtgatctctctcgatcgcttccggcctcaccgtagcccgatccacgcaggctcggccacgacccgcggcctccgcacgacctggatctgacgcgcctccccctgcccccgccctccgcctcgtacttcctcgctgcggccgccgtgctcgcgctactcggcggactcctactctatatgcttccccggaagcggggggtcgacgccggcgaggaccaggacttgcacaacaaggcccttcgcgccgccgcagttgctcaggacaaggagaaggtggttgcggagatgggcggcagggcgccagagatcgatgaggacctccacagccgccagctcgccgtctacgggcgcgagaccatgaagcgcctcttcggctccgacgtcctcgtctccggactgcagggactaggcgctgagatcgcaaaaaaccttgtccttgcgggtgtcaagtccgtaaccttgcatgatgatggcaaagttgagctatgggacttgtcaagcaactttttcctctcagagaaggatgttgggcaaaatcgcgctctagcttgtgttccaaagctacaagagcttaacaatgctgttatcatctctaccataactggtgatttgatcaaagagcagctttctaattttcagcgccggggtttttactgatatcagcatagaaaaggcagttgagtttgatgatt

SEQ ID NO: 21327 - DNA, 925 bp, Zea mays
cccccggctgcagggatttttatttttcacaggaattgatcacatgaacaatctcagagcgctatgtgcgtcctgatactgtaattgtcagctgttaatcaggtggcccagggccacgaatgcatctttggcaaggcatttacaagagctgtcgtgtaaaaaaaatcttaaagctgttgcagaacggcagcttagttgcaggccatgataatcaacactgactacggccatggccgagtcataagaactgcttcaagaattcagtggccactagccggccacgagtgtttactgacagcttcagctcactgatctccttgtcaatatcctccataaattgcacgatgaaatctatgagcttgtgcttatgcatgtcctcacaatggtagtttgttatcaggaaactgatatcatagccctgaaccggttttctcctcaacacttggaatgcctctgccctcattgacaaaaacctaaggaacttcttggcaagaatgttctccaattcatctgcctgcttaaccttcatgcttatacgtatggagttgattgaagtctctatcaagcatttttctgcttcgttgcggcatatcagtaccggattcagcagaagttcagggcttgtcttgagctccacctccggtttgttgtgcctctcgacttcttggcaagggaaattctggaggcacatcgccgcctccagagtgttccggatgcaggtgaggtacaaccgcagcgtattggcctggtgggtgctcatcgccggcgaagagccggacgaggacctgggcacctggcgtagggcggccgcggcggtggcccaggcgtcgccggaagggaggaagggagagagatcacgccggggcgggcccgacatggagcaggcctgatgcgtgacctcgggccctctcctgggccggttatt

SEQ ID NO: 21328 - DNA, 1801 bp, Zea mays
attgggtccctcgaggccggccgggaccttctgcccccgccccgcttcttccctccctccactcgcgtccaaattctctcctcaccacaccacccctccctccgacgcacgggtgcgtcgcagtgctaggtagagtgaccatgcaggcggcggcggtgacggtgaatggcgcgggcgacgtgcagaagccccagcagcagccgatggtggtgggggcgccgccgccgccggccatggtgccgccccattgggttgccataccgatgccgccgcacccgatggcgccgccccagttcgcggcggctcacttcgtgccgttccacgccgtcgtgcagtcgccgccgcgggcggcacctgtgccagcggtcgtcctgggatcgccggcgccgcatcaggccgggcaggaggagaacaagaccatctgggtcggtgacctccatttctggatggaagagaattatctgcacaactgcttcggctacaccggcgaggttgtggcaattaaagttatccggaataagcagaccggacagtctgaaggatacggatttgttgagttctacagccatgctgcagctgaaagggttcttgaagggttttctggtcatattatgccaaacactgaccagccctttaggttaaactgggcatcgtttagcatgggagataggcgctcggatgttgcttcggatcattccatattcgtaggcgaccttgcttccgatgtcaatgatgccacactgctggaggttttctccagcaggtactcctctgtcaagggtgccaaagtcgttatcgatgctaacactggtagatccaagggttatggcttcgtgagatttggagatgacagtgagaagacgcatgccttgactgagatgaatggtgtgtattgctcctctaggcccatgaggattggcccggcaactccaagaaaatcatcaggtacctctggatcaaatggctcatctgctcgaccagatggaggagatttgacaaacacaacagtatttgtgggcgggctcgacccagatgtcagtgaagaggaccttaggcaggccttctcccagtacggagaaatttcttccgtaaagattccagttgggaaacagtgcggcttcgtgcagtttgctcagaggaagaacgcggaagacgcgttgcaagggttgaacggcagcactattggcaaacaggccgtgcgtctctcatggggtcgcaacccagcaaacaagcagtttaggggcgacaatggcaacatgcagtggaagaacgggggcgtgtactacgcggcgcccccgttctacaacggcggctacggctaccctgcggcggccccgttccctgatccaggcatgtacgctgctccagcctacggcgcctacccgttctatggcaaccagcagcaagtgagctgacctggactactgcgccggcctcgcttggaaagctggggcctggcctggcctggcctggagcggctgttaggtgtagctcttggtagaagaagatgaagtagacgacgacggtttcttaggtgagctagatatatataccttgactagtctcgtatagtgcgttttgttacacgtgctagctagggtctagcgccacccaccgagtgtccgacacacctattgactggccacgtacggtatgtcgaaatcaacgacaaaaggaattttcgatgacctggagctgcatgctgccttgaagcagcagaacaataaagctaatggaatcctttgcccctgcaatatattcggtccggcttgagtttaaaaaaaaaaaaaaaaaagcggcc

SEQ ID NO: 21329 - DNA, 7181 bp, Zea mays
  misc_feature (1173)..(1173): n is a, c, g, or t
tattttcttttgggttactgggctatatatcaagttggaaaatcaggattctcaccctaaacccgcacaagttttatttataaggttctaagaggcaactagtcgttggaactgttagtgtgcattatgcggggttgtcagaccgtctgacgccccaccattggaccaaaactcatggtttgatgccctcaaatcatgccatcgtactagccatttgaatgttactattgtcacccaaacatctatcagagtgtatagtctaatgtcctcaatctgaaaattgtcggcccatacaacacaaagtccaacaccctttataaagtgaccagagagaaaccaatggttttagactggtctgatgcccttcgttagaccaaaccacatggttcaactccctacttctagtcgcacgggatgactgaaagtggaaccgtcctaatgaacaatgtagttatctggtttggtgatctaattttgttatttgttagaccaatgcactagggtttgatgctctcctaaaaacaaccaaagagcaactgtaagtatcagactagtcatatgacacccatcagaccatataaaatggtctgataattcactctgatcacatagctagggttcgtcgtcaggctagtactgttctggtctgacaccattgtctactatagtatgatgtttattctaggcctcacttagtcctatttttttcaacctttgcatgtgtgctaatgttgaacaccaaagttggcacttggatggttggagggtccggcttgtggctcggacgattcgcatcctagacggtccgcgattagattagttcagacgggagtccttatcgtgtacatggttatcctaacaaactcgtggaaaactgttggatctcgcctaggaatgggttcaaacctcaccctatatatatgaaggggtatgactgactgagaaaatacacaaccaatcgaaccaatctatctacattgtcatgccttaagagtagaagcatatctttagttgtagtttcccaatgtcaatcttcacctctatgttgtttaaagacgtttttggtggcccatcgatcccgaagcaaccctacaatatctccttcctaatggggtccctcctggacagcgagatctaggttcttcgtgaagccatttgcgtcaacgcggaaantccgtcgcctacaggcgaacggtcgacgccactgcagagaagagagtagttatctgctcgaaggtgacttacacacggaccgttcgacacctcgcagagaggcagggccgtgccagtaaaaaccgaggccccgtacaaaattattgaatagagacctttaccacaaaatcactaaaatataaaaagtatgtaaacataaatactgcaatgtattatatagaaatgaaatttatgaaaaatatacctattaaactcttggttatataaattttacttgaacaattttattttctttgtgttccttgcaataaattcttaatggtatgatcatattcaatcttatctgacaatccactctcaaaccgtttagtaaccagaatcatattttcaaagaccaattggtcaaagacatgtcatcgataattggatcttaaaatactacaatatttagtatgcatgtatacaagataaatagattaatcaataaattatttcattaacaaagttagcaaataaatatacatgtatacagtaggatgttagaggtacattatgatttgaacactttgtttcctaaatatcaagacacaaagcaagcgacggagggagatcgttgttgccgcgttggctgcctaccgctggacgacgaacgagtgtagtgtagagggcagaatcacgtggtgcgctggtagcaagcgaaacaaatgtctgtgatcgtcgcccatcaggcagcagcgcgctgggcgcttggcagcaggcgaaacaaggtcacgtcgaacggtaggagaaacgattaaagaaagatgcattgtgtccgtatagcaggccgcacacagcaggatttactctctagttcctaataatctaattagcattactaatagatcatatatggaaagttggggccccaaagaaatggaggccctgttcagccgaacaggttgcactggcttgtgcacgggcctgtagagaggtctcaaatgtctcgactccctgtgagcaggattctagggatcattagtgtttggcccaaaaaaacatgagcagccagagagatgaaaggaccaccttctcctgcttgcttgatcggaatctatttacatttagaatagctgaagtgctacttcacttcacttagtagttgaaactcggagagacagagagagtcctctctcatacttgccaattcaacacattgtttatgaactagagttataagttttgtaattcatcttctatattaggcggtgtttgttttgtgcctcattctaaatatttcattctattatattattttcaacaaaatagattctgattttttatttaattttccacgcaaaatctcaaaatcccaacataaattgataataggatttgcattagattttgttagaatgtctccaacaactagtctaaaataggcgatgcagaactatatatgacattgtttaacactgtttgcagagtgtagtttgaaataaggaatgagataggagatagaataggggatctgctggagataaccttagtatccatcttctcaaaatctataggtaactaaacatcaccttagacatgattgtccctattaggctatagaagtttttttgtttctttttcttaaatcatgttccaaacctctagagctaattgttagtcagctaataagttattagctgggttgggacagctaacaactaatagctatttgaaagatataactaacaattaactgatctattagttgaactgttttaaacctcttagctaattttagccgctaaataggagtattagttttaggggtttggaacatggccttagtaataagtgcacatgaactgcgtgcctgcaggctgccttaccaatggtaagttaccatgtgaaaataacctcggattgcggtgaaaccgtgaaagtgacagccatgaatggagaatggtgccatgccatgggggacgacgatggtggaaacaggggttgaaggcacttccatttacatttattttatttttctttattctttacatgctctacccctatagcccttttgttttgggcgccacacaatggcgcaagcaggaacacattatctccctataaataaactgtccgatacacgaccgtcacttgaattagacccaaagagctcaaggacacatactcaccagcgtgctaatatggccgatctcgtcaagccgtcgtgggcgtgcattgtggtggtcgtcgtcttaatcctcacgtcgtcgagcggcccggcgtccggcgaggcgaggaggctgctgacgatggcggaaaatcacgcgatcaagggagcaagcgccggtggttggcatcccccacccccagtgcaaggactcacggcgacgaccaccgacgggcggcccacggctcccggacacagcccagggatcggcaacaagatcgctggcaactcccgtttaataatatacatcgcaacagggtgggtcatcctctgcgcgagttccttcgtattacgttacagagtccagcagagatcggcaagacggcaacaagctaagatctccggcagtaccgtcgttgactacacgtcaaagagaagcctttgtttgcttggtgtacatataggtcgtagcaggtcatagaacgctgttcaaaaattaaaggttcatgttcatctatatattcgagactatagaccttaatctttagtcccggttatgtacttttgattcctacagaatttcttttaattccataataacacattacatatctcgaggagaaatatgtattggacctccaatttagcttagacgctcttaagtacacgatgggcttctcatctgtttttggtgaaatatatggttggaaagaaacaaccgaatctttcaggaacatccgagatctacggtccaagttgcacaactagtgaaagatcaaattgagagtttttagtgtatctaagatagatcagtggatggtagcttttttattttgattttgttttttttctcttcccgtgtgtgtttcggtctcgtggattatcttattttttctaatctaatataatgaagaggcaagtcttttgtcgctttctttaaaaaaagatggtgtctaaggaggaggacccagggcttctttggtgtgttttctatcttcttggctctgaatatcagacctacaatgatgatgcatctcccaacaaaaacagcgataacttaccatagttattttgaaaccctttctgatgtatagaaatagatttgttttgttatggttatcatctcggccgctccatgcccatccgcagcaccctaatcgatagtcagaaacgactctacgtgtagcgtagcccgcaggggccggtttctgcaggccgacatcggcgtggatccggtctaaaatttccaaacgacggcctgcctgccggccgtccacgcgctccatcggacggctcgccgctcacccatatcctccgccgccgcctgctttatttagcctagcttctgcccgcgagcctcttcttccctccctccactcgcgtccaaattctctcctcaccacaccacctctccctccgacgcacgggtgcatcgcagtgctagatagagtgaccatgcaggcggcggcggtgacggtgaatggcgcgggcgacgtgcagaagccccagcagcagccgatggtggtgggggcgccgccgccggcggccatggtgccgccccattgggttgccataccgatgccgccgcacccgatggcgccgccccagttcgcggcggctcaattcgtgccgttccacgccgtcgtgcagtcgccgcagctggcggcacctgtgccagcggtcgtcctgggatcgccggcgccgcatcaggccgggcaggaggagaacaagaccatctgggttggtgatctccatttctggatggacgagaattatctgcacaactgcttcggctacaccggcgaggtgagcacggatgcgcctcagcccagatcttggccacggccgtgctattctcgagtcagccccagaaaaaaaaaatattatagcaaaacaaatgtcgacgtgacaaatccgtgttgttttctcgctgagttcagcctccgtttctcgggctgcgcgcaggagagagagagagagtaaagggtttcaggagtgactgcagttgctgatagtcagggtcattccgtcactgtgctgaaaagggaaacggatttggcaaccgttagctaaacggcaggcatggacctgcgagctgaaactggaagcctgcagttgcccagattgcctgagttgatgcatgtactggcaaccccatgacgtgccattgctgcacctgttgcagtcctgattggcagattttcttttatcatgtgttttggttcttaacaccatgtttcttagggtactttgctcttttcgtgatgaaaacatccttaaatgatatgccttatttatttggataccaaacaataacaggctaacagctacagaatgtcagaatcaattatttctttcatgaactctcttgcatttagtagactgaagggataaaaaggaaagtaatggcaaccttttggaagaaaatatagacacttgaaagtcatgcagaaacatttggtgaagcacggtaactttgggtgtaagccgatggtaataaagctcaaaataaacaatttttttttgcaagccctggattactctgtcatttcgatagatacctcatgtgtttaactgaaacctatcttgtgatgcagttctgcattcttctctttatttagatacctagagtccaaacttgcactaaatacgccgtgatatgctgtaggttgtggcaattaaagttatccggaataagcagaccggacagtctgaaggatacggatttgttgagttctacagccatgctgcagctgaaagggttcttgaagggttttctggtcatattatgccaaacactgaccagccctttaggttaaactgggcatcgtttagcatgggagataggcgctcggatgttgcttcggatcattccatattcgtaggcgaccttgcttccgatgtcaatgacgccacactgctggaggttttctccagcaggtactcctctgtcaaaggtgccaaagtcgttatcgatgctaacactggtagatccaagggttatggcttcgtgagatttggagatgacagtgagaagacgcatgccatgactgagatgaatggtgtgtattgctcctctaggcccatgaggattggcccggcaactccaagaaaatcatcaggttcagttcaaagtatccatttattatatctactagctttcacaaatccttgtctttgttctatacaactttatgctgctaggtttctttgatttttatataatccgttgtaaaattaaaactaaacagagcataagtgatttaattatttattgattgtttcagtggtcatttggagagcattctgatcctctgtcacattttatatgatgaaaattgcatctaactgttgaatccaattgaatgggtgtttcttgattttctcgcttcattttaaatgttggtgttccattaggggctgttcggttgctcaggaacggtggcctggaactattcctgcctggattgtttacctattttatataagatttcatcagctggaataattctgggtccaatcctggctaaccgagcaggcccttatttgtaatcctaaccccggatcaagttcatgtataaagtttataattttcacgtttcgcctattcaaccttgtaggcgacttttaaagactcgacatgttttagggtcggactagaccaatatttctactctttggactaccacggcacgatatgactttttttgaacttttagatcaagctcgtttagccagaagcgcgatagacatgaatcgggcggttcgacccgaaccaaattccagccgtgtcgagactagtggaatgtgtcgttttccaataaataactcaatataggtgagtatcagtccaaggtccagg

SEQ ID NO: 21330 - DNA, 1844 bp, Zea mays
ctccgccgcctgctttatttagcctagcttctcccgcgcacgactcctccacctcctcctcctcctcttcttccctccactcgcctccaaatcttctctctcctttcctcctctcgtctcaccgcatcacctctccctccggcgcgcgcgtccgggtacagcgctagagtcactcaccaccatgcaggcggcggcggcggcgaatggcgcgggcgacgtgcagaagcctcagcagcaaccgctggtggcgggggcgccgcccccaccgccgccggcggccgtggtgccgccccattgggtcgccatgccgttcgcaccgcctcccggggccgcggccatggtgatgcagccgcaccatatggcgcctccgccgccgcagttcgcgccgactcacttcgtgccgttccacgccgtcgcgccgccgcgggcacagtcggtgccagcagcggtcgcactgggttccccggcgccgcatcagcccgggcaggaggagaacaagagcgtctgggtcggcgacctccattactggatggacgagaactacctacacagctgcttcggctacaccggcgaggttgtggcgatcaaagtaatccgcaacaagcagactgggcagtccgaaggatacgggttcgtcgagttctacagccacgctgcggctgaaaaagttctcgaagggttttctggccatatcatgccgaacaccgaccagcctttcaggctaaactgggcatcgtttagcatgggagacaggcgctcggatgctgcctcggaccattccatattcgtaggcgaccttgcctctgacgtcaatgacgccacgctgctggaggccttctccagcaggtactcctctgtcaaaggtgccaaggttgtcatcgatgctaacactggtagatccaagggctatggcttcgtgaggtttggagatgacagcgagaagacacaggccatgactgagatgaacggcgtgtattgctcgtctaggcccatgagaattggcccggcaactccgaggaaatcatcaggtacttctggatcgaatggttcagctgctcgatcagacggaggagatttgacaaacacaacggtatttgtgggtgggctcgacccaaatgttagcgaagaggaccttaggcaaaccttctcccagtacggagagatttcttctgtaaagattccaattgggaaacagtgcggcttcgtgcagtttgctcagaggaagaacgcagaggacgcattgcaaggattaaatggcagcactattggcaaacaaaacgtgcgtctttcatggggccgcaacccagcaaacaagcagttcagaggcgacaacggcaaccagtggaacaacgggggcatgtactacgcggcgcccccgttctacaacggctacggttaccctgcggcggccccgttccctgatccaggcatgtacgctgctccagcctacggtgcctacccgttctatggcaatcagcagcaagtgagctgacctggactaccgcgacacgcacgcctcgctcggagctggagactggaggtgttaggcgcttaggtgtagctctcggtagaagaagaagaggaagaaggtagacgacgacggtttcttaggtgagctagataccgtgactagtctcgtatagtgcgatttgttatacgtgctatggtctagcgccgccgacgactgagagtccgagtgtccgacacacctattgactggccacggcatgtcgaattgaacgacaaaaagaatttctgatgtcctggagctgcatgcatgctaccttgaagcagaacaataagctaatggaatcctttggcctctgctaaaaaaaaaaaaaaaa

SEQ ID NO: 21331 - DNA, 3085 bp, Zea mays
gggaccctcgttttttctaacaatcgacaatccaatcccaggagaatgtgttgggcgaccttagcaaaagctgcagcgagacatttatgccaacaaggggcactagtgcgtccaagcagagaacaagagacgcaggtgggtgggcacgcactacttgagaggcgtgccattgcagcaggtcctgcgtcccgcaggtacgtccaagttccccataagcatacctatctcactgggaacattacactacagaagaacgcccagatgtaaacagaatatggcagctcaaaaggctaggctgagggcacaagaccctcagaaaaggaattaaaataaaataggaagagttcaatgtgtactttctggggaattaggtatccgacttaaatttaccctactttccaccaacaaagcttcagaatccccatcaattgcagcaaaatcaagtttggtgccgagtatagagctcaccctaccatccccaggattatcatcgataaccttaacctcaacctccatacctgtctcagaatcaagcatgaagggcttctcttgactgtcaggactagcaacaggagcaggctccttgcctagttgaggttctgccatagcagagggtatgatctccatgtcatcacctgattctccaacagcagaaggtgcaacatccagcaagacatcagcgggtgtaacttccggtatgccaacagcatgttcgagggttgcttgtagtgcaccatcctcaattgctggaggcaacacatcctccatgtgcttgttcggctgtgtgattactgttgttgccaccaccacctcaggttggggaagtgaaatttctggaggtgcatccagaaccccagatcctatagttgcagcaatagttctccctatgccatcaccaagttcatgttttgatactgatccttcctccatgacatcagtgtgacgttgtggagcaggattgctcaccactggttcaagcaattccatgtcatggtcatcttctggtacagccatcttctcttccatttttacagatgcagaggcagtagttaaaccctttcgagtctggttcttatgaagggccaaagccccctcaaagatagtattgtcacttttgaggtaacgtgaactgaaagggttgaggtttccatattttgttgacatttttccaatatttccattatcctgctgaatttcattcctaaccaaatgagaggtttttgttacgtccaaatctcccagcaaggatatacaccttttgtacaactcaggctcaacaagatcatgtgaaacactgattctggatagatagtttttacaaaagaccacgctattctttgacagcatagaagtcacaagttgtgctccttgaggagcttccaaactttttgaacttttagtatgattcttcgcttcaaagttttcagcagtcaagcgtccaatttccttttggtcagcctcaggttgaagattgtgttgtccaccagaatcagaaacagcagttattgcagagtcaggatccttcttagctaccagaagttcagcatccggcacatcatttggtcccttggatacatcaccagtcagctcccaacctctgctaccagcatgaggtctattctgatcccactcttgcctaccatagatatagggttcaccaggaaatacaccactacctccattccaaacttgcatatgaggtgggcatgattcatccagatgattaggccacccaaatgggcgcatgtgggtcgaaaacctatcaacagcatcatgcataggatatgaaactccaggttggtttaatttcatttgaggtctaaggttaaacataggtgggcctggaaactgatggacaggtggatgaaaaccaggagcaccaccatgttggatggggacgaaaccattagaaactggagaaggccagtttggctggctgttccagccatgtccatgtccacgaacagaattcatgtcattccttttttgatgaccatggaacctcctatctccattttgaggcctacggtcatcatcatgtagaccctggaaggaagggtcaccgttccgtgcaggtggcaaaggattatttggtgaactgcccaaaaaatgaccacctctacttatggatgaatttgacggtgttggctccctgaatggaaccttagctggcattcgatcttgatgatgtgatcgctcttgggctatgtcaccatctctatctctgtatttcgtaaggctctttctttctcctttattatcaagactacgcccaccactaagcctacctgaaaacctatggtcacctgaagatggagatttttcagacagttgttttggtgaagtatgcttatctttgctaggtgtgcggtcgtagtgtgatgtagaaatttccaatgttacatcacaaggttggtaatcatccttctgtttaagcctttcagacgaccaattttctgcatccctgtcacgaagtctagaagcaggtgtcctttctctaccagaagatgctcttggacgattatttctctcatcatatggaatttctctctttccatgatccaccactttagacccatgcctggacatcaatgaattaaccattttcagatgttagaaggaacagagcataattggttgcaagattaaccattttcaatgaattaaccattttcagatccaccactttagacccaaaatatgttaattggttgcaagattgcaatatttgacattctaaaaccaatatttaaaacacataccatgatgttcaagaaatgatcaagcctcacttgacaaacaacctctgtaaactaaataagaccaacccatggtctacccactgaaacaatatatagttttttttcttttatgtggattgtaaacaaaaccaattcgcatgaagccaaactaaatattttaaatagacaaatattaaccctgcacctcatagaggaactccccaaccatgaaccaacggttccattctggaacttactaacatgcgacagtaaaaccaaccacagagccaaccaaactgtatctgataaataaactgtgatctcaaccaggagcttccaggcct

SEQ ID NO: 21332 - DNA, 5093 bp, Zea mays
ctaaaacaaggttaacttctttgccatcattaaaatatatcagtgttgatgatcggctttgataaataaggtattggggagttcacaaggacaaatatgggttctttgtttaacaaaaatatctaaaacatcgccacgttttaaagaaaacaggaacggttcagcaatggcagcatagccagcttctagaccgttcaaatcagaactctctctcctaataactgctagggtcctagtcctagcaagtcagtcagccttcaaatttccacacgtggaatccgctcccacttgcactggctatccagtattccagttggcctgtttgggggcagagcccgatctgacaccgtcagatcttcatcgtacattcgtactacttgcttatgtgtctgactgagctagggcatagcggttcatgtgacttcgtttttccacgtacttccgttcttttttatttatcacagtttaatttaaaaataaaatagcataaaatgaaataaaatattacgtaaattaagtatattttcattttgtgcatgaaatgaaattgtgtgactaaaagtatagaaataaagttacttccttcgttctttgtaatttatcattatttagtttaaaaataaactaacgagcgataaatattggagaaataatgtagtacgttgtaacatattgggcatttagaaattttgttttcggggagaggaaataacacattggttgaagaagttagaagcatcgtcgactgtggtagctagttgggccgcaaagatgggagagttgcactcttttgctgcatcatttgcgcttcggcccatagctacataaaatcaggcccataaaactcattcctccgtcccatttgcggattagccgttgctgttcaaacagtcgaaggattaacctgtgtttatgtgcatgttctgacaacctgaagatggtgttttccgtggctcgctgcaggtgggcaacttcatgcactacatcagccggttcctggccggcttcgccatcggcttctcgcaggtgtggcagatcagcctcgtcaccctcgccatcgttccgctcatcgccatcgccggcggcacctacgcctacgtcaccatcggcctcatggcccgcgtgcgcaagtcctacgtcaaggctggcgagatcgccgaggaggtcgatcgcctcacattccctccatgtgtgctttgtattgtaatcgaccacggacgcgcgtactgacgctgccgtaggttcgtgcgcctgcccgcaggtgatcggcaacgtgcggacggtgcaggcgttcgtcggcgaggagaaggccgtgaggtcgtaccgggaggcgcttctgaggacgtacaagtacggcaagaggggcggcctcgccaagggcctcggcctcggctccatgcactctgtgcttttcctctcgtgggcgctgctcatctggttcaccagcgtcgtcgtccacaagcggatatccaatggcggcgagtccttcaccaccatgctcaacgtcgtcatcgctggcctgtgagttcacagattttaattccttgtccttcatgccggtctgcgtcggcgtcgccaagcgattaattggaaaattccgtatgcgcgcgtgactgctgctggtaggtcgctcggccaggcggcgccgaacatttcgacgttcctgcgggcgaggacggcggcgtaccccatcttccagatgatcgagaggagcaccgtgaacacggcgagctccaggacgggccgcacgctgccggtggtcgacgggcacatccagttccgcaacgtcgacttcagctacccgtcacggccggacgttgtcatcctcgataggttcagcctgaacttccctgccggcaagatcgtcgctctcgtcggcggcagcgggtccggcaagagcaccgttgtctcgctcatcgagcgcttctatgagccgctgtccggctccattctgctcgatgggcacgacatcaaagagctcgacgtcaagtggctccgccgccagatcgggctggtcaaccaggagccggccctgttcgcgacgagcatccgggagaacatactctacggcaaaggcgacgctaccgcggaggagatcaaccacgcggcgaagctgtcggaggcgatcacgttcatcaaccacctccctgatcggtacgagacgcaggtcggcgagcgcgggatacagctgtccggcggccagaagcagcgcatcgcgatctcgagggcgatactgaagaacccgtcgatactgctcctagacgaggcgacgagcgcgctggacgccgagtccgagaagagcgtgcaggaggcgctggaccgcgtcatggtcggccgcaccaccgtggtgatcgcgccccgcctgtcgaccttccggaacgccggttcgatcgcggtcgtcgacggaggcaggatcgtcgagacaggcacgcacgagcagctcatggcgaacccgtacagtgcctactcctcgctgatccaactccaagaggctgcccagctccaacacaagccttctttgtctgacagcgcaagcattaccaggccactaaggtatctctgttctctgctctattgcgcgtagtagaactgtagaagaaggtcaaacgtgataaacttaagggaccattcccttgcagtttcaagtattcaagggagttgtccgggaggacgagcatgggcgccagcttccgctccgacaaggactcaatcagccggtacggcggcgccggagaggcgcatgacgaggtgcgcaaggggaagcccgtgtccatgaagaagctctactccatggtgcgcccggactggttcttcggcctgtcgggcaccatcagtgccttcgtggccggctcccagatgccgctcttcgcgcttggcgtcacgcaggcactggtgtcctactacatgggctgggagaccacgacctggaggtgcgaaagattgccgtgctcttctgctgcggcgcgctgctgacggtcgtgttccacgtgatcgagcatctcagcttcggcatcatgggcgagcggctcaccctgcgcgtccgggagaagatgttctcggcgatactgcggaacgagatcggctggttcgatgataccagcaacacgagcgccatgctgtcgtcgcggctcgaggctgacgccacgcttgtgcgcaccatcgtcgtcgaccgctccaccatcctgctccagaacgtcggtatgatcgtgacgtcgctcatcatcgctttcatactcaactggagaatcacgctggtcgtccttgccacctatcccctcatggtcagcggccacatcagcgaggtactagatgtttctgtgtgcctaatcgtcatacagtgtccgatcaactaagaatcccctatggtcgtatatggaacagaaaatgttcatgaaaggctacggcggcaacctcggcaagtcctatctgaaggccaacatgctcgccgcggaggcagtgagcaacatccggacggtggctgccttctgctccgaggagaaggtgataaagctctacgcggacgagctcagggagccttctaagaggtccttccggcgaggccagggcgccggcctcttttacggagtctcccagttcttcctcttctcatcctacgcactggcgttatggtaaagtgttatactatatttgatggaacacgtacgatgagttttgcttctgcactccagaagtaaaatgttcagaacgcatgcaggtatggttcagtgctgatgagcaaggaattggccagcttcaagtccgtgatgaagtccttcatggtgctcatagtgacggcgctggccatgggggagacactggcaatggcacctgatatcatcaaagggaaccagatggcgtcctcggtgttcgagatcctggaccgtaagaccgacgtccggatcgacacaggtgaggacatcaagagggtcgaggggctgatcgagctgcgcggcatcgagttccggtacccgtcgaggcccgacgtgaccgtgttcaagggacttgacctgctgatgaaggctggcaagagcatggcgcttgtcggcatgagcggctccggcaagagtaccgtgctgtcgctcatcctccgcttctacgacccgatcgccggaagagtcttgatcgatggtaccttacctcgtccaaagataatataaagctccagttttttatgacaaaaatgctaagtgtgtggatgatgcaatttgcagggaaggacgtcaagaagcttaagctcaagtgtctcaggaaacacatcggcctggtccagcaagagccggcgctgttcgcgacgacgatctacgacaacatcctgtatggcaaggacggggccacggaggccgaggtcgtcgaggcggccaagctggcgaacgcgcactcgttcatcagctcgctgccggaggggtacaagaccaaggtcggggagcgcggcgtgcagctgtcgggcgggcagaagcagcgcatcgcgatcgcgcgcgccatcgtgaaggacccggccatcctgctgctggacgaggcgacgagcgcgctggacgtggagtcggagcgcgtcgtgcagcaggcgctgaacagggtgatgaggaaccggaccaccgtgatggtggcgcaccggctgtccacggtcaagaacgccgacgtcatctcggtgctgcaggacggcaagatcatagagcagggggcgcaccagcacctgatcgaggacaagaacggcgcctaccacaagctcgtcagcttgcagcagcagcaacagatgcagacgcagcagagctcatcagaagacatttgaataagatcgtgcgtttctgtatcttgctgtggctttgtctttcttgggcttttgtaaaagatctgcgctggttatcttttcaatgaaagggagtgttcagaattacaggatgaagcattattgggttcttattcctgactcccgtaaaaaaatatatatattgtacatagaatcttgcaatgtaattctgctccatggatctcaatgtttagtgcctacttctgattccaaaaaaaaaagggggcggccgttttaaaggaccaaagttaacgtccccgggcttgcaacgtaatagtttttttttggg

SEQ ID NO: 21333 - DNA, 1421 bp, Zea mays
gtcagcggccacatcagcgagaaaatgttcatgaaaggctacggcggcaaccgcggcgggtcctatctgaaggccaacatgctcgccgcggaggcagtgagcaacatccggacgggggctgccttctgctccgaggagaaggtgataaagctctacgcggacgagctcagggagccttctaagaggtccttccggcgaggccagggcgccggcctcttttacggagtctcccaggtcttcctcttctcatcctacgcactggcgttatggtatggttcagtgctgatgagcaaggaattggccagcttcaagtccgtgatgaagtccttcatggtgctcatagtgacggcgctggccatgggggagacactggcaatggcacctgatatcatcaaagggaaccagatggcgtcctcggtgttcgagatcctggaccgtaagaccgacgtccggatcgacacaggtgaggacatcaagagggtcgaggggctgatcgagctgcgcggcatcgagttccggtacccgtcgaggcccgacgtgaccgtgttcaagggacttgacctgctgatgaaggctggcaagagcatggcgcttgtcggcatgagcggctccggcaagagtaccgtgctgtcgctcatcctccgcttctacgacccgatcgccggaagagtcttgatcgatgggaaggacatcaagaagcttaagctcaagtgtctcaggaaacacatcggcctggtccagcaagagccggcgctgttcgcgacgacgatctacgacaacatcctgtatggcaaggacggggccacggaggccgaggtcgtcgaggcggccaagctggcgaacgcgcactcgttcatcagctcgctgccggaggggtacaagaccaaggtcggggagcgcggcgtgcagctgtcgggcgggcagaagcagcgcatcgcgatcgcgcgcgccatcgtgaaggacccggccatcctgctgctggacgaggcgacgagcgcgctggacgtggagtcggagcgcgtcgtgcagcaggcgctgaaccgggtgatgaggaaccggaccaccgtcatggtggcgcaccggctgtccacggtcaagaacgccgacgtcatctcggtgctgcaggacggcaagatcatagagcagggggcgcaccagcacctgatcgaggacaagaacggcgcctaccacaagctcgtcagcttgcagcagcagcaacagatgcagacgcagcagagctcatcagaagacatttgaataagatcgtgcgtttctgtatcttgctgtggctttgtctttcttgggcttttgtaaaagatctgcgctggttatcttttcaatgaaagggagtgttcagaattacaggatgaagcattattgggttcttattcctgactcccgtaaaaaaatatatatattgt

SEQ ID NO: 21334 - DNA, 1266 bp, Zea mays
ggccctaggccccttttttttttttttttttggcgataactgcatgaatttgttcacacttagcaaattagcatacgcccaaaattgagtcagttacagcgctacggatatcccaaatctcaagcactgccctgttgtgaaacatattagcatacgcccaaaattgagccaaactcgcacttagccaacataggctctctctcacttagcgaaaattgagccaaactcgcacttagcaaatatcgcaatgtttttttttggttatcctactgctgctgacagtgacagtgcctttccattgcttggctcgaggagcacacgatctggaatgccgggctcactttgatgttgaggtgatgaatagtagaaatattagcataaaattgtgtcaatcagcaacccacaaaggccaggcttgaagttggttgaaggaccggctcaaggactccccctcgaggcctgcatccttctgttctcttccatgtaccatttcttcagcctctcttgagcgaccaccacctgtttgtcccagtcggtctttactgttatgaagagaagcacgatagtctggaccagcgttccgagcagcattccgatccaaatgcccttcacatgaagccccaccacgtagcctaggactgcgccaagaggaatgccgatcaggtagtacgacgtgacgttgacgtacgcgactacgccttgccaaccggcaccaacagcgacacctgacagcacgggctggacgctgttgagcagtatggagaaggccagcaggggcgagaggtcggcgacggctccggccaccgcttggttctcggtgaatatgtaggcgaggctcccgcggaagaagaggaggcgcacgaacagcacgagcccgatggcgaaggaggtgatgaccacgttgtagatcgcgaacttggccctcctcgcgctcccagctcccagctcgttcgccactcgcactccatattgaaagggcgtcaagtgcgatctctgcattcttcatgtatcctgtgaggagcaccagtatggtgttgtaccacaattccaagcagagcatgacaccagaagagagcgagagcctgacgatggcgccgaggtcggcgaaggcggcgtacgagaatccggtccaggtgagagggcatccgccgaagaagacgaaggcgagctggccgaacacggggatccacatggcgacgaccatggagcccatgacgccggcgaggccgaggcggaggtgcccggccggcctcgaggtacccaatg

SEQ ID NO: 21335 - DNA, 807 bp, Zea mays
  misc_feature (6)..(23): n is a, c, g, or t
tttttnnnnnnnnnnnnnnnnnntttttttttttttttttttttttgaagataattattttttttattcacatttttcttaacatgaaaacagttttttttaaataacaaacagcctgctacatttaaataatttaatttaattttatgataactttgtcagcatttcataaatgcttgcttttattcaacacatggctttacttggctttgccttgagcagcaactgattcaatggctttccttactgtctcctcatcgcccaagaatttcattgacacaactggcttgaagttctcatctagttcataaacaaatggaataccagtgggtagattgagggccatgatcgcatcatcagacaaattatccaaatgcttgacaattcctctcaaactgtttccatgggcagcaatgataatagatttgccttctttcaattgtggaatgataacgtcgttccaatagggcagagtacgggcaatagttagtttcaatgactcgaacattgggaattcagcttctgatggaccctcagcgtaacggggatccttcacaatagtattatagtagggatgatcgggttccattggtggtggtggtgtgtcgaaactgcgtctccagatctgcacctgggcttcgccgtatttggcagccgtttccgatttgttcaatccagtaagacttccgtagtgacgttcattcagtcgccatgttttattgactggaataccttcttgtccagattccttcaggatgttgccgagggttacctgagcacgagttagtacccgaggtatgagctaca

SEQ ID NO: 21336 - DNA, 698 bp, Zea mays
tttttttttttttttttgaagataatattttttttattacattttcttaacatgaaaacgttttttttaaataacaacgcctgctcatttaaatattaattaatttatgataactttgtagcatttataaatgcttgcttttattcaacacatggctttacttggctttgccttgagcagcaactgattcaatggctttccttactgtctcctcatcgcccaagaatttcattgacacaactggcttgaagttctcatctagttcataaacaaatggaataccagtgggtagattgagggccatgatcgcatcatcagacaaattatccaaatgcttgacaattcctctcaaactgtttccatgggcagcaatgataatagatttgccttctttcaattgtggaatgataacgtcgttccaatagggcagagtacgggcaatagttagtttcaatgactcgaacattgggaattcagcttctgatggaccctcagcgtaacggggatccttcacaatagtattatagtagggatgatcgggttccattggtggtggtggtgtgtcgaaactgcgtctccagatctgcacctgggcttcgccgtatttggcagccgtttccgatttgttcaatccagtaagacttccgtagtgacgttcattcagtcgccatgttttattgactggaataccttcttgt

SEQ ID NO: 21337 - DNA, 3151 bp, Zea mays
gtggttccgcggccccttctcgtgttttttttttttttttttttactgcaatgtcagactcaatactgcaaaaatatatcatctgatccagaacgggaaaaacatttgcaaggcaaaacctcctacaacacaaactctcagtatcaaaagtggcagtgagccagtgactattcaaatgttgcagacgagtgcgagcagacccttaactatcaacagtaagaaatataaggagcagcacctaggaagtacaagtgactgttactacaagctacctccgcctaggtggatcagaggacctaggttgtttcccatctgtatccgatttgtccttctccttcgtgtctgattgtctgagtttcctcgtcaagtcatcagcatagcgccgccaaatagactctttgtctttactcggtagcttattgtaccttagatcagatcttagatgaccttttgcctcactccaggagttgattgccgtcttcccctcagctgttgtccgtgctgctacctctggagtgataacctcagatagaagtgcccggaaatcacgtacacaccgctcatataggtccttgacatggtcacgaaacaacttttctgcatcaccttggcctaagtcaggatttcgagcacgaccttgtggatctttttcaagttttggtttggattcagtccacgatgccttgggatccttaatcatttcaacaagtaaagcttggtatgatgacacagcctcttttctacgtatcttcatttttactctttccatctcctgctcctctctttctttccttttacgtgtttcacgttccctctcctttaacttggcttgctcatccactttggccttggcagcttgctctgcttcctgttcagcagattttagttccactatgtattcattaaatatagtctccctttcttcatgcttcatggctttgtaccttggatcactacggaaattttctttaacttttgcccatcggctagttgaagttatatctttactttctcgaagcattgatttgaaattagctatgacagctttgcgcattgattggactttttcttgaacagccttgactttctcactaaaaagaatctccctttcctttcgatccaaggcttcaaaccttgtatcagcaccccattttcttttgaattcttggtagtctgttttctggttgatgtcctcggatgcttcttcaagtaattctttatacgcctctactgcagccttcagggcagctcttttctctttccgctcctcttcagcacgtgtgcgaacatagtggtcaaatatagcccgccttgttgagtgactaggaatagccttaaagcgtgggtcaaaaactatttttggaagttccttctcccacttcgaaaatggtgcaactcctcgttcctttagcatcaccttaaactgacgaatgcagtcctctttacttggtccatgttcctcatcatctgaatctgaagaagaatctgagatattcacatcaccattgttatcttttaatttctcaccattattcgccactagttgccccttaagtgcagcatcagctggtttggatccattcaattcagaggtagcagatgaagtagccagagctgaaggcgcactggaagcaccagcatcctgcaatttcttctttattaaatccaatggagatggcgatgcaggggcaactgtttgccgaagtggcaacgaatcacggccacctgtctgtatggcaggagtacttgcgtcaatgcttattactcccttattctctatagttgcagcatcctgcagtgaagttgaaccttcttttaaggaaccagattccgcattcttgaggatctcacacacctctggcggaagttgccagctgctaaccttttgtttgttatcataataatatttctttccatcacttgtagttactatgctccagttagtaccagccaatttatcccaagaaactggaactggttctgttgcaaccttctcaagctcccccttataaccggttggtttctggtaagtcgactctcctgtcaaagcattgtaataatatacaacaccagtttcagttttgtgagcagaccatgcatctgaatcctgaactccagtatttctattgtcctccagctgctcagtgacttgacctccatgtcctgtagaatctggctcagctgcagcatgagtggactgttcagatcctgcatttgttgatgcttgtactttcctatccccaccagttgacacgccaggtggttgcacattggcaaaggccatagttgcagcagaagccccagttattggcctgccaagagagcctacaggaccagctggatagtactggaagggaggctgctgaaatccagtaggttgtggaggatgagggtgtggccataaaggttgaggtgggacaataccaggtcctgaaggataggacgggtaaaacggtcgttgagaattctgtggtgtgccaccttgggttgcaattggtggtggtgtttggggcaaaggagcagcaggtggaactataggcctcccaaggaaacctgttggattagagacagttgcagaaggttgtgcaggtacagatggtctagtggctccaaatacctcagggcgaggtggcaccgatgaatttgttagtgtctggatggggattgaaggacttccagaagcacttgcgattgttgaaggagattttgatggcatgccagtagataactgcatggcttggggtgtaacctctggtgcccttggggagtccgatttcaaattattaatgtctgagctgccctgttgtgcaatagcaccaaaaggaatattggatggtcttggcactgaaaacggcaactgaatagatccaggaggatttggtgccatagatcctgggaacgctgtactagggcgagttatgtgcccaggggtgggaggctgcaaggaacctggtggaacaaatctagaaattggaccagcaagatttgctccagtgaccggttgaaactgctgaccagtaggcaatctagcattagcatgcgaaactacgttatatgagaaagaaggtctgttcccaaaatattgccctggggctggtggctgaagagctgacgcgggtataggagcaaccataagagccggagaagagca

SEQ ID NO: 21338 - DNA, 1344 bp, Zea mays
ccccaaaaaaaaagttatgcgttggaaggcaggggtaggtaagttgggttcttttaaaaccggcccccccttttttttttttttttattttttttttcaatcagagtccactatactattacattattcttctttgagccaccgaaccgtgtccaaatggatgggcagtgagatatttatttacacaaatgaagatctttttcgtttccatgtggccatgtgggaatagacagaagagactaaatcgccagcacatataggtagtcttcgattatggacatagctgatgaacggtagccagagccaaagagattgtagtgattcaggtagtggtagaggagatagaggtccctcctcttctcaaaccctggctgtttcggcatcacctgaaaataggcgttgtagaagtccccaccaaatccagcacaccaggacatcccaaactctgcctcgttgtgtccatagtagcaagcaggatccaatattacaggatccccattgctatcagagcttatgtttccgctccacagatcaccatgaagcaagcatggctcaataaccgctccatcaaaaagtgggcggatattcttgatcaaccgctgacctttttcgagtatggccgaatctccatatcgtctcgatgccaactccaactggtaacccaatctatgcttggagtaaaactcaatccagtcatcagtccaagtgttaatttgtggagtgcttccaatagtattgtcaaccgggaaaccatatcctttatcagatttagcagccttatgcatttcagcaagcttccttcccaaatctgactggtctccccttgaacgaccaaattcaataaactccatgatgataaaagaaccacctgtaggtaaagaaccaaccttgtatggcaacggaacacggatcgactttgtgtcatacattgccttcaaaccaagagcctccccttcaaacatttctggaccaatgcggctgttggtcttcacaaagaaggggcccgcgtcggtatcatagcgctgagcggagttaatgcagccaccaccaatggacctgatcccttttatctgcgtggccttcccttctgtaagaatccattccctgatcgggtcatcgcccaacgccgacatgatggtggtggctcgggagcttgctcttcttcggcgggagggcaggaagcggcggcgagggaggagcgaggcggcggcggcggaagtggagggcgagcaggaggatagcagcaccagcgccacgtttgcggccatcgcgctcgccacagccgagacaggtgtgtcgcgtgtggctgtggcatgtgttgtcgtcttgccgagatgccgatcg

SEQ ID NO: 21339 - DNA, 1303 bp, Zea mays
  misc_feature (1302)..(1302): n is a, c, g, or t
ttgggaccctcgagcccggccgggaattctaaaaaaccctaattcgaacaaccgcgccgccgtctctcgctcactcgctcgcgctctccatccgtgagaactcccacgcgaagatctcgtgtcgatccagtcgaaccagcgccccgcgttccaactaacctggttcgtgccgtctcagagatcggagcgctcggttcggataggggcgactaggaggtgaaggcgggcgcgtcagccatggcggacgaggagcacccggagaggagggaggaggcctccgagcttgccccctttgatccaaccaagaagaagaagaagaagaaggttgtcatccaagagccttctgatgaagtggacaaggttgcagagaagacagaatcactagcagtcgcagaacctgctgaacttaacttcactggaatgaagaagaaaaagaagaagcaggtggatcttgattcatctattgatgaccttggagatggggaggacactcaaggtgatcaagttgtagaggaacaaggggacggtattgtgcttggaggtggccctacatatccttgggaaggaactgaccgggattataaatacgaagagctgctggacagggtgttcaacattcttcgtgagaacaacccagatcttgctggtgataggcggagaaccgttatgaggccacctcaagttcttagggagggaacaaagaagacagtttttgttaattttatggatttgtgtaaaacgatgcataggcaacctgagcatgtaatgatgtttttacttgccgaaatgggaacaagtgggtcacttgatgggcagcaaaggttggtgatcaagggaagatttgctcctaaaaactttgaagcaatcctgaggagatacatcaatgagtatgtcatctgccatggatgcaagagccctgatactattttgtccaaagaaaatcgtctgttcttccttcgctgcgaacagtgtggatcttcacggtccgttgcaccaatcaaagctggattcgttgcgcaagttggtcggcggaaggcctaagcgcaaaccaaattggtcctttgcgctgcctgctctgttttggtcgtgtatttcttgttttttttcgtgtcatgttaatgcagctgaggttcggtttatgattgtcctatctttgtgtggctgaaatttgaggccataccaattcgacaatattacattattttgccggatggacattctgccgtgcaatgttgagagcatgatgtgtcaacaaaaaaaaaaaaaaaaaaaactcgaagggggggcccggtaacccattcnc

SEQ ID NO: 21340 - DNA, 1239 bp, Zea mays
gcgccccccgagaccgccaattcgaacaaccgcgccgccgtcaccgactcaccgtcgtctctcgctcactcgctcgcgctctccatccagatcggagcgctcggttcggataggggcgtctcggaggtgaaggcgggcgcgtcagccatggcggacgaggagcacccggagaggagggaggaggcctccgagcttgccccctttgatccaaccaagaagaagaagaagaagaaggttgtcatccaagagccttctgatgaagtggacaagcttgcagagaagacagaatcactagcagtcgcagaacctgctgaacttaacttcactggaatgaagaagaaaaagaagaagcaggtggatcttgattcatctattgatgaccttggagatggggaggacactcaaggtgatcaagttgtagaggaacaaggggacggtattgtgcttggaggtggccctacatatccttgggaaggaactgaccgggattataaatacgaggagctgttggacagagtgttcaacattcttcgtgagaacaacccagatcttgctggtgataggcggagaaccgttatgaggccacctcaagttcttagggagggaacaaagaagacagtttttgttaattttatggatttgtgtaaaacgatgcataggcaacctgagcatgtaatgatgtttttacttgccgaaatgggaacaagtgggtcacttgatgggcagcaaaggttggtgatcaagggaagatttgctcctaaaaactttgaagcaatcctgaggagatacatcaatgagtatgtcatctgcaatggatgcaagagccctgatactattttgtccaaggaaaatcgtctgttcttccttcgctgcgaacagtgtggatcttcacggtccgttgcaccaatcaaagctggattcgttgcgcaagttggtcggcggaaggcctaagcgcaaaccaaattggtcctttgcgctgcctgctctgttttggtcgtgtatttcttgtttttttttcgtgtcatgttaatgcagctgaggttcggtttatgattgtcctatctctgtgtggctgaaatttgaggccataccaattcgacaatattagattattttgccggatggacattctgccgtgcaatgttgagagcaagatgtgtcaacagttacattttgtcttgcattcaaaagatccatcgaatgatggcgcagtcctgtggcggctggcgagtgtcactc

SEQ ID NO: 21341 - DNA, 647 bp, Zea mays
  misc_feature (44)..(44): n is a, c, g, or t
  misc_feature (552)..(552): n is a, c, g, or t
ggtagacgtttttccgttgcattaccgagacgatctccgaggantatatagaaatggaaaagataaggcgaacgatgtccacctagaaaccctagttcgaacgcgccgccgtcaccgtcgtcgctcgcgctctccgcccggatcggagcgagagtaggggcgtgtcggcggtgaaagcgactgcgtcagccatggcggacgaggagcattcggagaggagagaggaggcctccgagcttgcccccttcgacccgaccaagaagaagaaaaagaagaaggttgtcatccaagaaccttctgatgaagtggacaagcttgcagagaagacagaaacactggcagtcgcagaacccgctgaacttaacttcactggaatgaagaagaaaaagaagaagccggtggatcttgattcaactcttgatgagcttggagatggggaggacactcaagatgatcaagctgcagaggacaagagtggtgtgcaaaaagccgggttcattgtgattagctacgaagaataaactagagtcatcggaattccattcgattcanaaaaaaaaaaaaaaaaaaaaaaaaaaaaaaaaaaaaaaaaaaaaaaaaaaaaaaaaaaaaaaaaaaaaaaaaaaaaaaaaaaaaagggggcggcc

SEQ ID NO: 21342 - DNA, 2704 bp, Zea mays
  misc_feature (1698)..(1698): n is a, c, g, or t
aatatagaaatggaaaagataaggcgaacgatgtccacctagaaaccctagttcgaacgcgccgccgtcaccgtcgtcgctcgcgctctccgcccggatcggagcgagagtaggggcgtgtcggcggtgaaagcgactgcgtcagccatggcggacgaggagcattcggagaggagagaggaggcctccgagcttgcccccttcgacccgaccaagaagaagaaaaagaagaaggttgtcatccaagaaccttctgatgaagtggacaagcttgcagagaagacagaaacactggcagtcgcagaacccgctgaacttaacttcactggaatgaagaagaaaaagaagaagccggtggatcttgattcaactcttgatgagcttggagatggggaggacactcaagatgatcaagctgtagaggaacaaggggaaggcattgtgctgggaagtgtccctacatacccttgggagggaactgatcgggattataaatatgaagagctgctggacagggtgttcaacattctacgtgagaacaacccagatcttgctggggataggcgtaggaccgttatgaggccaccacaagttcttagggagggaacaaagaagacagtttttgttaactttatggatttgtgtaaaacgatgcataggcaacctgagcatgtgatgatgtttttacttgctgaaatgggaacaagcgggtcacttgatgggcagcaaaggttggtgatcaaaggaagatttgcccccaaaaactttgaagcaatcctgaggagatacatcaatgagtacgtcatctgcaatggatgcaagagccctgataccattctgtccaaggaaaatcgtctgttcttccttcgctgcgaacagtgtggatcttcaaggtccgttgctccaatcaaagctggattcgttgctcaagtcggtcgtcggaaggcatgagcatctatatgtggatggtgttggggtcaataccaactcaacaatagttgattatttgttgactagagattctgcggcgcaatgttgagcaagatatatcaacgatgccctttgtctgcattcaaaggattcatctattgatgtcacaagcctatgaaaactggcgagtgtgaatcctgatctacgactccctgcgatcataatcctgtgactgctggttagtgtcaaatgcagtctgttaaacttcttgatgcggtcactaatacaagttcatcaaagttttgtccgaatgccataattctgtcataaaatttactttctctgtaatacacaatgaatctaagtgtttacttcattattcgatccttggaattcagctgattcattcaaacaaacattctctttagcttcaaaagcatccaccaattaaagctgccatccgtatcatttaacaagtaaattgtgtgaaactgcaaattaataaactcattcaaaattttcatttgacgcgtgcataactgaggaaacctcctcttaatctgctaatcagtcgccgataaaatattatagaagattcggattatatgtgtttttctttctcttagttagtctttggttgcacggtcttacgtagtgaaccgggctgcatgtttggtttaattcagatggaaccgagccatttcaacagtgaaatattttttttttaatatgctgcatctttggttccctaaaaacgaccaaacatgngtgctcccgagtccaacactcttatcgtttttgttagtagccttctcttttgtttcaactaggctccaaacactatcttaataacacactagtacacactagtataatgcttatatgttgcgaccatacacaatcatattggatacctgccaacagtgtcacggacgagagcctagtaagccgctgtagcgcctgatatgagcctcgtggagaagcaatctgtagcgtctggtatgagcctcgtggagaagcaatgactagtccgcctggtatgagcctcgtggagaagcaatggctagtccacggtgctcgtactttagcgcttggtactaagacctcgactcgaggcattttctgtaccccttcttaccctgaaacttatcccttataacttgaatttcgtgagtcggaccttggaaagtttttgaataaacaaggggaatttgtagatcctccaaacgtagagcgtgaaaggctttgaaaccaaatacgttatccactatggaagtaaacatgttacagtgaattcaagatttataatgtttcagactcaacgtttatactttcagtctttggtggcatacgctatcggcacataattgtttgtaataggggttataagcgggcgagagatagaagggtcccaagtctctaaggattgttctgctagagggcctacatatcgaatgttggctctcgagttcgtctctcttctttcaatccgaccccctcccccgcattttatagcctaaggatggggtggttataaatgactttttctcagaaggatttgttgtgctgtaaaacaaaatagtttcccctggataaaccccttatgtgtcgttattagtcttgtataactctccatcgtgcctcctcaggactgctagtgaagcgtgccgatgacttgagtctgagcgtcatcattatttcgcctgtgtgcctctacccacgtcgacccttggtctaagggcatgtacagtggagagacaccaaaaacggttct

SEQ ID NO: 21343 - DNA, 1462 bp, Zea mays
attccacggtttgtaacatgtcctgagcaagtcaacaacaaaaacaaactggatcgctgccgttggcgccgccaccgccgatgtagggtggagcactcagcgtgccgtcgtcgcatgcggcctcgaaacatttacgtctgccggtgctgggaaggaaggggatcgaggggcagcagacagcagagagacgacagccaccaaggcaattccaactttttaaggtacttttccaagaccgatgtactgcgtccgatctaaatcaatggctcaggttgacactgagaggaggaaaagataagaggaaaggatctccaccgagaaaaccctaattcgaacaaccgcgccgccgtctctcgctcactcgctcgcgctctccatccagatcggagcgctcggttcggataggggcgactaggaggtgaaggcgggcgcgtcagccatggcggacgaggagcacccggagaggagggaggaggcctccgagcttgccccctttgatccaaccaagaagaagaagaagaagaaggttgtcatccaagagccttctgatgaagtggacaaggttgcagagaagacagaatcactagcagtcgcagaacctgctgaacttaacttcactggaatgaagaagaaaaagaagaagcaggtggatcttgattcatctattgatgaccttggagatggggaggacactcaaggtgatcaagttgtagaggaacaaggggacggtattgtgcttggaggtggccctacatatccttgggaaggaactgaccgggattataaatacgaagagctgctggacagggtgttcaacattcttcgtgagaacaacccagatcttgctggtgataggcggagaaccgttatgaggccacctcaagttcttagggagggaacaaagaagacagtttttgttaattttatggatttgtgtaaaacgatgcataggcaacctgagcatgtaatgatgtttttacttgctgaaatgggaacaagtgggtcacttgatgggcagcaaaggttggtgatcaagggaagatttgctcctaaaaactttgaagcaatcctgaggagatacatcaatgagtatgtcatctgcaatggatgcaagagccctgatactattttgtccaaggaaaatcgtctgttcttccttcgctgcgaacagtgtggatcttcacggtccgttgcaccaatcaaagctggattcgttgcgcaagttggtcgccggaaggcctgagggtcctttgcgctgcctgctctgttttggtcgtgtatttcttgttttttttttcgtgtcatgttaatgcagctgaggttcggtttatgattgtcctatctctgtgtggctgaaatttgaggccataccaattcgacaatattagattattttgccggatggacattctgctgtgcaatgttgagagcaagatgtgtcaacacttaaaaaaaaaaaaaa

SEQ ID NO: 21344 - DNA, 676 bp, Zea mays
gaaggatgttcaccgagaaaccctagttcgaacgcgccgccatcaccgtcgtctctcgctcgttccctcgcgctctccgctcggatcggagcgagagtaggggcgtgtcggcggtgaaagcgaccgcgtcagccatggcggacgaggagcattcggagaggagagaggaggcctccgagcttgcccccttcgacccgaccaagaagaagaaaaagaagaaggttgtcatccaagaaccttctgatgaagtggacaagcttgcagagaagacagaaacactggcagtcgcagaacccgctgaacttaacttcactggaatgaagaagaaaaagaagaagccggtggatcttgattcaactcttgatgagcttggagatggggaggacactcaagatgatcaagctgtagaggaacaaggggaaggcattgtgctgggaagtgtccctacatacccttgggagggaactgatcgggattataaatatgaagagctgctggacagggtgttcaacattctacgtgagaacaacccagatcttgctggggataggcgtaggaccgttatgaggccaccacaagttcttagggagggaacttagtagacagcgtttgataactttatggatttgtgtaaaacgatgcatatgctacctgaacatgtgattgatgtttttac

SEQ ID NO: 21345 - DNA, 5967 bp, Zea mays
  misc_feature (5819)..(5819): n is a, c, g, or t
gcgccgcgcgcagggagcaggacgcgacgccaggagaggcgaacgagaccgagagaaaatggcgccccccactgccactgccaccagcgcggtggacgccatggacgcgctacgcctgagggcttccgacttgggtttcgagcgaggcaaagttaagatgtggcagagccgcagagggccggccggaggggataagcgcggccgcggagcggattgcctcaaacggacctcggattttgggcctcgctttagctttgcggccgattcgtggcacgtatctcatccagcggcccatttgactgcccagaagtgcagccgtctcgtgaaggcgtatactagaaagtacgcttcttccacgtcggaggcgtcaacatctaagctgaaaggctgaaagactctgaataacctgagcgggtgagcatgaaccttgaagcatgcgtgaagacaacaaaaacctgcactgcgcatattattgtaagaaagaagaagcatctccggatcctcccgtcgaatattcatgtcagacgaagacccaatcataaaccgtgactattggaaacgtactataatattatatcctttttatttgtccggaataacgcaggcagagagaggcaagcacgcgcgtgacgaccacccctgaacccgtcagcgacaccgtcaaagatctgaaagcaagttgcagtttggcactccggcgacgccatgaaggggggtttaaagaaatgcgggcccctctgttctgaggtcaggcgacgggtgcggtcgccatcgccggggggcgatgccgcgtccgcgtgcgcgccggcggcagaatccgcccttgcgcctggacaggagctattgggcctacggctgctgcaaagattggcgagacacaggcagccagggatgtatctggacggactgacgacggagatctcggttgattgtcctggtcaaacactctttgtttctgtaaatggaagttggataggaaacacaaaggtcagtgtcagtgaaaaccatatgcaaattcgtgtgaatccatcaccatgccccttcttcaggccctttttggtggttgatccctgatcggaggggattggattcattggggaaaaaacaaggtttgtttggtgatcagagaattgaagtgggaaaattctcttgctattcaattatctggtaagaagatttcttcacatggatcccctccaattttctggtcattcagttggtttagagaaaaggtagagaaggtacagtttttgccgtgttaactagccagtaaattcgtgtttgactgctgcagctagaggagcatgacgaaacacaacctttttttccagatgttttgttttttgattggatgggaaaaaaattcgtttgtgagatttgcagtttcgcaagaaattcgaaaaggaaccgttgtcaggatcagcagaagcttccaaagcaacactttttttcctgtaaaaactatgtcaacaattaaacatgacgagaggagccagtttaccttaccagtaatacagagacatgatttggcgagaggtccatgttagggaagggaggctccaaaccggcgcttttcagccttgcgtcagtgttttatatatatgattcaaatatgtcgctgtaatgccgagtaaatctatgggcacttattagactggccatccacttcctccaattgctgcatcatgttagatgctgtcagtgtcaaaacacctaggaccaagctgctgcaaattaatccttggactaggaattctgagacgtgttgttgaattcaagcagtgtactgcttttctgttcatacatacacctaatataggccgcttgtgcgtgttcattggcgcgaaagtggccaaattcttcactggccgatttttccactgatgagacaaaatgaggagaacggaatctttgcctccgatgaagggaaagatacctgccatcactttgtttagtcccagctagctagtgccacactcaactagtacatgtcttctgtgcttgaactcttctgccaggcactactttttgtaaggttatttggtgctttaggtgggattctattttatattatctcatatgtttcattgcttctgttgcttgaatttcaagcgattgtccttagtagccctgctactgcaacactactaaagacagcttcttgtgactcccgttatcaatctggtcaatcgttgcaccaggagaggggagggtgagctgagaggggtttcatggagatggagggcagaggcctgtctgatttgttcaggaacaccagcgaggagatcttcctcaaggcagtgatggagaactcgatgggagtagcagcagcgccaagcatggagatgctggggttcaagaacacgtcgcgaagtctcagagaagacagcgaggagctgttcaacaactggcttatgaatggagagatccctggatttgggtcagtgaacaatcaccctcgacaaccatctaggttgtcatcagaagccgcaggccttccgaatcaacagcatgacattgctcaacaaagttttctcactgacaacttggttccacagaatttaacaattccttctgtcgaatatccaaataaccacaaccagcaatcactcaaaaatgcagcagagaagggaatgcaagccagtgacctacttctagcaaaagcctggttccacagcactcaaccaatgactagaagtcgttcgtcagagttaaggaggaggtatgctgcgatgcaaactaatatggcaccaataacaataggaagcattgaaacacctaaccaattaaaacaagattttacaaacacaacaaacatcacaccaatgagcaacacacttgttcatacaccaaagtttgtatctccttcaagttcatcaacatcccctctggataatccacatgtggcagcacaagatactgttacctcagtggtgagcatgctcaaggacacacttgagcgcaagaagcttggtagccatgctaacaaagacacctcagcaggcaattcttttggattctatgacactcagcagtttcaacaaaacattcttggaggaacagatttctttcccatagtgacaactgcccaagttcaggattccctgatgcttcccaaggttgacaggcccatggaaccaaacaatggtaacttcgttgctcctgcaaaccaggtttggttcagtgcagcttctcgagagccttcacacagtggatcgtctactgctatgactactcattcagctggatttgaaatgtgtgatgagctacctcctgcagcgcaagcgatgagtgtttgtgagagcaccagaaaaaatgctgcaaatggaacaaccgactgcaaatcaaaaggcaaagagtatagagagagggtacaaaaggataatttgaaagatgggaggaagaaagcagccctaactcgaataggatccatttcatctgaacaagcagctgataatggagatcctacaaagaagcgcagggttgagcgctcacgcaaaatggcagaagcaaaggaaagaagttccacaccagtaataccatctgatatgcaagccgtacttaaacgctgtgaaaccctagagaaggaggtccgatcactaaaacttaacctgtctttcatgaacaggaaagattcagaacagaccaagcagatcgaggagcttcagaagcaaaacgaggatttggccgaagagaaggagcggctggtggaagagatcgaaaggattgtctctgaccccaacacatgaccgcccaatcatttctgacatttttttatatactaatagaattagacttgaaatggtcctagatacaaatacacatacacaatccagcagggggcagcaagaattaagtgctggcctaaatgtaccattctttccttgttttcacaagtgtaacgtatacgaatatcaacaagcaaagggatcagggattacagtttatttcctgcagcaaaaaaatgttggcctcatgggtatcaatcagaacatgcgtgtgatatgaatgtggagtatgtgtgttatgtgtatctagttgcaaccaataatttctgttcttgtcttacgggtaatcgttatttcagtagtagatttgaacaaaactcagcagtcttaattagattgaaaatcgcaaagcgaagacacctacggtttttccctaaagaccatcttaaaaaaaggaaaagaagagactggaaaaaaaaacaatctccttggtccttgctgactccatcggtcactccaatgcgatgcgagcccatcaaccttttcgctcaccagcagccgctgctgcggccgcaatggccactcgttccagttctttggcgtcggccagccacggccgccgcctcaacgccgccgtatcttcaacgtcaccggcggcatccgacgaggtgccatcgaaggtgccgtcgaacggcgcctcgcagaaggccatcgtggccacgagcctatccaccggccgcttcttcgtcttcgcggctgcggccagcctcgccggggcctcggggacgttcgttgcgcaggcgcggcctccgacagcggcacctggcgacagagcccaggcgccgtcgaacggcgcctcgcagaaggccatcatggccgcgaccctctccatcggccacttggcggccagcaacgccaacctcgacggcgcagccttgggaacgttggatgaggatgggctgttcccggcggcaagcgacgacgcagccgaggtgcggtcgaacggtgcctcgctgaaggccaccatggcaatgaggctctccatctacatcgccgctacctcgagtctgttcgattggttttggtcggggattagatgctggcggcaggcggcgtctatatatatatggacgcctcaatatcgatgtcgttcggagtccgacgcaggcagaggtgtaacggaaacagacatttggttgttgagattttcttgtagattagatgggagctgtatctccaacactttaatttctgttagtcgaggataatctccaacgctatacgcatgttttgctaccattatctgcaactctgtatgcagctatataatgcagccatcgtgacccaacacctgacactcccatcttttgggaccgttggatccaatttaggttctattactagaagtaggcggtggaaaacaagtcgaacctcggctcatcagtcaactaatgagagtcaagtaatgagtcgagctctcgcctcactcctctcgtgaacctaaaaaatcggctcgactcggctcatcgagccagcgagccgtgagccttaccacgtaaactcatcctctaaattataatataaaaattttaaaagtaatttaaacaatatatttaatcatgatctatatactagcatgtgaacattctcataaattccacaaaacagaagatgttaaattatttttcaatttccctagcatgagagtctcggttaagtagttaatgattcaagcacgagaaataaggcaggcccaaaaatgtgacatgttcataaaatttgaaggatcaacattgagacaaccatcaatccaattccatcaagatataaccctcatctctcccccgcgacccgtcgcctccagcttccccctcccttcgtatcatcgtcgtcgctgtcaatccttcctctccttttcttcgagatcatagtgttagtacgaactatatactagtaatattgaataataaatatggaaccaaaaccaacgaacaagtgccagaataatgccaaaactagtagaggtatgtgttgtaaacttctatttagtaaaatttgatataaaataattagacgctcatcaaccatttntagtttttttaactgttaacggagggaggggctcccacatgaatttcaatgattcaatgacttcatttttaaggaaacgacggaaaaccttttcatatttgtggcaggccacagattataggcagttgcaagcacatcacagcaagta

SEQ ID NO: 21346 - DNA, 808 bp, Zea mays
  misc_feature (38)..(38): n is a, c, g, or t
  misc_feature (76)..(76): n is a, c, g, or t
gatcacaggaaaaagtcccgctcgacaaggaaagctgncggtacttaattattgtgcacatgtgcatgcatgatanctaaacactatactactaattagcaagcattgttttgtacatacatagtacgacgaggacgacgtacgagcagctggctggctggctggccggctggctagctacccggcggctcgctagcacagcacgtccttgaggagcttgtaccggcggggcctccggccgccctcggcgtgctcgctgccgccggtgaccttgctgcacccgccgctgggcgggaacgacgacgacgctggctgatgctgcgcgctcctcctccagcctgctgctgctgctgcttcttcttcttcttccgcctgccggtgcggctgcttgccgccgcatgccgccgccgccgccgccgacgccgaagagtgctgccgcttcttcgtcccgccgccgacgtcgtcgcggaggcaccagtcgcacacgccggcgcccgccagctgggccggggccgcgtcgccgtagtagttggtgcagtaggagtgctggaagcggcggcggcagcgcgcgcagcggaagagcttgtcggggaacccgacatcgccgcacatggagcacacggcggtggtagtggtactgccggccatcgatatcggcgcggcgcgcggacgggggcgcgggtgtcctagctagctagctcgtgtggaccggtggactggaatggaggaagggattcgttcgctcgcgcggtggcagccagcgcaggattgagatcgagcggcaaaaactcaagccgccggtcggatc

SEQ ID NO: 21347 - DNA, 1865 bp, Zea mays
  misc_feature (1250)..(1250): n is a, c, g, or t
aaacaactcctgattgctaacacattcaatagtatattataccatgcaatatgatttcctcgtatcacagagacaaagacatcctataataatctctattggttacattgcaacaccgtgcaataaaactatgatagactatttcgtgaggatgcaaggttgcaataatgctatcgattcgatacatctctcgttacatgtcatgtcagatatcgaggataagttctgcggccacaaaactcaaaatcatgaaggccttgtttagatgttgtcggattcaccttaatctacatatgtcggatgaattggggtagaatttagttcaagcttcactgtcttcaatccactccaacagatatgaattgatgtgaatctgactacattcgaagaaggccaaaactggagatctatatcccgactattctgaaatcactctatttcttcagtaggcaatccttgaaccccttatccagctcttctttattgaggttcctgccgatgaagacaatcttgttgatgcgcggctcatttggctcccacattctctcaggagatccctggaaaatgtcatggactccctgaaagacaaatcgctgcggcattccactgacagaaagcagacctttcatcctgtatatatcctcgctgtgttccagcagtaggttccccaaccacatgtcagccttttcaagatccatctccccttcgcaaacaatgctcacagaagaaacaccaggatcatgagtgtggtcatgtgcatgatgatcatgatcatgatcatgatggtgatgatggtcatggtcgtgttcattctcatgctcatgctcatgctcatggtgttcatgatcatgctctgcgtgatcttcatgtgacttttcagcaacagcactctcaatcctctccagatcaaatcctccaattccaagaacatagtccaaatcaactttaccatactcagctcgcttcaaattagccatgtggttgataccccttatacgctcaaccaaggacaacacttcaggttctttgacaagatcaatcttgttaactataattctgtcagcataggcaatttgctgaactgcttcattgactatacccttgggctttacttcatccagatgctgtctagcatgctttgcgtcaactaaagttacaacaccgtccagcttgacatcattaaaaactacatcctctgcatagaatgtttgtataatgggtgctggattcgctagacctgtggtttcaantaacaatatgatcgaacttccccttcttcttgttcaccaattcaccagtcatacggactaaatcaccacgcacagtgcagcaaaggcagccgttatttagcatcattatgtcctcagctccagcggtttgtgcagcgactagtgagccatcaatgtctacttctccaaacccattttcaataacagcaattcgctttccatggtgagcagtcaagatgtgattcagtaaagttgtcttgccagagccgaggaagccggtgatgatggtggcggggatgcgattgtcgggcgggatcagcgtctccacccccgagcactcctccgcctccgccgcggacgccgcaaagcgccgtcgcgcccgccacgacggcgccggcgccggcgcgtgggagcaggagcgcttggcggagcgcaggcgcaggcgcaggcggaggaaggacgcgaccacgcgcgcgggcgacccgagggacgccgccgcggagatggccggggaggcggagcagagcgccgccatggcgcgcgtgcggctgcgctgcgcgaggagggtcgagggtgagtgagagcccgaggccgagaaggggggcgagcggatatttcccccggccggcctcgagg

SEQ ID NO: 21348 - DNA, 1098 bp, Zea mays
tttttttttttttttttgggactggaagggcacacgttccaaaatgtttatttagcaaggatacaatatgtcaacacaaataacacaaaaaaaataagaccaaagaaaggaacctctccagatcaaatcctccaattccaagaacatagtccaaatcaactttaccatactcagctcgcttcaaattagccatgtggttgataccccttatacgctcaaccaaggacaacacttcaggttctttgacaagatcaatcttgttaactataattctgtcagcataggcaatttgctgaactgcttcattgactatacccttgggctttacttcatccaaatgctgtctagcatgctttgcgtcaactaaagtaacaacaccgtccagcttgacatcattaaaaactacatcctctgcatagaatgtttgtataatgggtgctggattcgctagacctgtggtttcaataacaatatgatcaaacctccccttcttcttgttcaccaattcaccaatcatacggactaaatcaccacgcacagtgcaacaaaggcagccgttatttagcatcattatgtcctcagctccagcggtttgtgcagcgactagtgagccatcaatgtctacttctccaaactcattttcaataacagcaattcgctttccatggtgggcagtcaagatgtgattcagtaaagttgtcttgccagagccgaggaagccggtgatgatggtggcggggatgcgattgtcgggcgggatcagcgtctccacccccgagcactcctcggcctccgccgcggacgccgcgaagcgccgtcgcgcccgccacgacggcgccggcgcgtgggagcaggagcgcttggcggcgcgcaggcgcaggcgcaggcggaggaaggacgcgaccgcgcgcgcgggcgacccgagggacgccgccgcggtgatggccggggaggcggagcagagcgccgccatggcgcgcgcgtgcggctgcgcgaggagggtcgagggtgagtgagtgcccgaggccgagaaggggggggcgagcggatatttcggcaaagacaaagacctcccggccggcttcgaggtacccaatg

SEQ ID NO: 21349 - DNA, 720 bp, Zea mays
tttttttttttttttttttgaccaaactgaccagatttcatgttgaacagtgatcctaaatatgagccccaaacagatggattacctgagcatggaactaattatcggaccaggaatttagaaaggggtatacactatctgctttccttgctatctgcatggctctgcatccatttggcccgacccttttgttcagatccggttgtggatggattccaagctatctccaccaaaagcacctcttgcgcagcaacatcttttctccggccttagattaggactaatggttgtatgcattatttgccatcaatgtcagaaaccgatcccagcaaccgtttatcaaatctttcagcttccatctccagcaacctagcagcttcatccatcccgtgtgcagtgtatgcctgaatcatggtggcataagttattctgtcaggcttgcacctcttctccttcataagctgcagcatctcctccatgattttgatatccccagacttggcatatgcgcttatcacacagttaaagaatggtgtgtccaagacaacattagtgttctcggtctgtcgaatgacccccgcaaccttatcaagaagcccggctttgctgtacccgttaaccagcgagcagtaggtgatggggttgggtttcacaccctgaattttcacgggcgcgtgaaagacctccatcttttcgatgtcgccagcacgtccgaaacac

SEQ ID NO: 21350 - DNA, 2123 bp, Zea mays
cgaggccgctgattgcctccatttctgtgggactcgtcggattcactcaccatcgatccattgttttcgtctcttgcggccttgccccacccataaagccgatgggttagctcccccgcaccgcacgcccaagaacaaagaggagccgacgccacggcgacggtcgtcctctcccggccagcaccgtcgcggactgcgttgcatccgtgcctttgcttctctcttcaccccgcgtctctctctcttggcgacgactgggggaccactgccgccgctcaacgccagttttgtgatcggtgaaaatggctgctgctgaagcaagggctgcttggcaacgtgctgcaaaccgttgtctggttcaggaggacaggaagagagctccaaaactagcttgctgtccatcatcggctgaacaacatggtacaaacaatgggaactgtcgaaattctgtagatcgtcctatctgcagtttaatgcctttgagctgcaatcccatgcattctaatctgccaccagatgtcagatggtgggttcagtcacagccaaattttgggatccagaaggatattgttagcaagcggttatgttcgttgggcagggacattcatgagaagcaagtggaagattcagtgccacaacctaaacatgaggaaacattactctgtcaagcagttgacaccagcactgaaaagattggagatgctttggagcctccatggatggtttcgccagccttcacgaagtattcccttgaaacaggcttagaagagatgaagactgttggtagctattctcaagtgtcgaagtgcatagaaactctcagcaattgtttgtacaaggataatgaattcccagattttgaatgtattgacccagcacctttgaagaacccagataaggctaattttgacatagatgcaccttggaaaggtgaaaagactcgaccatggtggcagattgctgacgaggaccagctggcttcactggttgcagaaagagcaacacagcacattgagaattgtgacctaccaaggcctacccagacagtacgcattaacaggacagaaccatatactcaaaaacatataggtgactttgggggaccttcatctcctgcaggaagagtgtcacaccctgttcctggacattgtgaccatatcgagtgtacctatagcacaggaagtacagatgagttggttctgttatatggtaatggagtttgggaacagcatggaagcagtgatacatatagtgtggttcaacatttttctagcagtagcacaaccggattggaaagcaaacaaacactccagaatggctctgagcgagacatgattttggaggcactccgccattcacaaactcgtgctagagaagctgatatggcggctaagaaggcgtacaatgagaaggacgacgtcatcaagcttttgctccgacaggcctcacatctctttgcgtgcaaccagtggctgaaaataatgcagctggagaatattgtcctgcagctcaagaacaaagagcatcagatagcagccatcatacctgaacttccatggttaaccctaaaagagaagcctacacagggtcaggggcagagagattggactaggaggaaaggtagaaggcagaagaaggcagccgggttcttcgacgcgatcttatttgctgttgggttgggtcttgctggagctgggtttcttcttggctggactcttgggtggcttctgccgaagttttaaagttgttggttatttttattttggggtacccagctaggcatgtattttgctgtgtaggatccagagggaaggccaagtgcactctgtgaaaatggtgtcaaatgatcaaatttgttagaccctagcatctgttcatttggaaacaatgatggcgcaatgagtaaatgaatggctgtccgcattccaccaaaaaaaaaaaaaaaaaacattctgtttgttgtaaatatgtgtggtgaactgtattactttgatctgttaggttgtgtgaggtacctagatcaagctttataaaaaatgaggctgaggagaatatgtacctagatcaagctttataaaaaatgaggctgaggagaagagtctacgggctcggctatgagcagt

SEQ ID NO: 21351 - DNA, 1914 bp, Zea mays
accatccatccattgttttcgtctcttgcggccttgccccacccataaagccgatgggttagctcccccgcaccgcacgcccaagaacaaagaggagccgacgccacggcgacggtcgtcctctcccggccagcaccgtcgcggactgcgttgcatccgtgcctttgcttctctcttcaccccgcgtctctctctcttggcgacgactgggggaccactgccgccgctcaacgccaggtagtcccttcgccggcgacgagcacccactagttttgtgatcggtgaaaatggctgctgctgaagcaagggctgcttggcaacgtgctgcaaaccgttgcctggttcaggaggacaggaagagagctccaaaactagcttgctgtccatcatcggctgaacaacatggtacaaacaatgggaactgtcgaaattctgtagatcgtcctatctgcagtttaatgcctttgagctgcaatcccatgcattctaatctgccaccagatgtcagatggtgggttcagtcacagccaaattttgggatccagaaggatattgttagcaagcggttatgttcgttgggcagggacattcatgagaagcaagtggaagattcagtgccacaacctaaacatgaggaaacattactctgtcaagcagttgacaccagcactgaaaagattggagatgctttggagcctccatggatggtttcgccagccttcacgaagtattcccttgaaacaggcttagaagagatgaagactgttggtagctattctcaagtgtcgaagtgcatagaaactctcagcaattgtttgtacaaggataatgaattcccagattttgaatgtattgacccagcacctttgaagaacccagataaggctaattttgacatagatgcaccttggaaaggtgaaaagactcgaccatggtggcagattgctgacgaggaccagctggcttcactggttgcagaaagagcaacacagcacattgagaattgtgacctaccaaggcctacccagacagtacgcattaacaggacagaaccatatactcaaaaacatataggtgactttgggggaccttcatctcctgcaggaagagtgtcacaccctgttcctggacattgtgaccatatcgagtgtacctatagcacaggaagtacagatgagttggttctgttatatggtaatggagtttgggaacagcatggaagcagtgatacatataggtgtgcgttcttcagcttagctgcattaccctcacgacattaggtgtacttttttcgaactgtatctcaacttgcagcttattttgtttccttttatgtatgggtatatgaggtattcaagatttcatcaacagcatattacaagtataattagcattcaaggagaaaataaagcttgataacttcggttctgttggtgggatatgcagtctaatttaatattggttttttgttgttcaacaattatcaagccttagtaaattttacatgtctattgtcagcaagagggtacacagttcacatatatactatatgcatcctttcttgaagactttcaaatgtcttcctttttttcataattttgtttagtatccttgtcacatactcattcatctcagtttcatcatgtgcagtgcggttcaacatttttctagcagtagcacaaccggattggaaagcaaacaaacactccggaatggctctgagcgagacatgattttggaggcactccgccattcacaaactcgtgctagagaagctgatatggcggctaagaaggcgtacaatgagaaggacgacgtcatcaagcttttgctccgacaggcctcacatctctttgcgtgcaaccagtggctgaaaataatgcagctggagaatattgtcctgcaggcagcaag

SEQ ID NO: 21352 - DNA, 2520 bp, Zea mays
cgtcctaattgtagaaccaaagtcacatctcatatactcgattttggtcctgctaattctaaatcgttttgactctagagtctgacgctataactctagttttctatttacttctttccaggtttcatctactagaattacatcgtcaacgaaaaacatacaccaagggatatatctccttgtatatctcttgtgacctcatctatcactaaggcaaatagataagagctcaaaactgaatcttgatgtagtcctatgttaatcggaaaaatatttatatcattatcagttgttcggacgttagtcacaaccttgtcatacattttttgagtgctagaaaacccaaggcacttaaaatgcactgatacacagagaaggggcatcaagtaaagaatctatagtatggtaatttgtataaaaaagcaattagtattgagtcttacaacggaggaataacaatgaagaattactagtacattagcgaaaatcatctgataagaaaatatgggtcaaaacttgatcctgaatcacccacttggtcctcaggcttatctgatgatatgaacctctcgtgtgacaattttaccagagcgtaaagattagaaatcaacgggttcttgaggaatggtgtgatagacctttcaaggtttgcaaattcctgcaaataaactgcacagtggtcctccaattgatccagagagccagactgcgtgagcgcgtataaaccgagtaggactgcatacactgatatgaacacgtccttgtggttacctatgccgccaatccaatcgttcttcccctctttctcaatatagccaccagtcagcgatgtgagctgctttagaaatatctccctccaattctgcaggaacagtttagtctctgctcctgcttccatctggcattttgaattcagaagtttctgaatgtttgaacagcagatttgacatatcaatagcttctcctcatggtggttatcaatttctttatcaaatatctgacggaccaaatcgccacgggagttcagagcgtttccagtgcccaagactatccttaacaagaattcaacgtatttcagccagaggccaaacaaagaagttaaatagtccaagcttaattcaatgactctatcaacttgtagtggtgtggaatcatcacagaaggtattagctgaacccttagcgattattttctgaatatccttcgcaagtttttgcctcagatatgcatcctcatcctccagcaactgaatacatacaaaccacaagtcaagtatcttgcatgtataaagactaacaaattcaaaaacgctatcttccatgcatttctctttggtatggtcttcatcaaattctgaaggagagtacatgttggacacagatgaagcaacgtagcttgcttcttcaagaagaccagaagcaacaattgcctcagcagcagcccgtcgagcattcatgctttctgatggttcactttggttcttgacaagtgtgacaaacaagtttaatctaagcatggcatcagataatccatccccttcattgattctgacaaaggatgcagagatctcactggtcttaagacaatccattgaaataccacccctagattgtttagtgaacaatttcatgcacatacccatgcaacatagaactatttctctcgtttttgcatgtgacatggtgctgtttaaatgaactaacctatcccacaaggacaaaagtgtgctagaatcttctccattgttgaatgggaattccatgttccatgaaaagatgatcttcagattataataaaggcacttagggtgttcttccacaaacaaccgttccattaaagcaggctgcagattaactcctgcccactggtgcaaaatgttatctgcataaccatgtctgattgattttgtgagccaaagaatcctcttcagcaccgtaattctaacatcatatgaaggatcagtgagacatgacaggatctccttgtgtacttcatgaagggagtaatccactctaggcatctctaaagttggttcaccgagtatttgcaactgcacatcatcatcgttagtttcatcggttttcttagaaagaccaacacagctcaaaaatgattcagttgcttgttgttttagttcaatacgggttggatcatggaatgcgtactgggttgatgctgtgttgctcaagcactgggaagttaactctagcagcaatgcctgaatgacttcagtatgtctgcttttccctgtccttgcaacatcaagcatgagatccaatacccgcaagtaagatgtaattacgatagggcatgagcataatttcgtgcagccaagccaagagcatcttgaaagaacctccagtaataggccaataatctgatccttcatgctaccgtctgtcaaacctctaaagttgttatccagaagagaagccagctgcagcaaaaggccatgtattgaattgaatgacttagacagcagaagtacatttgcttttcccatattagctgatatggcag

SEQ ID NO: 21353 - DNA, 4813 bp, Zea mays
  misc_feature (238)..(238): n is a, c, g, or t
gtagatatctttttttataaatcttgtttgtttattttatattgatttgatataatcaatttaaatttggcctctaaatgttgtcttttctaacggggatagattccccattggggataaattcctcgacgatatccccacgaggacggggataagagaaaattttcccgtgaacgtttgcaggaacgaagacagagaatttttcttcgacgaggacatagatggggagtcattcatncacaagaaattctccgttgctatccctatgcctaacggtaccaggaaaggagagatgggatgatgggttatcgtctactgctggtagtggcctagcagcagggctgcaacgcaacccaacccaacccaccatggatggatggatctctgcagatacgataaggatctcgacagccagataaatagatagatgttgctgctgcaattgcaagcctctcataaactgtacggcatgtgataagtgataacctagtacaatgatgaaatatccccggccatttcagatagatagatgttggtgatgcagtatatcttgtttttccccccttcctttatgtctttagagtctataaacaatgtttggctgtacctgttcacttggccatccagtctagtacctgatcgaccagttaaaagttctgttactgttgctggatctggcacttggctataaccaacaaaactaaaagtaaaacatcatggatggatcatgtttttatttttttgagcgcgttgacaatgcagaagaaacgggtcgcggcgaacactggcactgagcatctgcttttgtttaaccctggctggctctgggctctggctgtcaacaggaggaaagcaaagcagcatgtgcgcaggcccctcgcgcctttctaccaaaagacgcggtccgccaccacctacctaatctatctcttcagtgattccattccatgctgcttcctcatccgtttcaactttcccagggtaggtcgggtgggtaccacagctgggtagaaaagccgatcgatcaggagacttcatcggtaaactagtagttatctgtcatctgaatctaataagttttagtcttagaccatccaaacagatgggctagctttcagtttaacttcaccgtacaaatgaaaccaaatttaaagttgcaagtaataattagaaggaaaaaaaaattaaattagcataatttaaaaatatttaacagcctgcgaattggaaactgttggtggctagatttgtttttattccttatactagatatattagctaagtgatgttaggatggatgtatcaaaaataactactacattctgttttcgaatatttttcgttcactagtttatttttgaaaaaaaagaagaatgagctgttgatccctttctcttgctccacggaacaaaaaagaccccttctctcttcaagctcgcctttagattcgtttgtacggcaagatacactccttggagcaagagcaaaggatccgaggagaatagaaacctggcctggatccgtcgaaccaaacacatgcacgtgaacacgatctctctctctttgagcgaggagccaccatgtttgatgcctccaccaatattccgatgccgttcttgcgtccaaagacagccatgtggtggtcgggggaatctcagatccatccaaggctccaccggtgctgcattttgcttttttgcttctttcttataaaaacaattgagagtgaggggatgcaaatgtgttcaacctatacttatatcgagctgcataattaaaaaaacttaagctcatgaaaacaggtgaacaatttaattatattttctttaagatagagagatagagtaaaattaagcctactttggaacgcagaaaaaatataagataataccttattaatagaaatatcaaatacttgctaccaatatgttaggtcggaaacagctcggtttcgtatactgtatcgagattgcagaagctgggcgacttcaatgataatcataaataaaaaaaaagaagaagaagcatttccaggcatctttgaagcaggagcgtgatcggggatggactggagagaatctttgtagctcgggcaacgtgacgtcgcgttgcccctttgagccagagaggggacgaggagaatctctctatctccctgcagtctgcgtctccttgccgtgtcctttcagcgatggcgaaaacaaaatcccacggagatctcgttctgacccggactgcacgcacctctggcccacttacacacatggaatccttatcccttcgccaataattccttccttccaaccgctctacggcagcagacggaatcttttggttgctagatgcctgatccaccgccacgtggacgactcagatcactcacagtaaaaaaaaaaagattatctttttttattccctgtttaccgccacacatgtcgtctactcgacacttggcttgcctcgaccgtccaccaaccgttcccgaactcgggcgcctctttctttctggctgcctgcctgcctgttacgcgacgaaacgcccctgctcggctcccctcgtctccgcccacccaccgcgtccagcagccagagacgcaggcagaacccgagcggcatcttttctccacctcccacgcgccaaatgacccttctgccctcccgggatctccatcttctccccccttccccttccggtataaacccaccgacgacgcgacgggactcccccctccctccctccctccgcccgttcgttccccaacagcacagcacgaagacactagacagcagccgccgccgccgccgccttcgcccgcgtaaccgggacagcgtacgcgcacggtggatcgcacggtgtgccggcgatgatggcggggaacgaggaccagctgcgggcggtggcggcgcgggccgtcaccgactcgctgcgcgcggccgcgtcccgctgctcggccgccgaccgcgccgcgcgcttccgggactgcgtccgcagcctcgaggccgagaaggccaagatggaggtcttccgccgggagctccccatcagcgtccacctcgtcgccgacggtacgcgcttgcttctccccagtccccccaacgcctacgcgcgcgccgtgaccgacagctgtccgttcctcatcgcctcccttcttccctcgccgtgcagtgatcgactggctcaaggaggagctcgcgcagcaccgccgccgcccgtcggacctcttcgcgccaccagcgccgccgccgccggcaaaggacggagccgtcttggcggacgcggacgccaacgacaagcgcagctggatgagctccgtgcagctctggagctgcggtagccacgacgacagcaccgccaacaccaacggcgccgccgccgccgcccacaaggtacggagcgcgggcgtgagtcgccagaactagacgtcccgtttttaaaaaaaaaagaggataaaacaaaacgaattgttttcgcgtagcataattcgcggctaataaacaacctgctctgcccgaatcccttccataaataacaccaggtgtccagcgcgttcgtggcactggccgccagcccgccggcgccgacgctggcgaggccatccggcgacgcggcgggtaagcccggagccagcgccagcgccatgccggtcgcggacctgtccctctcgtccccggcggccgccgcctctccgagcgccgccagcagcgccgtcacggacgcggccggggcgcaccgccggcaacatgcgcagcagaggaaggcgaggaggtgctggtcgcccgggctgcaccgccgcttcgtcgccgccctgcagcggctcggcggcgcgcaaggtaagggatccgtcggttgtccgccctgctctggggcctctggctccgccgtcgttgtagttgtagtgcgctgtgtctgtttcttgaggtggtctctccatcctcttgctgaatcgtggccgtggtgcgtgctgcagtcgccacgccgaagcagatcagagagctgatgaaggtggacgggctcaccaacgacgaggtcaagagccacctgcaggtaacgtaacgcagagagactgaaccatcttcttcttcctcctcttggttgggattgctacatacatagtacatacaattcgaggtctgcagccattcaataattttttttttttttctggcccctgctgcagaaatacaggctgcacacgcggcgcgcgtcgtcggacggcggcgaccagcacgcgggcgggctgtggtcgtcggcgccggagcagcagtacacgacgtcgcagcacagcacgtcgcagtcgcagtcgcagtccgggtcgccgcaggggccgctgcagctggcggtgtcgagcagggccatgtcggccaccgccggggacagctgcgacgccggcgacgaggcccagggcggccggtcggagagctacggctgggagatgccgcagcacgggacgaaggcgtcgtcgtcttgatgatccttgtccttggacgggatcacaattcacaacagtatagaagacggtgcggcgtggggcatggtactgaggacaactgcggaagaggcggcattttttgtacaggcgttgagatgatttcatttttcccccttccttttttttctggtagagggaggaggatgtgatggtgaagatgaactgatctggtgttgttgatcgagagtgaggcatatgagatgagatgttattttttacatcccattgtacaatctggaggctggatcgcgttgttttaacggggatggatcggttttcgcatcaacaaacccaccaaaaggccgcccgctcgcgatctagaa

SEQ ID NO: 21354 - DNA, 2143 bp, Zea mays
cgcaaaacaaaaaacatccatttctcttgtccaagaaagtcgtgttatcctaacaagggagtgcatccacccaggacccagcaatgaatcgatactacaatttccagctccattattctattgacatctattatgttacaaaaaagatcatatgctttacatgaacaaacgcaaaaccgaccccgaccctgaccccgttgtaatggaaaactgtacaatgctatgtactgaaatgcagccactgacagctgctcattggtggggaatggaggcacatctgtatttggtggcagtaacaagcccactcaaggtggcctcactctagaaaccgttaccatggtgccttcatggttcacactccgggttgagattaacatgttccgttttgcactacaaacgctgataagaatgccgtccactagggtttgcaggagctgatggtggagagggagaagaagatggcagacggaccaatgaaggttgtggtggcggtgcggtgagggcgtaagtgagtcttgatgatgagctctcaatgagcccagcaattccagcagcagaagattgtgcattggatggaaggaaaaggtcgtgcttctggtctttgtaagcactccatacatcagaggaattcaggacttcacgaactctagcacaatgtgcaccttcggttgcaaaagcatgaagcacctccacagccaaaacacgtccaattgaagcctctgattcattccacttcatttgattacagagcccctgtcttccaccaacacgccaatcaagaataccaaggagtacttcaacaagaccaaccttaagcccctgtgcaacaagagcatcacgagcccgattaccagcaccaactacacgctttaatgtctccaatgccagtatacttccaccttgccatccaattgctttcataagcagtggtacaacctgaggagttcctgcacttgttgctgccatagcttctgcacaagttgtactagacgcaagctgatgcagaacacgcaaacaactaaggcgaacacgttcttgtggagtctgtacagtggcctcggagtgagctgagttgtcatgttcgctaggttctgccttcgatgcactggtagcctgcccagatgccatagtctcccttcttccctcataagccatagccgcaacaagctttggaacataaccgaggtagccaacatggtcagcaagtgctggatgaactcgtagtaaggaaaccaatgccgcagacagtagtaaaggaagctctgggtctgtagcaattgcttcataatgcgtagcagcaacagaggagacatattgatctaggagcccttcaaggaatcttttagggtttctcagtggaaatttggggtccttaagaaaaagtctaacataaattccaccaacctgtggttcatcatccttcattacatgttgcccagatgcttgttcaggtacatcccaatcaacaacacgtcctttcatctgctcttggtacaggccccatgccattgttgcccactgtgcagaaagagaagctgccattgcgggtgtccatactagttcaggagtttccgttgtctgttcaagagaagaaacaacagcttcaccaggtccatctttaatggcagaaaccaacccttcaggcaggaaccctggcaagggtgattgccacccctgggggccatgcattggttgtccaacaagtttgcccaataaagatgcagcagcagctctttgctgcatagagatttcctcttgaagtggcaacataagttcaagaatgtaaacaaccccaccatgcttggcagcagcccaggcaagctctggtgtgctggctaaagaatatagtacagctagagctccatccctgctaggaggattccagtggagtatctgaaatagctaaatgaggctcatcctttctgcaaccatagcctccaaacaaggagcatgcttagtcaacagagaaagaatacttaaacagatttgtgggatgctgctttcaggagacacatggagtgcaaggcattcaaaaagaggatccagacgctccttggtagcaaaaacagcagctaagcctggattacttccaacccgattctgaagtgatgttagcccacattggaggtttataataacttca

SEQ ID NO: 21355 - DNA, 1206 bp, Zea mays
  misc_feature (16)..(17): n is a, c, g, or t
  misc_feature (26)..(27): n is a, c, g, or t
ggcgaattggggttcnncctcgaggnnccggccaggaaaaaaattataaatactctcgcaaaaggcttagatatacgcctcaaccataaggttgtggaaattgttcgccataggaacagggtagaggttaccgtaagcagcggccaaacgtttgttgcggatgctgctgtggtcactgttccgttgggtgtcctgaaagcgaaaaccattaaattcgagccgaggctgccagagtggaaagaggaagcgatcagagaacttacggttggagttgagaacaagatcgttcttcacttcgggcaggttttctggcctaacgtggagttcctcggcgtcgtttcctctagcacctacggttgcagctatttcctcaaccttcacaaggcaacaggccaccccgtccttgtctacatgcccgccggccgccttgctcgtgacatcgagaagacgtcggacgaggctgctgcccagttcgccttttctcagctgaagaagatccttcccaatgcagctgagccgataaactacctggtgtcgcgctggggctcggacgagaacacgcttggttcgtacacgttcgatggggtgaacaaaccccgtgacctgtacgagaagctgcgcatccccgtggacaacctgttcttcgcgggagaggccacgagcgtcaagtacacgggcacggtgcacggcgccttctccacgggtgtcatggcggccgaggagtgcaagatgcgggttctggagcggttcagggagctcgacatgctggagatgtgccaccctgccatgggcgaggacagccctgtgtctgtcccgctgctcatctctcggctctaaaagcagacgagtagtagttgtgtatgggatggatcggcacctgagagtaggctgggacatcccactgattgccggagggaagcagggaggaagaagctcccctcgcttcgcttctcctcggcatgaggcatgtgcctggcgttacttgtggcgtgccaagtgccatatttccctaaacttattctgcgtgggaaccctctattatgtatgtatactgtgaatttgtgactctgtgttcaggtaacacgagttatcgtgacatcttcgtagagaaagataccgtatgtatgatgtatgtatgatatacatatgatattatgatgaaccattgtagtagtaataataataaataatacatatatgtgactg

SEQ ID NO: 21356 - DNA, 740 bp, Zea mays
cggttagtagtgttttttggcaatagcttgagctatagtaacaaaagatgatacagcctacgctgcccaaatgcagctgagccgatgaattacctggtgtcgcactggggctcggacgagaacacacttggctcctacacgttcgatggggtgaacaaaccccgcgacctgtacgagaagctgcgcatccccgtggacaacctgttcttcgcaggagaggccacgagtgtcaagtacacgggcacggtgcacggcgccttctccactggtgttatggcagccgaggagtgcaagatgcgagttctggagcggttcagggagcttgacatgctggagatgtgccaccctgccatgggcgacgaaagccctgtctctgtcccgttgctcatctctcggctctaagcagacgagcggttgtctatgggactgattggcacctgacagtacgctggacgtcccactgattgccggagggaaagctggcagtacagggagaaagaaactccccttgcttctccctcttcggcatgaggaatgtgctggcattacttgtgtggcgtttcatgttaaaacctatattgtgtattgtggccttgtgggtctgtgtgtgttcagggttatcatgtcatcttggtagaaaaggatgccccgtatgtattatgaacactagtaataataatacatatatgtaacttaactgtttggagtattgagttatttggcatgtaacacgtcagggg

SEQ ID NO: 21357 - DNA, 993 bp, Zea mays
cgattctgtgctgtttgatcatgatctggagagctatgcactctatgacactaatggacgtgaagtaccacaggagttggtagaaaagattgggaaggtgtttgagaccatactggaagagactggcaaattgagggaaggaaccaatgaagatatgtctatcgcaaaggccattgcaattgttatggatagaaatccacagttgaggcaagaagggattgctcatgaagttcttcagtggtatttgtgccgtatggagggttggtttgccactgacgcagattcaatttcactacagggctgggatcaggaggtgctgcttccaggtggccatggcctcatggttcgtggatatcgtccagttataaatactcttgcaaaaggcttagatatacgcctcaaccataaggttgtggaaattgttcgccaccggaacagggtagaggttactgtaagcagtggccaaacattcgttgcggacgcagcagtggtcactgttccgttgggtgtcctgaaagcgaaaaccatcagatttgagccgaggctgccagagtggaaagaagaggcaatcagagaactgacggttggagttgagaacaaaattgttctgcacttcggccaggttttctggcctaacgtggagttcatcggcgtcgtttcctctagcacgtatggttgcagctatttcctcaaccttcacaaggcaacaggccaccctgtccttgtttacatgcctgctggccgacttgctcgtgacattgagaagatgtcagatgaggctgctgcgcagtttgccttttctcagttgaagaagatccttcccaatgcagctgagccgatgaattacctggtgtcgcactggggctcggacgagaacacacttggctcctacacgttcgatggggtgaacaaaccccgcgacctgtacgagaagctgcgcatccccgtggacaacctgttcttcgcaggagagggcacgagtgtcaagtacac

SEQ ID NO: 21358 - DNA, 2388 bp, Zea mays
ggggcacgagaacacttgtgtgtacagactggcaaattgagggaagaaatcaatgaagatatgtctatcgcaaaagccatcgcaattgttatggctagaaatccgcacttgaggtttgaactaatctgaggggtgttctattgcgctggtcagcgcaaacgttccagtcattgtaactgtgctttctacgtgttcaatacaggcaagatgggattgctcatgaggttcttcagtggtatttgtgccgtatggagggttggtttgccaccgacgctgattcaatttcactacagggttgggatcaggtatgggttttttggtttgtcgctggccagtatacgtgcgcattatgagattactgtgccttattacatgataatgttgacgggatgtaggaggtgctgcttccaggtggccatggcctcatggttcgtgggtatcgtccggttataaatactctcgcaaaaggcttagatatacgcctcaaccataagtacgcatatctatccttttcttgttaatttggtaatcactagttgtggtttcacttccaccagccattcctagatcactgatcctgttctttgttcttcagggttgtggaaattgttcgccataggaacagggtagaggttaccgtaagcagcggccaaacgtttgttgcggatgctgctgtggtcactgttccgttgggtgtcctgaaagcgaaaaccattaaattcgagccgaggctgccagagtggaaagaggaagcgatcagagaacttacggttggagttgagaacaagatcgttcttcacttcgggcaggttttctggcctaacgtggagttcctcggcgtcgtttcctcttgcacctacggttgcagctatttcctcaaccttcacaaggcaacaggccacccagtccttgtctacatgcccgccggccgccttgctcgtgacatcgagaagacgtcggacgaggctgctgcccagttcgccttttctcagctgaagaagatccttcccaatgcagctgagccggttagtttgtcgacacagtacctagagctacgagtagtaaaagaatccttgatgtagagcatttctcctcttacagcctgtccttcccaatgcagctgagccgataaactacctggtgtcgcgctggggctcggacgagaacacgcttggttcgtacacgttcgatggggtgaacaaaccccgtgacctgtacgagaagctgcgcatccccgtggacaacctgttcttcgcgggagaggccacgagcgtcaagtacacgggcacggtgcacggcgccttctccacgggtgtcatggcggccgaggagtgcaagatgcgggttctggagcggttcagggagctcgacatgctggagatgtgccaccctgccatgggcgaggacagccctgtgtctgtcccgctgctcatctctcggctctaaaagcagacgagtagtagttgtgtatgggatggatcggcacctgagagtaggctgggacatcccactgattgccggagggaagcagggaggaagaagctcccctcgcttcgcttctcctcggcatgaggcatgtgcctggcgttacttgtggcgtgccaagtgccatatttccctaaacttattctgcgtgggaaccctctattatgtatgtatactgtgaatttgtgactgttcaggtaacacgagttatcgtgacatcttcgtagagaaagataccgtatgtatgatgtatgtatgatatacatatgatattatgatcaacaattgtagtagtagtaataataaataatacatatatgtgacttaactgtttggagtaaagagtgattgtgacatgtaacacccttacatctaagcaagtataaagcaagtagtataagagcatctccaataaattagttaaatggctcgccgagccaaatttttgctactcaacaaaaaaataactctccaacagactaaatatttgacttgccaggctatccgactctccaaattggctctatcatgagccaaatttcgttaaacacctggctagcaaaactatatatatatatatatagtatgttgagtgagatgctattatttataaaaagataaattaagagtcaaatagagtaaaaaataaagagtgtcctgaagatgctctagtgaggctataagttaggctagctccagcaagcaccgctatacggtcctgtacgccaaatttagagaaccaaacatcatgtattgcctccaacaaggaactgtaaaggttcctgtaaagtagaggatggtccttgcgcacgctatttgtggcggatggttgtgtatccgctattcgaccaacaagcgcgggcaacaacatcgcgatggagcgcatctgtacaacatattgta

SEQ ID NO: 21359 - DNA, 2028 bp, Zea mays
cgggaaaaaggccaatcaatttcatcgtatcaattacatgtttaaaaaagaatcacccgggccgagccggccctcgcggtccccaactgcccgcgttcccgtgcccgtactaaaaataaataacggactgccatctcctcgtgcactccgccaaccgccgccgccactcgccactctcacgtctcgcccatcccgccactgctgctctccagagtccaggcgacccaggctgcgcggtcgctcggtgttgttagtcccgaccgccgccggccatggcatccaacggcatcgctcccagagatgtatgtgttgttggcgttgcacgcacccctttgggtggtttccttggtgccttgtcttccttgcccgcaacaaagcttggctctatagcaattgaagctgctctgaaaagagcaaatgtggatccggccctcgtgcaggaggtctttttcggaaacgtcttgagtgctaatttgggacaagctcctgcaaggcaagccgctctgggtgcagggataccaaacactgttgtttgcaccactgttaacaaagtctgcgcatctggcatgaaagctactatgttcgccgcacagtcaattcagctgggtatcaatgatattgttgtggcaggtggcatggaaagcatgtccaatgccccaaagtacattgctgaagctaggaaagggtctcgttttggacatgacacacttgttgatgccatgcttaaggatggactttgggatgtatacaatgactgtgccatgggaatgtgtgccgaactttgtgctgacaatcatgccctcacaagagaagaccaggatgcttttgctatccaaagcaaccagcgtggaattgctgctcgtgacagtggtgcttttgcatgggagattgttccgattgaagttcctgttgggagaggaaaaccacctgtacttattgagaaagatgaaagcctggataagtttgacccagcaaaactgaagaaacttcgcccaagtttcaaggagaatggtggtaccgttacagctggaaatgcttctagtataagtgatggggcggctgcattagttttggtgagtgggcagaaggctcaagagcttggcctgcaagtccttgcaaggatcagaggatatgcagatgcagctcaagctccggaactttttacaaccaccccagcacttgcgataccaaaggctatatcaaatgctggattagagtcatcccatgttgatttttttgagattaatgaagcattttctgctgtcgcacttgcaaatcaaaagcttcttgggattccttcagaaaagattaatgtccatggaggagctgtgtctctagggcatcctcttgggtgcagcggtgctcgcattttggtcacccttcttggtgtccttagggaaaagggcggcaagatcggtgttgctggtgtctgcaacggcggaggtggagcatcagctcttgttctcgaactcgcataagaagtattggcttgaagcactggatatgtagctaattcagtcgcattcatctatacatgatgaagtattgaaaaaaaaagaccctacgatatccatgccgggtgccactgtctgcttaattcaacagaatatgattgtgcaatcattctgccgtgccgcttttgctgaccttaggaacacggcgtcggaggcgcaatcattctggcaattagcaccagctagctccctgaggggcgaccttgtactctctacattgatgtatgtgtagtgctggacattcttaagttaattcggcaataaagtgtgttgtgcttctgctacctgcatcttagataagagaaatggagcagcctctttgatcagttcaattcatctttacatcccacttggagactccggtttcaagtattttttttttgaactgaagctcgtctgcttaaactctgagcagacatgtagagcaggacatggtgcaagtcagttttgtgttactgatgcttccaaaattgccttggtcagctacttatcaccagttctcagattttctttc

SEQ ID NO: 21360 - DNA, 961 bp, Zea mays
tagcgtggtcgcggccgaggtacattgctgaagctaggaaggggtctcgttttggtcatgacacacttgttgatgccatgcttaaggatgggctttgggatgtatacaatgattgtgccatgggaatgtgtgccgagctttgtgctgacaaccatgccctcacaagagaagaccaggatgcatttgctatccaaagcaacgagcgtggaattgctgctcgtgaggagattattccggttcaagttcctgttggtagaggaaaacccccaacattaattgagagagatgaaagcctggataagtgatggagctgctgcattagttttagtgagtgggcagaaggctcaagagcttggccctcaagtccttgcaaggatcaaaggtttcgctgatgcagctcaagctccggagctttttacaaccactccagcacttgcaataccaaaggctatcgcaaatgctggattagagtcatcccatgttgatttctatgagattaatgaagccttttcggctgttgcgcttgcaaatcaaaagcttcttggaattccttcagaaaggattaatgttcatggaggagctgtatctttaggacatcctctcgggtgcagtggtgctcgcattttggttacccttattggtgttctcagggcgaagagtggcaagatcggagttgctggtgtctgcaacggtggaggcggagcatcagctcttgttctggagctcgcataagaccttgtagttagcaaaagttccctgaggtgatcttgtagtccatagaacatttcttaatttaatttggcaataaagcgaagtcgtgcttctgttggttgcatagtagagtatcatgtaataagagcaatggggatgtttcatagacccagcttagatattttcgaggatgctacagaaatattttatatatttttgatatttttaaaaaaaaaaaaaaaaaaaaaaa

SEQ ID NO: 21361 - DNA, 1696 bp, Zea mays
gcacgagaccattacctagaacatcctaatcgaaaacccagcgccccccgcgcacacacgcacacactgtcttagtgtctttctctgcctttctttccctagcgccgcgccggcgccgccattcgatcagtcttcgtcggccgcttcgccggcgacagcatactccagtcggttggttttggcacttcggaccggcggccatggcttccgacggcatcggccccagagatgtatgtgttgttggggttgcacgcaccccaatgggcggtttccttggtgccttgtctcccttgcctgctacgaaacttggctctatagtaattcaagctgctctggaaagagcaaacgtggatccagccctcgtgcaggaggtctactttggaaacgtattgagtgctaatttggggcaagctcctgcaaggcaagctgctctgggtgccgggataccaaactctgttgtttgcaccactgttaacaaagtctgtgcatctggcatgaaagctactatgtttgcagcacagtcaattcaattgggtatcaatgatattgttgtggctggtggcatggaaagcatgtccaatgccccaaagtacattgctgaagctaggaaggggtctcgttttggtcatgacacacttgttgatgccatgcttaaggatgggctttgggatgtatacaatgattgtgccatgggaatgtgtgccgagctttgtgctgacaaccatgccctcacaagagaagaccaggatgcatttgctatccaaagcaacgagcgtggaattgctgctcgtgacagtggtgcttttgcatgggagattattccggttcaagttcctgttggtagaggaaaacccccaacattaattgagagagatgaaagcctggataagtttgacccagtaaaactaaagaaacttcgcccaagtttcaaggagaatggtggtacagttacagctggaaatgcttctagtataagtgatggagctgctgcattagttttggtgagtgggcagaaggctcaagagcttggccttcaagtccttgcaaggatcaaaggttatgctgatgcagctcaagctccggagctttttacaaccactccagcacttgcaataccaaaggctatcgcaaatgctggattagagtcatcccgtgttgatttctatgagattaatgaagccttttcggctgttgcgcttgcaaatcaaaagcttcttggaattccttcagaaaagattaatgttcatggaggagctgtatctttaggacatcctctcgggtgcagtggtgctcgcattttggttacccttattggtgttctcagggcgaagagtggcaagatcggagttgctggtgtctgcaacggtggaggcggagcatcagctcttgttctggagctcgcataagaaatctagaccttgtagttcgcaaaagctccctgaggtgatcttgtagtcttattttccgttgtagtagtcccatagaacatttcttaatttaatttggcaataaagcgaagtcgtgcttctgttggttgcatagtagagtatcatgtaataagagcaatggggatgtttcatagacacagcttagatatttttgaggatgctacagaaatattttatatatttgtcatgtgtctcgtacatttatctaggtcacatcacctatcctgccgcccaaaaaaaaaaaaaaa

SEQ ID NO: 21362 - DNA, 1000 bp, Zea mays
  misc_feature (884)..(884): n is a, c, g, or t
cctgcagttccggtgcagcgctccccccttgctcttttcttcctccgcttcaacctgtccccagcgccccccgcgcacacactgtctttctctgcctttctttccctagcgccgcgccggcgccgccattcgatcaggccgcttcgccggcgacagcatattccaggtcggttggttttggcacttcggaccggcggccatggcttccgacggcatcggccccagagatgtatgtgttgttggggttgcacgcaccccaatgggcggtttccttggtgccttgtctcccttgcctgctacgaaacttggctctatagtaattcaagctgctctggaaagagcaaacgtggatccagccctcgtgcaggaggtctactttggaaacgtcttgagtgctaatttggggcaagctcctgcaaggcaagctgctctgggtgccgggataccaaactctgttgtttgcaccactgttaacaaagtctgtgcatctggcatgaaagctactatgtttgcagcacagtcaattcaattgggtatcaatgatattgttgtggctggtggcatggaaagcatgtccaatgccccaaagtacattgctgaagctaggaaggggtctcgttttggtcatgacacacttgttgatgccatgcttaaggatgggctttgggatgtatacaatgattgtgccatgggaatgtgtgccgagctttgtgctgacaaccatgccctcacaagagaagaccaggatgcatttgctatccaaagcaacgagcgtggaattgctgctcgtgacagtggtgcttttgcatgggagattattccggttcaaggtcctgttggtagaggaaaacccccaacattaattgagagagatgaaagcctgnataagtttgacccagtaaaactaaagaaacttcgcccaagtttcaaggagaatgatggtacagttacagctgggaatgcttctagtataagtgatggagctgctgcattagttttg

SEQ ID NO: 21363 - DNA, 4512 bp, Zea mays
tctgtattataattcttgtgatttaccatggtgctagtgaacttctttctttacattgagctggtactttattatttttgttgctgccctgcgcataccatatttgatttgtgtttgttcttatgaattgacactcctattatgttttaggtgaatttgttaaattattttaagttttcttcctataaatgattattatcacatcagaaagtaaaaaaagtgtttgtaacgtcatattcccgttcaaaagaaaatcagcctatgtgtataatttcttcttggttgtcttcaaaattctttcatctcactttgcacttgctattttttccattggctggtaccgttcagtgtgtactgcctactactgctggtgtagctacaatcggtcatatctgatttgcttttatatggatcagtgatggggcggctgcattagttttggtgagtgggcagaaggctcaagagcttggcctgcaagtccttgcaaggatcagaggatatgctgatgcggctcaagtaagctacattaaaaaatatctcacttgagatgagagtatattttgtcttgatatttacgttgtgacctaaatgttcaaggatatcgggagtgtattttctcggacggttttatgctctattttagacatcaaagtttgtcaattattagaattatagtctggaattatattttgtaaccttgaatgtttgttgtttatacaggctccggaactttttacaaccaccccagcacttgcgataccaaaggctatatcaaatgctggattagagtcatcccatgttgatttttttgagattaatgaagcattttctgtatgtaatgactactgagagcttctttctctgaataatcgacttttgtaataatatctatttttactttgaatacaggctgtcgcacttgcaaatcaaaagcttcttgggattccttcagtaagtgcccgctgatattgagctttcatttcttctgtgtgaacttaaaagcctaaaactgtcactctcagaaagtgcaccttgattcttttgtggtgtgctaggcagcagcaggatttttaatggcatgataataacgtttcttgtgtgtggatttgaaagtctaaaatgtcattttcagaaaatgtaccttgattcttttgtagtttgctatgcatcagcagcatttaatagcatgataataacattctctgtactaacagcacatgtggggttgcaggaaaagattaatgtccatggaggagctgtgtctctagggcatcctcttgggtgcagcggtgctcgcattttggtcacccttcttggtgtaagttttatcttaagatgctgtttttttctgactttcttagctagctacaatccctttgtttaaacatgtgcaaagtgttttctgtcagaaaaaaagttgaagctgactcgcattgtttggtcaccttctcgacagtgtccttagggaaaagggcggcaagatcggtgttgctggtgtctgcaacggcggaggtggagcatcagctcttgttctcgaactcgcataagaagtattggcttgaagcactggatatgtagctaattcagtcgcattcatctatacatgatgaagtattgaaaaaaaagaccctacgatatctatgccgggtgccactgtctgcttaattcaacagaatatgattgtgcaatcattctgccgtgctgcttttgctgaccttaggaacacggcggcggaggcgcaatcattctggcaattagcaccagctagctccctgaggggcgaccttgtactctttacattgatgtatgtgtagtgctggacattcttaagttaattcggcaataaagtgtgttgtgcttctgctacctgcatcttcgataagagaaatggagcagcctctttgatcagttcaattcatctttacatcccacttggagactccggtttcaagtattttttttttgaactgaagctcgtctgcttaaactctgagggtcttgctgatattggagaagccaggtttcagtccaggtagagcaggacatggtgcaagtcagttgtgtgttactgatgcttccaaaattgccttggtcagctacttatcaccagttctcagattttctttcccctgtgaatgcaactctgttctgagccctgtggatgaatggtcggtataaacaggcccccttctccttttttgagatggatgctaatcatgttgatatcatatggatggaggagtcatcaagcaataatatagtacatgattttgaatttggattgcaacctgtactgtgtactgtctccctccctccctccctttatggcgtttaattatgcgtctattctacctagtactctttagtctttactacaagtagtagtacctttcttcgcaccctgcaccgcacggcaagttcgtttttttctccttttttttcctttttgattgatgaggaggaagaaaagaaaatagctcttcagtattcagacaggaggcgctgcggcctttccctctaactccagctccagctgctcgacgtcggcggcggccgggttcttgaacctgtaccagcgcgcgcaggcgacgaagtagactaggttgaccgccgccatggcggctatgagcaggtagtagaggtcgacgtggccctggttgaggtcctgcgccagccagtcggggcggccgtcggggcctccggtggtccggtgcacgacgctgaccatgagcccgctggcgtagctggcgatggcgaatgccaggaagagcatggcccccgcgacgctgcgcatgttctccgggaactgtttgtagtagaagtcgacctgtccgatgatgccgaaggcctcggacaggccggccagcatctgctgcggcacgagcaggaagcaggaggcggagtcgccgagcctgcggcggtggcgctcgacggcggcggcgacgagcatggtgacgatggagaggacgatccccgtgccgatccgctgcagctgggtgatgccgccctcgcgcccggtgaggcgctgcatggccggcacgagcacgccgtcgtagaaggggagccagagggtgagcgccagcatgttgaagacgacgaaggagcccgcggggatgtggaagcccccgcggccgacgcggcggtcggtctgcatggcctggagcacgttgtagttgccgaggttggtgagcacgatgtagtagacgatgccggaggaccagacggggagcaggcgcgccaggcacttgacctcctccacctgctgcagcgtgcagaggcgccaggggttgggggcggggccgtcctcaggggtgcgcacggccgccttgtcgaggcacaggaactggtcggtgtacgcgatcttggagatgaggctgctccggtgcggcgggtcgtagaggtcggcgcggggcgcgggcaggcgtcgcttgcgcgcggcggcgacgagcacctgcgcgaagctggtgaaggggctgccctcgggcgggacgcggacgtagaggcgcgtgcccatgaagaagagcgcgcaggagaggcccatgagcgtggccggcacggccagccccagcgcccagctgacgtcgctctggaggtagatgatgacggtggcggagaccatcatggcgatggtgaaggtgaagtagtaccagttgaagaagctgttgatgccccggcggccggctggggtgcgcgggtcgaactggtcggcgccgaaggccaggttgcagggccggatgccgccggcgccgacggccagcagcgcgaaggaggcgaggagcacggccatctggagggacgaggggccgccggtggtgctgctgttggcggcagggtggagcgacggcacggcggcggtgagggtgaggacgatcatgccgaggaaggaggccatggaggcgaaggcgatggtggcgtagcggcccatgtaggtgtcgctgaggaaggcgcccaggagcggcgccaggttgacggtgcccgaccagaggctgagcagggtggcggcgctggcgcccgacatgccgtacacggtggtgaggtacaccagcaggttggccgtggtgccgatggtgcccagcttctcgcacgtctcgttccctgcagcgcgcctcggcagcgtcatgcatgcatgcacatgaagaagccatgatcgatcgatatgatgctcgatcggttagcgattgcacaggacgtcaggacgtcgttcgttcgtggatctttaacttttgggagctcgatgaacgcaactcaacaagcagccttgctgggtgccacgcaggcacgcaattattggattcgcttttttgtactgggtgagtcgtgactcgtgagtgcacgcagccacacaccgacagacacacgcactgcacgggcgtggctgtgcatggcaagccacccgtacgtggtctccatggataggaggaccacagtcaggaccatcccccgttgtctcaccaacacccaatatatatgtaacaagtgtacatatagtcttcaaatttagcaacaagagca

SEQ ID NO: 21364 - DNA, 2616 bp, Zea mays
  misc_feature (2341)..(2341): n is a, c, g, or t
ttatcttccatactaccaaagaaaacgagtcgcgctagcgtataatagcaataaaagaaagaaatcttcagtccagggcagctggcaagatagggcaagcaagaaatcgcagacacaagagtttaacctactctctttttttcttaataatgtcattaaaacgaacgtctgatatagtctcttctttcttttccacaaaagaaaccaccacccaccaccagaatgttgcctttaaaactagcttttcactcaatgaaacttgaacctaactaatcatcatctttttttgttcttttctttttttctttttttgatgccatatagaagctaggaaccaccaaccatggcaggcacattcaaccaaaagaaaaaggaaaatggaaatggaaatggaaatgaaagccttggcagacagggaggggtaaaagattaacccagaagggcaaaaagggaaaaaactgtgggtgagaccaaaaaaaaaaagctccggatgggccactactagacgtcacaacagtcaacccggacaggcatcgagccgattgtcaccacaccaactgcgctagttttacggtcagcttccactgccgccctggaaccgatcttgagagaagcaagtttggcagcggccctctgctcctcgcaaccctcttgaactgcgctcgaacagccgctgaccccatttaaccgcttctcaggtgcttcttcctgtgagcactgggcagggacgctgtccgcatgctgctttggattttcgaccttcttccagcgctgctgctgctgcttcccctccgcacctgccgccttcaagcctgaagctggcgggtggttagttgcagttttcgctgcctcctcttggccctgattgccgctgcaacgacatccctgaggtccattctctttctcggcctcgctagcctgctcttcggagacgcacggatcctgaggcttgatcaccttggtatcgtggggcttctcggccgcattttgtatcccagatgtcctgtctacaagtacgctcctggattctctctgctcagtgccagactcatcttttgtacgctgtgagacaggtacaaagtctggagcattcgaacttagcttgcaccttctgtgtgccctcttttgcgcctcttctgcctcatagctcataaaatcatcaaaaaggcagtaccgcactttgatgtctttgaagatattgatcacagacattccagggaggtatggtacctgcaaatgagacattgggacagatcacgacacgaggcatccagattcatacggcagcaaagtaactaggcagggggctacagaaatgctcgagagaaataaaactgcttcctgaaatcaaacaatttaacagtagtaaaaacaaatcaaacgtaaaacaggacatgccagacttacttcctgtgtatctctgctgtgcgtcacaggcttgttttcgttattctgcagtgtgatatgctgcaaagaaccatttggtatgtctttaacgatgtgccatctcacaggaaagcatccggtccatttatcctgacaccagaagtccatgtccttgtgaaaatcaacaggtccgaccatctcagccatgccacagaagtgcccactaccattgacctgataaacataataaaaattttcaattgttagccttcgagcatgataaatgttatcaatgttcaataaatagatactcacagagaagaacaagaaaaccggacacttagtagaatgcctcctcgatatcctgtcagcatccctgaatgcgctatctagcttgctgtttccactggaggaacttgaccatacaccatattttatcgatttgtgcacatctgcctcaccaattgacttgataacaaagaactttgcatacatatagtcgattcggagatcatctctgttgtactggtcggttcttataacgattgtcccatccggattaccaacagggagccttgttgtgtgagacttcacaattatagcaggcctctgattgcttggtttctcagaatcaactaagctatgcgctttttggccagtagcatttagatggccacttgactttgaagatggttggaatttctcggcagcagcccacttccgaagatcagacccagcagcacatccaagacaattgtttccagacaaatgtgctgatacctgtcataaataagacatgtcagttgggaacagatgacacacatcttactacaagtaaaacatgttatatttaaagaaaaaccagtacaatatttatataccatgcatccgcttgccactatagaagcaaatcacagtttgctaaagacctacccctcctccccgactaaattanggcccacagtacagagtagacgtagaaaaacctctcacgaggtaacctaactccaccattgggtttaagtaaaacaagccctacacatattcatgtccagaacaatcatagatggaatgtgcttataatttcagagttcatttagctaaaagtaatcccaaaaacaaaaaagaaacgacccttataagttactgaaagttaacttttgaatgaattccaaaacttaggttccttgctgaagccgttttaatgaactaccactaccccacctgaag

SEQ ID NO: 21365 - DNA, 3157 bp, Zea mays
  misc_feature (2935)..(2935): n is a, c, g, or t
cggcggcgcctcatctctatctccatcctgatcgtcgatgaggtccgagttcgacacggaggaggacggcaatgaggcacaaggaacaggggttggggggacgtacgcgaaggggctggagcgggtgcattagaaagcaaccgcgaaagaaacgctatgccgacagggagatgagatagctatttgagagggagtcgggataggtctaggaccactagctgattgaaggcaccgatctcgacgacaggtggtgagtgcgacgctagctgattgaaggcgccgatcttggcgagtgcaactctgactgcttatgacagatagggcagggtcacagggcacagagcatagccgtgggccaacacggagggggtgcggagacatagccatagtatcgctaaacgtctaagttagattcttaatagagtagtatagatatgttactataatacttctaatataaatcttgacgtatttatgatttatgtgagtttaatgataacagaaaaaactaaaatattacaaaaacaagaattaataattaataatataggaaaagtatagcactccttcagccttcagagaggacgaccggattcactactgaatgtccaaaacaccacactactcgtactccgatcctactttgaacaatgctttcttgcacgccacatcagagtttaataatattataaaaggaaaaataagccaccttttgtagcaacgctcatataagatcctgatcctgccacaacacaaagaaaacaaggggagatagaacaagcaagaattcacacccgagcccaggttactaatctcctccctttttctttcttaatagaatgtcatgaaaacgaacacatattatagtatcttctctcttttccacaaacgaaaccaccaccatgagaatgctgcctgcctgcaaaactagcttttcacccccaacgaaaaaagaatctaactattcgtcgtctctttttttttctttttttgataccatatagaagctaggaaagaaccaccaaccaggacaagcattcttctaccagaaaggaagatgaaaagccggggcaccaaagattaccccagaagggcaaaaaagataaaaacaaaagctcccccccgctggccactagacggcataactgtcaacccggaccggcatcgagccgattgtcaccacaccagctttgctcgtcttccggtcagcctccactaccttggaactgattttgaccttctgctcctcgccaccctcaggaactgcgctcccagagccactgactccatttagctgcttctccataccagctgtgctagtcttacggtcagcctccactgccttggagcttatcttgagagacccaagtttggcagtgaccctctgctgctcgccaccctctggaactggaactgtgctcgcagagccgctgactccatttagccgcttttcaggtgctttcagtgagccctgggcagcaccgctgtctgcatgctgctttggattttcgaccttcttccagtactgctgtttcccatccgcacctgccgccttcaagcttggacctggtggatggttggttgcagttttcgctgcatcctcttggttctgactgccgctgcaatgactttcctgtagttcattctctttctcagcctcactcgcctgcttatcagaggcacgcggctcctgaggattgatcaccttagcatcatgcggcttctcagacacattttgtatctcagatgttctgtctaccagcacactgctggacttcgtctgctcagtgcgctgggagacaggtacaaaatctggagcatcgtaactcagcttgcatcttctgtgcggcttcatttgcgcctcttctgcctcatatctcataaaatcatcaaacaggcagtccctcactttgatgtctttgaagatcttgatcacagatattccagggaggtatggtatctgcaaataagacattgcaacggatcatgacacgaggcttccacatgcatacaatacgagagcaaagttactacggcaatgttcaagagaaataaacgagttcctgaaatcaaacaatttaacactactaaaacagattcaacgcaaatcaggacatgccccacttacttcctgtgtatctctgctgtgcgtcacaggcttgttttcattattctgcagtgtgatatgctgcaaaaaaccattcggtatatctttaacaatgtgccatctcacaggaaagcagccggtccatttatcctgacaccagaagtccatgtccttgtgaaaatcaacaggaccaaccatctcagccatgccacagaagtgcccactcccattcacctgataaacattaaaaaaagtcaattgttgaactttaagcatgataaattttatggatgttcaataaatcaatactcacagagaagaacaagaatactggacacttagtagaatgcctccttgatatcctgtcagtatccctgaatgcgctatctagcttgatgtttccattggaggaacttgaccatacaccatactttatcgatttgtgcacatctgcctcaccaattgacttgataacaaagaactttgcatacatatagtcaactcggagatcatctctgttgtactggtcggttcttataatgattgtcccatccggattaccgacagggagccttaatgtgtgagatttcacaatcatggcaaagctctgattgcttggtttctcagaatcaactaagctatgcaccttttggccagtaccatttagatgaccacttgactttgaagatggctggaatttctcggcggcagcccacttatgaagatcagatccagcagcacatccaaggcaattgtttccagacaaatgtgctgatacctgtaataaacaagacaggtcggttgggaacagatgacacacagcttacnttactacaagtaaaacatgtcataatgaaaacaggcaataaaatatcagtacaatttttatataccatgcactggcttgccattatagaagcaaactaaagttctctaaagaacccccttgaacaaaattaagacccacagtacagcatagaaataggaaaacccctcacaagtcacaaggtcaacataactcacctttgactttaggtaaagcaaggcccc

SEQ ID NO: 21366 - DNA, 2117 bp, Zea mays
gcagggacgctgtccgcatgctgctttggattttcgaccttcttccagcgctgctgctgctgcttcccctccgcacctgccgccttcaagcctgaagctggcgggtggttagttgcagttttcgctgcctcctcttggccctgattgccgctgcaacgacatccctgaggtccattctctttctcggcctcgctagcctgctcttcggagacgcacggatcctgaggcttgatcaccttggtatcgtggggcttctcggccgcattttgtatcccagatgtcctgtctacaagtacgctcctggattctctctgctcagtgccagactcatcttttgtacgctgtgagacaggtacaaagtctggagcattcgaacttagcttgcaccttctgtgtgccctcttttgcgcctcttctgcctcatagctcataaaatcatcaaaaaggcagtaccgcactttgatgtctttgaagatattgatcacagacattccagggaggtatggtacttcctgtgtatctctgctgtgcgtcacaggcttgttttcgttattctgcagtgtgatatgctgcaaagaaccatttggtatgtctttaacgatgtgccatctcacaggaaagcatccggtccatttatcctgacaccagaagtccatgtccttgtgaaaatcaacaggtccgaccatctcagccatgccacagaagtgcccactaccattgacagagaagaacaagaaaaccggacacttagtagaatgcctcctcgatatcctgtcagcatccctgaatgcgctatctagcttgctgtttccactggaggaacttgaccatacaccatattttatcgatttgtgcacatctgcctcaccaattgacttgataacaaagaactttgcatacatatagtcgagtcggagatcatctctgttgtactggtcggttcttataatgattgtcccatccggattaccaacagggagccttgttgtgtgagacttcacaattatggcaggcctctgattgcttggtttctcagaatcaactaagctatgcgctttttggccagtagcatttagatggccacttgactttgaagatggttggaatttctcggcagcagcccacttccgaagatcagacccagcagcacatccaagacaattgtttccagacaaatgtgctgatacctgagaagcatgagggagtttagcaggcatcatacatctatctggcaactcttgcttctgtggaactgaattgtgcagctgaacctttggtggctttgcatagtcctggaactgctttgaagggacaatagtagactgtacatgtggatgcataacaatgtcactttttgtggtgacgggagcaattaaaggaaatgctgcatttgcagatgttgcagcataacctggtatgccaggaagaaatgcaacattggagttggagtgaagatgtgtggtcgcgcttcccaaggcactatcttgtgcataaggaagaacagctggaatataataggatgtctgggctatttggcatgtggagttagcagggtcagcaacatactcctgaggcataaatgagccatcgggtacgaaagaaggatcagaagggtaagaactgtaggtaggatgcacagatccgttgtctggggctgcgtagtatacgcattgcatgccttcagtcggatagaaattatcttggccatcatatcctaaagagctcgactggttacaccattccatctgtgatccaacttctgcataaccatattggtagggagttgcagtagcaggaacaaaaacattttgtccatacattacatcaggagtcattcccatctccatgcaattcacacttttgaacaagcacaactccaatgctcagagtcggcttgctcctccgggcggagtggcctccgatcctttgctttgccggtgatacagtggaaggaccgaaacggaacggagggagggaggaaaggtcgccggaggggaacgattccttggcccgaggagatcctgcaggcgacggggaggggggggggagcgcatgggttgggttgtggttgacagaagtaggcgtcgtgcgcgagtaaccctctgtacccggccggc

SEQ ID NO: 21367 - DNA, 2664 bp, Zea mays
tttttttttttttttttttttttttttttttttttttttttttttaaaaggagaatgaaattcatttcttttcggaggtctatagctggatcctattatcaactgtagaaacatcgtcatacaatacaaaaaacgctatatcgtggaattcgcctctggtcaaatccaacagctctagtaggcgcaccaaacaaaaacaacacatcaaaccactcttaacacgctgtaaggatgccacaaggggtgatgaagcacaggtgcaaataacctcccactggatacctaggatccatgcgggctcagtaacggataatatcacttaagatgctgaagaaatggttgatatctatcttgtcttctccggcataaattgcttctgcacttcctccggttggcccctgtgcagccatctcaacaagcgtgtacagcttcttgattggcatatcatccagtgcttctgctgctgcatcaaggtccccgtcatcgaacacatcaagatgatgcaatacctttttcgcatcctcctttttcagcttggggacatggtatgtcacagagaacacgtcacacattccaacagattctaggaagccaacctcgcttgttgttccaatcacaagcaggttttttcccttaggaggaaccctcttgaggaggaccagaagagtttgagagatcaagtttgaaaaacgtggtccaatggctacatactccagtaacctttcgatatcatcaagaactatgatgctgaactgagacttgtatgcatcttcaaaaaccttgcaaatctgtgcacatttactgctttcactgaaaccaatcattgtttctgctgatataattttcacatatgcaaaatcactgtcaatgccaacacttgctgccatagctgttttaccacttccagcaggaccttccaacaggcaagtcacaagtggactacctttgctaactttaacttgctctacaaggagcatagctctctggtaaatgtgcttatgtgccttaccacagtcaacaatacctcgcaatctgcatctttcgagatcatcggtggaagcaccaaatgcaggagtaatttcatgaagtgcattcacaaagtcatccatagtaaccttaatgctttcctcatccaaaggtttagtgaggtcatccatggttatctgccggttcaaagcatacgagacagcacttttgacaacaccttccaactctgctccactgtagttctttgtccttgcggctagctcaagaagattaatatctggagataggaaagaattctctttcatcttatttgtatgaatctgaagaatttggaaacgaccattttcatcaggcaggtttatctcgatgtgaacttccaatcgtccaggtctcaataaagcttcgtcaagcaaatctttacgattggtcattccaataagcaatacgttattcaacgcctcaacaccatctatctttgtaaggagctggtttacaatgctatcatgtacacctgtaccatcgcgggtagatcctctagacttgcagatggcatcaatttcatcaaatataattacatggaggtcactctgatcacctcgtgtcctctgctcattttcagcatcagcaaacaaatctctcacattcttctcggtttctccaacaaacttgctcagaacttcaggtccattcacaatcttgggatcttttccgttcaataattttccaatttgtcgtgccataagagtcttgccagtaccaggaggtccatatagcagtataccttttacatgtttgatgcccaacttactgacaacttgaggaggaaagactcttgaagcgaatgccctacgaaatatgtcagtgaattcagcacttaacccacctatccccaatttttccaggttaaactctttatgtttgaaaagtttgctgctagcagcttccttttggttgatcaccttaattcctgaattaggagcagcctcaaatatgatgtatgtatcacttgacaagaatcctctatccaatggtgtagaactctcttgaccctctagcaaagcttgattgacggtgaatacatagtttgttccatgaaattcaaatggcaccctttgccccaaggtcatgacctgatccagaaacctcttacggagttgttgggcaagcacaacagcatccagctcgtcatttcggttggctcttgccttggcatactctagctccaaagtgagcaaagccaacttgaaatcatcaggggggacaaagctgctaacagtaacagaatccccagctgaaacctttgcctgacgacgttgaatagcattcaaggcaatgcgcccgcttgcgacagcattgtgttcacgtagggtgaagacccaggagtcggcgacgacggcgagcgcgttggggaagcggcggaggtccgcgggacagacgtatgcacagttggtgagggccagctcctggttcggcgtgctgactacctccatggacgtgcccccgccaccgccctggccctggtagtaccttcccgccatggccacggcgccgctgcggtggtgagatctcgctcgcaggaggagatcgtgcaggcgcgtgtgatgcctcgctgctcgcgaagacgaagaagagggagtcagttccgctaagcccccgggcccggccggcgcctcgtgc

SEQ ID NO: 21368 - DNA, 1525 bp, Zea mays
  misc_feature (28)..(192): n is a, c, g, or t
cgcctttgatctaatccaacagctctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatattcaattaagcaatatatatatcatggatacaaagaaatatgctcaggtgttaagctggatcccattaagaactgtataaacatcgtcatacaatacaaaaatgatatatcgtgtaattcgcctctgatctaatccaacagctctagtaggtgcatcaaacaaaaacaacacatcaaagatcaaaccaatctacagaaatggttgatgaagcacgggtgcaaacaaactcctactggatacttatagggttcatttcggctccatgcgggcttagtaacggataatatcactcaagatgctaaagaaatggttgatatctatcttctctctccggcataaatcgcttcagcacttcctccggttggcccctgagcagccatctcaacaagtgtgtacaacttcttgattggcatatcgtccagtgcttctgctgctgcgtcaagatctccgtcatcgaacacatcaagatgatgcaatacctttttggcatcctcctttttcagtttgggaacatggtaggtcacagagaacacgtcacacattccaacagattctaggaagccaacctcgcttgttgttccaacgacaagcaagttttttcccttaggaggaaccctcttgaggaggaccagaagagtttgtgagatcaagtttgaaaaacgtggtccgatggctacatactccagtaacctttcgatatcatcaagaattatcatgctgaactgagacttgtatgcgtcctcaaaaaccttgcaaatctgtgcgcatttgctgctttcactgaaaccaatcattgtttctgctgatataattttcacatatgcaaaatcactgtcaatgccaacacttgctgccatagccgttttcccacttccagcaggaccttccaataggcaagtcacgagtgggctacctttgctaactttaacttgctctacgaggagcatagctctttgataaatgtgcttatgtgccttgccacaatcaacaataccgcgcaatctgcatctttcgagatcatcggtggaagcaccaaatgcaggggtaatttcatgaagtgcattcacaaaatcatccatggtaaccttgatgctttcctcatccaaaggtttagtgaggtcatccatggttatctgccggttcaaagcaaatgagacagcacttttgacaacaccttccaactctgctccactgtagttctttgtccgcgcagctagctcctaagattaatatccggagacaggaaagaattctccttcatcttacccgtacgggtccgggggggttgcaaacgaccattttcatcaggcaggtttatctcaatgtgt

SEQ ID NO: 21369 - DNA, 3763 bp, Zea mays
aggaattagaactaaaaaacaaaatttaaattttatactcctatgcttggtacaaataggacggttcaatgcagcggtgagagttgtctcactaagtcactaggtcccctatccacttatgttggggccttcgacccttgatcgatacaaatctatataaccagacaaaatggaagctcgtctgaggcacatgcacaaaaaacctagaaaatggttgtccatgtatttaaatttccagtcaaggacccttgtagcatgatgcacttgtgcatattatggtaattgattatttgtgtggaatgatgatactttataataaacaaaataagtagccccctattgttaaaggtctaatgttgcacgtgttgtcctgtagatctagctataatagcgacatatgatcatattcatgtgatgtttcatgcatatgagacaatatgttgcacacatattccttgtttttttgtcattgcatagttttttctgttgtaattaatagtcttaatctctttcaatcttatatattccctccgtcccaaaacaatattcgttttagctcttagtttttatttctatattcaacttggtgatgatgaatctagacacatatataaaacacatagaccaagtattatatgaatatatcaaaaatataaaacgaattttattatttgttgttgttgtttgcaatattatggataggaggtgatatatacccttgatatattagagggttatgtagacttataaaaataacagatcagcaaaaccacatttaaaattatctttggttatttagatgattttcaatagtttgagaggtagagtatctgagtttttttataagtcggtggagtggacaactatccatatcagaacaatatacatagtcacacgaccacaaggaccgccatccatgcgatagggtgaacgagaaggaaaggaagatgtcacgtgaataacgagcgagcccgtctcgatggccagacggtgaggcttgatggaggtgccaccgactcaccagcaatagccacgaaaactttctctgagcccgtttgttgcagtgctcgctcgctcgctcgctcgctcacctgacctcactcacctcgatcgcctggcctggtaaatcgatgccgtgcgttgtaagagttacccaatgccaatgcatgcgtccacacgcctccgcggcgcgtcggtccttgaagcaaaaagcatcatgatctcatggacgcgaagaaaaaggaggagcttgcggcgcacgcgtcccgcgtccggcgtaagttacgaacgtccctccgtccgtcctcggtcggctcctcgcggcacccgcccgaccttgtttatcatacatcttgcttaacccactggtgaacagcgcgcagaagaaactaattaagggcgacgaccggcttggttttgcctgattggtttctttatgacggcatggtgacccttcgtcacaaggcgctgcggcgtgcaccagtttaatgggcacggtggtcttgattgagagtgaaaggtggcactcgtacgtccgcgagggttcgaagatccgcgaaaacgacggggcaacgtaaagatcagctgcggacacgggcgggcgcagcttcggcgtggcatgattgcgcggcaagggagtctggtggtgtggtgtggtgtggaagagggagcacgcagacgaaaccggaacccaacggatgaacggacggaagggagggggagaatagtgtgggaggctttacccaagtgtaaagcaagccaaaggcacgctcccgcggccgggttgcttcaccggcgggttgctcatatacacggcaccactgcactgaccatggtcagtgaccgcaccgcaccacctgccctgcccctcctctgcagcagctcttgttcttcacgtgctcgttcgtcttcacgacgaacccgcacgggttagctctggctctcctgctatagatatgagatgcaagaggcggccaaggctcggcatggggtggcttcgctccgtgctctccccgctcaggaagctctggtgccgcgtcaacgcggtgcagcgcaagagtacgtccgttgcccagtcagtcacaccacgcgctctgctgcgccccgcgtccggttgctctggcttccgcctcggcgcggtgcagcgcaagaagagagggatctacatcctgtacgacgacgtcaagtcgtgccaatgcgaggacgtgcacgtgctgtgggcgatcctcgttgagtcccacggcctgccgacgccgacgccgacgccgcctctgctgagcctgaagcgatgaggggcggcgggtgctccgccgctgcaccccctgaataagcgaacggtccatggatatacctcgacatggctatgtcgctgagaggtgaattcaagtagtagcgattctgaattctgatgtacatagggatcaaccgatgtgtgttgtgtcgccggtgtgctgctctgctgccggcctggattggtgcctctgttggaggctgccgagacgagagtggtcgtgcagctgcggaggaatgcagctgccgcgcgtgtcgctttgttgacgagtgtggtgatgagcttcttggagttggagcgcacccctcgttcgtttgacttctacagtttacgtacgtgtaagactgcatctggatgcggtccttcagcccatctctattggagtttggaagggaatagcaggaacagaaattgaatcctcacccaattttctgaatcggctagctcccgttttcagttttcgcttatgtattcactttgcactagctggagtagcacaatgcttcttcctgcaaccacatggtacggacaacagggtagttcaggttcaggaagaagatgcttgttcagacaaccgtaatttgcttggtttctgctttttttttcctgacgggaaggttgctacacttaggtctgatataggttaactattagtctatgattggttctataaagcacaaacagtttctcagaaaagagaaagcttaaagctatttttagcttcacataaaaaaactgcgtatgtgacagaagctgaaaaacaaggttctaaagagaaattttatatagatctaaaatcggctcagtcaagtaaaaatacaccaaacacattcttatagttgctctatattctattgaactttctccgccaacacagtggcagtcgatagaccaagctgtctagctacatggtgcgccaaccggcgccattacccacgctcacaccacatggtaaacctagaaaaaacggccaaagagtgccacctaaaccacaccgaagaccgaactgagaccaggcatgttatcttggctagaatggaattagctagctaataaatataactaatttgttaaaaatatctaatagttaaactattaactatgtttttagctaattttatcaactaactagctttagtacattcaaacacccccttaaaatcttatcagaccaaacaactagccaagaaaacacacaagctcacataacagaagaagacgaccgtgcttcgacaacttttctagagtatatttatttgcttgaatagaagattacataaaaaataaattgtaatcctataatcaaacacataaagatttattttctaatatgagtaacatacataactaagcagcaagcttagcatcgaaggtttattttcaacactcctcctaaaccttattgttggggcatttttctccgccgaaggttctctaagcaaaaaacaccttcggcaggacgatatgcaagca

SEQ ID NO: 21370 - DNA, 2636 bp, Zea mays
ctaatactgaggaattgaactttaatttaaactataaattcattatacaagcaaacaacataatttaggaatcttggttccaatttctaattctagacttcaatatctacacccaaacgggttgtcagagtaagtttaataatatagccgaccattgatggcaaggacagttgcagtctaccatttagctcatttgtataatatttagctcttcactattaatacatgactccacttgtctttctcacatggcttcttaatttttttttgtctaaaccgactgtaaacctctttcctctcctcatctctcccctatacctagcctgtttggaggctcttattattcttgctcattttcatctcatcttctatcttacttcctatttcaaattttgctttcgtacaatctagagtacaaaatagtgttttccagaactatatatacggtctgctgatcagagacttagaaaaaggaacgattcagcaaacaagactaaacatgtctcgattagcaaatctggatttttcatgacaacctgacatgcggcttaagtcactgtcgcaagcacttgaagttcctcgggttcgctcaacaaatttagcggcaaagatagcaggttaatctctcaaatgccctctaaaataacgaatcgctgctatcggcttgatgcagagcgcagagcatccttgcacagtttctccccgtgacccctgatatccatgaaggctttgcgcagcacttcctttgcaactctgaaggcgccggccgatacagttcccttctctgcacacttgatcgcatcacgaacgagatcattatatcttgatgccacagaatctggactgctacttccatttccaacgttaagcccgatgagttcaggccctgacttagccttctttgtccatcgctttgtgatgcaaggctctggaagcatgatgacaccggccaagaggaacacactaaggacatgcctgcacagtatcgccgagaaagcgaatctgcagcactcgcaccatgccttcttctcagcaacgttgtagaaaacggtgtgcctggtaggaggatcaccgtttctttcgacgtagtatttcatgtatgatccatcctgaaccttgacggcataatgttgcattgcttcaaccaattccagctggaatgtttcaaatgcagctctggtgtagatactcctcgcttgtttttccaagaccatgtcggttttcagaaactgttcaggagaaaaagaagtgatgtctttctgggcttcacttgcatacagaccatctatatattgatcaaatctacttataaaagtattcagagaaactcttgaactgaagttattcctataaaacttactgactgtttctactctgtgagttaaggaaagctcagcgaagaagaagctggttaggtatgcaggaacccatttgtgccttatttcatacagtgactgcagccaattatcgtctctcaggccatacttgtcaagaatggagccccagagcatgtcaaaaataaccgcggtatcacacccattgacacatctcttgagctcctcatgtaacccaggaaaccttgtgcgggcatcagtcagtctcttcttgcatctagacaagatgcgccatctgcaaagacgatggaaacactgaggaaatacttttgcaacagcaggggggccgtgttatagatgaacttggttgttccattttaggttccgaataaatgatggaaatctagggctacacctgaaccggcaacactatatatatatctagtattttaatatctgctccattccaatttataattcgttgtgcatgaactatagtactatcgtctctctctcctgcaaacactgctgaaaagcaaaaaaggattgatgtcttgagtcaaatcttctccaaaacgagaacgcatatggttcgtagaagttgcattggagcgtagaaatccagttatcccccatacacacggtgcagtacaagttgtagttgttctagatggagagaaccttttcttggtgcacgcggcgcccccacagggggaggttcaatgcatatggaagaaggcatatcgaccggcaggcaagttgcaaaaataataacaacaccaaagttagctagggtttgatcatctccaaactgacctcactcacctcgatcgcctggcctggtaaatcgatgccgtgcgttgtaagagttacccaatgccaatgcatgcgtccacacgcctccgcggcgcgtcggtccttgaagcaaaaagcatcatgatctcatggacgcgaagaaaaaggaggagcttgcggcgcacgcgtcccgcgtccggcgtaagttacgaacgtccctccgtccgtcctcggtcggctcctcgcccgcccgacctttgtttatcatacatcttgcttaacccactggtgaacagcgcgcagaagaaactaattaaggacgacgaccggcttggttttgcctgattggtttctttatgacggcatggtgacccttcacaaggcgctgcggcgtgcaccagtttaatcaaatgggcacggtggtcttgattgagagtgaaaggtggcactggtacgtccgcgagggttcgaagatccgcgaaagcgacggggcaacgtaaagatcag

SEQ ID NO: 21371 - DNA, 4880 bp, Zea mays
  misc_feature (2305)..(2305): n is a, c, g, or t
  misc_feature (2462)..(2462): n is a, c, g, or t
ggttaacgactgttatctttagatagccgctgatggctctttgccgagggttcagcactcggcaaagctatttttgtcgagtgtaattctgtaccaagtgtcctgcactcggtaaacgagatcgttaccgagtgcaggattttgccgagtgcggctctcggtaaaagcatctttgtcgagtgcccgacaaaaagcactcgataaaggcctggatttcgatttcgatagtgaaagcattaaatatgatatatagagagagagagtatccactaaaccaaaaagcagcagttccggagacttccctagctgtttctacagtctacgaaattagcaagctcgctacgtcaactacgagaacggtcggcctcaccggccgttcttggcacaatcatcgtgtttgtgaatgcaagtagaccacgtaagtgtgtgtgggtgcatgagaagagagatatcacatacaatttattttgttttcctggactagattgtgccagcatacgcaaacaaacttggcaggtatggatcatcacgtggtgaagacgacgcacgtaagtggaccaccgccttctggctgcctgatcctgatttccacgatattcgatatatatattatatttgtgtaaatcagcctcatcacctggtggtgctggaaaagaagtccgaacggaggagcagagctcgatcgatcaccaaaccaattaacaatggcgtccgcagcaagaagcactgggtctctcccggtggctaacgtccaggcgctcgcggaggcttgcaatgacgacgggggcgacgtccaggtgcccgagagatatctcagcaaggatcccagcagcgcggaggaggtcgtcgtcgtagccggcgacgacagcgcctgcagggcgattcctgtcatcgatctccgtagcccgtaggttgctcgatccggagtcatcggaggaggagaccgccaagctggcgtctgcctgcctcgactggggcttcttccaggtacgagtacgttcttgaggtggtcggatcatttgctgcttgtgttgtatatcaaccatgagccggcggccggtccggcctgtgctgctgtgcagctaatcaaccatggaattccggacgaggtgaccggaaacctgatgaacgacgtggctgggttcttcgggcagccgctggacgccaagaaggaatgcgcgcagcaggccgacagcctcgaaggatacgggcaggccttcgtggtgtcagaggaccagaagctggactgggccgacatgctcttcctcatcgtgcagccgagggaggccagggacacgcgcttctggccgacgcgccccgcgtccttcggggactccgtggactcctactccctggaagcttcgaggctagcgtaccgcctgctggagctcatggccaggggcgtcggggccgccgacccggcgtcgctaagacgcgtgttcgaggggcagacgcagggcatgcgggtgaactactacccgccgtgccggcgggcggcggaccgggtgctgggcctgtcgccacacaccgacgcgtccggcctgacgctgctgctgcaggccagcaacggcgtgcagggcctgcaggtcaggaaggacggcaggtggttcgccgtggacgccatcgacggcgccctcgtcgtcaacgtcggcgactttcttgaggtacgtacgtgctgtcagttttgtgtggattctatgtggctgatgtatatcgatcgtcttgtgtccgttttgcagatcctgagtaatggaaaattcaccagcgttgagcacagggccgtggtacacccaaccagagagagaatgtcggcggcgctgttcctgtaccctcgccagaacatgagggttggcccattgccggagttcgtgaatggcggtaatgagcggtatggatcaacggattatgaggaatttatgaagcattactttgcaacgaagcttgacggaaggaagcacctagacagattgaagttggagcagtaggcagtagctatctctaccgtatctatctcgctggagggaccaataaataatttttctatgcgataaatacttcgtcctcaagcacctagagagcagatataaataatgttctccagctttgattcgcaaaaaatgcgcatgattcaaaatgtgttatgataggataggatcgactcggtccatgaccgagacggtcaagatcaaccctaacattctctccatttaatctcatactcattttcttatacttacaacttttactttattaacgtcttaatttcataacttatggttttcacttcacaatacatcagtacacnaacaccaagacatttaagcaacttgttaggtactattgaactcaatgactatagtgcacatttctatctcaaagtatagaacctaaaacttgaggaagatggttgtatttttatgaccccttagtccagaatcataggtgctccattaaacctatantggttacgagttttctaaatacgttgagtataagccctttagtgagcagacctgcaaacatttgctctgtacgtatatgtatatgctcatggtcaattatttgatcatgaactctcttctttataacataatatttaatgtcaatatgcttgacaacaacacttgagaaagctaagtgatggtaacacaatttatatggttagatcttgtatgtctatcttaagtggttgagaaaatggttaaggtgtgccacgcatgtacgcgccgccaccgagccaaagcgagacaaggcgtgatcacggtcagtcgggtcacaacatggtgtgatgtagacacagagcgtgcagggaatcaaaatgtcacagagttagagcgtgtgcaaggagttttagaagtttcatagcttgtaactccagaagttactcgtccggttgtgaagtttccttatgatctcccacacccgctcgattttcgcgtcgtataatctttcgggttcgcttggttctcccgatgtctaatctcctatgtctctttgattctccttgttcacctatataaactccatcttgtctttgtttatcggttcgctttcgctgatgttgttttagctgttagccaagcactcagttttagttcttgcgcacacaaacacaggaagaacaggccttcgaaacaagtgtcgtccaagagttcacctgctcgggttaaggacgataaacacaattttgggtagtgttcgtaagcgccatgattgctcgcttgctcctctcatttttggtgctaagctatgttctctccttcatggtatattgctttggtagtgatcaacacaattacataccaacactgcatctaacgaaatggctacatcgactagcgccgctaggtatgttttgtcttcttgattgtttaaagtcttgtttctttgtacttcttatatgtttatcgtgataaaatggaacgatgtcaccaagttgtcattatactttttctagattaaactacaattaaaaatatctacatatctagcactaacataatgtcagaaagttgtatcgtaaaaactaaaatagtgtatattctataaagttgtgttcaacagatcgtatatatggtagcagtatatggtagcagtaatgtcatattcttaaaaagttgtctcataaaaactaaaatagtgtatattctataaaattgtgttcagcaaatcatatacatggtcatgtaatatattatagataacactatttatcgagtgaaacttgaaataaaaatgtgtaatagaaaatgtgatatgagaaataccggagatagtctcgtgaagaccaaaaacatcaacaacctgtgcgccgggaccctcgaagaaacaaagaaaaaaggtgtgcgctggcagatcggcacacgctcgccctttctagaccgggggtcgtcctgcaacgcggagcgaggaggctgcgaaagagaccacaacgccgcgcagccggcaggccggccgtcgcgtggctcgttgatacgcccgcgaaccgcgaccccgcgtacgccatggtccggcctgcgcttatccggcgacattactcacgaggcgatggcgatgcgaggaaggacagctaggacctatccttatttaaaccctgacgccaccttgtgctgttcaaggagtgaatactgaacagtccagtcagtcgtctctacctcatacgcctgacgaatcttgattcttgaggtgagcctgcctctctcgtctccctcttcccctcgatgcttcttgctcctcctgcagctgtaaccctagatctgtgggggttttttttgggtggtgggtggttctgattcagtttcctgcccgtgatttcttctctcaccagcaagacgcggtcactccaatagaactatgcacaacctgttcgtcgcctcctcccagtgcctggccaaaagactgattggtttaagcttcaccaaaaaaaaaagagactgattgacttcccaacttatgtttcactagattttagttcattactaagcaagtgctcagctcttttgttggcaatgaagcaaccataacattgcttctatggccaattgaaatggctagttccattcactgtcatagtgcaatacaagcgccaggaagagtatctgtgatgtaaataacagctgttgattttaggacagtcgtattgattttgtgctgccgagcaggcttggaactggatgccttggttttccagatctgggagtttggtcgttttggcctactctgcaccgctattgagatcctctctttctattaagaaatttaactgatgggccaaagtttcagcagcacactacatattttttttctttgaagcaacatctcactaaagtcatctatctactcattggatgactttggagatctgttgatataatatcaaa

SEQ ID NO: 21372 - DNA, 1531 bp, Zea mays
ttgggaccctcgaggccggccgggatattatacccaaactatagtgtcctggctgaattgaactcaaaagggtttggtttgagaaaaaattgtcccaagattggattgcttgttaaagctcaatattgtctcgggggcgggggtccctcgaggccggccgggatggtcaaaacataatatttcagaacaagtccgaacgaactgaaggagaggaggaggaggaggaatggcggacgcagccagaggcctcgggtcttcgtctctcccggtggctaacgtgcaggcgcttgcggagtcttgcaacgacaacggagccgatgcgccggtgcccgggaggtacctcatcaaggatcctagcgccgaggaggtcgtagccgccggcgacagcgcctgcacgattccggtcatcgatttccgcaagctgctcgatccggggtcgtccgaggaggagtgcgccaggctgggagccgcgtgccaccactggggattcttccagctcatcaaccatggcgttccggccgaggtgactgggaacctgatgaaggacgtagctgggttcttcaggcagccgctggaagccaagaaggagtgcgcgcagcaggccggcagcatcgaaggctacggccaggccttcgtcgtgtcggaggaccagaagctggactgggcggacatgctcttcctcatcgtgcggccgagggaggccagggacatgcgcttctggccgacgcgccctgagtccttcagggattccgtggacgcgtactccttggaagcttcgaagctagcgtaccgcctgctggagttcatggcaaggggcgtgggtgccgacccggcgtcgctgcagagcatgttccaagggcaggtgcagggcatgcgggtgaactactacccgccgtgccagcaggcggcggaccaggtgctgggcctgtcgccgcacagcgaccccaacgggctcaccctgctcctgcagatgagccacgacgtgcacgggcttcaggtcagcaaggacggcaggtggttccccgtgcaggctctccccggcgccttcgttgtcaacgtcggtgacgcgctcgagatcgttagcaacggagcgttcaggagtgtcgagcacagggccgtgatacacccgaccaaggagcggatttcggcggcgctgttccacttcccggaccaggatcggatgcttggtcctctgccggagctggtgaaggaaggcgacacagtgcggtacgcaacgacgacttaccaagagttcatgaagcgattcttcgctgcaaagctcgatggaaagaagctcatagagagattcaagctacagtagtagctacgacctctcagctcgaacaaaaaataaattcacttgtaactattaataatggccagttattgaacggtttgcttgtctaaaatgttaacgcgcgcaacctcgggtatgcattactgtgttacatccgtttgcttcctacctactgtcgcatgagttatccaaatgataaattttggtagatgcataaggcttagcccctatttt

SEQ ID NO: 21373 - DNA, 2531 bp, Zea mays
  misc_feature (1314)..(1314): n is a, c, g, or t
  misc_feature (2322)..(2322): n is a, c, g, or t
agatattttctaaaaaaattagagataaaaaccaaattcttaaaaactaggttgctttcaaacaggtcttaatttatctgcttttgatgacttttttattgaatctataataattttactatttgagcaacacacaataaaaatagaggttggtgaaagaaagtaccacgtaattatatatatggtctttctttacccaaagagggcggtatttgtttaactactacatgtttggaagcaccctgattagatctaacgtctctagttatctggttatatatgtgcacatgatacatatattaatcatcatcatctatctagatataaggtttctagttgtatctagttgtttggtatattttgctaaagacacccttccacgtggtgagagtgtagtggtggaagatgttatttataaattacaatgatcaagcagagatattagatctaagataaataatgatgatttaatatatgcaccatgtacaataatctttcatgcactggatatatatcatcttcatacatatatcacccctacagctctgcatatgttatgtctaaatcctctagctctctcagagcaactccaacaaagatccaaactgagtcgtatcttaaaatacaggggaccagaaaatagtctccaacattgcagtaaattcatataagacttcactcttacgttgtttggcgcttgatttttctgtgctagcccgtttggttattgataaatagatgtttaaggcctgattgttggcagataatatgttagggtcctaaaacaaatcaaatcaggtcaaaaacaatatttaggactcaaatataggtctcttttttggagttgctctccggactccggaggagtcagagataaaaataggaacgagcaatatctattttatttaattgtgctaatcaagatttaaaactcaaagatatctgactggacaccatatattaaattatatgtatcaattaaacttaaattgatggagagagatgtggaatccacttattctaatggtcacatccgtgcattgactagcactagctcaaggcctcaagtattttctgtacagtgacctggcaatcgccaaagcatcacccgtggccttcacggcgtacacctcctttccggactgccactcgttggaatacgagatccagtccttcctccactcctccagctggaagctccggttctcttgcaggctcctcgttaagtaggcgaagtactttgacgcccttggaaggtagtagctcttcagcagcccgctccaaaacttattggctggtgatttggtgtttacngagaacaacattagtaacgcaaagctgaaaccatacagctaaacaactaaagaaactgttccattgtactagccattaccgtagtcatgcagtttactctgctcggtctccgtgttgtcataccacatcgtcaccggggttctggcgttccacttcgtcctgggggaaaaagttcagtccagtcctcattagcagaaaaagggggatgggtatatctaggatccagatgttgggggaagaagaatgcatgtgtagcatacctgctggcgttccttttcagttatagcaaggctttttgcactttccagccaggggcccagcagaaagttatcatcagcagctagtaacgtatcgatatccacgatgatctcaagaaatttcctcgcgtgagcattcaggccatgtgaatctttcttttggtacaaacttatcgcgtcaaggtaaacttcattcgctagtttggataggcactgcctagttaggtcgacaaggtcatacctggggtaaaagtcaccacccagccagcagtaataatcagttaaagcaaaagcatgcctaagcagcataattagttttattcgctaaactagtagcgcttatttggtaccctggtttgggtacggtcacttaaaccaattgatagctgtaactgcatgaatagagttggcaatagctgaaaataagaacaaactagtctcgagacttcaaaggaatatgcagattgtacgtacctatacgtgagactttctgaaaatgtgcttcctgcatcaagaaatagttcaagggctttgacggcctccttcgtagagtaccacagatgcggctgcggtaggattccagacacctcgcttaagaaaaacctcctatggtttctcgtaattgacatgccccttcgtttagaaacctgataagtaactgagctgggacttatgtctggaaattcaactatatagtctttattatggtcctgcaaccaaaatatgaaaggacatgttactatacagacangctctggatagttgcaacaaaggggcttgtttgaaatcacaccgcaatcccatcagtgcaattgtatattgtatgatacaaatatctccaagctttctctatgtcagcatttgcttgaccatatctcctacaggagtatgtttttagccaatcctggaaggttatggacaaatgttagacggtaatcaacctatcaaagcaaaaacctg

SEQ ID NO: 21374 - DNA, 1763 bp, Zea mays
  misc_feature (6)..(8): n is a, c, g, or t
  misc_feature (1723)..(1723): n is a, c, g, or t
  misc_feature (1760)..(1760): n is a, c, g, or t
tttttnnnaaaaataggaacgagcaatatctattttatttaattgtgctaatcaagatttaaaactcaaagatatctgactgtgacaccatatattaaattatatgtatcaattaaacttaaattgatggagagagatgtggaatccacttattctaatggtcacatccgtgcattgactagcactagctcaaggcctcaagtattttctgtacagtgacctggcaatcgccaaagcatcacccgtggccttcacggcgtacacctcctttccggactgccactcgttggaatacgagatccagtccttcctccactcctccagctggaagctccggttctcttgcaggctcctcgttaagtaggcgaagtactttgacgcccttggaaggtagtagctcttcagcagcccgctccaaaacttattggcgtagtcatgcagtttactctgctcggtctccgtgttgtcataccacatcgtcacctgtgttctggcgttccactcgtactgctggcgttccttttcagttatagcaaggctttttgcactttccagccaggggcccagcagaaagttatcatcagcagctagtagcgtatcgatatccacgatgatctcaagaaatttcctcgcgtgagcattcaggccatacgaatctttcttttggtacgaactcatcgcatcaaggtacacttcattcgctagtttggataggcactgcctagttaggtcgacaaggtcatacctatacgtgagactttctgaaaatgtgcttcctgcatcaagaaatagttcaagggctttgacggcctccttcgtagagtaccacagatgcggctgcggtaggattccagacacctcgcttaagaaaaacctcctatggtttctcgtaattgacatgccccttcgtttagaaacctgataagtaactgagctgggacttatgtctggaaattcaactatatagtctttattatggtccgcaatcccatcagtgcaattgtatattgtatgatacaaatatctccaagctttctctatgtcagcatttgcttgaccatatctcctataggagtatgtttttagccaatcctcaacctcaaccttcttattatgaaatgccatttcagacataagttcataaacaactggattgtgcctcggttccctccatgcacatgccaacgccaatcattgttgaattgtaacttgtacgggcatcaatggggccagatgaaattgaatcaagtatgccatacatttcaatgttcccaccaaagttgtgtaacatgcaccagatgtatggtacgccgtaaaactgagaggacattttccaaatgggcttgacatcagcaaataaatcgagaactatcatcttaccaattggaacagagtgaagtagtgctttcatttgtggctccttccagaatgcagcatctgagtagaataaccaaccctgcattaaccatactgcattcttgttacctcgggacattgcttcatagatagcagaaccaagtgatgaaatatatgccggttcatctgttggtggagtattctcattgaatgtgtcacagttatagatgttggttacatcaccgtactcttttatctgttgcctgataaaagcctgccccatatctataaacaatgaatcagaaggatcaagaagataagtgcaacaccacttaggattagcatcaactgtattccttctcccgtncacccacgcgtccgcccacgcggccggacccacgcgnccg

SEQ ID NO: 21375 - DNA, 748 bp, Zea mays
tacgcggggaccagagaaacacctctgagcattctaaagctcatagccctctccttccagagcatttcacatcgctctcatctccacctgcttgcatccagcgcctcgtcactctgcaaaacagggactcctccaggagggcgatggctgatgaggagtcatccccgagctcctgcctatcgtcagagaacgagcatggcctgcagtggtccaacagccctgaggccacatccatggttcttgctgcctgtcctcgctgcttcatctacgtcatgctcccacaagatgaccctcggtgcccccagtgcaagagccctgttctccttgactttctgcaggacaacaacaacaacagtaagaacaacagtaataatagcagcaggaggagcaggaggggatgagcaatatggttccataggcggcacgacatcaagaaaaagagttatatgaagtcctaggtccagtagttctatttgtctagtcatttcttcagtgtaactgtgatatatccattctaaaattgtgaagctagcacccatacgttagtatcacaattttggtatatcacagatacactgagtgagggcgatatctttaatccttggttccttcctttgggtctctaaatgtaatagttttgtttagacataggaccagacttcctatcttttcgtttcaagataagaaaagttcaccctgatagagtgaaattgagacgtaacttcattctatcattcataggagcttc

SEQ ID NO: 21376 - DNA, 4651 bp, Zea mays
  misc_feature (2055)..(2055): n is a, c, g, or t
tgattgattacttgtttttagagctatattcattcatttacgtataaaaactctcttgcattttcttttcacttaaaattatctaaaacaagatcattttagtaacaacatgcattataaaaaacggaagaaatctattgaaaaattatatcatgagaatataagttcatttaaaactatattatcaatatctctaagaatattcgggactagttattacattgaatcgaaggaagagacatgaatccttatcccagaacaaaagaataaaaaaaggaaaacattttttattataaaaataggtgtttggaatataaggacatgtaaatatgtttttctcgctactaataaataaggaattgttcatctctatgtctacatgtaggaaaacattttacaaggttaaaagatgtttaatttttttattttgtaaagtaaaacatgcctttctatagaaaaaagaaaacttcatgtcacaaatcaagtggtgtacatgatcaaattcctgcaattctcatttgacatatgtgtcaacatctagagaacattataccctccgatcaccaagacacattcaaatattctggtaaaagaggctatcattgagccaattatatggggacaaacaacacctaggataccattgctagaggacctccctctccctaacataggagcccctgacaggttcgcatctcatagggcctttgctacttcatcgaggacatccacaccagggtactttcctccttcctggattagttagagctcctctaaatgtttcactttttttctcttagttttgagaaacttgtgaaagacgcctagagggggtgaatatgcgaaacctgaaaattataaactttgaacacaatctttgtccgagattagcgtttgcaaaaaatggcttctcatctcataaacgagaaataagtacctcctctttgtagtaataataaaaatgtcatgtgtctctactatctgtaagctatcccaatcaacttttggcatatttcctgcaacctcaagatcatacctaaacaaatgtaatcatttatgaaatacatgacatgatataggacacaagcacatgctttcttcatacttgttgtactatacagctgcgcagggtgtgggcagggcctgtctggcgctgggaaggttgtggccagcctagcggcggcgatcgattcgtcaatcacaggttcgatcctcccgtccatggcggcgcaagcaaacacgatctcaacgaacactgagaatcatgcacaggggtaaatgtgtctcctcaggtgctaactacatgcaaatggttaatggtttacaaaagaatattatacggtggaaggcagtatactcaattggaagatctttgtaaacccatttttgcgagataaatatttgtgatggcattactgcgtgtttagagtcctaaatatgcaattgtctcccaaaatacagttcagtcagtcctatctaataagatcttgcgaacaatggtctcaaacataccgactgattggttaagtgtgtccgtggctgcaggatgacccgagcctggctggtcggataccggcgttttggcggtacgagcggatgcagtcaattagcctctaaatgacttgttttgcatcggctcgtacaatccgcgtcttccacgtgcaggtaaccaaatacacgcttagtcaaagtcaatgcacgcagtagtccagaataaagcgatgcgagcaaccaatcatatggatagtgtctttcacactgacacttgagattccaccagagttgctgcataaatgacgtaaagcagaaattgtgtgatagtatgtccttgcaataaacatggcattctcaccgtgagcagtatagtaatctctgccactttcctcctgtattgcttctactacagcctccttatcaaagataggcccctccttaaaagtagcagacaccatttatcaaagataggcccctccttaaaagtagcagacaccatgtcatcgatgtagctcagacaatttgtcaaacacatgaagggcgcactagtgttaaagatantatcaaatacgagctccacgtcaaaggcagggtgcccgttgaggacgccggtgtgtgcagtcgaggagccatcgtttccttggttgaacacggcaagcacgacatcatggaccggctcggtgtcaaataccgacaacgacctgtccgagtcggtgtcgaagacggtgaactcagaatcaccgaccatgtcacggagacggtgatatggtcggtgatcgaatcagtgtcgaacaccggtcccttgtcgagctcggcgaggtcgtcgaagttggtctcaatgtcctcgaacaccacatcgtcaaaaacgggttcggcgctgaggttgtcggtgtctgaagacgggtgcaaggtcgacgtggaacagctcccggtcaaatatggttctcccgactgctcggatttgagtggaatcgagagagaaatagggtagggtaggatgggaaaattttctccaaggaatggaatggctcaataccatttgtgatggttccaccgggacgtgagcgcaccgcaagctgaatccgccttcggacggaagccggcgacggaaggggataagacccgattcttttcttctcccctccccatctctctgatgctgctcttgtacccatctccgagttgtgggccatgggacaccagaccagaaacaagccatgttttacagttttttttttttttagaagattaataccagattaaacgagtaaatttccaaagaacaccaaataggatgaacaagtagctaatactcaaatgttattgtggtactgtgaatttgcttatttgaatgatgatgcaacgctgccattcaaaaccgatttcgccagttgccacgaacgctcacgccacggtggcccttgtcatcgcaagcttctcgtcggctccgtcttcaacatcaccatcctccttcccggaggagttcagcccggccgccacctcaagctccctccacggcccgtcgaacatctcggggaacttcttgcacaaaccgacaaccacccgccttgccgctcgccccttgccagcgtccttaagaccgcgcaccagcacacgcaccgttccaaggtcggccaccttccggcgcttcactcccgcgtagaacacgtcctccgcctccgaccaccgccctgcgccacaaagtgcgcccaccacgcaactatatgtcgcgcagtccggcaccacgtccgccttcttcccggcctccaggctgcggtacacctccaccgcctcatccaatcttttgtgccgcgccatcgcccgcatcagcgcgttgtaggacccgacatccggccgtaggctggcctcctcgcgcatgacgcggatcacctccttgacctcatccacggtgccgttggtggacttgtaggtgagcagggcgttgtaggcagcggtgtcgggggcgatgccgtggtcctggaccatggcgcgccacatctcctcggcgcggtgcgggaggcgttgcttgtagaaggagtcgatgatggttgtgaagagctggagcgacggcggcgctcccgacgaaggcttccggaggaggtggagcgcggagtcggcgccggaggtgaggcagagcgacttggcgaggatgctgtccgtgacggcgtcccgcgggacagaggcatgcgcggcgaggattgagggcacgagcccggccaggcggcggcggcggaggagtggaccgaggaccgcgttcaggtgcgcggtattgggcgacgtcatggtgccgagcagagcggaggcgcggtcggggaggcccagcgtggagagggccgagagcgcggcgacggggtgggaagggaacaggggcgcgagagtcgcgtcgatgtcgtcgaggcggccagcgcgggcgagctggcgaagacgggcgatagggacggggagctcggttttctctgccgctgccgcggcggtggagaggagccggcggccggcggcggagaaggttgcggcggccatagcggcggaagtgcggagcgaaaccagtggcccagtacccggtattagggtttcgagaagccgactgcaatagtgatcagaccgcccgcccgggggcccccaggctccccttgagaatgtggagctgggtaaaacagcccgttcagcaaaattctctgcgtgcccttcctgtccatacatttttagtcccaattttatgtctgcgtttcctattaacctcgtccgattaatccacttttaaaaattaaaagatctcgtaaacaataaattgaaggatttgattactcaatatttgattgaaatagattcataacaattctaaaaaatatgaattttctatttcataatcattcctaatttcattctaaaaataaaataaagaacctatattataatatggtttctgtgattaatatttattactttgattcgttagaacaacttccattgagtctctgcacctccttttcctttgggttctagtttaagaaccacttattttttaaaaaaaaacagatttggctcaggattcccattttccattccaaggtttctctgaatttggaagttaccatttagcaggtttcgataacaaggctcaatagaatcaagtttgtagcgtctaccgatttctcca

SEQ ID NO: 21377 - DNA, 2870 bp, Zea mays
  misc_feature (5)..(5): n is a, c, g, or t
  misc_feature (12)..(12): n is a, c, g, or t
  misc_feature (20)..(20): n is a, c, g, or t
ccggnattcggncatatggncttgtcctagcattgtgcatggcttacttaataatacttaaaaaaaatcgaattaataatcgagattccttgccgatactctactcagcagtggtaacaacgcagagtacgcgggaccatctatttaatgaatagcataagattcattgagttcttgtcgcactcctttgtgaaagagtagaatgagaaagctagtgaatcttaaacccattgataaaagaaaaaaaggataacaactatggttagggaataaaagagggtttggggatagagggacttgaaccctcacgacttataaagtcgacggattttccttttactagaaatttcattgttgtcagtattgacatgtagaatgggactctctctttatcctcgtccgattaatccacttttaaaaattaaaagatctcgaaaacaatgaattgaaggatttgattactcaatatttgattggaatagattcacaataattctaaaaaaaaattatgaattttctatttcataatcattcctaatttcattctaaaaataaaataaagaacctatattataatatgggttctgtgattaatcgttattacttcgattcgttagaacagcttccattgagtctctgcacctatccttttcctttgggttctagtttgagaaccacttgtttttcaaaaaagggatttggctcaggattgcccatttttcattccagggtttctctgaatttggaagttaccacttagcaggtttccataccaaggctcaatacaatcaagtccgtagcgtctaccgatttcgccatatccccattttacttttctttgaaaccaggattccttgtataatttaatccatctcttagttttttttgaatcattgaattcattattcgacgtagtctagcaactcatctctatttgagacaccccgctcgcttattgcaattcagaattgcattgattttatcgttgatatatttgcaattcaatcggaatgaatatatccaaaagtttttctctctcccgcctccctccttccttttttagagtattccaaatcatactataacgcttgatattcattctttttttctaaactgaattagaaatttcatttgctatgattctatcttctccttagtgaactatttatcctaaaaaaaaaaaaaaaaaaaaaaaaaaaagttcttaccattgttcccactgctcaaatgaaaatgccaatctcttggcattttctctttattatattatccatttatgttcttctttttcttctttcctatgtattagattattcctccgagccatatcaaattgaaaatatctgaaatcaaattcaatatagaatttggaatagattctattaaaaaaatccatttgcgaattagagaaataaaaagaaagttcaataaattctataatcctatttaagaatatcatttagttaagcatatcaagctaactttatctttatgaaattctagtattttttttctatctaagtggaacttccaatttagaactagttaataactaaggttaataattaagatctgacattttacagattcccccgcattatttttatttgttacactatttctgttatgtaagcccacttagctcagaggttagagcatcgcatttgtaatgcgagggtcatcggttcaaatccgatagtcggcttttttttctatcgatgttctatgaacaagaatttctctttttctccgaataaaatggggaatccagggtctattatgtcgttttaccttacaattttgctagatacaaagcataaaaataaataatatatatacaaaaaatccagatgttgatgaaattccattttttgtgttactccattttttgtgttactttagtagattttactctgtttatcctttagtttaattctgtttgaatttcgctgtattctgtaatgtaaatagaacgaaatttattgtgtaaaatgaaatttcaataaaataaaaaaggagtcttcatgtcccgttatcgagggcctcgtttaaaaaaaatacgccgtctgggagctttaccaggactcactagaaaaacgcctaaatccggaagtaatcagaaaaagaaattccattctgggaaaaaagagcaatatcgtattcgtcttcaagaaaaacagaaattgcgttttcattatggtctgacagaacgacaattacttagatatgtacatatcgctggaaaagcaaaaagatccacaggtcaggttttactacaattacttgaaatgcgtttggataatatcctttttcgattgggtatggcttcaaccattcctggggcccgacaattagttaaccatagacatattttagttaatggtcgtatagttgatataccaagctttcgttgcaaaccccgagatattattactacgaaggataaccaacgatcaaaacgtttggttcaaaattatattgcttcatccgatccgggcaaattaccaaagcatttgacggttgacacattgcaatataaaggactagtaaaaaaaattctagataggaagtgggtcggtctcaaaataaatgagttgttagttgtagaatattattctcgccagacttgaacttaacgaaaaaaggaaaggttcatagaatttttttccccttcccctttccccgaactaaatcgacctaaggctcttaattcgtattttcccgttcacctagcagaaatagattaaccctaggatacttttttcttttttgttatttcctcgatgtgtattttacataccacagtaatttgctatagagaatttctattaattaaaggtattattgttggaataaattgttatttaatt

SEQ ID NO: 21378 - DNA, 725 bp, Zea mays
  misc_feature (676)..(676): n is a, c, g, or t
tagcgtggtcgcggccgaggtacgcggggaccagagaaacacctctgagcattctaaagctcatagccctctccttccagagcatttcacatcgctctcatctccacctgcttgcatccagcgcctcgtcactctgcaaaacaacagcacatacctccaaaggatgagccgcagcaacaggaagagctctaggggccttgacctgaaactgaacctctcacttcctgcaacaggggactcctccaggagggcgatggctgatgaggagtcatccccgagctcctgcctatcgtcagagaacgagcatggcctgcagtggtccaacagccctgaggccacatccatggttcttgctgcctgtcctcgctgcttcatctacgtcatgctcccacaagatgaccctcggtgcccccagtgcaagagccctgttctccttgactttctgcaggacaacaacaacaacagtaagaacaacagtaataatagcagcaggaggagcaggaggggatgagcaatatggttccataggcggcacgacatcaagaaaaagagttatatgaagtcctaggtccagtagttctatttgtctagtcatttcttcagtgtaactgtgatatatccattctaaaattgcgaagctagcacccatacgttagtatcacaattttgatatatncacagatacactgagggagggcgatatctttaatccttgtttccttcct

SEQ ID NO: 21379 - DNA, 3703 bp, Zea mays
  misc_feature (1981)..(1981): n is a, c, g, or t
  misc_feature (3170)..(3170): n is a, c, g, or t
  misc_feature (3326)..(3326): n is a, c, g, or t
gtgcgggtgaccttccttgaattgctgaggtgggttgccagtggcagatattttttgagggggtaacaaatttgtttctatccgagtgttgaaagttttttttttttttttcccaaagaaatgaaagacatttatttcaaaatttccttactgtataaaattcaaaaataaaaattgtcgagagtacaggatcgtagcaaggataatttccccatgctaaactgtagcaatagtcaaagagccatgtaggaaaataaggaaccatcaggttttctgtatatttttctttatagtaatatgggtgttcttttcttcacgccccgtacgccatcagttctggaaaccagcgcagctgccaaaaggattttgtagtgtacactcctgctacggcagtgccagctttcaaggatttgttgagtcgattacacaggccaactatctggtttacaaaatcctagcttctgacctcacagataacatggtaagttgcttactgcaggatggttgcacagaccaactatcttggagatatccatagactaaactggtaatctgacgaacccgagccaatgccttcgttgccgtcaaactcatccaatccaatcaactcttcgatccgactcttcttatccgctactttttggacgcctgctgcttcaatcttcttattactagatcgatctgcctgcaactgtggagaggtaatctttcttggaccaccgagtttcaagtgaggcggccttcttttctgacagatgctcggcatctggtgatgactgtaactggagggtgcagatgcttttgttaacctggaggcaactgcagccgtcttctgaatcttctcttggcaggaggacgccacgcttccttttgcgtctgaatttctggtcctttggtgcagttcaatgcacttctttactgaagatagtgtgctgttacggagcctccgcaagaatggattcgagtgacggacttgagcgtacccgggatccattgtgtttctacgaggcgacagagtcagaaatctgtcaaattcaggactgttgtaggaggtgccctcaaatggccagaatattggctcatcagagtcgttggcttctttgctcaaaaacattccagcactatagctggaagaaccaaactggaggcttctgattgcgctgaaagaagggctggggaaatcaaaaccgagtatatctggaaattgttccttgtctggctctggcagcaaggcacaatcctcggcatcaagatctaaagatgaaatccagatatctgttctgtcaagatcctcaggctgagtgaatggcgtactgggggcactgattgtagatgactgttcgctgagagaactagcatatgaagaatcaccccattctgtgtctgaaagaacaaaggtcccgtcaagcctccatttagctgcatcctcctcagtagcatcctgcttaaaactctttaggcataaatgaaggatggccaaagggcaccccttgtcaggacatgaagaagttgcaatctcctcgccatcactggaattagacaatgatgacaatgacaactgtgtcgagaactgatcatgaagtgaatttgtcttgttatcaagttcagaaccgtcaaaattgtgggccctcatgctccttggcaaaattgtattttacatcatcctaaaagatccattcgacctaaaattatacaaacaagaactgtcagtggaattgtcgagctttacaagaaaaattatatggaaacaacagcagctttagttgaaacaagcattgcagacaaaccagaaacaaaataagcaaggataacaaattaaatatttgattgaagaaagtaccccatagaaagtataaatacattactatttgcgctttgaaaaggcacttatcttcattaaccaatgttttgtatctgctccatttcgtatagcaacactgcttttggtgaccacttcagctacacatgggcttttaaaaanaaaagccgcctactcctgtctatgaaaggtccctaattccatgtatcacaagcaatttcaggtgccccggcaagaccaagaataaaaaaaatatattttcagataagcaccggataaataattacagcaatggaccactaaaatcaacctgacgcacgctctagcctctagtcaagagaacaagtccattcacatttgaggggtttggtttgaggaatgaggtaatacatcatcttctcctcactttcttgtttggtttgtgcaatttaatgaattaatccatcaccatttcatttcttataggctaataattagtactaatatgagaaatgagtttgtttcaccaagtttatggaatgaacttatgatgcaccacctaatttaggatgagttgatttttaaaccaaacaccaccattatgaccgtcttgcataggttcagaaatggtcagagtggagaaggtgtgatagtgatatgcaaagaaattctttttgttaatagaacataaataaatatcgatagttaccgctgttcagttcatagaccacatacacaatgatgcatagaacaagtggctagaagcaataaaatcccatacatctggaatttgtatgcagggttcggttttctctcccagattactctgttgctgatgccgagttataacacctagagttcatagtggcacaaacaagtaattcccagcatcgtagacaacctcttgacggtggattacttctagttgattaaccagagcacaaaaaaacaagagatacgaaaatgtcgcgtctgggaatcgagaaacagacgggaaaacgatgataaataaatcttgcgcaagaacgctacctctcgtagaaactggtaaaatcgcaaaaagaaatgcaaaactggagcaatagatctaagtagagcatgattagtaaccgcagatgaaaggagagggacagtccgttacctgaatccgtggttcttgacgaagccgccaaaccctttggctccgctgctgctcctctccgtccttcctctctgatggagcagttttaagacttgggtctctgtcttttgctgttgggaccttcgattcctcagggttcacgttgcgatccttaaaaatttaggaaacgtattggcaagtttccttacctgaaatagcaaaggcaagatattcaggtgatcgtgtgcaatnagtataaacaatatcatgtgtttccttactggattccgtgcaatggtgccatttttgcaccttaataatgtatagttgatactttttttttaggaaaacacggtatgatggtgatgctcaaatacaaccctacattcatacctaatgatgatgtgngtgtaatttactaaaataacaaaattaaatgtttaccacaagaagaaaaaatatcacaaagtctatgacaaagtctatgagaatgggtcacatgtgcagagcggtagacatagctttactggactaagttccatggtaacaaacctagcctcgtagaattatttcacatcgagagcctaaacctatcatatatatttctttgtgtctcccatggttttattttcaacttttgatcacgtgacctaccatgtataattaccgtcgaacaatcttcgaatgttagcgtgttaggtaggggaagtcacactcatcaatagagagttgatggcaacaatgaattttgcatcgggagaggaattcatcttccgcaccaaagg

SEQ ID NO: 21380 - DNA, 1433 bp, Zea mays
agaccccattgtgctaaagctgatagcagagaaccgattctgtcagaatgggcagcaacgaaccacagaccactgaacccaaaatcatgacgcgttatgtgaaaaaaaaagttgagtactgttcacacgtggcaagcaagcaacacgacgatgttccaaccatcacaagggggcgaaaccatgaagaacaacacatgcagttcgtaagaacggaatggcaaacacgggtggatgttctagcacaggaatcaaagtatatctggtaacaccgcaaactcgagtacaaatacaagaaatatctgggtccttctttttccagcagagggctacttaagatagaacactgaaagaaaacaccaagctgggctccacgcaagtctgccaaccatcgctctctaccaaaatttcaaaaactacacgccatatctacctgagaggaggatttctttgcagaagtatgaactgtgattacaacccaccggagttacaggccaaaaggagtcgtcacctacataacacctaaagtatcgtacgatccatgaggtttctctctctcttttttgcagcagcagcagcatgtctttgtctgcacacctaggaagagcagcaccctcccttcatgttggcagacgaatccgcaacgttgatggtggttccttgacctggaggtccactacctgctgcctcttgggctgcaagcgccttcttgcttatgatctgatggatgtcggagaggacggtctgaaacgccttctcgacgttaagggcttcgagggcggatgtctcgaggaaggataggccttccttctccgctaacgcctgcccatcttcctctggaaccgacctcaggtggttcaggtcggacttgttgccgaccatcatgatcacgatgttggagtccgcgtggtcacggagctcgcggagccacctctgtatgttttcaaatgtctgcttcttcgtgatgtcatagactagaagtgcacccacggctcctctgtagtaagcacttgtgattgcacggtacctctcttgccccgcagtatcccatatttgagctttgatggttttcccttcgatctggagggtgcgggtggcgaactcgacgccgatggtggacttggactcgaggcagaactcgttgcgggtgaaccgggaaaggatgttggacttgccgacgccggagtcgccgatgagcacgatcttgaagaggtagtcgtactcgttgtccactcggtgcgccatcgccggccgaccactgcccaccgccgcagatcctcggattggagcggaggctcgtggagagatcggaggccgatggaggtgtcgacgatgccgagaaacggaaggagatgtgggcgtaaacagcgcggcaggggatgggaaatggaagggaatagttaattcatcccggccggcctcgagggtcccaatcc

SEQ ID NO: 21381 - DNA, 1295 bp, Zea mays
attgtatacaaatcgctagaaaaaaaatattcataattttaatagtgataacatttatgattaaggaatcaaagtttttagtgtatatataatataccggagacaatacaacaaactcaggtagaaatacaagaacgtatctgatcatgtttttttttccagcagaagactaccgaggtagaagaacattgaaagaaaacacgaggctggactccacccgaagtctgccagccaaacattggcctctaccaaaatctcgaaactacacatcgtatctacccgagaggagaatttctttgcaggagtatgaattgtgattacaaccccccagagttacaggccaaaaggggtcaactacataacaaaagtgttgtatgatccaccggggggtttttttttcgcagaagcagcagcatgtctctttgtttgcacctacttatgaagagcagcatcctctcttcgtgttggcagatgggtctgcgatgttgatggtggttccttgacctggaggcccactgcctgctgcctcttgagctgcaagtgccttcttgcttatgatttggtgaatatcagagaggacggtctggaacgccttctcgacattgagcgcttcgagggcggatgtctcgaggaaggataggccttccttctctgccaatgcctgcccgtcttcctctgcaaccgacctcaggtggttcaggtccgacttgttaccaaccatcatgatcacaatgttggagtcggcgtggtcgcggagctcacgaagccacctctgtatgttttcgaatgtctgcttcttcgtgatgtcgtagactagaagtgcacccacagctcctctgtagtacgcacttgtgattgcacggtacctctcttgcccagcagtatcccatatttgggctttgatggttttcccttcaacctgcagggtgcgggtggcgaactcgacgccgatggtggacttggactcgaggcagaactcgttgcgggtgaatcgggagaggatgttggacttgccgacgccggagtcgccgatgagcacgatcttgaagaggtagtcgtactcgttgtccatacggtgcgccatcgccgggcgaccgccgcccgccgccgcggatcctgctcctcggattcgaccggaggctcgtggagggattggaggccgatggaggtggctgcgacgggccgacgatgacgattgacgagagacggagaggggtacgataggcgaatggaacggaagcgcaaggggacgcgggcgtaaacagcgcagcacggtgaggggaagccggaccccg

SEQ ID NO: 21382 - DNA, 1221 bp, Zea mays
tttttttttttttttttttttttgtcaaaatggtaccggagattattattagaaggatgtgttacagagtacatacaaagtgctcttcaatttatccaagtatacaggtgtaagttgaacaacaaatgcaacaggaagacaggttacatgtagtatatgacgctagagggagttccatgtgacaaagaatcgaatcaccagtcaatcaatggctttggaaggcaggcagataacgcaaataagcgatctacaacctacacgcagcgatgtgcagctcggcggaaacgaacccttccgacgaggcctgtcggaagcggctcttcagctagagcagcaggagcctttcgtgacggtggacgactcagcgacgttaatggtggtcccttgcatcgagcgcccgttggtggacgcggacgcttgcgcggcgagcgccttcttgctcaccgtctgatggatctcgctcaggatggtgtggaacgccttctccacgtttatcgcctccagggcagaggtctccaggaaggacaggccttccttctccgaaaacgcacggccgtcttcctcggggaccgatctgaggtggttcaggtccgacttgttgccgaccatcataacgacgatgttcgcgtctgcgtgaccccggagctctcggagccacctctggacgctgtcgaagctttgcttctttgtgatgtcgtagactagaagcgctccgaccgcgcccctgtagtaggcgctggtgatggcgcggtacctctcctgccctgccgtgtcccatatctgtgccttgacagtcttcccgtctatctgcaggttgcgggtagcgaactcgacgccgatggtggacttggactcgaggcagaactcgttgcgcgtgaatcgcgagaggatgttggacttgccgacgccggagtcgccgatgagcacgatcttgaagaggtagtcgtactcgttgttcacacgatgcgccattttctgatcgatcgagcgagcacgaaccaatgcccagccggccggacgccgctcgctcgctggccgagcccgaacgggacgggattcaattcgcccgctcgatttccgctcgcatgtggattgaaacggtggaggcagcagatccgaggtgggatggggtggggtggggtggggaggagggaggagacgggaatgggcgcgccgaccgtggaggcgggggcggagcgcgaaaggggtcgtcccggccgg

SEQ ID NO: 21383 - DNA, 3399 bp, Zea mays
ctttggtttaaattaaacatgtgtgataccgaaaaaatattcaaattctaaatcacctttaaaaataaaaaatttgaaataacttagcatcaatatcctataacattcttgaattacatatccacgctgatttcgatcaaggatggatccgcttattcggatgttaatttttcatcttctttttcgatttcaaacaaatatgatataaaatttgctatacgagtttatattttttgtttttagcattgaccttattaagatccataaaaagtaaacctcaaatttgttctatatcaaaaatttatataaaatttagaaacggacctggattctgattttttttttacctttttcattgtaaggacggagaaaacaatgcacacaaaaaattctacaaaattttattcttgtcttatataaaatatgctggacaacacgactaaagatgagcacaaaattctataaacatctatgttaaaaaacattgattttgttatataaattcgggtgttttatgatccatcgttagtttcgatttagtagagagagagagagaaaataactatttacagcggaataaaaacttatctaaagctttaagctcaagaacaatttttaatttagaaaatattaacttaatttttcagcgagcataaacttagagcagtccacacctcaggtattaacctaggtcgaggctaggaaactccacgccggactaaacagaaagcggccggtcaacgttggttaccgttaccggcatgttactgtggtgtaaaagagagaggttattgtgtgggcgtggcacgacacgactatcgtccgattctgtcctctgatagacatgcgttggataacgaggtttctaccaatggcttgcagatgcgacgcgtgctttgggcggtcggtcgctcactgtgcacgttctctgcgagggcaggggaacggaacacgattctgcgtcgctgggaatcccgtcccgtcggaggagactcggggggttgacaaatgacaagcggcccgccacgaacgagcatcttcttcggccgcagcagctgcttcgggccgaaaagattgaccttttttttgtgtgtgtatgtgcgtgtggacagaacttgttcttcgtcttcctcctccgtcttcttggcagcagctgcaaatggagatcacaagttggcagaagcggaagggggcgcagcgtgcggtcacactcgacaagccacaggacgcaaggatcgatccaaatgccactagcagtgggcctcgtctggtgctcgtcctattcagatctctggaacactgggcatctgaataacctgaagcagtcacgtttgtcgcgagatgaatcggccgaaaccgacgcaacagctagcgacgcttttttgcactcccagcctattcctaccacggtttgcaagctgatctctgcaggaagggaccgcgcatctgcaccatcggagatgagagctgctccctctagtaatgcacggctgtcacactaccagaacagagaagatgcagagctggaaagaggtttgtgctgaagctgagaactcaattctgtcagaatggattagcagtgtagctcaaggaacagaaaacgattatgctaaagctggtagcaaagaaccgattccgtcagaatggaacaacaaacaatgaaccacagactcaaatcaatcatcggccatgacgcaaacaagcaacacggatacatgttgtagcacaggaatcaaagtttttagtgtatatataatataccggagacaatacaacaaactcaggtagaaatacaagaacgtatctgatcatgtttttttttccagcagaagactaccgaggtagaagaacattgaaagaaaacacgaggctggactccacccgaagtctgccagccaaacattggcctctaccaaaatctcgaaactacacatcgtatctacccgagaggagaatttctttgcaggagtatgaattgtgattacaacccaccagagttacaggccaaaaggggtcaactacataacaaaagtgttgtatgatccaccggggggttttcttttcgcagaagcagcagcatgtctttgtttgcacctacttatgaagagcagcaccctctcttcgtgttggcagatgggtctgcgatgttgatggtggttccttgacctggaggcccactgcctgctgcctcttgggctgcaagtgccttcttgcttatgatttggtgaatatcagagaggacggtctggaacgccttctcgacattgagcgcttcgagggcggatgtctcgaggaaggataggccttccttctctgccaatgcctgcccgtcttcctctgcaaccgacctcaggtggttcaggtcggacttgttaccaaccatcatgatcacaatgttggagtcggcgtggtcgcggagctcacgaagccacctctgtatgttttcgaatgtctgcttcttcgtgatgtcgtagactagaagtgcacccacagctcctctgtagtacgcacttgtgattgcacggtacctctcttgcccagcagtatcccatatttgggctttgatggttttcccttcaacctgtgtaattcagttccaaacttatacatcaaaacattaaaaataaattaaaataacagtaaatcagtacagaaggggaaaagaataatataacaatacaaccaaacaatactcaaactttattgtatatgtatttaattaatcaaaggacaagtcttcagaaaacataccatgttatacatgggtatggcctgtttggccgggtaacatgataaatctactaaaaggtaaacaacacaatcatgaactcaggatatccatacgacacacaattccttgttctgaaaattgaaatattcctgacataaattcatacacttacacactctcagcaagttgctcgttctcacaccaggttgaacaaaccatttgtaacccatggaccatggtaaaggtgatagtttcatcttgcatgtatgatttgcaatcacagatgacaaacacaatgcttgtgtatgcccatcacaatataccagacaaatatcagtgaaatcaaacacagtatatagcagaactacaactaaaacagcagtatacaaacatttttccaattagggttaaaccatgctggtaaagttgaatacagagtttaaaccaaatttgtagagttattaaagcttaaaacagtagtagacaatcggcactagtgtatgccgaacttgttttataatgagacaaaacaaccaaataaaaagtgacacacaaaacagacataccaagcagcaaaatatgcgccattagatggaattaaactggcaagctgagaaacctccaaactgaagggcacatatcagcaacatgcagaactcaatacaacc

SEQ ID NO: 21384 - DNA, 2602 bp, Zea mays
gcacgagaccattacctagaacatcctaatcgggccggcttttgctgcgtctttcctttgacgtcagcgagcgaagaactacttctttccctccctctctcatcattctcagatctcccgctccctccttcccttcatctctctgaatcctgctgcccacctcgccgtcctcgcattccgccgctcgctctcgcgatccggcagcttcctcttcgccgtcgttcttgcctcacctcgtccgctatcctgtaagctgctgctgggtcacccgtggctggactcgaccccgccggcgccgcctccgggggctgggttcgccggatgtttatcggctcctgatccatccggatcccggatccgccgcaaaggcaccgcctttgtaggttctccgggcccatgcaggagggtttggcgattcggcggtgaggcagggctctggtttagttcttgcgttggactagcccggagatgcttcgtggaacggggcacggcggcggggatgcgcggaggcgggcactgcgctcgtcgcggcggcgtctgcccgggtggatctggtggcttctcgggatcttcctccttgtcgggctcatgctcttcgtccttcaccacaaccaaaaggagcagttccggccgcccgtcgtggataatggttcagagatggaggaagtccctcgtgagaaagtgaatttctcagaagagcttttgagcagcacatcatttgctcgccaattagcggatcagatgactttagcaaaggcgtatgtcatccttgcaaaagagcatgataatcttcagcttgcatgggagcttagttcgcagataaggaattgtcaaagattgctctctgaaggggcagttagtgggagagcaatcactaaagatgaagcccatcctataataagccggctagcactgttaatatacaaggctcaggactctcactatgatatcagcacaacaatagtgacattgaagaaccatgccctggcactagaggagcgtgcaaaggcagcaattgttcagagtgctgagtttggccagttagcagcagaatccttcccgaagaatctgcactgtctaactgtgaaactgacagaggagtggcttcggaacccgaagcataggagtcgctcagaggagaaccggaattccacacgattggtggataataatctgtatcatttctgtatattctctgataatgtgctggccacttcagttgttgtcaattctacagtctccaatgcaaatcaccctcaacagcttgtgtttcatgtggtcactgacagaatccattttggcgcaatgtcaacattgttcctcataaatgacttcaaaggttgtactgttgaagtccgatgcatagatgagttctcgtggttgaatgcttcttcatctcctcttgtcaggcaactatctgaggttgaaactcagggttactattactcagctggttccaagaatcctgaaagagaaataaaattccataatccaaagtttgtttctctactgaaccatttacggttctacattcctcagatacttcccaacttggagaaggtggtgtttcttgatgacgatgttgtggtgcaaaaggatttgactcagctgttctccatagagctgcatggcaatgtcattggagcagtggaaacttgtttagagtcgtttcatcggtatcacaagtatctaaatttttcgcatcctactatcagctccaagattgatccacatacttgtggatgggcttttggaatgaacatttttgacttgatagcttggaggaaggcaaacgccacatcattgtatcattattggcaagagcaaaattctgacctattgctctggagaacaggaactcttcctgcaggccttttgacattttatggcctgatggagcccctagaccgcagatggcatgtcttgggtctcgggtatgatgtagacatagatgatcgtctgattgagagtgctgctgttgtgcactataatggaaacatgaaaccctggctgaagctggctattcgccgttacaagtatatatgggaacggtatgtgaatatctcacacccgtatgttagagagtgtatgttgcattagaaagtctgcaaatctctgtatgttcttgcatggcactgaagctgcatgcttcagtttcttcacatgaggctgcttttgagcaccttatgtgccggaaagttccagaggtagaatatatactcaagggacagcatcaaagaagtcaactgttaagttttctttttgggttgggagaagattcattttgggatgaaaataattcctttgcagagtttacatacaatttggactggaaaatttagcagtctaaccagatacatctggatagatactgtaaaagagatacagttggatcaatggacattcttttttttagatttaggaaatgcaaattgtgagctcaactgtgcagggccagtggtgttggattcttttagtagtatctttttttataccggcgaagaaggctctgcctccctcgtataagtagctccttttagtaatatcttgttttataccggctggatgcggagctcgtcgccctttaaggccgacagcaacg

SEQ ID NO: 21385 - DNA, 947 bp, Zea mays
  misc_feature (929)..(929): n is a, c, g, or t
ccggccgggggcttttgctgactttcgttttacgccagcgagtgaagccccactgcctccctcggccttgcgcccctcccctgccccctctctcatcactctcagatctctccctccccctccctccttcccttcctctctctgaattctgcacacctcgccgtccacgcattccgcgctcgccctcgcggatccggcagccctttcttcgccgtcgttcttgcctccgctgtcctgctctcctggaggctgctgttgggtcaccagtggctggactcgaccccgcggcctccggggggtgggttcgctggatggttatcgcctcctgatccatccggaccccggatcctctgcaaaggcaccgcctttgtgggttgggttctctgcgcccatgcagaagggtttggcgcgtcggcggtgaggcagggctctggtttagttcttgcgttggactagtccggagatgcttcgtggaacggggtacgggggcggcgatgcgcggaggcgggcactgcgctcgtcgcggcggcatctgccggggtggatctggtggcttctcgggatcttcctcctcgtcgggctcatgctcttcgtcctgcaccacaaccaaaaggagcagttccggccgcccgtcgtggataatggttcagcgatccaggaagtccctcgtgaaaaagtgaatttctcagaagaacttttgagcagcacatcatttgctcgccaattagtggatcagatgactctagcaaaggcatatgtcatccttgcaaaagagcaaggtaatcttcagcttgcatgggagcttagttcacagataaggaattgtcaaagattgctatcctgaaggggcagttaatggaagagcaatcactgaagatgaagcccatcctataataagccggctagcacgggtaatatacaaggctcangactctcactatgatatc

SEQ ID NO: 21386 - DNA, 4143 bp, Zea mays
aaggataggaatccggttgttatcaggtgtaaatatggggataatgggggcccaaggggttcagtttggatattaaatttaattttttgggggggaggggtccacttacagtggctttgccagtgggacccctggagagtcgctcggccgtttgcaattctgggtgaaacctggcgcaccccaaacaattcaatttggagttttgttattaatattttttacggacaataataagcagagagttgaaagttttagtaacagatccagaggcaaggaaggctggtggcatctcctgtaatcctgttttaacaatcatcgaatgtctcgttccttcgatactaccagccccaaggcgcctgacctcgctctcttccccttacccttcagctggtatgcttcgatcgagtttcatgtgcctgtccaaccctgatccaaatcggactcaacaaactccaggaactacatcctcctgtgtcgtatgcaaccggcaaatccacttcattccaagcaggcagagatcaccagtgccccttcattctcttcttgcatcccaaacgcggcagtataaaacatgaatgcaagccacttcattgcagctgatcacattttttttttttttttgtaacagatacaggcactgcaaggcatatcgtactaaatttcaaaaacattttctcatctctttcctttttatcttaatacatgctaatagtcaacttcctcgcaaatgatcacctcaccaaacaatgggatctacacatctatagcagtataaaacaacatcaagacatacatacacctctgctcaaatgctggtatctttgtgccgaatcgcactgattacaacgctgagtttggagctccccccatcagacttcacttctggatgccattgccagccaacaacaactcatccatccatacgatgcatgccacgatttccacgatagcggctacgctcgaggtctcctgtattctcatcgcacaagcacatcttgtgactgttgcttccatacatcacaaggctccacctcaaccttgaacggtttatcgatccactggaaaacacagccacgtgcctcaacattttttatcgtatgaggaggcatcatggatctgaatgcttcatgaagcttcactttcgtcaacccaccgcaaaccataagagttgctgtcaagccattgggtgttatacccgccaaatggacgatggtcatgttctgcaggccggatatgctagaaagggaaaggagcccaacatcggtgactgaacagtatgacaagtttatctgacggaggctatgagcgaactgggaaaggtaaagcattccaacatcattaatcccgaagcatttcttaatatcaagcttggaaagcagcctgcaccccatcgctatttctgagagcccaatcgatgaaacactggggcagccacggatctccaaagtattcagctttgcgcattttgagagtgaaatcagtgaacggtctgttatttctgtgcagtatgataggttgatagactctagcatcggacaactctgcgcaatttgaataattccatcatcgctaaggcctccacacctgtacaaatcaatctcgcggagttttgggcaagaccttccgatgtgggtaagaccttcatcacttatcttcaagcaaataccaatttttagactcgaaagttcgctgcatctggcaagagctttcaatcctgcacagaaaatattcagagtcggctttaggtccatccaggggaagaataattcagtagccagttcagtaagtaccttcgtcatccaaatcactgtcagtaaggtccaactcttccaagcgagaacagtgcttcccgatcagttggagtgctccactggaaacacggccccgcgtacaagactccatcctcatagagatgagagaagagcacgaactagttatggccgctagtgaaacatcagtgatactgcgacaacaggtaatgtccagcttcagcaggttctttagccttgacacagcaaaagagagttctgtgtcggtcactccagatgacttgctcagacttagctcccttaaagaagcacaagaggtcccaatggcttttagtccatcggccatgaatttgcagccttccagcttcagggcctgcagtttaggaagcttctggaagcttctcaccatagaaggagtgacctgatacatgaaggatgtaaattaagctgtgagggctcaagttatgccaaggtgatacaataccacgaccagatgattagctacttacaggacagcagtatgaaagttccagttccaatagattgggtaccgacttcaggatggatgaaactcccacacctgtgatattctgacactgagacatatgaagcacctgcaaccgtgcaagcatgcaagttcagttcagtaataagctgagctttgtgctattatcaaaacttattttgtgtgaccaatcaaaaatacatattttagtacaggtaacgagttcagacaaggagacaaggcatcttcagagttcagaacctaagagtgtaagatgaaatagaaaataataccgtagtgtttgaaatgaacatgacgtgtgtttgctcgtaacaagcaaatcaataaaaacgacaaattgccataagcacctcacctgtagtgatttactgcattctctctcaagactaccaagagcatcatcatcgatcgcaatacaccccaccagtgtcaactcttgaagactgggtagcttcatgatgggaggcaagctagcctttgtgatctaaaacagaagacacgtttccattttgttattactcgagcacgataagataaggggtcgctacgcactaggcacgaagctgcaagagaaagtagagttggctactagtactgctctgccgatccattgttgcaacgatgatttgtcatgtttacagatataagaacgtctgcagatcaagaatattatactacctatacacagtggtccaatgccctaaacactagctgaataaattagatcgatcagaatgatggcctagtaagtagtaactgatgaaagtagcagctttagcaaaggaacccataactgaaggccgttttgctccggtggattaaagagggagcctgatgccccttaaatcaaatcaagaaacatactagaaggaaacaaaaacagaatcgtccgtcgcctctttttttgtgtccatgaaacgaacagagaaaccaagaaacccgaataacgctcaccatggtgtaggagagatccaggctggtgagcttcctgcacttgagggcgaggagctggatccccagatccgtgagcccaaggcaccacttgagcgagagctccctcagctccgtgcacccgacggcgacgcatccgaggcccatgtcggtgagcggcttccagcgggccagcgagagcctccggagcgccctggcccgcgccacctcggccgccgcggcgtccccgaggtcgaccccattggagaggtcgagggacgacgaggcccgggcaggcgacggcgagctcggagacgcccccggcgctgaacccgcgggagcaggagaggtcgacggcgcggagggcggaggaggacccggagacggcggcggaggcgagggcggcgtcggggacgcgcgcgcagagggtgaggtcgaggcgggtcgcggtcgggtaccgcgccagcgcggcgggcaggaggtccgcgcggagcgggcggagcgtccggcggtggctggactccgcggcgtggcaggcgcgggaggccagcgcgaaggacttgagcgcccgcgggtcggcctgggccacgcggtccaggacaaggaagagaagctcgtcggccagcgagtcgagcggcggcgtgggggcgccggggatgcgcgcgagggacggagaaagggagagggcgacgcagcggcgcttggggtgccggtgctgctgggctgtcatggtcatacggtggtggagggggggtttggtggcggcttctcgatctgcggcggacgagagtgactggcaggcaagaaatggaagccggcgaagagatgggggaaggaccggaggaggagacgaggtgagatgtggtgaggcggggagacgacgatgccgccccccggcgtgtcgaactagggtaaaca

SEQ ID NO: 21387 - DNA, 1229 bp, Zea mays
cattgggtacctcgaggccggccgggatatgggaaaactggaagccattttgaaccaaagacgattccaccacctctaacaaataaggctgactgggagattaacccacttgaattggacttcacaaaagcaactgttatcggaaagggctctttcggtgaaattctgaaagcaaattggcgaggaacacctattgctgtcaagcgcattcttccatccttatctgatgacaggctggtgatccaagattttaagcatgaagtcaacttgctaataaagctgagacatccaaatgttgtccagttccttggagcagttacagaaaccaagcctctaatgctaattactgagtttctacgaggaggtgatcttcatcaatatctgaaggacaaaggtgcactcaacccacttaccgctgttaattttgcactggatattgcaagaggaatggcatatcttcataatgagcctaatgttgtgattcaccgagatttaaaaccaagaaacattcttctggtgaattctgctgccaaccacttgaaggttggagacttcggccttagcaagatcatcaaagctcagcatgcgaatgatgtatacaagatgactggagagacaggaagctatcggtacatggcccctgaagttttcaagcaccggaaatatgacaagaaagttgatatcttctcttttgccatgattctatatgagatgctggaaggtgattcacccttctccaactacgaaccttatgaggctgctaagtacgtggcagatgggcatcgtccggttttccgtaaaaatcataccactgagttgaaggatttggttgagctatgttggtctggggatatcagtctgagaccatctttcttggagatcctcaagaggcttgagaagctcaaggagcattattcacacgagaaccactggcatttgttccagtagcagtgcgcatataatcatacagtatatttttttactatgactgttgtcatgattggggctttctcgggagatctgacattgatgaatgtacaaaattgggtgcctctagaaaggtccactgagactgaaaaatcttcttgctgttttacgtcgatgctatttctggtaaaaaaaaaaaaacagaagctctctttgtaccacatcctctacaactttggggttgtttggtttagggtttaaacgtgtcacactttgcgaaaaaaaaaaaaaaaaaagcggcc

SEQ ID NO: 21388 - DNA, 718 bp, Zea mays
cccacgcgtccgcccacgcgtccgggtgaattctgctgccaaccacttgaaggttggagacttcggccttagcaagatcatcaaagcgcacatgcgaatgatgtatacaagatgactggagagacaggaagctatcggtacatggcccctgaagttttcaagcaccggaaatatgacaagaaagttgatatcttctcttttgccatgattctatatgagatgctggaaggtgattcacccttctccaactacgaaccttatgaggctgctaagtacgtggcagatgggcatcgtccggttttccgtaaaaatcataccactgagttgaaggatttggttgagctatgttggtctggggacatcagtctgaggccatctttcttggagatcctcaagaggcttgagaagctcaaggagcattattcacacgagaaccactggcatttgttccagtagcagtgcgtatatttttttactatgactgttgtcatgattggggatttctcgggagatctgacattgatgaatgtacaaaattgggtgcctctagaaaggtccactgagactgaaaatcttcttgctgttttacgtttatgctatttctggtaaaaaaaacagaagctttctttgtaccacatcctctacaactttgtctttaggcttctctccgtaaatgatggaaaatcttgaactaaaaaaaaaaaaaaaaaaccctgca

SEQ ID NO: 21389 - DNA, 5279 bp, Zea mays
  misc_feature (1869)..(1869): n is a, c, g, or t
  misc_feature (2665)..(2665): n is a, c, g, or t
agaaaacccaaacaaacgccggctacctcgacagtcgacactcgagagtcgagaccctctcccagcatcaacccgccccgcgctgccctcgtcccgatctccgacccaaatacccgatccaccatggccggaataaggcttacgcccgaggaacccgagatgcccgttggcacgccaccccgcccccagctcccacccttcgtcgccgcggcaggcggtggcggcggaggtctggaaatggcgtcggacgacgagcggtccattgcggcggattcatggtcagtgcggagcgagtacgggagcacgctcgacgatgaccagcgctacgccgacgctgctgaggtgctcgccgcttccgcgtcctccgccaacttcccctccgccgcctccgattactgctctgataaggatgatcaagatcctggtgatgttgaaggatcaatgctgggtcttcaaagttattgggatgcttcttatttggaagatcttgcaaattttcaggaacatgggcacactggagaaatatggtttggtgcagatgtaatggacacagttgctgtttggacgaaaagtttgtgtaacattattgaaggcaagattccatctggtcaagacaacatcaaaagtgaagtcaatgaaaatttattctccaactaccctgttcttgatgttggaactggaaatggtcttcttttgcaagcattggctaagcaggggtttacagacttaactggaacagattacagtaaaggagctgttgaacttgcaagaaacctagctgctcgtgatggcttctcttcaataaactttttggttgatgatgtacttgagacaaagttagataggaaattcaaaattattacagacaaagggacattggatgccatcggattgcatccagatggtcgtgcgaaaagaatggtatattgggaatctgtatcaaacttggttgagcctggtggcattgtggtcataacgtcatgtaatcacacaaaggatgagcttctgcatgaagtagaagatttcaccaagagaaaatttggcaaggagaacgtggatgaaggtgcacgagatgcgtctgagatcttccggtacatagaccatgtccgaacatatcctaccataatgtttggaggaattgagggctctcaagtctgcactgtggcctttcagcgggtgtgactgaaagctgaggcacacatagttcttggcctgacgtgtcacgttgggtccagaagaaatggataaaaaattttgtgcttcgcctgtgggactgttcctaccgtattaaggaacagtccaaactgtgtcttcttctgttgttagctcatctatccaggatggtcgtgtaattttagatggaccagactatgagacgaatcagtcctgtattgttgtcaccgtgaacatttccttgtatttccgttcctcttatacatactctagccttaatttattactctttcttgtaaggaggtttcaacttgctaccagtggattgtttaagtgatcatcatcttgttatattggctagatcagaggaacgagttttcttgtctcggatcccaggactgctggacggctgtcagcttgcctgctccataatgttggacacagtctgctggactgctggacacagtctgctgcaacttgcctgctccgttctcttcccgtatgtattaaattgatgtaatggtctagaaaatcaacaaggttctccaaaaaaaatctgaacgcaaaaatcatcatcaggggataaaaaaattcctaggggttgacaagtttaaatgagttggaatgtgttggctaaagcaaatagtttggcgtgttggactttgacatgaatgcatgtacaactttacttgttcngttatgctagaaggctagtaactattttgggtgaccaattgttatataaattagacaatcattgtggctagaaatcattcctcgacaaagttcttgaataagcaaatagacccttatatagttatataagctttgaccagttagaataatcctggacaaacaaacaaggtcttactcgaacctcgtcttcatcacttgtgacgtcgactagctgtattttcagaattcgctttgtacatagaaactactatgaaacactacacgatctcgcaaattctgtatcttccaaagcacattatgacaagcctgaagctcaaacatttttttcagatatttacagagcctgccttgccagaaatcaacgtgcaacatcgctagtttgggagctataaaatcagaggggattggagggactaaaatcctctactttttcaattttgaataataagaagattttagcctctctaatccctctgttttttagactaccaaaaactcgaatccccttcggggttaaaggagattagaagggaaattagtttatttccacctcaacccctccaatccgaaagggaatttgaggttcccaaaatagtgtttatgatatgccgcaaacccctgctccacgaggttctggaaccggcatctggtgcacagcctgcattctcatgaaagtccacattgtgattatttgtaaatgaaacggagattggaagtcctctttattaatagagtctgcagctctcctgcgcgattcgtttagacaagctggaattggaatgcaaaatggacctgnattctaaaggtctttcgttgattgagccaatgaagcaatggaggaattgatatcaagatgatgtagattggtacgacaattccagctgttctgaacagttcaggtgttcacttggatataaataatggttaggaagataataatgagacatcagatttgctgccttacagtgatcacaatcatcgcttggtgtgccgtcagtttgatccgaggtgtggccataactagcaccgaggttttctcgtatttctccagcccgtttggttcacgaaatgtaacatcaatgataataatttatacttaagtatcagcggtaataagtttaaattagctggcatcaattcctaagtataatatctaattacggttaaagttaaacaaacatgatttaacgttatcagttacgcgtaacgttacaaatatgtgaaccaaacgacatctaattactaggtgacccataagggttggtttggaacaaaggggagataaacctaggagataaaaccacccataaataactaaatatattatataaataatatctctgggattgctcactctgaaaaaatgcagggatctctagaggatttcagtttcattttggtcttgagtggttgactgctgaagtcccaccatggtgtaagactacgtgtttcgcatgtgacgacatactacatacgaaactgatattttaaaagagtatagattaattgtattatgtataaataacgcatgtgttttttttaaagaaaataaccctaaacaaaaggcatacttgagtagttcattcctatggacagtacagcatcaacgaactcctgggtggccatgtcggacgagccgccttcagccaacgccgcgcaggtcttgtctctccacccctgggcccttgcgcggatatgcttcccttgcgcgccatctcccattaccacctcgaccgattggcgcagggcgtctcgcgtgggagacgtcgggagccggaccgcgacgccgcacacgtccaccaggaacgcggcgttggtgcgctggtcggagaacacggggtacgcgacgacgggcacgccggccgcgagtgcctccgtggtcgagttccatccgcagtgcgtaataaagcatccgacggcgctgtgcgagagcacacgccgctggtcgcaccaggacaccagcttaccccggccccagctgtcgccgctcgcgacggcggtgtccgggaggaggtcacggctgtcgtcgcgcacaacccacaggcacggtcgccgcgtagacgccagcccgcctgccaactccgccatctcgtcgcgatccagcttcacgaggctcccgaacgccacaaaaaccaccgatcgcggaggctgagcatcgagccacgccgtgcattcgtcgtcggcatcgtcggcggcgcttattttctccatgtcgaggagcggaccgactggtaatggtagaactggcaggtgcgggcgaagcgcttcgatggctgcgtgctccagctcgtcggcggtgttgacaagaacccacgacaccgtctcgcggaggctgcgaaagtccgacaagagcgcttggcgccatatgttctcctcaggctcatggattaacgcggggagatccccggccgccagcgtgggcagcccagggacatcgacgggcgcgtccggcccagcctccttcgaggggaacgccgccagtgattggaagtagtggtagtacagcgacatgacggtgcaggactgcgtccacagcatggcgcccgggacgcccatggctcccgcggcgcggagcgcccacggtgcgaaaacgttggctacgacacaggtgactggccgccctgcgtcggcctggcgacggatgagctcggagagcgccaccgaggccacggcgtcgaggttgcgccccacgtcgtcggcgacgtggtagcgtgggtcatccggggcccaaacctcgcccccacgcaggtgctcgaaacgcatcgcgccgcgcccgacggcgtccacggccgcgccgtcctcgccgtgctgctggtgcttgaatctgaggcccgtgtggactgcggtggtgaaggtgacgaggaggcccatggaagcgaggcgctggccgagggcgagtagcgggttgacgtggccctgaaaaggggcagagacaaggaggacgtggggcgggggaggggccacgactgcatggcacgcgggggtgctttcttggctcatctgatctccgaagggcaaaaggtcgttctagtgattattaactttctttacttctgcgtgagtatatatgtagcttggtactcccgtttatatatattagtacgaaaagtagctctctccctccacaaacccaccgttgcattgcgatcttacacgtgtgtcacgtttgtagtcgtcctgtcacacctgaagtttaatttcttgcatatgacacatctaatgctagctctatatcatatttattgtttttgcatagttgatttgtagacatgctcctgcactgtatctaaacatataggttaattgcatggtcacttaaagctagctatttttattagagttaactttgtctgatgttattttagttaaatttaaaaatcttaaaagttatactccatccgtttgtttta

SEQ ID NO: 21390 - DNA, 867 bp, Zea mays
tttttttttttttttttcgaagaattgatgtacgcgttaaaaagaaattgtcccagatttgtctctcctcgcttcaaaacttctctaccggctctatatatatgtacacagctagcaacttacttcagtttgacatgaatcacactaatacaaagtgatgtacaatgccagggaaggagagatcgcgcccttcactgggggtgggggtaaaagatacagaacatctacaaagagaaccgcccggttacagttcagtgccaaactagctgcaaaactgctgaggtaaggcctcctcgcttcccgacattacctcttccctgagtgatgaatcatttcttctgctatctcccccgtgcggggctgcggaggtgtccaacaacgtcattgatatttgaactgtccttgcctgtgtccaacaacgccattgatatttgaactgtccttgcctccacttcaccgtgattactatcaaattcagcacgatgtgattccagaaatcacggagtctctcaggtttcctgtgatatgcgccattgactgaatctttccaagacaagcaaacttctacaaaggcaaagcataatgctcatgcccagacattatcagccttacgatgagcgacagtctccgaaacacaattgcaagtgacatgttatgagtgactcatttcaataggcctctgaaaaatctttaattctttgcttaataatctgcagttcctcatgaagcaaaaggaagaccttcttcatcaatttatgccttgctcctgattcatgatacatgtctctgagtctttccaccgtgttataatactgttccttgtctctttctttcgcaacattgagatcatcctgaacccttaaaaaa

SEQ ID NO: 21391 - DNA, 1551 bp, Zea mays
  misc_feature (1551)..(1551): n is a, c, g, or t
acagtagagcatatgcatatttcagattttttttttttttttcgaagaattgatgtacgcgttaaaaagaaattgtcccagatttgtctctcctcgcttcaaaacttctctaccggctctatatatatgtacacagctagcaacttacttcagtttgacatgaatcacactaatacaaagtgatgtacaatgccagggaaggagagatcgcgcccttcactgggggtgggggtaaaagatacagaacatctacaaagagaaccgcccggttacagttcagtgccaaactagctgcaaaactgctgaggtaaggcctcctcgcttcccgacattacctcttccctgagtgatgaatcatttcttctgctatctcccccgtgcggggctgcggaggtgtccaacaacgtcattgatatttgaactgtccttgcctgtgtccaacaacgccattgatatttgaactgtccttgcctccacttcaccgtgattactatcaaattcagcacgatgtgattccagaaatcacggagtctctcaggtttcctgtgatatgcgccattgactgaatctttccaagacaagcaaacttctacaaaggcaaagcataatgctcatgcccagacattatcagccttacgatgagcgacagtctccgaaacacaattgcaagtgacatgttatgagtgactcatttcaataggcctctgaaatctctttaattctttgcaattcgtaccagccccgtaacaagcaaaatagatccgcttggacattcttttctcctttctctttgcgtaaatacagagaaggggctccatggcgaatcacttcgatatcacgcacggtatcccaagccggacgttatgcaacgagattaagtgcgctcacgacatcgctttctccagcgtcttgatttgtaaacagccccaccgatcgaacccaaccccacgtactatgctagggcattttttcaccgtttcctcattatcagccaagttgctttccctccagactctttctcagatacttccccctgcgctttaatgggtagcccctctcacttccgaagccctcaaatggttaggtgccatatgcagcctcccattctttcccagcaaattctccctgtttttctttttaagggccttctctcctccacccgtcgcgttatctctcccggctatgggatcaatccccccgaatatacatatctataataaccgccccgatctcctagattgtgttccctcctgcgaaagatgcccacctcgcttctgttatcctccaccacacttactcgcccaatgttccagatcagagaaacttcgcccctcttttcaacctggccttcccaccacgggaggatcttagacatagaggatatccagggaacttccccgtcccctctgggggtgtccacttctcgaagggggcctcttttttcataatgtcctcactcacaaattagcccggctaataccgcggatacccacccttatccctcagagccactaacgcacatttctcggtgttcttggccgcccaccgccn

SEQ ID NO: 21392 - DNA, 811 bp, Zea mays
tgcaggtgatcgtatggagaggcactccacatgcatgtatatatatgcacgcatgcaatgaccttttttttttttttttggaatacccaagaacatgtgagtgacatgtcacacttgtgatgtatgtaagggaagtacaaagcatatatattgttcaggcaatcatcagttcagatccgaagtacagatagatctaacccagtgtttattgcttacataatctagcctgcatgatctccggggacgacaatccggggacgacaaccacactctggctcataataattaagctacccgaaatacatatatatatatatatatataatatacctacttacccatgcaggagtagaaattgaacaaccaaattattagcttgaagcagcggcacgtactctattctggagtaatagtacgtatgtaggtagcactactacgtcatgctcttcgccggtttgcctatatattggcctatacgtactctcgcagcatatctcaatcagaactcagaacacaggtcaagttcaccagaacgcggcgggttctcgatcaggcagcaggagcgcagtcgtagtcgtcgtcgtcatcgtcgccgtcggtctctgccatccttccccgtgcgctgcagcacccatcgcaaggcgcggcgtaaaccgcacccgaggaggaggtaatgctgccgccttggacgaggtagtagctagccgccgccaccgacactactgctggtgccatcctagttagtttaagactttaagtgtgcgagcgaattgcaagctgacagcgggaagaagcaaagctctcgcttggt

SEQ ID NO: 21393 - DNA, 2065 bp, Zea mays
tgagcgacgaaacgcacgcgacgcgacgcagccttgtcacgccaggacaaatccagcgctccccaaagcagaaagaccgcgacccaaagcaagctcaagctccgctcctccagtctccaccgcccgccagccccgagatatacctcccttcctctcgaagcttcgtctgcagacgaagtcgccggctcttccctcggcgctggtgccggtgggttgccagtggcggtgggtgggtggccgggtggtggtgttgctgggatgcccgccgcgacggcgaccgcagcccgcctccgcgtgccgctgccaaaagccgcccaccactcgccctgctcgagccggcgccaccccgactgccgccgccgctgacgagacgagcggccacacgcttggcgcgcgccatggacgccttgtcccgccctgctgtcgtcatcgacaacggcaccgggtacacgaagatggggttcgcggggaacgtggagccctgcttcatcacccccactgtcgtcgccgtcaacgattccttctccggctccgcccagccggcggtgaggggcacccccgccagggggaactggctcgctcagcacagcgccggcgtcatggctgacctcgacttctacatcggcgacgaagcgctggcccgatcccgcgccagcagctcgcatagtttgagctatcccatccgcaacggccaggtggagaattgggataccatggagaggttctggcaacagtgcatcttcaattacctccggtgcgacccagaagatcattattttcttctaactgagagccctctgactgcccctgagacccgggagtacaccggagagatcatgttcgagacgttcaatgtgcctggcctctatattgcagtccaacctgtccttgcgctggctgctgggtacactacaaccaagtgtgaaatgacaggtgttgtagttgatgtgggtgatggggctacccatattgttccggttgctgatggttatgtcattgggagcagtatcagatctattccaattacaggcaaggatgttacccagtttattcatcaacttctaaaggaaagaggtgagaacattccagcagaagaatcttttgatgtagcaagaaggattaaagaaatgtactgctatacttcttcggacattgtgaaggaattcaataaacatgacaaggagccatcaaagtacattaaacactggacgggcaccaaaccgaagactggtgcaaaatacacatgtgacattggatatgagcgattcctagggcctgagatcttcttcaacccagagatatataacaacgacttcaccactcctttgcaagttgttattgacaagtgcatccaatcatctccaatcgacacaaggagggctctttataagaatattgtcctgtctggaggctcgactatgttcaaagatttccacaggaggttacagcgggacctaaagaagatagtggatgcacgggtccgtgcatctaatagccggcttattagtggggatgctaaggcccagcctatagaagtgaacgtggtcagtcatccgatccagagatatgcggtatggtttggtggctctgtgcttgcttcaactgccgaattctacgaggcttgccacacaaaggcagagtacgaggagtacggtgccagcatctgccgaacgaatcctgtcttcaaagggatgtactgactcagagcggttccctgtggctgacgtcgtggatgatatccactcaaagcttaaatggggagaagtgacagtggtcgtggagacaggactgtcgagagggatcctgatcgtggggaagcatagccgtacgagctgtacaaaagagaagcgcaaatagataggtttatgtttcaccatacaatttagatgctggtaggcctgacaggatgggtttgccacccctgctgaattgggtggcattgtaatttgtagcgtcaacacttctggcggtgcgagattgctccttgtatacatgttgattcggcagcgatgtttatctctcaaaaaaaaaaaaaaggacggcccccgggggggcccggtaccca

SEQ ID NO: 21394 - DNA, 2823 bp, Zea mays
  misc_feature (2192)..(2192): n is a, c, g, or t
  misc_feature (2639)..(2639): n is a, c, g, or t
  misc_feature (2666)..(2667): n is a, c, g, or t
atccgcatcaccaaatggtaaaaagtaaaaaaggaaacaattctgaatgttgtcttaaacgcagtgcgcaactaatgccacaagccaccccagtgctaaaatcaagattaaatgctctagaacaaagtatagcagctaccaaatgtcgtattttcatactgaatgactaatacctcattttttcacttcttggaaatctagagagagatcagcagcagatggcctattataaactgccactacgaattattgctacttctacttgaatctagataacagaacaagtggatttcatggcggggtgaggccaatatcactgttcttcgccggctcgatgctgctgctgccaccatggtacctcttccagggcttgtagtcctccctttccagcatccgctccacttcctcgaactgcaggcctttagtctccggcacggtgaggaagacgatgacgagcgccagcaaggagacagcacagaagaggaagaaggtggccgatgttccgagcgccttggtcagggacaggaacgtctgcgtcacgatgagattggagacccagttggcgacggcagcgatgccgccgcagatgcccctgaaccgcagcgggtagatctccgagttgacgatccacggcaccgtgcccatgccgggcgagtaggagacgatgtacgcgcccaggccgatcagtgccagccacccgaagttgttggggcacccctccgtgtagaactcccggtggtctgcgcggcacgcatgccgagacgcgttgttcagcgccaagcacgcccccggaagaagctgcaactccgacgacatcgattccgttaggatgaacgtgcagcagaaaccttacagacagcaacaagaaatggcgcacttgccttgtctccctggtgagcacagaagccgcacgtggacgcggccttgaggcagtccatgcagctccagcggacgttcgggttgaactcgggacacgtctgggtctgggtctggttctggttcgccaacagtcgggtctccaggtcgctgacgggtggggcgtggtgtgcggcgcccaggaacgtgccgccgagcacggcgagccacacgacgattccgaccaggctgatcagcatcaggcgcctccggcctccccccgccacgaagaacatgctgacgatcgagccgatggcgttcaggcccgaggtgatgagggacagtgccatggctgtgttgttggacgcatagccggccagctgcacgatcgtcgggctgtagtacatgacggtattgatgcccacgaactgctgcgcgacctggacgatgacgccggccgttagcccgcggcgaacgaccttgctgcccatcgccttcctcagcttgcccatgaagccactctcaccgatggagccctcaaggagcacctcttcttcgacagaccggcgcattgagtcaatctcttgctcgacctcattcgcagggtaaatcttgtgcaagattgctgctgcttcctctttcctgccctgttttgtttcaccaagaaagtgcaaattgtcagtattttccttccctttcgcagcataatcctttcctcgtgttggcattggataatgactcactacattatgtagctatctataaggtacagacaaagatgtggtatttgaatccaaagtaattcttgtacacgaactactttttgtaataaaaaaatactactaccaaccttcctgtagagccatcttggtgattctggcagcatcagcatcagtacgaactggaccagggcaggaacccctgcaatgccaagcatccaccgccaggtccctggcacctgacacaggcaatggatgtaacatcaattattcctttttcttaatgaaaagacaggagctctaccgctcaattaaaaagaatcgaagttcagataaagatgtgacacagactttgcaaaacaatgttttccaaacttgtagaagatgacaagagttgaatgtttagttgagcggggtaccttagtgaaggctagattgatgaggtaggccaagaactggccaccagtgatgagaagcccatttgtgctcactagagcacctctgatcctagcaggggaggcttcagagatgtacagaggagctgtcatggaagccattccaacaccaagaccaacaaataccctcccaacaatgataactctaggtgttggggaaaangccatgataacggcacctccaaagaacagtgcatcggcaagtatgatggaaggcctccttccaaacttgtcgttcatccagccaccaaatgcagctccaactatagctccagcaacagccatactgactattgtctcctgttatttggactaaacagtgagtccgtgacatcagatatcaaccttgctagaatgttagtattgtctgaagaaaatgttagatgaactgaagttaaacttgaaccaccgtgcataatgggaaatattgtcatgtacccttaatacagtgctcttttccaccgcagcaaagtcatctctaatgtacaggagggctcccgatatgacacctggcaaggaaaatgtcaataaggtgataaatcaatcagctacactaaacttcttgagtatgtaaatgagatgatatggcaggcgggaagtaaggatgtcnacgtttttaagcacaagcacaacatgnnagatgtactacaggattaatatcatcatgacagttgtaaatagaaaggaaaattttctggatttccatcagaatttcagggtgtcggataaaggttaaaagcaattcctcttgatttcttcagtaattttaagaaagatatattgagtaattggtg

SEQ ID NO: 21395 - DNA, 949 bp, Zea mays
aattcggcaccagggcgtgccccgtcgccgctcctccagtctcctccgcccgccaaccccgagatatacctcccttcctctcgaagcctcgtctccagagtccagacgacgtcgccggctcttcactcggcgctggtgctggtggttgccagtggcggtggctgggtggccgggtggcggtgttgctgggatgcccgccgcgacggcgaccgccgcccgcctccgactgccgctgccaaaagcagcccaccgctcgccctgctcgagccggcgcctctccaattgccaccgccactgacgagcgaccacacgcttggcgcccgccatggacgtcttgtcccgccccgctgttgtcatcgacaacggcaccgggtacacgaagatggggttcgcggggaacgtggagccctgcttcatcacccccactgtcgtcgccgtcaacgattccttttccggttcaggccagccggcggcgaggggcgcccctgccagggggaactggctcgctcagcacagtgccggcgtcatggctgacctcgacttctacatcggccaggaggcgctggcccgatcccgcgccagcagctcgcacagcttgagctatcccatccgcaacggccaggtggagaattgggattctatggagaggttttggcaacagtgcatcttcaattacctccggtgcgacccagaagatcattattttcttctaactgagagccctctaactgcccctgagatccgggagtataccggggagatcatgttcgagacgttcaatgtgcccggcctctatattgctgtccaacctgtccttgctctagctgctgggtacactacaaccaagtgtgaaatgacaggtgttgtatttgaatgtgggtgatggggctacccacatcgttccaggtgctgatggttatgtcattgggagcagtatcagatctattcc

SEQ ID NO: 21396 - DNA, 2398 bp, Zea mays
ctttagagccgcaaatgagatcagactttacttctcaacatgtataaataaataaacagaaaagggcttagctgccataagtctttaacacccaataaatatggataggtaacacaaaacttgttgtaacacatcaataatttaaaatcaattctacaccatctccattctgtggctatgtctcacccaaaaaataaaaaatgggaaaattacatcgatggtcgcaagttatgatctgtgtagtggatgtagttcaagtagcagcctactgcatagcagtctcagctcgtgtgctgtttacctgtggctagagatacgcaattgttgtgctccatcaactacagatgctatagacatccactgatgttttgtcagagattgtaacttgagagaaaagccaactgatttaactacaatgtttccgtgtggcagttggagcatgtgctcggaacatatctaccatgaagcttacaaaaattctaatgttgatacacatcaatcaacgcatgaagcactgctgaatcaaagggtgtgaatagtccacatagttatcccaaaagctcttgtacttctccattccgattttgagccatggcttcatatttccattgtagtgcagtactgcaccttccttgatagtagcaagatccacatttgtgtagccaagtcccaagacatgccatttgggatccaatgcttcaaccaagccatagaaagcaagaagtccaggtggtaaagacccaagcttccatagagtatgatcagcattgcgctcctgccaataatgatatatgcctgtcacattcttgttcctccattcaaccagatcaagcacgttcataccaaatgcccagccgcaagcatcagggtcaaaatgagcacggattagcggatgggaatggttaagatacttatgaaatctgtggaatgtctccatgcaagtctctacagcacccatcacattgccattgaggttgatagtaaacaattctgataggtccttctgaacaacgatatcatcatcaagaaataccaccttctgcaattcaggatatatttctggaatataaaacctcaagtggttaagcattgataagtactttgggttcctgaatttaattggtgttccacgactaccactgccagagaagtagaacttctgtgtagcagcattctgtagctgtttaagaacgggaacatacgatgcattgagccaggtaaagtcctccaccttttgtatctccacagtgacccctctgtagtcattcatgccaaaccatgccttcatcggagcatagttcaactcatcagtcactaagtgaaaaacaaccttgtcagggtgcctcgagtttatagccgtagaattaacaacaactgaaacagcaaggatgttgtctgagaagacacaaaaatgatagaggctgttatccctcagattgctctgcactgctgggctcctatccgaaaacttcctctgaagctcgggactcttgaaccattccatggttaaccggacaccaaggcaataaagtccctttgggagctcctcagcagcaatctggccatattttgtgcttttctccacctcaactttcgacttctcctctagggactgaatctggcctttcaacttcatgattgtgatactgctgtcgtaccgaagctgctgcgcctggaagagcagcaccgacatatccctgatcgccttctctgcttcctgctccatcaccgtgcccccataggctgcagcatgcgcaaggatgctctgcgcccgccgtacctgggcactaagctccgccacaaactgcaggttgttggcctccttggcaacgacgacatatgttttggctagataaatctggtccatgagctgcctcgagaacgagcgggcgctcagcatttcgtcagtcatgttgagcgcatccgtgattccctccaggtaagttctctgacggaggagaggtgaggaggtggtctcagatccggaggacgcggcggaggtggacggcgaggcgccggggtcgggggagccgaggaggacggcgaggaggaggacgcatgcgagggcgagaaggagggaaagcgcgaggcgcacccaccacgggcgctgctgccaccggcgcttgaacgaaggccgccgctgctccaggaacggccgccgcctcatcgggccgcgctctcgccggcagggccgggcgggaggcgccgcaccgagatctgggacgcgctaaccgtcgcgcgcgcgtgggggagggctgctggatcctctcgcccgcccgtttccttcctgccgcgccttcagatctcggactcagaggagcagcacggccgggccggcagcgtcgtctgctcgtcgtgctcttggaccgacgtgccttgcttgactgcgctgcgactt

SEQ ID NO: 21397 - DNA, 1076 bp, Zea mays
taatcgtatgccctataagcatactgtatactgtacaatatatttttttttttttttttgtttggactctggattcactctcgtattcatttcaataaagccaaacaagaccttaggaaggtcaaaatagccaatagataagtttcagccttagttactaactagcgttttcctttaaattatacccttattcgttttcatacagatctcctggacgaataaacatacaaaagctacatcaaaatcaaacggctattttgttctccttttgctcattacgagggctctccagttggcttttcgtgtcaggagacgtatccgcttcgtccacatttctgaacccaagctctgacatgtcttgcttcgccatcaagtttctctccattcgacattccagatacttctttgagaactgtcgacatttttcagattgaaaccctgtagatttcaggcaggcaagatagtccttcttctccaagtcgcactcatgtaagtgatccaatgggaatacacctttttcagggggtacaggcctcacccccctatttccaccaaaagcaccaccggcgctcattttccaaaaagttcagaatgcctccaggaataaagtcggatctctaacagttgtgaacaatgctcaccaagatgcatctagacgtggatctagaaaactagcatgtggcttttggtggcatgagtgcatcggcggagctggtgaattttcttgagcatccaaatcacccacataccaagcccgagcccgagcccgcgctcctgcggacctggtcgctggtgccttgcccacaccgcaacggagatgccggcacgccgcttggcgcttacggctggccggccaggcgggcagccgcccaccccagtgcgcccggcgcctcccaaccggccacggacagcccctaggtcgctgcctgctggattgatgcggcggcagacggcgtggagagggacggacggcggtcggtcggattgcggtgcagccgccgagtcggggtcggccgtagtgacgggtcgtgacctcacgtgtaatactcaaaagtgtaataaaagtggataaagat

SEQ ID NO: 21398 - DNA, 1041 bp, Zea mays
gccggggaggaaggcgacatacgccaagaggatcaacggccgataggtatgtacagaaacaaaattacaatcccatctctcgtgatcgatggaagcatccctcgattaatcgtatgccctacaagcatactgtatactgtacaatataatctgctccttgggattgtttggactctggattcactctcgtattcatttcaataaagccaaacaagaccttaggaaggtcaaaatagccaatagataagtttcagccttagttactaactagcgttttcctttaaattatacccttattcgttttcatacagatctcctggacgaataaacatacaaaagctacatcaaaatcaaacggctattttgttctccttttgctcattacgagggctctccagttggcttttcgtgtcaggagacgtatccgcttcgtccacatttctgaacccaagctctgacatgtcttgcttcgccatcaagtttctctccattcgacattccagatacttctttgagaactgtcgacatttttcagattgaaaccctgtagatttcaggcaggcaagatagtccttcttctccaagtcgcactcatgtaagtgatccaatgggaatacacctttttcagggggtacaggcctcacccccctatttccaccaaaagcaccaccggcgctcattttccaaaaagttcagaatgcctccaggaataaagtcggatctctaacagttgtgaacaatgctcaccacaagcccgagcccgagcccgcgctcctgcggacctggtcgctggtgccttgcccacaccgcaacggagatgccggcacgccgcttggcgcttacggctggccggccaggcgggcagccgcccaccccagtgcgcccggcgcctcccaaccggccacggacagcccctaggtcgctgcctgctggattgatgcggcggcagacggcgtggagagggacggacggcggtcggtcggattgcggtgcagccgccgagtcggggtcggccgtagtgacgggtcgtgacctcacgtg

SEQ ID NO: 21399 - DNA, 766 bp, Zea mays
ttttttttttttttttagccaatagataagtttcagccttagttactcactagcgtttccttctcattatacccttattcgttctcatacagatctcctggacgaagaaacatacaaaagctacatcaaaatcaaacggctattttgttctccttttgctcattaggagggctctccagttggctgttcgtgtcaggagatgtatacgctttgtccacatttctgaacccaagctctgacatgtcttgcttcgccatcaagtttctctccattcgacattccagatacttctttgagaactgtcgacatttttcagattgaaaccctgtagatttcaggcaggcaagatagtctttcttctccaagtcgcactcatgtaagtggtccaatgggaatacacctttttcagggggtacaggcctcagccccctatttccaccaaaagcaccaccggcactcatttccgaaaaagttcagacaaatgccttcaggaataaagtcggatctctaacagttgcgcccacaatgctcagcacaagcccgatcccgagctcctgcggacctggccgctggtgccttgcccacaccgcaacggagatgccggcacgccgctcggcgcttacggctggccggccaggcgggcagccgcccaccccagtgcgcccggcgcctcccaaccggacacggacagcccctaggtcgctgcctgctggattgatgcggcggcagacggcgtggagagggacggacggcggtcggtccccaa

SEQ ID NO: 21400 - DNA, 1855 bp, Zea mays
ggacgaaaggattagtattctcgatgcttagtgttccattccagtacaattccgcgatcatctagggttggaaaccaaacacattgttgccctaatcacacttggtgctcatctagttggggctgcacaaaacgctgacttgtgcttctccccaatgccactatgagccaacacctgcaactccctcggtgtttgctgttgccgcttcttgtgccaccgccgctgtaccggcaactcccttggctttcgctgccaccgacgttgccgcttcttgtggcgccgctgctgtacctgcacctccctcggtgtttgctgttgccgcttcttgtgcggccgccgctgtaccggcaactcccttggctttcgctgccaccgacgttgccgcttcttgtggcaccgctgctgtacctgcacctccctcggtgttcgctgttgccgcttcttgtgccaccgctgctgtacctgcaactcccttggctttccctgccgcctcttgtgcaactcccttggctctggctgccggtgtcttctgcggcaccttggcagccttcttctgcttattgttactattgtccacctgtggcagtaatttcttgatctgcgctccagacagtgtctcatgctcaagaagggcgttcgctagcatatgaagctccttatcgtgagttgtcagaattgcctttgcgttattgtacgccttctccagaatttccttcacctccttatcaatcacacttgtttggccgctaacactattctcactgtaggaaacaagacccacacgcttactcataccatacttggtcaccatggctcttgccagcctagtcgcgtagtttaggtcagacgaggaaccggtggttacctcgctttccccaaatataagctcctcagccactcttcctcccatgcacacatccagcctcgccagcatctgctttcttgaaacgctatgctggtccttctctgggagctgtataaccataccaagagaaactcccctcggaacaattgtagccttgtgaacagggtgaccgccctctgtgtggatcgcaacaagggcatgcccctccctcgtgatacgcagtaatcttcctggattcatcagatataactgctgatttgcgctcactgcccatcatgatcctgtccttcgcatattcaaggtcctgcatcgtaacagcttttgcttcatccatagcggccttcagagcagctacattcaccaagttcgcaagatctgcacctgagaaaccaggagttccccttgcaatgatcatcagatccacatcatcagctcttaaaacctttgacatatgagcctccaggatctgccgccggccctcaacatctggattaggaaccacaatatgacggtcgaagcgcccaggcctaacaagcgccttgtcaagtgactgagggaagttagtggcagcaatgacaatgaccccgccattctgcttaaagccatctagttcaacaagcaactgattcaaggtcatcttcatgtattgttgatccttgggatttctgctcccaccaatcgcgtcaatctcatcaatgaatattatacaaggagaacatttttttgctgcattgaacaggtccctcactcttttagccccgacacccacaaacatctcctcaaattcactaccgctgcatgagaagaaaggaacaccagcttccccagctatagcccttgccagcatagtttttccagttccaggtggtcccaccagcaaaacacctttaggaagctttccaccaaggcatgtaaaacgcttaggttctcgtaggtagtgaacaatttcctcaagtccggctttagcttcgtcaactcccttgacatcac

SEQ ID NO: 21401 - DNA, 1670 bp, Zea mays
cttatcgtactactgtacacttcaagaggaatcttgtggcctggcaaccatttggccatttctcgcaccctgcagcagccagcgcggcgcacggggcacctgctgcttgatcagtattcactgccacatacacatggagcaggacaacaacttgacggcaaagaaagagacttgacacgctgccatgcatggttccttttcccagttcattgtccttttctttaatctatggggtttttttgtttaggattataatatattcagattatataatctaatttatttttgaactattatacaaacaaataggcccataatctcagaaacggggggaggccggggggttggtaattttctgaatcgatcgatcggtccaagtagtggcaaatgccagattgaaacaagtgacatttcaaatttgtgatgcaaccatcggacgctcattttggcccaatcgatcggcacgtcgcgaacgcgacccaaggaagaagagcccgaaaatttggggaaagctagctagctagctatatacaagcagaatgtagctagaatacagagtactacacaaacgtacgtacgcacgcacgcctagctctagctaaaagcactcctccgggatgcactgcagcgccggcgaccagcggccccggcgccttccggcagcagccaccgcgtcggccgcagcagcctgctgcttcctggcgtgctggcggcgcttcagcacgctgacgagctgctccagcgccggcggcagcccggcgaaggcgccgccgctcccggcggcggcgacggccgccgccacctgcttgagctgctgcttgctgagcacgatcttgacgcgcatcgcgccctcggcggcgacgctctcccccgtggaacgctcgatggccgtggccgtctcggtgtccagctgcagccgcgggcacctcaccagcctccgcccgtccctcctgcacgtagccggcgcggcagcagcctccagctccatggatcgcccgtctatccttcgatctggtaacgccagtaggcagtagtagctagagaacaagtgaacaacggaggaatattatgtaacaacactgtcacttgtgcgtgtccaagctagggtttttatgtagagagaagaggagcttacgagcgagacagctcagaggtgtttgtctatgtaactaaaaaaaatattggaaagggacgcagcaggtggaaccttttccattttccacagttcgatcggttgtttaaatactgcggatatacagatgtactaacggtacttgcagcctgtcaaacgctacgatgcatgcgcagtcagcgggccccacgcgtcacatgtcactgaagaattcctgaggaccggcaccactgcgtcattgcaggtctgatctggatttctcatcggcttaggtcttgtccggttatttctatgtcaaatgtattggataagattagaaaattttagaaagagttttaacttactatgagtttaaatttatgcaatctgacatctaaacacgtgattggttaccagggtgctggctgcccgcatcgctccggcctggcccgctgcaagcgcggaggaaatgcgtttccacgcatgcaggcgagtgagcacaaaaaatactacactgcatgagcgggtacatgtgtcgcaactgctctgcaggcatgca

SEQ ID NO: 21402 - DNA, 624 bp, Zea mays
gacgaaagctagctagctatatacaagcagaatgtggctagaatacagagtactacacaaacgtacgtacgcacgcacgcctagctctagctaaaagcactcttccgggatgcactgcagcgccggcgaccagcggccccggcgccttccggcagcagccaccgcgtcggccgcagcagcctgctgcttcctggcgtgctggcggcgctttagcacgctgacgagctgctccagcgccggcggcagcccggcgaaggcgccaccgctcccggcggcggcgacggccgccgccacctgcttgagctgctgcttgctgagcacgatcttgacgcgcatcgcgccctcggcggcgtcggcggcgacgctctcccccgtggaacgttcgatggccgtggccgtctcggtgtccagctgcagccgcgggcacctcaccagcctccgcccgtccctcctgcacgtagccggcgcggcagcagcctccagttccatctccatggatcgcccgtctttccttcgatctggtaacgccagtaggcagtagctagagaacaacggaggaatattatgtaacaacactacaacactgtcttttcgattaggatgttctaggtaatggtctcgtgc

SEQ ID NO: 21403 - DNA, 4513 bp, Zea mays
  misc_feature (4102)..(4102): n is a, c, g, or t
tttttttttttttttttgaattgttatctcaaatatattatgtgactataaaattgtttgcagatatgcatgaacatgaattgtaaccacagtgagtgatattttaataactaccagtaaaatacttttacgttgcgacgatatatgaactattcaataaaatgttagtgcataacaattacgtaaaaacgaatacatttatattgtcatcgatcttaatgtcttgcaaattctttgctttgcccgagtcggttgctctcctgcttggtcatgcacgagaactgagcccgaatagcacctcagcgacctcgatctactcttgcatgaaagatggcgacatcaaaatcttcgacggtgcgattgtgacgggactattgaaggtgctgggaacgtgcgttggtcctggaccatcgtggcttccatcgccaccaagtggtttatgagaggcaaaaccgaatagaaaaaagttagcaaacacgagcaagatgagagacggaggtagatggctcaaaaaagagcagaagcaaaattattgtcatcagacatgtggatgaaacagtccgggaggccaaaaaatccacgttttcacggtggtacggacttttctcgatacaagcacaccgatcatttcgtcaacaactttgcccacgatggtactcttcagattgaagtcgctaccctttcgctgcatctggtgctccgtggtggtcgaacggaggagacgaggtggggcgtacatagggtgttcatcgctggataaggcctgaaaatgtaggcctggaacacctgacgtaggcccgactgtcaccctgtcgagttgggatgcgaggcgataaggaggaagggtacaggcagggtcaatcaaaactaccgtttgcgagatgtgtggggtcgggtggagtccgcaggatcagatctgacttataaatcgcggattgtttagaaaaaagtataagaaccttttttgcaaaaagggtgacggtgggagaaataaaattggtgctttataagagattatagagatatgagaatgaaatgcatgaagcacatacaaagtgcgtcgaaattagacccacttcgtggagggacggtcatattagtaacgggatgtcaacacttgtcacacgttgacgaccaattgactatcacttgcttcttgcgatatgatttgtttgtctccaatatcttatgaaactatgaatctggttgcagatacaagtctttcagcaagagtgtatgaatatgaactgtcatcacagtgactggtatttaaaatgttgtatagggtgggatgaaatgtatgaaccactccactaaagtgctatttaaaatgttgtgtgttgtagggatgaaatgcatgtgacatgtatattacggagatgaaatgcatgaaccatatcccctcaagtgggatcacaaaatgttatatgaaatgcatgaaccacacaaggccttgttcggttattccaattctatgtgtattaccatgtgtattggagtgtattggaccggattgtgatggattttagcttgcgattacgatgaatttaaaccgactcaataccacccaatgcacatggattaaccgtgaagcgaacaagccctaagtgaaggaatggtgcagtggcattcaaaatgttgtatattgtggggatgaaatgtatgaaccaagttaatcaatcatgcatcagtttaatcgatcatacatctttcctttttctgactttccgaaaagacacacgtactacatattatacatgaaagtatatatgcatgagaatgagatggacatgtggtgcgagattgggagtgtaaaagcgagctgttgaaaaaaatattaatatatactcttttcgttctttttttatttgtcgttgttcaaaattaaactagctgaagataaatattccagaaagaatgtaatactttttaaaccctaatacaatacttgggattcttcctatcataattttattttattacgcctttagtaatgtactacacttagtctgttgaacttttggcacattatgattcaacctaaaatgacattccccaagtcccaaacagtttcacggttcacctaccttccctgcatatagaatataagggatgttcttagaacatccgacttatatgacaaaggtaacatttcaacaaacaaagatatgtgttgtgatcttgttttcaatagctatatagcatcaaaaacaaggcaatataaattaagacatttggaccttcgtccttgagttattacttatccaaagtattagcttaaggtcgagggtctttagaaagaactatgaacaaaataatatttgaacaagataataacgaacaacagacaacgaaatacgaaacttatcttgcgaaccttaacattattttgtcttccttcatattacaaaagttcaaacatataccttcgttttgcttgtaaaaaagcccgaaggtattccggaagttaaacgaagtgaagtctaatgtcctcaaaaaggtgaatttatgcaagacattgttcattgatttatagtcgcagtgtatagttttggtgaaattacaattcacatcctcaagtctatacattgagctattttgcacaacgaggatgaagttgttttttttcttttactactttcgtgagaactctggcttcgttatgcttcgtgttttgtccgttgtttcttcacggtaatattccgaagcaagttttttccctccaactgatccatctgaaggtactccgggcaaagatacttgtaatacttaaaatataccagaaagcaactattatctcggtgtttcgaggaccttcgtaagaataaggcccccaacaatatgcatagaatttaaagttaattgttggtcttgttattaagaatattataaagtacaagaataaaattttacatattttttgtgtgaattattttctccctacaacaaaaaaaggtgaacaaacatctaaatttgtatccgaattttatatcaattgtttaaaaagatatatgacaattttgaggtttaccttttataaatattaagacaatgtctaacagttcacacatatggtcacccaaaatactgttttgtcactgttcgtagggtgaaatttaaatacgagtatgaggatgagtaagttactggagatagattaataggttgaatgctaaaaacaacaatttaaatttaaatagcaaatttaatgttatttgttcataattgaagaaagaagacaaaaaatttaacattaaaaataagtattcaaatccctccctaatataggtaacagtacctacaccaacagccttagactgttcgcagcgcatgtcgcgcggtgccccctcccctaatactattcaccgtataggagcaacagtagcccccttccccccgcaacggcggcgccctacgggctcctctccgacgcgttcccttctctctcacgccagatgaggcggatgactggtcactcccccgcagtcgcttctcgtggacgcctacgcccacgccatagcgaggaaacttctcggtccacttcgctgcatctcgacgcgtctgtcgacctcgggcgagctcgggcgatgtggcggcagatctgccggtgcaaggccgattcggatccggtggaggtcgacgacgagcaggagcaactcgaccacgacgaggttgtgacgaatcaatcctgtgagcggaggaggacaaagcggccacaaatccgactccgtcgaggctgttcttcgtcgccgcatccgtctccctccactccgaccgtcgacggcatcctcagatccggatttgcccccttcgcttcctcctgttgcgccccagatcttgccttcatcaggtacaaagctcatctctattcggctcccaggttaatccgtcttcgtttaatttacgaatttgtacgttcttagtttcgtacttcagcgaagtaatgaaaatgatccgtttcgaagactgcagcaccactagcctagatggatctagtctatggtttagggtttagggaacacatttgtacaacctttcatttgcttattacacatacatgtgctcaaatcctaggtttagccgtaaatctcatacgtaaacnctggctactccttggtaaatctacagttcataacttaatttttgcagtacatatgacatcatgcttacttgttttattattgtgactgatgttatcttacaacaagtaggtttcggtttatggaactttaattggttttcatatttaggtcttctgatggtattgtaccaattaatggtagatatgtgttttctctttcatatagttaatcagtacatcatgtgaagcgcatcacatcttctgatggtattgtcataattagcctcttacatatacttcatcagtatatgtaagagttttttgtgttttcatgtactcaaattgttttgttctacactaatgacatataatggtcatagtattcggtacaatatgagtcatgcttccatcaacattatattccctgccaac

SEQ ID NO: 21404 - DNA, 1316 bp, Zea mays
cattgggtacctcgaggccggccgggatcaacaattcggtttcttgggtggtttttttttcttgcttgctcggtttcttgtggggcgggccgcgaaccggcgaggcgggggcgcggggcaacgcaaagcagcgcagcgcagcgcagtgcagcaaaagcttcgatctttatccgccggattcctctcctcccctttcctctctctccgtctccccgcttgctttgtgcttcgttgttgagaggaggggagaggagaggagacccacatccacttgcctttctcctctctcctctcgcagccccccttccaactcctcctggtccctggaaaaaaaggagaccttttggtgcaagattcgatctgctgtggctgcctcggccttgctgcgtgcgcggagatttggtttcttggctggcggctggcgcgcgcgggcagttggagctctttgattcaacaggttcagattgcagcggcgagcgactgctctgcggtcgaggctgctgctcgccgggtgattccgtgcccgctcttggtggcggcgggcggtgtcctcgtctgatccgtttcttcgggaggctttggttgatgtgctgggtttcctcggagctcagttccccaattcgccattttgatgaggagctcttcccactgtgagagctactgcgctcctcccctgtgctacctcccctgcctccccaaatccaaagacgttgcagtcggtgacccggagtccgggtccccgagccctgccgctgtcgccgaggacaagccgcccgtggtccagaagatcgaggaatctgtggcggcaaccggcggcgatggcgtcggtgatggtgacaagtgctatcgggaggtggcggtggctcccaagagttgcttgaagagggctaattgcgaggacagcagtaagaatgcggtgaaaggcaatgtgaagtggaaggatttgctggggaaggatctcacgctcacgcaggtcaaggaattcgagccaagcgaatctggagactcagacgacgaagagtacgctggcgcctgcgcctgcgtaatccaatgaggccagggatctttagtgtaaattctgtgaagaaaaaaaatcaaaacaaacaaacagaacgctctcagtcagccattagtcctggtcagtagagggtagggagcagctgtgttggtaattggtatgtggatgccatggctcgtgttgtgttctgtcagcagcttcaactgtaaaatgttgttacaaatgcatagctttagaagatattattattatctgccaaatgtgatatgttctcctgtctggaaaaaaaaaaaaaaaa

SEQ ID NO: 21405 - DNA, 1428 bp, Zea mays
cctttgcttaagaggtcacaggatcaaatccccttgatgacatgtgttttttttaattttagctagatgtgggctgtacgggggaatgagaatgggaatgagctttgcgggaggagggaatgagaaagacagaataaagaataggaatgacagaacacgggaatgaccgactactcttgcagccttaatagtagtagagattctaaaattcatcataaacaaagttaattgtgaaattaatcatctaatgtttttatcgctaacacatggtctaccaaattatgtcattcttctttctaaacataaattctaaaataattgtaaactttttttttttttttttttttcgatactagttcatcgcatacacttaaaatcaatcgtttacatacacatcacaatacacacaaattaaaacaaatagttacataaaacatgattttaaaaaattaaataaaatttgagttgtcttcaacctccggttcttgcgttcgagcagttcattgacgaacgaagggagaggaggaacgacgtcgagcagggagcggccgacggcgaggcacaggcgcgtactgtctggggagcaggggcacgggcatggccgagaggagggcgcgggcgcggccgaactccggcgacggcgtcgggtggctcgatgacgagcgaggagagagagagagagaggaaaagagggagagagcgagcttgggtgagccaggagctccggcacggcagagaccagcttttatagagagaggagagggagagggagggtcggtaaagagagagagagactagctatttacataggaggcctctcagaaaagtggcaaggcaaacaagaatctcaccctcatgatgagttcacaaacatcttcagcaactagaggggccatcatcttagatatcgtaaaagtctcattgaagtacatgtagatttcctttatcttgcgtccataacagtcacacccaactcataacctaatccaacaaatccatgccactatgaatgaatgaaattgaaccaaagccagacgttacttacgtcttcgaagaaggacttctttgtgttcttgtgcaggatcgacacaataaacctcgccactagcttcacgaatcacaatggagaacaggggcgaccaaccccacgttagcacaacatagatagataggatagctaaaactagggggaattcgtggtgggctcctcaccgaggcgtagtcgcgacaagctcattgagttggctgctggtggcgcccttatagacccacgtgcagaccttttgcatgacgagcattaggttgaagtggtcctgactgaggccgtagctgagcttcttaaggcgcaccgtgatctcgtcgaattgcaccgtctcccggcgttcgtcccgcttgaccacgtactcttccgcgccggcgaggacgacg

SEQ ID NO: 21406 - DNA, 1387 bp, Zea mays
  misc_feature (1340)..(1341): n is a, c, g, or t
attttgttttgtttaaatatataactttctattatatatttaaacatattaatgttagaattgatctttgacctcgtgcctgatcgagggcgtctaatctaagacgagactggtgagcccatgttgcacaactctataaatagagagatgtggacgaacgactagagatataaggttcacattagctatcgtctcaattccccacctaaaccctagaccgatctatatggatgggttgttagcaacggaaaatcctccactagtagagttcgcttccttaattgtcgctgctctagcgtagatcttcacagataaatgtgttagtgatcagatcaaaggtatcatctatttttggtatcgatatacggtggttattattaaatatctagatacgtgacaaaattaaaccagagtaaattataatttcaaacacatagtctacacagccatgccatattcgtcggtaaactctgtttcggctatgcacgtcacaactctcgcgggtgctccttggaaaaacatgccgtgtagccggcagtggtgtacgcagagcaatgacgaacgttacagccatcgaaagaaagaaaaaaacatccagacctgacctcaggcaaaggaacatgcactgcggcgccgtgaccacgagtgcactgtgcagcagaaacgctgtgcctgtgcgcctcgctccactgatccaaagctgcgctcgctccaaggtcgccatgggatcgtaccactacacctcgcaattcgtcgattccaaccccaagcccagccacaaacccaagaccaccgtccaaatcccgattaaatcccctcgggaaggatcgcctgacgcggtggcggccgccaagatccaggcggccttgcgtgggtacctggtcaggcggcacgtcacggccgtgcgcgctgccgacgccgaggcgacgcggctcgagcggctgctccggcggcaggagaccgtggacgccgtccgcagcgacgagcgcgagcgggcccggttctcggaggcgctgatggccgtgctgctccgcctggatgccgtgccggggcactaccccgccgtgcgggacgcgcggcgcgccgtgagccgccgcgtggtcggcctgcaggaggtgttcgacgctgttgccgtggcacccaaagcccagacgtgcggggtgccggcgagcctggagcaggtcctgcaattgatctggggagtcggagaggcgcctgctccggtgccgccgccgcatgcggaggtggaggaggaagtgagaagggccgggtcatgctgggcaagatttttttggtggagtgtagtgagtagtgtacggtcatagggtggctacagtgtnncacgttgtacggcgccgtgctcatttgtacatgttgtggatgtatt

SEQ ID NO: 21407 - DNA, 1521 bp, Zea mays
ttttttggcacaagaccataacaatataattcaataaaggaattggacagtacaacaggtgtgtgtatgtacagtcaagcagttgtacatatataaacatgcttgtaagaaattgcaacaggagacacatggtagtcggaggaggcacaactattatcattcacatgaatgaagactatacaactactcgtattaataaagaactccaaagtggtagtaatggctcttctataataattttgaggattgtcgaccttttctctattgctataagtattcctcccattttcagcaaaatcaacacataattgacgaccattaatctcgtaaccatgaaggtctcgacatgcacttaaaacagtttcctcatccttgtactcgcaaaagccataaccttttggcttgccagtctctttgtcaatcaccaatctaaagttaatgtgtctcatgaggtgtatgccatgtcctcgcatcaaacaatatgctccacatgaatcggtggcagacatcagttgtgcgttgtagaatctgatcgcacaatttctttggttctggtgtataaagtaaactgttggtgaagagtagcccgatgcacaagctgcctaggaaaaggaggaaggtccatttctaggacatggggcctgaacctggtagcaccaaatcatctcctcgtcctcctccttgtcccaatctgaggtgcctggttgaataccctgcgttgcaacagaaaaaaaattgcgcaacaataccatatgtatggccatgtgttgtattgttaatcaaaatgttagtacacaacatgccatgcctaaagcgtataggaagaatagaagcacgaaggaaaaaatacatgattaccagcaccggtcacctcagagtgggacatgaaacaggagtaagagaagtaacaatgccaaaccagaatttccaacatccaattcttgatcaatgtcgttgttgcaaggtcctccttgttgggagatcttatggctgctgcacctgtggattccgacatatcgtgcactggcagggtgttacccatatttacagcagtgaactccgaggtagctgcgagtcccaataaactctagccggatcaagtagggcaggcagcagaatcgatgggagggcaaggggttggaaacttgcttgcccatgcagtagatattcacactcagttcacgacgtaagttgcaagagtcaccttcaaaacctcacccttaagcccaaattctttagtgtggcttagtactccataagagtgccaaaaagaaatccaaacaaaggcttgatgacaaactgtctgatatagcccacaataatttgcttcaataaaatatgacactgaatacatatgatgcaagccttggtgataagtctcttgctatcaggtagtttcagacaatactcctttcttacccgcgcgcccctcaagcaaaacaaggtacttcaaatgctcagtatcagacttatctgaagttctttgctgaacagatggagcagaggcagcaagtgccccgg

SEQ ID NO: 21408 - DNA, 1026 bp, Zea mays
  misc_feature (282)..(282): n is a, c, g, or t
  misc_feature (338)..(338): n is a, c, g, or t
  misc_feature (351)..(351): n is a, c, g, or t
  misc_feature (360)..(360): n is a, c, g, or t
  misc_feature (400)..(400): n is a, c, g, or t
  misc_feature (408)..(408): n is a, c, g, or t
ttttttttttttttttcggtaaaacattgccgacaaacgagccctgaaataaaggatccaaatggtgacttacagtttttctctcacgtcattaacagcaacatggcactttggtatacaatacgacacatctcaaaatacatgtgcagccgagtacggcacagcagtagactatagccattctagtacccaggtaccctcctcgctacacactcacagagtcacagtcacggccagcccactccaccaaaaaaccttgcccagtatgatccgcccctcctnacttcctcctccaccgcggccatcgcctgcgccggcggcaccggaacaggcgcctntccgatgccccanatcccttcnaggacctgctccaggctagccggaaccccgcaagtctgcnctgcaggngccgcgacaacagcgtcgaacacttcctgcaggccgacgacgcggcggctcacggcgcgccgcgcgtcccgcacggccgggtagcgtcccggcacggcgtccaggcggagcagcacggccatgagcgcctcggagaaccgggcccgctcgcgctcgtcgccgcggacggcgtccacggtctcctgccgccggagcagccgctcgagccgcgtcgcctcggcgtcggccccgcgcacggccgcggcgtgccgcatgaccaggtagccccgcaaggccgcctggatcttggcggcggccgccgcgtcgggcggtcccgcccgagcccgttctggtagagacgtgatggggatttgcacggtggtcttgggcttgtggctgtagctgggcctggggttggggttggaatcgacggcggcgaagacgaattgcgaggcggaggtgtagtggtggtgggatcccatgggtaccttggagcgagcgcaggcgcagctttggatcagtggagcgaggagggcgtgcagttccggcagctgtgtttggcggccgtggcccgtgggcaatgtctggaatcgtcgagcgcacaccgcacacgcacagcgttgtgcgcagtgcactcgt

SEQ ID NO: 21409 - DNA, 2358 bp, Zea mays
accggcccgattaattccgggtcgcgggttaactagtcgggggccgcccttttttttttttttttttttagctgagaacgacagcaaatcaatttctcacaacctgaaagaatatcgcaaactgacaggcaggcgtcatggtcgcaagtatttcagcttccacaaattgccagagcgcatcttgctcaatagataaccaatcaatcatacatacatggctcgttctagacagcgacttgtgtaaaactaaatatcagatcagaccctacgattcacgcagcttccggaatgcagattcacacggcttctcgtttacatgggcgtgatcgcctggacggatcttccaaacggtagaaacaggtccaccatggagtcatactcctctctgctaacctgagcagcgttcaacatcttttgcacaagcttcgaattcgaaaagactggagcaagggcgggaagctggtgcacagagagcgcgtcaagcattaccagaaccacagcctgccactgcctcgatcgcagagaaggcagggcgtcaacaaacgacattgtgtcaatcaagtagcccagagtaatctccagttttgaaaccggtatctgcaacctcaagtttgatatgagtactggcacggcgttacaaacgcaagaatctagagctcttctaatctccaatgagagcccatccttcagaactgtcttctcaggacattccctcccattggcaatcaacaactcctccactgaacccctttcaagcccatacacataggccaaagacgaactggatatccatccgaatagcgcggcccacatcgtcccgaaagcagacagagttagactaaaaccttctggaggcatgtcatgccaagaatcatcaacttcaaacaagtctgtatccagaagtacaggtttcttaggccacttgataacatccctatctatctcagggtcatcatctccgccactgtttttgccattgtcatgttcttgctggttaagcatgtcaggcagaatgatgattccagcatttgaaactgcatcttctgcttctgctgtgcctgaagaaatagcttctgctgcctcaacaagtgctgcagcacacgcttcagcagatgcacgccttagtgaattgtctatgccttcctcaggtcgttttatactacttgaagggctttcatatgctttgcttgtttctaggacacttccattctcatctgcccatgtaacagactgcctactgctcttagacccggcaactttcaacgaagacttccatgcaggtctcatcttttcatcacttgtctcatcatttccaatgttcactgcttcactgaattcttcacacagttgttcagagtaagcctgtgttgaatctttttctgaagattgagatgatgaggggtgattgtctaccaatacagaacttgacaagtagttatactgattcatagcattttcctccatgtttgtcgaagcaggcctttttgtagacttacccttctgtgctcttgatgatgctttactcattttatttttctgactgccttttctctcttccaaaactacatcctcaagctgcttggcaatggaatcagatatgcaagatgacagcatactgttatcttcctcttgctctaacatctttgatggagttttagttttcttctttctaggcgtccttgtattctcaccaagaaccaggctgcccattctctcaactattacttcggagctcacgtgtgttttaaccaatgaaggtgaacttgtcatgccatcttcaccaggagcagcagcaccataatccacattctcagttctggacagttcaggtccagcaccttcgttctgctgaacctgtggcttttgtccatgagcactgcggtcatggcgcggcacataaccctcaatggcatcggagggcccaacccagtcctgcagcaagacctcgccagccccggcgacctgcttctccttgatctccaccttccttcccccgtcctccaccttcccattcccatccagtccctggaaccctaacccgctcccgtcccctgcggcggcgccctcaacgagcgcgacgaccgcggcgaggcggtcgagcgggaccccgtagggccgatcgtgcgggagcgaggcggccaaggccttggaggcgacgaggcagcgctcggagcagaacttgcgtgcctcctcgaggtcgtagacgcggtgctcgctgagggcgatgtggaagcggggccccgtggcggcggcggaggaggaggggagagggttggggcacgcggggttgccgcaggcgtccgagatggtgcgctcggtgacgacgtcgtcgtagtcggcgcgggagaggagcgcgga

SEQ ID NO: 21410 - DNA, 3306 bp, Zea mays
  misc_feature (211)..(211): n is a, c, g, or t
  misc_feature (1422)..(1422): n is a, c, g, or t
gttggagatgtttggatactagttttttataaattagatccaaaagctagttttagccgggggagactagcttcttcgttttaatcttcgttttaagaatatgagaaactagattttagaaactgaataaaaaactgactcgtttggggcaacaactaatatgcaatcagatcttatatgcaagcgtgaagccgtgaagtgagtctcttgnttcgttagatcatgatctaactgtagatacgatcatagtttgttagcgggttttttttataaatctacatgaacaggtggtggaaggatttaaatattaaatatgatatagagatgtatcataatctaatgaattaagaacatcgcttgcatataagacatgattacatattagttgatagttgttgcccttatttggagaccttctagctttcaaaaaattgtttctaaaaaaaactagataatccaaacggggcctaaggcatcagattgcacgcatatgattgtacgtataccacgagggcaattgttgtttttgtcgcattatctatattcaaactgttattgataaactagaagatgaggtgcccagaatttaactcccagttctctagatctggggaaatgatctcatttgtaaagtgaatcaagtagctgtccttttggcaagttacgtggggtcaggtgcggcggcaaaggaaggcgatgagcaccaaaaatggcggctccgcgatcagatcaactcaagtaattattcttatctcgtgcggagttatccatctaatcacgtgggatttgttggctatctcctaagaacagatccagacctcctctataaatataaaggtgtacagattgagaacctcgaacgcattctaatcgaaccaattactttctttatcattactaccatatgagtatatgtagcatagttttagttatatttttccgcatatccacctccacccatattcgactctacgtcatctagactcgtcttggatggtctgctgaccacaagacgaccctatgatcttaccccttccggggggcaagatctaattgtccacccaagacctatttctcgaattaatctcttagtttttaggcgacaccacgtcgtctggagacgccccgggtgacctgtcgactcagggcgccctaagatctctttcctagtgagcgagatctaggttccaacgaggatgaagacgaccctgcgccatcgcggaccgtccggccctgtgcgctgaccgtctggtacgaagcagagaagacgttgctcctacgtctaggtcatggaccgctccgtctagagccgcggaccgtccgcgccgccgcagaaggcaccgctagtccgtacaccctgagatcagcactaacagaaggcagcgtggacggagcgaatcaaacagacgcgaaagggaatancgattttttttcagctccccgcgtaggcaaagatgctttctatcaaacagacgctactccagttccaccacaggataatgaaatcaaagaactgagttgcaaattagagatgtagaaccatgaatcaagaaaccttaacatataattttatcccacagaacaaaggctattacaggagacagttaagatagcgttttgttgggatgcaacgacgacgtctccgggagcggtttcatcccagaaattttgaggagccaaattattcaacatttaaacataattttgtatttttagaaccaccttattttatatagaatagaatagaatagaatagaatagaatcaatccaaacaacaactagacctaaacttgcttgcttgtggcaaaaaagatggtataccccaaatttgcttgcttgtgccaaccagcagcgccgtgttctcccaatccacggacctaaacgttcgtacccaacggtaaggagtcagacgatagcacgggagatttgtggggaagcacgagcatcggaataacgaagctgcacagaagatcctatcattacaccgccactcatacaacgtacgtcggaaacgggataccaatggaagttctgcttgaaccaaagacatctgctttttttttttgacaaagttttaaataaacaattacgcaacaaacaactgctgaatgctgaaatcccatgtgttcatagcatacactagccacctaccacatgttactggactaggatctaggaagacaccaggctaccagcaaacgatcgttacatttacagttgtgtcaagtgtgaatcacgtatcaaatagaaacacaaggctttccacaactcatcaggcctgagaacctgcggaggatcctggagagaccggttcatggccatggacccggaggcggtagatgcacgtcagctgcgagcttccgtgattcgaagtgaaatccagccggaccatattgatcacgcctacatctggggctgtcacgtcaaatgtctgcacattgttcttctccaagtcgtaggcgaactctgccaaagccatctttgcagcatgaccagattgggtctcaccgggcgtctcctcgtaccatccatacacccgacagccttttggagctgtagacctgtcatacgccacatccttggacacatgctcaagcgttactgcctcaggaattatccctgacttgagcttgacctcaacaaacccattgctaccctgcaaagcaaagcactgtccaggttccccaaagctcggttcttgcatagctttttacatagtgtcaatattgctaaagtgacaataacagtttttttcgagagaacagggtgatagcccagtggctgggatcagtggtttccatcctacctaccactgttcaattccagtgggaatcagcaggtgtcagggcctacggaggcctacggagggggctgcggcagcagcagccatgggccctccaaggacgattagataatgatagttagagataagactagaagattagaaatgttatcagttagtttgttgagagtttttaggagataaggatctctagctagacagggacggtcagccggcctatttatgtaatcaatggatgagaaataaagtaggcaaaaattagaagggagaaaccctcctcttgctcggccgtgggcagaggctccggccgacattcctgcccatcgatacacctctacaatccctcactgatctagcgaccataacatctggtatccggtagcttgggtttcgatccgatcccatggcttctgctaccaatttcgtggcattgtcctggcaaccggcgtccccatctccatggattgcacccgcatgtcaccttcgtcacgccgtcctggca

SEQ ID NO: 21411 - DNA, 1712 bp, Zea mays
ttttttttttcttttttttttttttttttttttggcaaaggttcaaacaaacaattacgcaacaaacaactgctgaatgctgaaatcccatgtgttcatagcatacactagccacctaccacatgttactggactaggatctaggaagacaccaggctaccagcaaacgatcgttacatttacagttgtgtcaagtgtgaatcacgtatcaaatagaaacacaaggctttccacaactcatcaggcctgagaacctgcggaggatcctggagagaccggttcatggccatggacccggaggcggtagatgcacgtcagctgcgagcttccgtgattcgaagtgaaatccagccggaccatattgatcacgcctacatctggggctgtcacgtcaaatgtctgcacattgttcttctccaagtcgtaggcgaactctgccaaagccatctttgcagcatgaccagattgggtctcaccgggcgtctcctcgtaccatccatacacccgacagccttttggagctgtagacctgtcatacgccacatccttggacacatgctcaagcgttactgcctcaggaattatccctgacttgagcttgacctcaacaaacccattgctaccctgcaaagcaaagcactgtccaggttccccaaagctcggttgaagcatcttctctggcttaggccccacgtcaactccagacatccaaaccatgaaaccacgtttaggcacataggcctccgaatgccggacaacccttcccccgcctgaggcaacggcgtagtcaaccctgccgatcccatctgcggcatgtttctcaatctccctcatgacgatctccctggctaaggcacgaacctggtccagatcaacctcgctctccgaactcgagccaaggctccccttcacctcgtcccagaacttctcaaactcgtccttccggaggaactccatccgcttgagcccggccagcgcgtcgccgagctcaccggccctcgcgtcaagccgggtgagttggcgctcgagcgcgagccgcttatcctccagcagagcgagaaggtcgcccctggcggcgccgacctcgccgtcgatcttgcgatctacggcctcgagttgcacctggatcatccggaaggtgcgggtgagggaggcctccacctcgtcgacgcgggcggcgtagccctcgagcgcggcgcggtcgggcggcggcgagggcgggggcgggtgggaccagcgccaggcgaggtccccgagatagagcagcgcggcgaggagagccgcgttcttggcggcgatgctgagcacggtctgccaccgcggccggggcgggtgagaggtcttttttcggcgtgcgtgctgagcggacgcggcggcggttggttggagcgggggcgtaggggagaccgggtgcggacggtggttgaggaggaagaccgaccgcttgcgctgggcggcggcggctccgggtgcggggcgggaggcgagggggatggcgtctagggttagtggggaggaggcggggctggtggccgcagcggcgaaggagggggacgccatgggacggagggctgcggaggcggttggggttcggggtggagtcgagggggggaaatccgaatgcgaaatgcttgggcggtttgggggagcgggcagtgcaggggaagacgaaccacgcacgcgccgaaccgaaacggagcggcgcttcttcg

SEQ ID NO: 21412 - DNA, 1127 bp, Zea mays
gattttgtgatggtcttgccagtcaatgtcttcacaaaaatctgcatgccacccctgaggcggagcaccaggtgtgtgagtgctctccttctggatgttgtaatccgccagggtgctttttttctccattttcttgccggcgaagatgaggcgctgctggtcgggtgggatgccctccttgtcctggatcttggccttgacattgtcaatggtatccgaagactccacctcaagggtgattgtcttgccagtgagtgtcttcacaaagatctgcataccacccctgagacggagcaccaggtggagggtgctctccttctggatgttgtaatccgcacccgggcggccgtcccggccgcgaaagccgtgatccatccgaataaacggcagactgtcatccctgccaaaatctgagctcgcgtccgcagaggtccatggcgtccaagtccgtcgagctgcgcatgacgctgctgggcgtggccctgctagggctgctgctgctgagccagcacgcggcgcccgtcgatgctgccgagagcgacggccccagaaaggaaaagactagcttcagcatgaacgtcgtcggcggccgcactctcagcagcttcagcatgaactccgcatacagcgagaagaagcccagcagcaagggcgcaagcgcaactgatcccgcacacgggtgatgttccacatccatgcctataggccactcacctcaccacgcagcgttaccggccgtactactatatctacatacgaccgtgggacaacgtcgaccggagctcgatcggcgcagttgccgcatgggcgtggctgtcaaagttcctttgtttctttcttgatttgtgcttgcgttgggttcggtgttccactttctttttatgtgattattaatcttgttttcagatgcatgtacgcatgtatgtgccggcaccatttggtcttgtgttaagtttattcttggattccaatctctagtgtagggtcgtttggtttgtgtgtgcatgttgtactcataccaacttctgtctttacatcagtatttattaagaaatagcaatgtgacctatccaaattagatagagtcgctagaattgctaaaaaaaaaaaaaaaaaaaaaaagtcga

SEQ ID NO: 21413 - DNA, 1396 bp, Zea mays
ttttttttttttttttttttttttttttttttttttttagagtcaagagtataatatatgtaatgctaccccaactacagctacaaggtttccggtattcaaatgatccgagtattatcgaaattttatttctgacactaaggactgaacaagaagctaaacaaaaacggctacaacatttacaccacaacatttctagcatgtcgtggtagggaagtgcaaaaggcaaagtaatgcttaaccacaactcaattggcgtggctgtaactagtgtacagaagattgcaacttaagattctgatggtactcagcaccaaccgcttcaatccgctacaatcgaagacaaactcatgctcaggaagaaagtagacatggtttctagtctccagacaagcaccgaaggcaacggcactcgaagccaaatccatcagcaagaatcttctgtctagcgtcggcatccatgctagcatcgatgtagcagatgcacagctcctcgccttcttcaatgtcgcggagagccttcaatttcgcgtccgcgttttgcagccaaacaatgtgagcattcggatcgcagtcatggttgtagaaagatgggagcatataaaccgcattgccaactgatgaatcacatgatacagaggctgccgctgaggataagagatcctcatatgaacttgcaaccaattcaatacgaaaagcatttatgcgtattcttgccaatacattgatgtaccaatctatggtcaaaaaggttgtgatttcttcctgaaatccagcttttctaaaagtggattccaacaactcaaattcctctttcatctcaatcagcgtcccctggtgcaacagagctggctgaagtatgttaaggcaatctgcattagcagctcctgatataaccatgcaagcaaggcgcttggccatgtatgggtacttcagatcacgtgaactgcagtggtaatcgaataaagaccaatctacattcttttcaatgtcatggaaccccttggcgtggtccctgcaagcatcgctgcagaagtagtcacccccgcttgaagcgcgcccttccccgggcttccttctgaggcaattgtagcaaacctcgtggagcagagagtgggaggggtgggagacgaggggctgcgctgagtggaggagctcgccagaagatactgggcgggtagcgaagacgccgcggcccgcggactccgttagggacacgcggatcggcggtgggccgcgggcggcggtcgcagcggcagcggtggagaggagacggcggcggaggaacatgggatgccttaccgcagacgaactcaatgactgtgtgggaagaggagtggcgatttacaacccaaatttttttttgactagccccttctaggtaatggtctcgtgc

SEQ ID NO: 21414 - DNA, 3632 bp, Zea mays
  misc_feature (898)..(898): n is a, c, g, or t
gagagatgaatgtagacataaaaatttagggctaaactgaatactattttgtgatggattgagtagtatttaatgtttttatagagggttaaaaaacaatctataatatcttgtagttgtagtttatatattttatatgatatggaaatattgtgaaaagatacagtagactagacatagcttaacaatattgcgtacgtgatcgaaacggacgtgtcgtcatcgtcgtgtgtccccatcccgtcccgtcccgttggctgcactggctcgcacaagtctcttcctctacctgcctacgaacattatccaacaaacaaaacaaaacaaaacaaaaaaccagtaatatgctagagcatggagtggtgccgtgttccgtccgtctccacgatcattggcgacggaaacaaaataaaataaataaaaaggaccccgaaagatattcctgcggcgacgaacgagcgaggagtcgtgccgctcgacgcttgtggcaagaaatccacgcgacgacgtggcacgcacgataaaggagagtactagcatatatttatcccgtcgccatcggtcgccaaatttttctgatccccaggccctccctgtcactgccagcctgccacgtgggcgtgtcggacggtggaggaacaagtaataaattaaaccagtagatcttcttaaaactccaagtccagctaaaatatgcatactgttacaaaacattttgtacatatgatctaatccatccatgtgtcatagtgacagttattttctaagagacacactccttagaaactcttgtatatatacttcactacactacaataaagaactgtccctgtctttctcctgttgccactgagtactacacaatagattgcaacatatacataaagcgtttggctcnggagccaaatgtgatagaaaagctcacgtccgagagattttagaaaattaaataatttaacattttaaacaaaataatttaacatttaaacataattttctatttctagaatcacgctccaccccgtccgtcctatatagaatcaatctaaacaaccattctttctatctccgtcgcctaccccgtcactatcggccgccacattttcctgatccgcgggcggcgctctctatcgcctatgggtgccaactgccaagtgagcgtgtcggacgcagtggagcaacaagtaaaaaaaaaaaaactagcagattttaaaaccaaggccccgattaataaaatatattcagccatgtagtgggtgacacggcagttttcgagaacaggcaagcggatacatgtaaagaaaaaagagagacttggagtctgaaatcttacgtgtagttgtctgttgttggagagatgccgtagcagaatccttacttgttctgtacgcatccttggattgttgacaaatgacaatgcaaaataaaaagtcgggctacgttacgtaaggcgtcgcgtttggatccttcgaatctaactccactctaattatcctacttgagatgtgagtcggctcagctaatatgattctacgcggaatatatttgtatactacagttgttggatatttatgtgatatatttctaccacatctctactacagaagagtgggctgaaagttgcgttataaattgtagagtagaaacatagattgacaacatgtaaaatcaattcctatactcccactctatgaatattaaatatgagacgaccttgtgtctgagatttgtaaagtgctgggacgttaaatccaaaccaaataatctacgaagctggtggagagggcttttcctactcagaaaccgatgggcgcccacagcatctggatatgggataagacaacgacccacagatttccgggttttttttttttttttgctgctggtgttggtgtgcgtgacccgtggactgggtgagtgagtggcagggagaatctagccccatgtggtggtgtggcctttctgaattcttctggtttagcttctccctccctccccggccgggtcgtggcgtcgtgctcttgaagcttaatcagtggtccaggtgcgctgcagaggaatcaagcaggggtgatcaaggcaaggactgtcttcttcggctgctggcccccccatctactaagtgcttggacgacttggcatcttcgaggacgttgccatagtgccactgcagattgttcttccttggaatctgtttcgtcaacccgtgtggttatataagatactcagttcagttggttctggaataagaatgcatcctagatattttcaaatttcaggacagaacaagggatagtgtcagagacatgcgcatcatagctttattccaggaccagtttgattcctgcatatgtagaactatctggtagacgtatttggtctttaggcaattgtatcttgtatgtgtgaattttgtgtttggttagtacgataagccatgtctaggattacaagatttcacgcatgaattgggcttgccacgccagcaaaacgtcccaaaagcggccagctttgacgtgtgctgccgtggcaaaaaaaatgtagaaacccacccaaagctgacatctgtgctctcgtcgtcttttgcaaatgcggcagcaaattaaatatcacattaaattccgcgtgccacaccggcaccgccaaaatcagcaaacgtaggcattgaaccagacagacagattgcgcatgctaactatataccacaatctatcagcggccggctatcttcacaaaaaaagggatgacatatcatcctgaataactggcgatggcaatactgactacggtgaacaagatgtacatgcccataaggcagtatccccagaacctgggcacccgaaacctagcccaggtgaccaccaacagggtgcccatcaggctcaggagcaggaacacaaacgcgacgacgatcccaacatggaactcgagcacaaaagctccgggatacaccctcgccgtctgtaccacaagggcggttcccagcccgaccagcatgttgaacatcgggccagcgaagcagccggcgacggcgatcgtaggctgcccagccctggccagcgccacgtccgcgacgaggtcgcccacggagttcccccacgccaggaccgtcatgccgagaatggcgggagggaagtccatgatggctccgaccgcggcgaggcagctcaggagctctccggccgtggtcgagatccagaagacgctcatgatgaaggagatgatggtgcttgcgatggtctctgtctctggggcttctttctcgaggaggtagtgggagagggctaggcacaggctggcgaagagcacgacggaccatagagggaagcggacttgcgggaggaggaacactattcgggtgtctagagggatgaacgagctgaaggagtacaggattaggagagggcacaggccgatgtttgcgctgatgtaaactttgctccactcggaaggaagggttgatggtattgtgagcttcagaacgagtgcgatgggccactcccaaacttctgttacctgccagaggtagatgtacttagatcagtcagagagaatgagaggggaaatggtctccaacaaactgagtatctgtggcgccccccaacctcccacttttggtcccctttaagggg

SEQ ID NO: 21415 - DNA, 1250 bp, Zea mays
gaaagagtaggggaaccaattttttttttttttttccgtggaaatcgattgttatattctgaatctccagatacgtgtggtcatttcagtcactaaaccacacaagctggtttagtctggggcaacataatataatagatttacaacgaactgaatcacttcattgcctttccaaatacattcaatccacctttggaacagccatcgtccttctgggctctggctgcaggctcatctagcaggggcttctgatacttgaaagtcccatcaacgtcatccacattattcaagctgttggttgggtagccgatttcaccttagaagggaggtccaataaaacttccctgtcatattctactctcgtcaggcactggtgccaaatcgaagtgctcctccagcacagcgaatacttctgtcagtgaggacaccttgaagtcaggttttacttcctcaggtaaagaatcgtgaggaccatatcgccccgtttcatcaagcaagcaagtgaaagctcctgccctctttccacaaacaacatcatccttgagactgtcgccaaccatgatcacttcgtgtggtggaatgttccaagcggagcatatgtgaagcagtggagcaggatttggtttataggggcgaaattctctgctcagtgcaggagtgaacgtcataccaaatctttggtggaacaaatcaactgcgtccttcacattacgggtgatcaaacctcttctgatctgcttcgcgtccaggaagccacacagctccgaggccccgggcatgatctggaggcggtcgaggccctcccgctcgaagcgcgcgatgacctcgtacgcgtggcgctgcttgtcgggcgcccagtcctcgatgcagtggaggatgtcgacggagcctccccccgcgccgcgcgccgcggcgtaggcggcgtccccgccgagcacctcgcggtacatggccgggaaatcgatgactggcaccgtgagggtgccgtccatgtcgaagaccaccccgcgcagcggacgcttctgcccgggcgcgggcgcgggcgaggcggaggcggacatggcccggcggccggcgaggacgcggcggcggtggaggggcgcggcgcccgaggcgtggggcccgccaaggagcaggcggtggggcccgttgagcaggcgggggagcatgcgtgcgtggcgtgagagcgtgacctgggccgctggatgggccctcccgtatcggatggcttcggctggggtgggggttat

SEQ ID NO: 21416 - DNA, 8942 bp, Zea mays
  misc_feature (104)..(104): n is a, c, g, or t
  misc_feature (4300)..(4300): n is a, c, g, or t
  misc_feature (4310)..(4310): n is a, c, g, or t
caaacgggcatgacgaattaatgatcagaaagagggtgatgaaacaacttacaccaaatctttggtggaacaaatcaactgtgtccttcacattacgggtgatnaaacctcttctgcaaaaaatttgaggccagaaatcaatgctgaatatacatccctaacacaacaaatgactgacagaccaaaagaacaacgattgcagttattcatgaatattgggcaagataaactgaactcaattttaaaatgacacccacacaagcttgacagtagttccatcttccatgatgtggaggcagcaagcactgacctgatctgcttcgcgtccaggaagccacacagctccgaggcccctgcgtacccaggacaaaatcgcaagcagtcacacaccacaaaatcgcgggtactcgcagcaagcagcaagcagcaaggcaagcagcgtccagtggtggccgcacggctgaccgaggccccgggcatgatctggaggcggtcgaggccctcccgctcgaagcgcgcgatgacctcgtacgcgtggcgctgcttgtcgggcgcccagtcctcgatgcagtggaggatgtcgacggagcctccccccgagccgcgcgccgcggcgtaggcggcgtccccgccgagcacctcgcggtacatggccgggaaatcgatgactggcaccgtgagggtgccgtccatgtcgaagaccaccccgcgcagcggacgcttctgcccggccgcgggcgcgggcgaggcggaggcggacatggcccggcggccggcgaggacgcggcggcggtggaggggcgcggcgcccgaggcgtggggcccgccaaggagcaggcggtggggcccgttgagcaggcgggggagcatgcgtgcgtggcgtgagagcgtgacctgggccgctggatgggccctcccgtatcggatggcttcggctggggtgggggttatgggctgcgcctgacttgtgtccgtgttgtgtggtgcctgctgcggccttcgggtggcgttggcctgccgcctgcctgggtggtggctggcggcctttcgctgtctccaggttaccgcctccactgcattttgggttcagtcagaggctacctttctcttgccttgccagtaaacaagtctagcattgcccgacactgtgatgcacatgcactgatgccttgtcgaacgaggatagcgagcctgctatctgcttaaccttgcacaacctttgttatcatgtgtaggagtataattataatcagcttcttatattatgtttaaattataactcaggcatcactgcatgtgcagatgttgtaggtccagcgattcacagttgcgatcaaagccaagccatgcagcagcagtatagattgatttctgctctgtgccctgtcatttcttgcagttgcagtgcagacccgacaatcatctttttgaccccactccacctcctttggaggctattcaattcttcgctagctcctattctaccgcctcaactccacacaaaggaatgatgtcgtacaggtacagtgacagtcaatctatctcgtacgtctgatcagattatagtaaatagtattagtgtttatatcttcaaataaaatgcatattctacaaccaatccagttatattcgctttgaaccttttatttaaatttaagaaaacattcaattattcgatctcttggaaagaaaagtaagaattgtacgtatctctttttgtgtgtctacggatgatggagtagctagtactagtagcacacatgtaccagtggtaccatggctctttgcattggcaggacggtgcacgaactaacaagctctgtcgtgtcaagcccttaatatatagcagcacttcacatcagcgtccggttttcacttaatctggttttatttaactatgccgaccaaaataatgatgcccattagtatgtgtactagattctgctacatgtataacatgctaaaaacaaaagataaagcattacgttactttaaaatatataaagatgatataaacagaatagactattgcggtagagaatatttctcaaattggttttctttttttctttttggttcacttagagcatgacattatttatgatgtggatgacaaaaaaacaattcctgtacttgaaccgactctatacaggcatacagccctgtacttgaatctactgtttctgcttgtcttcttagttatgggcttgttggattcatttgacaaacagattaccggttagcaccttggactccaaacaaactaactaataaattgactaattattagtcaaaaggttgatagattgtttacacattaaccatattaaccatttgaccttgttaatagatgctaataaatcataaaaagatgagaaaaaaaagaagatccctacctctatcgatttctttactttctctcatgtctaattctttgatatgcacacataaaacatactatttactatgttttagatatatattagcaaaaactttaaatatactctgactaattatttgtcaattaattatttaccggctaattgttaaccactgataaacaattagtttggaggatcgaagcagggcctaactcgtcactgtgttttcgttttcaccctcctgatcagtccagggaccatcagaattcaatggcctccataagaaggtgaaggtatggctgcatacctgcactcacgtacgtcaggtcgcttgtaaattgaagagcacgctccgttgtttggatctagaaattcaatgcgtattcattaaattgagtaccgaaactaaatcatccttgtattaaaaatggctcacgatatcaaatctattgtttggatgtatatagaatagaattgtgcattttcaagattaaattaatttcaaacataattactacatgaacaatggataaaatcatgcataacaaataataataagtttggattaaatatgcctttgaatgcatataacagaactatgaacgagtaacttatcattacttacaatgagaattgccctagcctgatcaaagatgacttaatgacatagtcatgtgatcgatgtcaattttttttgctccaatctatatcggttcatcaatgaaactagattttatagtcattgctcaatgtactgtcgtcgtcacatcaacatacgtcgatggttctcgaacttaacatactgtgtcacttgagttaacgaactctaaaaaaacagaataataggagttgtagcttggctgactcatttaaaattgggtttgctaaaaaataaaaaatgagtgtcgacgtgtcgtgccgtgttagtcacttaggccttcgattttgatatgtgtgtgttacttaggtccccgaacttttattagtgtgctctagtgtagcatgctatattgacatttggattgagtaaacccagttttagaagagctagccaaatcacaacactaattttcatggttttgagagttcgaaaacccaagcgaaacaatatgtcaagtttaaataccacgaatgcattttattcataaataaaggagcatgagtcctacacgtatcacaactaaactatatttaatactcgtaattagcattcaaacatttgatattgatacacatgggtggacctaggacaaaacgggagtgagagcacaattgtgaggacgagtaccaaaataatagagcgagggcgtctaagttaggttgagcagaggacctaatggtgaaagtttatgctctactactcgcgggagaaaaatgagcgagggcttgtgccctccctccaatcaacgtaggtccgcccttgattcatacggactaaactttagttagaaaccaaacccccactagctcttgtttgaatactctcgtattaaccaaagtccacgtgtattgagctctagcccttgtttgaatactctcgtattaaccaaaatccacgtgtattgaggtacgagagtatcaagcaaagccctaaaaagtggataatctagacttataattacaactatttgacgaatagatttttgtttcctactgtcatggaaaaaaagactctaggccttgtttgaagtctagagctaatagttagttagctacaaaaatattagttaggttgaaccaacgaataaaataattgttagatgtgcatgtgagttagctaacaatattagctggaggtgtttttgaaatctctgcaattaatttaagcagctagctattagcttcggaggttccaaacgggaaaaatgtcactgcacgttgggagactcggacattgtttgtttcctgcagaatgtatngtatcatcangtattcaggttgcccgcccgtccattcatgcaggatccaattcagggcttgttcggttgcgtctggatcgaaggggattgaagaagattaaatctctctctagtcaaaattgaatagaaggagctttaatccccctcaatccacttcaatccagacacagccgaacaaggcctcaacgggctcacttttgcaaatcaagataggaaagtgacaccactattggtagctagcattagagaattaattaagcaaatgccttttttttgtttttatgaatcgcctgaaaatttatataaattattacaagaagctgtcctgctatatgacaattgacaggatacggtcgtcactatcacacaattaaacacctgcactgcagcacacacacgaacgaacgaacgaaaccctgcagaaaaccacatccggaaactgatggcacatgatgcactagctaggtactctcactacacacgcatacgaaactgatctgacgatgtggcaatggcgacgcacgaagctgatcaggcagctgatgaagcggatgacgacatcacgtcacgtacgcagctgctgcttctggaggtcgacggcgaggacggtgctgaggttcatgggcgtgatgtagtcggtggagccggacatgaactgctgcacgatgaggcggttggcgcgctccgtggggtggaaggcgtcccagaacacgtaggtgtcgcggtcggcgcagaggctggacaccatggtgcagagccccatgccgttgaagcggccctggccgcagcacgcgtcggtggcggtctggaagccgtacgccttggggtcgtcgatgaagtcgttgtggatgcgctgcatgttgacgccgacgaacacggggtcgccgccgccgtggcgcgcgttgagctcctccagcagcgccatgagccgcgggttgtacatctcggcggcgcgctgcagctcggcgtcgcaggtgccgtcgaggctgtgcagcgccagctccgcggggacgcagccgatgggtcccaccccctgcaccagcacccgccgcgcgccgaggtcgtagaggcggtccagcacctgcgcgtactccgacagcaggtaggagacgtagtccggcagcgagaactcccgcgaccgcgccgagtagggcaccaggtagtagttgttcacgaagtcgttgccgcccagcgtgatgagcaccagcgcgccgcgcaccacgcgggacgccgcctccgggccgatcagcgcggccaggcgcctctggtactgctcgaagtagcgcagctgcttggagatatggatgatgttggcctgcaggcgtccgcgctgcgggcagatgcattattagtttaggcgcttagctgtaccagagctccgagctcaccagtgcaagcaggatagggcggcgatggatcgcgtgtgttacgtacgaactggattccggtgtcgttgaggatgccgacgccggcggacgcgaagttggcgccgacgagcatcttgtcgccgtcgagctccgggctcaggtacggcagcacgggctccgcgccgaggtgctcacctgcggcgtgcagtcgtgcaccatgcatgcaagtttagttagttagttagtaactggaaaggcaggaaggactcgggaagcattccggcatgcaagcgacgacgactcaactgatgatgtccggcacgttcttgccgttgctgaaccggcccgtggcgcggtggtcgggcgtgtcgatgccgtagggcggcgagtcggcgcgcgcctccgtgagcaggtagttgttgttgccgttgtcgacgagggagtcgccgaagacgaagaaggcgcgggcggccgcgtcggcgccccgggccgcctggagcgccgcccccaggcacaggcagagcgcggcgaaggacacgaggcgcgaggcggaggccattgcgggcggcgcttgctgtcactcttgtgatcctgtcagtgtgtccagtcgatcgatgtgatggacgactgcatgcacttgcacaccacactcagcacttgcagtgccttccctttttatagtgccctcgtcggccatgccgccgctgaggggaatggactggagtgatgggatcagagaagaatgagtggtcgcgatcggtggttggtgcccgccattactgctgcactgcggttcaattccccccacaatcttggctagctgctggctgctgctaatcccaactccatttctgtgacgtacgcagcgaggagcttcttctcttgtccaactccagttgcaacagtccagctttgtttccatcaccaggtgacattcgagacgtgcatgaaacagacgcgacgtgttgcgtcgaacctgggcatgagtttggcatcatccagcacgacggatccgatctacaagcaggacgaggacggcgacgtacgcagccggcctctactctaacaggtgtggtgtgtgtggcgtgaatgaatgccaagcagaagaataaagctcaactgcaaggagcggcgcatcatcagtgagccttctgtaaacgcacggcgatcaacgctccggacgtacgtactgaaacgggaatgggatttgccagtgccgcaagggttcacattacagcgatcagatccagagcaactagcacgaacagtattcatgagggcagctggatctatctatctatgtatcagcccatgcatggttgtaatgatgcctgctggggttagattagatgagctgtagtatgaagcgagctagatgagagtcttcttgacagtgaacagtgagtggcactgcagtagtagtaagatcggtttgcatagcatcccacgtgcggttccttcttggaagcccaagaacaggaaggaaaaagattgtggagagagtacacagattaactgcaagaacaggcctgcccgagtaccaccagcaccaggcaccacccaatcaatccaacactgttgcactgcagctactgggcgtttatggatcggatccggccaaagctcaccggtgaaaatggaatccagagggaaccgtgaatccggccaagcacgtagacgtaggggggccggcccttcgtccggtccctcccaaccctcaaccgcactctgcattgactactactggcatcaccattgtccatacctcttcattccttgtaaatagatctagcatgtacttggaattttctccttttttcccccccgcagagtcctactgctttttcatatactcttgctgccatactcttctagcgacatttttgcaccaaggagccaaggcacacagtacaggttctgtgcagaaacaaaccggacagtgttgttgttcaagtgtttctgcactcactgttgaagtgaagtgaagtgaagtgaagatcggtttgcagacagtgtgtgtgttttatttaccaggtgagatagggcagcagaaggtggagtggaggagacaagcaggcgccccacagttacaaatgacctgggcagcttcaccttcctatggaggccattgaattccggtgttccctgcactgggctaggcaggaggatgaaaacaggagcaagagagagagagacagagaggagtaaaggcgagcagtagagatctctcgagtcggttcaagtacagagtttctactcctcatcctgtcggttgctggaactgtggccacacatgtaaactctcgagtcatcgtgaagccccggagaccgtggctcaaacataaatgtgaaaaaccaccggaggtcgcctgaacttcactgccggctgccgctcccctgaagaagagcccagtttgaaatttgaaggtgatgcttatcttagctgttgggaggtttggttcttaatgcgtgcgaaggagagggagagggagagggagactgacacctggcttgatggattgagcttggctgcttgatggctgatccatccgatcctcgtacgagacggcgacgacgacgtacgacgctgtcgcgattggcaaagcagagtttgatagatggcaggtcattgtcgctgaatccctcatcttccgttggttccgtcagtttcagctttagctttaccgtcgcgatcgcggatggaggagcgtgcagtggaggcggatgggcctggaaggaaaggccacccgtttcaccggccatttatggcagtcaatccggcggccggggagttcttcttgcatgcgtcggcgtcgtccgcgctcgcgttaccgctggatcgggcggagatggtcgaccgccgtgtggcagccgcagatgcagcgggaacggcaacggcaaccaccggcaggcggcagcggggcccgctattggaagccggtcgcagaaacacgcatgggttggcacggccgtgtgcttgggttgggcctgccactgccagcctgctgtacggtgattggctccggtggctcagggacgtcggtgccggccagtggaccccggcggcctcgtgggccggtagtctctgctctgccgaaccatcgttgggctcagatactctgcctatcaccagcacagggcttacatgggccctggcccgtcctctcttttgaaacctcaaggcctggtttatgttacaatattccactacagcacttacccttcgctaggagataacatcgagaaagttaggttttttgggactccaaataata

SEQ ID NO: 21417 - DNA, 863 bp, Zea mays
cgaaattcaaattgtcaactttattagaggtgaatgagggaggaaaatcagtttattttcacctcaatcccctccaatcctccagaactggagacccttaatttaaacgggaaagttacacccacattcataggccattactacaatgccagcttactgacgacacaaaagccgcagtacaggacgacgcggtcgcaggcacgaaagaaaatgcaagtccattcagacgtttacaaaaagtgaacaaaatgaggtccacagtccacacacaaaacaaggctgcatgtggggcaactgtagccaaattattagagctgcatacgagaggcatcactaacagttttgtggtgactggttgaagagcaagggacaaaaggcatttacgattctggaagtaggaatgcagaatggaacagtaggactgcctggccaacttgttgactggtccaactggaggtctcgggcggtacattcagagaggtcctggaaacgtcccatgctccctctgctcgttccatttctcaacccattctccagggcaaagggacctgtagtacttggcaaatttttcgcaaacaccagcatcatcccctttggcattcaaacacctgtggtactcgacatagcgagtaaaacaatgccttgtttggtttgttgtagggaagcggaagtcagcaggtgctgtttttatctcaatctccgccatcttgctgaaggaggaggacaaggggtcgagacagcggcgtgttcgcggcggaaggcggagccgcggagggaggtggtggcgatggctgattgtaatcgggcactcggctgctggtcgggtcaacctcgatggcttccgcgagccgcccctgaaggct

SEQ ID NO: 21418 - DNA, 903 bp, Zea mays
  misc_feature (890)..(890): n is a, c, g, or t
  misc_feature (895)..(895): n is a, c, g, or t
ttttttttttttttttttggaaattcaaattgccacttttattagaggtgaataagaggggaaatcagtttatttttaaactcaatcccctccaatcctccagaattggagacccttaatttaaacgggaaaggtacacccacattcataggccattactacaatgccagcttactgacgacacaaaagccgcagtacaggacgacgcggtcgcaggcacgaaagaaaatgcaagtccattcagacgtttacaaaatgaggtccacagtccacacacaaaacaaggctgcatgtggggcaactgtagccaaattattagagctgcatacgagaggcatcactaacagttttgtggtgactggttgaagagcaagggacaaaaggcatttacgattctggaagtaggaatgcagaatggaacagtaggactgcctggccaacttgttgactggtccaactggaggtctcgggcggtacattcagagaggtcctggaaacgtcccatgctccctctgctcgttccatttctcaacccattctccagggcaaagggacctgtagtacttggcaaatttttcgcaaacaccagcatcatcccctttggcattcaaacacctgtggtactcgacatagcgagtaaaacaatgccttgtttggtttgttgtagggaagcggaagtcagcaggtgctgtttttatctcaatctccgccatcttgctgaaggaggaggacaaggggtcgagacagcggcgtgttcgcggcggaaggcggagccgcggagggaggtggtggcgatggctgattgtaatcgggcactcggctgctggtcgggtcaaccacgatgcccgccgcgagccccccccgcccgcgcccgaccccgcccggccggncccgnagggtacc

SEQ ID NO: 21419 - DNA, 946 bp, Zea mays
ggccgcttttttttttttttttttcttttttgaacacagtgttgttatgattcagaattgatacaagcctacaatgtgttctcgtcagtcttataggagacgcggcagcaaaacgtatcaaacggcaaccctaaccaccctgaatctgcaaacgcggatgagatacatcctcgcatttctgcccaatgaaaacgagagaagaagaaaaaaaaaacatatacgatcctacgatgtctcgcttctccgccaccaatccggccgggaacagagcggagggcatgtaccggcggcgccctgacgtcgggcacgcaaggccaaacctaaaccgtagtaacgagcgccagccgcaacgagaaccagcagacggagcggaagggtctcctcacctccgccatcttgctgaaggaggaggacaaggggtcgagacagcggcgtgttcgcggcggaaggcggagccgcggagggaggtggtggcgatggctgattgtaatcgggcactcggctgctggtcgggtcaaccacgatggcttccgcgagccgcccctgaaggctgagaaggaggcgagaaagaccggagcccagcgtccgaaaaccgcggctcttcgtggcccatctggtccgcgcagcacaataccaagcccttccaacagaccgcgtggcccagctcaaaaccaggcctgttgatgccggattccttaggatgggcctctaaaggcctgcttggtcgtctaggctcatgtgtacagacagatagatagataaatagatagatagatagatagatagatagatagatagatagatagatagtagatattaggtagatcaggcgtacgggcacggaacacgacaacgaacacgcaggaaaatttggactctgacgagtcgatcttgttgcgtagtatatgtgcttcttttggtgaacgctgatctgcaggcatgcaag

SEQ ID NO: 21420 - DNA, 835 bp, Zea mays
caaaagctgaggctcgagggccgcttttttttttttttttgggaaattcaaattgccacctttattagaggtgaatgaggggaaaattcagtttatttttacctcaatcccctccaatgctcgagaattggagacccttaatttaaacgggaaaggtacacccacattcataggccattactacagtgccagcttactgacgacacaaaagcggtagtacaggacgacgcggtcgcaaacaaaatgaggtccacagtccacacacaaaacaaggctgcatgtggggcaactgtagccaaattattagagctgcatacgagaggcatcactaacagttttgtggtgactggttgaagagcaagggacaaaaggcatttacgattcgggaagtaggaatgcagaatggaacagtaggactgcctggccaactcgttgactggtccaactggaggtctcgggcggtacattcagagaggtcctggaaacgtcccatgctccctctgctcgttccatttctcaacccattctccagggcaaagggacctgtagtacttggcaaatttttcgcaaacaccagcatcatcccctttggcattcaaacacctgtggtactcgacatagcgagtaaaacaatgccttgtttggtttgttgtagggaagcggaagtcagcaggtgctgtttttatctcaatctccgccatcttgctgaaggaggaggagaaggggtcgagacagcggcgtgttcgcggcggaagggggagccgtggagggaggtggtggcgatggtcgggtcaacctcgccctcgtgggccccaaggggcccgccgcctcgagg

SEQ ID NO: 21421 - DNA, 848 bp, Zea mays
  misc_feature (7)..(8): n is a, c, g, or t
  misc_feature (10)..(12): n is a, c, g, or t
  misc_feature (14)..(14): n is a, c, g, or t
  misc_feature (16)..(16): n is a, c, g, or t
  misc_feature (23)..(23): n is a, c, g, or t
ggggttnntnnntntnttttttntgaggtgaatgagggggaaaatcagtttattttcacctcaatccactccaatcctccagaattggagacccttaatttaaacggggaaaggtacacccacattcataggccattactatgatgccagcttactgacgacacaaaagccgcagtacaggacgacgcggtcgcaggcacgaaagaaaatgcaagtccattcagacgtttacaaaaaaagtgaataaaatgaggtccacagtccacacacaaaacaaggctgcatgtgaggcaactgtagccaaattattagggttgcatacgagaggcatcactaacagttttgtggtgactggttgaagagcaagggacaaaagccatttacgattcgggaagtaggaatgcagaatggaacagtaggactgcctggccaacttgttgactggtccaactggaggtctcgggcggtacattcagagaggtcctggaaacgtcccatgctccctctgctcgttccatttctcaacccattctccagggcaaagggacctgtagtacttggcaaatttttcgcaaacaccagcatcatcccctttggcattcaaacacctgtggtactcgacatagcgagtaaaacaatgccttgtttggtttgttgtagggaagcggaagtcagcaggtgctgtttttatctcaatctccgccatcttgctgaaggaggaggagaaggggtcgagacagcggcgtgttcgcggcggaaggcggagccggtggcgatggctgattgtaatcgggcactcggctgctggtcgggtcaacctcgatcgcctccgcggccccatcccgggt

SEQ ID NO: 21422 - DNA, 659 bp, Zea mays
  misc_feature (567)..(567): n is a, c, g, or t
ccgacggtcattggctccagaactcccacgaggccacgactggtcgactcctccgaggctgaggctcccatgggccactgttcgagttctacggcgagcgacggccgcctgctggatccatcgccgccagcagacgagccccgctaggaggaggcaacgggggcgcgtcgcacagtgcattgtaacagtggaaagtgggaaacgatacgtacgtctccgtttattcttgcccccacctcatcttgatacaaatgccatcagcagcggtgaaaattgtgatgcagttttcttaccaaatagctaaaaagttcccgaggaaatctccagcagcaagagtaatttgggtggttattacttcatgtatggaaaagagtgcagtgaagagacaatatatgaagtaaccaataaccattgaattataatcttgatccactccgtgtaattcaaatatggggtaactattgttgttcttgctaatgtgtttactagattcttcttatacgatagctctggtactttacactctttactatattcttcttgctaatgtgtttactagattgtgcncgatagcatattgaggttgtagctattcctttgttttatttaaataaatgtctggtctgtgtaacaaggtatttacaaaaaaaaaaaaaaaa

SEQ ID NO: 21423 - DNA, 840 bp, Zea mays
ggctttcctatctcacttcatgttacaaactctttactctatagacagcagtctatagagatggcttagagggcaaaatcgaagctgtggtttgacccatatgccatcacagcctcacaggcaatacgctcagtgttcagatgctcgaaccacacagtacgatcatataacgcggtgttggtcatgtcatgtctccatatcacgcacactaccacaacagacaccatgttttagcaacatctattgaatatctcgctgaagcctattcacgagctggaggcctcaaaagtatctggcttatgcttctccatcagggccgtcagggctgcgtcgtgatccctctccagctccagctccttcttcatgtattgtttcttgagcttcatcttcttctcctcgtggcctttgatcagctcatcccgctcagcttcaaactctgccacattcttgacctggcaatcaatgaacttctgtacatgttccttccttagcttacgatcttcttcggtagttccagaatcaacatcaaagcgtctagcctttgagcgctcctcctgcagcaacttctcaaatcgtttttctttatcctctgtggccttgtgaataccctcaatttgactatgaaaaaattcctcctggtgcttcatctcttcctcatactccaagtgcttctcttttgctttcctcttgacaaatacgttctcttccatagtctcacgtagcttctgggtaataacacccaatgtttcttctactgctttagatctctgctctgtcttaaccatcttgttctttaggtaattcagttgttggttatcttcactcatctgtttcatctga

SEQ ID NO: 21424 - DNA, 3181 bp, Zea mays
accgtccccacgcatcctcgatctacgtttgctagatgatagacttgtctttgttgataccatcttcttccgcaaatctctagttagagagtatttttattcatcatcaatctgcagctttcggctcgtttcaaatgtttgttatattgaaagaaatgggggaaagagagaaccacgaaatgggccgaaaaaagaaatttcaaatcctctttccggtgggccaacgtgacagccgacaatatccacatcgcgcctcgcgaccccgcccgccatctttgctccctggggcgggtcggggcccacccgcccgcctcggctgctcagctctgctctgctcagctctgctcccttcccttcccttcgcctaccccagccagccaggaatcgccaccggcggaagccaagcatcgtcccagcaccggatcgattccgcccgcccgcccgcccgtccatggatccggcggccgagccggcggcgtggccgccgtggacgtcgctcctgctgcgggcgctgagccggcggcggacctgggtggcgctcttcctcgccgtctacgccgggctgctctcgtcctcctggtccctgctcgcctccgtccgcgcctggtactactccgcctcctcggcgtccgcggcgcccgcctggcccgccgcgctctacgcgtccgtcatgtacggcgccgtgttcggcctgctctccatggccgccgcgctcgccgtcgccgcgcccgccatgctcgtcacctggaccaccgtcctcgtgctgctcgccttcgcgggccgcccgcgcaggtcgctcgtcgccgagggccgccgcgcaaccagggacatcgcgggcctcgcgctccgcgtactcctgcgcgagggcaacgccgtcgccgcgctctgcgccgccgcaagctttgccgcgctcctcctcggccaccgcgatcaccagtagtagctctaagtctgttgccgtcctcttcttctcgcgctagatctgctacaaccttactggtgtagttgtaaattatcacaccaagttgtttcagttactccacaaattggacactgatggcatctgtaatgaatgtagcttgtcacatcacgctcaggttcaaaagattatttggatgagaaaaattgacctcaaggctaactaaccttgcacaaagcatccatctgtcactgctagcacaacaaataattcgagtagggatttctttcagatgacgtgatcttctgttagggagaaggatattggccgctctggtggaagccatctcgacaaaatgggcatgcatttgtggagctccagtttggatccagctattactgatgaaatcgtaagtgttctttctcttgttaattcccctgagaggccggactttatgcttttaattagcacaacaaatattcgactcgactagcatatcctttgaaatgatgagttgcatctttatgaaattcctttctagttcttagctaagtgtgtggattatctgtcatgcaacgtatttatcctaaaattaaagtgtgttatttaattcgtattgttgtatcagctatctgaattgtccctcgaaattgtgaaatggcagttcccttatagtttgtcagtcaatgtaccagttatgatgcatgcccattactactttatttagcttggacacaagattaggatttaggaggaccaacacaatgataatggcgaccaatctgaagattaaccaatacaatgacataaacattactacttattctcaatctttttatgggcccaactgtaaacagaaaatgcttgagctcccctttgtcatgggtgcccttataaaacccctggcagagaaattgaatgaagattcttcatgcgctgattttctggggaaaagcatgttgatttggctttatgcagcaatctcttgtttgtcatccagcctccagcctgaggaaagtaccagtgcaaggtaggcttcattgtaattataggtagataactccggtataatattggatttacaatgtgtttggcaaatagattccttcgcagtcatgtaatatgatctattaaattttcaggtatttaagacttgctgcaagtggcactgacctgtttcccactgagcataactggaagaatttaaatagacgagtgagagatcagtggatagtgatgcacaaagatcattattgtttcccatcgaaccagcgattgggcctgcagctccgcgacgggggcggacatgagcgagtgggccggcacccggcagttgggcttcaattcaatgagccagatagtcgggggaggtagatgataaaaatacgtggagagaaattttacgataaatacttaataaggttcttaaaccataaaaaaacatctctaaccttctaaaatatcctagagctactctggatactacgaatcggaataagaaatttaaatttcttaaattatatctcaatggttccaaaaaataaatctagttgttagaaagttggcaatatatagaaaaccctaaaacgttgcaatcgatagctaaataagttataaaaaacttttcatgacaaaaatatgagatgcaactagcaaggacgcaacatatgttggtgtagaaagcattcattctctgcattcgtgctagttgtttattatattttgttgtgcaaaattttaaatacatgtttagatgccaattagaatatgtttaggatttttctaatatttttcctattgtgctagagctaaactctagaatctcttagagatattttcatgagatgcaaatattttagctggatttttcatacctcaatctttctcgagtattttttatcacaaatttagaagattaggtttcattttatatggtttaaaaaccatataaaatatttaccatattttaaaactaaaaggggacaaaacatcctttagaaacattccaaatcaatatagaaatatattttgaacaactttgagagttcagatggtaagagcatctctactagggagctctaaaataaagtcctataaattaaattaggaccacatttaaagtgttttgagcctcaaaaaaactttactccaacaggtatgccttaaatatggctatttaggaaataaatcatgttattagaaaataaacaatttaagattaagaggaaatgaggataaagctctaggtactatatttaagat

SEQ ID NO: 21425 - DNA, 2012 bp, Zea mays
cggccgcccttttttttttttttttttttttttttttttgtttggacatcggaaggcccccacatccacagcaacaaaatcatgaaaagtaacttcagtctcggtcgtcaactttttagcagtgcaagtagcaatactattgcagatggcagcaacaaattgaacagtatggtaccttttcatgcacaagtaaaatagtacattgttaacttcacgtaattgattatgaaacgaagaaagtgaatatttggaaacctgcagaagcatagcaccagataatcagttctctacaatgggaaaggctgatccaattttgttgttccccaatcggtagcacttgacgttcacactatacgggccaatatcgacgcggttgtcttcccctccaacaaaaaagcacaacgtgtagagtgcaacctcaaactcaggactgacgccaatcaacgtgctggataccgatttcagcacgccatgccactcaaactgaacagtcagcagctgtatctctgaatcaggcgattcaccacggcgccttggaaatatataaccttggtaatccacatttcccttggcttcttccaggtaaaactgaatccagttatggaagcctgatacctcactctccccttgtccccgtcctttgatctcaccaacaaacacatgctcaaaggcagaagagcagctagagttgccacctcttccatacaaatcaaaccatagggatgtcagcattctcttgaagtcctcgtagtcctgaggcacagcccccttctgcactaagtaccggtgcaagtacttaattggcgctgttctagcgatctcttcaacgaaagctatttcttcgtgcttatcctgctgggtaacaacttctttgtacccctggtgggggttgtagttatccagaagtgcgcagaaacgtgagtaggtgggttttcttagcacatcgtcgcctagccagctgaacaagctttcagatgccatatcacccttctgataaactttcttccccttgccacagtcgattatgtagtccttaccaggaacaatacggttcatatcgagctcccaaagtcggctacacgctttcgataagctattcagctcctccctggtgggctcgaaattgagtccttggtggatatgaccgacatcctcagagtacttttgttctgatggtggctttctgtatccattccatgcttcagactgctgtggtcttccatggcgctttttctcaccgacggtctgccagcctccatcgtttatcctttcttcttcctgatgctgattcccgtatccttgtgcctgctgctgttgctgacgccgccggctgccactgccatcccacctttcctccccctcgcactggttctgccggcctgcgtggtgctgctgctggttccgaccatcggcccttttccaaccctcgtcatccctcctctcatggcgattgtcccgccccgagcttcgatggtcccggcgctcgtccggatcgctgcccttctgctcggagacgacctcggcccacgtcgaccgcgatcgttcgtcgcgttcctcctccccgtcgtcatctggatcggagctttgggccgccctcctcctcggcacctcgtcgtcgtcggcgcggccgtggtccctctccctcacggcgtcctccacggcgtcgatggccacgtggaccaaccccttgatgagaccctccatcgcgcgccgacgagagcgaacggggaaggcgggtgacgggctgggtactggagatggatcggactgaccggctgccgcgggatgggatctgggacggggagggacgcgtgcttggttggtggactccactaatcgagtggctggcgctgcgacgcgcaggagatcatcggggatttccttacttggatttatcgtccgtgcgtgattactgattaagaacctgaagaagaaacttttgcagcggtcgtggacattcgcggtatgggccgggtggctggatgcgatcgcgggaggaccccccctcgagc

SEQ ID NO: 21426 - DNA, 5126 bp, Zea mays
  misc_feature (565)..(565): n is a, c, g, or t
tattttttaaaattaaaaaatcattttcagaaaaaggctgaaatcgtttttaatatccgaaaaatatctcaaaggctccaaaacttctaagaaaattcatagacatgatttgacacccaatgaactcaaaaaacatatttaaaacttttaaaaatattttaagtacctcaaataaatagattttgaatttctaaaaatagaaaaatattcagaaaaatacgaaaattcacgggaaaccgaggcaagagcattgacccaatgtgctgtttgggcgcccttcatcataacttccactgttcctcgtgcgttaacgaggtatggagaagacggcggtggaggagacgagacgataccgcccacgcctgcgcacgacagcgtgtcaggctacgccgcaacctacaccaagggctacgcacgcttgtgttgcgattatgtggaacgggaggataggagcctgtgcaacaacgaccaagaagggatacgcgctcaggaagatctagtgttgacagctttatcgggcgcttcacgtttcatattgtaaatactcttgggcccatgttcaatnttttgggatgcatacttctaagggcttgttcggttaagagtagattgagggggattggagaggattaaatctattcctagtcaaaattgaatagaaagatattcaaccctcgtcaatcccgtccagtttagatgaaaccgaacatgccctaagtggctattcccacaaaacattttgctcatgagttaagcacaggtacattagctccatgattagagctactcaacggtgcagcagttagttgaacgcgcgcggagctagtttttttaggttatatatataaaggagagcagtgtctaacctttgtacgcttatacccaaatggcgtgaagtcagatgtgcatgtgcgagccggccggacggggacggggagggcacacgtacgaaatcaatcacacacaggcaaagctctatcccctgtgtctgattgatttcacgtggggtggggacacgaaatctagcgcgtggccaggtcaaccacaaccatatcagtgcgcgctgtgcgttcatgcatctttgcgggctggcggttcctcgcatgaccaacgaccggccgggccgaggtaaccacgtacctccgccgctaactaatccgagcctgtcattgtcatgcattggccctcccgccgccatatctcgttcgctccacgctagctacagcgtatacgagtcgacgcggcgcgtcggtgccccctgccgatcaatcgagccgcttgtcattcacttctctgcatataatgtatgcacgtctcctcgctccgttggggtaactaaccatcccgtacgtgattcattcattcattcagacggcatgtcgaaaccaattaagcaagcaaagccccccactcgccggaagtcggactcgacagacacacgccacagctagctagctagctcacatgcatggaacttgaagtagaacgagtccaagagctagcagaccgactagttacgacagtgaaacaaagttaatatgccttgatgaactcgaacgaacgaatcgttcgacgggaaagcgaaatttgcaatcatgctgcagctggtaacacttcaactcagctctccatcgatgattgcaatcttgcaaattgtcaggactgtaaaggcggggtagctagtagatgccctacgtcgaggcttcaggaagcagtggtgcctcaatcccatcaacatcgtcatcatatctctatacttgtattactcgatcggcaacgatgcggttgcagagacaagtacagcacggtgcgcagccgcagctacagccacacacacacagcggcagagattcggacacacctccggtaataattcctatctctctctgtatacgtcaaattaagtcacatcatcagcaaaaatgcgttaattgttcgtatcatggagatgagcttttttttttttttttatatattatagtctatcgtccattaataataggctatacataagcatgcaaataacatatgtagagaactgattgattaattaatacagcaagctacaattccgttgcggcaaacaaacaaattaaaagctttcgtagtatagctagcttgtatatataataactagctagttagttgacgatgtagcatttcttcctgatctccccctgagcagcaccggtgagcacgccagcgttgcccatcttgatcatggactcgccgaagtcctggaagaacacgccgtcgaacctgccggtggccatgcgcaggacgtactccctggtggtggcgtcggcgagcagcgcggcgtcggactggaagaggcccctccgcttggcgacgtggcggtagtagctcgtgtcgaaggtcttgtagctgccggggtccatctcggagagcgtggccgtgtcgtcggcgctccggcagcgcgtcctcagccggtcggcgtactcgctgtcgagggacgggtccgcgccgccgtaggcgctgctgaagttgtagagccgcccggcgtacgacgggcagtgcgccgtgccgagggtgtgcgcgccagagagcacggccaggtccttgaggtcgaggccgttggcggcgaagatctcggcgagcagcgggacgtcgccgaaggcgggaggcaggctgtcggccgcttccgtggcgctcgacaccctgccgtctcgcctccccagggccactggccaggatgggcccttggcgagcaccacggcgtcgcgggccatcagggccaggacgtcggcgcaggaaaccgtgctggggcatgcggcttccagcttggccttcactctctccacggagccgaagccccgcaggctcctgttcggcttggcgtccttctcggccttgttacccccgttggggtcgtcgagcaggaccgaggcgtcgcaaccccggacgttgctgtcggcgccacgcatgcatgcagatgaatgtttctgtaagtattcgactacacatgcaatgatcaaatgaaatctcgccagtcgctactgcgatctgcgacgacatgttgtaccaccacttaccctgacgaagcagtcgtggaaatggagcctgagaagtgggccggcgaggctgggcgcggcggcgatgatcttctccgtctcgttgcggacgatggcctcggcgtccgggcatgtcttgctgtagtagccggccaccagctgagccgccgcgggcgagctggcagcgagcagaagcagtgctgccatagggagcagcagccgtactagacaagacctgaatgccatgctgctgatggacgatggatctatcggtgttaaacaaaagcagggctcagagcgtcaattatgtgatgtgggtagagcaagaatgttcttgttaagtaatctcgggtggaatggacatgccctttcaactctttgtatttatagacgcactggctgctatgaggatagtggcgatcgacgtggtgtgagttgctcacttcgctgtaacagcctggtcctgcgtaggcgtccatgtgcgctaactgcaatcccttctctgtgtaatcttctcttgacctactaagagcatgcataatgaacttaggcattgacatacgaacgcgttccaaaaaatggagctctttaaaaaattggtcctaacataaaagataaacatgaactaaacataaacggagctagctgatgaggtcagttaccgtgcgcgccatatatattcttttcagttttgccatatatttgtttttactacgactatttgtacgaacacaaggttgatatgtatcattttagtttagtttgttatgagtggttgtcgataagtgtagcgcctttggttaaatcgggtagactaataggggcatgatgttgttggtgcatcatatcacttgacttgtggtaataagcaggtatagagtccgatgacggtagccgatgatgaagatgaaggtcatgttcgttggtatcgatggatcgggagcggtgaaggacgagggctgagccttgatcgagggattggagtagatgggtgacttgccatgatggatgacatctagggacggatcatgtcgccgatgtggttgtgggtcggcgcgacacttgtctaccaagtgggggacgcgtatgtagtacgctacctacgggggctttggtgtttgagcaaaaccatacaatgcgacaattcacaggtttcgtcggatttgggtcaaacacaaaacgtggtggcatggttctgtatggaatcagaggtgacacgtggtgtcatcatagagggtgtgtcaaggtgaagcaacttcatgaagattgtgtgactgccagatcaaaattttaagattagtctattttacccttgtctaagtggatatactctatgtatataaaagtagtttagaaaagaggaataatcctttgtaaataggagcagagggctgaaccacttggttatctattttagcacttttatttccctcacttagtttgtaatgctcccctttctcattttagctagaaaatccttagatgtttttaaaccacgacatctaaagtttatgtatttttgaagaagtgtggccctaactagactcagccctcatgacgtttctttttcggaaaatctaatggtatttgcttgtgagttgcatattctctcaaccccgcttgtttgaattttgatttgattttgggagatgttttagagataatctctagatcataagtaactgtcatggattcattggaacctttggtatgagtttatctgatttgtagacaagtttctaatagatttggtcttttgacaaaacataaataaaatcctaggtcaagtctgagtttttggatcctacttgaaaattttgatctttttgtgctcaaacttcatgaatgacttcaacttcctaaactcttgctgcctacaaattttgaagttaatctgagcattttttttgtcgagcaacacttctcactagcattactggagttttgcccggcactattggagttttcctctgaactttttggttccaaatcaagttctctttgttcctttgagctcataatattgttaggaacttggttggaacaaccaatcgataattgattgagttgttcttgtttgaaccatttcagagt

SEQ ID NO: 21427 - DNA, 5766 bp, Zea mays
ttttttttttttttttttcttttttttttgtaacgacggtaggtttttaactgctgaaactgaagtatctgtgttacatgtgtatgttcacagcagatgaacttttactagcagatgaactttacagcgttacatgtgtatgttcacggcagcaccctgtgtgtgtgtatgtgtatgcgtatgcgcctgcgcaacctactacttcgcggcctcctcctccccctcctcttccttccagaccggaaggatgccttgcccagccagcctcttgtagacccagaacaccacgtacttggccgttatcctcttctcatcgatcaggaacggctcgatggtgctcacttcgttgctgtaggacgatagcgcaaagcccttcggtcctgcattgtttgttacgagatcagtgtgcggtttgcgcgagcccggtcccctgttttttttatctttatggctagtttggcaacccagggattctcatttttctaaggaaaattagtttattttcctttgaaaaaaataagaatcccttagaaaaataaaaatagagttgtcaaactagccattagcgacaaaggaatataatgtgtgggtttacgtgctacatatcctacagcagagtagatggccacaaaactgatggtacccatctagctatgctatacatcattcaataatcggaaggcatagctgagctcctgcattttttttccaaagagaatatgcatggtaatggctaatgagtaacaacgaaggcttttattcgcattctacattgttctgcaaaccatgcgctattctacattcttctgttgcttagaaaacaggaatctatatcctaaactacgaaaatagtacgacgttcttcatgtcatgtagtgttcagacttcagagtaagcatgttagtgcttaaaaatgaaggatattcctactatcagaagtttcagaacagtatatacctgtgaggtctccttttggaaagaaggcccaaaaataataagggacgtcgttctttatgaaggatccctccagctgcaatccataagcactagaagggtcagtaatctgccgactaatttgtgggaacgatctcaagtttctaaatgtacatgtacacccaaacaaatgttgggtgtttcgtggaggcagtaggagattgatgcaaggtgaacaccaataattcaatatcatgcttctgtttttgcaaaagaatacacttgtgcccacatagaggacgcatggaatttaaaaacggtgtacgaggccatcacattagagtaaacagtttatcacaaagtattgagtgatatcatagcatgggccggactggatcaccattttgctgatcaactcctcttttctccattacaatttactgtgctcaagaaattaatgaactgcacaaacgctacagttgacaagtgagtggcataagcgaagacaatttcccgctcagtatatactgatattttagctactcctcttgatggtgatctatgctacatggaatttatttcctgtccgctagaacaaatgcacagtaccaatgccaccagtttttagtaactcaggaactagtacgttcactagctccaagcattctgtatttgagtgattaagtactgactacttaccgtgttgttttggaaggcgagctgcacctgggacacgtcgtcctccgcctccaaggcatccttcagcggtgggatgatctcctgctgcatcatctccggcagcggcagcgccgcggccttctttggcttggcggccgcggccggcttcgccgcctccgctgtggcctccttggccccgtccgcggcatccttcttcttgctaacttcaggaaatcaaaatagcagcagcaaacgatgcgtcagcaatcgggagtacatactgcatagaaacaggctcacgcgtgctgcgtgcaatccaacatttctgaagcgttaccatgccgatctacgtctcgagagaacttattcagaagagatcccacccaccccgcaattagggtagcaagacccgtaccagtggtggaggtggacgactcctgcacggccgagcacgaggcgacggcgccgccgctacgggcgcgggggaacgcgacgacggggggcgcccgcttcccgaatagcggcgcggccgagcacctgcacgccgcgtggccagcgggggcgctcagcctcggagcgcgcaaaggctgaggcgccatgaccgtgagcgtccgcgaggatcagcgatcaagcaagcaaaccaccgacggttgtgtttcacgatcggcggagggctggcagcacgcgaatcagacgggctgagctgaccggtgcgcgcgatcaaggcccccggggcacgcacggaggcgacaaaaaaggagatcggctagaggatgaggcggctggttttaccggagacggccagaccggacgggggtccctcgtgtagtctagtgcagccgtgcaggggtggctcctgtccactggttcagggggacggcagtggtttggcgccacgctatctgatcggcacctcctcctgcggctgcgggctgcagcctcaccggcgctgcacgggtgcctgtgaaccagccatttcgttcacgacccgcagcttgaggggacgtggcgggtttgcgtcgtggcccacgagctatgcgacccgtccggtcgtcttcgacggtttagattagtctgaataaagggtttgcttactgtcgtttatttattggattggggtagaaaaggaggtatcgaatagcaacgcttgctttccaacaataaagcaatggctaagaaaaatgttgaatagcaatactaccccaaatattacactgcgtcgctaaacattggcccacctacaaagccactcacgcccaggaccatactttatatttttagtgccagtcaatgtcgatacaagatcgaatttgtgactgctatgccagcggaggcccatcttgaagcggtggtgtgggctgtggcgtcccgtgatcgctctggccttgctttcggcactggcccccgcaaacagcgcaccatccccggcccaagttatttccagacccgttggttcatcgctctccgcgttcggctgccgggctgctacgcaggtccgcaacgcggcccgccccaccagctcctgcccaggcctagtgttcctctgttcttggcttcgcttgtaattgaagtattttatttaacctttctcaaaatacgtacatttatttacattccccacaacaggcggcctaacgaaggcgagatgtgaagggagaaaagaaaatgaggcatgggcggtacacgtcttgctagttgctccgtaccgacccttcttcgcccacgtcgtattccgcgttgttctgctcccatcacgggtatagcgtgatgagctgtggtgcctgccgccgccgtaatacttccgtcgcgagttgtcaccatttcatacgaccgtcgacatagactcggaccatacgctcacagctgctggaggataggcaggtcgcaggcggagaaccacgcccacatggaggcccggcgcgattgccccgtgaaccgggtccacgccatttatttccgtcccgctcgcgcaggcagggattccggtgggagcaacaaccgcgccgtaacttcgcgtaattccaaaactgaaatccatccacccatgaaccacaaatccatccgcagtcaccaaagagggtacgcccgccgaccgcgacatccccctgacctgcgggcccacaccaacgcgcggtacagattattcaacgtggcgggtccggcagaggggcagtaccgtcattaaaccgcgaagtaaagaaaggttggcaagggtttgccccattttgccagaggccgagaagcatccggcggacgggctgaggcatctcgtgggatcttccttcgcaccctctcgcaaccctagaccctgccccacctcgagccacgctcaccgacaacgttgcgctgcccgccacacaaccacccgcgggacccaccccaccagcgcgctcacgccgccgctagtcacgttaccgcccccaccaccaccgctactgcctactcccacgcccgccgacccaccacccacaaggggccgggtccgccgggccctgtcatcccatccccgctagcgcaacttgccaaagcgaaagggaaacgaaagcggctgctgtactgtcctctactccaccgccatatctccccggctcctcgcgacagatcaaacaaagggaggttgttccacttcactctccatccagcccagaccaacaactgtatattactcgcccaagcccgatttcaccgcaagaacagagcaacacacacctgcacctggggcccgcttgacagtgacacagagaacgagccccgcgatagaccacgggcaacacgacgcgaccaccgtgaacccatagacacgctgctgctgaaggcagcaggctgagagcgagcctcccctgccgaaaaaaaaggccttaaaaatatacaggcactaggagcccggtttgcctccatcgctgcaaccacagccatttcacctatctcaaagcagtaaccataacagaaagcaattcagccgattggaggtgcagtacctcaagaattcaaatgggggcaacggctaccatgggcatttgaaagggggggcatttcccgggctttcttttggagggaaactacagtttgtgcaaccctacacggccagtgcaacagaaatttcaaaggatggagggaagccccacggttgcaactaccatttgaaagttggagggaaaaatcgaacacaaaagggggcttgccggcaaggtgagagactgaagaaccgaactggttacctactggcctactaggctacacaaggtgtttctctccattacctcctaaaatctgctattccaaggaggcagaagctctctctcaattcaaagtttttacaagaaaaaacaattaaaaagaagacaggggaaacccaccatatttctgttcctgctgcctcctcctgctgctgctgatcttgctgcttacttctagctgaagaagggggagggagggatccatgtacattggctgctccatcacttgtgcttgaagggcctcaagtcctcaacaccgtcatcctcactgtcatcaccactgcctgacagatcatcatcatctctcttccgcttggctccatgcgaggatgaaggctgatctgtggccccatcatcatcgttgtcgacttcttccttgtcctcgtcagcatcatcagggtcaactccatctaattcacttccaatagccatggcttgaggctgagcgattggttgcacaagatattcagtatcttcatcctcatcatccgcatctgcgtcgtcttcgtcgtcgaaccgaatttcttactccatgccatgaaagaaatctctcaaaaactcaaacaaaaaaaatattgttagaatggactggaagtggaatgcagatggccataaatatagaccagattcctttgtacagaaggcccagcaactcaagttttggcaaacatgcagataatcaattctaagcaaaaaaaaaaaaaaccagatagcattgaggaaacagaatactaataggcaatcttatatacagtacagttcaggaatacttgttcaacatgtaccaaaagaaccaccatcacaagttcacaggcaatccaagattaaggcaacaaaatactaaacatacaccatcgcaagaatgatcgcatgaaatattttggagaaaaaaaactagataacaagtagatatagagct

SEQ ID NO: 21428 - DNA, 1114 bp, Zea mays
gcggccgccttttttttttttttttttttttgtaacgacggtaggtttttaactgctgaaactgaagtatctgtgttacatgtgtatgttcacagcagatgaacttttactagcagatgaactttacagcgttacatgtgtatgttcacggcagcaccctgtgtgtgtgtatgtgtatgcgtatgcgcctgcgcaacctactacttcgcggcctcctcctccccctcctcttccttccagaccggaaggatgccttgcccagccagcctcttgtagacccagaacaccacgtacttggccgttatcctcttctcatcgatcaggaacggctcgatggtgctcacttcgttgctgtaggacgatagcgcaaagcccttcggtcctgtgaggtctccttttggaaagaaggcccaaaaataataagggacgtcgttctttatgaaggatccctccagcgtgttgttttggaaggcgagctgcacctgggacacgtcgtcctccgcctccaaggcatccttcagcggtgggatgatctcctgctgcatcatctccggcagcggcagcgccgcggccttctttggcttggcggccgcggccggcttcgccgcctccgctgtggcctccttggccccgtccgcggcatccttcttcttgctaacatgccgatctacgtctcgagagaacttattcagaagagatcccacccaccccgcaattagggtagcaagacccgtaccagtggtggaggtggacgactcctgcacggccgagcacgaggcgacggcgccgccgctacgggcgcgggggaacgcgacgacggggggcgcccgcttcccgaatagcggcgcggccgagcacctgcacgccgcgtggccagcgggggcgctcagcctcggagcgcgcaaaggctgaggcgccatgaccgtgagcgtccgcgaggatcagcgatcaagcaagcaaaccaccgacggttgtgtttcacgatcggcggagggctggcagcacgcgaatcagacgggctgagctgaccggtgcgcgcgatcaaggcccccggggcacgcacggaggcgacaaaaaagttttgattaggatgttctaggtaatggtctcgtgc

SEQ ID NO: 21429 - DNA, 1024 bp, Zea mays
tttttttttttttttttaacgacggtaggtttttaactgctgaaactgaagtatctgtgttacatgtgtatgttcacagcagatgaactttacagcgttacatgtgtatgttcacggcagcaccctgtgtgtatgtgtatgcgtatgcgcctgcgcaacctactacttcgcggcctcctcctccccctcctcttccttccagaccggaaggatgccttgcccagccagcctcttgtagacccagaacaccacgtacttggccgttatcctcttctcatcgatcaggaacggctcgatggtgctcacttcgttgctgtaggacgatagcgcaaagcccttcggtcctgtgaggtctccttttggaaagaaggcccaaaaataataagggacgtcgttctttatgaaggatccctccagcgtgttgttttggaaggcgagctgcacctgggacacgtcgtcctccgcctccaaggcatccttcagcggtgggatgatctcctgctgcatcatctccggcagcggcagcgccgcggccttctttggcttggcggccgcggccggcttcgccgcctccgctgtggcctccttggccccgtccgcggcatccttcttcttgctaacagtggtggaggtggacgactcctgcacggccgagcacgaggcgacggcgccgccgctacgggcgcgggggaacgcgacgacggggggcgcccgcttcccgaatagcggcgcggccgagcacctgcacgccgcgtggccagcgggggcgctcagcctcggagcgcgcaaaggctgaggcgccatgaccgtgagcgtccgcgaggatcagcgatcaagcaagcaaaccaccgacggttgtgtttcacgatcggcggagggctggcagcacgcgaatcagacgggctgagctgaccggtgcgcgcgatcaaggcccccggggcacgcacggaggcgacaaaaaaggagttcgggccgaggatgaggcggctggtttaccggcccggccggcctcgagggacccaat

SEQ ID NO: 21430 - DNA, 1231 bp, Zea mays
taagataacagttttcgcttaaattaataatctctgaaatctcttgatttacatgaaggtattctattctaaacagatggcgaagggctggacggatagagtacggcacgcaggactggcgataacaaataataatattcagataccatagctttcagacgggactcgtcgtcgatcccggcccacgaaggtttcgattgttcaacaaatttgactggcttctgcagcacaagattacgaagggattgcgactgcgaatggctatgcgcctatgcagctcgagcccaatgctgttttgcttttgtctcagcagctcttagcatctgtatatatattagcagacgaactttaacagtttcagacatgatgactgtgtgtaggttcacagcagcaccctcctgcctcctgctgcgtgtgttctacttggcgtcctgatgatcctccccctcctcttccttccagaccggaaggatgccttgcccagccagcctcttgtaaacccagaacaccacgtacttggccgttaccctcttctcgtcgatcaggaacggctcgatggtgctcacctcgttgctgtaggacgatagcgcgaagcccttgagtcctgtgaggtctccttttggaaagaaggcccagaaactataagggacgtcgtcctttatgaaggatccctctagcgtgttgttttcgaaggcgagctggacctgggacacgtcctcctccgcctccaaggcggccttcagcggtgggatgatctcctcctgcatcatctccggcagcggcagcgccgcggccttcttcggcttggccgctgtggcctccttattggcaccgtccttcttcttgctaacagcggtggaggtggacgactcctgcaccggcaaggccgagcaggaggcgacggcgccgccgctgccggcgcgcgggaacgacaccacgaggggcggcgccggccgcttcccgaagagcggcgcgagcgcggccgagcacctgcacgacgcgtggccggcgccgggggcgcggctcagcctcggactcagagcgcgcgaaggctgaggcgccatgaccatgtgtgtgagtgtccccgggctcgctgcgcccctcgcggcgtgcgtgcggcgctcgtacggcgacggttgcgtttcacgatcggcggtggacgaccggcagcatgcggatcagtcagcagaacaggaggagtacgtacacgtgtgttgtcacggacgggccc

SEQ ID NO: 21431 - DNA, 434 bp, Zea mays
actactctactccacatccatccactattttgtcctgcttggattccatccgctccgacctccgtctctctgctgcctagcaagctctgcccgtcgggcatggggcccacgttggacggagctgctggcggaggcaagaagcgcaagcgcgtcccgccgggcctcgccgacctccacgacgacatgctagagcgcgtgctggcgcgcctcccgccggccagctacttgcgcctccggggcgtctcccgccggtggcgcgccgcggcggagtccagcaccttccgcgccgcctgcgcgcgcgtcacggcgcgggacccatggttcctcatgctcgacgaccccgaccaccaggacgagcaacggccacgctacgccgccgccgccgtcgtcttcgacgccgccgagcgcgcctgggcgcggtggcgcggcgcgcc

SEQ ID NO: 21432 - DNA, 1863 bp, Zea mays
aaaagcaaaaagctacaccaggtctacagcgccgggagcccgggagtccgggatccagccacggccacggggggcgctctcgagagaaagatccagccccaaaggcccaaacccgaaacccctctcttcttcctccttccattggggtcgcgtccaacaagaggctggccagccatcccgcgcgagccacttcctctctcctccccatcggatccagcgccacgcggatccgcaaggcaatccatggcctctacccaggcggaagcggaggcgggggcaccggccccgcccgaggcggcggaggcgaaggagaagggcaagcagggcggggtgctggggagggtgtggcgggcgctcttcggtggccgcgaggacttcgagaagcggctgcagtacctgtccaaggaggaggcagccgtgcacgcgcggatgcgccggcggacgcagttctcgcgccgcgccgtgcggaacctcatcgtactctccgtcctcgccgaggtgttagctgttgtttatgccatcatgacgacaagaaatgaggatctaacttggcaaatgagggcaatacgagtgctacctatgttcattcttcctgctgtatcctctgtcatatattcaacagttgttaacttcacaaggatgtttgagcagaaagaccagaagacccttgaaaaattgagggctgagaggaaagccaagattgatgagcttaaagagagaacaaattattatctaacacagcagcttattcagaaatatgatcttgatccagccgcaaaggctgcagcagcttcagttttggcatctaagcttggggaggagactggcttaaaagttcatgttggagaagaaccaaagctggatgctgcagtggccagaagcaatgatgttgagatagtaccttcagatggtttgagaaacaggaagcaacccaatgcaagaggaagcaggactgggagccccacttctcataccccagcacagggaactgaaactaatctacctcctgctagtgctgtcctggaaactgcaccagctccagtggtggtagagcatcatcaagggtcaggggctagtgatggtggtggatggattgcaaagattgctgccttacttgtgggggaggacccatcacagtcgtatgctttgatatgtgggagctgccatatgcataacggcttgtcccgaaaggaagattacccacatgttacttactactgcccacattgtcatgcattaaacacatcaaagcagtccatggggcaatactcaggctccaactcaggccggtcgacccctgttgttctggctgatggattatctacttccagctcagtacaagagactgaattgagtaacctgacgacattgcaggagctacccgaggaaggaaagacagacaagcaacaagtggaggcaagttgatggttcttatgacttgtattgttgatgtgtgtggaactagtttatctttagacttatatcgtcatgtgttcaactggtggagccacagatttagcactgttgtaaattggaaatagtgagtgatatgatcgtcggaagcatagcacgcaaaaacaagaaatgggacatggtgtacatccttgagtggatgattttttgttgtcatatagagcgcgaagtcttcttcctgcgagacaaaaagctatatgacgttcagacaagatggtggtgcaggatataatataagatcattgcttgttcagagaaaaaaaaaaaatagaattttttgcgtttgtcttgaccttcggtcttttctttgttgtttgttacattaccaccttacagcatttcgtacacagtttccttatgatgttgaaaccgtacttttcatttggcgtt

SEQ ID NO: 21433 - DNA, 2048 bp, Zea mays
cattgggtacctcgaggccggccgggaaaaattggcatccacccggagtcccgctggttgcacgcgttcgttcctgccctcatctctgtattgggagctagacgaggaccgagccatccaagagcttggccacggggacgggggaagctctcgaggctcgagggaaagagacagccccccaaaggcccaaaccctctcctcttcttcttcccttccattcgggtcgcgtccagttgctggcagccatctctcgcggtcgcggcctcgcgggcaacctcctgtcttctccccatcggatccagtgctgcggatccgcatttccgcaaggtagtcaatggcggcttccccggcggaggcgggggcacaggcgctgcccgaggcgacggaggcgaaggagaagggcaagcggggcggggtgctgaggagggtgtggcgggcgctcttcggtggccgcgaggacttcgagaagcggctgcagtacctatccaaggaggaggccgccgtgcacgcgcggatgcgccggcggacgcagttctcgcgccgcaccgtgcgaaacctcatcgtactctccgtcctcgccgaggtgttagctgttgtttatgccatcatgatgacaagaaatgaggatctaacttggcaaatgagggcaatacgggtgctacctatgttcgttcttcctgttgtatcctctgtcatatattcaacagttgttaacttcacaagaatgcttgagcggaaagatcagaagacccttgaaaaattgagggctgagagaaaagccaagattgatgagcttaaagagagaacaaactattatcttacccaacagcttattcagaaatatgatcttgatcctgccgcaaaggctgcagcagcttcagttttggcatctaagcttggggaggacactggcttaaaagttcatgttggagaagaaccaaagctggatgctgcagtggctagaagcaatgatgttgagatagtaccatcagatggtttgagaaacaggaaacaacccaatgcaagaggaagcaggaccgggagccctactgctgataccccagcacggggaactgaatccagtctaactgctggtgcagacctggaaactgctccagctcctttggtggtagaacatcatcaaggcttaggggctagtgatggtggtggatggattgcaaagattgctgccttacttgtggcagaggacccatcacagtcatatgctttgatatgtggcaactgccatatgcataatggcttggcccgaaaggaagattatccgcatgttacctactactgcccacattgtcatgcattaaacacatcaaagcagtccatgtggcaatactcgggctccaactcagggcggtcatcccctgttgttctggatgatggtctatccacttccagttcagtacaagagactgaattgagtaacctgacacacactgcaggagctacctgaggaaggaaatgcagagaagcaagaaaaggcaagttgatggttcacagaacttctattgatgtgtgtggaactacttaatctttagacgtatatcgtcatgtgttctggtggagccacagatttagcactgttgtaaattggaaatagtgactgatatgatccctcagatacttagcacacacccaaaagaagaaactagccatggtgacatccttgagtggatgattttttgttgtcaatagagcgcgaagacttcctactgcgtgacaagagtcacaagatggtgctgaaaagctatatatgataaatgaggcaatctaacaggtcagatgtgtaacgttcatacaagatggtgtaggatataacataatatcattgcttcgttttctatttctatcatttttatatgcacacgcttgttcagagaccagaaacgtggacaatttttgcgtttattttgaccttcgatctttcctattatgtttgttacttcactgattccaaattgtgtaagtttgttcagattttgatacagctaaatatgcattatgtttagataatctagggacgctatttgccg

SEQ ID NO: 21434 - DNA, 2526 bp, Zea mays
tttcttctgttttcgttgtttgttttttttttttttttttttcgctttggagactgataattcagatagaaacgcactacaaaccagttagctaaagcaacttcgatgagacaacagccagtctatatacacacaacacaacacaacaccatgcccctgaaccaaaaaccatcatggcaagccaaagccttcgagctgaagaccagcgcagctgcaccccacaccgaaccacatagcacccctacggctctacgcccgctacaactctttacaagcacgcgctcgctgcaacctacagagcctaacggagagagagcagccatgcgttactcactccttgcctctcttgccaaacgccgccctggtaacggccctgatgcccctcacccacagctccgcggcctccttacctccttggcacacgaagtgcacctccctccctgtcgcagtcaccacgcggaacagccccggctcatacgcgtcccccttcctctgcctgtgccgctggaacgccgagctgccaccgacctcggcctctcggcagatcacgttgcgccggcttgacccgccccaccggagcacgcccgccgcagcgaccatgcgcagcgacttgccgtgaggcctcgcgcgtccgcccttggtgtgcttcctgacgcgcgcgccctgaaggaccgcctgccggcccatctcgtccatgatcacgtcttcggccttgttgaacgccgccgtagccagcgctgctcgcgccagggagagcgccgtctcgccgcgcggcgtccggaggtcgcagcgagcgccgtaggagatgagaagctcgcacacgcccgcgtggccttccctggccgcgagcatcagcggggtgtagccgtcaccgtcggggatattgacgtcgcagcccgtgctggcgaggtggcgcaccgccgcggtgtcgccgcgccgggaggcgcagtgaagcgcgtagaagcctccaggcatgcccttctccagcgcgagctcgagcatgacctgctcgaagaggtctctcttcttgctctgctgcgccagcccgatggccgtctccccgcgcttgttgctcagcttcacgttggcgccggcgaatacgagggcgcggaaggcctcgacgtttcccatcttggcagcagccattatgggcgagcatccgtccgaatcctgctcgtccacgtccacgtctggctgagagagcagcacttccatcgcggtcgcgtcgccgcacagcgcgccgaacatcagcggggagaacacgctccgttcgctggagcgtgggacggccccgcaccgaatcgcgccaataacagcccgttcgaagccggtcttccatcccccagaggaagcgacggaggccgacgagtcgccagccgagtttaacagcgcgacatctgcaccggcggacacgagaactcggaggcagtcctcgcgtttgtggcgcgagcagatgatggcggcagtgtcgccagcctccgccctcgcgttcaggtcgcagcccctgtcagccagcatccgcaggatctccggctggccgaggcgcgcggccaggtgaaccggcctggacctgttgctcctggtcgtcttcacgggagcttccgagtctgcaccggacgccagcaaggtctggacggcaccggcgctgccgcagaggatggcgtggtggaggagcgtccggccgaggtgagcggcagtcgacgtgaacccgctacggaggagcatgcgcaggatggagcccgtggactcgtagtactccacggcgcaccataccgcgtcgtaaggttcggcgagtccggcgccgacgcgcagctcctcgccggtggacgcgtcccaggaccacgctcccagcctcaccttcgtgtccctcttcacgccggcctgaagcagatggcggaccacagcgacttgacggctcacgattgctgcaaagagcgccgtgcagtcgacgttggcgtgcagggatggcttcagcgaccgcaggagcacccgggcggtcgcgtttggatcagctccacacttgatgagcgtgtcgaccacgtcgacgaagccgcgcgctgcggcagacacgagcgcgtgggcggcaacgcgggggcggacgaggtccgagcccatgaagatggccgcgagggccgcctgtccctgcaacgcagcctccacgacggcctcttcgcaggccggctgcgacgcgcccgcacgcacaagcagctccgccacctccgcgcacccttcccgtgccgcggccgtcgtcgggtagccccggaacaccttgccgttcacgtccgctccctttgcgagcaaggcgcggacgagcgcgacgtccccgttgccggccgcgaggaagagcggcgagacgtcggcgcggatctcctcgtgcacggcccgcgcctcggcggcggcgtcctcccggggctccgcctccgcgacgcgacgcgccctgagccacaccactccggcgtagttcacgtccgcgcgcccccccgcgagcagctcgccggcccccctcgcgtcgccgcgcgccaccgc

SEQ ID NO: 21435 - DNA, 1334 bp, Zea mays
  misc_feature (1211)..(1211): n is a, c, g, or t
  misc_feature (1213)..(1213): n is a, c, g, or t
tttttttttcttttttttttatccataaagagaaacttttactttctagaactttatatttactttgtctagaggacgaatcatgctacttacatataaaaataagggcaaacaattttatacaggccatatacagtgaaggtaaaaaaaaaatgggacctcaaattctcttagacataacacctagagtaagaagcatcaacaagaaagagaataagaaatatcctcatcctcaatgtaacgaatcttcttctttttccacaaaattgttgaaataatggatgttataaagcggctgaagggatcctgcaagccttccatttcataatgaccaaatcgccaatcccgcaatatgaatgatctctggataggccgatccagaccccctgcatacatccggccatgtttatctactgccctaaaaaacgggcgtgttttcttctgaaacgctgcctgttgcagctccctccaagccgccaaccttagagaacaaatagtacgagggcctaggtttccgtgctaggttgttagcacgatcaacagccacaagcccaaatcttaggaccatatccatctgcccattcccaattatctgacgttgtccagaatagataaccaagcccaggcacacccataaggattgctttttttttttttttttcgcatctgcaagatataatagtattgcttacagcatttcaaaatatgattacagaccctccccttgtttggcagaaatacttctaacctttgctatgtttctcatctcaccaaaatgtgtcaaactaactgaaacaaatatcacggacgaagggcctcgtccgttgtttgtctggatgaagcaagcaactctttgaactgtgctaatgccttctctgttatttgcttaaacggtatgcgctttatcacatgggctccaaagaagtataacagggcatctgttgcagtttccgtgttgatgcctctagcctggaagtagaagagctcgtttggatcaagctcaccactgatggcggcaccatgagtacacttcacatcatcagcaataatctgaaggttcggcttgacattaacaagtgcctttggtgataggataaggcacttggtttcttgccccgcatcagtttgctgtgcatacctgttgactttaatattgccatcaaatatgcattaggacacaaatataaaattgcagcttcagatatagctgngngtcatgactcatgagtaaaacatagattttggacatcctaggaattatataactgcatctatgtatcaccgatatgcgatacggtgacacactgatacagtacggatgtgatacacgtttg

SEQ ID NO: 21436 - DNA, 3660 bp, Zea mays
aatgctttcgttgagagtcgaactcaagacctcccgcttactaaacgggtgctctaaccaactgagctacgaaagctgttgtttatttcttaaaataattacctacacatgccaaatcatctgcagaacatacaaagcaactacaaacccgtcagctaaaaagatgtacccgccatgctttcacttacaaaatctagtctaaatgattttttctttgttctgccgagctgcatcacttcgtgctatttctttatagaatttttttcgaggacagattcgactcaggtataatgcaacatcgataattcagaatgttcacagaatcacatcatcttcccttggtcgggcccgtcgggcctttgcaaacaaactgcatttgcaagatatagtagtattgcttacagcatttcaaaatatgattacagatcctccccttgtttggcagaaatacttctaacctttgctatgtttctcatctcaccaaaatgtgtcaaactaactgaaacaaatatcacgaacgaagggcctcgtccgttgtttgtctggatgaagcaagcaactctttgaactgtgctaatgccttctctgttatttgcttaaacggtatgcgctttatcacatgggctccaaagaagtataacagggcatctgttgcagtttccgtgttgatgcctctagcctggaagtagaagagctcgtttggatcaagctcaccactgatggcggcaccatgagtacacttcacatcatcagcaataatctgaaggttcggcttgacattaacaagtgcctttggtgataggataaggcacttggtttcttgccccgcatcagtttgctgtgcatacctgtgaatcaagactaccacatcattaggacacaaatatagaattgcagcttcagatatagctgtgtgtcatgactcatgagtaaaacatagattttggacatcctaggaattatataactgcatctatgtatcaccgatatgcgatacggtgacacactgatacaggtacggtatgtgatacatcgtttgtaaaaaacaaagatacactgatacttccaatatataaaatgtatagttaaaatgattgcatttacatgtccttagagagagaaccaaaatgatcgaatcaatttcaacaaaacataaggaaagcgacgatctaaatgaccaagcagccaggaactgaccggtcagcatagctagagtgcacctatctcagaaccttcagcagctgcgcaagatgatctcccaagtcccagagttcagatccaagcggtagcactcaatcatgaggattgaggacatcagcacacccagtggtgacgtgcctcccagcgaggcagtggcactagcttcttacggcatgcgctactagtagttggcagcgctagatccgggtggcatgtgctccatgtgaggtggtgacactccctgactccctgtccatggtggcgccaagaagcaagaggtgggagttggagacgaggcaccgtttgttcttgggtgaggcttgagaatggatggtgatgggctaatgatgttgggcttgcattgggctgtaaaatgaggtactattgggctggcatgcatcggcacagcgtattgcaccgtatcgtgagctaaaccattcagtttttttatctcgtttccctaatacttcgcgacatgcgtatcgggatgtatcaccgtatccgatatgggtgcggcaccctccctggtgtattggtgatacatagaactgctactgcataacaacataactatgagtgaaacaaaattcaacagttgagtaacagctaaatgtttctgtggctttctgttaactttctctcaattattttatatcatgtaacaccaaacatcttatacaactatcaatactatattatagacttcaagttcacttaaatatatcctagacaaatatttaatcttaggatgtcatatattcagttactgtgaaaagcgagcaatagaaatatttctggcacatgctaacaataaatatttttatgccatgaacacatcaaatgtgttatgcaattcagttaaaatttaaatctatcctagacaaacatataacaccaggatgccatatattcacctactgcgaaatactgagcaataaaaaagtgtatggcagaggcatgaaactagaaatctatgcaatgctgaccaggtaaatggctggaagcctggaatagacaacatttctcatgtaagaacaaaacaacaaaaaggaaaaaagctgtcaaatatacctgttgactttaatattgccatcaaatatgctatttcctgtgccacaagcaatgcatttatggagctgtcgcgagaaacctctagggtgatcaagtatcagtctgctatgcagatcatgtatctgcttattctgagacgttaagtgaagtgttgatagttctgtctctgtctcaggacctaattgctcgatatggagattgtgtctgttcaattttgctccagtgctgacctcaacaaactcatacttactagttgtatcctgaaaaagagaaaaaaaaagtttcacaacaaataagactgattttccctgttcaactaagcttcactgatcaatcccaacccaaaccaactagaacaggcatgactccccaacacccacaatgactattaacaataacaaacggaggcaactatcttgagtcataactcatgaggtagatcaaacaatgagatcttggaatgacaaatgcccccagctcagaaccaatctgagtaactccaacatctctctcccatagtttgatctgagttgggttctcttatcatcactatcctaacccatttcaagagtatataacactcaaacattacattcataagtacaattacaggtatcttccaacatttatctaaaatcaagacttacctgctggacgactgtccatttagtatgtgctgcagcaaatgattgatgttgcacgtatgaatgaaccactcttgcgccctcgtcaattataatcgctgccactggattggcccaatagcaaccaccttcttctccagccccaaaatgctcctccactatagccacctctgctgacttctcggccacaactagaacccttggatttgacatcagcatactctcagcgaagctattggtataggcgaacatgatgtgtattgggtcgtcggccaccttgaccccctcaggcacgtgcacgacaacaacgtccctcgccccaacggcgttgaagtcatagaagaggtccttgtgggcgaattcagcggcggccgcgagcgcggcggcggcgcggtcccgggcgcggccagggggaagatcggcgagggcgctgacatgggcaccagaggaagagacgaggattccatccgaaaagagcacgtgggaagagaaaggggaggacggcagcttgaggtcgggctccctggacgggagggagatggggagggagcggaggtaggagatgtcagtgaagcggaaggcctcgctggaacggcgagtgggccagcgtgtggagaggagggagagcgcagaggcggagcggagggggtccaggagcggggaggtggaggtcaccgagtcctccagctgttcggcgatgcgtaggacgaggtcatcggagacggcagggcgccgtgcgcggcac

SEQ ID NO: 21437 - DNA, 654 bp, Zea mays
ttttttttttttttttttttttttttttttttttttttttttttatgggcacgaattcatttgatcgaaaccctattctcgatgtttattgtacaaccgcgaaccccgttgcccgtgtgtgaaaaccttgcccccaggaaataaaacaaaaccatccgtaacgcattatgaggcccccaaaacagggctggatccccgtgaaacctcaaactcatgacaccctgatgccacgcgtgaaaaaccaaatgcccaaaacaaatcaagccatcaaagcacttatttcgtcgaggaaaaatacttggtgacggccttggtaccctcaaaaacggggtgcttggcaagctcaccgggcaggatgaaacggacagaggtctggatctctcgggaaaaaatgggggacttcttgttgtaggcggcaagcttggaagcctcaaaagcgacgcgctcgaaaatgtcgttgacaaaagagttcaggatggacatggcacggttggagataccagtgtcggggtggacctgcttgaggaccttgtaaatgtaaaaaaagtaggtctccttgcgggtcttggagcgcttctttttgtcaccaaaggcgggagtctttttgccagcatccttcttttcaggagccttggaggcagtagcgggagcctt

SEQ ID NO: 21438 - DNA, 780 bp, Zea mays
ttttttttttttttttagagaaataacattatactttcagaagaggatataatacacagaagtatatgacactgtctcaatagtgaatgaacaaaccagtcctctcaattcatcaatagttttaaggaccatgcatacaaaaaggattatgatattgagctgattctaccatgggttccggcacatcatttccctattgtagtctgtgtgcgtgactccagtcacgtgcatcagactatcagagtcgccgggtaaggagaagatacaattcataaatgttatgtgcattactgaagtaatcaaagcttcatagatttacaagcatatttgcgagctcctcatctttcacttcaacctcctggtgctctcccacagcctctgcaagccgtgcagctaactggtgcttacagctcagctgctcgccacgcccgacgacgtcgtagaagaatgagtagcacgtgcagaggtgctccgggaagcataggtactcctccttcctcttcgactcccccagcaccagaaagaccgagcggccactgggcgcgccggtgacgcgcctgacgccgcgctcgtcgacgatcttgcaggcccgcagcatgttctttccgaacagcgtctcgaggatggataggtgctcgtcggatgcccggccagcggatctgatctccgcccagacggcgtcggcgacggcgagggagacgctggtggcggcggacattgcgctagctagcttttcgacgttttttttcgattaggatgttctaggtaatggtctcgtgc

SEQ ID NO: 21439 - DNA, 964 bp, Zea mays
tttttttttttttttttggctgtaaaatatttagattacaagagaaactgaaaaaaaacagggattcacatacagacatacagtatactaccatcatagaatcttgaaactgttgtgaactgttttttttttttttttttcgggaatttatatacacacggcatggtgtaaactgccaacgaatttgtgtttacaaacgctcgaaacggcaaaccagctagaccaaaatcagctacatttactcgtatacgcaattcaattctctgaagtctgaataccaagccacattgtgcagccaaaaagcatgcgaccagaggtacgatataactaacagtagaggtcgaagcagcatgaatggcaggcggctgacacaggcgcttcagcggttgtggagtgggtccgacgagttgggcacactccgctcgctgcccgtgacgaggccttccgtagccgggaaccgccaccacttccttgcccgcacgttgagcggcgcgccggccggtgggctcgcgtcggtggcattggccccgtcgtctgtggccgtgccggcgccggacagtacgaccttctccggcgaccaacgtcagcaggaggaggagaagccttctttgactgcaagggcgaggtgcgcggcacagctgccgcggcgcgacggcgggggcaacggctaggggcgagggcactgcgtcggcgcgctactgggcgagcgccgggagggagcggtaggctagcgacggctaggctcgtgccgaactcgaggaaatcagggtggttggcaatttaatgttctatctgggcctccagcactcgggctgttctagctgggcctccagaggttcggacctctgccacgcacaggtcagccacagtatgactagggctccctctagttataagaagcctagggcttctaatactataactatatatatatatatatatatatatatatatatatatatat

SEQ ID NO: 21440 - DNA, 2729 bp, Zea mays
gacaacaaagtaccacttttacatccatctgcaaactagaagcctaaaatatcatgaccacatagccaagaccaacaacaaaatcacacgaaacactgatgcgtccttgcctttttttgctggtgctgcacgaacaaaaagataccaaaagtttcctcatctcgtgtttcgacaacctccaaccccattagtcgttgtggaacataattagcagtgacccaagtcctaatgagagaagaccaccttcccgtcctgccgccacacccaaaaccgtacattacttacaatagggcaagcagaccaaaacgaaatgaagccggaaaaaaacttaaccaaacgcattagagagaatgaacaaaattgaatacacaacccgctaacgactccacacagaccaaaaacaatttgggcctcttctatcttcttgctgtcttccttttgtatctacatgatgaagtatgctcggatgacctcgattatgggtgcgcggcacaacgggcatttccctccacctcgaaccaattcgtttgcgcatttcgagcaagtgcacatgtgcccacatctgtacagaagggagtcaatcggagtctcacagcatatgcagcaggtcccttttctcacatttatccatttcgatccatcatcgattatttctttactttcaccaccttgctccccaatgaaacgattcaaggctgctgatacttcttgccttacagaacgctgcaactctagctgcatatccatgcaagcttccaacatcctttgcatatggctcatgccttgctgaagtctagccatatcagctcttaaatcattgatagcctcccattcaatatcagaagatgaacgatgaatgttttgtctgatccaattagtacgatgcaactctgaatgccaaagtggctgacgaggaggcataggtgggggtggtatcactaaaggaggcctgttgacagtgcgctgcagttcctggtcctcatcatctctttgctcctcctgaatttgaactggtgatggaggggcaggggttgttccttccagatcccaagggagaggaccacgaccttgccgttccacatatgaccggataagtcgatccaagttttcacgaaaagcactgtgaagaagattagaaacgctccttctgcttagaagttccctcaattctgtgctgtacacattatcatcatctccagggatgaaagtattagctcttctaataagagcagcatcatgatcaattggttggtcagaattattatcatgccaattgtctgcagtatcattagactcatcatcattatgccactcttcatttacttcagggagatgatcatcactctgccactcatcatagacttcaacaggacgatcatctcttctccattccccatgtgattcctgaaagtgattatttccatgcagctcttcaagcactgcaggaagatgatcactgtcatgctgatcttcttgcgcttcaggaagactaccatcagtgatagacccttcaagtccttcaggaaggtgatcaacactggttgactcttcatttgcttctggaagatgatcgttattatcatcttcaactgctgtcccctcatgagatgacatgttgtctgcattttcacgccaagttctttcagattcctctccaatcacagcatgggaaaatcgttgccagtctcttctctcatgttccaaatcatcctgactttctgcttggctatgagacccgcagaagacttcagcaatgttagggctgccactttcaaatcctgatgtcattgccgtactgtcgatttgttgaagactgacaatctcacttgtccgctcatgtctctcctgagtagtttcaggaggccttaattcagaacgatcatttgtagataactcaacatcgtgaactgaagaagcatccacttggctatctgcttgaccacggacaagattctccaatctgaagcggaactcttctctcaaaccagagacaggatgcctttgccgcagctggccaagctcccttgcggccacagatgggggcctcctctcctctggtaaaccgctgttgcgcagaaaccgaccccggagcagcgcatggattctgttgcgatgcggaaagtcagagacggcgcggtgctgcgagaggcggtggagctcggcttggcggtcggcggccatgcgcatgacgagctcgaggcgcgcttggcggccgcggatcctgggggcgtccctgcgagcgtgttcatggacgggggacggtgggggtccggtgtcgtcgtcacggtcgcgggcagccatgtggacccactccctgacgaggcgcacacggtcgcgctcgatctcgcggagccaggaggacgaggaagaggaggcgcgcgagatctggacggcgggcgcgcggcggaggaggtccggggagccctcgcgactggatccagcgtcccagtcgctgtcgctgcggggctcggagggctcacggcggcggcgtggggtcatatcgatgccggaaacagggggagctggagaagggactgggacgtcgcccatcgccaccggccgcgacgaggcatggggcggcgggaagctgctgctgactggattgggctatagcgaagtcaatccccaccccaccagagtcccagcatgagatgagacgccgacggaggcgaggtggagtcgaagcaagcccgtccaattcccctgatcccctcgaacggggagacgac

SEQ ID NO: 21441 - DNA, 1716 bp, Zea mays
gctcggtacccctgtcttttttttatccaagcacgacagtagatcggcagatcctaattcgccgacgttcaaatcagatgacccatgtggtggacggaaatcagtttgaacagtcactgattaagttcccgttgccgaactgataaaggccacatgtttagtttaaaatgccacagctacggtctggctttcttacctcgcttatcgtgaactcattttttaccaactgtaacagccatcttgctcgtcgcatttttggcgaccaaccatactctgccaatggttaggttcgataaactatggctatgaaccaaacatggaacccaatcaaattatgctcaacctggctgacaatcagcaattttttttttttttttttcgaagaaccatctcaacttgtttgaataaatatactccttacaagtgacaagaaaaaataagtataaaaaaagcagaaacaacaaaacattctttacggtcgacccacttcaacacttactatgctacaagaccagtacctagacgacacgactaggcgttggggatgctaaggaaattaagaatattaaccgcgaccaggggatgtaactttgcacagatgcagagacacagggaggaaggaagtggaaacatcagctcgatgttatccggaatccttctgcttcatcattcatgtgactagttacagctgctcatcagctttgaactgaaagtcaccgcattttctgtcttcttgacttcaagttctaacgcttcatctatctccctgaaccaatcaaagcatcaaaaaggccacagcaattccaccatgttgcccgctgccctgaagcaaccactgccactgcaggtccacgggccacctctgtagtatgcacatcagcagtgtcctgagatctcgacacctcagcagggtccttgacaaccacattcctcctaatcagctctggtgttttcaacacaacagtagccccggcgcccttcacatctggtgctacaggcgtttgctcgaccaccacaacttcatcaaccttcagctcagattcaagcaccggatgcaccttggccacctctttcaccgccggcgcatcagccactgactcctgtaccacggattcctcggccaccaacacatccttcacctccggttcctgtgccaccacggcgtgcacctccacctctgcttcatccacctcgccctcacgtacatgcccagcggtttccggtggaaacgcgtccacaatgacctccccagacccggcgacgtccgcctcgacggcacgctccacgggaacctcggccgcgggggccttcctctcctcctcgtccggctccgacgcggcggccctgggggtcaccatctcttcggagctctccatggagtcctcgctcgcatcgacgcgagaaacttttggtgggatgcacaggtgggggtcgccgtcgcggccgctcgaggcgttgttgttgttatcgctgccgttaccattgccgctgctggcgtttgtgttgccgccatcgtcggggtgaccctgctgctgctgcttcttgagtttggcgcgcttcttggcgcccttcggcatggcggagagggatttcgattcgacagacggcggcgtggacagggagaggagcgagaggcgagcgatgagagggggaagggacggggagaattgcgagccgatttgtttggattttgagccggagggaggggtatcggtt

SEQ ID NO: 21442 - DNA, 1202 bp, Zea mays
  misc_feature (983)..(984): n is a, c, g, or t
  misc_feature (1002)..(1002): n is a, c, g, or t
  misc_feature (1017)..(1017): n is a, c, g, or t
  misc_feature (1056)..(1056): n is a, c, g, or t
  misc_feature (1086)..(1087): n is a, c, g, or t
  misc_feature (1113)..(1113): n is a, c, g, or t
  misc_feature (1115)..(1115): n is a, c, g, or t
  misc_feature (1117)..(1118): n is a, c, g, or t
  misc_feature (1141)..(1141): n is a, c, g, or t
  misc_feature (1154)..(1154): n is a, c, g, or t
  misc_feature (1200)..(1200): n is a, c, g, or t
ttttttttttttttttgagacgagatggaattttactcccaagattctgtttcatggttttacgaagaatgtaggcaccatgacaggatgcatcctatagtttagcactcgacaggtgcaccacttacaggagcaactctgggttagcgcactcagttgttcagagaggtccgctcgacgctcgttaaacctagtgtggattatggggggcaaaacttccaactagatcttcaaatccacaacttagatggcaataagttgccaatgcggcaacttcattacctgcaaacccaacaacaaaaaagagacatacggagcctacggcatgctacgatttagcaagcctcggaaagacagatatagatctttgttttctggaccaaagatctcctcagctttcttgagagtttcctcacgggactgcttatgggcattgagttctttgatgttggctaagaatgctccaaattgttcataggatagacgactcctggcttggcgaaaaaattcctttccatcaacacgaggcttggcgaaaaaattcctttccatcaacacgaggagtccgacctgggtttgaacctcctcgtggaggtgagctagctgccgaggactgcttgcttgatgggtaccatggtgtcattgacatgtgagcttcaattcgagattttgttggcgaggtagcaccagacatcagcttcggtgttgctgtggtagatatttgccttggagaagcagaagtggacattattttaggagtggccttgggggtaagccgaaggagtgatgtgcgatgagggggcatatttttggatcggaggccttgatgccgtaccgtctcggttcgtacttccagcatccaaagattcactaaatatatttgttgtagggtggctgccagatccaccatctccactagacgatgcttttgttgctactgactggtcacatgttgtaatgtcaactgtttcctgtggtgatgnnctatcatcacgcaatgantgcatcagatgcctnttgaatgactccagcttctgcaggtcgcgcgccagcttnttggacgtctgcgccagcgagtctcgctcnntgctgagcttaatattgtcctcgagnangnngcggagcctggcgttggtctccngcagcgcggtgtngagcagcaccactcgctcccggagctcggcgttctcgcggtccttngt

SEQ ID NO: 21443 - DNA, 1632 bp, Zea mays
  misc_feature (234)..(234): n is a, c, g, or t
  misc_feature (251)..(251): n is a, c, g, or t
  misc_feature (296)..(296): n is a, c, g, or t
  misc_feature (310)..(310): n is a, c, g, or t
gattggacgactgagattgtagaacggtagaatggacggctgagatcgcagaatgacagaacacaaaaaggcagactactattgctaacttaataagtagtagagatttttctataaatttagttaaatataaagaatatttgattcaccacagctctaaaaattaatttatttagatatagaacaagtataacaagttatttatcccgttgtgacgagaattgatttgattcnatacattgacacttgancggtcgttgcaggcccattcatcgtacacacatgagtcacatgcnccatcgcgacaagnccagcatcacgtgaccacgtcacgcgcacggtgcaccccttgtacagtagtactccaaactgctacccggcttcctcagccgtcgtatcatctgccgccgccatactcctgtccacctgagtacctgaccggcatccttccccctcctgcccgatccctcgaggcggagatccctaggccgtcggccgggatggcgggggcgctggccctcgcggtgttgctcgccgtcgcgtcgctccatgctgaggcggtgtggctggacgtgccacagtcggggaccaagtgcgtgtcggaggagatccagtctaacgtggtggtgctcaccgactattccatcatgtacgagtcccacccctattcgcaccccaccatcgccgtcaaggttacttcaccatatgggaacaccttgcatcacagtgagaatctacagttggtcaatttgcattcagtcaaggtatcgcttcccgcgattctgttccccaccccccgcttattcagtgctgcgagccttgatatgcatcccgattagcgattagtctgggccatagagtttaattccatggcacttttgttaagagtatattcttcatgtcttgtgacctgttattcggggtaaataggagtactaaataacgaggaaattgtggttctatatgctcgagtcgagcattctaagaactgttatactcgagcaatatggtgacaccagagcattaggaaaatgtagaaaatctgaatctgaatgttggcctgctgcttcgactagatttgtatgaatcagttcatgacccaggtgattctcataccatgttggttccttctgtctaagcaatggtgtttccacctaggatgtcacccatgagttgggatagaattacagaatcctaggctatgcattttatgggatttgcctatttctcttccagtgaactactttaaagtttcataaacaatagaatcgtaatcaaatcgtccccatgtgatggaataagatgtagtatcaaagaagggggcgaattgaaataagttagggcactgaagcgagccagtgagagctcacagctcaattttttaaaaatctttcaatatcctaaacaccatttaggtctactgttttaacattgcattggtaaaaggctaaggtaacagtgaatgataagaaactcttactgagttttagatcttgtaaaaattggcaaagttgctagacttatctttgctatatattccattccccatcatatctagttacaaaccgacttcatttctcagttcagatttaatgtgcatcaccaatgcaacatctaggtactgaatacatg

SEQ ID NO: 21444 - DNA, 1184 bp, Zea mays
ctccatcgcgacaagaccagcatcacgtgaccacggcgcgcccccgggccgccccttgtacagtagtactccaaactgctacccggcttcctcagccgtcgtatcatctgccgccgccatactcctgtccacctgagtacctgaccggcatccttccccctcctgcccgatccctcgaggcggagatccctaggctgtcggccgggatggcgggggcgctggccctcgcggtgttgctcgccgtcgcgtcactccatgctgaggcggtgtggctggacgtgccacagtcggggaccaagtgcgtgtcggaggagatccagtctaacgtggtggtgctcaccgactattccatcatgttcgagtcccacccctattcgcatcccaccatcgccgtcaaggttacttcaccatatgggaacaccttgcatcacagtgagaattctacagttggtcaatttgcattcacaaccgcagaagctggaaactacgttgcatgcttctgggttgatagtgcagagaaaggatcaggagtatctgtgaatcttgactggaagattgggatcgcaacaaaagattgggatgctattgctaagaaggaaaaaattgagggtgtagaactagagcttcggaaacttgaagtggcagtgcaggccattcatcagaacttgatatacctcaaagaaagggaagcagagatgcgaactgtgagtgagacaacaaattcaagggtcgtctggttcagtactctgtcgctatgggtctgcattgcggtatcggttttgcaagtccgacaccttcaagggttcttcagaaagaagaagctcatttagagtctctctgtaagatgttgcgctgtggttcagatgttgttcaccttggaagggtacaattttgccttttacatggaacatttcacaccagtgatgactgatgggctacttgtactgtatgtaatttaagtacgattggatcgaaaatctatatttcagggaaaaaaatcttatatttaggctccagcacatacatgtaagtgtaaccaggggatagcccatctaggcatgttgtagaatgagactgaactcatcgtgacagcaaaatcgtggatacttaggcccttgttgccttccgatcggtcttatcgatgctagccctcgattattaaaaaaaaaaaaaaaaaagctgtg

SEQ ID NO: 21445 - DNA, 2122 bp, Zea mays
cgaagcttgtatcctctagagctttcgcccttttttttttttttttaagcaaacaaaaccattccacggaatctgatatctaagattcagttttgacagctcagcaaataaaaccgttcaaggcatatacataagacacaactctggatcaggctctctggaacctagtgactgtgtgaggcacaagggccatcacatggtacattacacagggcaaaaaaaagtttcaccaacgtacagtttacagggtactccatctaaatattggccacgctaactagttatcagtcgaaatgttgtcgaagagccatctcggtttcgctcttccaggacgcatgcgacgattggcccctcatcctcttgatcttctccttgtctttgacagtggaacccttcttcttttcgggctcttttgtcagcgccggtctatcaccacattgagggcaaaccatacccttgccatgtgagtaggtctttggtacaccacattggagacacatcctaaacaatgagccgaagtcacaattaagaacactaatagtattaaggaattctggtatatattagagttcaccgaaaacatgtacacaagctatttcaaaatatttgtttcgttgtgacatggatacaaaaatgaccaataatacctcagaagatcagctgcatcttctggaccaggatttgcggcacctattattctttttccatcaacagaaccagatgtcactgaacctggagggttggctccaattgtggtaaccaactgcggttttgccaccacaacagctcctggatattatttttctagtcatatcataaggggtgtagcatatatctgaaattgcataactggcacccaagatgaaacttgcactgctatcatctcagcaccaagcttagaaatattgaggtggtaacccgtaacagaacagttaacaggcacattggatgatagatgtatgtattggtgtgttgtattttgaaaaaaactaacatgctttactatcatattagtgccaaggtcagaaatattgaggtggtaacccataatttaacagttaacagaaatgtgggatgatgtatggatgttctggcatattgtgttttgagaaaccaatcctgcattactgtcatctgagagccaaactcagaaatattgaggtggcattgtggcaaccaataacagaacagttaacagggacatggaatgatggatgggtgttatagtgtattgcattttgagaaaaccagcttttataaatactttcaatcgccaagtttcaaagtaaaggtaaaaccataaaactaaacaccaaaaagtaacatcctatttacttagcttggtgaggccacctaagtatttctatactagttactgctcaaaggccatatcattgtcgttattgcatcatcctaaaatgtcatcatggttttgcttgataagtttatactagccccaataattggcgcacaaataattacaacttgtaacaataacctaacaacaatcatcaaacaatagtacacagtcaataggagatatcagctgaacaaccatgtttacatggccaaaagcacaacggtgaaacaaacaaatagaatcaagaattattgcatcttttgctatgttctttttccttgagggttatgtgatgtgcatgctctttctttagtgttttagcagattggttggttcctctagctgagttgattaggtgtaggtggtccaatcagcactccccaagtcctgagttcgacttcccgcgggagcaaattttagtctagggtgcgatcggcagtcggtgcatcagctccaccatcatgaatctgtgcccctgttctttcctctatcaattgtcgctgtttcccttctaatgtgcttcacgttcttcaacctctggtcaaggtcgacactgccaccggtggtgagttggatgacggtgaggagatgaccatcaacttcactacgacgcttatattgcctaggcaagaataaattactctttattcactttaatgtcatgttttttacttgcaagtgttggcccagatctagaactagaaattcttctacgtgtccccaaaagaaacaaacatacagtgcagctgcaggcatgcaagc

SEQ ID NO: 21446 - DNA, 1456 bp, Zea mays
cttgcatgcctgcagagcctaagtcagctccacacagacaaccaatcaaaacgtaaggcaatctccagcgcatccttatcttattgtttattttaaacttcactattcaaacagtatcagctattcttattgtttatttcaaacttcactattcaaacagtatcatatacaataccgcgtcctcttttttaaacgatccattgaaaacagccaatactgcctctgttccgaactataagtcatcgatctattttaaattacacaagtcattttagcttgtctatataaaggaagataattcgactcacgctacagcagagcggccaaatcaacgacgaacgaccgtcagggactcaggcgagcggtcggcggttgcaagcaagtctgcacggacgaagcagtgaccagtatgccttccgcaaactgcacaaaccagctcacacttcacattgcctcgtgccccggtgccccccctcgcgtagcaaacaaaatccattccacggaatctgatatctaagattcagtttgacagctcagcaaataaaaccgttcaaggcatatacataaaacacaactctggctcaggctctctggaacctagtgactgtgtgaggcacaagggccatcacatggtacattacacggggcaaaaaaatgtttcaccaacctacagtttacagggtggtactccatctaaatattggccacgctaactagttatcagtcgaaatgttgtcgaagagccatctcggtttcgctcttccaggacgcatgcgacgattggcccctcatcctcttgatcttctccttgtctttgacagtggaacccttcttcttttcgggctcttttgtcagcgccggtctatcaccacattgagggcaaaccatacccttgccatgtgagtaggtctttggtacaccacattggagacacatcctcagaagatcagctgcatcttctggaccaggatttgcggcacctattattctttttccatcaacagaaccagatgtcactgaacctggagggttggctccagttgtggtaaccaactgcggttttgccaccacaacagctccaggaggcggctgcttgctcccctctttcccacggcgatcgagtacaccgagggcctccgtcccttcctcgggctccgcaaccctgtgcctcaagaactccggtggtcccgagacatcggagaatgcctccagatcggagggcagagaggagtccccgtcgccgccgccggcatctcccttcttacggtttggtcggcggcggggcttgaaggccggcttcggaggagcggacccctcgtcgccgtccgatccggcttcctcggctgacgaatcagcggactcgctcagctcggcgccggcgccgtcctcctcctcggcggaggagtagccctcgagaagtgctaagctcattgactgggctcctgatttttctaac

SEQ ID NO: 21447 - DNA, 1581 bp, Zea mays
cctcgaagccggccgggtatttgtttgtttgtcatttagaggtctgagacagagatgaggatgtgtaatcctatcaattttctgaacgggagttgtttctatgctccgcaagcaaacatatgacactgcaaaaaaaaaaaaaaaaaaaaaaaaaaaaaaaaaaaaaaaaaaaaaaaaaaaaaaaagagagaatattctattccagctcccgaccgttcccctcttctcttggaagttgggctcttggcctaattgggcaccgcgaggcccgcccggggccgggaagtgtgaaggtaggagagagagagagggagccaagggaagctctcttctttcttcctcctcctcgtcctctcgaattccgtctcttgtctctgtcctcctcgctcggcttccccggttcttgagaggggaaataggaggcggagccgaggagagggatggggagggacgagaggttcccagtgtgggaggccgcgctcggcgctggggtcgccgccgccttcgccgctgggctcgtcggggtttacctttccatgccggactccgactacagcttcctcaagctgccacgtaatctccaggaactccaaatcctcactggccatcttgagaactatactagcgactacaccctacaggtgttggtaggctactgcgccgtgtacatcttcatgcagaccttcatgatcccaggaacgatattcatgtcactgcttgctggtgctctgtttgggcagctccggggcgtggccctggtagtcttcgccgccactgctggcgcttcttcgtgctatttcctgtcgaagatgattgggaagccactggtgttcacgctgtggccagataaactcagcttcttccagagacaggttgctaaaagaagagagaagctcttgaattacatgcttttcctcagggtgaccccaacattgccaaataccttcatcaacttggcttcaccgatagtagatgtcccctaccacatattcttactgggaactctcattggccttatcccagcttcttatgtgactgtcagggctggaatcgctcttggagaattaacttcgctaagcgacctttacgacacccagtcgatagcgctgctattcctgatcggtgttgtttcagtcacaccagcattgttgggcaaggacgaggcacaagaaaaaccatcagaaatggctgtaggcgcgtcgtgatcaccaaagcaccgagcacctgtacatatcaacatgcagccatgcagtggcttcattagttcagatcgacgggcccgtgtggctggatgacaaaaacggttcgcatggctactacacagcttggataggccattcagcacattatgattatgaacgattgaatgaatctgggaagcagaatgcccgttccacaagctgctctgatgtgtaaacgagtagtgctgttcggataggcctggcatttagtctaatccctgtttatattgaccagattcattcaatccatattcagtggttcaaagataatgccctgtccagctgctgtgttcctcaatgtctttctccatttctaaaaaaaaaaaaaaaaaaaaaaaaa

SEQ ID NO: 21448 - DNA, 1496 bp, Zea mays
ttgggaccctcgaggccggccggggagagatcattctattccagctctccccctcggcccctcttctctccctccctccctccgtccccgcattaaactcggcgaacgggccaagaaaagcaaaccgagggaggagaaaggcaaggaaagtgggaaggtaggagagagagggagacagggaaagctctcttcctcctcctcctcctctcgaattccgtctcttgtccctgtcgtcctcgcccggtttccccggtttttgagaggggaaagaggaggcggaggagagggatggggagggacgagaggttcccggtgtgggaggccgcgctcggcgccggagtcgccgccgccttcgccgctggactcgtcggtgtctacctttccatgccggactccgactacagcttcctcaagttgccacgtaatctcgaggaactccaaatcctcactggccaccttgagaactatactagtgactacaccctacaggtgttggtaggttattgcgctgtgtacatcttcatgcagaccttcatgatcccagggacaatattcatgtcactgcttgctggtgctctatttgggcaactgcgtggccttgcactggtggtctttgctgccactgcaggtgcttcttcgtgctatttcctgtcaaagatgattgggaagccactggtgttcacactgtggccagataagctcagcttcttccagagacaggttgctaaaagaagagagaagttgttgaattacatgcttttcctcagggtgaccccaacattgccaaataccttcatcaacttagcttcacccatagtagatgtcccctaccatatattcttactgggaactctcattggtcttatcccagctgcttatgtcactgtcagggctggaattgctcttggagagttaacttcgctgagtgacctttacgacacccagtcgatagcactgctattcctgatcggtgttgtttcagtcacaccagcattgctgggcaaggatgaggcacaagagaaaccaccagaaatggcggtaggcgcgtcatgatcaccaaagcacctagcggtgtccacgtcacctgtatatatgtcaacatccagcatgcagtggcttcattagttcggatcaacgggcccttgtggctggatgataaaaatggttcgcatggccacacagcttggcgggacctcggcctaaactccctccactgctggcctacagaggcgcctgtgttgccatcatcagaacatgattcggtagccattcaccacattattaatgaatgaacctgggaagcagaattgcctgtagacgagctgctctgatgtgtaaacgagtagcgctgttcggataggacaggcatttagtccaatccctgtatatattaaccagattcattcaatccatattcagtggttcaaagataatgccctgttcagctgcaaaaaaaaaaaaaaaaaaaaaaaaaaaaataaaaaaaaaaaaaaaaa

SEQ ID NO: 21449 - DNA, 961 bp, Zea mays
gtcgacccagcggcccccctagccgcctgtcttgctgaagctgaactgctgatccgtcttccaagctgtgagggcttgtgaggtgggattctattggggagtgcggggttgggctttcatccgtggcctcttatatcctcctcctgcctcttccgtaggcgcgcctcttccgtaaaccctagccgcctgtcttgctgaagctgaactgctgatccgtcttccaagctgtggtgtcatccctgcgttctgatccaagatgtatctccagtattacatcaacgagaagggggacaaggtctacaccaccaagaaggagtcgcctcttggggtgccgacgcagtctgctcacccagctcgcttctcaccagatgacaagtactctcgccagcggtacctgttgaagaagagatttggacttctgccaacgcagaagccagcactgaagtactgaagcttcaactttccaaccatggatgtgcagtttgtgtcactgcttgatgcttgttggttggaatgtagaataggtatctgaggaaacatatcaaacactgctaggcactactatgacatctcagcgcattcaggcactatatgtaatgctatgtgtttgacaggtcttgttcttattatgtacttggtgtgtgggccaaagcatcgtttttggcgttctcttttcatcatgaatgatgacgtcccctttgctaaatcaatttgaagtcaggtctcaagtgctaatcaaggagggtaacagctttggacagctcgaatctccagaggagacttgggaagaggttgctgaaaaagttcacaaagaccaatggcttaaattcaatggcacaatgatttatattatatggaacatttgaaggatcaattactaaattcaacggcacagtgatttatattatatggaacatttgaagtatcaattactaaattcaatggcacaatgatttttatt

SEQ ID NO: 21450 - DNA, 687 bp, Zea mays
gcgggagagcggccctcaagttcgcgaatcgcgagttgcggcgacggtagaggaaaaatcagccgtggcctctcttccgtaagccctagcccctagccgccagtgtcgtgcattcgtgctgaggctcaactgctgatccgtcttccaagctctggtatcatccctgagcactgatttaagatgtatctccagtactacatcaacgagaagggggacaaggtctacaccaccaagaaggagtcacctcttggggtgccaacgcagtctgctcacccagctcggttctcaccagatgacaagtactctcgccagcgatacctgttgaagaagagatttggacttctgccaacgcagaatccaggaccgaagtactgaagcttcaagtcaactgtccaacctgcgatgttctttttgtgtcaatgcttgttggttggaatgtaccatcttcgttctcgaatatttgtggtccgttagttcaattttgaactaaaccgcgacaaataaaaaagagcggagggagtagaatataggtatttctgagaactgaaatcaaacactggtaggcactactatgtcatcctgcatcacattctgtcactacatgtaatgctatgtgtttttggactgttgacatgctttattagttactgcttattcaccaaaaaaaaaaaaaaaaaaaaaaacaaa

SEQ ID NO: 21451 - DNA, 2299 bp, Zea mays
tcttgattgtttaacaagaataataattcaggttcccatggacctcgtcacctcttggggtgccgacgcagtctgctcacccagctcgcttctcaccagatgacaagtactctcgccagcggtacctgttgaagaagagatttggacttctgccaacgcagaagccagcactgaagtactgaagcttcaactttccaaccatggatgtgcagtttgtgtcactgcttgatgcttgttggttggaatgtagaataggtatctgaggaaacatatcaaacactgctaggcactactatgacatctcagcgcattcaggcactatatgtaatgctatgtgtttgacaggtcttgttcttattatgtacttggtgtgtgggccaaagcatcgtttttggcgttctcttttcgtcttgattgatgacgtcccctttgctaaatcaatttgaagtcaggtctcaagtgctaatcaaggagggtaacagctttggacagctcgaatctccagaggagacttgggaagaggttgctgaaaaagttcacaaagaccaatggcttaaattcaatggcacaatgatttatattatatggaacctttgaaggatcaattactaaattcaacggcacagtgatttatattatatatggaacatttgaaggatcaattactaaattcaatggcacagtggtttttattatttggaacgtatgagggacggatgttcagatgacccgtgtagtccgcgtctcttcttggttgattattttggcaggtttctgcggttgcattcggccttttgtgttagccgcccagacctctagcgttgcggcctggacttgattcagtggtgttaaattttctttcacattttaattgaaatgcaatgcttggcactttacttaaaaaaactagtaaagtacttgtttgtgtaggtgctcaccatgccgccatcctcacacatctccggtggagagccaacgcccccgccggccgccgccttgctccctcctgcatggcgggcggcagagaacagagcaagagaaagacaacgggagagagagcatcgcggggccgtgagggcgtggatggagtagtatgcaagggtgggatgatctggacgtctttgtagttaggtgtgagagaaagaataaggagaaaaaactggacggtttaatatgatggatgaagattttttgtatacaaaataggatgcgtgaaaacacatctcggtgtgggacatggggtcatttgttggatggacctaaattaatttaactggtattttatttagggtataggtaaaaaacgcatcaaaaaatactaagtcaccgtttgtttcgttggaattaaatttcattttaataattataatttagacaaaactatttaagtttatatatttatatatgtaatttatttgtatattatcctaaattatatgatagaaatacttatatactacatttatgttatagcggcacaagtagaagattgtactataagttgtacatcgaaaaaataacatgtaaatctatataatcaatttctatatcttatcacatgaatttgagatagacttatatgataactttgtaatgttgtggaatgttacattctaaaaaaatagcttattctattagtaagattttaattcctcaaaataaaaggaaacaaacggagctaatagtttttacgacctttttttttccctagattggtttgttcgtaatgcttctttgcacggaagagaaaaacgagtcttatcagtctaaggcctgtttgaatggcgacttggcccaggcaggtgcgtccagcctgccagccccaacaaacgctcaaaaacgaacgactcgaactctgagagcgatgcctagcccagacaagattcctacgacaggaaacaaacagcccctcgatgcatcgcaaaagctgtatcaataaaaaaaactaaactaaatattttgaggtgtttggtttaataaatcacttcatctaaaattaaaataaggtggtgcatcatgagtccactcctcaaatttggtggaataaattctctcataatattacttttagcttataagaaataaaatagtgataagaaataaaatagtgatggaaaaactcattacattctataaaccaaacaagatagtgaagagtggcaagatgatagacaacttcattccttaaaccaaacatgctatttataatttggaatagggtagaatctatatcattgtgataacatctaaaatcacatggactaggaaaccaaaatgtagaatcagcttataacaggca

SEQ ID NO: 21452 - DNA, 3093 bp, Zea mays
tttttgttttgtttcatccagcaacacaaaggtgctgtatctactagttgcatctcgcacatgcccaggaattttccaacagcgtcttctaatattggatagtattaacaacgcataaagttacatgcttatcagccaaccttaccttacttcccaacgtccgaaatgaccaaggatgaacagaaatctgcaaggaagggggactaaagactactcttgcgcttacgtggtactgatatatcattgggactaccactacagctacaactaaaagagctcgaactcgatgtcgtcgccattcagccggaattccagacatttgccttcctttttcttgcgtgttcccgcgagtgttgctgcagtatcaatatttttcggggtctctggtggtgaagtccaccggatcaaggcccagttcagaccttcgaagaagggatgccgcttaatctcagcagctcctctcgacgagccaagccggtactccggttctttcacaagcagccctctgatcagatctcgagcgtggaagcttaatgctggactgtcagggaacttcaagccctgtgagatcacatttgagagtgtttcgtcattgtccggtcccctgaatggtgtcttgccatagagtaattcgtaaaggaagattccaagagtccaccaatcaaccgagctgccatggccatctcctcgaatgatctctggggcaagatattcatgggtcccaacaaacgaatttgaccttgcttccgtaggctcaacaacgagctgtggaagtgatggtttcttcaggggttcagctctagtcctccgtgtccttgacggtgtagatgaaaccagactgggcgtgaagcaagacgaattgctccacgatggctggatacacaggggatcaatgcagctttgtgcacagggaccagaaggcctacttggctcatctctgtctactgatgatgttctcacaagcattgggctcactgagcacctcagcgacagatcaaagtctgagagcatgatgtgcccatcttcacgaacaaggatgttctctggcttcagatcacggtatatgacccccaacatatggagatactccaaggctaagaggacttcagcgacataaaatcttgcagctgcttccgaaaaggttttggtaggttgcttctgcctaagaacatgtaggtcaccaccagggcaaaactccattaccagacaagaaaggttgtccgtcgtgaaatgagaatacagggttggaaggaatgggtggtcgagcatttgcagtatctccctctcagtttgtgctctgagcattttctttctgcttatgaggtactcgatgtccataaccttcaatgcgaacatgcagtctgagcccactaactcagccaaataaacagtgccaatatccccacaaccaagttgtttgagaagcttgaagttctttaatcccaagctcccttgttggatagccatgcgcctgatggctccccatctcacatcctttgacatgtgaggcctgcttctgttagcactgaagctgccataactgtcctcactgatgcttgtgctggtgctataatcaccaatgctactcttagagctttgggagcattctcccttctcctttgatcttaacaactcaccaaccttcgagccatggatcacaccgacaccacagcctttggtgccaaaatcagctccatcaacagtggtggagctgacagtagccttcttgtcagttggcgctggggttctgggttcatcctgaagggactcctgatgtttactagtgtgagatttaggacctttcgtctcacaatgcttgtgtgatgcaggcactatagcaggttcgggtttcaccttctttttcgtcgaggttttattccgaaacattggcctcaccaaccgtgagccacctactggaacagcccgggggctagatgttttcattgatttaccttttctctgctttggcagagttacttctacagaaataccttcaactccctctgatgacttgttactgatcacatcttggattctggttttatgaacattccctgtggtaggagatgctgatctcaaattcttcttggctgagctcttgctctgccccttactgatttcacttggcttacccactgaacttcctgccgatttctcaggcttcacagaaactttccctgccttactcttgtcatcttgctcctcattggtttgaactgcaacagagccatgtagcttcttgattgctccagaatcagaaggggtggacacccctgtcggttttgacagtctcttcatggctgccatctccgacgcctgtgagatgcacatcttcctcagggcctgcttcaggctcacggactccacaatctctgagctcgacactggcgacttcccaagcgcaataagccgcctatccgtgctcgtctgcccagaagccctcgccgacgtgcgcacgttgatcgatctgatgagctggtcaagatcatcctccaccgagcacgaccgtgccccaagctcctgccccactggcttgaccctcaccctcaagtgggtaagcccacacgaacgagcatctttcggctcgtccaccagttcgactatctccgagcacccaggagaacccatccccttcgagccttccggttccacaagctgcatcttcatctgggtgggaggccgtagaagggctgccgcatttcaagtcatcaggaccgacggttgcctgcacttaggtggccgacgaagccgctttcccgggccaagaaccggcatcacggagtccggacggcggcacccggggccgagggcgctggcgcggcacgcgaagggtggcggcggcgggagctgctacggctcgcgctcggtcggcggcgcgggttgctcccacttggagaagctggctgctgcgagcgaggatttgctagggttttctggccgaaacggcggcgaggagcggcgagagtgggggagtggcgtggggatgaggatgagttcaagcgggcgaaagcggcagcgctcggcagcaatgagcggcgcgcatcacgaggagcagatgatccagtggcctcctctcgctcgcccccttcttcc

SEQ ID NO: 21453 - DNA, 1724 bp, Zea mays
  misc_feature (3)..(3): n is a, c, g, or t
  misc_feature (7)..(7): n is a, c, g, or t
  misc_feature (18)..(18): n is a, c, g, or t
  misc_feature (23)..(23): n is a, c, g, or t
  misc_feature (36)..(36): n is a, c, g, or t
  misc_feature (51)..(51): n is a, c, g, or t
  misc_feature (56)..(56): n is a, c, g, or t
  misc_feature (66)..(66): n is a, c, g, or t
  misc_feature (69)..(69): n is a, c, g, or t
  misc_feature (77)..(79): n is a, c, g, or t
  misc_feature (87)..(88): n is a, c, g, or t
  misc_feature (91)..(91): n is a, c, g, or t
  misc_feature (111)..(111): n is a, c, g, or t
  misc_feature (113)..(113): n is a, c, g, or t
  misc_feature (122)..(122): n is a, c, g, or t
  misc_feature (137)..(137): n is a, c, g, or t
  misc_feature (156)..(158): n is a, c, g, or t
  misc_feature (164)..(164): n is a, c, g, or t
  misc_feature (168)..(168): n is a, c, g, or t
  misc_feature (175)..(175): n is a, c, g, or t
  misc_feature (187)..(187): n is a, c, g, or t
  misc_feature (201)..(201): n is a, c, g, or t
  misc_feature (204)..(204): n is a, c, g, or t
  misc_feature (230)..(230): n is a, c, g, or t
  misc_feature (240)..(240): n is a, c, g, or t
  misc_feature (242)..(243): n is a, c, g, or t
  misc_feature (250)..(250): n is a, c, g, or t
  misc_feature (280)..(280): n is a, c, g, or t
  misc_feature (287)..(287): n is a, c, g, or t
  misc_feature (299)..(299): n is a, c, g, or t
  misc_feature (301)..(301): n is a, c, g, or t
  misc_feature (304)..(304): n is a, c, g, or t
  misc_feature (330)..(330): n is a, c, g, or t
  misc_feature (384)..(384): n is a, c, g, or t
  misc_feature (399)..(399): n is a, c, g, or t
ccnaaanccaaaattttnttttngagaaaaaccttnaaaagttttttttcnaattnccccaaaggnttnccctttgnnnggggtaannccnaaagcccccctgtgatgggntncccccattnttccaccatcccttntgaacaatgtggaaggccnnngctttncccnttaagcnactgaaaggctngcccattaacctgnccntccacctgaatggctggtggcctggngctaataaancnnccaatgntactttttagaggctttggggagcattcancccttcnccttcggatctngncangctcaccaacctttcgagccatgggntcacaccagccgccacaccctttggtgccaaaatcagatccatcaccagtgganctgacagcagccttnttgttagctggtgctggggttctgggttcatcctgaagggactccttctgtttactagcgtgagacttaggacctttcgtctcacaatgcttgtgagatgcgggcactatagcaggttcaggtttgaccttctttttcgtcgaggttttgttccgaaacattggcctcaccagccgcgagccgccgaccggaacagcccgggggctagacgttttcacagatttccccttcctttgccttggcagtgttgctcctacagaaacatcttcaactgcctctgatgacttgttactgatcacatcttggattctggttttgcgaaccttgactgcggtaggagatgctgatctcaaattcttcttggctgagctcttgctctgccccttgctgatttcacttgcctcacccaccgaacttcctgccagtttgtcaggcagcatgtaaactttgcccaccttactcttgtcaccttgctcctcgttggcttgaactgcaacagagccatatagcttcttgatcgccccagaatcagaaggggtggacgcccctgtcggttttgacagcctcttcatggctgccatttccgacgcctgggagatgcacatcttcctaagggcctgcttcaggctcacggactccacaatctctgagcccgacaccggcgacttcccgagcccaataagccacctatcggtgcttctctgtccagaagccctcgccgacgtgcgcacgttgaccgaccttatgagctggtcaaggtcatcctccagcgagcacgaccgcgccccatcctcgtgccccacgggcttgaccctcactctcagatgcggagcaggacgagcacctttcgggtcgtccgccagctcgactatctccgagcacccggaagaacccatccccttggagccttcctgttccaccagctgcaccttcatctggacgggaggccggccgtagaacggctgccgcatttcaaggcaccaggaccggcagtcagtcgcgtgcacttgggcggacagagaagccgctttcctgggtcgagagccgccggcatcacggagcccggacggcggcggcagcgaggagacggtacggcccgcgttcgggcggcggcgcgcgctgctcccacctggagaatctgggtgcggcgggcgaggatttgcgggagttttaggccgaaacggcggcgggactggggaagtggagttgaagcttcaagtggggcgaaagcggcagcgctctgcagcaatgagcggcgcgcatcacgaggagcagatgatggctgcctctccttgggccccttcgcacctgcctcgtgccgaatt

SEQ ID NO: 21454 - DNA, 6465 bp, Zea mays
  misc_feature (499)..(499): n is a, c, g, or t
ttagatatagttttcagaagtcttaattcaccccctcttaggcgtcatcgtttccttcaatctctcaattagcagatgggagttagtcgttatactaacactattgtagtccaacactattgtagtgagggtttgacgcctactgtttgtctcttttcttataacctctttatctgtgctaactctaacatgttccaactaggggttgagttagcctaaattagtgtataaggtggattttcacgacttcattaggttctaatgcaaatgcattagttcatctcacctaatgatacataagcaatcgtcttgaacgttgagttcccctcttcatagtatgctactttatcctaaatctgatcataaactctattgctccttgattggtgaaacaaaaatacaagcttatatctttgtctttcatcttgcttttatgtcttcttgcatgtctccatttttgcaccatcaatgacctatgaagatcaaaatgtttaggcancatgttcgccttacttttgtcaatcattttctttgttgagcacttgttcacctttgtggacttgaacctgtctcattcgcaacaattagaatatatgttattcaacaagttgtaccaatcacaaaactatacatgaagctttcactcttcatagtaagcatgtcttcctagacacatgataataagcttctctattatccacttttcagaattcatgttataatttataataaaagtatcaaattctttaggtagtgatactaatattaggtgaataacacatttattattcaactctatattgaaggacttgagcttatttgtaaagttggtaatcttgagtttgtgctcccttatgccagagccatcataattcttagtaagaaatctcttaataatggttccaatatgaactagtgaactattgatgacccttgtcaatgtactatgtggcattgtgatattctaggattggttcacttattgaccataatataggcccttatgatgatcatagatttttttcatttctcctacttaacacgttcgagatcatatgctataattaaggctgcattattagttgtctcaaatgcttcttctaatgctaatattagaccaacaagcttcacattatcattggtataacctatttcagctaatgttaattccatatcaatcttgtgccttcaagatagataattaaagtaattcaatggctcaagactagataatacacttagagcatttgaaatattggatgatgatgctttagaaagaaagaaaattaaatcagtataaatcaataattcaacattgatttaaactaaacatacatagtgattgattaaagaaagttattttaattctaaattgtttggacaggattagaatagaataaaaacttttaaactaatcttagcatcaacattctataatattctaaaaaatatcgatgttggtttcaattttaattgagaataaaacaaattcttgcatggaaaacatatctaaaacttaaatttaagcttaaaacttaattaaagaactaacttaatgttctttcagcaagtatgaacttaaacgatgctagagattaatgtaaacctgtttatataattataacacttaaagaaatatagaaaaatagagagcattgtgcttggccaaaatggcccacatagtcaagccaaaatagtcggttgaccttcgccttgtgcgctcccacgtcccatgtcgcaacctgggtctaggtcgagaaagcttacgtccacttgggctgaatctggcccactccccttttgtcagatctgcgtcattcacccaagtttgataaccagcagtccagcactcctcacatctaggtataaaaggatgagaatttcgccaacaaagcttactctccgaggaagtcactatggagtaccagcgccgctcaggcggtccctctctgatgtgtgcacacacccaattgtgaacatgctgccgtcaagtgatctcgcgcagtgtcctatgatccttgcatgaatcctttgcacgcatggtgtgtcgaccgctccacctcctttcctcactcgttgtttctggacggtaaggtattagagtgaggtaacactagtattcattcatatctatcttatggctcatgtggggagaaaactagggttaggggttctagattaggaatttcgatttagggttggagattgggtcatatgagtggtcccttcctcgcctccccgttgtagatcaaaaggactcggtctgatcctaaaatctgaaaggtttgagttctaaggtgagggtgagggaccaaatctgggctccaatgccactattagcaaactaggatctcacccatcactttagacactagaacaaattaactaccttcgaaatttgggaaggtcaccataagaaaacaatgtccgatgatcggtgccagtgttgacaagagtgacgaggggtagtctttccctcccttttgtgtagagatggatttggtgtcaataggtctgtatggctcaggaagtacgatgaacattggttcatgtgccaggctttatttatatttattttatgtggtgtgaagaagaccgtaattaagagctattgcatctaaattagggtttgagaggtcggactcaatgtctgtttggttctcggctgcaccaaaacttatgtaaggttagtcacccaaattaaacaaccttagatagacagaaaaaactagacactgtagcaatttagtcaacgaaataaacatgccctcgatctctcaccgagtctgaatgagatgaacctaaccgtacacacttgttcatcagtaaagaacgatcgtaattgtattggtggtagcaggaaatgcacttaactgccgaatccgtgctcctaagtcctaactttgtacagtagtacagtagtaaacctactacgttattaacatggaataaagttacaggccgactcccagctgtatcatcaagtaagcgaggcacaaattgttccatccagcaacacaatgtacactttctgccagctgcatctcagcatctcgcacatgcccaggaatttcccaaccgtgtcttctaatatttgatggtattaacaaggcataaagttacaggcttaacagccaatcttaccttacttcccaacgatgactaactttcaacagaaaactgcagggaagagggactaagactactcttgctagcttatcatgatatttgatatatccttgacactacaacagcgatgccactacagctacaactaaaagagctcgaactcgatgtcgtcaccattcagccggaattccagacatttgccttcctttttcttgcgtgtcgttacaggtgttggtgcagtgtcaatgttcttcagggtctctggtggtgcggtccaccggatcaaggcccagttcaggccttcaaagaagggatgccgcttaatctcagtggctcctctcgacgagccaagccggtactctggctctttcacaagcagccctctgatcagatctcgagcgtggaagcttacagctggattatcagggaacttcaagccctgtgagatcacatttgagagtgtttcctcattgccaggtcccttgaatggtgtcttgccatagagtaattcgtaaaggaagattccaagagtccaccaatcaactgaactaccatggccatctcctcgaataatctctggggcaagatattcatgggtcccaacaaacgaatttgatcttgcttccgtaggttcaacaacgagctgtggaagtgatggtttcttcagaagctcggctctaggccttcgtgacgaaaccagacgaggcgtgaagcaagaggaattgctccaggatggctggatacacagcggatcaatgcagctttgtgcacaaggaccagaaggcctgctgggctcatctctgcctacggatgatgttctcacaagcattgggctcactgagcacctcagagacagatcaaagtctgagagcatgatgtgcccatcttctcgaacaagtatgttctctggcttcagatcacggtaaatgacccccaacatatggagatactccaaggctaagaggacttcagcgacataaaacctacaaaatgtagatctcttgaattacaatagctcagtactaaaatgaaacatataaataaaatgttaattctcttaagttacaataactcattagtaatatgcaacctaaataaaaaaaatgcaaaatattggattacaatagcatggttcactatcactggacaaaaaaacatctatctggtagcaaatgcagtgagattatataatcaccatttttagttcttggtaaagtagctaatagtgcataaagatagcacattgatgacacgactaaaggtccataccttgcagctgcttccgaaaaggttttggtaggttgtttctgcctaagaacatgcaggtcaccaccagggcaaaactccattaccagacaagaaaggttgtccgtcgtgaaatgagaatacagagttggaaggaacgggtggtcgagcatttgcagtatctccctctcagtttgtgctctgagcattttctttctgcttatgaggtactcaatgtccataaccttcaaagcgaacatgcagtctgatcccactaactcagccaaataaacagtgccaatatccccacaaccaagttgtttgagaagcttgaagttcttcaatcccaagctcccttgttgggtagccaagcacctgatggctccccatctcacatcctttgacatgtgaggcctgcttccgttagcactgaagctgccataactgtcctcactgatgctggtgctggtgctataatcaccaatgctactcttagagctttgggagcattcacccttctcctttgatcttgacagctcaccaaccttcgagccatgggtcacaccagcgccacaccctttggtgccaaaatcagatccatcaacagtggagctgacagcagccttcttgttagctggtgctggggttctgggttcatcctgaagggactccttctgtttactagcgtgagacttaggacctttcgtctcacaatgcttgtgagatgcgggcactatagcaggttcaggtttgaccttctttttcgtcgaggttttgttccgaaacattggcctcaccagccgcgagccaccgaccggaacagcccgggggctagacgttttcacagatttccccttcctttgccttggcagtgttgctcctacagaaacatcttcaaccgcctctgatgacttgttactgatcacatcttggattctggttttgcgaaccttgactgcggtaggagatgctgatctcaaattcttcttggctgagctcttactctgccccttgctgatttcatttgccttaccaatcgaacttcctgccagtttctcaggcagcatataaacgttgcccaccttactcttgtcatcttgctccccgttggcttgaactgcaacagagccatatagcttcttggtcgccccagaatcagaaggggtggacgcccctgtcggttttgacagcctcttcatggctgccatttccgacgcctgggagatgcacatcttcctaagggcctgcttcaggctcacggactccacaatctctgagcccgacaccggcgacttcccgagcccaataagccatctatcggtgctcctctgcccagaagccctcgccgacgtgcgcacgttgaccgacctgatgagctggtcaagggtcatcctccagcgagcacgaccgcgccccatcctcctgccccacgggcttgacccctcactctcagatgcgcagcaggacgagcagctttcgggtcgtccgccagctcgactatctccgcgcacccggaagaacccatccccttggagccttcctgttccaccagctgcaccttcatctggacgggaggccggccgtagaacggctgccgcatttcaaggcaccagcaccggcagtcagtcgcgtgcacttgggccaacagagaagccgctgtcctgggtcgagagccgccggcatcacggagccctgcgcaagatcgaaacatgaaatgtgaatcaggtaacgatggagagagagagagagacaaaacagacggaactagcacaaatggtaggaaaaagccgtttaaaaactctctaggcccgtagatcttggtggtgcccaacgtccggccgtttctctcttattaccttacccgctcgaaagctaagatttttttgcattttttgtttgtaataaaataaaatgggaaatgaagggagatagcaaatggagcaacagagatgcggtaggtaggtgaggcagggcggcggttccgcttcttttcctagcaaagacgatgcaagatccgttaaccccctcctgggcgttgagggagaagacgacgcaagcagccggggtaaacgcccccccccccccccccaa

SEQ ID NO: 21455 - DNA, 1727 bp, Zea mays
cgaggaaaaaaatacatggggcccccttcgtttttttttttttgaagtcaataataatgatcattcatggatcatcacatcatactattgggacacttcaacagataatagcacataaaggtcacattgtttatgcagtcaaaatgagaagaaagcatctgcataagcattgtttgcactttttggctacatagttcttataacgcttagataataccagctaacctggcatctcattttgcatcccaatccttcagcttcttacttccctttggtttagcaataggtgcattcatgcctgccatttttgcattatactttgctcgcagaggcccatttgttgaccatggtgcattccaatctgtagtgtcttcattaacaagatgcgtccatttcgtcctgccgctgcgcccgaaatgtttaacttgcatgaccttgggcaggatgctcttatccatcttatcttctccagtgggctcagagaaatcacgggtgtagatatcctctttacccgctgactggataacatcatcagcaccttcctggaagaaggcgcctttgtggtaatacttctgcataaacttccacttctgtttcgtctgacgaagcggcttcggattcttccgctcccattcgcgacgctcctcctcggtcatattcctgactttctcgatctcctccttctccttcaacctcgcatctctttcctccctgtccctcttaatccttgctatttctctgtttttccacgactcgtactcctctgcttcgttcaactcgtcgtctgtatcgacatcctcgatgttggcctcttcgttcagtgccttctcgatgtgctcctcctttctaatctcttcgaccacaatctgtctagtctcgatcttcctagcctccagcctcttcttgaccagctcctcaagctgccgttcctcctcctccagccgttcgcgctccgcgatggtgtctctctgtgactttggtatgaaaacgggcttcaccatggccattcccatctgctcatcctcagagtctgtctcgtactcagattcctcctcagactcctcggcctccaccggttcctcctcttcctgaggaagcagctcttcctgctccctcagcagctgccttgcccttattctcctcctcctctcctcttgggcctcctcatcctcctcgtcggcgtcagcctcctgcctctcgttctcctcctccgcggttgacacgatctccgcctgccgtatgcggcggtgatccgccctcagctcctccttattctccgcgcgggtctccgcgagccggcggagccggcggtcatccttggcgggaacatcgccgtcctcgtccctggggaacgccttgtcgagggagacccgtgccgtcctgaggtcgacgtcctcatcgacgtcatcggcccactcaggcgccttccccggccagtaccgtttgaccttggtctgaccaatctttccacggagcttgtcgcgcaccgcgatggccgcgtcgctcacgccggccgccacggacatggctgcagctgctcaccggttctccacccactgcgttccggtcagcctggtggaaactcgtcgccgccgaagacctgggaagtgataacgggccgcgccgctcgcccagccgtcgccgccaggagagaagggcacgagcgagaaccggagaagaaggaggccacgggagattttattattattattattattaaaaatgtt

SEQ ID NO: 21456 - DNA, 1103 bp, Zea mays
gcacgacggtaagttttaatccaaacattgatgcacggctaaatgatctgaagctcaccttgggaccagaattgaggattgtttatcctttaattctgaattttgctgtcagtggtgacctagagcttaatgggatggttcatccaaagtatctaagacctaagggcatcttaacatttgaaaatggtgaggtcaacctggtagctacgcaggttagacttaaaaatgatcatttaaatgcagcaaaatttgaacctgatcttggtttggatcctgttcttgatctcgttcttgttggatctgaatggcaattcaaaatccaaagtcgagcaagcatgtggcaagacaatctggtggtaacctcaacacgctctgtggaccaggatgttctgtcacctagtgaggctgcaaaggtttttgaatcgcagcttgcggaatcattattagaaggtgacggacagcttgcgttcaagaagcttgcaactgcaacgctggaaactttgatgccaaggatagaaggcaagggtgagtttggacaggcacggtggcgactggtttatgctccgcagatcccaagtttactctctgtggatccaacagttgatccgctaaaatctctggcaaacaatatctcttttgccacggaggtcgaagtgcagctcggaaaacgccttcaggcctctgtcgtcaggcaaatgaaagattcagaaatggcgatgcagtggacgctgatatatcagctaaccagtaggctccgtgttctcttccagtctactccatccaataggcttctcttcgagtattcagcaacatcacaggaatgattcattttttgttattgcgcacagcaagaattggttgtagcagctgcgtcgtacaaagattaggtggcctgataatcgttttttttgtagataagcaagctttgataagttgtacgtgtacaatcgctcagttgtattgtatttacattctttctcggaaacaaagtttctgagcctgtaaataataggtagcgatcttagcgtcgggtgtagagagaagtataaatgaatgaacgtttcctgtctcttgcgttgctgtccatacgtgaaattggcttt

SEQ ID NO: 21457 - DNA, 1518 bp, Zea mays
tgcgagtagttatacacacatgcacatacatgtcatcacatatatcgcactatttttctggattaaattaaaactaaaaatgcctaactttctaacacattctgtgtcggtgtgactgaagaactcaccgctaggaatcgggtctgccgctcgacgtcatggcggcgtcatcctgggaccggcctgctgcctggtgggatgattggagcttggattatcatgcatgtaccgcgcctgccacccgatccgtcgcggtgcggcgacaaccatgagaggtcaagaccgccgcgtgctcatgtgaaccaaagctcgcgccgtgggcaaccacatacagtaacgccgcagtgagtgagctctgcctctcactcactcatgacttgcttgggctttataggccactactgtactcgagaaaggagatcacggccggcgccgtattgagtcagtatattcagtaattcagactctcagacagaaaaaaaagacgtatcccaaagctgagactcgatacgtgaaacactgatggttcatactgctaacggagcactgttggcagggcagcatatacacatgggaccccaactagatctgacactcttgcacacatggatgcgtttaccaaacccacatgaggacatgtccgtgggtgatgggcgaggcagcataatgcagcacgcacgcaggctgcacctcatcctctggcaccatgtgcagcggggcaatacatgacacagaagaagaataaacggtatctgtgtatagggagggatcaaacagagtttttttttaaagcaacttactcctccagattcccatctcttccaagtgaggcaaaaaaaaaacgatctagacctacaatgggaacacaagagtcgagggtgaactgtagtgatcatctgcgatgcagattgcagacgagttcgacatagtcacagactctaccaaagagaacagaaaggggttcctcggatatgcacgcaagcttgctagagcaaagagtaaccaagaagaacaacgtgtaaacgcgcaagcaaagacttacaaaaggagaacgatgtgtaaaaaagcgcacacacacacacacacactctgagaatgccaatttcgcatgtattcagactaccgtttagctatttattcagactaaacgaccatttaaacgtactaaacagtaattaaatgagacaaaacgactggttaaacatgtattgtaagctactacgtagtgtttacatggcgtgcacatggacaatgaccatagaaataactgctgaaatgagatcagtaagacaaaaggatgacacttcttcgcgaagaaaactcaacacttaacatacacatgcattgcaaaatcgctgtccggagggcaattacaagaggatatcaggatatgcacaggcctactttacaagctagctatgactcattttacaacaaacagcagctacaagatccgcgtatgtacagctgcaggttttcctacactgctcgccaggtatttaaactctaaagggtcca

SEQ ID NO: 21458 - DNA, 4680 bp, Zea mays
  misc_feature (3677)..(3677): n is a, c, g, or t
gccccgccccgtccgcggcgcgatcactcgtcgaggcgacccggtctcggtgcttgagaaggagacggccatgcgtgactcgctagctggtggctgctagtgcgccggagctcatgtgggggcaagcgggcaagcaattatggaggtccagattgttcgcgccctcgatcggggcgggcacgtttgtccgagcgagtcgtcgtcggaggaggagaaggaggaggagctgggtttgttcagatttccagcctcctagtacattcctttggtcgatcgtcacatgatagtagagccgctcgctattcatagatctcgacgcttcctttcatcgccagtcgcctcgccctcgcctcattactcctgccagctcccttctccttctcaagcatgtggaccgtggcaatggcggcttggcaagcaccgtcggctcgcacgttacccagtgttccggagtccggacgtacgtggcggtggcacgggggattctggttacagctcccgcttcatcagctgtcagcgtgtctcccatgtgaatcttggacattccctggacgcggaggcattctgtgtcggtgtgactgaagaactcgccgcctagcgcagcgcagctgcgccaggaatcgggtccgccgctcgacgtcacggcggcgtcatcctgggaccggcctgctgcctggtgggatgattggagcttggattatcatgcatgtaccgcgcctgccacccgatccgtcgcggtgcggcgacacccatgagaggtcaagactgcagtgcgctcatgtgaaccaaagctcgcgccgtgggcaaccacatacagtaacgccgcagtgagtgagctctgcctctcactcactcatgacttgattgggctttgtagaccactactgtactcgagaaagtaacgccgtattgagtcagtatattcagactctcagacagaaaaaaagagacgtatcccaaagctgagactcgatacgtgaaacactgatggttcatactgctaatggagcactgttggcagggcagcatatacacatgggaccccaactagatctgacactcttgcacacatggatgcgtttaccaaacccacatgagggcatgtccgtgggtgatgggcgaggcagcataatgcagcacgcacgcaggctgcacctcatcctctggcaccatgtgcagcggggcaatacatgacacagaagaagaataaacggtatctgtgtatagggagggatcaaacagagttttttttttaaagcaacttactcctccagattcccatctcttccaagtgaggcaaaaaaaaaaaaacgatctagacctacaatgggaacacaagagtcgagggtgaactgtagtgatcatctgcgatgcagattgcagacgagttcgacatagtgacagactctaccaaagagatcagaaaggggttcctcggacatgcacgcaagcttgctagagcaaagagtaaccaagaagaacaacgtgtagacgcgcaagcaaagacttacaaaaggagaacgatgtgtaaaaaagcacacacacacacacacactctgagaatgccaatttcgcatgtattcagactaccgtttttagctatttattcagactaaacgaccatttaaacgtacttaacagttatttgatgagacaaaacgactgattaaacatgtattgtaagctactacgtagtgtttacatggcgtgcacatgaacaatgaccatacaaataactgctgaaatgagatcagtaagacaaaaggatgacactccttcgcgaagaaaactgaacacttgacatacacatgcattgcaaaatcgctgtccggagggcaactacaagaggatatcaggatatgcacaggcctactatacaaagctagctattactcattttacaacaaacagcagctacaagatccgcgtatgtacagctgcaggttttcctccactgctcgccaggtatttggtacacaagggaactgctggtcactggttagagctaatgtaacggaactttcagcgtcaatgtacaactcatgtactggacacttccttggtttttatgttctccgaaggctccaatcaaactcttgttatcgattgttcgctctccatattttgttcggcttacattgttttgtttctttgctttttttgagctcggatttgcgccgagttagcttgttaattgctcagtgacctgccaactccactgttatctcgtcttggctttccttctcttctgcacaaaaacgtaccagtagacacattcagagaagtgaattaaggaaaaaggaaaggcaacaaagaaaaaaaaaatgaacagcaaccccgtgtctaaaattaatgtagaatttagatgttaggataagtaacattccaagttacttcatagtagggaactgacttgtcacttcctaatataagacacattgtgattcgggagcaattcaaattaacttgatcccaggaaaacataaagtacgttataacattctttcaacatttgattcttggaaacggaagtataggtttggttagcaagaatctgaggctaacataacaaatatgaacacaagagagaacttattcttctataatttcaaaagaattcttgggttaacacaagagcaacagagtctgctgaagtattgaatgcacaagtacttacatgatgattctggctgctatacttcctagtcccatcaaggtaggcggtaaatcgtgcaccagctgggacatgagatacgcgccggaggaacacttgaatgtgattgtaaatgctgcaggaaggagtagcagttatcacctagcacactcgaagttataatgcaatctaactttggagaagagggcaaaattcgttttgggccacttaaggccttgtttggtttgatggagatcggaaggggattttgacctctagaggataaaaccccctcaatccctttcaatccccatcaaccccctagattggggattaactgccctaactgtgtaagagaggaggaaaaggttacttaaacagccaggggacataaaagttattttgaactccgcagtaaaccaaggtgtcattgtgattttcatttaatgttcctcggatcttactgaactgtatcgttgcacaggtgttggaataaaaaaaatacttgagtcggtgcctattacatgttgaaaagaaggcaacaaaaccatacaaaatgctccgtagtgcacggaaaatctgaaagaaagaaaaggtcaaagtaagtgtcatagatagttttacatatgctttacctgtgccaacgaacttctgatacctgatacaaaagatctttccacagtgaggcccagatgttattatcagatgtaagcacaggtgatctgggaacagatccaacttgatataaggcacttagtgttgaccagctcccccttagaaaattgataatatcaacaaaaaggtccactacaaaacttgatagcccaatgactagtcggaaaggtgcagctagtatctctccgaggagccaaattatagggtacagaattgaattcactggtgacaaacaaaaatagcatgacataagaataaaaaaatatggaagaaaactaaaatagatgatgcaagaagttacagcaaccttaccaatgctaaccatagtactgaagacaaaccaaaatgnccagacaatcatctccactgtatcaataactacactccaagacgcttctacagataacatgacaactgaactcagatatcctactgtctcagcacaaaggttccaaattggcatcgtaagttcaaaaacctccagaattggtcccgcaattggctttgtcaaaacactaagagcagacttagcagcacccacaatcttaagggaccatgtaaaagcctgctgaaaattatgcaggaaaagcatagttccaagatacttaagtcttgatatcatttcccatgtttctatccaatcaaataaagggccaaacaatcttgaggcagttgccttcagcatgggcacgttcttgtagaggtcataaaatcctataagaacagtgattaatgacatcaagacatacaatgctctggcaagagggcacatccatggccgatatatcttgcaaaacaccggatatgactgaagaaatataacccacgatggaaggccatactcaagtagcgtcaacagtctgacgtcagatagtatgacttctttcagtccgaatggaaggtcatgatcatcaaagcggaagcagatcagtacatccttatacgtgctaggctccaatagcggcttagcattctcattatcactgtcacatgatgaacacgaagatgacgaatgttttggcgaggccacaatttctgtgtatgattcttcagtcgaactacttccatcatctgattttgttatttttcttctcttgtaaggtccagagcaaggaggtgtagtgtaagatgagtctgtgaaacctgatgactctctgatgatttgaacatggctagaatcatcactatcacttggtaaattctcactatcccattcaggtgttaagaaatcattttgagcatcatataatatatctccgttagaagagatgttggtcaaataatccttttgaatgtcagctcctacccccgtcccgtccgtggtcgacccggattccgacgtactgcaagtt

SEQ ID NO: 21459 - DNA, 1242 bp, Zea mays
  misc_feature (1215)..(1215): n is a, c, g, or t
  misc_feature (1229)..(1229): n is a, c, g, or t
agcggggtggcgcgccgccgcgaagaaaactcaacacttgacatacacatgcattgcaaaatcgctgtccggagggcaactacaagaggatatcaggatatgcacaggcctactatacaaagctagctattactcattttacaacaaacagcagctacaagatccgcgtatgtacagctgcaggttttcctccactgctcgccaggtatttggtacacaagggaactgctggtcactggttagagctaatgtaacggaactttcagcgtcaatgtacaactcctgtactggactcttccttggtttttatgttctccgaaggctccaatcaaactcttgttatcgattgttcgctctccatatttcgttcggcttacattgttttgtttctttgctttttttgagctcggatttgcgccgagttagcttgttaattgctcagtgacctgccaactgcactgttatctcgtcttggctttccttctcttatgatgattctggctgctatacttcctagtcccatcaaggtaggcggtaaatcgtgcaccagctgggacatgagatatgcgccggaggaacacttgaatgtgattgtaaatgctgagtcggtgcctattacatgttgaaaagacggacccggccgcctccagcgccccccgtagtgcacggaaaatctgatccaaaagatctttgccacagtgaggcgccagatgttattatcagatgtaagcacaggtgatctgggagcagatccaacttgatataaggcacttagtgttggccagctcccccttagaaaattgataatatcaccaaaaaggtccactacagaccttgatagcccaatggctagtcggaaaggtgcagctagtatctctccgaggagccaaattatagggtacagaattgaattcccaatgctaaccatagtactgaagacaaaccaaaatggccagacaatcatctccactgtatcaataactccactccaagacccttctaccgcgtgccggacctctgcccgcggatatcctactgtctcagcacaaaggttccaaattggcatcgtaagttcaaaaacctccagaattggtcccgcaattggctttgtcaaaacactaagagcagacttagcagcacccacaatcttaagggaccatgtaaaagcctgctgaaaattatgcaggaaaagcatagttccaagatacttaagtnttgatatcatttcnccccacgcggccg

SEQ ID NO: 21460 - DNA, 1278 bp, Zea mays
  misc_feature (28)..(28): n is a, c, g, or t
accataaaaactaataataattaagttncaagatgctggacttccaaagtaggcccccgttcttttctttttatgagaacagcaaattcaatagagtataagcaagtactagtaggctcaactatccaaatcaagacggtgacatcttcaacaacaaaacaagcaattcaacctctcctggttctatgctgcgctaagcactcctaatgctaaactcatcattctccgagaaacctccacatttattttttatatcttttgccccccaagatatttataccacatctttgactttgccatgatgaaaattcgacgaatttgggtggaataacaggtaccagacagcaagcaacaacaatacagcatcgcggtgaatagtgacacggaaatgaaagctcgcaactcattggcagccactcattcttgcccagtcaacaaactgcatccctccgtacacgttattggcaaacctcacaccaacggtgaatgccaaagaagcagccgggacacgcttcccaacaggtgaagcctcaaccaggcgctctaatccattaataatctggtaccgtgtgttggaagaaacagcaaggaatgcaccccacaaagcagaagtcttgagaagaggtggaacaggtacatcatcatctgacttcttaacactccgtttggctgtcattatcaaattagcaatcccttgtcccacaagaccacaaaaagaatccaaccagaaccataccattattcccttgaaaaagtatgttcctatccgttgctgcacagaaaatttgtatcctggcctttcagcttcaaaaacgctgcttgggagggcatcataagcatgcctaacgcgcccaaggaagaccttctcccggccggcctcgaggcagatctgctaccaaatcgagcatatggcgctaacatgccgactaaagctacattaacaactactcctaccaacatatctgcagcatacaactcaaattctgaccaaaactcctcccctctcttctgaacctcagcaaatgtcgcacaacatgtatcgatgactatctcagtgccaattttgaagaggaatgcaggatcaaccagcatcctattccggagaagcgagcaggacctaattgcaggccccaagggccaagccgacgcctgcatgtccagatatctcagcagccagccagtttctgaatcccaacgctcttggccgcctcaaccatgtccgtgggcaaactggaccacagaattggtggggatgggtgggattcggctcccggccgg

SEQ ID NO: 21461 - DNA, 1558 bp, Zea mays
cacggacgacatcttcatcaacaaagcaggcagctcaacctctcctgggtccatcctgccctatgcactcctaatgctaaactcatccatcctccgagaaacttccacatttattttttatatcttttgccccccaagatatttataccacatctttgactttgccatgatgaaaattcgacgaatttgggtgggataacaggtagcagacagcaagcaacaacaatacagcatcacggtgaatagtgactgcaataaaaagcatctgcattattggcataatgttatctatccattggctacatcaagagaagagaactgcatttattgtgggggggagaggggggcatgtatagaagaaggaagacctcaccacggaaatgaaagctcgcaactcattggcagccactcattcttgcccagtcaacaaactgcatccctccgtacacgttattggcaaacctcacaccaacggtgaatgccaaagaagcagccgggacacgcttcgcaacaggtgaagcctcaaccaggcgctctaatccattaataatctggtaccgtgtgttggaagaaacagcaaggaatgcaccccacaaagcagaagtcttgagaagaggtggaacaggtacatcatcctctgacttcttaacactccgtttggctgtcattatcaaattagcaatcccttgtcccacaagaccacaaaagaatccaacagaaccatacaatattcccttgaaaaagtatgttcctatccgttgctgcacagaaaatttgtatcctggcctttcagcttcaaaaacgctgcttgggagggcatcataagcatgcctaacgcgcccaaggagaccttctgatgcagatctgctaccaaatcgagcatatggcgctaacatgccgactaaagctacattaacaactactcctaccaacatatctgcagcatacaactcaaattctgaccaaaactcctcccctctcttctgaacctcagcaaatgtcgcacaacatgtatcgatgactatctcagtgccaattttgaagaggaatgcaggatcaaccagcatcctattccggagaagcgagcaggacctaattgcaggccccaagggccaagccgacgcctgcatgtccagatatctcagcagcagcagtttctgaatcccaacgctcttggccgcctcaaccatgtccgtgggcaaactgggcagactaacccctctcttctccgcctcctggaccacctggtcgaagctgagtatgggtccgaactcatcctcctcctcgtcaccgtcacccccgccgccgctaccgccgccattctcgccgtccccaccgccgccgccggcgggagggagcttgccatttccaccatcatcgacatcaagcttctccgggagcacaacaggttgaacaaccgcggccacctgctcagtagcgccacaggggcgggggtatggagggcgcggcggaccacagaattggtggggatgggtgggattcggctgggaaatagcggaggagggcgaggggtttggtctttcgtgggggactgggg

SEQ ID NO: 21462 - DNA, 1057 bp, Zea mays
  misc_feature (1047)..(1047): n is a, c, g, or t
accaaatcgagcatatggtgctaacatgccgactaaagctacattaacaactactcctcccaacatatctgcagcatacaactcaaattctgaccaaaactcctcccctctcttcctgaacctcagcaaatgtcgcacaacatgtatcgatgactatctcagtgccaattttgaagaggaatgcaggatcaaccagcatcctattccggagaagcgagcaggacctaattgcaggccccaagggccaagccgacgcctgcatgtccagatatctcagcagcagcagtttctgaatcccaacgctcttggccgcctcaaccatgtccgtgggcaaactgggcagactaacccctctcttctccgcctcctggaccacctggtcgaagctgagtatgggtccgaactcatcctcctcctcgtcaccgtcacccccgccgccgctaccgccgccattctcgccgtccccaccgccgccgccggcgggagggagcttgccatttccaccatcatcgacatcaagcttctccgggagcacaacaggttgaacaaccgcggccacctcctcagtagcgtcccccgcttcggggacgacgacgtccgggccggaggtggcggcgccatccgcgctcgcccgcggcggtggcgggaggtcagcgcggattcccctggcggtgctccacctccaggcggtcggacggaagcaggtgccccgccgcccgagcagggccgcgccggggcggcatttggcgccgccgacgccggtgcgaccgtggaggcgcgcgctcgcgcaggagaacgccatgctcatgctcgatcggagaaaagtggtcggattgggacggctaaacgattttgccgcggcgagagagatgagtgcgccacaggggcgggggtatggagggcgcggcggaccacagaattggtcgggatgggtgggattcggctgggaaatagcggaggagggcgaggggtttggtctttcgtgggggactggggattggtggggtggcggcgcggcgggaagaagaagcgtgcggggctgccggntcccaacggt

SEQ ID NO: 21463 - DNA, 1202 bp, Zea mays
  misc_feature (1179)..(1179): n is a, c, g, or t
  misc_feature (1190)..(1190): n is a, c, g, or t
ttcatacaaaatttgatgtatatgttttatatgtgtctaggttcatctatttaaatctatttaaatatagacataacaatcagaagctaaaacggttactattttggaacggagagtacacgattgtaatttggcagcaaggacataagaacctagcagccctctcttggaagtaacagttgcagtttattggaattcaatgaacaaatagtactgtaatatacatcggtattatgtcaacaagtacatgcccaaaggaaccaaggttcggtttacaagggcattctagcaacagctaagtgccagaagggaccagtattcagtgaccttatcatcgagagtacaacaaatcggaggcaacatgcctcacaccaagtactgtacaaggggctcgctggcaaaaattatgtgccagcaagatccagatcatctaatgttaagtatcaagaatacagccagccgaggagacatgcctcagatctataattgaattactgccaacaaatccaaaaccgaaggttccatcctcatatagccaaatccttccctccacgctcctcccatcatccaagggagttgagagatgagtatcaaccacatcataactggaattgatgcgtaatatccttgagacaaccctgttctcagcgcctgcatgattggaagtaacaccttggatatgatcgcggctggcataattaaccagctcttgctcagagaatggtggttcaagaaatgtagtatctgttgtccaaaaaacaggagagtagccagagttttggctctgtgtatccctaaatcgtcgacaagttactccaccaatgtcatcataggtgacaaggtaaaattccaaagtcctatcctcgcatataccctgtttgggaacatggaaattaatccattgtgcttggcaaaaggtcaactaataataaatcattctgccaagtacatagtagtcctccaattcaaaattggtaacgtcattctgttgtgtgcatgcctagtgatcaacaacatgaaaacaatttttcaaagaaacagataaatgaatattaaaaattaaatggtcattcatcattgatgagataaaaacaaaaatttataacatttcgatgaaaatgaattttcttgtgggctcccgcacctagaaaaccacaattgctgcttggtccacgaatntaacctgtatncccacgcggccg

SEQ ID NO: 21464 - DNA, 2392 bp, Zea mays
  misc_feature (30)..(33): n is a, c, g, or t
  misc_feature (35)..(35): n is a, c, g, or t
  misc_feature (38)..(51): n is a, c, g, or t
gtacccgggccccccctcgagttttttttnnnntntcnnnnnnnnnnnnnncgtgtagaacactatacgtggtgagttggtacctattacagatttatagggaaaaagaaactaaaacaactaatatgccacacatgacacacaggtgttcgtgcgaaaacacagatcaatgctataaaatggaactgctctacgataaaagttcagacagcttgccatctacgaattgtacagttcttgacaaagttcttctatccaggaatacagggcatgagctaccaatcaaggaaaacacaaatagctctagaactgctaattttatagtcatcaaccaattctgtacaagagtgcggctacatatttatcaatttcgttcaatgacatacatatgttctcacgtggtcattgggcataattgccactcggattcacataaccactaggattccttctatcggacacctcctggggtcttctcaattgtatccattgaaggtccaacacctccactagttctgtcacttgccttcatccgcaggttgcagcctatctgaggatacttcaaaatggtccagtcaaaactggtatcctccatgggagtatccatttcgcactaatttttgtcatatttctgcttcttgatcctgctttcagcccctgccttggtaggctgcccctaaagaagtacataaaggtgccaccaattaccaccatataccggagttcctgcctgctcctccttgggcgggaaggggtcaagaataggtatctaattcattccctggtccatgctgggtctgttgccagcagtggagaggccaagtagcaaagaatcaatggcaccgggatcttcaaggtaaccagttaaccaccatcctcaaaggtcacccgaacccctgatggtgcaggatcatagagaggatggagcagtccacttcacagcgagatgcagtgcctccgcctcacagcccacagcgatgcacagcagcaccacctccgcagatgcgacgggataaaccaaggcaagccttcctccgcagatgcggagaggctgcttcgaacccgtgacatggtgacttagtcagacagctatcaccactgcaccaggcctgcccttcagactcaaagtactaaataccagttttgatagcaagggccttgcaatatgggtagatagaatgactcatttttcttctgtacagctgtacccagtacacggtatagttgaatatctggataaacaccaacagataacatgatcgatatgagcatcaaagcttctctggtgaactgtcttttgcatagtcggttgattgccgcactgaagtcttcaatagatgcctcaaaccctgcatctagaagcttgccaacccacataatagccttgtaaggcatcccttttgcacattgagctttgataagtgttgtatatgcaaattttctcagctcggcaccctgttttttgaaggactccagtttcatttcagcgtgaataactagtccctttaagcacagcacattaacaagcaagttataagtaacaggagagggcatcactccacgacataccattagttcatacacgtagaaagcatttttagcatcctgagtttcacaaaaaccttgtataagcgtgttgtaaggtattggatcagcatcaaaaccttctctatacatatcatcaagaacatttttggcatcgtggaacattaactgcttacaaagtcctttaataactacactgtaagttattgcatttggtctgataccttttccagtcatttctttaaaaatacttagcatggaatgaactttcccagcttcagagagtgcatccatcaaagtagtgtaggtaactgttgttggcagcaggtcacttaactgaatagccataaaatagctttctgccatatgtagatccccaaatttgcagtagccatatagaagagagttgcatgttacaatggttgggcacataccagccataataatcgcatcatacagctgaacagcattaccaatatcacccacttttgcataaccatcaataactacattgtagaggactacatcggatggctgatatttgctagccacagtttccaaatatgacctcgcttcatcaaggaatcctttcttgcaaaggcctagaagaatagatacatggtttactgaagttggaattaccctctgagaacggggggggggggggggactagtgagctccctgcacccccgggggaccccttgtttcgagcggggccgccacgcgggggagctcagcttttgtccctttaagagggtaaattcaagctggcttaaccggcctaagttgttccgggggaaatgtttccgccccaattccccaaaaaaaaagcgggaactaaaggaa

SEQ ID NO: 21465 - DNA, 4472 bp, Zea mays
ttggggccttttttttttttttttttttcaaggatcaaacgcaattatttcattattgatagggacaaccattacagaacagataccagttttcagaatggaacgactaacaaactcaggcctcccaacaattattgcacgacagaatacagtccaatggtccacagaaacagaaagaatgtaactagtaagaagaacacgcacatgtcgaacaaaatcaatctgaagtgaaagatctaacaattttatggaacaaaaaagagagatccaaagctactacttttgttgctggtcatctccatgccaggcccagactatgtccttcagtgctggccggatgtcctcttccaacagtttcttgtactcaagtgaatcaccgcccgtttgtttcatctcgatgaggtggtaggatgccgtgatctcaaatatttcagtgtcgaactccaggacacccttcctccccaccttcctcccctgaatcttgacaacaccattgtccttcttccttaccctgagattcagtgcttttgcaacatcttcaagcttcgagatgatggacacggcacccttatcagaagtgaaccgcgtctccttcttacactcctttctgataaataggccagagaggtccaatcctgtggagaaagatataatttcaaaggcgtttaagcttgtgacagtcgggggcttcacgtcttcatgaacattcttcttgcgcctcatagcaacggctggagcagcatttgtggtgtcattctcactcagaattttctcctttactgtacgggtctccacagggccttttcgaaaccaggtagactcttttatcttctgcactgaaattcttgtgtctgggctggggtcgaggatcttgtacaagagcttcttgagtttgtgtgaaaaccaactagggcacctgaaatcaccattctgtatcttgcgatacatctccatcatgtttggggcccggaaaggaagataaccagcaactagtacaaatagaacaacaccacaggaccagatgtctgactttgccccatcatagcctgtcttgctgatcacctctggagctacatatgctggagtcccacaggtggtgtggagtaagccatcttgccccttggattctgaaagtgcactcagtccaaaatctgagaccttgaggttctcattctcatccaacagaaggttctcaggcttcaagtcccggtgatacacacctcggctgtggcagtaatccaccgcaccaatgagctgctggaagtacttgtgtgcagcggcctctgtgagcttgccactcttgccaatcttgtcaaagagctctccgcctttcacatactccatgacaaagtagatgttgttccgcgtcgccatgacctcatgaagctcaacaatgttcttatgagccaccaaccgcatcgttgtgatctcccgccttatctgctccgaaagcccggccttgagcactttgtccttgtccatcatcttaatggcaacactctcgttggactcaagattctttgcgtagtgcaccttgccaaatgtgcctttccccagtagcctccccacctcataccgctccatcaaaatctttcctgtcgactccatatcttctctctctgcaaaaagtataaatcacactgctggcgccaatcaggtgggactgggcaaagagttagccttcctcccccatgtcatgatccatgacggtgaacagtactcttatggcttggtcgtggcgcagtctgaacgttgtagaatcgatgcagatcaggtcatcaagagttgagcagatcagcagccctcggggagcagcaaggtccttgatgtcgcaacagaaatatcttctaggaaagcacatctttcagcattccttgaggctttaacttgttgtgatctctgttaccttgctacggcgcggcggcggacggcggagacgagattgcgggagtggaggggagggaaggtggaaagatgcggcgatgccggccgcctaggatgttctaggtaatggtctcgtgcagatgcttcacagttcacacagaatttaaaaaagggggcgtcctgtactaaagcaaacacgaacacgactatgtgggttatcagtagtagaagatacaatgtttccctactggaatgagtcagaaaattccaacagcatcatgcatccgtagaaaaagaaacacaagtgggctacatacaaagaagataagacagaaggcatatccctagcacatctgcataaagagtgaatccatccacggcagacgtgagtccaaccattccacatctgtcaagaacttcataggacgcaagtggcggcgaagcgctttatcaagggaggggagggcgcaataatccagcaaaaatctcgccccctctatacaaaacatataaacgccgtatacctaccggtctccgtccgtctgatcaaattgacggcacaggagaacaagaacaggctcccggattatcttgggggacgggggggactagattcctcggtcaacatacagaacggtgcgtcgaactagtactgaaatctgaaactgcactgggggggctcaccttgctacggcgcggcggcggacggcggagacgagattgcgggagtggaggggagggaaggtggaaagatgcggcgatgcggggacgatgaggagaagaggctcctctttataccataccaggcggagctcggggtgaacagaatagaacagggttagccggcctatacgcgtgggtgatttgacgataatgaccctgggtggttccgccgccgcgtttcctgcgcaccgcatcacacgaccggatatgatgctcgctcgctcgctcgctgccgtgattgattgacaggtgggaccaaagaccaaccaacatgctgctgcaacgttagtttaggaagttgttaagatgcttttcccctacttatgtgatttttgctaaatttaggtcccgtttattttctcggctaaactttattaacatttttactcttaaataaaaaagattgtttattacgtaaatccagacgctttgagaagggacggagtacatggctgatgtgggggtctcatccttttgctgactcaggtagggaccactaggagggggggcagcctgttccatggaccatggaccttggactgattgaatgattggaccaccaccctccagatgattcatacatacgtggcgcttggatcttgtgtggtggccgttcagtaacgttgtctgtttgtataactagtgtatagagctcaaatatttctctactttttttttgctggggttaacctttgtttaacataaattttaaatagggtagttagatcttagttagtggaatccgaggttcatgtaaccactctcctcacttgcactgtaaaaaggaaggggatgaacaacatttgaaggggatttgatctaaaatgggttccgatcctttctagagacacaacatcgattaggacaagccatgttcaaagacagactcgaccccatacactctcatgttagagtttatctattaggcagtcacaaatgtggattagtattactaggctagaacaatgtcaccacaaaccataaggtaagggggaggtagaaggatttgatactcactggtgtttaggtttgtaatcttttccacttttatgtccaccaatcgataaatatcaaaaggacgtaagatattacacactacggccctagcctctctaatagtatgtgtccaggttcaacacaataattgatttgcgccatgctccttcctaattctctctctttttggtactctgtgtagctcggtgttattacacaataacatgtgcattacttttactatatatttgtatataatgttatacatctaagtgtatatatagtaaactatatgtatgtagaaaattcaaaacatattggaagggtgatttaaaattttgttatgaacttcataagctgcaatttgcatatagctagagaaatggaaacaaaccccctttttgttcttttcaatgaacataaattatagaatacctttgtcaacttcaaaaaatcaaaaccatgtattttggtttgaattttgattctgtccctctaatagttcatctgttactactatgtcccctcatgaatatttctcgaccttcttccccaaacgtgaacaatattatatattttaatattaaaataaatttgatattcaaatataaatttgaatttgtttcttttgtctcttatcctcgttcaccagtcacacctcttcagtaactaaacaactcacctttgtcgcttttatatatgacaaatatatacccgttacatcagttttgagctataaaagcttcttatttggcacacactcatgtctaggctaggttgcccggccgaccccacactagtggcactggcagcacacacgtgggtgtgtagctcatgtttcatctttttttaaccaccaatatgtaata

SEQ ID NO: 21466 - DNA, 576 bp, Zea mays
acagctctacctgatgatacaaaagtatactgtgggcatgaatataccttgagtaatgcaaagtttgccttgagtgtagaaccgggaaataaagcattgcaggaatatgctgcaaatgcagctgagctgcgtaataagaatatacccacggtgccaacaacaattggaagggagaaggaatgcaatcctttcttgcggacctccaatccagaaattaagagaaccctgtccgttccagatcatttcgatgaagatcgggtgcttggagttgtccgtcgagcaaaagataacttctgactaacaaaaggaaatgctcgtgacgtatgacctaagtcccaataaacataggaggaaatgaaggtatatatgtttgagctagattttgaaatgcttcggcaaaattatgtcgagtgtatgtagcttgggcagtgcagtgcttgtctatagcaaccaatgattcttttgaccactacaaataagcgtgttctgctatcatctaccctctgtaaaaaaaaacgccacgtacccgtttcctcgtcgatcttcagttcttattcccaacaaaaaccacaaccc

SEQ ID NO: 21467 - DNA, 1551 bp, Zea mays
  misc_feature (1534)..(1535): n is a, c, g, or t
  misc_feature (1537)..(1537): n is a, c, g, or t
  misc_feature (1539)..(1539): n is a, c, g, or t
cattgcccacccctatggcgggccgcggcgcgatctttaccactagtcgccgtgccgtcccctccccttctctctctcctcgctccccacgccacgcatcgcctcgtcggaacggaaggcggcagcgctgcgagcaagggagggagggagcggggatgaggatgctgtcgaaggcgtgctcgattgtggcctcctccctcccgcgctgctcctcctccgccgccgcccccacgatgagggggcagccgtccttgctgccaagcgtgcggaagcaatggcccgggaagccactgctgtatggaatcggcaccctgttggtcatgccactgaggacactgtatggagtgggtcgtgtttttggcgcaggacggtttctctgcaacatgaccaacgtctcttcgtcgctgcaaattgagcttgtaccatgccttcgagataactatgcgtatatcctgcatgatgttgatactggaacagttggagtagtggatccttctgaggctatgcctattataaatgcattggaaaagagaaaccagaacttgacttatatactgaacacccatcatcactatgatcatactggtggaaacttggaattgaaggcaaaatatggtgcaaaggtaattggttctgagaaggataaggacagaatacctggcattgacatcacgcttaaggagggtgacacatggatgttcgctggccatcaagttcttgtactggaaactcctgggcatacaacaggtcatgtgtgctattatttcgctggttctggagctatatttacaggtgacaccttgttcaatctatcatgcggaaagctttttgaagggactccacagcagatgtatgcctcactccagaaaattacagctctacccgatgatacaaaagtatactgtgggcatgaatataccttgagtaatgcaaagtttgccttgagtgtagaaccgggaaataaagcattgcaggaatatgctgcaaatgcagctgagctgcgtaataagaatatacccacggtgccaacaacaattggaagggagaaggaatgcaatcctttcttgcggacctccaatccagaaattaagagaacactgtccgttccagatcatttcgatgaagatcgggtgcttggagttgtccgtcgagcaaaagataacttctgactaacaaaaggaaatgctcgtgacgtatgacccatatcttgttaaagttcagacagagaacctaagtcacaataaacataggaggaaatgaaggtatatatgtttgagctagattttgaaatgcttcggcaaaattatgtcgagtgtatgtagcttgggcagtgcagtgcttgtctatagcaaccaatgattcttttgaccactacaaataagcgtgttctgctatcatctactctctgtaaaaaaaacgccacgtagccgtttcatagtcgatcttcagttcttattcaatacttcaaaaaaacggtttgcactgtggcagtggatattacttgaatgcattgcactccgatctgtagggttcnntntngaggaaatataa

SEQ ID NO: 21468 - DNA, 1018 bp, Zea mays
ccggccgggactgcatgtttaccactagtcgccgtgccgtcccctccccttctctctctcctcgctccccacgccacgcatcgcctcgtcggaacggaaggcggcagcgctgcgagcaagggagggagggagcggggatgaggatgctgtcgaaggcgtgctcgattgtggcctcctccctcccgcgctgctcctcctccgccgccgcccccacggtcgcccttctctctcacctatgagggggcagccgtccttgctgccaagcgtgcggaagcaatggcccgggaagccactgctgtatggaatcggcaccctgttggtcatgccactgaggacactgtatggagtgggtcgtgtttttggcgcaggacggtttctctgcaacatgaccagcgtctcttcgtcgctgcaaattgagcttgtaccatgccttcgagataactatgcatatatcctgcatgatgttgatactggaacagttggagtagtggatccttctgaggctatgcctattataaatgcattggaaaagagaaaccagaacttgacttatatactgaacacccatcatcactatgatcatactggtggaaacttggaattgaaggcaaaatatggtgcaaaggtaattggttctgagaaggataaggacagaatacctggcattgacatcacgcttagggggggtgacacattggatgttcgctggccatcaagttcttgtactggaaactcctgggcatacaacaggtcatgtgtgctaattatttcgctggttctggagctatatttacaggtgacaccttgttccatccatcatgccgaagaaccttttggagggactccaccgcagatgtatggctcaatccaagaaattaaaggtccaacccgtggtaccaaagtttaccgagggcaatgataaaccctgagtaatggcaagtttgccttggatggaataccgggaaattaagccttggcgggattaggcgccaattccgccgaacttcgttattaggat

SEQ ID NO: 21469 - DNA, 1381 bp, Zea mays
atcagtagtagtggccttttgcccttgcccctcatctctctcaccacctctcttttctcagccttgcttccgatggatcccatcccactgccatcctttctttcccttgcgcgcattgcctagccggccggccggcctgctatattaaaccactttaccccccctctcgctcacgctcgacgcagctcccttttccttgcttgcttattgcaagtctctgcaagaacctgctagagaggaacaagctggtatcgtcgccagcatgggtagaggaaggattgagatcaagaggatcgagaacaacacgagccggcaggtcaccttctgcaagcgccgcaatgggctcctcaagaaggcgtacgagctctccgtcctctgcgacgctgaggtggccctcatcgtcttctctagccgtggtcgcctctacgagtatgccaacaacagtgtcaaggctactgttgagaggtacaagaaggcacacaccgttggctcttcctctgggcccccgctcctagagcacaatgcccagcaattctaccagcaagaatcagcaaaactgcgcaaccagatccagatgctgcaaaacactaacaggcacttggttggtgactccgtgggaaacctgtcactcaaggagctgaagcagctggagagccgccttgagaaaggcatctctaagatcagggccaggaagagtgagctgctggctgcggagatcagttacatggccaaaagggagactgagcttcagaatgaccacatgaccctcaggaccaagattgaggagggagagcaacagctgcagcaggtgaccgtggcacggtcagttgcagcagcagcagctgccaccaacttggagctgaacccattcttggagatggataccaaatgcttcttcactggcggccccttcgcgacgctggacatgaagtgctttctccccggcagcttgcagcagatgctggaggcacagcagcgccagatgctcgccaccgagctgaacctcggctaccaactggcgccgcctggttctgacgctgccaacaataaccctcatcatcagttctaaactggatgcatgtacgagaagcttttcaagcgaactgtgaacggtggaagctggctgttgcctctagatgttcttggcttccatgacctagcttattgcggtgtgtattgttgttgccttttgtgtgtgattctccttgtgctactctacctgatggagaactaaacctaatcgattggacataatgatcaaatgctacagatcctgtgaggctgtgatcaggttaaggcaaaacaagtatactgattgcttaaatgggtttacgagtgacgacaatgctatttgttgcttctatcaaaaaaaaaaaaaaaa

SEQ ID NO: 21470 - DNA, 1407 bp, Zea mays
gaactcgtaaatcttgtgttcctgtgtggctgctttcgttagatctctcggctatgtctatatgatcgtcttggccagcatctctgggttcttttcgcggccgagaggaaacttactaactgatcgagtgtgccaggcatcaatctgtcgaatcgtgactcgtcgctttttcatgtcttcagattttgtccatctgtcaaatcatgtggaaaaattggcatatcttcttgtattctcttctgtcctttttaatgcctccagcggattaattgcgagctccacgcccttcagcagcttcagcctggccggccggcctgctattaaaccactttgcttgcaagtccaagaaactgctagagaggaacaagctgagatctccagcatggggaggggaaggattgagatcaagaggatcgagaacaacacgagccggcaggtcaccttctgcaagcgccgcaatgggctcctcaagaaggcgtacgagctctccgtcctctgcgacgccgaggtggcgctcgtcgtcttctccagccgcggacgcctctacgagtacgccaacaacagtgtgaaggctacgatcgagaggtacaagaaggcacacgccgttggctcttcctctggccccccactcttagagcacaatgcccagcaattctaccagcaagaatccgcaaaactgcgcaaccagatccaaatgctgcaaaacactaacaggcacttggttggtgactctgtgggaaacttgtcactcaaagagctgaagcagctggagagccgccttgagaaaggcatctctaagatcagggccaggaagagtgagctgctggctgccgagatcaattacatggccaaaagggagactgagcttcagaatgaccacatgaacctcaggaccaagattgaggagggagagcaacagctgcagcaggtgactgtggcccagtctgtcgcagcagcagctgccaccgacgtggagctgaatccgttcttggagatggataccaaatgcttcttccctggcggccccttcgcgacactggacatgaagtgcttcttccccggcagcttgcagatgctggaggcacagcagcgccagatgcttgccaccgagctgaacctcggctaccaactggcgccgcctgacactgacgttgccaacaataaccctcagcagttctaaactggatccatgagaaagccaactgtgaccgatggaagctggctgttgcctctagatgatattggcttccataacctagcttattatggtgtgtattgttgccttttgtgtgtgattctccttgctactgatggagaataaacctaatcgattgggcataatgatcaaatgctacagcacccgtgaggctgtgatcaggacatcatgtttaaaaaaaaaaagcggcc

SEQ ID NO: 21471 - DNA, 2169 bp, Zea mays
gtagtttctgctagctgagcgagatcgatctcgtttgtactttctccctttgaggaaacaactccccttttctgtgcttcaagttgttctgagatctccagcatggggaggggaaggattgagatcaagaggatcgagaacaacacgagccggcaggtcaccttctgcaagcgccgcaatgggctcctcaagaaggcgtacgagctctccgtcctctgcgacgccgaggtggcgctcgtcgtcttctccagccgcggacgcctctacgagtacgccaacaacagtgtgaaggctacgatcgagaggtacaagaaggcacacgccgttggctcttcctctggccccccactcttagagcacaatgcccagcaattctaccagcaagaatccgcaaaactgcgcaaccagatccaaatgctgcaaaacactaacaggcacttggttggtgactctgtgggaaacttgtcactcaaagagctgaagcagctggagagccgccttgagaaaggcatctctaagatcagggccaggaagagtgagctgttggctgccgagatcaattacatggccaaaagggagactgagcttccgacggtccccgtgctcctctcgtcccagattgaggagggagagcaacagctgcagcaggtgactgtggcccagtctgtcgcagcagcagcggccaccgacgtggagctgaatccgttcttggagatggataccaaatgcttcttccctggcggccccttcgcgacactggacatgaagtgcttcttccccggcagcttgcagatgctggaggcacagcagcgccagatgcttgccaccgagctgaacctcggctaccaactggcgccgcctgacactgacgttgccaacaataaccctcagcagttctaaactggatccatgagaaagccaactgtgaccgatggaagctggctgttgcctctagatgatattggcttccataacctagcttattatggtgtgtattgttgccttttgtgtgtgattctccttactactgatggagaataaacctaatcgattgggcataatgatcaaatgctacagcacccgtgaggctgtgatcaggacatcatgtttgttttgaatagcacttttatctattacgaggactctaggcctcaatatatagaggtacaggagattacaaatatacacaaaactccttatacaatgggaaaatacaaataaagtatatatatctctaacgcccgtgtcaaattcaaggtggatcaaaaacactaagtttggagagataaaacactaccagacacaacttctttatcgagtgctccgacatttgccgagtattccgagttttgtcaagtgccgctctcatcaaacaagaaccctcgacgacaacgatctggtttaccgagagccaaacactagacaacaaaatacagtcggctacatctttgccaagtgtccggctctcggcacaacagcacactcggcaaagcgccgtcagcagccgacggtagctgacggccgttaactatgcccaatacccagggaagacactcgacaaagttatgtatttgccgaatgttatgtggacactagacaaagaatgcttttgctaagtatcttttctttacactcggcaaagattatttgtgtttttctttttgccccaacttttttagtgtgttcctgcaatctatggtcctacgtgttcaattttgacacatttatcaaggtgtttgctatacctattagatttagtttatttaatagaatttattcggataattcaaatttgaactgcaactcactcgaaaaatggaaaacaataaatgtaaaaacgatattcatgttattgagcacaagttatgccttaatttaggaacatactagaaatttcaaacaccatgttcatgaaacatgaccataaacttgcgatccagttgttttaaaattgtataaaatacaagcaaagtcaaaaaaatcgtgaaatttatcgagatgtcatgatatcatatgtagaggttatgataaaaatttgtcagtgttttgtgaaagatgtcacatacagtgtgtacaaatacaggaatctacgtaaaactttcatgatttcatgtgaaggtcgcataagtttgtacatatagtatgcgataacttttttaaaatgctctc

SEQ ID NO: 21472 - DNA, 2024 bp, Zea mays
  misc_feature (12)..(12): n is a, c, g, or t
  misc_feature (1557)..(1557): n is a, c, g, or t
ctatatctatantgcagctcgcccccccccgcccgccgtccagttttcccaatctgcctcttgctttatgataattcaacttgcgctgattatattcttggctacctagctagaaatgtctaattaaactttgtttgctagccagattttgttgcttcttttcgcatctgatctttttatctcttctgagtgctccgcaaagccttccagtgttgaagaagctgctggaagaagagatgagctttctcttgaaggaaaaagagatgatcattgctgctggtatcgtcgccagcatgggtagaggaaggattgagatcaagaggatcgagaacaacacgagccggcaggtcaccttctgcaagcgccgcaatgggctcctcaagaaggcgtacgagctctccgtcctctgcgacgctgaggtggccctcatcgtcttctctagccgtggtcgcctctacgagtatgccaacaacagtgtcaaggctactgttgagaggtacaagaaggcacacaccgttggctcttcctctgggcccccgctcctagagcacaatgcccagcaattctaccagcaagaatcagcaaaactgcgcaaccagatccagatgctgcaaaacactaacaggcacttggttggtgattccgtgggaaacctgtcactcaaggagctgaagcagctggagagccgccttgagaaaggcatctctaagatcagggccaggaagagtgagctgctggctgcggagatcagttacatggccaaaagggagactgagcttcagaatgaccacatgaccctcaggaccaagattgaggagggagagcaacagctgcagcaggtgaccgtggcacggtcagttgcagcagcagcagcagctgccaccaacttggagctgaacccattcttagagatggataccaaatgcttcttcactggcggccccttcgcaacgctggacatgaagtgctttctccccggcagcttgcagcagatgctggaggcacagcagcgccagatgctcgccaccgagctgaacctcggctaccaactggcgccgcctggttctgacgctgccgacaataaccctcatcatcagttctaaactggatgcatgcacgagaagcttttcaagcgaactgtgaacgatggaagctggctgttgcctctagatgttcttggcttccatgacctagcttattatggtgtgtattgttgttgccttttgtgtgtgattctccttgctactctactgatggagaactaaacctaatcgattggacataatgatcaaatgctacagatcctgtgatgctgtgatcaggttaaggcaaaacatgtatactgattgcttaaatgggtttacgagtgacgacaatgctatttgttgcttctattactgctcaactctctcttgcttccggttttggacacaatttgtttgacatggtattctgcacacaactttgggtgttggtttttgtccttactactccacagtaagaatatttcaaaaaactgggatgcatgtgttaacgcgatcagtggtgcggaagcanttgtttggaagcttgctttgacctggcagcgttgcgtgttagtactttttataacaatgagtacatggacggccaggtttatctccagcagattatattggctgtagcctcagacgtagctgactccaattcaacatatatatctaattatcaagctaaattacatgcaacgaatatacatgagttggtttgggttacaatgaataccgactttatctaatactccccttcattctcaagctcataagagattgagattgtgcttgagattctccaatttatgaactgccataggcttcttaaaaccatcagctaattgatcatcgatcagacgaaatgaaatcaatgtgaagaagtttatttgctaccatttctctaaaaagtgatagtcaatttctacatgcttcgttctcccatgaaacgatggatttctacacagatatttggctcccaatattattacaccc

SEQ ID NO: 21473 - DNA, 1233 bp, Zea mays
gccggccggatcagtagtagtggcattttgcccctgctgtgccatctctctctcgctctcgctcctctcctctttttctctcctgctcagccttgcttcccgtcccatcctttctttcccttgggcgcattcagcagcttcagcctggccggccggcctgctattaaaccactttgcttgcaagtccaagaaactgctagagaggaacaagctgagatctccagcatggggaggggaaggattgagatcaagaggatcgagaacaacacgagccggcaggtcaccttctgcaagcgccgcaatgggctcctcaagaaggcgtacgagctctccgtcctctgcgacgccgaggtggcgctcgtcgtcttctccagccgcggacgcctctacgagtacgccaacaacagtgtgaaggctacgatcgagaggtacaagaaggcacacgccgttggctcttcctctggccccccactcttagagcacaatgcccagcaattctaccagcaagaatccgcaaaactgcgcaaccagatccaaatgctgcaaaacactaacaggcacttggttggtgactctgtgggaaacttgtcactcaaagagctgaagcagctggagagccgccttgagaaaggcatctctaagatcagggccaggaagagtgagctgctggctgccgagatcaattacatggccaaaagggagactgagcttcagaatgaccacatgaacctcaggaccaagattgaggagggagagcaacagctgcagcaggtgactgtggcccagtctgtcgcagcagcagctgccaccgacgtggagctgaatccgttcttggagatggataccaaatgcttcttccctggcggccccttcgcgacactggacatgaagtgcttcttccccggcagcttgcagatgctggaggcacagcagcgccagatgcttgccaccgagctgaacctcggctaccaactggcgccgcctgacactgacgttgccaacaataaccctcagcagttctaaactggatccatgagaaagccaactgtgaccgatggaagctggctgttgcctctagatgatattggcttccataacctagcttattatggtgtgtattgttgccttttgtgtgtgattctccttgctactgatggagaataaacctaatcgattgggcataatgatcaaatgctacagcacccgtgaggctgtgatcaggacatcatgttt

SEQ ID NO: 21474 - DNA, 5239 bp, Zea mays
  misc_feature (2413)..(2413): n is a, c, g, or t
gtctaaatatattggctatattctggttaagcaagataacagggctctggttttcagtagtagtggccttttgcccttgcccctctctctcacctctcttttctcagccttgcttccgatggatcccatcccactgccatcctttctttcccttgcgcgcattgcctagccggccggccggcctgctattaaaccactttacccgccccctctcgctcacgctcgacgcagctcccttttccttgtttgcttattgcaagtctctgcaagaacctgctagagaggaacaaggtagagtagtatcgcttttttccatctaggttatctctttttacatgaaaaatttcagccgtatttcgttctccatcagtcctgcgataatatatacgcgcgtcttgtgtgatccggcatatgtatagttcctgctaactgatcgagatcgctctcgtttgtactttctccctttgaggaaagagtttccccttttctgtgcttcaagttcttgtaaggaaaaccatgcctgccagcttcttctgctacttgtatgatgattcttatttgcttattacttgatttccgttttttttcttgctttctatatgtatgtatctgggctgtcttcccctgcgtctcgttactgctaagctttggaaggtttcaactctttgtatacgatgaggtttctgctcctagtagcagatccgcgcatatgactagatgtttgaggaaaagaaaagggcaagacgctatatatatatgcagcacgcagtcgcacatatattcagttttccaatctgcctcttgctttatgataattcaacttgcgctgattatattcttggctacctagaaatgtctaattaaactttgtttgctagctagattttgttgcttcctttcgcatctgatctttttatctcttctgagtgctccgcaaagccttccagtgttgaagaagctgctggaagaacgaagagatgagctttctcttgaaggaaaaagagatgatcattgctggtttgttgttgtttcgtgtttttttagcttcttgtcccccatttatatttcgcgcctaatgaacgagctcgtagatcttgtgttcttgtggctggttttgttggatctcgatctcggttacgtttacatgagtctactcctgcctaacatacatctgtgttctttttctaggctgagagaaacttaactgatcgagtctgcctggcaggcatcgatctatccagtcgtcagttcgtcacatccgctttttcgtatatatcatcttcagattttaattgtccatctgtcaaatcatggaaaatctgtcgtctttgcttgtattctcttctgtcattcctgctgcctccggcggatcaattcttgaatcgacccgtgttcctattcccttttgttagacagcccaaatcgcttgctcgatcgtagcgtactgcactactgcggctagctagatcttccaagctagctagttcgtcggtccctttgatctgctccacttgaactcttttgcgcttatgagaaaacttgctgctttcagctggtatcgccagcatgggtaggggaaggattgagatcaagaggatcgagaacaacacgagccggcaggtcaccttctgcaagcgccgcaatgggctcctcaagaaggcgtatgagctctccgtcctctgcgacgctgaggtggccctcatcgtcttctctagccgtggtcgcctctacgagtatgccaacaacaggtgagtgagccgtgtgaggtgcttagatcttggacaccctggtgaacgcttgatcatttttcagcatgtcatcatttcatgctcaagtcatcgacttgctgattgcgctgttgcgttgcgtcatgggcactcagcagaaaatggaatcttattcatttgtagtgcggcggcgcttgcgggatttagttcccgtttagaagtacccaatttttaagaaacagatttatagaaatttaggtagtaccaaacataccaatttatggcttagtttataaaaattggattactagtttcttagaaaccaagaagttgacctttcctaacttaaagataaaaactggtttttcaaacaacatcttagttcctctctcatcggtagttcatgaataaattgattagtaaggatttctaaaagatacaaaaaatcgtcaaaattgtcatatgttcagtggtcagaccatatatatatatatatatgtttaggagttatttcttcaaaattatgtgatggacaggaaagggcacagcgttcatcatgtataataatactgacagagacgaccattttattgccatgcaaatttacacaaaaaactaccacatgcttattggattttcctcatctgtgttagctaatataatgatttatcttgttaacccactanatgttatcgagttattaatcatatattgcattgtcatgtgatatatcttgtttgtgcatataataccgagacaaggattgactgactctatgtacacatgaattggaacgtaaccgtgcaaactgcaaactagtgcttctttcatgcattgtttgctattcaaatactactgttattagattttgattttagatctgagtgttcattcggatctatgtttttagacagatttagggtacatttggttggagagtcaactagaatagagtgactccattccagttatttagaataaagtcattcaattctgcgtttggcaagccgaacagagtcattctatttttttgtttgatcgaagatagagtggagttgctctgttctttatttggatggagagtcatatgaatgtagagaagagggagagggaggagagtgctcgtatccagtcattttggtggagctggagtattccaattatttacggtaaatttttatatgaagactttaggagccgctccacttcttttttgttgaaaaccaagtatccagaaaacaagaatagatcaactcctcaaccaaacacacctttactctctccctcggtttgttttggtgtgatttttaataataagttggtctcatcctcttcctagaagagataaaaccggatgtttaattttcatggcataaaaaaaatgttatttagattttcagagctaaaacatccgtgctctagtttccacacactaggttcaacaaaatcgataagaacaagaatgcatttgcgtagtggtagatgaaagtttgtcgcactgacgtcttctgccctgtcaaatgcctttacatgctcctcggtctctctctctcacacacacagaacacaaaaaaacaaggtcttcttgttgcactgtgtccgagaggacgttgcaacgtacgtactgacctgactctaaactagctgtcaagagttaccctttgctcgcatcccgctagtaccagaacgtacacctcagtcacctcgtcggcaaacttgcaccggctcacccccccatattcgcggtgcttgctctcccctctccgatgcaaagcgtcaatcaacaacaaatgcacgccgcagtgctccattcctctcctgtgcttcattctgccgagcaaaagtttttcaacagcagcagaggggaacgatgacaacacacacacagctgcattttattctttcaaaagtttcgcaatgggaagcttgttcacatgcatgcatgcatgcattgactgggccgggtgtagggaaaattttcacctcacaatttaatagctttcgcctgtttcgtgttgctgtggcctcgagaacacagaaggagctataggctgcattgtcacttcagtattactgacaacacaccatgcatgcatatgcatcctccatgccttttgctttgttccactaattgattggtctagctgctgcagtgtcaaggctactattgagaggtacaagaaggcacacaccgttggctcttcctctgggccaccgctcctagagcacaatgcccaggtaatttatacctttgctgttcttacagtaaagtacggtggtcattttatgatttacaatttctttccatacacgtagccatccatatgcatgcattgagagattcttctggaagtaacttaatttgacattagtactagggctgtagcgcatatgctaaatatatacacatactgaatctatatttcttgatgatcatgctgatcgagaaccaatagcgattgaatgacccggaaatttctaaaactgaaatagtcatacacctgaacaaagtagttgtcagaccccctcaatattccatttacttaatttggacttggataatgtccaaaattatgagatccatgcatccatctgatcctttcctccaactctttgttttatatgctgaagcaattctaccagcaagaatcagcaaaactgcgcaaccagatccagatgctgcaaaacactaacaggtacgtagagaagccttgtgcagaatttactctctctaaagctagagaaccattggtaacaactgactgacagtacacacgtactgacgtactgcctgtattctctgattatttttctcccttgtgagggcacttggttggtgattccgtgggaaacctgtcactcaaggagctgaagcagctggagagccgccttgagaaaggcatctctaagatcagggccaggaaggtaagaaatgtatagcattatccaaaccatcttcaagcaaactaatcatataaactaattaagtgatactcaattctttatatactgtgtatatttggccacatcaattaattgcttcccaagactccttttgtttcaataatcttcaagttctgatgtaattctgagttgggctttggataggttgttgccagacattgacttctgaattcttgtttcagagtgagctgctggctgcggagatcagttacatggccaaaagggtaatgcacacataaacctcattttagctaaccctattggattcattcgtttgcatcatatcatgcatgtccgcaggagactgagcttcagaatgaccacatgaccctcaggaccaaggtatatatgcttgcttgcagcaattgtagaactagctagaacccaatcttttctttttcttgcatatatagccacctagaccggaaagtaaagaaaaaactacatgattagtaatcttgagaattatttatgcatctgtggtagctgaacattttgtcaattgtcttgtcagattgaggagggagagcaacagctgcaggcatgca

SEQ ID NO: 21475 - DNA, 1923 bp, Zea mays
gctcggtacccctgcttgctgccctcccaatcgagcggcagggtcccaccgcccaccgagctaaaggcatccaaaattgtactagctatcttgattcttaaatatttattattcgctagttcatttctgaactaaaatgtgataaataaaaagaacgtcgagagattaatatttaaatattaatatttaagaattaggatataaaattaaattttcaaatattttaaaatatataaatgaaaaagccaaagttcattttcgggccccaatctgctaaatcttggcccatgtttagacacgccctcgacccggccgcgtcgccagaatatccgggcatccggcccaggcatgaacggtcggttaaaccggccaatcctcctctcaagcctcgacgcagcacggcgcgccggcgcgggacgacggcatgacgccgccgtccatcttccaccaccatcgctgcctcgtctccctcccctccgcttccccgacctggacctcgtcccgtcgtctcatccatcaactcgcaaaacccacagtcctgtccctacatctgcgtccagtcttatcctcttccttcgcggttgccgccgtcggcgacgacgaggatgtcgtagtcggggattgcctcgtgttcgacgacgacgctttcgaggaaccggacctggacctcccctcgtccccgtggccgtcggctagcgcctcacgccacggccggaggtcggaggcaggcgagagcgacagcctggtgccggagaggtggaggcatgccgaggaggagatcaacctgacgaagaaggataagcgccgcatcgcgcacgggctgcggttcgggagccgcctcgagcggcgggcgcccccagctgttgctgctcctgatgaattccgcgcgtaccgcaaggggatgctgagcgctgagcgtgagcatgtttctcatgtataccgggggccgctggagaggactcctccgccggaagtgaaggaacatccaccgccggagccggagcctgggacgcgtgtggccccgaggaatccgaggatggggatgggcgttggcacccttgacgacattgatgagtttttcagaagtagggaatatgttcaggatgagatggaggacagcaagagtcctaagggccgtcagaagttgttctcaaatgaggagaagattcttctgaacaagcgagtgcctgatctggaaacagctacttctagtaaatggcttccacttcacacccttgctgcatctggtgatttctatctattgaatagccttttaaaacataacgtggacataaatgcgcttgataaggatggcttaccagcgatccacaaagcaattctttcaaagaaggctgctattatcaattatcttttaaggaactcagcaaatccattcatccaagataaagatggtgcgactctaatgcattatgcggtccaaacagcatgtagtcagaccataaagacacttttactgtacaatgttgacatcaaccgtccagatgattatggatggacacctttgcatcttgcggtacaaacacagaggactgacattgtgaagctgcttttaataaagggcgctgatagaactattagaacccaagatggattgaccccgttggagttgtgcctccggttgggtcatgatgtgcggacgtatgagcttatcaaactacttaaaagtttccgaggacaaaagcagcatgatttagtttagcaactggagggtgtgtgaccctctttgaaccagtgaggttaaccagtgtggtggccttctgggaggccagttttcaatgtaccattaatgattcatggaatcgctcctggtttgagataggtacatgccaacttcattgtatttgtatcatttatatatttcattggcctaaaccatcaaaaaaaaaaaaaaaattaccccta

SEQ ID NO: 21476 - DNA, 5055 bp, Zea mays
gtattatggtgtcacatattcggggatcataactactccatccgtcccaatttataatttgtttgacttttttttatcaagtttgaccggcttgtcttattcatttttttgtgaaacatgaaaaatttaaaggcgtacttaaagtatattatatgcaaacgatatcaaaggaaaaaatataattattattatgaaaaaaaattgaataaaacgagccagtcaaacttgaggtaaaaaattcaaacaaattataaattggaacgaagggagtagtttttacctatgtccactgccctaaaagtaaaatggcatatacgctggaaattcttttttttaacagtgtttgtattgctaatatggatactaggttgggaaaaagctgaggccgaggcactagctatcaagacacaacttgatgatacattagatgaaaaaatggcaatgcagcagaggatttgtcagcttgatgaggctctaaatgttgcaatggtagagagggactcactcataagggagacagctcaaatgatttcttgtgaacaacacaaagttcagaagctggaagaaaatatagtggataaaataaacataattgctagtttagatgctgagaatgtcaaactttctaaaattctgtcagtgaaagcgaacatcatcacagagctagttgagtccaagggaataatagagtcaaagttcaaggaccttgcagtaaagctagagtcagccgaaagatctaactcttcacatagatatgaggtttgcatgctgcagaagcaacttgagattcgaagcgaagaaaggaaatttagtctcaaatctgctgacgctgcacacaagcagcatcttgagaacgtaaggaagataaccaagctcgaatcagaatgccagaggttgcgttcaatggtacgtaaaaggttaccaggtcctgctgccattgccaaaatgagaagtgaagttgaaacagtgggtatcgatacaggaatcacacgaatgagaaagtcgaattcagtgacatcacagaacccctgtggtttagtacagaactctcatgatacatcacatggaaattctccgttacttgcaaggctacatgcaattgaagatgaaaataaggtcataaaggaatctctttctagaaaggatggtgagcttcagttttctcgcactatgcttgctcgcacaacttccaaactttcccaagttgaagcccagcttgaagatttgtcaaaaggtcggactactgcagaattggtaaaaggtagccctactgttgttgaaaaccctctttcatctatctctgaggatggctttaatgaagataatgtgagttgttcaggctcatgggcatcagccttgctgtctgaactggaacacttcaagaaggggaaacacacagcacattctagtaagagcacaggagtatcagacatgagtttcatggatgactttgcagagatagaaaagttagcatctttatgtaatgataaacatgtggaacaatatggttcaaagagagaagccacagagtcatctggaaaggagctagttccagttgatgtctccactggaacagccgaccaaattcgccaaccgagaattgagaaggctgtccggaagttaattgaacttattgagggagttatccaaagatcatcaaaagattgtagtagcacagttgtgctatctggcggcgatgaggaaaacggccaaggaacactatcaggctatgttgctcgtgcattcttgtggaatacatcagaacttacttctgtactgcaaaattttgtttttgcgtgcaacgagcttctgtatgggagtactgatgtcgaaagctttgttcatgacctacaagtcacattagattggataatgaaccactgcttctcacttcgagatgtatcagacatgaaggaagccatcatgaagcatttggaattaaacaacagtgatggacttgaaattgttgcggtaggcagtcacactggaatccatacaacagatgagcctaaaacgccggaaaatgttcagacgtcattattaactgactcaagctgtgtagatattaagcctgatgttagcaaacagaggacatgcaatgaagtagctatagaagaaaaggcttcacatttgcgggcagaacttaatgagctgaaagaatccagaaaaataatggtacacctcgatggtaaatcaacaatgactgaatgcattacacatgaatccatcttcatatctggacaaaatacgggcaagcaagatggggttagttgtcttgaaccgaagcatcagcttgaacggtaattctttttcagccttgtccttccatggttgatactattctgtctaacataatatttgctagcagttgctccactaaacaaggctcaaaaagtgtcaccgagaatgaagataaacatttgcaggtggtgagacccttacgatctttcttgtccttgtcatttcccttaaagcaattgacacttcatgctatatattttgcaagcaaatttctctaccctgacgaagcacattgtagatgtccaaattagtaaactaaacttgaaactagcggccattctttgctcgaattactaaccagaccttatatcatctgtgtcacaggagcttgagatctcaacagcgtcagagaagctgatcgagtgccgggagacaatcataaacctgggaaaacaactgaaagcgctcgcatcgccaaaggacgccatcctcttcgaccaggttcttcagaccgctgttcgttctgagcggaaaccccgatcgcagtcactaagcgagatgttatccatggaggacggaggattctattactcaggctccccaaaaaccaaggagatcatctgtactgaaccaagtgcgtcaggcgaaggaaaccgtcctgccgacgacgagggagacggcggttccgccgcagcatgtagctcttcacacccaatgccggtggctccacacgtaaagcaggcgtgcagggtgaacaggacctgcaagggagaagccgacgtgaaggtagtgacgcttgccgttgtcccgagaaagcagaaggggaacggcagcctgctgaagaggatcctgacgggcaggaggaaggaggccatggccaagccgcaggtggtgctgagttcttagctgaccgaaagaatggaggttttggacatggcaagtcatcgtttcatgtgtagatggagtttgttcgtttgtgtgtggagccatgttcatgtgaggttagtaataaagtcgcaggctgctgcgtagatgatgtatgtattagtgtggtgtgtgtgtgtgtgtcagtgtgaggtagtgctctgtcatgaactcatgaccctgttttctgaagactacctccttccttgtgtgttctggggaggttcctgaacctgtttgagatagtgctagttgcctagtatgttggcaatggtatatgttagtgtgcttcgtctgacgaaagaaccttgttctgaatgactgtagttgtcccctcttagtttctgttttcttttttttctctctctgaaagcaacgtcagttttgtttctaaacttggttacatctcttatgtgcactttctactctatcaatagaaaccttgcactataagtgtcgatttgttcaaaaagatacatccatcctccttgacagtttctagtgggggctgaaagcctagggtgtagggtatggtgagatacaggatcatatctcctacccagattaccttgttcagttattcctatcagatggattagatgtgattggaaaaaattataaaggatttcgaattgtttaagatttaaacccactcaaccacacccaatctatatggattgagagtaaaataaacatgcctttagtgtataaacatttatccagattagtgtagaaacatttcagatgctgaatgtgaatcattttatgaactcgttttgctactagattggattttattcatttatatatatactgttttttaaaagaaaatataaatatcgatatgctttaaaaatcctgtatttttatgaactgagaacaacgtaaatacaaattattttagctggttgcactaaaattcgattataattgaaaaaatacagttagtagtgtagaagagagaatagaatcactgcaaaaccaggtatattgttgtctcctctaacgacgagccctagctctcccctccggcagcgaaataatgtggcggcggcggcggaggagcaatccagcacatccactcaagccgatggcaggaatgttgagagaaaccccggtgagaagagatttgactgcttctcctcaacagattgacaaccagtacttgttgttcagaaaggccaacactacaggttcacaggccattactactagttcacaatcttcaagttcagaagaaggccaaaattataagttcacaggccgatattaccaaatcaacatacaagcaccaaaaggacacgcctctacataacaatttcagaggccaccgacccagcttacagccaccaaaattacaagcttacaactactttagactctaaatccttgagacttctggccacttcagctggaggagctgctgcgtctttttttctgcttttttttcagtgatgtcacgcatgccctcttggatggaccagcagtgtcaactccatattgtcttttcctgtgagtacctttcagttacaacgatacatacttgaaacacataaatcaatagaaaattagatgaaattggttctgaccttttgtttgttgtagtagtctcaccatcttcacctaccatctctagtttgcacgtcttggagaagtgttcaaaacctccacaccttttgcacataacttctttcttggtggcttgtttctccagcctccaggcagccaggcaggcccttatcctctgagtctttgacctgccaactcttctccccagcaaaggtggggtatacttcgaacccaagccaaaattcaggacattgtgatctatctgtcatagtctgaactcttccttcatatgcagccttgaatctagcaacagaataatac

SEQ ID NO: 21477 - DNA, 3307 bp, Zea mays
ctcaatatgtcaagtattatggtgtcacatattccgggatcataagtactcccctatcccaatttataattcgtttgacttttttatcaagtctgaccggcttgtcttattcatttttttgtgaaacatgaaaacttcaaagtcatacttaaagtatattatatgcaaacgatattaaaggaaaaattaataataattatgaaaaaatgaataaaccaagccaatcaaacttgaggtaaaaaagtcaaacaaattataaattggaacggagggagtagtttttacctatgtccaccgccctaaaagtaaaatggcatatacactggaaattctttttttaacagtgtttgtattgctaatatggatactaggctgggaaaaagctgaggccgaggcactagctatcaagacacaacttgatgatacattagatgaaaaaatggcaatgcagcagaggatttgtcagcttgatgaggctctaaatgttgctatggtagagagggactcactcataagggagacagctcaaatgatttcttgtgaacaacacaaagttcagaagctggaagaaaatgtagtggataaaataaacataattgctagtttagatgctgagaatgtcaaactttctaaaattctgtcagtgaaagagaacatcatcacagagctagttgagtccaagggaataatagagtcaaagttcaaggaccttgcagtaaagctagagtcagccgaaagatctaactcttcacatagatatgaggtttgcatgctgcagaagcaacttgagattcgaagcgaagaaaggaaatttagtctcaaatctgctgacgctgcacacaagcagcatcttgagaacgtaaggaagataaccaagctcgaatcagaatgccagaggttgcgttcaatggtacgtaaaaggttaccaggtcctgctgccattgccaaaatgagaagtgaagttgaaacagtgggtatcgatacaggaatcacacgaatgagaaagtcgaattcagtgacatcacagaacccctgtgctttagtacaaaactctcatgatacatcacatggaaattctccgttacttgcaaggctacatgcaattgaagatgaaaataaggtcataaaggaatctctttctagaaaggatggtgagcttcagttttctcgcactatgcttgctcgtacaacttccaaactttcccaggttgaagcccagcttgaagatttgtcaaaaggtcggtctactgcagaattggtaaaaggtagccctactgttgttgaaaaccctctttcatctatctctgaggatggctttaatgaagataatgtgagttgttcaggctcatgggcatcagccttgctgtctgaactggaacacttcaagaaggggaaacacacagcacactctagtaagagcacaggagtatcagacatgagtttcatggatgactttgcagagatagaaaagttagcatctttatgtaatgataaacatgtggaacaatatggttcaaagagagaagcctcagagtcatctggaaaggagctagttccagttgatgtctccactggaacagccgaccaaattcgccaaccgagaattgagaaggctgtccggaagttaattgaacttattgagggagttatccaaagatcatcaaaagattgtagtagcacagttgtgctatctggcggcgatgaggaaaacggccaaggaacactatcaggctatgttgctcgtgcattcttgtggaatacatcagaacttacttctgtactgcaaaattttgtttttgcgtgcaacgagcttctgtatgggagtactgatgtcgaaagctttgttcatgacctacaagtcacattagattggataatgaaccactgcttctcacttcgagatgtatcagacatgaaggaagccatcatgaagcatttggaattaaacaacagtgatggacttgaaattgttgcggtaggcagtcacactggaatccatacaacagatgagcctaaaacgccggaaaatgttcagacgtcattattaactgactcaagctgtgtagatattaagcctgatgttagcaaacagaggacatgcaatgaagtagctatctctaaatttgaggggatagaagaaaaggcttcacatttgcgggcagaacttaatgagctgaaagaatccagaaaaataatggtacacctcgatggtaaatcaacaatgactgaatgcattacacatgaatccatcttcatatctggacaaaatacgggcaagcaagagggggttagttgtcttgaaccgaagcatcagcttgaacgttgctccactaaacaaggctcaaaaagtgtcaccgagaatgaagataaacatttgcaggagcttgagatctcaacagcatcagagaagctgatcgagtgccgggagacaatcataaacctgggaaaacaactgaaagcgctcgcatcgccaaaggacgccatcctcttcgaccaggttcttcagaccgctgttcgttctgagcgaaaaccccgatcgcagtcactaagcgagatgttatccatggaggacggaggattctattactcaggctccccaaaaaccaaggagatcatctgtactgaaccaagtgcgtcaggcgaaggaaaccgtcctgccgacgacgagggagacggcggttccgccgcagcatgtagctcttcacacccaatgccggtggctccacacttaaagcaggcgtgcagggtgaacaggacctgcaagggagaagccgacgtgaaggtagtgaggcttgccgttgtcccgagaaagcagaaggggaacggcaacctgctgaagaggatcctgacgggcaggaggaaggaggccatggccaagccgcaggtggtgttgagttcttagctgaccgaaagaatggaggttttggacatggcaaagtcatcgtttcatgtgtagatggagtttgttcgtttgtgtgtggagccatgttcatgtgaggttagtaataaagtcgcaggctgctgcgtagatgatgtatgtattagtgtggtgtgtgtgtgtgtgtcagtgtgaggtagtgctctgtcatgaactcatgaccctgttttctgaagactacctccttccttgtgtgttctggggaggttcctgaacctgtttgagatagtgctagttgcctagtatgttggcaatgatatatgttagtgtgcttcgtctgacgaaagaaccttgttctgaatgactgtagttgtcccctcttagtttctgtttttcaaaaaaaaaaaaaaaaaaaaaactcgagggggg

SEQ ID NO: 21478 - DNA, 914 bp, Zea mays
gccctttttgtgcacggctaattgtttgccatgataattctaaaacctgtttaatatctcagagaatctactgcacaagtttttttttccttagcaaaatgctgcataagctcagtaattccagagatgagtgctcaaaggggccatcatcacaggggcagatactagtacaccaaccactctttctccctttgcaacaacagtcatacaagcagcaaactcaactcacagagagaggggtacaagaaatcaaacatgtcacccttagtaattttaaccagggggccacttcatctgccttccaccaagtacatgcaggtgcagatgatagacagattggcatccttcagctccattgttgatgacaacacggtacccactcgctacaccttccttctctgccactactttcgctgcgtaaagaagccggcccaggatttctgtatgccttggctcagccttgtctaatccggttagcccatctctcgcttttgggatgactagaacgtgcacaggggcttgtggattaatatctctaaatgccagcacattttcatcttcatatacgatgctcgaagggatttccttcgcaatgatcttgtcgaaaatggttggtcctccggcgtcagcagtggcggcggctgctctggcagcagcttcctcgtttgatgatgaagcaatatggcgcacaaacctttggggaggcacgcggtgggggacccggagtccctgcggccgcagcgaggtagagcgcctaagaagagaggacgtagccgccgtgagcgtggctgccgccgccgccctggtcgccatggcagccgatgggtggagtgtgggtgtggagtggtgctgccgcagacgtgcccgggagacgtgagcgtggctgagcacacgagcgattcatgaatcatgat

SEQ ID NO: 21479 - DNA, 1898 bp, Zea mays
acggcacggcacgcgacttgactcatctctccggccaggtagttggagtcgcgagcccactggtggttgcagtgttagatccgtccgcctgagccagagccagagcgaaggagtcaatctcacggcacgcgccatgtccgacgagtcgccgccgccagctccggcggccgagaagagtcagcccgccgagcaggcggcaggaggctggggcggatggggactctccatcttctcagagatctcccgcaacgcggtggaggttgctaagagtgccatcgccgacattcagcaaccgccggagcaggacacggtaccgggtagtggcgagaaggatcaagagaaggaaccggagggggaggaggaggaggaggagagacgcaaggcggctctggacaagttggagaaggccggtgaggactcaatcctgggccaggggctgaaggcctttgatagctcggtggagaccatcacgactggtacttggcaagctcttgggaccgcatggaggagtggttcactatttgttcaaaaattggaaaattcagcttcaagcttggccgaaaccattcagcaaggagaactgcctgcaaaagcatctgcgatagcaccgaccattttagagacagggaagtcatttacagcaaaaggaatggaagtgcttgaacgtgttggaaaggagacaatggagtttattgttgaagaaactggtatggaagttgataaaggcagtaccggtgaaggtgaccagcagacagaagaggaacagtttgaagaagtctcatttgacagatgcttctatatttatggggggcctgatcaattagaggagctggaagcattatcaagccactatgcattgttgtttaataggaaaaaggggaaacttaattctgaccagaaaacatattacgatggaaagcttaaagaaatagagcagatttttagtcttagcaccaatgctgatgaagatggaccagaatctgacaaagggaagaagattgaatcagctgacactgatactgacgctgagatgaagaagttatgtgaatctagtgttcgcaaggctgctaagatggctgcagggttcaccactgccttgggtgggctttctccaaacgagattatgaaacgaaccactagtaggcttgagaccattcactcagagggtgttcatagattatcggagatgtgctgccttgcagtttctcagcttctggtgctaggaaagtcagtaatatcttctgccaataaatcaaagaatgaggacggtgaaaatgatgttaagattgattggcccgaagatgccatttcaaaagccaaaataatcagatggaaggcgcaatccatctctgtggatatggaaaaggtgtctactagtttcgctacaggtatctcggatgtcgctgaagcttatgcggcagctatgcaaagtgctctcgccgacaagcaggacgacctcccaaatcagaagtctttacaggagaaggttaagtccatatccatccatctcaactccgatcagaccagcgctgtcagcaagctacaagatgccctgcggtacctggcctacgtcgtcgtatgcgcttcaatgccaagtgtgtgattgtggtgtgttccctgtctgagcatttgcctcaatcgttggccatctatgtacatttgcgtacacggggatcccttcaggcttcagggttgcagaattaggtacctcactaggacgtgttggttagttgtgatgttttgtactccattgctcttggaaagttgttgctctctttgtttttcctctgagaacaatctgatgtttaatatacatacaagtgaactgatgtgttcaatttaccgttgatggcttactgctcccaaaaaaaaaaaaaaaaaaaaaaaaaaaaaaggac

SEQ ID NO: 21480 - DNA, 5876 bp, Zea mays
  misc_feature (2255)..(2255): n is a, c, g, or t
  misc_feature (2279)..(2280): n is a, c, g, or t
  misc_feature (3500)..(3500): n is a, c, g, or t
cgcggggatccccacgaacgcttgcggggagcatttcttccccatccccgttccccgcggggataaatccccaacggggatccccatccccgtttaaattacaattaagacatatgtactttgctattaatgttaaatattgtcgcttatacacattgtcagatataagaaatcattatgcacacatcaaaataaacacatttgtacaattagtgatctcttgataaggtaattatttatttttgttgttaactagtacaaaaaacatagtcacgtgcaagtttaacgggtctccgcggggaacggggatggggaatgcttccccgtccccatccccgtttacccgttgggggataaattttccccgtttatatccccgcgggggaagtttcttccccatccccatcccctaatggaggaattccccgcggggaatcgggtatcgggtccccattgccatctctaagcagcactggcagagccgatagctgtggtggtaccgcgctagtgctcatgactagagcagagcctgcggatgtgtggcacttcagtgatgcagatctggagcagaccggtgacgaaccgatggcgctgcatgtgcagcgacgcaacgcccacttttccccgtccttcttccatccttgttttaagaacaaaatccagctgttgtatctactgatcaagtcaaggtcatgtgtggctgtgtgtgtactctcccacctttgctttgatcaggaaactaatcagcatttatggcttcatttatcacattggaacgaatgatgcgcagcaggcaacaagtgcagaagaagatgcagagcatctcatccatgagttccggcaccttggcaagtctatcatgggatgtgcagctcatctacttgtcatgattcaagtactctagtgaaggtggagccgtggtcacggacagctttcctcgctttctttctttctctctctctctctttccatcaaaagaaatggtgaacaaagcaatgtgtaatcatccagaagaccaaaaacatacaggccactatacttgaacagcttttcgtgtatacagaaaagaaccggcgtcctctttttctttctctattcaacaggggcaactaacagcagagagcaaatctgtgcatactatccgaaaagaaaaggaaaaaaagagctgtgtctcagctttcggaggatccagatgtttatgctgttctactcttgttttgctgctctcaacgtactacggatacaatgtgctctaagatgaggaagacccagttttgttgtttctgaccagattttggacaaagagctctcctgcacggtaggatgaccgaacctgataaaaatcaaatgatataaagtgagttcttgttgcattagctataccatgatgtgtggtacattagctatatacattgtagtgcttatttcagagtggtggcatattagtttgttttggtatttaccatttagagggtaaaactggagggagtaatcagctgcatgtaacacttaccaagggtccgctagcaacatatcggaaaccgaccgattccccatactccttccaaaactggaacttttcaggagtcacatactctcttactgttagatgtctttctgttggctgcgatatcaaattgttaatagcaggaagatgggacggcaggatatctagattcaataggtgctgcgtgccttgcgctaacctgcaagtactggcccaaagtaaggatgtcaacaccgattgcccgcagatccatcatggcttgtttcacctcttcatcagtctctccaagaccaagcatgatagaagactttgtaaccatgccctccctgcaagcttttgcatgcttgagaactgccaagctctgatcatacctgtaaacatgaggcgacagaaaaaatgtttacaatgtcagggatcatgattcatcagaaagaacataagtacaaaggttagataggcattgccagaaaatactagtttaataatttctatgaataatgccattaacaaaaaaactcggccgggaagggaaagaccgccctcccgatattatactaagaagagaccgaaacatggtcacggccgagaaaatcccagaacctttgcccctcatcactagcaggtcgtcaccacccactctacaacggcccaaccagagggtggcgcgcaggatgtaacccgagagcgggcgagccacaacgaggagattttttcaaccaagcccaaaattcgccatcgagggggatcnaaactgagacctggaggtgctacnngaaattacgctagaggccctttcgcaataatgtcattaacactaacattagcgttgagatcaagagttatatcaaatctacccaaatgaacatagcatgccatatgaactcatgaaaattgggtgcaatggcatgttagctagctagttattatctaaaaaatgttagtggccatataaaggaaatccattcaatgattgcaaactaactaacattagaaagtaacacaatcaggaatttatcaaattaatttctgtaatactttgtttaaacttgtaatgtgtataacacatctctgtttcttttcacatgttgtgtaatacaacatgttcatgcatgttgtgttattgcttcgccagcagcttgctacctaaaaatatagttcttgaattgataaatgtcgttggaactggatcaagtttagattcatggttgccaggaaaatggatttaactattaagactgattccacaaacaaaaacgcataagtggcctgagttgatcatactcaaatgcacaattatgttgggaattgctgaaagccaagatccagcaacgaaaaggtacaacactttgtttttctttgctaggccagtttcatccaggacatggtagattattctcatggaataagggatgtaaacataaccatgctactccatgccaacttctcccgagagttacactggttagaacatttaagtccaggtctcaatgaaacctgtgcgaccagtccaggttcgatggctggcacaaacttcttaagggaaaaaagcatgcgagaaggggcatctctccccctggttgagtcttattttaaactatgctattccatgaatgaagtagaaacaaatggaactagtttcaacaaaagagctctagttatatatgtaggtacatcaactatcttaggcatccagagaccctcaagattcacacaagcacattaccacgaacctaagatgagatgctcatttcaattccaaaaggctgcgtcactcagggaatatttgatgatggtaatagtacatgcacccacatgtacaagtggaataaacatattgcaaatgagaatacaacaatgttaaatggccaaaagtctggaacttgactgtttaaaattaaatctttcagaactttcagcggatagtaatacctaggggtgaataacatgtgggaatgtactgccaaaaagagttacatgcggaaatcaagttaantgtacttcagagtttatatttcacaaattcttaaagaaacacaatactgtgccactgaaaataactgaaccacattaccctgcccggggatccctcacaatcctctgcagactcctcacagtttcaatgttgtgcgcataaacatctaggccagagttagccaaagatgagatggcctccaggtcacctcgaaaatctgaggttaagcactccaccagtattccaggtttgagctcctgaagcgaaaattcagaaaacatcagccagtacttgtacccaagttcaaattctaacaaagtaagacacaacacagagcaaaaagcatggataaggctgacctttaaagctttcactgtttgagcaaaatggctacttccaccatcaggtaagtcatctctatcgacactggttagcacgacataatctactctggaaagaacagcattccttaaatcagccatgtaatcaaccacataaacagaaaatgaacagtggttaacatacagcttatagtaaaaatgtgtctgctttgatataccaattacaatttcatcgatcagtcactcagaatgatgagaacctaacagtttctaatctgcagatgatcaaccaggcaggaagatcatacccccagcttgcaacagccaaagccgtgtttagaggctccaggggatccggcggcggtggcttgttgctggtcttcacagcgcagaatcgacacccgcgcgtgcaggtgtcaccaagcaccatgatggtggccgtggcgatgccgtccccttcgccgccggcccctccacctccgttccaacactgtgcgcccccaaaaaacaagcggttccgtcagaacccaacactgagaccaaagcgctgttctcgcgggtaggtactgacgcgacggcgtcacgcggagggaggcgtcatccgtgtgcgtacctcgccgatgttggggcactgtgcctcgacgcagacggtgttgagcttgagctcgccgatggactcccgcaggcgagcgtacttctcgccctgcgcagcgcgctgccgcagccaagcgggcttcttcacctccggatccctcccggtgtacggccccgcgggcgccctagacgccgtccccaccggtggcgccgcctcagcgtggcaccgtgccacggctaccaggccccgtctaccgccgcgtccggccagtaccggaggccgcagcggccgcgcgagggagctctgcatcgttgtcggccggtggaatcgggcgcggcgtcgggcacagtggaggcgatgggttccaggcggggaggacgggtaagcgttcccgtttcaccccttgtgtagtagaacagggggtcgatattaggccggcgatgataccaaggttggtctttcttcgcctcgcctacctctgcctaccgaagtcgttgcgatgaattgggtctaaatcgacgtgggtcagcgggtgcgggtgctcgtagctcacgaactaacatttctttgataagtgatctaagctggaaatcgcacagttgcctaaggcaaacagctccacattccgcaaggaatgttggggaatctgatgaaaggaagaccggcagaacatgatcaacaaggaacaactcaaacatttccacccaagactagcggccaagagcccaagactcaagagtagctcaataacagtatgtctgctgcgtatatctgctggtctataggtacggagattagactaggtcttcggcaatcggcatgcaattttctgcatctcgtctcctgtaaaataagactcgtgcagctgaatattccgatggcaagtcgttttaaaacctgttggtataaaataaacccatggctcagggccaggatactttaaaacctgacggaaagatgatgatacaaataggtcggacaataatatttgctgatggccacaccaccaccctttccattccccgtcccgtctagtctagatcgacgaggccaccaaacggaacgcgcgcctcgttctggacaagccgttcgcgtcgcaccgcctggccccgctcccgtctatttttgtcagtcgtggctcggggcgtgtcattttccgcggcggagtttgttcgccgactagacgacatgacttgcgctgagttgggcgttcggtttcgagtgtggcaggcagtgtgggtgaactgcttggaaatcaaatgaccgaaccaagtttctaggtgacagcagtttggccaaactccgctacagatgtctcgtctccgatgtatcatgtgtgtgaaggaagggttattgccttattgggagcttcagttcaggacaatcctgctgcaggagctgatgcgtcgtcaaatgtccaaactccgctagagatgtctcgtctccgatttctggtacttc

SEQ ID NO: 21481 - DNA, 1550 bp, Zea mays
ttttttttttttttttagaagaccaaaaacatacaggtcactatacttgaacagcttttcgtgtatacagaaaagaaccggcgtcctctttttctttctctattcaacagggggcaactaacagcagagagcaaatctgtgcatactatccgaaaagaaaaggaaaaaaaagagctgtgtctcagctttcggaggatccagatgtttatgctgttctactcttgttttgctgctctcaacgtactacggatacaatgtgctctaagatgaggaagacccagttttgttatttctgaccaaattttggacaaagagctctcctgcacgataggatgaccgaaccaagggtccgctagcaacatatcggaaaccgaccgattccccatactccttccaaaactgaaacttttcaggagtcacatactctcttactgttagatgtctttctgttggctgcaagtactggcccaaagtaaggatgtcaacaccgattgcccgcagatccatcatggcttgtttcacctcttcatcagtctctccaagaccaagcatgatagaagactttgtaaccatgccctccctgcaagcttttgcatgcttgagaactgccaagctctgatcataccctgcccggggatccctcacaatcctctgtagactcctcacagtttcaatgttgtgcgcataaacatctaggccagagctagccaaagatgagatggcctccaagtcacctcgaaaatccgaggttaagcactccaccagtattccaggtttgagctcctttaaagctttcactgtctgagcaaaatggctacttccaccatcaggtaagtcatctctatcgacactggttagcacgacataatctactccccagcttgcaacagccaaagccgtgtttagaggctccaggggatccggcggcggtggcttgttgctggtcttcacagcgcagaaccgacacccgcgcgtgcaggtgtcaccaagcaccatgatggtggccgtggcgatgccgtccccttcgccgccggcccctccacctccgttccaacactcgccgatgttggggcactgtgcctcgacgcagacggtgttgagcttgagctcgccgatggactcccgcaggcgagcgtacttctcgccctgcgcagcgcgctgccgcagccacgcgggcttcttcacctccggatccctcccggtgtacggccccgcgggcgccctagacgccgtccccaccggtggcgccgcctcagcgtggcaccgtgccacggctaccaggccccgtctaccgccgcgtccggccagtaccggaggccgcagcggccgcgcgagggagctctgcatcgttgtcggccggtggaatcgggcgcggcgtcgggcacagtggaggcgatgggttccaggcggggaggacgggtaagcgttcccgtttcaccccttgtgtagtagaacagggggtcgatattaggccggcgatgataccaaggttggtctttcttcgcctcgcctacctctgcctaccgaagtcgttgcgatgaattgggtct

SEQ ID NO: 21482 - DNA, 1155 bp, Zea mays
  misc_feature (8)..(66): n is a, c, g, or t
gaaccccnnnnnnnnnnnnnnnnnnnnnnnnnnnnnnnnnnnnnnnnnnnnnnnnnnnnnnnnnnngctcaaatacttccgaaaagagcgcacaaaactactatgatgaacattccgaacaggtaacagatagtctcaaaatgctgaacaacgacctacaaatccttgcatacatagttcatatgctcaaagaatatatagcgtgccactgcagacagacaggagatggtgacaaagcaaaataatggcagaaaacattacacctacttacacgctcacaaagcagctacagcaaaaagaatggccgtcaccagcctcagcgcaccagcactggtcaaaacggcgccatttgtggggcccgagcagtcgtcattgttgccactgaagcatcccgggtggatggctgccttcggcacttcgccatccaccttgaagctggtagtcggcttgccgtcactgaacaggacgcaccagaagtacggtccaccgccatcggtgccgctcacagccgccccgacctccgtgtggttcttgctgcgcagtatctggaggcccttcgcgtcgttcaccaacaagacgccaaaggcctcagctggagccaagtactgggactggcaagccaccagccttccggtgatcttggagagggttgtggcctggacgccacaggtcggggcgaacgtgtcggtgaagcttgactccatcggcttcttgtcgtccacctggtcacaatggccttcgtatgctttgatgtactgcagagcgatgcatcccaaaccttggttgtccgaaacagaagatgccttgccagcagtgcggttgctgttgatcagtgccacgagctcatcagcagggttgctcttgctgtcggcggccgaggcggcagagagcaggaacgccggcagcagcagcagggtggccagcagcggccgcgcgaacatcgccatccggtgattccttcgcgccaccccaaacgcgcgcgggcaggagactgtttgggatctagcgggacaggagctcctgcttgtgcgcgtgtgcgtgcgctcgagctcggttgggagcgtgggagtggaggagcaggacaggagtgtcaagtactatctcttgttctcttctccgttctccggcccgatgcccgccgcgagcgcgctttat

SEQ ID NO: 21483 - DNA, 1278 bp, Zea mays
gatatcaatctccccccggactcagctaagaacatgtatacggccagtgcacatttgagcccctataaagggaacaacatctggcacttgagggcggcggtgtcatgccgcagttgcttctgttttttttttttttttttctctccctccaaaacttcttctctatcggctctacagatatgtacacagttagcaatttatttcagtttgacatggatcacactaatacaaagcgatgtacaaatgccaagagaggagagatctcgcccttcacagggggttaaaaaaacacagaacatctacaaagagaaccgcccggtcacaatgccaaactagctgcaaaactgctgatgtaaggcctactcgcttcctcagagataacctcacctcttccctgagtaatgaatcatttcttctgctctcctatgcggaaccgcgcaggtatccagcgacgccattgatatttgaactgtctttgattccacttcaccgtgattactatcaaattcatcacgctgatttggtttgaggacaaagtgggatgaggcagggcaacaccgtcccctcgattttttggatcacgccgccacctaaaactactccggtgttcacctcgcccctacgcgactctcatccaaacactattgaaactgtggccaccttcttccatcccttcatgtacatccaaccaaacacaccctaagtctctcaggtttctgtgatacgtaccttcgactgaatatttccaagccaagtaaatttctacaaaggcaaagcataatgctgatgcccagatattatcagccttgacaagaagcagtcacatgttatgagagtaaaacagctactcatttgaataggcgtccgtaaaatcgttgattctttccttaataatctgcagttcctcatgaagcaaaacgaagaccttcttcatcaatttatgtcttgttcctgattcatgatacatgtctctgagtctttctaaggtgttataatactgttccttgcctctttcttttccaacattgagatcatcctgaacctttaaaaattctgacatagttttgtctatctgactattcaagtaagaataaaccccatacttctcattgtactcctgcacataatccttgtattgtgaaaaatcttttattggatctttaagttccggagcatctttatcatacttggagaaaaacaaattatcatcatctgaagaactgccccttctcttcctacctgtctttgtctcaatcaaagagtcgttcctattctttc

SEQ ID NO: 21484 - DNA, 1182 bp, Zea mays
ggtagcgaaagctttgacattttgcaggctctggagatcacagaagccagagtgtagctacaaaaaaaactgatcgattttacacgcatccgcgcatacagtgtcgagccagcgacaggtttggcgtatgccaagggcagcgtcaggttcattatttgctaacccagacagcttcggcgcgacgacgacaatcctactcctatgaacagcaaaatctcctcctaacgctggacgtttggtgctgcagagattctaccgtctccaccagttccatctgcttttccaccgcagcctgcagcgcctgttgagcataatcctaacagtcacctaaacagcaacacaaaagctaaggaactgtcaatatgtagactaagaatgagagcggtgcaactgtcaactgaccatagcacgagtattgaggaggaagtcttgaggattaaagtagagcatcctgatgatccccattctgtctttaatgatagagtgaagggacagctgaaggttactagagcttttggtgctggttttctaaagaagccaaaatttaacgaggcactacttgagatgttcagcatcgactatgttggaacatcaccatatatcagctgcaacccttctgtacttcaccatcgtctctgtgcaaatgatcggtttcttgtactgtcctcagatggattgtatcaatatttcagcaatgatgaggtagtttcgcatgtgttgtggttcatggaaaatgtaccagagggagacccagcgcaataccttgtagctgaacttctttgtcgggcagccaagaagaatggaatgaattttcacgagctactggatatcccccagggtgatcgtcggaaataccatgatgatgtttctgttatggtaatctcacttgaaggaagaatctggcgatcttctggatgagtgttgaaacatgacctggtctgttccttgcagccttgcttagtgtagtaaatcgactcaatcaggaaaggcaccaatgtcttgctgtctttatttttcaaccatgttcaaattctggcaatccatgtgccttctctgtcttatacgttttggatttgcgctgcattcttgggcagtccgaattgacgtatacatgttcttctcttttgttattaggaagaaaaggttctttggagggcagatatgtttccccggtgttccctt

SEQ ID NO: 21485 - DNA, 2379 bp, Zea mays
tcgcgatctagaactagtttggggggttttttttttttttttttttttttagcgaaagctttgacattttgcaggctctggagatcacagaagccagagtgtagctacaaaaaaaactgatcgattttacacgcatccgcgcatacagtgtcgagccagcgacaggtttggcgtatgccaagggcagcgtcaggttcattatttgctaacccagacagcttcggcgcgacgacgacaatcctactcctatgaacagcaaaatctcctcctaacgctggacgtttggtgctgcagagattctaccgtctccaccagttccatctgcttttccaccgcagcctgcagcgcgtttttcgtcgcctccagttcagcctcgagggattttatccgatcgaaggactgcatcaatacaagttctttctccttcggcatatccggaggtttgctcatgaggtgatcacacagtgactcgagcttcttgaggcgtcgtaaacaagcactcatgtcctcttccctttgaggttctggttcctgtgctgcggcacagggttggacggtttctagatatctttcttgccggtagacggaaaggtggaagaaagatgatatcctgatcaagagcgtgatcagtccagtagcaaggttttccagagtccttccagcggatgtaccatgcaaactaatgtaagcattccctaaattatttagccacccaaaggtaggaaaatatttacggcaagtcaactgaatgggcatctccatttgaggggtggcctgaggagatccaggagttgtatctaggagatgcttactgctagaactacaaaatatcgaagtatctgaccccttgacttcttcatgaactggggttagtaaactgtggtccgtactcttttggacaactgttaaaccaacgtcatcaacatccgactcagattcagcatttgatatgtcactaagcatgcccttcaggttttctgcccttagggaagagccacttctttcgtccccgtcagaaacttgctttatttctctagtactaccaccttccatactgtgtattagcttcataatgacagggtcattccatggacccctgttagacctgaggcaaccacccttctcactgcatgtgcatgatccgccaagaaattttggcaattcacttgagtcaataacttcgataagtctgctctggtagttggaaccaagaacatggatcttggaagaagtttttgggtctaggaatcccttaacactgttccagatcaacttaaacccactgcctgcattcacaacatacatctgatgtagcgtctcgggatagtagtcactgtctattctctgcatacgttggacaagctcccttgcggtctttgagaaattcttgaaccccacaccatggacgtccagtatggtggtagtggagtcaatatgtctcttggctgacagtgtgcaggcagggaacctctccctgaatgccctctcgaactcctgcacatggtacttgatgtagcgatccaccgaggtgatctgcatgagcttgttcggatcaactttgccgagcctctcaatgtacacgggccggccttcacggtcgacgccatggtagccctgaggatagtagtggagtacatcgttgagctcgtcgaactcaaagtcctccaagattgtgtcggtaccaaactctttcctccacctcagcatctctgaccacatttgcattgccttgtcggaatcaaacttcctggctttcagaaacctcagcatcatgtggtagtcgtcgtgcttgtcggggaggaggcggtgcgcggcgagacggtcgcggaaggcggcgacggcgcgctcctcctcggcgtcgcggacgtcctcgatggagatggccgcggggaaccggaagtcagtgacgcgacgccgggcgcgcttcttccgtagcgcgtggatggccttgagcggcagggacccgatcttccggcgccgccggtcgtcctcggagctggggtcgcacagagatatctcgtgctcgtcggcatggctcactgacattgctgtgactctgtgtcaaatttgggattgcgcgcagtatcggagctcccgagatcgatcgaacaggagcttcttgcactcgctcgctggtcgattttcccccctaatgaagcccgcgagatcccgattgtagggtaggcagagcagtggaggactaggttcctgccgtccgctgcaggtaaccgctgcggtgttgcgttccggctggcggcggcggcctatctccggcgacggcgagactggaaggggcagtggcccgattaggatgttctaggtaatggtctcgtgccaccagggccgagggcggggcgcggcggggatgcgtgcggaact

SEQ ID NO: 21486 - DNA, 4090 bp, Zea mays
gacatgcatgtcgagtgagacttgtgcgccaagacttgtatcgaacgtttggaattttgttggtcgcgcaagaaactaaggtttttttcccgttttcagatgagaatttttaatcaaagaggggacaaatggcgtagcgtggccattaagccaaagccggcctgcctgtctgcctgcgcaagcgtttcaagtcagaaacaaaattacgacccacgaattaaactattatgacgcgttaaaaaaaagacattagaatttccttggtaaacctgcaacgagagaaggggaaaagtactgagagaaaaaacatcattcaggagcaagagttttacagaaatctgtcggaaagaggcaaacaaaacaagaagaggaggcaacgcaagcaacagccaaaacaggcggcggcggcgagcgagggagcagcgttgcaaaccaccagctccccctctggagtctcgtctcgcttccactccactgcgctgtgctcttccactccactgcctcctccctccctcgctcacacagcttccaacgattccattcccagctccctccctcctctccccaactttttcctccgtcccccgttcctcccctcccaacccatttcaaatcgcaccaaaacccccccgaggacctgcagcgaggcctcccctctccgcgctcgccctagcctagccaggcatccgccccccgcctagatcccccattcctcggccccatcgctctctcgcccgcccgccgccggcggccagattccggatccgccgggaggtctcgttcggagacgggaggcgccgcccgtgcctgcctgatcgctcgctgagacttggcggcgggtcctggcatgggattgcggcgccggggcatttccccgaccaggcggcgggcggcggcctaagatgcgagggcggctggcccggggtgtggggcaccagctcggggaccgcttctcgccgtgcgccggcgtccgcctgctcatgctgccggccgcccggggccctcggcgacgggcattggggcgcgctcttcccgcgggctgctgagacgcggacgcgccgcgccgcgccaccagcctcccgccggccatgggcaacagcacgtcccgcgtcgtcggctgcttcgcgccgcccgacaaggccggcggcgtcgacctcgacttcctcgagccgctcgacgaagggctcggccactccttctgctacgtccgcccgggcggcggcgccgccgcagactcgcccgcgatcacgccctccaactccgagcgctacacgctcgattccagcgtcatggactcggagacccgcagcgggtccttccgccaggagcctgccgacgacctggccgccgccgccgccgctgccgccggtctgcagcggccctgcaggagcttcggcgagactaccttccggaccatatcgggggcctccgtcagcgcgaacgcgtcctccgccaggacgggcaacctcgccgtctccctcgccggtgacgtgcaggagcccgccgccgcgttcgagagcaccgcctccttcgccgccgtgcccttgcagccggtgccgcgaggctcgggggcgctcaacaccttcctgtcgggcccgctggagagaggattcgcgtccggcccgctggacaagggctccggcttcatgtctgggccattggacaagggagccttcatgtcaggccccatcgatggtggcagcagaagcaacttctcagcacctctttcctatggcgggaggaaggctcgtctcgggcgtcttgtacataggatcagcagacccatgaaaaccgcattgtccagaacattcagcaggagctcacaaaatccaggctgggttcaaaagtttctctcgcatcctatgactcaactgccctgggcaagggacgcaaagtccagatcagaaggctcacagaatggcttggaacccgggatacctgaacatgagtataatgtgacaaggaaccttcagtgggctcatggaaaggcaggggaagatagggtgcatgttgttctatccgaagagcaaggatggctattcattggaatttacgatggttttagtggccctgatgcacctgactttctaatgagcactctatacaaggccatcgataaagaactggaaggactgctctgggtctacgaagacagctctgaaaggagtgatcatgtatctactcatgaagagggtgaatcagttgctgcttctgtggatgctcctcatggtgatagtgaccagttccagagtgacagtgggaaacaagaacaagttggtaattttggaaaacaaaatatttcacctggaaagggttgtgatgaaagtgtcttgcaggttcagccaaactgtaccagcagtgaagagaaaaatttggctacacagggttcaactagtgacaagttggccagggatgagatagttgaggaaatggctggagctgatctgggaaatgatctccaaagtagagaatctcaaaactcaaacagaggtctttcagatacagatctaaacaccaattgtagctgtgcaacagaaaccacttcctattgtgatcagcatgccaaattcttgaaagaaaacagaaagagcaagcgtctttttgagcttcttgagatggaattgctagaagattataacaaaaggttatctaaggcatcaccaaaggaaaggaaaataccgaacttgcatgttacacaggcgggcactgcagacgtgctctcaagaaacacagctgaagtctccaggtgttcattggcagcaactggagaatgttttgatgattctgaagatcttggaagttcaagacacgctgatagtgtacttggcatagatattaaagagtgtactgggtgttccatatctacatcttcatcagggcacaagcaagttacgagaagatttgtgttcggatcaaagttgaggaagatgtacaaaaagcaaaaaatgctgcaaaagaagtttttcccgtggaactacgattggcacagagatcaacctcatgttgatgaaagtgttataaaatcttcagaggtcactaggagatgtaagtcagggcccgtagagcatgatgctgtattgagggcgatgtcacgggcgctggaaacgacagaggaagcatacatggatattgtggaaaatgagcttgatagacacccagaacttgcattaatgggttcttgtgtccttgtaatgttaatgaaggaccaggatgtatatgtcatgaatcttggggacagccgagctatcttggcacaggacaatgatcagtacaatagctcaagtttctcaaaaggagatttacgacatcgaaacaggtcaagggagtcacttgttcgtgttgaacttgataggatatcggaagagtcgccgatgcataatcctaacagtcacctaaacagcaacacaaaagctaaggaactgtcaatatgtagactaagaatgagagcggtgcaactgtcaactgaccatagcacgagtattgaggaggtaatgattctgttaaacaaatgctattattgtgttcacttcctaatgacatctgctatcctatacatatttggctttgagttcttcgtctactaatcctgcagaattagcggttcctttgatcagttttctttatttccttaaggaaacagcaaaatgatatacaaacttcttgccttagttaatacagcgatgctaaaatatgtagtttcctaatttgagttgattttgtggcacagaatttgatagagctgattgtaatggagtttaaacctcttcacatatccaaatcattttcttgatactgtaaattcatgatattatggttttaaaaggtattgtaagtagttcagctatcaggaaaccagcaaccgaaaattttatttagaaaataatcctttttatgatttatatgtgcttctgtgatttttggatactattcctttaggttggtcaaaaataattcaaacccactagctatcttgaactttttgaagtactagtttggcttatcatcaccacatggttagaaatacctcttggcttaaaacttgtgcctggtactacattcaaatcactgtgcccgtttgtcctgaactgca

SEQ ID NO: 21487 - DNA, 1325 bp, Zea mays
cacacgcgtccgcccacgcgtccgcccacgcgtccgcggacgcgtgggtttttcccatggaactatgattggcacagagatcaacctcatgttgatgaaagtgttataaaatcttcagaagtcactaggagatgtaagtcgggaccagtagaacatgatgctgtattgagggcaatgtcacgggcacttgaaataacagaggaagcgtacatgaaaattgtggaaaaggagcttgatagatacccagagcttgcatccacgcgttcgtgtgtccttgtaatgttaatgaaggaccaggatgtatatgtcatgaatcttggcgacagccgagctatcttggcacaggacaatgatcactttgatcagtacgatagctcaagtttctcaaaaggagatttacaacatcgaaataggtcagggcggtcacttgtccgtgtggagcttgataggatatcggaagagtcgccgatgcataatcctaacagtcacctaaacagcaacgcaaaagctaaggaactgtcaatatgtagactaaaaatgagagcggttcaattgtcaactgaccatagcacgagtattgaggaggaagtcttgaggattaaagtagaacatcctgatgatccacaagctgtctttaatggtagagtgaagggacagctgaaggttacaagagcttttggtgctggttttctaaagaagccaaaatttaacgaggcactacttgagatgttccgcatcgactatgttggaacatcaccatatatcagctgcaatcctgctgtacttcaccaccgtctctgcgcaaatgataggtttcttgtgctgtcttcagatggattgtatcaatatttcagcaatgatgaggtagtttcgcatgtgctttggttcatggaaaatgtaccagagggagacccagcgcaataccttgtagctgaacttctttgtcgggcagccaagaagaatggaatgaattttcacgagctactggatatcccccagggcgatcgtcggaaataccatgacgatgtttctgttatggtagtctcgcttgaaggaagaatctggcgatcttctggatgagtgtttgaaacatgacctggtctgttccttgcagccttacttagtggtagtaaatctcaatcaggaaaggcaccaatgtcttgctctgtcttaatttttcaaccatgtttcaaattctggcagtccatgtgccttttctgtcttctgcattttgaacttgcgctgcattcttgggcggtctgaattgacgtatacaggtttttcacttttgttattatgaaaaaaagggacaattttgagggcag

SEQ ID NO: 21488 - DNA, 1421 bp, Zea mays
cccacgcgtccggggatggactggcgccgcctccgggccggccggcagtctactcgctgacgttcgacagatcccagagcaccctcggcggggccgccgccagctgtggcggtagccgtggcatccccaagggtttcggctccgtgaacatggacgagctgctccggagcatctggaccgcagaggagacccaggccaaggcctccgcctccgcccctatcgcaggagcgagcgcggggatgccgcccacgccgatgcagcggcagggatcgtcgctcacactgccccgcatgctcagcaccaagacggtcgacgaggcgtggagaaatctcgtgcgcgacgaaccgccgcagggggcggacggcggcggacaccagccgccccaccgccagtcaacgctcggggagatgactctggaggagttcttggtcagagctggcgcggtcaaggagaaccccgctcctgctcctccagcgccgccacccatggtgccgccgcggccggtacctgttgcccctaaaagctccgccttttttggggatttaccgggtgccgacgacgacgcagctacggcagcggtagggtttgcaccggtcggcatgggggatctggccctgataccgcccagggcggcaggcatgggaggcagcgccatggctgtgcaaacagcggtgagccagcttgattctgtcgggaagggatacagcgacctgtcgtcgctgacggagccgcaaactttttcgtttgaaagaatgattcgggggagaaggcatggaggcggagtggagaaagtggtggagaggcggcggcggaggatgatcaagaacagggagtccgccgcgaggtcccgagcgcgcaaacaggcttatacaatggagttagaagccgaagttcagaaactcagagagcagaatcaggaactggagaggaaacaggcagaaattatggaaatgcagaacaacgaggtatcagaaatgttgaaggatccattcggacggaagaaacggctgtgcttgcgaagaacgttgacggccccctggtgacgattgcctagaacagcacatgacttgcacttgctacgtacctgcaggggcgtttgggatctgtagataatttctctcctatagtgtagcgatgaacccatgaacatgaacataatctaaatgattgtactgttagctcccttctgccgcttacgtagtactgcagtaccgtagtggtggagtcgaaaactgacatgtaaattatgtacgtagtagagaacaaaatggagtgaagccggtcgcaagagttgtggcttcagtcatcctccagagcttgtgcagagttgcctaggttttgcatcttgctggcacatccagagcttgtgcagagttgtctaggttttgccatcttccagtgcttgtgcagagattgaatga

SEQ ID NO: 21489 - DNA, 3283 bp, Zea mays
  misc_feature (2020)..(2020): n is a, c, g, or t
catataaatttcgttcacagttcctacgaaattcgtagcgtttcaaacggggcaaatctgaaacactcatattggggcaaagtgagggcccattgattttctttcctcttccacgtagctccgcaactgatctttttacgagtataacgctcttcaaaattaaattgagatatggatgacctgcatttcttttcggaactgtacctgtcatagacgggaaacctaccaccatgtttccatcaatacaccagaggaactgacaccgggtcccgctgacaggtaagccggcagaggccctacatggcagcaacctagcaccaggtgctcttctcccggggtcgaagatatttttgtacgtatgctaacaatctaacatcccaacaaccgacggaggcaagccccccacgtggcgacatatggttggctgctcgtcgcgtgctcggagaccacgacctgtgacttgtgagcgtatccagattatataatctaaaatattattaactaacattctctaagtgttagtttaaaatttgttaatgtttttaactaacatttcctaagtgttagtttaaattttttttggtgctgagctgagacagggacaggcaagcaggaggaaggggatggagtggcgccgttagcgaggcaaggttcagtctactcgttgacgttcgacagatcccagagcaccctcggcggggccgccgccagctgtggcggtagccgtggcatccccaagggtttcggctccgtgaacatggacgagctgctccggagcatctggaccgcagaggagacccaggccaaggcctccgcctctatcgcaggagcgagcgcggggatgccccccacgccgatgcagcggcagggatcgtcgctcacactgccccgcatgctcagcaccaagacggtcgacgaggcgtggagaaatctcgtgcgcgacgaaccgccgcagggggcggacggcggcggacaccagccgccccaccgccagtcaacgctcggggagatgactctggaggagttcttggtcagagctggcgcggtcaaggagaaccccgcttctgctcctccagcgccgccacccatggtgccgccgcggccggtacctgttgcccctaaaagctccgccttttttggggatttaccgggtgccgacgacgacgcagctacggcagcggtagggtttgcaccggtcggcatggtggatctggccctgataccgcccagggcggcaggcatgggaggcagcgccatggctgtgcaaacagcggtgagccagcttgattctgtcgggaagggatacagcgacctgtcgtcgctgacggagccgcaaactttttcgtttgaaagaatgattcgggggagaaggcatggaggcggagtggagaaagtggtggagaggcggcggcggaggatgatcaagaacagggagtccgccgcgaggtcccgagcgcgcaaacaggtcacagccttttgctgaattcatgcatgtcttactgaccaaggcaccaagcaatttgttagtgcttcttgactcatgacattgtgaactttcgcaattcgattataatcagagtcatcgtactcttcctggttactgtgttaccgttcttttaaagcagacaaattttccactttgctgtttcggttaaaaagaatcttattttactgcataggcttatacaatggagttagaagccgaagttcagaaactcagagagcagaatcaggaactggagaggaaacaggtgtcttttctacaattttctctacacacttctagatttgcttcttctttgggatttggtgcattgcctctcgacgagcatttatttttagtcattctgaaatagatagtttcagcatgctccatgttgcctgcatcaattgtattcccctgaatcattcactatctacttcactcctgtatttttcactgcatttccagaatgaaaaaggtgcaccctgtatatttctggatatcaataattgccttgcgccacacttcatggaccangtttttaagtgaacattaccaaagaaggggcacggcaacagttcgtcagcatataaatagatttgacgtccggatcacatttcgtgtagcttacaatgagactcgttcatccggatcacatttcgcgtagttacagtgatactgcgtccataggctagtgctaaacacttttagggataggcacacatccttgcacctcagactgttctttggatgtgctcatagtactgactactgatcattcatttcttcgtaatgcaggcagaaattatggaaatgcagaacaacgaggtaactgttaattcaatatactctattaatctcgcgttgtgagttgctagctgagcaaccagtcgctaaattggttgtaggattcagttaggggaatcatacttccagagtttctctctattccacacatctagttcaacttagcttcagatatactgcatcatccttgtacactgctcagcctgtgagttcatcatatcgattatgattgtctgttactcaacaaactatacttttcattattcaaagaaaagaaatcgaattaggtttttaagagagctggctttgatacatgtgtgttagctcaatcccctgagggctccatgagtgtatgcacggctagctcgttattactggggttttttggagttcttcctcttacctcgtttaaaaaaaattactgacagaatctggagcagtttacaaatgtacggcattgcttccagcacatataattttattttttttcataatgacccgcctgtttttgcatttggtaacgatgactgcaaattttggcgacaggtatcagaaatgttaaaggatccattcggacggaagaaacggctgtgcttgcgaagaacgttgacggccccctggtgacgattgcctagaacaccacatgacttgcacttgctacgtacctgcaggggcgtttgggatctgtagataatttctctcctatagtgtagcgatgaacccatgaacatgaacataatctaaatgattgtactgttagctcccttctgccgcttacgtagtactggagtaccgtattggtggagtcgaaaactgacatgtaaattatgtacgtagtagagaacaaaatggagtgaagccggtcgcaagagttgtggcttcagccaaaaaaaaaaaaaaaagcagagttgcctaggttttgcatcttgctggcacatccagactccagagcttgtgcagagttgtctaggttttgccatcttccagagcttg

SEQ ID NO: 21490 - DNA, 584 bp, Zea mays
aacccgacggagcactccccgctccactgcgcgccccaagacctggatcccctgcgctgcctttctcttctgcatcattcgcaatctcaggtcacggaactctatccactcgtcagcaccaagctagctagtcctcgtgcccttcggacgagaggcgcatgtgactcggtaaggaggaggagggaggagatcaggagatggaattcaagaactgcgggtcgtcgtcgcagccccggccggcggtggtagtgggcgaggaggcggcgttggcgagacagggatcagtctactcgttgacgttcgacgaattccagagcgcgctcggcggggccgccaccggcggtggcggtggcggcagcatccccaaggatttcggttccatgaacatggacgaactgctccggagcatctggaccgcggaggagacccaggccatggcctccgcttctggcgctggagcgggtgcggggatgccgccaacgtcgctgcagcggcaagggtcgtcgctcacactggccccgcacgctcagcaccaagacggtcgacgaagtgtggcgcaatctcgtgcgcgacgagccgctgca

SEQ ID NO: 21491 - DNA, 1560 bp, Zea mays
  misc_feature (20)..(20): n is a, c, g, or t
gcgttctcccagcgtccggnaaaaaaggccaatggggggaggggtgggaatttatttagaagacatgagccgtcgcgtgattgcggagggtgcagcaactctccgaatgaagcaggatatgcaaaatgagaacaaaaatatgtctgacttaatagcatatagaataaaattcacccctcatccacatgctggtgataattggtgtatctatccgagctatgactatgctcattgcatggtggattctcttgaaaacatcacacattcgctgtgcacacttgagtttgacatacgccgcccttcatactactggctacttgttgccttgggcctttatcaaccatatgtgtgggaatattcgaggctaaacatatcaaatactgtgatgtctaaaagaaagttgaatcgacttgtgacagagaactgggtagatgggtgggatgatccccgcttgttgacactggctggactccggcggcggggagtatcatcaaccgcaataaattcctttatccgtggaatcgggataacaagaagtgacaacagcttaattcgcgttgatcgtctagaataccacatcagggaagagcttaacaaaacagcccctcgaaccatggttgttttgcgccctctaaaggtggtaataactaacttggaagaaggaaaagtactagaccttgatgggaaaatgtggccagatgcttctgatactgatgcttcctctcactataagcttccgttctcaagaactgtctacattgagaaaactgattttcgccttaaggactcaaaagactactatgggctggcccctggtaaatctgtcatgctaaggtatgcgttccccataaaatgtacagacgttatctatggtgatactcctgatgatatcgttgaaattcgagcagaatatgatcctttgaagacttctaaacttaagggtgttctgcactgggttgctgagccagcacctggtgtcgaaccattgaaggtggaagtaagactattcgagaaattgttcatgtcagagaatcctgctgaattggaggattggcttggtgatcttaacccgcactcgaaagaggtgataaaggacgcttatgctgtaccatcgcttgccactgcagttctgggcgacaagttccagtttgagcggcttggttacttcgccgtggacacggactccactcctgagaagctcgtgttcaacagaactgtcaccctccgtgattcattcggtaaagctggaccaaagtgacttccagtgtaatgtaggtagggcgtgggtgctcggttgcataggcgcacctgagctatacttttttttgaagaagaaaatgatcttgtaatacagaacagcctaaaggcctcaatctttgtaaaatttacatgtgactgcagtgcagcttgtttgcttcgaaggaatcagattttgtatggtagtgttagtgcgccggttcccagtctggtttgatgatgtcaagagctactcatgctatcataatcgaagttctgtttcttccctgcgtcaaaaaaagagttgatattggttttttgggc

SEQ ID NO: 21492 - DNA, 625 bp, Zea mays
atagtcccagatgatattgttggaaattcgagctgaaatatgctccctttgaagccttataagatgaaggggtgttcttcatgggattgctgagccagcacctggtgtatagccattgaaggtggaagtaatattattcgagaaattgttcatgtcagagaatcctgctgaattggaagattggcttggcgatcttaacccacactcgaaagaggtgataaaggatgcttatgctgtaccatcacttgccactgcggttctgggtgacaagttccagtttgagcggcttggttacttcgccgtggatactgactccacacctgagaaactcgtgttcaacagaactgttaccctccgtgattcgttcgggaaagctggacccaagtgactgttcagtgtaatttagggagggcgctggttttgatcggttgcagaggcgcacctgaactatacactttgtgaagaaaatggtcgtctaatacagaacagttttaaagaccttactcttcataaaatttacatgtgactgtagcttgtttacttcgaatcagattttgtatgatagtgtttttgtcccgattcccattctgtttgatgtcatactatcgcgatgggcgttctgttt

SEQ ID NO: 21493 - DNA, 2990 bp, Zea mays
aatccaacaatccaaaccacccacaccacaccaccctgctcttcacgagctcctccactctgttcttccccgccgctccactgcgcccttcctcccgccgggatcctaaaccctagcccctagggagcgggagaggctgctgctgctgctgctaccgcggcggcgccggagtggatgggcaccgggggagacgggagcaaggcgggcccggcgctgccgctggaggcgctgctggcgctcggcctcgaccagcgcaccgccgagaacgcgctcgtcaacgccaaggtcaccgccaacctcgcctccgtcatagccgaggctggtataaaggaatgcgacaagtcagtcggcaatcttctgtatgcagtcgccaccaagtacccaactaatgcacttgttcaccgtcctgtccttattagctatgtcttgtcaacaaagataaagaaccccgcacagctagatgctgctctgtcatttcttactaatactggtcctgattctctagatgtggttaaatttgaagaagcatgtggtgtaggtgtggttgtttctattgaggaaattaaatctactgttactgatgtgcttgaggagaatatggaagctataaaggagcagcgatatcacataaatgttggtacactatgcggacaggtcaggaagagacacccctggggtgatgctaaggcgataaaggaggaaattgacaagaggcttgcagaaatcctaggtcccaagacagaagctgacaatataaaaccagtgaaaaagaagaaggaaaaaccagcaaaagttgaggagaaaaaagttgcagttgccactgctgccccaccatctgaggaggaattgaacccgtacactatatttccccaaccagaggaaaacttcaaggttcatacagaaatatttttcagtgatgggaacatatggagagcgcataacacaaaggaaattttagaaaaacatcttaaagcaactggaggaaaagtgatgacccgttttccaccagaacctaatggatatcttcatattggtcatgccaaggctatgtttattgattttggtctggctaaggagcgaaatggccattgctaccttagatttgatgacacaaatccagaagctgaaaagaaagaatacatagatcacattcaggaaatcgtccattggatgggatgggagccctacaaagtaacatacacgagtgactatttccaagctttgtatgaacatgccgttgagttaatacagaaagggctagcatatgtggatcaccagactgcagaagaaatcaaggaatacagggaaaagaagatggatagtccatggaggggtaggccaattgaagagtctctgaaattatttgaagacatgaggcgtgggttgattgcagagggtgcagcaactctccgtatgaagcaggatatgcaaaatgagaacaaaaatatgtctgacttaatagcatatagaataaaattcaccccccatccacatgctggcgacaagtggtgtgtctatccgagctatgactacgctcattgcatggtggattctcttgaaaacatcacacattcgctgtgcacacttgagtttgacatacgtcgcccttcatactactggctacttgttgccttgggcctttatcaaccatatgtgtgggaatattcgaggctaaacatatcaaatactgtgatgtctaaaagaaagttgaatcgacttgtgacagagaagtgggtagatgggtgggatgatccccgcttgttgacactggctggtctccggcgacggggagtatcatcaactgcaataaattcctttattcgtggaatcgggataacgagaagtgacaatagcttaattcgtgttgatcgtctagaatatcacatcagggaggagcttaacaaaacagcccctcgaaccatggttgttttgcgacctctaaaggtggtaataactaacttggaagaaggaaaagtactagaccttgatggcaaaatgtggcctgatgcttctgatactgatgcttcctcccactataaggttccgttctcaagaactgtctacattgagaaaactgattttcgcctaaaggactcaaaagactactatgggctagcccctggtaaatctgtcatgctaaggtatgcgttccccataaaatgcacagatgttatctctggtgatagtcctgatgatattgttgaaattcgagctgaatatgatcctttgaagacttctaaactgaagggtgttcttcactggattgctgagccagcacctggtgtagagccattgaaggtggaagtaagattattcgagaaattgttcatgtcagagaatcctgctgaattggaagattggcttggcgatcttaacccacactcgaaagaggtgataaaggatgcttatgctgtaccatcacttgccactgcggttctgggtgacaagttccagtttgagcggcttggttacttcgccgtggatactgactccacacctgagaaactcgtgttcaacagaactgttaccctccgtgattcgttcgggaaagctggacccaagtgactgttcagtgtaatttagggagggcgctggttttgatcggttgcagaggcgcacctgaactatacagtttgtgaagaaaatggtcgtctaatacagaacagtttaaaggccttactctttataaaatttagggttttttaatctggtgccctcagttttggtgatgtgttcatttataccccttgtttacttcgaatcagattttgtatgatagtgttagtgtcccgatacaaaaaaaaaaaaaaaagccgtcccgggttcgagccccagcctctgcatattatgcgggtaaggcttggcgcttaaaaatacaattcccaagaccccgcccagtgcgggaagcctacagccctgggtacgcctagtgttagtgtcccgattcccattctgtttgatgtcatactattgtgatgggagttctgttt

SEQ ID NO: 21494 - DNA, 1243 bp, Zea mays
tttttgtttgtgtctgtttttgtgtacagagaaaaccaagaattgagtacaataatccatccactggaaacatgcgtaatggtggtactgttacaattcaagctgcattaataacacatcagtaaaattctctgtaatgtaacacggttgtacccacaaaccagaagcctactatatatcttcaatcatgttgtgagcagaagataaacaaggcctttcaaatattcaactatctcggacccgccaagttttgaaattccaaatactctgtccacaaacgttattggaacctcttcaatgtgataacctttccttgtagccctaacaatcatctccatctggaacacgtagcccttgctgacacatgaggagattaagtcttccaggacatctcgcttatatagcctaaatgatccggttaaatctgaagctccaggctgcagtaacgtttgtgcaagaacatttgcacctctgctagtcagcttgcgcatgagattccaaccatggacaccaccattcttaacataacgtgtgccagttacaatgtcagctccagtttccttttgcttcctaataaagcttggcaagtattttggatggtgagataggtccgcgtccatgataatgacaaattcccctgaggcatgctttagtccatgtaaatatgcggtaccaagccctagcttccttggcctagctcgcagtaaaacaaaatcttcaccatatacttgctgcagctgttttacaatgtcctgagttccatctggactaccatcatccacaataatgatctcaaagttcacatccgggaggtgcttgaagatgaggtagacgatgagggcgacgttgaggcgttcgttgtaggtaggcacgatgatgctgtacgcgcgcttgcggctcgccgccgcctccatggggacgaggcagatgtaggtcgaggtgaggcgaggggcggaatccgggtcgaggtgaggagaggggaccgaggtggagctggggcggtggggcctggggctgggcggctggatggcggctctttagcggcggaggggcgaggagccgaggtcctcgccggacagccgggtggggagtcttgacgcgccaccgtctggtcgccggcgggtgcgcgtcgccggcgtgccctgctgtggccaccagtctggacagggaaatagagggaggaggaggaaccgtggaactgattcaaagggatacaaatgacataatgacatccatgatcgat

SEQ ID NO: 21495 - DNA, 811 bp, Zea mays
aacataacgtgtgccagttacaatgtcagctccagtttccttttgcttcctaataaagcttggcaagtattttggatggtgagataggtccgcgtccatgataatgacaaattcccctgaggcatgctttagtccatgtaaatatgcggtaccaagccctagcttccttggcctagctcgcagtaaaacaaaatcttcaccatatacttgctgcagctgttttacaatgtcctgagttccatctggactaccatcatccacaataatgatctcaaagttcacatccgggaggtgcttgaagatgaggtagacgatgagggcgacgttgaggcgttcgttgtaggtaggcacgatgatgctgtacgcgcgcttgcggctcgccgccgcctccatggggacgaggcagatgtaggtcgaggtgaggcgaggggcggaatccgggtcgaggtgaggagaggggaccgaggtggagctggggcggtggggcctggggctgggcggctggatggcggctctttagcggcggaggggcgaggagccgaggtcctcgccggacagccgggtggggagtcttgacgcgccaccgtctgggaagaagaggaagccagtaaggggcgccgcgaggagaagctgagaactagacaaggggcggcgccgggaaacctggtcgccggcgggtgcgcgtcgccggcgtgccctgctgtggccaccagtctggacagggaaatagagggaggaggaggaaccgtggaactgattcaaagggatacaaatgacataatgaccccggccggcctcgaggtacccaatg

SEQ ID NO: 21496 - DNA, 1481 bp, Zea mays
taggggccttttttttttggggtgttgcttctttttattggcattttcaaaagcaaatgtttcacaatcacatgtaatgcaaatcagtgtcatttgaccatctctctgatgctcgaagctatagaagatgaaatgttattgcttccgagatcatattacatgaattgcagagaaacggaaaagtcagtgttctctcatcgtttcgttcctctacaattataaccagaatgaactctagcaaaaccataaagtagttcgatgcacctgaattgtagaacaagttttatgagcgcttaggtttctcggtcgagtatagcacggtacagcacactgacatcaggtgatatgagctcgcttgacagagtgatagatcgtccttcaaagttcaaagcatatctagaatcgccggccaccggaattataagcacgaccaccagggtattgagcacgctgctcagaactacgaccacgacctctgcccccatcatggaactctggataatctggacgatcgctaaatgattcatactggccagaagcataaccccgatgagcctcaccataagcacctccagcagcaacaggaggcgtgcctgctgccgttgggttataaccatgctgctccccagccgtggaattgctggcgtaatggctcatgctggcgtgctggtattgctgctggcgtgctagagattccttgcgcaggaactcatctctatagttcgcttgccgagctctaagtgctaatagtttctcctggtactgtgtatttatatccttcaatctctccatgtgtctagaattttcagcatcctctgcctcctgtagttccttggatagcaaaataatgtcttcatggaaactttgttcaagaccttcgaatgtccgaggaagattataattctcgtatcttgtttcagttcgttcagtacgaggttgctccctagactccttgctgggctgcttttctagaccaacctttgtatcagatctctgcccatcataaaaggattgcgcacctccagcaccttgggcttcgttatatgcatatgatggaacctggcttggcgcatttggtccacctcgatcccattgactctgtcttgccttagggggagtgtactgatgctccgcagaagcttgtgcaggatctcttccagtgtagctattctcagggtgtttctgtaccctttgctgtgcctggtagtgatgcaactgggcagcaaccatggagttaatatccgcttcaccatattgcccctgccgtctcattctatcctgcatctcttgggtgcttgtcgacggctaagagatcgacgaaggcctcggcacctgcgtatggcggcggcggcggcggcgagcggcgttacccaaccctgtcgtcgcaggagaggggaagaaccgggagagaaacagagggcacgcgggctgaagggtgaaaggatgtcccccggcccgccggccgtggcccccgcctgttc

SEQ ID NO: 21497 - DNA, 2298 bp, Zea mays
  misc_feature (2296)..(2298): n is a, c, g, or t
ttttttttttttttttcgacataaaaagggtactgtgtgcccgtttcctctttcagtgcatatatatattggtgattttttacagtacatgatttaaatgctaagaataataaagtcagggtgagaaggcaggcatacattattaatcagtctctctccaacatggagcacattgtcaaaccgtcggtggcccgacgatgctagctgcatgcatctgcatcatgcatgtcgttgagtcccacggtttgatttgccattaggatcgactaaacaaaaaaacatggttggtggtgcggtggttgtgtctgctagcacagcatgggtacctttctttctgttgacctttagatgcacgtcttgatgcagacggtatagagaggagggtaggcaggcccctggactggacccccggtgctgctggctctctgctacgtactgctgcaccagcatcccattcccagatcccagtacgtagaatggacgtactgtacgcgacaggaacagtagtgtgttacttggcatgctagcttgttgttactgtacctcctacatgttgctcctcttctaccttccctccctgctgatgagttgcagttgcagttgcaggtagaatagagccgccaaaagcaaaccgcatgctctcgtccttgctgcacactgcagactgcccaagatgcatgtgcaccgtccctccactccactcatgtcatagactcatcatagtgtagtgttgatcagacagcatctgtcggccggcggatcaataccggagcttccttccttcattccctccctgtgtgtgtgttcattcaatttcatgcgagcattcgttcggtgcatcgtccgcacggcttcttcttggcctcgtgcaggaatccaacagctagctaggtgcctcatcctgcagggaatcacgtggaccaccattcggttgcaaccactgatacaggtttaattttaccagcctttttatttatttatttaaaggctcaatcaatcagcttcagctggtgcacattccagtaataatggtacccattctccagcatgtctcgtctcccccgccggcatcctttcttctctgctaatcttttcagacagaatagctttccttttttccaaaacagatttgatgccatcaagctgcttgaaaatcttcaatggctcactcatctccttcaaggcattggtatgcttccctccacagatcggatcataagggcagacagaattgagaagcatgccagtgtctggagggatgccgacatcattgtcttcaattcttacctgccaaattgcaggggaaaattaatcaccgtaaattatagcagaacacacccaaatgtgaaagcaagcaaggacgcataactctacagaagtcttgctttgcttggcactgccaggcatggggggtgggggggcgaagtaggcgctgctgcagttggtgcaaaggtggagccataacctcgatccaacatatgatggaacctggcttggcacatttggtccacctcgatcccattgactttgtcttgccttagggggagtgtactgatgctccgcagaagcttgtgcaggatctcttccagtgtagctattctcatggtgtttctgtaccctttgttgtgcctggtagtgatgcaactcgcaacgaccatggagttaatatccgcttcaccatattgcccatgccgtctcattctatcctaaaaatcaagccatttctttgcaacctgactgtggaaaaaggacgtgtactcagttgatcgtgcaagttgctgaagtactgtctcaggagatttgatgacttatccatttgtagccaaacctaaacaacgaagccaattcagtatgtgcatttattgattcatactatcttagtatttcagttacatgctatcttgtgtaaaaacctccaaataaggtggctatatcactcacttttcatcaggaaataataaagtgagtgcactgtattgtgctaattatatagcattataagagaactacatgaatcttcaatgataattatattgcaaaatctgaaaaatagatggtacagtgcaagtttaaagaaaagctagaaaataaaaacgtctaaaaaatatggtagcataaacataccgatcttttcctgccatcactcctagtttgtttggccgatttgagatatcaaaggaacaaaaattgtcaaaactaagtgtttttatttatctaataataaccaacacataatcatgcagtctataagagaaacaagttaagaatggagaattttaaaagggaaaccggacgnnn

SEQ ID NO: 21498 - DNA, 571 bp, Zea mays
  misc_feature (543)..(543): n is a, c, g, or t
tttttaagaaatagttcctttatttaaatcatgaattatgttggatagaaaaatagagagaaaatgtttgtatgcctgccaaattgcaggggaaaattaatcaccgtaaattatagcagaacacacccaaatgtgaaagcaagtaaggacgcataactctacagaagtcttgctttgcttggcactgccaggcatggggggtgggggtggggggcgaagtaggcgctgctgcagttggtgcaaaggtggagccataacctcgatccaacatatgatggaacctggcttggcacatttggtccaccttgatcccattgactttgtcttgccttagggggagtgtactgatgctccgcagaagcttgtgcaggatctcttccagtgtagctattctcatggtgtttctgtaccctttgttgtgcctggtagtgatgcaactcgcaacgaccatggagttaatatccgcttcaccatattgcccatgccgtctcattctatcctaaaaatcaagccatttctttgcaacctgactgtggaaaaagnacgtgtactcagttgatcgtgcaagttg

SEQ ID NO: 21499 - DNA, 3043 bp, Zea mays
accgggccccccctcgagttttttttcctttttttaggtgaacattgtctattttttaaagacaattcatttattatacagaaataaaatactttaagttggtccagatgcactgaaatgtacacacaaaaaaatcatttggttaatatacagcctgcatattcttgcaatacatatatgacaacgctaagcctgtgcctctatctaagaaagataacatacaacacgcacacattgtccgaccgatattacaacatgttaagtttcgctatacagtatggacacgcgatgtgatgtgactaacatttctctctatataagagcatcctgcagctgagcttcataacgtgcaaagaatggccatgggaaacacaaccgccattcctatcccacctcaaaaaagccatgtacatggggggttaacgacgaaagatcaccaatgtgttcctgcatgctcactgcttagttggtatcccaaagctaatcgtatcgcgcacttgctccacctttggtaccggcgtcccaaattcacggacttagtttcatcagctaaagttggcatatgaagccgaatggcacttcacacaggattgatcatgccacttagccaagcttcaatgcttctctaagaccaaagctcatctggcagtgcccctttttccctagtgggttatttcccttctgcatcattgttacaaactcgttgtagtcgatccgaccatcattgtcctgatcaacgtcatggatgatatcttctaggtgtgcatcttctataccgaattcctcacatgctttttgtagctcatcatgagtaatataaccgctgccgtctttatcaaagtatgagaatgctgcgaagaggttgtcttctcgctcgactttgttcagatgtaaagttgcagctaggaactctccatagtcgatggaaccactgttatcaatatctgccgcttccattagtgttgtaatttctgagtcctttaagttagcaccaactctcttcaaaccaatttttagttcctccaacgtgatctgcccactattgtcagtgtccagcattttgaacatctctttcaatcctgcaatttcatcttcagacaaattttcagcaatgaccctaagggccatcttctttagtttattcattgcagaaaactgtttcaatctggttaagacagcagaatccagaggtttgtcaggagcaactccatctacacaaacccaaggatgacatagagcatcatgtgcagtcaatctctttctgggatcacgatttagcatcttcctaaccaaatcctttgcactctccgaaatgctgggccagggatcggatgaaaaatcaagaccacctttcagaacttgtttaaatatcccttgttcagattcagcccaaaacggaggaaccccactcaataagatataaattattacaccggcactccacacatcaacctcacagccatagcgttttttcagaacctcaggggcaacatagtaaggacttccaacgacatcagaaaatatttcacctggtttgaagaagatggagagcccgaaatcgatagcctttaagggtgcatcctccttttggttcacaaacaagaaattctcaggcttgaggtctctgtgcatcaccccaagtgaatggcatgcttcgacaaccccgatgatcacccgggccaactgtgcggcggctttctcagagtagtgcccccgctgtatgatcctatcgaacagctcccctccagcgcacagctccatgacgaggtgcacggctacagcgtcctcgtaggctcccacgatggatacgacgttggggtggccggccaggtggtgcatgatctggatctcgcggcgcacgtcctcgacgtcctcatcggtgacgagcttccgcttggcgattgacttgcaggcgaagtgcttcccggttgccttctcgacgcactggtaggtggtgccgaactgcccctgcccgagcttcttgcccagggtgtagacgtccttgagccgctcggagtcgcgcttcagcacggagccggcgaggaggccggcgctctgcacgcgcttcaccttgggcttgggcttgggcttgccgttaggattgggcggcgcggcggggcctaaggcggtggaggtggagtgtggcgggtgctcggagtcggagatggtgacagggttaggggccctggaggggggagagcagggagtggatgagctgggttcagcggtcggggaaggctcggcgcggtcagcggcggccgggggtcgccagagcacggccagggagacggtgttgaagaagctgtggcggtccgagggggcgctgggaccgatgcaggtgttccccatcgcgccggcgagggagcggcggccgccggaaccctaggcggcccgcggcggcataggcggtgaggggttggttggatttgatggagaatttggtgaggattggccgacccggccggctgtcacacggacatacggctgtagctgtctgcaacgatagtgctctactcgagattcccgtatatcctgctgtgacgccaactactgactaaaagttgttagtctttatctatcaaattgttttaaaaatcatcaaacatataattaagaaaaaaaatgtatcctaactcaaaaaagtaaaaaaaaaatgcaacataaagaaaattaaaattacataattagtaaaaaacgatatgtcatttttgtcttcacctctttagtatttttcttcatctcgtttcaatttcttgatcaattttttttatcaactatggattcttttcatatcatcgtccatattagtggtggtccaatccagcaactttataatttatgaagtgcttgtataaattttattgacttatcttctcatcgtccttgtaagattgctcaccactctcttcactatgatagcagatccattgctagtcacttacctttgtgttgcgcttttgtcctatcacagtagagcgtgttggtctgacactatctggcgacgtggagctatattcgccttttatgttgagacaagatgttg

SEQ ID NO: 21500 - DNA, 2044 bp, Zea mays
aagaatgcggagagccaacccactgccgtcccggacgcgtgggcggacgcgtgggcgaagccggagaatgaagagctagcctatcaaccatgcatggaagtagcaatggcacctgaatcagctacaaaccatgatccaatcctagcggctagcgatctctagtttatattacaattaggagcaagcgatccaattatcgatagagcgcgagatcgatcgatcatgccgggccgctcggtggtctccatcctcctcctcctcctccatggcctcctctgcctgcagctggctgccttggccgagatggacgacgacgacgtcatggaggacggcagctgcatgcatttcagtgtgtccccgccgcctgctccgccggaggacgcggatgagcggcgcgactatttccgcgccatgcaggccaaggatctgttccggcacgagcagatgatcacgatgatgggcagcgaccggaacggcagcagcaggaggcggcgggcgaaggagtcgtccaagctgccggaggtcatgtccgccacgtccatgttcgagctgccgatgcggagcgcgctgaacatcgcgcacgtgggcatgtacctggtgtcggtgcgcatcggcacgccggcgctgccgtacaacctggttttggacaccgccaccgacctgacgtggatcaactgtcgtctgcggcgccgcaagggcaagcactatgggcgacagtcgatggggcagacgatgtcggtgggcggggaaggcgcgacggcggcgaagaaggaggcgagcaagaactggtaccggccggccaagtcgtcgtcgtggcgcaggatccggtgctcgcagaaggagtgcgcggtgctgccctacaacacgtgccagagccccagcaaggcagagtcgtgcagctacttccagaagacgcaggacggcacggtgacgatcggcatctatggcaaggagaaggcgacggtgacggtgtcggacgggcggatggccaagctccccggtctcatcctgggctgctccgtcctggaggccggcggcagcgtggacgcccacgacggcgtgctgtcgctggggaacggcgacatgtccttcgccgtccacgccgccaagcgcttcgggcagcgcttctccttctgcctgctcagcgccaacagctcccgcgacgcctccagctacctcaccttcgggcccaacccggcggtgatgggtccgggcaccatggagacggacatcctgtacaacgtggacgtgaagcctgcatacggggccaaggtgacgggcgtcttggtgggcggggagcggctggacatcccggacgaggtgtgggacgccgagaggtttgtgggcggcggtgtcatcctagacacgagcacgtcggtgacgtcgctggtgccggaggcgtacgcgccggtgacggcggcgctggacaggcacctgtcgcacctgccgcgggtgtacgagctggagggcttcgagtactgctacaagtggaccttcaccggcgacggcgtggacccggcgcacaacgtgacgatacccagcttcacggtggaaatggcaggcggcgcgaggctggagccggaagccaagagcgtggtgatgccggaggtggagccaggggtggcgtgcctggccttcaggaagctgctacggggagggcccgggatattgggcaacgtgttcatgcaggagtacatctgggagattgaccacggcgacggcaagatcaggttcaggaaggacaagtgcaacacccatcatctccacaacagcagaggcggagaagttaataacaatgctgccgcctcctcaagcgtcgtgcatcgcgtcaattgattcattcctctcttctccatctaccaaaacaatacattttctttccaatttgttctaatgatctgatttctatctttcctgattgtaagatagatctcaggtctacatgctcatgaactaacatcgcctgaaaacagagtattgaaatatatatataaatgaatgtcatcccttgccaaaaaaaaaaaaaaaactttgctccaacaac

SEQ ID NO: 21501 - DNA, 1295 bp, Zea mays
actcctatgggcgattgggtccctcgaggccggccaagtcgtcgtcgtggcgcaggatccggtgctcgcagaaggagtgcgcgctgctgccctacaacacgtgccagagccccagcaaggcggagtcgtgcagctactaccagcagatgcaggacggcacgttgacgatgggcatctacggcaaggagaaggcgacggtgacggtgtcggacgggcgtatggccaagctccctggcctcatccttggctgctccgtcctggaggccggcggcagcgtggacgcccacgacggcgtgctctcgctggggaacggcgagatgtccttcgccgtccacgccgccaagcgcttcggccagcgcttctccttctgcctcctcagcgccaacagctcccgcgacgcctcgagctacctcaccttcggtcccaacccggcggtgatggggccgggcaccatggagacggacatcgtgtacaacgtggacgtgaagccggcgtacgggcccttggtgacgggcatcttcgtgggcggggagcgcctggacatcccgcaggagatctgggatgccgagaaggtggtcggcggcggcgtcatcctggacacgagcacgtcggtgacgtcgctggtgccggaggcgtacgcggcggtgacgagcgcactggacaggcacctgtcccacctgccgcgggtgtacgagctggacggcttcgagtactgctacaggtggaccttcgccggcgacggcgtggacctggcgcacaacgtgacggtgcccaggttgacggtggagatggccggtggcgcgaggctagagccggaagccaagagcgtggtgatgccggaggtagtgcccggggtggcgtgcctggcctttaggaagctgccgcggggagggcccgggatcttgggcaacgtgctcatgcaggagtacatctgggagatcgaccacggaaaggggaagatgaggttcaggaaggacaagtgcaacacccatcatctccacaacagcaaaggcggagaggtctataataataataatggcaattcctcctctactgtcgtgcatcgcgtcaattaattcgttctctcttctctatctctacaaaattaaaggaccagaccatgcatgcacttcgctgtatgtaacaaaagaagcaggtagctcagctgccttgcctgtgttatgtttatttcacttcttcatttgctgattatcttggagtatatacccactctgtaagaggattacattcataatgagagagaagcgggggttacatgtttaagccaaaaaaaa

SEQ ID NO: 21502 - DNA, 1079 bp, Zea mays
tccaccgcggtggcggccgcccttttttttttttttttttttttttttttttttttatgcacgccaccaacaaactttacgtttataatttattaaactttgtcgggatatcgtgtaaaagaattgaattacacgaattaaatcgttacagtgtgtgcagaatcatcgccggatgcagcacgccttggctacagcagaaaatttctgtactttgctgacacaggttgctgaaatacaagtttctgaaggggctcagaatatcaatgcaggtgtgcacaaaatagctaatgtatcccaggttctgaaaatatttcatggggctctatcaaatgggcgtgtgtcattgtagcatatatcccatacagcatcaattgcatcttttgcagcaccctctgagcagtatgggttgtttttcacagacatcagagcccgccttttgacacattcaggctcatgaccctttatcttcatgaaaccacgcaacaattcacgtttgtaatggcaatcaccactaaggtgattggctcgaatctcagagcaagcatggtgagcacaattcgtccagttcagatttttggcaacacagtcatcataagcatgtatcagttcatgaatcatgacctgagttatctcatcttgacaggtcatgtgattgcagcaaacttgtatcccttgctggctagcgtagccgccggcggaggagcaggtcgccgcccggatgaggcgcggccacaccaggcacccggcactctccatccgctccctcaggaaccgcaccgtgggatgtttgagcgcggagcggatgccctcgacgcattcttcgtgcggcatggcggggatcgaggagcgcttcggcgagggctcggaggactcgcggacgccagcctcggcgcgactgccgccgttcccctccgccatttccgtccccgtgccgtgcccgtgcccctctcccctacgccggcggcggctgcgtcgaggggtttaggttcagccggcggcggctgcgtcgcctcggttgggatgggacttgggagttggtttgggccagtcggaaaggttgttgggccggaaacttaacg

SEQ ID NO: 21503 - DNA, 1164 bp, Zea mays
gcacgccaccaacaaactttacgtttatgatttattaaaatctgtcgggatatcgtgcaaaagaattgaattgcacaaattaaatcgttacagtgtgtgcagactcatcgcgccatgcagcacgccttggctacagcagaaaatttctgtactttgctgacacaggttgctgaagtacaagtttctgaaggggctcagaacatcaatgcaggtgtgcacaaaatagctaatgtatcccaggttctgaaaagatttcatggggctctatcaaatgggcgtgtgtcattgtagcatatatcccatacagcatcaattgcatcttttgcagcaccctctgagcagtatgggttgtttttcacagacatcagagcccgccttttgacacattcaggctcatgaccctttatcttcatgaaaccacgcaacaattcacgtttgtaatggcaatcaccactaaggtgattggctcgaatctcagagcaagcatggtgagcacaattcttccagttcagatttttggcaacacagtcatcataggcatgtatcagttcatgaatcatgacctgagttatctcatcttgacaagtcatgtgattgcagcaaacttgtatcccttgctggctagcgtagccgccggcggaggagcaggtcgccgcccggatgaggcgcggccacaccaggcacccggcactctccatccgctccctcaggaaccgcaccgtgggatctgcgcggcggatcgacaggcggggtcagcgcacggagggtgacacgcggtggcctcgagagtcgagaccaaagaggaaaggtagagaggaagaatccgccgccgtggtggtggtggtggtgccggctgcggggcgcgcgtacgtttgagcgcggagcggatgccctcgacgcattcttcgtgcggcatggcggggatcgaggagcgcttcggcgagggctcggaggactcgcggacgccagcctcggcgcgactgccgccgttcccctccgccatttccgtccccgtgccgtgcccgtgcccctctcccctacgccggcggcggctgcgtcgaggggtttaggttcagccggcggcggctgcgtcgcctcggttgggatgggacttgggagttggtttgggccagtcggaaaggttgttgggccggaaacttaacg

SEQ ID NO: 21504 - DNA, 773 bp, Zea mays
tttttttttttttttttcggataacttttgctattattccaaagaagttgcgccagaggcacgttacaacatcaggtcggaagcactacggacaatatcatccacagacacctatgcacaatgcaacccgctgcatcgtcataatactccaacacctcccttagactctcgtccggtaagaccgaaggaggacctatgactctccgtaggttacaaccggtctagatctctccaataagcagtgtcgtggcaacaccctggcgagcgccgagaccagcaacgccccaaacacaatgtgggacatcattcaaatgtcccaccagagaggagccacgagccttgataaaaaaccagaacttgacctaaacgagagcgtagctcctctagctcggcctccagggctgttagaagagaaaacgataatgccaagggaaccaccgaggaatctagaaaacaaggggtgaatgccttactggacacatgaccatcagactcggcaagtcgagaccggagcagctcgacctcggcctcggcagcctcctacaccatacgaaaaactccataactctcccgggaagtccgagagagagagagagaggacaatggatctggccacgatgagcctatagacgacccctcggcagatcccatttaaggtgagagcctaagggccaagagcttggaggtaatggtaggcaaatgctcgcttaagtttttgaaagaaggaagaaacaaccatccctgccgtaagtagaaacagagtatgcaaagat

SEQ ID NO: 21505 - DNA, 1113 bp, Zea mays
tttttggttttttctggtcgaaagaaactcttgagagtagagattattattacacgacctcaactgcacaatatcattgccagatcgagatgaaacgaaattcctaatcaactgaattcaggtgacgggaagggaaacatccgcactgagtagatgtgcaattaccgcaccatcgcaaatgcaaggatgagacgcccgcccacaacacaaaaatctttgcaaattacaagtatgaagttcgatcagcatgttcatttgctgtggactgccccgaatatgcatagccccagtcggtgttttacagggtaaacaccacactggtgatgtccgggaatttctccttgatggccgccttgataccgctgccgatggattccggcccgtcgtacctcaccaggcagtcctcgccatcgacggccaacacatccacgctcccgccgtagttcgcgatcgctggccgcagtatgtccaggtgccggttcaccgcctcggccgttgtctccgccgccggctggtccccgtcgaacacctgacggatttccttgaaagcgtcgccgaacttctccttgagcacacgctcgatgcccatattcatcgtcgtcgtcgagctggggcagctgccgcaagctccttcgagcttgagggagatgacaccgtcctcgacggcaacgacggtgacgttgcccccgtcagagatgaggtacggccggacgtcgtccaggacgcggtcgacgttttccggggtcagctcgtacgtcgccgccgagtagaggccgcctcccggcgccggcggtgtggacgcggaggccgcgaccaggcatgcccgcgaaccggaggtccagatcttggagggtccggattggaggcaccgagggcgtgggaggggactcgatttggtgattcggatgcggattcgcggtggagggaacaagccgacggcggcggcggcaagggacgcttccatgggttgtgtggtttgcgtatgagcgtgcgcgtttgtgcttttgctgccgtcggccggggggcccgacggtcccgtgaaatatacattgtttgctccacataaatcaccaagttcgcctgatcttgatcttattcgcttgtagcaactgc

SEQ ID NO: 21506 - DNA, 1789 bp, Zea mays
gccccccctcgagtttttttttttttgggcttcgtgcctagacaacgattcgcaatgcacttccaaaagagtttgatgtcaaatcatattctggaacatcagagccacaaattttactacataagttaaatggaaatgaacgctggcatatccagtgctacattctcagttagaacaaagcttccattctatgtactctttctgctaatcctattgccatcgccaaacttcagaaataggccacattacttttgtggccactcagaacaggcaccaggataactggactcggagataagcctacgcagccccattgatctggcgcatcatcagctcattgccttcgcagctcccaagccttttcctccttcatttgtctagcaacagaaggaagccatttctctcccctaaccttctttagttcctgcaccctttcttcctccctcttggcttttgcctttgctgcagcttctctcacttccaatctagccaatgatctctcagatgctttctttgcagaaacaactatgtcactgccgtcgacaacaacagaccggagcatatgccggaacttctttgatttctcatcgacctcttccccaggcacgattcttggtcgcttgagttgcacgtgccatttatccgtagaatccatgctaataccaggtggtgcttttttaaataactttattcctcctcctgtttccatggggtctactaagttcaagcacggagctttgactatttcgagatttttctctaacatatcatccaacatgtttcttaccttgacctggtacagcttaagcccaggactctttggcttcccctcacgcggctcttccagatcagcgcggttgttcacctcgcggctgccgctagaggctgccttcgccacgccgttggacgaagggacgctgaacccaacggacgcgatggagtcaatggctgccttccacgcggcgtctccgtcatcctcgctgctgctgctcccgccgctcgctgccgggctcccgccgccgccacccattctattgctgttgttactcgagccgactgaacagtggacacgttcggcggcggccggtgccacttcccggctcctgtctggaccgctagtgggctttattataggtgtgggccggaccccagggtttcggaccgacctatggccgcgggcggaggctcgagccactgcaattagatgcctttggaaattctgcatcgggttttagctctccattatcatctccgcgacgaaaacaattctttttggcgatccacataaatgcttgtagggatatttcttcactatctctattttccgtggagataaatctctaagggcctgtttgtttccgttgattttgaggaattagaatctaactaatggagtagtctattttttagaatgtgatatttcataactttccaacatttatatataggtctatctcaaattcatgggatgagatatataaattgattctatagattacatgctacatttctaatgtacaacttataacaaactcttctatttgcttttttatagtataaatgtagtttataattatctctcatatgatttaggataatatacaagtaaattacatatacaaatataataacttaattagtttgtgtctaaattattattattggaatggaattcaattccaaccaaacaaacggggccttaatggattaggctgtcatttatcatattttctttcttttctaatctcttatcatgtattttgtttcttagtagacacatttatggccg

SEQ ID NO: 21507 - DNA, 1538 bp, Zea mays
cctaatcaaaaaaaaatccgcgccatggtcccccatcccgtccctcccctagtcccctccgacctcttctaaaaatcctggtggctggctctcgttgtcctcaagcagtcaagctcctcctcctcctccccccagtccctcccaggctcccaccccgccttgctcgcagcctccccaaaaccctagccctagccctagccctagccctagctctcccacacccgcactgggagatggacggcggcggcacgcaccgcacgccggaagacgtgttccgggatttccgcgcgcggcgggctggtatgatcaaagcgctcaccaccgacgtggagaagttctaccagcagtgtgacccagagaaagagaatctgtgtttgtatggtcttcccaatgaaacatgggaagtgaacctgcctgcagaggaggttcctcctgaacttccagagccagctctgggaattaattttgctcgtgacgggatggatgaaaaagattggctgtcactagtcgcggtgcacagtgatgcttggttgctggctgtggccttttacttcggtgcaagatttggttttgacaaagaatccaggaagcgcctttttgtcatgattaataacctccctacaatatatgaagttgtcacgggaactgccaagaagcaaaccaaggagaaaactcccaaaagcagcagcaagagcaataaagctggcccaaaaccgccacgccagccagaacccaactcaaggggttcgaagatgccacctccgaaggatgaggatgacagcggaggcgaggaagaggaggaagaggaagatcacgaaaacacgctgtgtggttcttgtggtgacaactacggacaggatgagttctggatatgctgtgatgcgtgcgagacttggttccatggcaagtgtgtcaagatcactcctgccaaggccgaacacatcaagcactacaagtgtccgaactgcagcggtagtggcaagagagcccgagcatgatgatgctggatatatccatctctcatgcctgacttgatgtaaaacacccacatggggaccgaatgcccgatggttgttgctttcagtgtaggaccagctgtagggtcttgatgtgctgtttgctgtagtatgtcaaagacgttctagatctattgttagtaactagcaactaattgtagtagcctgtatttcttcaatcttctcccagggcgcctgtgctgaactcaaactgttttagatctaagttgtgcattatgtatcactcatgttagtttgttaaaaaatgtgttagcattcgtatgaaacgccaaccatgtttacaaattaattaacttcaagtctatttgcgcgcaccggtggtttagtctccccagttgcagtttcccaagtatgttgtatgccctatcctctctagattctctagattttgagacgtattgctgcgtcatctttccatccagcagcgtatctttgcatactttctggggtatggtgtatgtaaaccagaacgtagtggggtttgacttttgctgtgctgca

SEQ ID NO: 21508 - DNA, 1166 bp, Zea mays
cgaggccggccgggagtcccctccgacctcttctaaaactcctggtggctggctctcgttgtcctcaagcagtcaagctcctcctcctcctcccccccagtccctcccaggctcccaccccgccttgctcgcagcctccccaaaaccctagccctagccctagccctagccctagccctagccctagctctcccacacccgcactgggagatggacggcggcggcacgcaccgcacgccggaagacgtgttccgggatttccgcgcgcggcgggctggtatgatcaaagcgctcaccaccgacgtggagaagttctaccagcagtgtgacccagagaaagagaatctgtgtttgtatggtcttcccaatgaaacatgggaagtgaacctgcctgcagaggaggttcctccagaacttccagagccagctctgggaattaattttgctcgtgacgggatggatgaaaaagattggctgtcactagtcgcggtgcacagtgatgcttggttgctggctgtggccttttacttcggtgcaagatttggttttgacaaagaatccaggaagcgtctttttgtcatgattaataacctccctacaatatatgaagttgtcacgggaactgccaagaagcaaaccaaggagaaaactcccaaaagcagcagcaagagcaataaagctggcccaaaaccgccacgccagccagaacccaactcaaggggttcgaagatgccacctccgaaggatgaggatgacagcggaggcgaggaagaggaggaagaggaagatcacgaaaacacgctgtggtggttcttgtggtgacaactacggacaggatgagttctggatatgctgtgatgcgtgcgagacttggttccatggcaagtgtgtcaagatcactcctgccaaggccgaacacatcaagcactacaagtgtccgaactgcagcggtagtggcaagagagcccgagcatgatgatgctggatatatccatctctcatgcctgacttgatgtaaaacacccacatagagaccgaaaaaacagatggttgttgctttcagtgtaggaccagctgtagggtcatagatgtgctgtttgctgtagtatgtcaaagacgttctagatctattgttagtaactagcaactaattgtagtagcctgta

SEQ ID NO: 21509 - DNA, 7831 bp, Zea mays
gggcagtagggctcccccgctgttcgcaggcgccctgatgagcagcaacagaggtaagaggcggttaataatgagcaactcgatcgatcgtagggaatgcatcggccgtgctatatctagctagccatcctccatttcttgtcgggttcctcgtgactgtgtgtggttgagatgtagcatcgtcatcgtgcagtgcagagtggtgcggccgtacatatataaaggcgaacgaacgaacggcgatggaacgaaaagcgagccagtcgctggagtggagtctgatagatgatggcacatcacgatactggaccatcatgagtcggcgccgatgctgcaagctgaccatgaaataatctttttttttttttggcggctctagagatgatttgcgcggactggcttattattttacctgcgaattgcatcttatcttatgacgatttttacggctttagagatactgtacattgcatcttatgatggtttttacggcttttatagtccggtagaattgcttgttccggatacctcatgccttattcacttattcccattatacatgaatttgatagaattgataaatatttagaaaaactttaacttgcttgagatttaaattcactcaatcacgttcaatctatatggattgagaactaatcggacaaaccctcgagctgttaaaccagaactctgaaaccccgtacatattgcttgttggacataaggtcggagtgataatatagtagcggcgggtgaggctactatatatggtcactgctagtgcctttttcttttcttttcatgacatcaaaagacgggtccgtggctttgactgttattattttttcgtggattgacctcttgtacattaaatcagcgttttttttcgtctaacttaaattatcatgtacgttgccgtcttttctcgtcctatatataccttgtttccagattgaaaggtcaaaaaacggatttcctttttttaaaaaagaaaaccttttaaactgcgctacaactctgggaaaacagtgtccgcacgatgaatttcacagcgatttcgttattatcactgatggcattcagttcactaacccgtcactatataaaatgcgcctgtcaagcaaattaaattgcagtgtggcatggtgacctgtcatgaggcacggtaatccaaacctattctagtcaatcgaagtaacaacgtttcccttcccctgcctcgttccggtggagatcatcaaatatctacgcacactctttagtcttaacgtccccctgtcgtgtacgacaccggttcgctcggcatgcagatcgttgactcggattcacaatcccgtcattccatttcccaccaccggaaaaaaaaggctgcgctgtaaacgtcagaacgtgaccgaaccgaaccacacgtctcacgccggccggccgttccacggcctcagtccacctccggcgctcgcgctccgctcgatcggtcaggcggaatatgaaagaaaaggcgaaattgggaaccaaaaccaagggccctggcccctggggatttccgattctccgcggagcaggtaccagctcacgcgcgccctggccgtgggatctcacacgcggcagcccgccgcgcgccaggatcccgagggaaatcgcgcggaagccgcccgtgccggggacagcgacacctggggcgcggccgcggacagcgaccggcccctgctgctcgcgcgtccagatcggacgacagcgccgggccccggccccccgatcgaaaagcccccggatcgcacgcgcatctcccttgtccccagctcgatcggtcatcggtcactccccctccctccctctcccccgcgccgctaccgcctcgcctataaaaggtcccggccgtgtccccgcctcggctcaggctctcatctctagcattccagcaccagcagcggcctggagtagtggtttctcttgcgtccgcctcagggcttgcgtccccccgatctgtgtcgcggaggcggcgagcggcttggccggccgggagagagtgagatcgagctgcgagggcgacactcggacggaggtcggtcgagaagaggccaacgatcgacgagaggagaaggagatcacgcagccgcctgcaagaaattcagcagcaggagaggatcgatcgaggaagatgtgcatggacggcgccgtgccggtgaagagggtctggctcggcatcgccgcgcgcctcggcctccgccgaaagaccggtacgtacgcttgctatacctgcatgcctctaaggctccggacctactcgtcgtccctagctagctctcagtcgtcggtcgacggtcgtacgccgtcgccgattagcgggtagtactagcactagcacctcgttcgacctttggttactgtttctcatcgacggacggccgggctggtgaatgcaggcctgaggaagctgaggaaggaggtgcgcacgtgcgagtaccgcgacgtgcacgtcatgtgggagatgctgcgggcgacggacgggccggcggtgccgctggcggagaaggaggccgcggcggcggcggccgtcgcggccgccgcaggcgccaggaagaggaggaacgcgtggaggcgcttcgtctactactgctgcgcgttctgagcgacgcgcgtcgatcgatcgatcagcctggctgatgaacccaacggccggcgtcctagctttgtgctggtgatcgtcctaggctagctagctcctcaaagatccaaggtcgcgagctttgtgaacccgtgaccaaaatctcgaacgtgatcgggccatcgggggcgtcatcaggggaacgtgagctcgttcgagactcgagactatcatcgtctcgtcccccggcgaagatcgagagtatgagtacataggaagagtttggagtgggtgcggagagaaagggatgatcgagatgtacaaaaaataacttcgaaccaaagaagacttttgctttgattcgtgccagtgcttacccctcccttttgcctttgtcagttactcctaaaaagatcgttgacgatcgagaggaggcacacagcacacaggtgtatcatgacatgcatatacctagagtacagctggaaccactggagtcgtcagcgtgtgaagacgaggaaagcacgtagtcacgctggtcttcccgcaaccgcaagaaaaaaaacaaaaagacatgtggaacggagctggtgttgatcatcactaccagtctaccacccttctgttctacaactgacgcactcaagcagtcaagactcgggctcaaccagccgcataacatcctggcgtttcttgcttgcaagcgatggccaactacttgagctttatggacgctgttttgcggcaaatccgcgtagcccaagactgtctggatccaacggagagcgaggtggtgcggcgttgtgcacagcgcatgcagtagcagatatgaaaggaagatttgtgccaacattttacaattatccaggagaaaaagaaagaaaggagagatacaactcccctaagcctgttcatttggctttaatccatatcggatttaatccaaaataaacggtagcatgaaaaatgctatggagtgaaaaaaatatcaatattttagtatattatttatgatatcttaataagcttgcgctcatatcacatccactagaaaacgatagaatgaaggcaagttatgttggttgcccggcccggcggcccccgccctgttccaatcataagttcacaattatcatttgtctgcatgcatgtatgagttcggttaagatctgtgtgtctgattccggcttcatagaagcccagaatatcaatatttttatgactgcgcgaccaaagagttcagaagttgttcgctggctttaatataatccgaaatggcttctactgtttttatagtgttttatctctatagattacagctatagcagtctcaataagtggtgttttatctctatagattacagctatagcagtctcaataggtggctttaattcgaagcgaacaacttccgtgctgttcgacacaaactgaaaccgccgtatcttttaagccttgtgcgatattcacctcaattcactgctaatcagcaatataactgtatattctgttacaacagattacatcgcggaatctatataactcgagatggcgtacatgggaaaatagaaggaaactaaaccaacgcccagtaatgacacgagtatttattattttttttaaagaggaagaacccagcttttatgaaagcagtatgaggtacacaatactaggaactctagttttacagagagaagtaaaagagactactattaccaggtttagatcccgtagacatccgtgggtataaaagccgaagggctaaagttcttcatccagcagataacctcgcgcttcacatggatgctacgctcctgattcacctcctttagcaacacattccacttctacaacaaggatatagcaatatagactacatcagtaggtgacttcgagaatctcttttcgatgaccatctgcccatcttgttcctagtgatccaaagagcgcaaaaaaaaaaaaaaaaccagaaacatgattaatctaattggtagaggccccttgccctaaagccaagtctcaggaaagtccttaggagataagaggcacagattcccatttgaaaacaacttacagaatcgtcaaatcaacttacctaagacacatttgaaggaaatgtgatcatttgattatgggatagcacaaacacaaaaattgtcattactcttccaacctctcttagtattactgtttagaaaaatgtgttgtagtttaccactctgacattcttagtggcaatgtcataactttcttggtttactcacctgggaacagtgaaataccataagctacgcttaagcagcactaatcagaaatcctgcacttcatgacagtgtgtgactccagagccctgaaaattggcagaacagatagaaatggggatattccttgatgagaatccatccagaaaaggaggcttgattgacatcaaagatttgatcaacatgaatcagcagatggcattcacaaatttagaaacatgattgcaccttgctgaatctccatcgctgtccatgggcatgacgtgcaatccacgaaccactaacctgcaagacaactgaaaaagtacaagatctcgagataatggtcagctaaacataagaattcaggtaatttcctctaggttaaaaggataatatttctcaatcacatatgggttcttagatctgagacagcagaaacttgggggtttcaagtacagtgtaaccgtgtaagctgcttgtgaaccaaacctaatttgagctggttattccaggtagcttcaataaggatagcaagcacctggtagcattcagccctgtcatcctggctaccaaggttcctagcgggcactatagatatgtggaaacgtcaaaaaaacaagtcaactgctaaataaacatcatatgcaagaaaaattagactatataacaacatttgacatgctaagaacatagcaaaaagttcgacaaagacaccatgcttctcaacaaaagaggatagtctgaactcgagcttaccattctaagagggtaaaatccttttttttttacagccctatatgtctataccacttcagtgagataataaaaagaaaaatatgctcaagacaagcaaagttttgtaatggcgtacagaaacaaagcataagttgtgtcaaaaactcaaaataaaacccaaattactaaactaagacatttgtcccaaagcaactgatgcaatctttggcttgaaccgggtgctgaaaaaatcacaacaaagaataccaactccaagaaaacattaaaaaatgttaacaaaaaaacatttgaataacttttgcgcagttcatggatactagaacaaggtgcatagtgtattcaagcaaaattccaaaacagaatatgaaactctttgatgctagaataaaagaaactacagtaatagacgcgaaatcaacacaccagagaaccagaaatttgattcgattagaaaagtacatatcataattcctggcaactcaactgtaactcatttggatgaatgcatgtttagaacatttatattccagccataggagagaatttgaagtccttgggcattttttacttttttttattcaacagggttaaacttttatcttaattgcaagcggtcattgccataatctgaatacaatgtacaggagcaatgagccattaaaggcatcatttatgatcattgaccactgagaaaaatgattacatttaagtctgtaataagaggaaaatgctctattacaacatcgcaacaaatctctaaaagtactaccggaacatagtctttgtgccaagagttgagagtatgtttgtcaaggagttactcagcttgacctggacatcagccaaccatattgattcttcgatttattatcgacgggctatatattcccaaaaaagaatttatgctacactgtccattgcatcaccctttgttcacttgttgggccttggtatttcttgcccgtgactccgtgagtgctgcaatactcagattttgtagcgctgttggatctgccgcttcatttacttcaatgccagctaacagcatctccttttgagaaattcatcagctataacaggctactatgtatcattcccctccaaatgtcattgcctgtatcttctcgatttgcgtggggcaatttggaccaagcaaatgtggatcagattgcacagcaactgcaaaatcttgcaacgttgtacactgaccctgatttggatgttgcaaagaattcattctaccagcaaacttttgattgactttgctaattcttctactgctggctcttaccctcgacaaatctacggtcggtttaatcaatcttcgcaacagctcatctaacccacgattcaaagcatcgacggcttgcaccgtcactccagtgccgttactgtacagccaccgctgcaaaccctcgcacagagaacctgtatccagcaaatgtccagaatcatagcatgacaccactgaatcatccaactccctccttaccctcataccactgcccccagcgactgaaatccccaatggcgctgttatcgggctccggctctggacacacggagcatacctaacctgctccacctcctccccatcttccacggacaccaccttccccaccggcgccccccgctccctcgccagctcgccatcacccgaatcaaccactgcccccacattccccaccaccggcagcgcgacgcccacgcactgcccgctcggggcggtggtggtgcccgactgccccgtcaccgcctgccggctgagcggaggcacccccgacagagcattgcctatgatccccctaatgagcgcgttgtgcagcgcgatgttctccttgccgatggtggccaagcagagcctgtcgaactccaccttggtgagcttcaggttcagcagcctggcgaggtgcgcgaagtacttgaccgcccgctcccgacccaggcgcttcaccaggcgctgcttcagctcggtgacatcgacgcgcgccgtcttgcggcaggtcgccatcaaccgctcccggaatgctgcccccgcgctcgccccggtaggaaccttggaatcctcgattcggtggggaattcgtcgctagggtttcgccgtagctgcgcgatcggggtagggggtgggggagggtgaaggggaacgaactcagcgacggagggcggaccgggtgtacgacgagtcgtgggtgggcgacgcgaagccgcgaaggccgaagggtagtt

SEQ ID NO: 21510 - DNA, 4603 bp, Zea mays
  misc_feature (4131)..(4131): n is a, c, g, or t
atccaacagggttaaacttttatcttaattgcaagtgatcattgccataatctgaatacaatgtacaggagcaatgagccattgaaggcatcatttatgatcactgagaaaaatgattccatttaagtctaataaggggaaaatgctctattacaacgtcacaacaaatctctaaaagtactatcagaacatgttttttgagccaagagctgagggtatgtttgtcgacgagtttcttagcttggcctggacatcagccaaccctatcgattcttcgatttattgacaacaggctagattcccaaggaagaatttatgctacactgtccattgcatctccctttgttcacctggtgggccttggtatctcctgcttgtgagtaacgcaatactcagattttgtagtcatggtgttggtctgtcgtttcatttacttcaatgccagcaaacagcatctcctttagagaagttcatgttcatcagctataacaggccactatgtatcattctcctccaaatgacattgcctgtaccttctcgatttgtgtgggccaatttggaccaagcaaatgtggatcagattgcacagcaactgcaaaatcttgcaacgttgtacgcggaccctgatttagttgttgcaatgaattcactctaccagcaaccttttcattgactttgctaattcttctactgctggctcttaccctcgacaaatccatgcacggtttaatcaaccttcgcaacaactcatctaatccacggttcaaagcatcgacagcttgcaccgtcactccagtgccggtactgtgcagtcgccgatgcaaatcctcgcacagagagcccgtatccagcaaatgtccacaatcgtagcatgacaccaaaggatcatccagcctcctccttaccctcgtaccactgcccccagcgactgaaatccccaagggctgtgttatcgggctccggctctggacacacggaacagacctgatctgctccacctcctccccatcttccacggacaccaccttcccaaccggcgccccaagctccctcgccagctcaccatcacccgaatcgaccactgcccccacattccccaccacgggcagcgcgacgcccacgcactgcccgctcggggcggtggtggtgcccgactgccccgtcaccgcctgccggctgggcggaggcactcccgacagagcattgcctatgatccccctaatgagcgcgttgtgcagcgcgatgttgtccttgccgatggtggcgaagcagagcctgtcgaactctaccttggtgagcttcagattcagcagcctggtgaggtgtgcgaagtacttggccgcccgctcccggcccagccgcttcaccaggcgctgcttcagctcggcgacgtcgacgcgtgccatcttgcggcaggtcaccatcacccgttcccggaatgcggtccccgcgctcggcgcggtcggaaccctagtgatgcaagcccggggtgctcagatctaaccgaaccatcaaggcaccgaacaaattgaggcagaatggagtgcaaggggggggcataacttacttggaatcctcgattcggcggggaattcgtcgctagggtttcgccgtagctgcgcgatcgggacaggggtaggggaaggggaacgaaatcggcgacggagggaagaccgggtgtacgacgagtcgtgggcgacgcgaagggtggttggcggggtcgcgcccggcccggccggccggcgcaggtgtatggggcgcggtgcagggagggtatcctgggctagtctggttggtggctgtttgggccgagagaggaaacggcggcggcaagcggccaagtggccaacggcacgtgctggtttgcggtgctagtatagtagtatcacaactgacagctggcgccggtatgctgcaaccattgagaattgatttggtgataagggatcccgagaggattagaaaagattgagggagaaataaattaatttccccctcaatcctctccgatcctcccgggatcccgggtcaccaaatcagtcctgaagttggggtgccaaacactagatatcatattacggatctccgaacagtagatacacctaagaaacatttctatacaacccaatatatttaagtcttctatcttattcattcgaacaccttaagatacggctcatttatgtgggttgtatggctgaactcgtatctagacttagagaattgtgtcaaagacgtacatttatcaagatgtgtcttttatgttttttttgcatttacatgcttgatactactaagatacgagatatttatatgagttgtacatatccttaaaagtaaaaaaatagtttggtctccaacaattcgtgatattaagagactatttgaattctaaatctagatttggtgggtctattttctgttttcgatttgcgcgatcatctctctctagcggtactacatctctttcatgatctgacgaatatccatgttcgcacatctccctagcggcacatctccttgatcacctgacggatctatggtagcacatctcctgtcgtgcacagttgcagcaaagctgcaacaagaatttggaagaaccatacctatttacactacttcagttggtactagcctcttgtagccatgttctcctatgatgtgatcattgtgccttgattattttaataatatttgcatgatctttgtctcatgccatattctctgttatacttgccttactaaatgttcatttattatgtatgtatagtttttgggttatcggtggtgttaagctcgagagcggtgggggagcgttcgcccgacaacggcggaggagcgggtttggccgctacgtggcctcgtgagcgaggaaaaagaaagcgctaagggctagtttgggaactacattttctcaaggcctaagattcaataggtttatcttgtcgtttagtcctaatctgtctagttagttttataactagactatatttaatatttctaaccagtaccaaacattaagtgagatagggaataaagtatagtccctgtatccaaacaaggcctgactttttagcgtgtggtttggtttgagcacgacatgagatgagttagattttttagttaggttagatctgatatgttcattctagttccatttttcggtctatccatcggtctatggattaggataaattgaaacttgagcatcgatttgtgtgattcctcccaggaccttaaggtgaattgtgtacctctatctgatacaatattcttacaaataccatgtaagcacagaatctgttacatatagcattgctaatagggcaccagtgtaggtagttttgatcggtataaagtgaacaaccttgatcaaatgaactataactaccaagatagagtcataatctctttgagtatgagccaaaccaactgttaagtccatacatattccatcccacttccactcaagtactttcaaaggttgtagtaaccaacttacattttgtgtttggccttcactctatggcaagtatcacaaaggataatgtacccaactatatttctcttcataccaacctccaatataccttttgaatcctcgtacatcatggttcttacctccattggtgtttcctatatttgttacaatcataggttgagatgttccatcaacaacttattttaaaaatctacaactaatagtcaattcacatggcttgtctagtaaaaggatctgcatccacgtttgctctacttggaagtagtggaactccaacttagtatttgatcaactccaaccattgtatctacctcaaattcaagtcattataagtgaaaatatactttggactcctatcattagtataggtttaacacttgtgtttgtcatttatttgtccacttaaatgttttctcttttccaacaaggttttcattagtttagcaatactcaagaatccttcgatgaatctcttatggtgaccacaatcccaataaaactttggatcccactaaccattttgaggtggtttacacttcaacacatcctcaactttacttggatcaactccaactcccccattagagatcacatgtccaacggtcccagaaaggaaactcccttgaacnaaaattcacacttggtcagtttggcatacaagtgattctcccttaacttatgcaaaaccaaccttaagtgatcctcatattcttcctcatcattgaagtaaactaatatattggcaatagagaatacaacaaaattatcaaggtactacatgaagactttattcagaacatacataaaatgtgtaggggtattagtcaaaccaaaggacatgatagcttactcgcagagtccatatctagtggtaaaagcgattttgggaatgtcactaggatggatcttcaatttttgataatcagatctctatcaatctcgaagaacacaaatgcaccttttaactgatcgaacaagtcatcaattctaggcagagggcatttcttctcaataataacctcattttaataatctacagcccacacacattctctatgaactatccttcttttatacaaacaacactaggactcatcaaaa

SEQ ID NO: 21511 - DNA, 1086 bp, Zea mays
ctcgaggccggccgggccggaccgggaccaggacaccacgcacgcagagccctagaggcattccctaggccccgcaatcgagccccagaggaacgactcctgccggacgccgccacaccatctgaaactgacggcggcgggcggccgctgcttcctctcccttctccgttcagatccggctactggcgtccctcctccgccatcttccctacccccgacgtggcgacgagctgtgagccgtgagctgttccaacattcctgtcctagttcaagctgaaaggagaacataaaagaggagaggctagggttttggcgtccgagaccaaaccaagctctctccggcgacggtgagggctcgatatcggagtccagtaggcggctcctgctgcttcggcggtccctaatccctctctcggcagtgtacagatggcgtccggcggtccggcgctcgagccgctcgtcgaccaggtcatctccgtcatcaccaacgatggccgcaacatcgtgggtacgctcaggggattcgatcaggccaccaacattatactcgacgagtcccatgagagggtctattctagaaaggagggagtccaacaacttgttcttggtctgtacattatcaggggtgacaacataagcgttgtgggcgaggttgatgaagagctggattcaagattggatatgtcgaagctaagggcgcacccactgaagcctgttattcactgaggtccgagtatgtctttgggtaatatgtggactggatggatgggtcactgttgaatgcaggatgtagcatcatcatggtgaggggactgagtaatatggacatgtatcttgcgtattgtgcaatgaatgtgttggctgttgggtcgcttgcctacgcattctgtaagattgcagttaccattaggaactgaactcaactcgactgaattaatatcatttggctctactcgtagaaacaaaatgcttgatttgactcgaaatttgaagaatgaaagaaataggactcggaaacagtgaaagtagcatagtaaattatttggatccacgcaaattaattccttggtagtaagttggctactt

SEQ ID NO: 21512 - DNA, 1935 bp, Zea mays
atctatggaattttttttattaggaaaatggacagctctaattcagcaataacacaaggagtattttacatgtttcctattcccacggaaaccatcacaaggcacactacagggcacatcaaaactacaagctcaagttatttgagctcaacaacatcaaaccttggtcgtcaatacagttagtttcagcatactcttggatccagcgatttaatttacaacgtgtttggtttgccggacaacggtctccggaatcatccgatcctatatccgaacctaatatatttgtttggtttacatcatagatctgtgtcgtccgacatcagatactccatgtagtgctcgttagaagtgcaattatgcagcaccggttcactcccagaaaaacatcggacgacctcatgcaggagcagctcatgccggatcaactgaattcgcaaaccaaacacgtccttagtgtctctcgttgctcctttttctcagcattttgattgtttcacctgcatgctgtagagcggctacatctttttccttccattgcatctttctttttccgacagtccaaacagagacatgggccaccccatggagcgtactgggaagagcagtaaccacctccattatctgccatcaaatcttggaagggctcttggtccacttggcagattgcacagcggaaaggtggtgaagctgctttcaaggacagattcctacccaacctttcttctagcattgcagacccttcttcaaataactcctccacggaaccaatggaggcagacttgcctccaagctttccaactgaactatgcgaccttctacgaaaaagtgacttcaacttgttctgatttttctttggagacaattgtggcgatgtcagatgatcggacgggataatgtcaactacgacacaggtggtgtcatcctttagcccgcttgttttcagagcttgcttaacgacaagcttcgctgccagttctgcaggcaatcctctgcatgcttttgcagctgcttcattggacaacgcgtcccatatgccatcagatgctattatcagtcttcctccggtgtttgatagcttgacttgcttgacatgtggaatgggcacaatgaactccccaacatccatgtccccgatggatcttgagaggcacaagccaccaggccagcaccggagagggccgacctcctggccgccaaagagattgagccggcctacttccccaccgctggccgtgacgcgctcccgctcctctgcattatcctccaggcggtggtccacggttagcagctgcaactcgccgccctgcgtgtccaggatgcagcgcgagtcacccaccgacgccaccgtgaccgtgaacccatcgatgaccaccagtgtcgccgtggttccggacacctcccccttgcgctggaaatcgatgtcggccttgacgaagccggcgacgagcgcgcgcggcagcgcctgcagccagtcttcgcggccgatgtccggcgacagcgcgctcatgacgtgctcgagcagatgctccttgctgtagaccgccgccgacacgccgttgtggccgtcgaacacggcaaagacggagaacgcggatgcggggtccccggggacgcggaggcagtcgggcttgacgaggaagtagtcctcgccacgcttggcaaagccggcgtggccgtagcgcagggccgggcgctcggagccccccgcgcggagctcccggccgatgagagtcgccaggggcagcgccggcggcaggcgcctctccctcgcggcggtcgccatcgccgcccaggtggacagtggtggtccgcctttagatagactttaagctggcacttacctaccgtcttgggttaggtcctcagaagaagacagcgaccagaggccaccaaccaccattcgtggcaggagacggcaagcaatggagcccc

SEQ ID NO: 21513 - DNA, 3272 bp, Zea mays
ggtaccctcggagcctgccgggaaacaaccgttctcttatctcctacggtcgtcttttcttcaaagcgaactaacagaaccaactttccttctctcgccatggatcccgcgagatctctggatcccgcactgcagccgccgccagggatgagatgcataggaccagccgcacatatctgccggagcgttgttccttggaggaggagcccccgtggtccgtgcaatccgccctcgcggcgccgttcgccgaggaagccctcgtcgcgccgtccgcggggccggaggagatgctttttgaagccacgcagtccgccaaggccgcgtcttacgccaagtccgcgcagtccgccagggtcgccctcgcggcgctgttcgccgaggacgcccttgtcgcgccgtccgccgggccggaggagatgctagccgaagccgcgcagtccgccagggatgccctcgtcgcgccgttcacttgtgctcatggagacatatgcaaagcagggtataaacgaagaagtatttctctttaaaacagttaattaccattcctaaaaaaagctaattactccagagaaataaagcatgatctgcaatgctttcttatggattagcacatgatgacgaaggaaaatgaaaagggttgccagttgcatggaatggatgtgcccattgaactgctaaaaaagttagtacttgtgccacctgaatcgatccaagcatgaataaatcacagcagcaagtccattttgaattttgatgcaccaattgtacactgagtaattgagtaaagcaaggaagtttgtggcgtgacggcatgtcaggcaattatagtactcaccaatcagtaatgaacaactcacaatagcattaattagcaatccatttcagcatgcgtccatgaaggaactagaggaaatgaatctgctaatctaagtcgggtggatgctcactcgttgctgggacgttggccagaggagggatttataaggggtaaaattgtcttgttcggagaaaatacatgacatcagattataaaaaggaagaatatacgttgaatggtagtataatcaattagagaaggtttgtagtaccttttttacggattaaatctttcggatggcattattgcgaagcacattgtttagagtcctaaatatgcaattgtctcattaatatcagatattaaagaagtagcgtatatggcaaccaattcagcaataacagccattacacaaggaacattttacacataagtacatctttagtacgtacttcaataaccaaaaaaaaaaaagaacaaacctagtaatacgattcactctcgttcctgcaccaggcatgtacttctttcaatcccaccaaaaaaataaaaacatgtccacgattaatcaccctcgatagctattttataaaaaaaaacagcaataggcaggtcaatttttccctgcacaaggcacgctacagggtacatcaaaactacaagctcaagttatttgagctatgtcctcaacgacaacaaacttttccattcggattgtgcgcaggtaacagactagttaggtcttactaccagccaaatatgtcttttaccgggctggcaatacagttagtttcagcaaacaattatacttgggtccagcaacttattatcctctctcatcggttcttttctgcttgaggcaaggactgtttcacctgcatgctgtggagcagctagatcttttaccttccattgcatctttctttttccgacagtccaaacagagatatggaccaccccatggagcgcatggggaagagcagtaaccacctccattatctctcatcaaatcttcgaagggctcttggtccacttggcagattgcacagcgaaaaggtgctgaaactgctttcaaagacaaattcctgcccaacctttcttctaacattgcagagccttcttcaaataactcctccacagaaccaatggaggcagacttgcccccgagctttccaacagaactatgcgaccttctacgaaaaagtgacttcaacttgttatgatttttctttggagacaattgtggtgatgtcaaatgatcggatgggataatgtcaactacaacacaggtggtgtcatcctttagcccgcttgttttcagagcttgcttaacgacaagcttcgctgccagttctgcaggcaatcctctgcatgcttttgcagctgcttcattggataatgcatcccatatgccatcggatgctattatcagccttcctccagcgtttgatagcttgacttgcttgacatgtggaatgggcacaatgtactccccaacatccatgtccccaatggatcttgaaaggcacaagccaccaggccagcaccggagaggaccaacctcctgaccaccgaagagattgagccggcctacttccccaccgctggccgtgacgcgctcccgctcctctgcattctcctccaggcggtggtccacggttagcagctgcaactcgccgccctgcgtgtccaggatgcagcgcgagtctcccaccgacgccactgtgaccgtgaacccatcgatgaccaccagtgtcgccgtggttcctgacacctcccccttgcgctggaaatcaatgtcggccttgacaaagccggcgacgagagcgcgcggcagcgcctgcagccagtcgtcgcgcccgatgtccggcggcagcgcgctcatgacgtgctcgagcagatgctctttgctatagaccgccgccgacacgccgttgtggccgtcgaacacggcgaaaactgagaacgccgatgcggggtccccggggacgcggacgcagtcgggcttgacgaggaagtagtcctcgccgcgcttggcgaagccggcgtggccgtagcgcagggccgggcgctcggagccccccgcacggagctcgcgaccgataagcgtggccaggggcagcgtcggcggcaggcgcctctccctcgcggcggtcgtcattgccgcccggtccggtggtcgcctttagacttttagctggtacctaccgccttgggttaggtcctcgggaaaagacagcggccagagaacaccattcgtggcgcggaggaaggccgcggcgatgtgcggacggctaggatcccgagattgcgcggcaggcgatgaaaatctcggaggtgatgaggattggtgtgctctcggtagcgactggggttcgcgggacaagaggattagaagaagcagaagagacggcagtggagtggccggccgcgcccggcccgccgcgaggtaccc

SEQ ID NO: 21514 - DNA, 767 bp, Zea mays
tcttcctcctgcatggatgctgatcttgtctgggtgggccttgcggatgtgtactactgactaaaccaaagggaatctttacttcccaaccaagatctagccctggtatcagatcttttgccccctccagtgtcttcgagagaatacctctttgtacagtatggaggtgagggtgtcaggtgtgatgtagatccctcatctgttcattatgtgttcagaaggatgcagggtgtgtgatcttgtgtgacctgaaaatcaggttcctgatactgtgtatttgtaatcttgctgagtttctttggtcatgctagcaccctatgtcacacattgaacataatatcacctgctacagagaatggtaaactttttcatacgtgttctcgcactgaaaatcatcaagcaaacatcaggactcatgatgacaatgaaggatgtgatgggtttgtatctgttagccatataaggttgcacgttaagcatgcccctgacttgccggacgagcagcaagacttcgggacctagattggctaaggcactaagaatagaatagcttatctaccgatatgtaaagtcttatttccacctttcgaattcttttcctcggtagctaagcttatttagttgcctaatggtcgatgtaatctttttattgtgtgattcattccactttcatggtatttccgctcttgttacctccctctaccgcttcttcatctacatctaacctcatgcctggcgacctctaataagtaactgttgatccggcc

SEQ ID NO: 21515 - DNA, 1713 bp, Zea mays
  misc_feature (473)..(473): n is a, c, g, or t
  misc_feature (510)..(510): n is a, c, g, or t
  misc_feature (531)..(531): n is a, c, g, or t
  misc_feature (560)..(560): n is a, c, g, or t
  misc_feature (569)..(569): n is a, c, g, or t
  misc_feature (616)..(616): n is a, c, g, or t
  misc_feature (651)..(651): n is a, c, g, or t
tgctattgcttcaatgagaaggtttgtgttcttttttctttcctacctatataagatgaataattggtctgttttctaaaacatacaaataaaattttgtttgtttattaagggttgattggacagcaaagcttaaacattggaaggatgaataaatttgtacactatgacatgtagtttgcaatggaaggaaacctaatttatatttttgagcttgggtcaggaattatagtggtcagtttagatatctatggattttttacatctccctccgtttttatttagatatcatatttgccttagtgcatagacaaggatgagattaacgctgagttaatccttgttttttctgctccgtgcaattgatgctgcatcatactcagtactcacgctcgcatgctcacctgcatgcagatttaatttttcgtggaaggaacagagggagtattagtcaataaacaacaaatttatanacatttatattttcttggctcctggactagagttttnatgttgcatttagtttatggngtacctgctttttctctaactttaacctnattgtatgntaccttcctgaggtgtaagatattcacttaccatactgttgttttgnagccggttgttaggaagtgcaccgaaatgttgagncgagcaatttgcatatctggcggcgatttttatgtacccaggtttcataaggatggacctattgtttggaggttgttggctttatctccattccgacgtctgtcaaagatggatgaaaaagcaatcattttaccatatagggatacctcacttaactcagaggaacctatggctgagatctccagccaaaagattcagattgcagtcctggacatgatcgctgcaatatcttcgaacaagagaagtgttgttgcactagaaagcgtactaaagaaggtctatggccttgtggtaggcattgcctacagtagtttgacaggtttgcaggaagctactataagggcattggcaggccttgcctgcatggatgctgatcttgtctggcttctccttgcagatgtgtactactcactaaaccaaagggaatctttacttcccgaccaagatctagccctggtatcagatcttttgccccctcaagtgtcttcgagagaatacctctttgtacagtatggaggtgagggtgtcaggtgtgatgtagatccctcatctgtttattatgtgttcagaaggatgcagggtgtgtgatcttgtgtgacctgaaaatcaagtagaatccacaactttccatctatatcgacaggtttctctttcacatttcattacttaagaattctactttttttttcaggttcctgatactgtgtatttgtaatcttgctgagtttctttggtcatgctagcaccctatgtcacacattgaacataatatcacttgctacagagaatggtaaactttttcatacgtgttctcgcactgaaaatcatcaaggttggtcacatgtctgaagaatgattatgacaagtctttaccactttgatcataattatattaaggtagaagtagtgtgctttcttcattctgcatatccactgttaaccttatagatatctgtacattgccattgtaccatatgttttggtgaatctcgtctaaagtacccttgaaatctttccagcaaacatcaggactcatgatgacaatgaaggatgtgatgggtt

SEQ ID NO: 21516 - DNA, 772 bp, Zea mays
  misc_feature (44)..(45): n is a, c, g, or t
  misc_feature (48)..(48): n is a, c, g, or t
  misc_feature (50)..(50): n is a, c, g, or t
  misc_feature (53)..(53): n is a, c, g, or t
ggccgctttattttttagttggctcagcgtgcgcccgtccttgnnctncntcnggccgctttcgttgctgtcggcctcttgtaattgtgctgctatgttgtatgccatgtcaagaatgagtattggtaagcattcaagagttcactcaaaacttcaatcgatacaaaacctaataactcagtatattagatgcagacagacttgaactgctacatctgacagggcaccacgtcaggactcgaaattacagcctccttcctcttctaccaccctttctgcgtgtgctgtctgtggggactggagtaacatcctcaatacggcctatcttcatgccagatcgagcaagagctctaagagcagactgagcaccagggccaggggttttggtcttgtttccaccagtagcacggagcttaatgtgcaatgcagtaattccaagctccttgcatctttgcgcgacatcctgtgaggcaagcatagcagcataaggcgaggactcatcacgatcagctttaaccttcatgccaccagtgatgcggacgagcgtctcccttccagacagatccgtcacatggatgaaagtgtcgttgaaggaggcgaagatgtgcgcaacgccaaagacgtgttctccctcgcggacagcggggccaagcgtcacgttctcctccttgggctcccgcgtcttcttcctcccagacatggcggcgcggaagagggtacgttaggtttgctagggaggaccgccgcccggccggcctcgaggtacccaatg

SEQ ID NO: 21517 - DNA, 3073 bp, Zea mays
ataatggaggacattttgacagaagcaatgtttgaggttgacttgttttttgattttgccatgccagtgggtaatccaatatcagcctggctgatagcactttggtcatcccgttgcagattcttgatggtagacacggaaaagagaaggttattgctgttcttgttgacgaagagtctgtaggaccactacactctcgagggtgtcgagcaaaaatttttcgggatgatggagccttggaactgtatgtttaccagaacaatatcaaactgcccgggctgattcagagcaaccccagacgcagacgcattttccggctctgccttctagtcgcattatcggcaacaaagctttggatttaccagacaattccttgtttttcatcgatatatgaatggattgcatggatactatgcaaggtctacaattttacacaataaaatatgatgaggttgctcggcgtgttaaactgttcacacagcaaaagaatggctggaccccacgttctgctttcttcggtagcttgcaatgattttgcaacaacaattcgtatcatttacacgctactggtagcaaacagacagttgttttgatactgaacctgaacaaatggaaaatggtttccaatggttacacatcaaaattatgtttgtatgcatccactgcagtaacacaatgctgagccagaagcaagctaatttttggcattgcggaaatcactaatcgtgctcattatattgatatataaactgacaaacggtagcttatgacttgaatgtgatgagcaaattgtggacataattttttgtggtcatcacagatatccctgctgcacattgcctccatttctttccgttggattgccttgaagtgccccctctccatcgtctccactttctgttggattgccatgaagtgccccttctccatcgtctccactttctgttggattgtcttgaagtgccccttcgccggctgttttaaggcctagcttactgagaaagccaccatccagggtgtttgcatcaggagcaggcgctcctccttcattctctgtcttccttttatgggctaggatagcttcaatggcagcggcactggctttagctgcggcttcatccttagcagcaatctctgctctcctcctctccctctcttctctggcaagagcctctgccctcgccttctcttctgcagcccgggcttccgcttcagccttttccctctccacatcctcatataacttggcgatgtcatttcccctcccatctccacgtaatgctccttctaaaagctccctcattccatagctgaacagaaccttctcattcaaaagaataccttttgcaacattgactgcatcatccaaccggtcagcagcaatatatgccttcagcaatgtctcgtagcttgagatgcttgggttaactcccttctccttcatctgattgaagtattcctgagccttgtcgaccatactgaaacccaccaggccatcaataagtttatgatatgcagttgcatcaggcttcagctccaattcgtccattttgtcaaagtaagagataccatcatcgatgcgatcaacactgaagcatgcttccatgagcagtaaatatgtctccttatccgcaccaacaccactctcacacatctcattgtagagcacctccgccttatctatcagctggttaatctgcaggtgccgaatcaaattattataggatgccacatcaggcaccagcttccattcccccattcttctgaacattgcaactgcatcttcaaatctcccagcagcacagtaggcatcaaccatcaccctgaagcttctcagatcaactgcaatccgcagtggcgggtcatgttcctcaagcattctgtcgaacagcttaagtgcatcctccaacctcccattctgcccaagcgcatcaaccacctcattgtagctctcggccccaaacctcaccgccgattcaacacacagcacctctttgtaacactccataaccttttcccccgttcccataaggaagtacgccttcatgagagtcccgtacacaatgccatccagaattggttcgcccccaaccttgtccttgagttcttggtacagctccacggctttggctccatccccagcacccacgaacccagccatgagaaggctgtagaccttgggatccggcccgacgaatccagaggtgagcatctcatccttgagcttgacggcatccgcgagccggccgtggtctgcaacgaggcactcgacgacgacgcggtaggccgtcggggagggcggcacgggggagccggggcgggcgatgatgcggaggtggtggagcgcgtcgtcggcgaggcggcgcgcggcgagcgcggataggtagagcacgtgcgtggcggcggtgggcgggacggcggcttggagcgcgaagcggtgcagcgcgaagaagtcttcgaggcggcgcgcgcggaggagcgcggcgaggacggcggcgcaggtgaaggacgaggggcggcagttggagtggagcgcgtggcgggtgaggagcgccgcctcggggaggtcggcctggggccccgagaggagcgcgaggatccggttgtggaacgcgaggcgtgacggcgccagcgtggggagcggctccgcgaggcgcactgcccgcggggaaggcgcggggatcgggggcgtcgcgacgaacgtgtccttacggcgctcgcggcgggaagccgtggccgaggcggcgtccgcgtgcgcgagcgggaagagcgccggcacgaggcggcgtgccgagaccggcttcgacagcgacatcttccgcgggtgcgcttgggcgacggccgccgggcggcgacgagggtttggggtttggggcggggatcggccttcccggttggcgccttgcgacccggagatatgttactctgtgtttcgccttggctgaagaaaaacgtactcgcaagtcgcaagatttatgatacaaactgacatcatttgctttacattccctttttgtgtgtctggaacttctttttttcattatgtcaaacttttgcttgtaacttagagcaa

SEQ ID NO: 21518 - DNA, 2068 bp, Zea mays
ccgggagcttgtgctcgttcgagactgagacaccccaacacgcctccctcagcgcagatctcgccgccgccgagatgctccgccgcggcgtgcttcttctcgcggccatcctcatcgccgtcgcacactcgcccctcgcgtacgcctcggaggccgagcacaagtataaaacagaagaacctgttaagctatgggtaaacaaggtccttggtggaaatgagctgattgatagtcagatcgatataaagttcataaaaaatgtggacaagggggccatttgcacaattgaacttgatgttcaaaaggttcagcaatttgctaatgccattgaaaactcatattggtttgagcttttcatagatgatctgccattgtggggttttgttggggagactgacaaaaacaatgagaaaaagcactacctttacactcacaagaacattgttgttaaatacaatggtaacaggataattcatgtgaatctaacacaagagtcacctaagcttcttgaagctggcaaaaagttggatatgacttattcagtgaagtgggtgcaaacaaatgtggcatttgcacggcgctttgaggtttacttagactacccgttctttgaacaccagattcattggttctccatcttcaattcattcatgatggttattttcttgactggtttagtgtcaatgatattgatgaggacactaagaaatgattatgcaaaatatgctcgtgaagatgatgatctggaatcacttgagcgagatgttaatgaagaatccgggtggaagcttgtccatggtgatgtgttccggcctcctcgtggccaggtgtttctttctgccctagttggtattggcactcagctggcggctcttatcctgcttgtgattgtgttggccattgttgtcatgttatatgttgggcgaggagctatcatcacaaccttcattgtgtgctacgctcttacatctttcatctctggatatgttagtggtggtctctattcaaggaatggtggaaaaaactggataaaggctatgatccttacagcatcactttttccattcttgtgtttctcgattggattgttgttaaacactattgctatcttctaccgatcattagcagctataccatttggcacaatggttgtcatgtttattctttgggctttcatctccttcccgttggttctattggggactgtagttggtagaaattggagtggtgctcccaacaacccgtgtcgtgtgaaaacgatcccgcgcccaattcctgaaaagaagtggtaccttacaccttctgttatttcactgatgggtggacttctccccttcggcagcatcttcattgagatgtacttcgtattcacttccttctggaactacaaggtgtactacgtctatggtttcatgttgctggtgtttgtcatcctcataatagtcaccatatgtgtcactattgtgggtacttatttcttgttgaatgctgagaactatcattggcaatggacatcattcttctctgctgcttctaccgccttgtatgtgtatctatactctatatactattatcatgtgaagacaaagatgtcaggatttttccagacaagcttctactttggttacaccttgatgttctgtcttggattgggaatactttgcggtgctgttggatatttgggctccaccctatttgtgaggaggatctacagaaatatcaaatgcgactaaacttggtctaggctgctagcatgtcttgtcacaatatggtgcagagtaataccttgagcttctgattgacttcggaaattacacaggaggttgctctccctttcgttactcttttcatcttttttggcctatcttcctggacgtgtggaactgcccatgataaatgtatacctagttggagaattagtcagagtactggaaagtacatgtaggtttttttggtgcggcctctctcggtcaattgtaggagtacattgatgaatattactgcagtgcagattccagtgggctagattcgcccctcttaaaaaatcgacgcggccgcgaattcgggc

SEQ ID NO: 21519 - DNA, 1316 bp, Zea mays
  misc_feature (1007)..(1007): n is a, c, g, or t
  misc_feature (1042)..(1042): n is a, c, g, or t
  misc_feature (1082)..(1082): n is a, c, g, or t
  misc_feature (1108)..(1108): n is a, c, g, or t
  misc_feature (1184)..(1184): n is a, c, g, or t
  misc_feature (1187)..(1187): n is a, c, g, or t
  misc_feature (1193)..(1193): n is a, c, g, or t
  misc_feature (1229)..(1229): n is a, c, g, or t
  misc_feature (1240)..(1240): n is a, c, g, or t
  misc_feature (1265)..(1265): n is a, c, g, or t
  misc_feature (1277)..(1278): n is a, c, g, or t
gggtacctcgaggccggccgggcccgaagcccgccccctctctttctctctctgactacctccgtatgaggcagcttgtgctcgttcgagactgagacaccccaacacgcctccctcagcgcagatctcgccgccgccgagatgctccgccgcggcgtgcttcttctcgcggccatcctcatcgccgtcgcacactcgcccctcgcgtacgcctcggaggccgagcacaagtataaaacagaagaacctgttaagctatgggtaaacaaggttgggccttacaataaccctcaagaaacttacaactattacagtctcccgttttgtcaaccatctgaaaaccctgcacataaatggggtggtctcggagaggtccttggtggaaatgagctgattgatagtcagatcgatataaagttcataaaaaatgtggacaagggggccatttgcacaattgaacttgatgttcaaaaggttcagcaatttgctaatgccattgaaaactcatattggtttgagcttttcatagatgatctgccattgtggggttttgttggggagactgacaaaaacaatgagaaaaagcactacctttacactcacaagaacattgttgttaaatacaatggtaacaggataattcatgtgaatctaacacaagagtcacctaagcttcttgaagctggcaaaaagttggatatgacttattcagtgaagtgggtgcaaacaaatgtggcatttgcacggcgctttgaggtttacttagactacccgttctttgaacaccagattcattggttctccatcttcaattcattcatgatggttattttcttgactggtttagtgtcaatgatattgatgaggacactaagaaatgattatgcaaaatatgctcgtgaagatgatgatctgggatcacttgagcgagatgttaatgaagaatccgggtggaagcttgtccatggtgatgtgttccggcctcctcgtggccaggtgtttctttntgccctagttggtattggcactcagctggcggctnttatcctgcttgtgattgtgttggccattgttgtcatgtnatatgttgggcgaggagctatcatcncaaccttcattgtgtggtacgctcttacatctttcatctctggatatgttagtggtggtctctattcaaggaatgntgnaaaaanctggataaaggctatgatccttacagcatcactttngtcgtcgtcgnttaatttttgttgtatgtatagaantagcaggacgcnngtttttgtggtcgttttgtaacaaaaaaaaaaaaaaaa

SEQ ID NO: 21520 - DNA, 1045 bp, Zea mays
ccgggtaatacgtctgatccattgcattgaccgctaacttcacctttgtcgcacgcgattctacggacgcgtgggcggacccgtgggaccgcctttcacctgaaaccgaaagagagaagcagctatttggagaaagtgaagcacgcgataagatgagaaaaaggaagagagaagaacagaagggaggactcgaaaatgggatacataggctccgtgccgaggccgagaggctggacgtgttgctcgcggagggccgtgttttctctgacctgcctgctttggccgatagagatagcatcttgctgaaggatacccgcctggagaattctcttgtctgccagccccaacaacggaacttgcatggtcgaattttcggtggtttcctgatgcaccgagcatttgagcttgccttctcgactgcgtatgcttttgttgggcagagaccttgtttccttgaagtcgatcatgttgacttcttgaaaccagtggacgtaggggacttccttcgattcaaatcatgtgtcttgtacacccagcttgacaatccagagcagcctctggtcaacgtcgaagttgttgctcatgtaacaagacctgagctccggaaaagtgaggtctccaacaccttccatttcaccttcacggtctgtagtgacacgctgaagaacgggttgaagattcgcaatgttgtcccctcgaccgaagaagaggcgcggcggatattggagcgcatggaggcagagggtttatgcaactaatctttccgcagatccacttgtttcggagttcggacgtgctttacttgatatatgtctcacttaccgttccacggtaccagctaaaacggggggatttggcgacgatttgagcagcagccagcagctatcataacacgccggcaatagaacggcatagctgtagctccatgcctccatggtactatttgtgattttttttacagagaccgcatgttgcgtataataacatactcctcgagactcaaaatgttcttttgagaaagcctcaaagcccttccgtttttttt

SEQ ID NO: 21521 - DNA, 1462 bp, Zea mays
gggtacctcgaggccggccggggtgtacaagttcgccaccgacgacatcctcagggagcagtaccgggacccctggaacgaggtgcgcatcggcaagctgctcgaggatcttgacgccctcgccggcaccatcgccgtcaagcactgttcagatgaagacagcacaacaagaccccttttggttgtgactgcttccgttgacaaaatggagctgaaaaagccaattcgtgtggacactgatttgaagatagctggcgctgttacttatgttgggcgttcatcaattgacatacagattgaagtgactcaggttgataaaggtattattggttcagttgaaggtcgacctagctcttcattgatttgaacagaaatgatgcttatggtagattttgttttctgcttttctttacctgactcatttcaaatgtggttatattgcagcagatggcgataatcagtctgatcccattgcattgaccgctaacttcacctttgtcgcacgcgattctaagactggaaaatctgctccggttaaccgccttttcacctgaaaccgaaagagagaagcagctatttggagaaagtgaagcacgcgataagatgagaaaaaggaagagagaagaacagaagggaggactcgaaaatgggatacataggctccgtgccgaggccgagaggctggacgtgttgctcgcggagggccgtgttttctctgacctgcctgctttggccgatagagatagcatcttgctgaaggatacccgcctggagaatctcttgtctgccagccccagcaacggaacttgcatggtcgaattttcggtggtttcctgatgcaccgagcatttgagcttgccttctcgaccgcgtatgcttttgttgggcagagaccttgtttccttgaagttgatcatgttgacttcttgaaaccagtggacgtaggggacttccttcgattcaaatcatgtgtcttgtacacccagcttgacaatccagagcagcctctggtcaacgtcgaagttgttgctcatgtaacaagacctgagctccggaaaagtgaggtctccaacaccttccatttcaccttcacggtctgtagtgacacgctgaagaacgggttgaagattcgcaacgttgtcccctcaaccgaagaagaggcgcggcggatattggagcgcatggaggcagatggtttatgcaactaatctttccgcagatccacttgtttcggagttcggacgtgctttacttgatatatgtctcacttaccgttccacggtaccagctaaaacggggggatttggcgacgatttgagcagcagccagcagctaccataacgcgccggcaatagaacggcatagctgtagctccatggtactatttgtgattttttttttacagagaccgcatgttgcgtataataacatactcctcgagactcggaaaaaaaaaaaaaaa

SEQ ID NO: 21522 - DNA, 3066 bp, Zea mays
  misc_feature (2346)..(2346): n is a, c, g, or t
  misc_feature (2383)..(2383): n is a, c, g, or t
  misc_feature (2432)..(2432): n is a, c, g, or t
  misc_feature (2467)..(2467): n is a, c, g, or t
  misc_feature (2527)..(2527): n is a, c, g, or t
  misc_feature (2603)..(2603): n is a, c, g, or t
  misc_feature (2685)..(2685): n is a, c, g, or t
  misc_feature (2689)..(2689): n is a, c, g, or t
  misc_feature (2722)..(2722): n is a, c, g, or t
  misc_feature (2737)..(2737): n is a, c, g, or t
  misc_feature (2760)..(2760): n is a, c, g, or t
  misc_feature (2811)..(2811): n is a, c, g, or t
  misc_feature (2890)..(2890): n is a, c, g, or t
  misc_feature (2905)..(2905): n is a, c, g, or t
tgcatgcctgcagattcatcatcaaaatatacatcctgcggcagatataataaccagagaaaaacatcaaacaccaatctgttcagttcaattcgaaatgatacaatgaatataaacagtaaatctgaatatacctcatcatcccgctcaagtgatgcttgagcctacatgtatcaaatataaacaaaaagttactgaataaatttttaaaactgttaatgtgttgcaactacagccaaagcttgctgtttaggtccatagtaaaatttaagaatattcttttaatgtaattcagcattttggatctcagaaaaaacaatgattcaatcttttaatgtaaatcaatatgcctatatataaagcactaaagaatgctaatagaccaaattagaaacatttttttttcttgaacgcgcaagagacatgtgcatcttttcattaagaaggaagagaaaaaggatccaaaatggatcagtacaggaagacccccattacggtggtcgaaaacaaagaaacaaaaatacatccataaataaaaggaaccagaaaccactttgacctaaagacctgggattggggctgttaagagatctaagtttgtggcccctcctaacacccacaggtccctttcctcctcggttctcttgatggcttcattaaggcagggagaaaggccgtcaaaaacacaggcgtttcggtgtttccacaatatccagaggccgagactgataagcgagtttagtccttttctggcaattccatgcaactgatcactacatcttttccaccagagcatggtattctcttcatagacataaggagtgaaattctggaggttaacctttgtcagcagcttgaaccagtaatttcttgcaaacacacagctcacgaggagatggtcaatggtttccatttcctggtcacaaagggggcactgatcagggtgatcaagccccctcctctgaagtctgtcagttgtccaacacctctgcagcgctacaagccataggaaaaatttgcatttggggggggggaccaggagtgccaaaccctgtcacaatgctcaaagtatgttgacccaataaataaactctcgtaggctactttggcagagtatttgccattatgggcaaacctaaaaatgtgtttgtcctctctatgtgggtttatgtttactgtgataatagcatcccaaagatcgagataatcagcaagaacctccacagtgagagctccttggatgtcatttagccaacttctatttgctagagctgcatgaacagttctactgttttggattcgccttggcacagctagtagcaatctgggagcaatatccgtcacacttcgaccatgaatccatctatcttcccaaaaaagtgtcgagtgtccattgccaatttccgtgtgagtggcagcatgaaagaaggatttcaccttggaaggaaaatgcatagggagtcctgcccaaggtttatcaggttccactttagtcagccacaaccatctcattctcaaagcccaactgagttctttaaggctgaaaatgcccaatcctcccaactcaactggcctgcacactctaccccaagccaccaggcagtgtccccctctgacttctttttttccacgccacagaaatcctttcttgattttatcaatatccttgagaactcttggatgtaagtccactgccattgcaaggtagatgatcattcctgtcataacatattggacttgtacttttcttccagctctagtcatcaagtcagctttccaccccgggagctggtcagcaatcttgtcgattatgtattgagtttgatttctggaaagcttgctcaaagacagaggcaggccaaggtatttacaggggaaagaagagatctcacaggggagacactcctgaagggtcgccacttcctcttccccacatctaattgggtacacactgcttttttggatgtttgttttcagcccagaagcttctccaaaaatctctaaaattttgagaaccagttgaatatcagattcatttggatgcaaaaacatgatcacatcatcagcatacaaggacactctgtgttgcaaaggtctagaagccaatggatgcagcagattttctagatcagcttttgaaattaaccaacctagcacgtccatgacaagtatgaacagcataggtgagagggggtctccctgtcttaagccctttttgagctgaattttttcgccagcaacaccattaagcagtacttgtgtggacgaggtagatagcagtccacgcagaacattcatccaaatctgcccaaaccccagtttttgaagaacttcgaggaggaaagnccaggaaactgagtcaaaagctttagtaatgtctagnttcaaaaggattcttgcttgtctttgctgatggaggagtctggcagttngttgcacaatcataaaattgtcttggatgaaccgncctttgatgaaagcactctgcctttgggagaccatagattgcagtttattccccagtctnttagctaggattttagtgactagcttggccatgctatgcactaaactaataggccgaaagtccttgacttggtcancaccctccttttttggaataagggtgataagagctgaatttagtttgtgaaagtgaccaaatttcctatcccaaatagctgncaanacttgcatcacattttccttaatgataggccancaggctttgtaaaancttcctgtgaacccatcaggtcnaggggctttgtcggacggtagctctttaatggcttcaaaggcttctttttntgtaattggtaagtccagatcctccaaattatgagagggcagccccaggtagttaagattaatagtgacagttctatcnagtcttgttcccaanaggcttctgtagaagttatccactagcatggctttgtcagcatgatcagtaaatacattatctccatagaccagttttgccacaaagttcttcttctttctatatctggcatgcatatggaatagtttggtgttagcatcaccctctctgagccagttgat

SEQ ID NO: 21523 - DNA, 2103 bp, Zea mays
  misc_feature (1678)..(1678): n is a, c, g, or t
gtaaacaatttgctaggtagaggggaaaaagccccccgcccttttttttttttttttttgcaatcgagaaaaacagtaatgatctgttgatatagcagtacagataatgccaagacggcttattaagtgaggacccgtgagtccgtgacaagatcacaagagtatgtcttcatgatacgaggtcctagtgtagtactatggtaattgtattttgcttaatgacacgttactccaaagacacattgcggcgccgctgattaattacgtccagctggtcgtcagctggccggcgcgaaggacacgagctcgcgggtgttggtccacgactgctcgtacacgaaggccccgtacgccgcgaccttgccgtcggcgtccgtggcgtcgaggacgagcttgtagttcatcccggacaccacctgctcctcgccgcccgtcacctcgccgaaccgcagcccgtcgttggcccgcctgacgtgctccgtcaccgcccagccgccgagctcctggatgtgcgggtcgctgacgttcctgatcgggctccacccgccggcgagcggctgccccgcacgcgcagcggcgacgagcaggagcagcgtcgcggtcgtcaggagaagagctctcgcggacatggtttggtttgggacgtacgtacgcgctagattgtgtgtgacgacgtctgacgtgcgggaaggaggaggaggaggacatgtcgggccgcccggcgcgggacgctgggatttattggcgtcaggcgcggagccgaaatttgaccaggctagctggcgtggcgtgagcagcagcagggtcatctgggggaggggagcccctggtttggtttgggccggcgcctcgtgaccacttgcatggttgtatctgtgtcatatttatcccctgcgtacgtctctatccggcgattctttagggtattgacttctgtgacgtttctgagttcaaattacaggaattgaagggctgacgttatgtcacactgcctctgaccgccggcgattattcatcgggttatcgtcaggacactctcgataacagttgaattgatagcttgttcttgtataatacccctacttacaaaatagtgctgacaatcgtgtgctagtatgctgctgtatgcgcgcagtacaaacttgcacaagcacacacgtaagctaacatcgatgaaaattgcggcttgaaaataaacttaaaccttctggttgcgaagattgtgcacttttaaacttaaattaatctttaaagaaatcaccatacgagcaataatggataaaccgtacatagcacgtacaagcatgaccccctagcagattaaatctatctttaacgtatctagcagaaacaagagcgagaaacttatcattattcacatcggagattgcttcagtctggtcgaagatgagttgttagcgttgctcaatccatagatgttgcagtgtaggtcaacttggcagagcagtcgtgtgaccgctgcctaaaaaccttatttgccccaattcgtgcaggttattcagttaggcgaggtttcgaagacactgatctccccatcgtcgttgttacactagcgtcaggatggaggagactgggattacgcaacaacgaggactaccttatctaaaaccataatatattggttgtttctcatacttttcgtggagaataccctctntattatataggggttagactcaggataatcatgcacaaaaaggcatgaaactaagtcggttatgatctcctcgatccaatggatttagttccaaacttgtcgtgcaaggcaaatccagttattgtagaaaacaacaaaaagataaaaataaaattagcgccaatcggcacgttgcaagtcacaagtcacgtaaaaaactgtgaacacgtgcatacgtgcgtgcatatgactttagcttcctccctatcatgcttcatttctaggaatgacaagaaaaaacctatataagttgagctcattgccttttcactttccatgtgggactaaaaattcaccatttctacactcaacattcatgagtgggcctataagatttattctacaattatttttaagtaaataggtgaagtccaataaactccaac

SEQ ID NO: 21524 - DNA, 3289 bp, Zea mays
  misc_feature (1888)..(1888): n is a, c, g, or t
  misc_feature (3071)..(3071): n is a, c, g, or t
ctgggcgctcttttttttttttttttttttttttaagtattgatagacatcgactttatttgtactagcagttcaatacatgtgtatcataaacatgtgctttggaaactactgagaatccaaagcttcatagttatgctataccacatggaaaacgccatcacactgtagtacaacttgtaatacacaacttggtactacacacatccacacaagtacaacatatgattattagatatgttgttttgatagttggttcccttatagatacctattgttcattaataactgatgatttgattgccctaatatgaatcactcgatcatcatggggggctgatcttactgccttggaacccgtggatctcgtagccacggtggctaccttgggtagtggtcacctttgaggtaaaggctgtagcgcttgacatatcgttgtctgtgccggtttcagagttgctagatgcctgtccagatatactgctaaccggagaattcactccattgatggcgagcttgatgtcttcctttagacctttgcgtggaagcgttgcatgcctcatgtctgctgcactaccgtccacaacattgcaggagaccacaagtaccatgctaataaggactataagaattgcatattcctttgccatattgttttcaatattgcatgtatcatgccaagcttggggtttcccagcccggccggcgtcctcatgtcacgataagtactgattggagacaaattattattccaatatgcaaataaaattcagcaacacattttaccagaagttagaaccgaagttggtagcatatgattgaattcaagagtaaagatgccatcatcggggcggcattagtgaattttcaaaacagaaggaaacttatttatattatcacaacttttaaattaaaacctgaagaagaattaatagtttgtggacccagaagcctggcagcagcaattgatgaaacaatagtcacaataatgtcaagaggtattatatagctagatttcaatggaaataaagaaagccaaaaaaattatctaaaacctctatacagccgagagcttaattacacaatgaaagagctccatgacagttacatggtatcatgtaagataagaagattgcgagtccttacatattgcatgtatcatgccaagcttgggtgtatgcatgtgtactgaagacaattgtggtatatataagaaacattgattgacaatgcgagtgggttttgccttgcaactagggcagtgggttttgggcaggcgcactttttttgtggctgataggagtcataaagcacctctcaattaattgtttttacgccatgggcacacaagtaaatcggttagttatatttgtcaccaataacaagaaaatgactggatgccgtgcgcgtacaaaacacgcaatgtacggcggtatccagcatttcaccccaaaattatctcccaaacagagatgaaataatgttggtcctcactgaatagcttatggtgatttctagtatgacgacctagtttatagattaataaacgtagattgtacccttttcttaccaaacagtttgtatgcaaccataatcccacaaactctacatataacagaacacgaaagctagctagtagtattcccctttccattctaccacgagaaaattggaaattattcacaactgctatcgtagatttcataaaatcatcatctatcaaatgcagtccttgcatctcctgtcattccacatgttttctttaatttgtctctatatttaacttctaaagtgactaatttacctttaaggctaattatagataacatcagttcagtaacttctatatattcgtgcagaagcagcagatctcgaacagaaacatcanttcagtaataagacaaacttgccagtgagcagtcaaattgtggtggcctgaatcagttgataatcttgatgcatgcatggtatctgggaccatagacagatgaaattatagaaagttggcatctgtctgaccatcatgaattagaacgacaatgaatccaacttgctggaaccctacacagttttataacttgcatcaggtggttccatgcatgcacatccattagttcgacatgtctaccggctagaaaaaagagaggccggcaatatagctagccgtcgagacaatctaatcccactattcatgggcggtcaggtacgattcttgcttccgatgcagcatcggattagttttacttttacagttgcaattatgatcagctttattgtttgccgcttggatggcagtcagtagcatatatgtatgttaccgtgtagatgttaaattaaagctgcagttcgtgagcaacacatcatggtttgcacaaacctatcgagctattgctacacactgtgtaggttcgaagaattatcttttgtaaagagagagattcctcttcctccagaagtaggatgaatgccagcctgaatacgatcgagacgatgacgtgtacgtgattggctagtctagtaccatacgagacaaattgtacccttgtcgggcgcctcatcatgtactattcgttataagcatctttatatatttatatgtagacatgagattcgacagcttccaaaatgataagactgtttgcaacgacgtcctctaaaacgtcatggactgggtttgacggtaaaaaaatgttgcagccgtatcctgtaatacgtcctctacatttctaggccagagacgtctcctccaaatgtacagggcccagtctcctcctccaaatcctatcccaatcgaaggcggccgcatgcccgcatccatatcccgagcgacggcagctgatcttcctcgtgcatctcttcccaagcgactacggcagatcttggaagaggcagcgggatgggcgtagcgtgggctcggcacagatggcgcgcagcggcgcggcgtagatggagcttggcgggccgcaggacgagtctggggtgtgggactttccaggatgatttaaatgctactgttgcaaaattatagagtttggaggttagaatctttttactgggacactaaatattcntatagaggatgtaatttagagtctatcgttgcaatcagtctaaggagccgttttcatcctttttatttggaggaattggaaactaataactgagctatttcattggaacttaatattttgtagggcaagaaagagaattaatcatatagaccacatatagatcaccatgctatgttttattcttcttcagcccactccctcgcaaatacaagtgcagc

SEQ ID NO: 21525 - DNA, 3068 bp, Zea mays
gagcttatgcaactactttacacacaaagctgtacatattttgacgtttatgtttctggatttaactcttgatagctgctaagctccacgactttgttaaccaaaacgtcaagtatttgtggaaagtcaaaactcacatgagtagtagtagcgttggactgttggaggtttggtagacgatcgcaggggggacagaacatgtcacgactcgagggtggtcaagcagccaccccaagcccccaacaactttagggccggggaactcggtgacccatacgtaacggcttagctaaccgttcctgcttcttgtcttctgcttgggcgccgcattatgattccacggttccaccatacgtacgcctgttaggaggagctcaagacaacccgcgctaacttctttttacagcaatcagcgctcagcggtactgcatcttattactacagtttccactcgcatcacaggctcacttcactgccacagtggcacctccgtctaggaaccgtcgcagtccatgggcacggcggcgtcttccacccgcttccggcacctgcgcgccgccttgatggccagcagggtgtcgcagacgatccacgggaagctccagaaccgcttctccccgcggcggtccgggtggtaggtcacgtggtaccacgccgacgccaccctcgacgcgtcgtcctccttgcacgccctgagccaccccctcacctccgcgtgcagcgcgtcgacggcggcgatgatgcggtccttcatctcgaagtagcgcttgttgtcccgccgcaggtacaccagcttgttccggatgttgcctgtcagaatctcgtcctcgcgctccgccgagtagtaggtcatcagggcgcccagcctctcggcgtacgcctcgtaccgctcctccgctgcgtccaggaactcgtcgaaaccggcgacctcgaggtccgggtcgtacacgcagctcggtgggcccgcaggcaggagcgcttctgcgtcctcctcgtgccgcagggcagcgcggtagagcttgccgaggacgccgttggagacgtacattggcctctcccaccgttccatgaagtccggaaactcccggggcctcagcgccaggggcatctcggctggagctcccgtcttggcgaagtcgaccgccatggagtgcagagcggccagctggacgcactcggggctgcgagctttcagcggatcacggtctgcgtggatcaagtgggcggtggagatggcaccgagggtatcgtttatcatgtaactgacgaagtgcttctgaatttcctgcaaccatttgcatgcagatgttaacattttgctcaagcgagatggcaaaatatgcaggaatttgctgaatgctcacggtgagcatattcaggttcaaaacatcatttttttcattttaaacatgtatttttcaagtaggtagattacttccacatgccagccaatgcacataccgtcttaatatcatgctggctggatggtcttgtgctcgttattgccctatcagggcctgtttcatggatttaatccttattacataaacacattttagaaacatgccaggtttcttagctcaatacagtatacagtacaaatcaatgtatccatcgtctcaggggaaagataacggcaattcataaactgatattttgcaagtacagaaatctgacattaaccaaataagaacagcaaatcatacgtagtatacataattcagaaaaaatgagcggatgagagacactcaggagtaaggagtgtacctcaagtgtaacagcatggtccattatgcgtggcctcgttgcagtgtagtccataggtgcatcaaccttctccggaatcagtttgtcatcccaagtaataaagaagaggtcgccatccaaatcgcccccggagcattcattcggatgaggcctaattaatttgaaggcttcaagtaaggatagtgcaagcattaacattaacccaaatggctaactgtaagctacacaattggatattaacataatatgggcaacatggctaacagggacaaatacggtgtcttaattcagtagacaggttgcttcacagccatggacagagaaattgaaatccacattctgagatggtctttttttcagcttcagaatagaaaacatacctttcccctctctgaggaaatacaacacaatcaataagacccctagcatccaatccagggtcatatacagcttcaagtactctgacatcaccaggatggagacaagcgtgctttgtgattgcaacttttcctacaattacagctgttttgccatcatcgttgcaaaagaacggctgttcactgtacttctgctccttgtgattctttgtaattctgatgtaaacttggccatactctaatttgcaagtttcatccaaacaaccaataagaacacggcctttctggacatgaatcttacaccgagttcttatgtcggtcagcctattagcccgatgggctttaagaatcattaataggtaaggctctgaacttggttcatagccttgcagaagcatatcagctgccgtcttggtatcaccgccaccaattttccctaggacagacaaagcagcttctttatttgttagcattccatctgattcgtgcatgtcatcttgttgcatcgattcaaatacttcatcctttatccccaatgttgaaagaagagagataatttcacggttcacataacatggctgagacttactccaatttgtaatgttcagcatagtgctcttcgattcaaacttcttcatactaggtcgcagagaaagattgaaaaaggatgtagggtcaatagtgatgactcctttatagcccccataccttatttgaaaagcagaaggaggatgagctgggtctaagccaattaatttggcgacctgtctggcaaatctagtagaaatcttcccgataccatctgaaaatatgtatttagtgccatcagttgtgacttcaatatctggaattacttctacatcatatgatgagacttcaaatgtttgcctggccgagctaaacagttggcccattctagctgca

SEQ ID NO: 21526 - DNA, 3397 bp, Zea mays
  misc_feature (2907)..(2907): n is a, c, g, or t
ggtacacctccgaggtctgccgggcactcgcacggccgcgctcgcaaaaagatccaggccgggtccacgcgcccacgggcacgggcggggatcccttccgttgtttcctaggccgcccgccgcccccgccggcccggtctccgtccgttcgtcgggcgcaatagagacaccacggcacgcgccgccgctcctgccctgcacttttctaccaccgaaggcgagggcgagggggccaaagacgagcgctttttcgtgcccgcctgcctgcctgctggtcattgccgctgctcacgagcctcccgccccgtgccgccctgccctctacggctctgccccaacgagccccaggggagccaggaaaaggagccgtcaaaagccgccgccgaggagagcgcgcaggtcaggcatggcatcaaccgttaccttcaacccagtgagcgcccaagctgcgctgatccaaaagccaaggaaccttggagccataagctatgctggcttaaagatgccggcatctgttagctctggctcagagtcgtcattcctgggctggaatgcatcccttcgggcagctgttactccaaggattgtgcccaaggcaaagtctggatctcagatatctccacaggcatcttacaaggtggcagtgctgggtgctgccggtggcatcggtcaacccttgggcctgttggttaagatgtctcctctggtgtccgagctgcatctgtatgatattgctaatgtcaagggagttgctgcagatctcagccactgcaacacgcctgctcaggttcttgacttcactggaccctcagagttagccaactgcttgaaaggtgtggatgtcgttgtcatccctgccggggtcccaaggaagcctgggatgactcgcgatgacctttttaacatcaacgcaagcatcgtcaagacacttgttgaggctgttgcagacagttgcccagaggcgttcatccatatcatcagcaacccggtgaattccacggtgccaattgcagctgaggttctgaagcagaagggtgtctacaatcccaagaagcttttcggggttaccaccctggatgttgtcagggccaacacatttgtggcgcagaagaagaaccttaagctcatcgatgttgatgtcccagttgttggtggccatgctggaatcacaattctgccactgttatcgaagaccaggccatctgtcaccttcacagatgaggaaactgaggagctgacaaagaggatacagaatgccgggacagaggtggtggatgccaaggctggtgctgggtctgctaccctgtccatggcctatgccgctgccagattcgttgagtcttctctccgtgcgctggctggcgatccggatgtttatgagtgcacatttgttcagtctgagataactgacctgccattcttcgcatcaagagtcaagttgggcaagaatggtgttgagtccgtcatttctgccgacctccagggaatgactgagtatgaggccaaggcacttgaggcgctgaaggccgagttgaaggcaagcattgagaagggtattgctttcgtgaacaaacagcgggaagctgctgcatctgtttgaggcgaagcaagtgaaacagaaggaacaatcgtcttgaatggcttttaagttttgcagcctagagttttttgttgtcggcatgtaggaagatgttccagatggttgctgtttgtttctaattgctacatgggggctgaacatccatcccccaagttatcgccggtttctgaaccaggccttatttacacataaattttgccccttctgtatcgtggttctgtttgtagcttgttggagtctacaaactacaaagaggctaataaaccacttttattggaagtgaaaaaaaaaaaaaaagcattgtcgtgaaaaaaacgaaaaagcagcggccccctggcttcattgcctactaaagttattatcttttttttttcatgggtaattgtctcattggttgagcaatcctagtcgaatttggtggtgttagaccttgatggtgacgatgggagacatggatggctggaaggttgcatttgtttcggtagattcggacttcacaaaaaaagaatttggttgttctgtgtctgctgtcctgttttctgcttggaagtcagccaggcgattctgttttagggataacagtggggcggctttaggtcagggctctacggattttgggtttatcgggttcgggcttgatttttctgctcaaacccgaaatgtatctggtttggttttgggttttcgtttccacacgtgaatgtctgatgaagactcgaaataaatcatgttgaataaaatatcgtgtgttttattaataattttttatgtgagctattaagtttgttataggtcgagtcatgaaaatatatgttcaatgcgtgttgtcaatagtctcttatttatatatgtgaatatgtaataccaagtattttgggaggtcttaaaaaaagatttaatggcgacgtttgcagactttcatagtggtgaattacaactctttaacctaaattttggaacaattattttgttaccaaaatgtaaagaggctgtaaaaaatcaacagtttagaccaatctgtttgttgaacgttagttttaaagatttttggaaggtcctgttgaataagttaacctcaggggtagtcgttttacacaaaaccatgcacgagatgcataggaagaaaattaatggggtattttttaagatagatttcaaaaaagcatatgacaaagtcaattggtcttttatgagatagacgttacgaatgaaagggtttagtgaaaagtggtgcaattggatcgacgcgttaactcagaaaggccatgtaggcattaagtgaatgattacatctgtaataactttcnaacctttaaagggctaagacaaggtgaccctctatcgctgcttctgtttaaattaacatggttgcagacatgttagctattatagttaacagagccaagcgtggtggtttgatcgcaggtgtagtttcgcacctagttgatgacaggttatctatctagcaatatgcggatgatacgatcttgtttatggaccatgacttagagaaagctcggaatctaaaaacgatcatatatgctttcaaacaagtctcaggtttaaaaataaacttccacaagagcaatatcgtctgttatggaagagcaaagaagtcggaacatcaatatgcggaactatttggctgtataccaggatcggtaccttttaaatatctggggattccaatgcaccatagaaaattatcaaactccgaatggcagggagtggaggaccgtttcaaaaagaagttgagtagatagtgtaacacccaaaatcctattttggaatttataa

SEQ ID NO: 21527 - DNA, 1008 bp, Zea mays
atataccgggtccacgcgcgcaagggcgggcgggaatccccctccgttgtttcctaggccgcaccgcagtcgccctcgccgcctccgtctccgtccggcccgcgggcgcaatagaaaaaccaccgaacgcgccgccgctcctgccctgccccccgtatctatagcaccgaaggcgaggagggggggccaaggacgagcgccttttcgtgcccgctggccattgccactgctcacgagcctcccgcctcgcgctgccctgccctctgcggctctgccccaacgagccccaggagagccagccagccagttaaaggagccgtcaaaagcccccgccgaggagagcacgcaaggtcagacatggcgtcaaccgttaccttcagcccagttagcacccaagctgggttgatccataagccaaggaaccttggagccacaagctacgctggcttaaaggtgccgagctttggctctgagtcatcattcttgggtaggaacgcatcccttcgggcggctgttactacaaggattgtgcccaaggcaaagtctggatctcagatatctccacaggcatcttacaaggtggcgctgctcggtgctgctggtggcatcggtcaacccttgggcctattgattaagatgtctcccctggtgtccgagctgcatctgtatgatattgctaatgtcaagggagtcgctgcagatctcagccactgcaacacgcccgctcaggtacttgacttcactgggccctcagagttagccagctgcttgaaaggcgtggatgttgttgtcatcccttgccggggtcccaaggaagccgggcatgactcgtgatgacctttttaacatcaacgcgagcatcgtcaagtcacttggtgaggctgtcgcggacaattgccccgaggcgttcatccatatcatcagcaacccggtgaattccaccgtgccaatcgcagcagaggttttgaagcagaagggcgtctacaatcccaagaagctatttggggt

SEQ ID NO: 21528 - DNA, 1825 bp, Zea mays
attgcgtcccccgccgcccggccggcctccgtctccgtcggttcgtcgggcgcaatagaaaaaccaccgaacgcgccgccgctcctgccctgacccccgtatctataccaccgaaggcgaggaagggggggccaaggacgagcgctttttcgtgcccgctggccattgccgctgctcacgagcctcccgccccgcgctgccctgccctctgcggctctgccccaacgagccccaggagagccaggtaaaggagccgtcaaaatcccccgccgaggagagcacgcaaggtcagacatggcgtcaaccgttaccttcagcccagttagcacccaagctgggttgatccataagccaaggaaccttggagccacaagctacgctggcttaaaggtgccgagctttggctatgagtcatcattcttgggtaggaacgcatcccttcgggcggctgttactacaaggattgtgcccaaggcaaagtctggatctcagatatctccacaggcatcttacaaggtggcgctgctcggtgctgctggtggcatcggtcaacccttgggcctattgattaagatgtctcccctggtgtccgagctgcatctgtatgatattgctaatgtcaagggagtcgctgcagatctcagccactgcaacacgcccgctcaggtacttgacttcactgggccctcagagttagccagctgcttgaaaggcgtggatgttgttgtcatccctgccggggtcccaaggaagccgggcatgactcgtgatgacctttttaacatcaacgcgagcatcgtcaagtcacttgttgaggctgtcgcggacaattgccccgaggcgttcatccatatcatcagcaacccggtgaattccaccgtgccaatcgcagcagaggttttgaagcagaagggcgtctacaatcccaagaagctttttggggttaccaccctggatgttgtcagggctaacacatttgtggcgcagaagaagaaccttaagctcatcgatgttgatgtcccagttgttggtggccatgctgggatcacaattctgccgttgctatcaaagaccaggccgtccgtcaccttcacagatgaggaagctgaggagctgacaaagaggatacagaatgccgggacagaggtggtggaggcaaaggctggtgctgggtctgctaccctgtccatggcctacgctgctgccagattcgtcgagtcgtctctccgcgccctggccggtgaccccgatgtttacgagtgcacatttatccagtccgaggcaaccgatctgccattcttcgcaacaagagtcaagctcggcaagagtggtgtcgaatccatcgtttctgccgacctcgagggagtgaccgagtgcgaggccaaggcgcttgacgcgcttaaggccgagttgaagggaagcattgagaagggtgtcgccttcgccagcaaacagcaggaggctgctgcatctgtttgaagtgaagcaagtgaaatggatgtccacaagagaataaagggacaatggtcttgaatggcttttaagttttgcagcctagagtttttttgttttggtgtcaacgtgtaggaggaagacgcagagatggttgctgttgctgttagtttctaattactacgcggggactggacatccatcccccccaagttatcgcatgtttctaaaccaggccctgcttaacaccacatatctatttttttctactcttgtattgtggttctgtttgtagcttgttcgagtttacgaactacaaagaagctaataaaaacacttgtattgtaaaagaaaaaaaaaaaaaaggccccta

SEQ ID NO: 21529 - DNA, 1347 bp, Zea mays
aaaaaaatgaaaaccatatagaacgtcgttcgcgaccccaccgtatccccctccctcgccccctcactgctctcgctttcgctcgccatccgccgtcccgctccgcacaccggccctgcccgatgccttcgcccgccgcggccgcggcggcgcctttccaccgcatcgcatgcgcgcgtcagcacctccctcaaacccgtctcttcttcctcccatcccgcgcgctgctcaaatccgaccgcctcaccgtcccggctccgctgcgcgtccacgcgctgaggctgcctccgacggtgccacgggcggcaagccacgatgccgccacgggcgtgagatcgcccacatctggcggccagatgctggtgttcgtcccgccgcacccgctcataaagcattgggtctccgtgctgcgcaacgaacagacaccctgcgtcatcttcaagagtgccatggcagagcttggtcggctgctcatatacgaagcatccagagattggttgcctacaatcacaggagagattgagacacctgtagctgtagctagcgtagaatttattgatccaagagagcctgttctggttattccaatactgagagctggtcttgcactagctgaacttgcttcatcagttctgccagccaccaagacttaccacctcggctttcgtagggatgaagaaacgcttcaaccttcaatatacctgaacaacctgccagacaagattccagagggtactcgtgtgctagttgttgacccaatgctggccactggtgggacaatggttgctgctattgacttgttaatcgagtgcggagttactagcaagcagattaaagttatatctgctattgcatcacctcctgccctgcaaaagctcaataacaagttccctgggctccacgtgtacacaggaatgattgatccagaagtaaatgagaaaggttttatagttccaggactgggggatgctggcgacagaagctttgccacataatcagactgcccaatttgattgggtcagtgttcgacctgcgagaatctttgcttgagtttcacagaaacggagcgactgccagtagcagtgtttattgctgtagattactttcgtttgagattttgttccttttttcagtgttatcagctgcctaccattttgtagcacccattctgtatgattgtgtagaatacaaggctagttcaaatgtccccagatggtaaaatgctcgagagaacaaggttccgttcaaaatgacggattattgaagtttctgctctctaatattttgccagtcgatggaataaacatacgtcattgtgcttaaaaaaaaaaaaaaaaaaaacaccac

SEQ ID NO: 21530 - DNA, 7538 bp, Zea mays
cggtaatcttatggttgcgaagagttatagggtctcaccttgacctagcataaccggaccgacactgagtatgataataatgtgatgtcaatcatctgcctcttttttttggcttgatgtgcatttaattttggtcttttgttgcttgttcgatatatgttggatgggaagtaataggcaacatatttctcaccgactattgctaccaggtggatgttggagcaatgcatgattctagtacgtgaaaggtgaaatgattgacgaaataaatttgctaaagtatgggcaacctcatcggcagtccgcactaacaagaaaagaaagcgagagttcttgaaggaaacacacgcactgaattgtctatagcaaaaaccattgggcaatacctacagctacagcgctccttgctttccgttacaattcctgaaacagaaggcaccaaccccagttagattagttcactgaagtgaggaacatttgcctattcttgttaggcagaatgggcaagaagtatggacaagagcaacgcattttatttgtccttgatgaattcaaaatcttgccagacgtgggcgcagtgcaaagcctcaccacacggctcgtgtgcagaggagagagatatatacacgactacacgaggcctcgaggccggccgggcaactcaccaagaacagcgccatttcttaatcgcagagcctaaacccggtcctcctaattatatcgccacagtgctgtcacaaccaggcgcgatcacaaagcttaaaacgcaccggcatggccactactgtactggatgccggtgaactgcacttgcacccctatgccgtcgccgccgcggcggcggcattggtgtcgatgtacatggtgtggttctgggcgctgacgcgggggctgtccgggccgcggatgtggcccctcgtcggcagcctgcccagcgtcgtcctgaaccgggcgcgggttcacgactggatcgtcgacaacctgcgctccacgggggaagcggccacgtaccagacgtgcatcttgccgatgccgttcctcgcgcggcgccaggggctggtgaccgtgacgtgcaacccgcggaacctggagcacatcctgcgcgtgcgtttcgacaactaccccaagggccccatgtggcaggcggcgttccacgacctcctgggccagggcatcttcaactccgacggcgagacgtggctgctccagcgcaagacggcggcgctcgagttcaccacgcggaccttgcgccaggcgatggcgcgctgggccaaccgcatcatcaagtaccgcctgtggagcatcctcgcggaccgctgcgaggccgccgcgagcgtcgacctccaggacctgctcctgcgcctcaccttcgacaacatctgcggcctcacgttcggcaaggaccccgagacactgtcgccggggctgcaggagaaccccttcgccaacgccttcgactccgccaccgaggcgacgctgcagaggttcctgttccccagcttcctgtggcgcgtcaagaaggcgctcggcgtcggcagcgagcggagcctccgcgagagcctcgcgaccgtggaccagtacatgacggaggccatcgcggcgcgcaaggcgacgccgtcggacgacctgctctccaggttcatgaagaagcgcgacggcagcggcagggcgttcccagaggacgtgctccagtgggtcgcgctcaacttcgtgctcgccgggcgcgacacgtcgtccgtcgcgctcagctggttcttctggatgctcatgctgcggcgcgacgtcgagcgcaaggtggtcctggagatcgtctccgtggtcagggagacgcggggcgacgaccgcaggaggtggaccgaggagccgctggacttcgacgagctggaccgcctcgtgtacctcaaggcagcgttggcggagacgctgcggctgtacccgtcggtgccgcaggactccaagtacgtggtggaggacgacgtgctgcccgatggcaccgtggtgccggccggctcagcggtcacctactccatctactcggttggacggatggagagcatctgggggaaggactgcgctgagttccggcccgagcggtggctctcggctgacggcacccgtttcgagccgcccaaggacgcgtaccgcttcgtggcgttcaacggcgggccccggacgtgcctgggcaaggacctggcgtacctgcagatgaagtccatcgcgtccgctgtgctgctgcgccactcggtcgagctcgtccctgggcacaaggtggagcagaagatgtcgctcactctgttcatgaagagcggcctccgcgtgcacgtcaagccgcgggacctcgccggctacgtcgcggcaccggaggacgcaccgcagctgggagcctttgtgatcccgaccacaactgcagcagctgcataagccttgcatatgcccgcgcacattggctcgggcttcttcctgctgaacttttttctgctatgtgatgtgcctctgcatgccaaagtcgtatcgttttctctgcacccccttcattagactgttaggtttgtggctacctggcgttttatggttgtaactgtgtatttttgtgtggatggatgtggtggtggatttaggataaaggatgaatgatacaaaattattacatatggttttgaaacataattcatgtattcgataaataattataaaatttcaaaataatttggtataaaaacagtaggtaacacatgataaatcctaatttcaaatattaaattagaagttacaatgaattacaatataaacagttcagatataatattaataattcaaatataggaaaaacatacttatctaattgtttatactaattatcttttttttgttgccgcttttttagaagatgatactcttgattatgtcatcttcgtgcacttaaaaaatgacatagtttaataaatatgattaaacaatcactgaaaaagactatcatccactatatatattatgtaacaattgtgaagctatcaacaatcgatggtctggcctttgattcttgaagttcacatttaaatggaagtgctgtcaaggttggcatgaagccatgaaccgaagtaaagtgtcattacaatttacaaccattcccctttcatctctcgtatccgtactttctatttattattatatacattcccctatttcaccttctctctaaccttttcccatattcagctttccatgtaaacctaaattgagttatttaatttttatacatcaattttagagttttaaaaaattatacaatatttatattacagtaatccacattgttgtcagttaatcaaacttaaaatagattaatttcgcaataatacaaaccaagatgatatcaccaacattaggctcagcctggatccataataggaaatcatgctcgcctcttttcttcggataatcagaatatcttcgcttggaagtcctctgacataccgggagtgtcgagggagagcacgcattcaatgtaaaattgtaagcccgacctcaaaaccctctgacatgcatgggcctcgcagcgaacaggactcagtacgtgtactgtgcaacctgttgggctagatttgtaattcttctaacggcccagtcaaaaacgaaatgtttgcttcgggtgtctggcacggacgttttctgagtctcctgactgatgagaaacgaggaggtggtgtccagtcgtccgtgtcaggtttccaacggagaggcggacggcggcaagccagtcaacgtagaccatatggagaccgatatgactatagaagctgtttggtttgtttgctttggttttggtgtgaccgaatcagaccatcggtagttttgtttgtaaatgtacgacgcaaatgaatcaatccccgttcacgaatcacgcctgatggtgagcggaagccaatcacgctcgcttccatgaacgtgcgatgaccaaccaaattgatttctccctctattcacatgatttagtcgttttaagtttgtcctaacttaaactatttaagctttaaccaacaatatatatatatatatatatatataatattagatcattttaataaaaaataattaaatattatggtagttaaagtaatgatgaatctagtaactttacttttatgttgtaaaatattacgaaacatccgatataactgatcaaagttgatattgattgacttagaacaaatctaaaacgactaattcatgtggacggaagaagtaagcaataattaattcccctttcgttgcctcaagatatttgtttcattcgttaactagttgatcgcttcgaattaaagttgaactactgcagctgtaatttatagagacaaaacactacagaagtagtataggttggtatagattagaactaaatgaatagcttaagatgaacgctctaaaaatgttagaacccgactttacacttaactataaacactaagtaaacatgaagtgataaaaagaaaacaccccatagtacagtgaaaaagatcggtccaccttcaagttgctctctattgctcggccgcttccagaagtcttgcacataaatgtgcactaaacatccatgagaggtaaaaaaaaagcatgcactgaaatttcagtaagaacatccaagctcaaccacgagcgcacagtgcataggaaggtgggtaaccggacaaatcacgaggatgtaagcggcgtgacgtcaccacagcagcaggtggcgcctaccacggctcgcgggaccatgcgccatgccgccatctgcgccacacattttcccccggagcaggcccaccgtcctggacccgcgtatcgaaataaagcccaggaaggttggtgagtgggccacgcgtggcccatccggctgccgggtcgtgagatccggccccggatcgcactagcgattcggcaacttgcgcgcagcgcgcacgttctgcacctgtattgtgtcgcactcgcacccaattccccagtatttcctgcagactcactgagtcactgtagtatttcttggcacctgccatccctgctccttgtacagcctggcgttcagcaaccttttccatgggctattccaaatatccgcatgttcctcggcatattccttgggcatatgaaatatgcacctctcgtttggatttcatcctcctcagccctcaggcctcactcaggtgacatatttttacgtacaggaagctagatcgtccgattgcttgaatgtttttttccccccgacctgcttggaaaccaagccacttgccagacttgcgctgacatagaagatcgatcagcaaatgaagctactgaaactgcatgcttgggatagaaagaaaagcttggcagttctccggtctctttgggtctggagaacgagggttcagtccacacaaacgcttatagaacatgtacatgccattatatatgccaagttggtgcaggttgtctgcagatgcttgcctctcagcagcattcgtgtctcgtcaggttgccaacatacttccatcttgctcaacgagcgcaaaagtaatgcactacttccatcttgctcaactagagcaatagtttcctcggaaagaaaggaaggttctagaactgctggctcaccagtagtcaatagtcatccgcgcgtcttgatcatgcatggaaggcaagcttctgcggatattggtgtgtgaacaacggagagagggataggtggcggatgtaacagtgtacggtcatccgagcttcggagatccggcgaggaggagataactgaggggtggcggcggatcgtcggctgttgctcatcaacggcgtctctgtcggccaaggagctatccagctgaatagctgacgccactcagaggatcctggcatcgacggtgtccagtggtgttctggtcaattacattacgggttccgggtcatgttaacagcgcctttatgatttgctcaccaaagctaacaatctcaaacctgtgcgttggtttgccttgagctggaagcagacacagtgttccgactgaatgtcggtggggccgctgcgtggaaaaaaattgcaagcaaagacaaaggcgggacggtacccctgattgagtagtgaccgttccctgctcgagaacgagagaggcccagaccgaaaatatctgagctgagccgaggcagcaaactgtcagtagtgccttctcgaatcctgagaaattaattaattttaagcttgacgacatttatagtaaaaaaacatatagatctacgaatatattagttaaaagtatgtaactttattaatttaacagtattcatttggtaatagaagattaatgtatacttttttgggattaaagtatgtaactttaaccggtggagaagattattcttggcccggggcgcgatgggaacagcagctgctactgctacatataaagccggcgcgcgcgcgtgcgtgtgtccagttccaattaagccagtgtcagtgtcagtgtcatgtggtggtgccgccaggtttgtaggggagcaagcgcagagcgagctctcacgctagccggtcatgccgctgtcaccgcgtcgcgtcggcatgccgtgccggaaaaagggaactgcgagagatgagtgaaaaggaactcgcgtccacatcgcgcgggcgagaggagctgagacacgctggtgttgtcacctgtttagcagcttcgttcgatctcgacttgagtacatgcatgcctgagggcggccatcaagccagtacagcactaattagcgatcgagcgtggcagactggcagctaggctcagtagtaaacttcagaaccttttgacgcagtagctgctagactagctagagactgacaagtcgagagagactagccaggtatgccttgcagtttgagaccactgagcgcaggaccagtttggttctgaacaacatgtggacgtcgtcgttggagatttaactggtattggtatctaccgcgtcgatgatgctgtgtctcacttgtctggcgtatcaaaaatctttacgcccacagatgctgagatctacgccgttaacggctgaccacacatggtggaacgaacaatcttcttttttccattcatcacctccaaccgccgtttgctgcctgtaaaactccggaaaaaaactaacggctgaagtcgcttgctgttgctggctttacttgaaaacaccagcggcgccgaaaagcctgtatgtacatgtacagaagagaacgtcaatgcatgcatgtagacgcgaatgcagctatgtactcccatagatcccagactcggcggcgttacgggccagaatccagacattgtggcacagaattcacggaaacgatttgttggatgtttatgccatgcatggtgtgcggcatgattctgaagccgtccattattattccatggcctttcgtctgacgacgacacgaagttaacaccgtgacgtgtgtgtcatggagagaaccggcggtaattaacttgttacatgcatggggccacactactcctttttttctgtttatttctctccttttttcactccatttc

SEQ ID NO: 21531 - DNA, 3450 bp, Zea mays
accaagcctccggcgacgggtatccgcttcgcttgtcaacacaaactcttatacagaatttggatcaccaactcaacagtaaacgagacacgataacagtgataacaatgtaatgtcaatcatctctgttattttgttgtcttttgtgaatttgattttagccttttctcgcttgttcgatacgttggatgggaagtaatatgcaacagatttctcaccaactattgctacctggatgatgttggagcaacgcatggttctagcacgtgaaaggtgaaatatttgacgaaattgatttgctaaagtacgggcaaccttctcggtagttcgcactaacaagaaagaaagcgagagttcttgaaggaaacatgcgcactgaattttctatagccaaaaccactgtccaatacctacagcgcttccttgctttctgttacattgttgaacaaaaactaccaaccccgcagttagattagtcactactagtacgtccactgaagtgagggaacattgcctattcttgttgggcagaatgggcaagaagtatgaacaagagcaacgcgttctatttgtcctcgatgaattcaaaatcttgcgagacatgggcacagaggaaagcctctcaacacggctcgcgtgcagaggatatatatacacaagggcgccaaatacatttcccaactccaacaagaacagcgccatttcttaatcgcagcgcctaaacccagcccctcctaattatatcaccgcacagctgctagaaccaggtgcgatttacaggcttaaaacgcaccggcatggccactgtacaggacaacggtgtcctgcacttgcacccctatgccgtcgccgcggcggcagcggcattgatctcggcgtacatggtgtggttctgggcgctgacgcgacggctgtccgggccgcggatgtggcccctcgtcggcagcctgcccagcgtcgtcctgaaccgggcgcgggttcacgactggatcgtcgacaacctgcgctccaagggggaagcggccacgtaccagacgtgcatcttgccgctgccgttcttggcgcggcgccaggggctggtgaccgtcacgtgcaacccgcggaacctggagcacatcctgcgcgcgcgtttcgacaactaccccaagggccccatgtggcaggcggcgttccacgatctcctaggccagggcatcttcaactccgacggcgagacgtggctgctccagcgcaagacggcggcgctcgagttcaccacgaggaccttgcgccaggcgatggcgcgctgggccaaccgcatcatcaagtaccgcctgtggagtatcctcgcagaacactgcgaggccgcggcgagcgtcgacctccaggacctgctcttgcgcctcaccttcgacaacatctgcggcctcaccttcggcaaggaccccgagacactgtcgccggggttgcaggagaaccccttcgccaacgccttcgactccgccaccgaggcgacgctgcagaggttcctgttccccagcttcctgtggcgcgtcaagaaggcgctcggcgtcggcagcgagcggagcctccgcgagagcctcgcgatcgtggaccagtacatgacggaggccatcgcggcgcgcaaggcgaatccgtcggacgacctgctctccaggttcatgaagaagcgcgacggcagcggcagggcgttccccgaggacgtgctccagtgggtcgcgctcaacttcgtgctcgcgggacgcgacacgtcgtccgtcgcgctcagctggttcttctggatgctcatgctgcggcgcgacgtcgagcgcaaggtggtcctggagatcgcctccgtcctcagggagacgcgtggcgacgacagcgggaggtggaccgaggagccgctggacttcgacgagctggaccgcctcgtgtacctgaaggcggcattggcggagacgctgcggctgtacccttcggtgccgcaggactccaagtacgtggtggaggacgacgtgttgcccgatggcaccgtggtgccggccggctcagcggtcacctactccatctactcggttggacgaatggagagcatctggggaaaagactgctctgagttccggcctgagcggtggctctcggctgacgggacccggttcgagccggccaaggacgcgtaccgcttcgtggcgttcaacggcgggccgcggacgtgcctgggcaaggacctggcgtacttgcagatgaagtccatcgcttccgctgtgctactgcgccactcggtggagctcgtccctggacacaaggtggagcagaagatgtcgctcactctgttcatgaagaacggcctccgagtgcacgtcaagccgcgggacctcgccggctacgtcgtggcaccggaggaagccccgcagctgggagcctttgtgatctcgaccacaactgcagcagctgcataagcctgcatgtgcccgcgcgtattggcactggtttcttcgtgctgaagttcttctgtatgcctctgctgtcaaagtcatatcgttttcgtttctccctcttcattagactgttaggtttgtgggtacctggcgtcatattggttgtacctgtgtagtttttgtgtggatgaatcggtttgtgtacttctgtacaaaaaaaaaaaaaaaacagagtaaaggagcattttactttgtatacaagtgctccttccgtttcgttttagttgtcgctggatagtgcaaaattaaactatcaagcgacaactaaaaagaaacggagaagtataaaacatgtttaaaatcaatggcggaggatcgagggtttatgtctctcttgtcttcgcggggatggcaacggatacgtattccattagatactgctcatctatactcatacctacgagataaattatactggtaaaaaaccatactcaccggtgggtataaaattgtacccatacttgcacctacatgcgtaaaaagtctatcgagtaatgcacatccgattaggtagccactaaacctatattaaatagcataaatttaataaatatatgatgtatttaaaatcataatcatcaaatgtaagttaataaaagaagaaaatttaatgagtaatgtagaaacatgcaagttgatcatatatgtacttaaagagtatatttatttatatgtacctaataccgaggtgggtataaattacccatcggtacgcggtatgagtagtatatacccatacccgcaaccgtctacgggtataatattgtgtacattaacgtactcacaggtaaagaatctatctcataactgttgttggggaaatgatccctaggcaaggagaaaggttcactcgggaagaactcgccctcgattagccccaaggcatgcgagaccggggtcgggcgaggcggattcgaaaggggggtcaggcggataactcgagagcgaggaagaagaccgagcaagaaag

SEQ ID NO: 21532 - DNA, 3558 bp, Zea mays
gatcttttttttcctaaaatgagccagcatgtatgcccatataatttggatgtggttaatagaggtcatcgcgttggttgtttacgtatatccagaactgttcgtataaaaaaacacttcattttttctcatgatattctcgtacacatagcacatccaacagtaacgcgcgcccacaggataatccgttgtcctaggcctttttattctagtagaaaagagagtaccgctgctttattgaaagcaaaagcaaataagcattcacattgaaagcaaaataatcgttcgcagacaaaacaaaaagggtgaggacacgggctcctaaacaccgtagttttcacataaaggtgacgcaggtgcaacagagattccgccgattccaccaatgcctaaaaccacgaaagccaggcgagtgtacgctcgtgtccacccatgcctcatctttcaacttgagcagtggccaccatctctgcacaaaagataaccccccccgcgacgccggccgggaattgagagattcgacgaccgaatgagtatcctgtgacggcctcggcaactcgctagctccatctcgccatctatctgttcatgaaacaaagcactatcttcttctagagctggtcacccaatctccctcgcttccacagtcactgaggccaggactcctttttttttctggtggaatgtaggggcaacgcggaaaacacgctgcaaaccttgcgtgcaaagtaggcttttaccaccaaaacctagcaacaatccatgttcttgcgagaatggcaggcaccagcactccagcagagtccactacatgtattgcatcagtcagttccggcgcaaaaagtgcaacggcgatcaaaagcgagtgtatacgtacggtcactgaattcatttcagaatcaggtttttgctatcacccgaaaatgacacatcacctccttgagcagttcagtcggactggactgtagggatacacatcctgtgcatcgatcgagatttctgcggagggcggacgtccaagtcgcttgctttgcttcacccggtggagaaaccagagcacagcgcatgacttttataaatatatggatcgctcgatccctctcggcatctatatatactcctgttgcgtagaatcggcacaagggtgcacgttcaggaggagctctcgtggcgtcctagtctgtggaaggtccaaagaagaagatggacggcgagatggacgaggacgtgctcacggagatcctcgcgaggctgccgtgcaggtcgctggcgcggttccagtgcgtgtccacgtcgtggcggcgcatcatctccagcgactacctccgccgccggctgccgctcatcacgtcgggcgtgctctaccacgatggtggcaggaggcagcagtcgtacacgtacgcgtgcgcgtcaggcggcggcggcggcggcggcgccatggcggaggccgcggacatgcgcttcttcccgcgccacgagacgtccaccatcatcgacggctgcaacggcctgctgctctactacgcgtcccgcccggcggcgttccacgtcgtgagcccgaccacgcggcggtgggcggagctgccggcgccgcgcgccatgacgctgctctccgtgctggcgttcgacccccgcgcctcgccgcgctaccgggtggtgtgcttcaccggctggctgccccggggcgccaccgtcgaggtgttcgactccgagcgcggcgcgtggcggggccacgagctcgacttcggcctcggcaccgacgccatgtccgcctccatgcactacgccgccggcgcgctccacgtgctggcctactcgggccacgtcgtccgcgtcgacctcgacaccatggcgtgcgcggtcaccccgctcccggcgcccgtcccctgccgcgcgcgcgccgggcactgccgcggccgcctgcggttcgcgtccagcgacggccagcgcctcaggatctgggagctccaggacgccgccgcgggcgagtgggcgctcaagcacgagatcggggtcagcgacgtcgtccccggcgacgcggcgtcacagcccatcacgttcctgttcatggcgttccaccccgaccgggagctggtgtacctgtggtcgccgtggaagctgctggcgttcgacttggtcgagaggcgcgtccaggaatgggtgttcggctccgagaaagaaggcacgcatctcatacaggtttggctgttcccgttctcgcgccatttggccaacgcgctggcctgatcaggccggcttgccgacgagccaaaaaaaaaaaaaagaaacatggggcgcaaatgttcgttgcctatccacactgctctgcttgcttaaacattgataaaatatcaaaaaaagaaaaagaaaataatgcgtcaaagactgtgttcgttgaacaaaaaaaaaagggagaagaaaaaagacgataggtagtagaactgaaaaatacatgcatgtaacaattatacattgcacgacatgtccatgtcctgtatatatcatgattactggtattaggactgttcacctgtaacggtgtgcaagcgtggaactgtctgtgtcgttgattttactagtaatgtttaagaacatatatatatgtggttcaagttactttgaatgttgttagcaactggagcaagttgcacaggagatatcaagttgtcaactgaatcgatgtgacagcttacagcgtgtactctcattgtattattatcgtggtacgcttgagttgaaatcatgccactcctttccttttcggctaaccgttcaagttatttagcttgtgagtgccatttactcactaacttagaatgcgttgaatacttgagtttgtttagcctccacgataggtgtgcattcgggcccgtctggcctggccctctagcgctagagggccaaggacgatacacagtgctgctagttcaagctgaactaggttttgtgatttattggtctaaaaaacacgctacggccaatgcaccaattataattgggtttcttgtttgtttttctattgttataaactttgtttattagatttgaacagataaccgatatgagttttcccttaataattccgtgaaagatacagaccaactcaaaaataataatgaggaagagatcaccgcattcgattcccgcacttccactcgagtacgccagcgggctccaggccgtttgtgcgtggcggcgtggtccagataaagcccggtttcctcctcctgatccgcatccggcaccggcaggcctcgctcgctggctcgctggcccacgacttgcatggcccatcagcgcacgcagcggtgctaacttcgatggactcgactcgcacggctgattcctgaacccttggcacggacccgtgattagcacaaaacccccaccccccagcggaatcgggccaggaaaggaatacgcaaaagtgttcaccacctccccatcaaccatacaactaaggctctggatcggcaggtgatcgacgcgacaagacaaccggcagttcggcggagtattgtatctgcactgacgcaccagcttcctacaaagcagcag

SEQ ID NO: 21533 - DNA, 1630 bp, Zea mays
accctatagagaaaccaaagcatagcccgacgcttcataatcataaataaataatatctataattctatatatatagcagtctcttgttgagcagaatcagcagaaaggtgcaggatcaggaggagctctcgtggcgtcagtctctggaaggtccaaattaagattagaagatggacggcgagatggacgaggacgcgctgacggagatccttgcgaggctgccgtgcaggtcgctggcgcggttccagtgcgtctccacgtcgtgcgccgcatcatctcgagcgactacctccgccgccggctgccgctcatcacgtcgggggtgctctaccacgacgacacgcgccgcggcgacgcggacggcggcaggaggcagcaggtgtacacgtacgcgtgcgcgtcaggcggcggcgccaccgccaccgccacggcggaggcccccgacatgggcttcttcccgcgccacgacacgtccaccatcatcgacggctgcaacgggctgctgctctactacgcgtcccgcccgacggcggcgttccacgtcgtgaacccgaccacgcggcggtgggcggagctgccggcgccgcgcgcgaggacgctgctctccgtgctggcgttcgacccctgcgcgtccccgcgctaccgggtggtgtgcttcaccgggtggctcccccggggcgcgaccctcgaggtgttcgactcggagcgcggcgcgtggaccgaccacgaggtcgacttcggcctcgacaccgacgccatgtccgccaccatgcactactccggcggcgcgctccacgtgctggcctactcgggccacgtcgtccgcgtcgacctggacaccatggcgtccgcggccaccgagctcccggcccccgtcagctgccgggcgcgcgccgggcactgccgcggccgcctgcgcttcgcgtccagcgacggagcgcgcctcaggatctgggagctcagggacgccaccggaggcgagtgggcgctcaagcacgagatcggggtcgccgatgtcgtccccggcgccgcgtcccagcccatcacgttcctgttcatggcgttccaccctgagcgggaggtggtgtacctgtggtcgccgtggaagctgctggcgttcgacatggtccagaggcgcgtcgaggaggagtgggcgttcggttcggagaaagaaggcacgcatctcatacaggtctggttgtttccgttctcgcgccatttggccagcgcgctggcctgattcggcttttttgccgacgagccggaaatagcattggggcccaagtgtttcgttgcctacccagtaccaacaagtccacaaccacaatgctcgggttactaaaaggtcgataaaataccaaaaaaaaaacagtcaaagacagtgttcgtcgaaataaactaaggaaaaacaattagtagtaaaactgaaaatacctttaatactacatggcgccttgaacggcatgttgttgtcctttatagatcacgatcactgtggtattggggctattcaattattcttccacgacggtgtgtaagcgtagtgtgtctcttcgatgttctagtaatgtttaagaatatgtggttcaagtggagtgttgagtgttggcaacaaaaaaaaaaaaaaaa

SEQ ID NO: 21534 - DNA, 716 bp, Zea mays
  misc_feature (706)..(706): n is a, c, g, or t
gccggccgggctgcgaaaatcatcaaaggtgcagcttcaggaggagctctcgtggcgtcatagtctctggaaggtccaaattaagattagaagatggacgaggacgcgctgacggagatccttgcgaggctgccgtgcaggtcgctggcgcggttccagtgcgtctccacgtcgtggctccgcatcatctcgagcgactacctccgccgccggctgccgctcatcacgtcgggggtgctctaccacgacgacacgcgccgcggcgacgcggacggcggcaggaggcagcaggtgtacacgtacgcgtgcgcgtcaggcggcggcgccaccgccaccgccacggcggaggcccccgacatgggcttcttcccgcgccacgacacgtccaccatcatcgacggctgcaacgggctgctgctctactacgcgtcccgcccgacggcggcgttccacgtcgtgaacccgaccacgcggcggtgggcggagctgccggcgccgcgcgcgaggacgctgctctccgtgctggcgttcgaccccctgcgcgtccccgcgctaccgggtggtgtgcttcaccgggtggctcccccggggcgcgaccctcgaggtgttcgactcggagcgcggcgcgtggaccgaccacgaggtcgacttcggcctcgacaccgacgccatgtccgccaccatgcactacctccggcggcgcgcntccacgtgct

SEQ ID NO: 21535 - DNA, 794 bp, Zea mays
gccaacatgcttattagcttgttgaagtatgggtcattgctctttgcgttgtcaagtgattcagctaatgcctttgaggatgacacgtccagatttaggccaatcgaagaggcagtacggagtaatggctcaagcatctcttttgttgggctaggatggcgccttagcaatgaacataaggggaaatgcttcaaaatcttctcagcaacagaaacattcgcagccaacataaattcttcaatcatttgatttgcctcacggatttgataaattcctatgtcaagaggatcatgagtttcactatcaatctcaaattttacttctgcagaagcaagagtcaaagcccctctttcacaacggcgttgtcgcatgatctttgccaatgaatttaagttccgcaagtctacagttagtggatcaactaagcggctgtcatccattcttgcctgggcttcaacataagacattgcagcacaagatttgataacactctttgtatatctcgttgatataacatcagcatccggagtcatttcccaaatgacagagaatgccaaccgttcaacatcagcacgaagtgaacaaacatcttcagtcaggggctttggaagcatatcaatccgctgcccaacaagataaacagaagtgcccctttgcgcagcttcctcatcaagaggggtaccagggtgaacaaaattagtgacatcagcgatatgaactccaacttcaaagttcccatttggaagtagtgtgcaatgtagtgcatcatcaatgtctcgacaacctggcggatc

SEQ ID NO: 21536 - DNA, 1007 bp, Zea mays
tttttttttttttttttttttttttaaccacccttgtcacattaacatacatctctttcacataaacagaatacaatgtcgtatattttctctattgtgagtaccattcagaaactaagcttccatgcatagagccccatgtattgagaaaaaactatctgatactacaaaatcttgaccatgtggtgattactgattagttttacaaatcgaaaatcacaccaatgttgaactaaagagtgagctggaggtgtgagaggcccgggaaaacactacaatgttgctacaattcagctgtacatttttcatatcagggtgagttgcagctttgggcgatgaggctgaggttcaacaacctccatatgaatcctgacagtctggaggatagcatagctgatgtttgttccgggcttggttactctctggtgcacctcgtcaacaacccaatcaccgcctttgtcgcccttcggagtaaggtagatgggcccttctatgccaaactttgggacaaatactatgaaaccatttgccttgatctttactatcctagcttcagtgtcagttggccttgtcttgaaatatatgtgggtgtggagttcaactgatgctctgcttgccatctgggcatttctgtgcctgtaattcaggttgtcagcaatgcctgtaagttgtggaccatcctgaaagattggtgggagctttgcaatattcagagctgcagctagcaatctatgaacaacaacatctgcatatctgcgaatgggagaagtgaaatgagtgtaaagagaagcagcaagcccataatggtaatattcagaaaaggtcaaatctccactgcagaaataaacagcctgtgtcatgcatctagtcgccaaaattctaataagcttgttgaagtatgggttattgctctttgcgttgtcaagtgattcagctaatgcctttgaggatgacacgtccagatttaggccaatcgaagaggcagtacctgcccggggcggcgctcg

SEQ ID NO: 21537 - DNA, 2031 bp, Zea mays
ggactgaagatcttaaatataatggtctatcaggtttccataaagactcctgctcaaatcgacatagtatttttgtcagggtccgcctcaaagtctccagtgattgaagagcggattagcaagctaacaggtcccatgctgagtgaccgtcttgaatcaaaacaaaaggaatttgaagagagatatgatcaaatctttaatgtgaacaataaggttgattccaaagagttatctgttggtagagctgccttatcaagtcttctgggcggtgttggctacttctatgggcagtccaaaattgcactcccgaaaggttttacacaaaaaaatggggataagtacatttcatattggcctgctgcattatatacagctgtccccagccgctctttcttcccaaggggatttctgtgggatgagggcttccatcagttagtcatttggcgttgggatgtgcatatatctatggatatcattggacattggttagatctgcttaattcagatggatggattcctagggagcaaatcttaggagctgaagctttaagtaaagttcccgaggagtttgttctgcagtatccttccaatggaaatcctcctactttatttcttgcgatacgtgatttagcaagtggaatacatgcacagcagttttcagatgaggacgcggaaaagatttcaagttttcttgaaagggcttatatacggctaaatgcttggtttcagtggttcaacagtacacaatcaggtaagtatgaaggcaccttctattggcatggaagagacaactcgaccccgcggccgcccaacccaaggactttgacatctgggttggatgactatcctcgtgcatctcatcctaatgatgaagaacgccatgttgaccttcgttgttggatgcttctagctacgaattgcatctgttccattgcagagttccttaaaatggatagtgctcttgagaaggattactataagatgtcaaatcaactttccgattttggaacacttaacaagttacacttggatgacacaattggtgcttattttgattatggtaaccatactgaaaaggttcgaatgagatggtttgatgtgaaagacaacaataatatgagacgagagttcttgcgagaaacattacaagcccctcagctgcagttagtaccccatgttggctatgtcagcctcttcccattcatgatggggactattccacctgaatcatgggttcttgagaagcagctcaatctgatatctaacacatctatattgtggacagattatggccttcgatcactttctagaacaagttcaatgtatatgaagcgtaatacagagcatgaccccccttattggagaggtgccatttggataaacatgaactacatggttctttcggcactacatcactatgcacataaggatggtccatatagcggcagggcaaaggaattgtatgacaagctaagatcaaaccttatccggaatatagtgcagaattacgatgcaacaggtttcttctgggaaaactatgaccagaaggacaaaggaaagggaaagggtgcacggtcatttactggatggacttcactcattgttctgatcatggcggagtcctacccaacattgcacaggtgagatatagatcgcgaacaaccacagcagaagatagctatggcaattggaatggaggggctggcagctggcgcttgtttagcccggtttgcaaccagaacactgggatagtttgattcgtagcatctgctgccttaatcatgaaaattttgacaacacctcctggtcaatctgttcagcatcatttatagagtgttagtggtcatccctgttcactctcatactgtaaactagctcctcgaagaactgattttggggggccaaaaccaccccaggaaagcatgagcatatggaaaacatgttcttgaaagctgacactacgtggagctgttacttgctattgagtgtaatctactgctactcttactatgcttggccatttgcaccccc

SEQ ID NO: 21538 - DNA, 961 bp, Zea mays
tttttttttttttttttttttttcttaggaagcctaatgctatatataaagtctatttcaaacttcactcaatagacagtgtggtctactgtttacatgaccatatgcatgctctgctaagagcagcctaaccatagccaggttagactcagggttgctgcgtgctcggcgttcccttcatcaaaattaaaagtaaccactagccccgaccgtgagtttcctcagttgcatattttgggccactttgtcgagctttcccaacaactaacgctgccaagttaatgacacacttaaatatctggcttcattggccaagacatgccttcagtctctggacttcacctacgaggttggagttcatctcacaagcatccttcaagatttcaaatctccggtcaagctcactgctcttggaatcctgtgcgatgccttgctgaacgaagcacttaagcataacctcatgatgccgcttctgtgcatagcaccggataagcgatttgaccagtttttttcgcagcattgtgccagaatcgctggactggaagacaaagcctgaaaggtgatgctttgccaatgtgaaggccatggaatcacgctgtaaagctttgtccaggacaccagacgtccatgatttagcataagattccaaaattttttcatcatcctcaagaggctccaagtatcctggggcgttgccaatgcatttgtctagcgggggtaacagttcaagcacatacgcactagacagtgcattccatgctgcaagacgtactgctggctcagcctttctatgcagataaatggccacttgccgaccaaaaacaaaatctccatatgagacagctgcaaattgatcaaccaggctctcaacaaaagtagtatagcttccatgaattttctcctgaaacctgagaaatttcaggctactgatctccatcgcttcctctgaagtgcccactac

SEQ ID NO: 21539 - DNA, 2053 bp, Zea mays
acaccgatcgcggggccgatcgagtctgctgaagcctcgcctcgcctcgcagaagaagcagcgtgagtaaaaaacccgcagggtgcagacgaaaacctcgtccgtttccgtcgtcttcctcctccctccgtctcccttcacccggcctcggtgggtccgctccccagccacgcgccgctctcttatttaaccccggccccggcctccgctccgccactcgcgcacccatcacaccccctaaccactccacctccctcagcagccctcacggccactacccactgcggctgtaccacctgtacggctgcactgtccgtcgatcggctttgcaccacacgtccgcgcgctcgctccgtcggtgtcggtagccatggcgctggcggggacgggggtgttcgcggagatcctggacagcgaggtgtacaggtactacgccgacggggagtggcgcagctccgcctccggcaagtccgtcgccatcgtcaaccccaccacccgcaagacgcagtacagggtgcaagcatgcacgcaggaggaggtgaacaaggcgatggacgcggccaaggtcgcgcagaaggcatgggcccggacgccgctgtggaagcgtgcggagctcctccacaaggcggccgcgatcctcaaggagcacaaggcccccatcgccgagtgccttgtcaaggagatagccaagccggccaaggatgccgtttctgaggttgtccggtctggggatttggtgtcgtacacagctgaggagggtgtgcggatactcggggagggcaagctgcttgtttcggatagcttccctggtaatgaacgaaacaagtactgtctgagctccaagataccccttggagtagttttggcaatcccgccgttcaactatcctgtcaacttagcagtttctaagattggcccagcactaattgcaggcaatgctcttgtgctaaagcctccaactcagggcgctgtggctgcacttcatatggtacactgcttccacctggctggtttcccgaaaggtttgatcagttgtgtgactgggaagggttctgaaataggagattttcttacaatgcatcctggagtcaactgcataagttttactggtggcgatactggtatagccatttcaaagaaggctggaatggtccctcttcagatggagcttgggggaaaagatgcttgcattgtgctagaggatgcagatctggatttggtttccgcaaatatagtaaagggtggcttctcatacagtggccagaggtgcactgctgtcaaagtagtgctgatcatggaatcgattgctgatgctgtggtacagaaggttaatgccaagttggcgaaactgaaagttggcccacctgaggacgactctgatatcaccccggttgtaacagaatcctcagccaacttcatcgagggtctggtgatggatgcaaaggagaaaggagcaactttctgccaggagtacaggagagaaggcaaccttatctggccgttgctgctggatcatgtccgccctgacatgaggatcgcatgggaggagccttttgggcctgtcttgcctgtgattaggattaactcagttgaggaaggcatccaccattgcaatgccagtaatttcggcctacagggatgcatttttacaagagacatcaacaaggcaatcctgatcagtgatgcaatggagactggaactgtgcagatcaactctgcaccggctcgtgggcctgatcatttccccttccagggactgaaagacagtggcattgggtcccaggggataacaaacagcattaacatgatgaccaaggtgaagagcactgtcataaacctgccgtcaccatcctacaccatgggctgagatattcttgttaagtgttctatagctccatgagcaatgtagagagttaaatgtttcatagccacgtgagatttggacgctatttacacctcagttcttcctgcagaagatcttttgcagtttaaagaataaagtgcgttgaaagtaaaaaaaaaaaaaaaatccagcccgctcgcgatctagtaa

SEQ ID NO: 21540 - DNA, 1575 bp, Zea mays
cgacggcctccgaggcggggccgaaccgccgaggtagccaagacaacacgagcagcgaaacgccatctattcccgactctgctgcacctgcacctccgggccgccgccgagatgggcgcggatggcgggctgaaccgggcggcggagaagcccagggatggagagggcggggaggcgagggtgttccggtgcacggactactcgctgccgcggacgacgctggcgctggcgctctggctgggcggtatccacttcaacgtccttctcgtccttgcgtcgctcttcctcctctccggccgcgccgctgccatagtcgtggcgttccagctcttgttcatgttcgcgcccgtcaacgacagggacaaatggggccagagcgtcgccaggttcatatgcagacacgcaatgggctacttccctatcactctgcatgtggaggactacaagtccttggatcccagcagggcttacgtgttcggttatgagccgcactcagtgctgccgataggtctgtcggctcttgctgatcttgttggctttctgcctctcactaagatcaaggtccttgcgagcagtgcggtgttctacaccccgttcttgagacagatttggacatggcttggcttggtacctgcgacaaggaagaatttctactgctaccttggagctggttatagttgtatcgtagtccctggtggtgtacgggaaatgcttcatatgaacaatgattcagaggttgcttttcttaaatcaagaaaaggttttgtcaagatagctatacagtctggatgtcctttagtcccagttttctgctttgggcagagctatgcatacaagtggtggaggcctggtggtaaattgtttatcaagatcgctagagcagttaaatttactcctattatcttctggggtagatttggcacaccattccccttcccaaaacccatgcatgtggtcgtgggtaaacctattgaagtcaataagattccccatcctacaattgacgagattaatgaagtccatgaacagttcatcattgccatgcgggacctctttgagaagtacaaggcgaaagctggatatcctggccttcatctaagagtcctatgacattccacaaccagactcaaagttagaattcagcaataacatggctctattactcttccctcaactggggtgtcaaactgcacctcgcaggcactcgggcggtagttgttgcattatggtgatgataataaggctccagcaccgatgccaaaacatgcacgagttggtcacgagtcagagccttttgttgctggcttaacttttttctttaatgttgcaaagataagataatgtaattactggttatgtgatgttgcatatgatatgagaatatgaggattggtgatatataagctcctgccctggcccctctggcgctgcatacagtactgcgtcagcatccggctgcagcccaaggggttcttgaactccaagcccaacatgcaggtctactgctgctgcgtaatcccctagcatcataacttctcgtcaacacacctaaatctgcagtcctgctagagaaga

SEQ ID NO: 21541 - DNA, 1455 bp, Zea mays
gaaaaaggacatgtgttcttgaaggttgactggacaaatggtatgacgaggatgtcgaagatctacatgaacgaggtaaccgaagctgttcatgcggggaagggcttcaccatcttgaaaagacagctggagaggggtcaattgctgatggtagctccatacttggttaaacgtaagaagcagcattttcatcatcttgaaaagtacaatgtcgacttgattcttggttgcaatggatttatctgggttggtgagcatgttgtggtgggtgaaaaaccaaaaacgacaggaggtcagcaggggttcagcactgaagcatagaatttcaccccattagagacaaggaagcatatttgccggcttgccaattctgtacgtgtgctctcagccctatgattcactctgaccatcgaattgataattgaaaccatggaagcaagtgcgtcatcaaatgtagagataaatgacatgctcggggctaagttttacgtccagacagcagagagggaggctaagcgccgagctgatctgttgagaaagaagaatggggcaaagtgagtaggtagcgccctcatccttggtgattggggctgcctgatttgcagagaacagctccatccgcatgtgtagcagtgccataatacttatctgatggtatctaaggcaaaattagtaaacatgttctatgtacacctttacgagtagcaattagcaaagatgtaaggggttcgctccgctctgatgttgtacatgcatttgatcatggtgcctggtgccggcagtgttgtgcttggcaggtctttgatccgttcgttgctgaagtcgatacacttttgagttgaaaaactggacgttcttcctattgaatattccagtaaaaaaaaaaaaaaattatgttgcctgagaaatgtgcaaggcattagcctgatggctataggaacaattcatttagccactctacgaagttgtcaccacagggtgtgcaaattaccaacgctttgttcatgcgtggtgaattcaatgctagaaagggattttgttgactaagggccatttttttcagctgtagaaatttggttaatatctcttgtttagtgaattaaatagattttttgcccatgctgctggatgtttagttcgtactataacttgtgaaggtccagggtccaaatacagtatcatcaatttcactgaaacaatctgaattctacgccaaataattcttcggtgtgtaagttctgtgtatactgctttcatgtgaatgtggctttcaagggtgctctatgtataaactgtataaattagctccaaataattcagatttctataaaataatttgtatagagtgtgtataaactgaagagcaatctgataaattgtgtataaactaattagctctgtccaaataatccagtttatacaagctagatgcatagaccgtataaacactataaa

SEQ ID NO: 21542 - DNA, 963 bp, Zea mays
tagggccttttttttttttttttaatggacatcttcttacggctcgagttatttttgaaaaaaacggtgttctttattttgacagccaaatagaagcaataatacaaatgcgacgcccaattatctatactcgacaatgctcaaccaatacggaacagtgacaccacagatcctgaatgtctggatccccaaacgccgtgggcaacagagctagatgagccaagattgtcacgcggccgagatgccgtagacggcaacagccgcgaatgccagcaccaggctcaccgccccccgggtcgacgcggcgccggacgtcaggaacggggccgtcggcgtcgccttcgatccagtgccggttcctgcggtcgctggtacgccggccgacggcgtggccggcgtcgcggcgcccggagcgctgccgccgccagcagagttgcacttgctcgccggcggggtcttgacgttgcacgcctgggggagctggagcgcgcgcgtcttgtcgacggtgacgccgccgagggacgaggagtcgccgctgagcgcggcgcagaggcactgcgggttggtctgcacgacgctggcgagctgcgagcagcacgaggacggcggcgccgacacgttgccgctgatgtagttgaggcacgggtacaggctgatcagcgtggtcgtgcacccggactgcgccgacgccgaggccagcagcgccgccgccacggtggccgccaggagccacgccacgccccacgctcctgctcttgttgctgctgccgccgccatttctctccacgcctcgatcggtaacgcgagagccgagagggcaggcctccccgaggtctcggacaggaagctgaactgccggttcgtgttctttggattcgtgtgcttgagttcccggccccggcccgccccccggatgttttttataggactggttcgtggttcgtttgggaagttggatgggtt

SEQ ID NO: 21543 - DNA, 3146 bp, Zea mays
agcttgtcatattatctctgcaaagaagaaaatattttggcttacaatgaatcaaagaagtttaaaaatggatatatttttgggtttaatgcccataacattttgcaaacaatggattagcggacaaatttacgaacatcttgtagaaacaaacaaacaatgttctttactctgacaaccaattacaagcaatagtacaaacgcgacgccaaatcctctacgccaaattaaatcctgaacgtgtcacgtctgaatccccaaacgccgtgggtaacagagatagacgagccaagtctgtcacatggccgatatggcatagacggtgacagccgcgaatgctagcgccaggctcaccgcgccccggactgacgcgccgccggacgttaggaacggcgccgtcggcgtcgccttcgatccactgccagttcctgcaccagtgcccccgtcacgtaagaaacaagctagccgtggacagctgagccggtgagcaataacggttgtttggcgccttacctgcggctgcggtcgctggcacgccggacgacggcgcggccggcgtcgcggcgcccggagcgctgccgccaccaacagctgccaagaagcaacggacgcggtcagctagtcagcacggttcaacagtgaatcatgttgctcggcagtcggcagcgccagcagctctgcgctgcaccggtgggagtgggagggattggattgggtcgggtggaggagcaggagcagaggagcacactcacagagttgcacttgctcgccggcggggtcttgacgctgcacgcctggggcagctgcagcctgcagcgcgcgcgtcctgtcgatggtgacgccaccgagggacgacgagtcgctgctgagcgcggcgcacaggcactgcgggctggtctgcacgacgctggcgagctgcgagcagcacgacggcggcggcgtcgacacgttgccgctgatgtagttgaggcacgggtacaggctgatgagcgtggtcgtgcacccggactgcgccgacgccgaggccgccagcgccgccgccgccacggcagccgccaggagccacgccacgggcgccgacgctcctgctcctgctcccgccgccatttctctcctcacctcacctcggtaacgaacgcgagaggcctctctgtccctgatgaggtcttggatcaggaagctgaattgccgccggtttgtgttctttggatttgtgtgccggacccggggtctttggatcggtgttgatgagggtttttataggacgggttggtttgggaagttggatgagttagttaactttggtgatctgccgcttcctaatcatcttttttcgcttcgatttgtgcaggaaaggctatacatacggggaacctgctaaaaaaaccggtgcaagcaacgttttttggtggctgtgacaacgacggctgaccggcattttgtaaaatgaaccgcttcaaattttcagcctggaatccaatccctggatattactacttccgctgaagataggaatacatcatgagatttctgtttgattttataaggcggctgtagtgtagggctgctgctactgctatgccgccatccggtaaacactgacgtatatccatcattggtagttgttgttcaactacgctcatggcttcaccaaatcgttaccaatctattgcccagtcgtcgtttgctatctctaatagcacgtgtttgatagtatagatattaatactttcttgatggacacaattaagttaaaagtggtcttgagtaggtactatgctagaattgtaatttgtcaacacgtagaaagtatctgacaattttaagtttgatgaagcgtatgaataataatggaatagacgaagattgggtcaagtgtgtcgcacgaattgtaattttaagtttgatgaaccgagcccacgtttagcagatccactacagcgcccacagcccgaatgtttgttattggcccagtaccagaggcccatatacgtctctatgtatcaggagcccaccgcggagtcgacaacccagcgggagtacgcgttggtcagttggttgagtggccggagaagtttagtaccaccgcggcagtcgagctgggacgcgagtgagctgccgctataagaagagcgccctgtgcaccgttgctacatacttacctggacggggtcgacgtgggatcaagaagccccgtggcctagatcagtggcctgcattgcacttggctggtgcgctggtctaccatctccccaagtgggagagtggacgtcataatttgtggcagagggggtacgcgttcgcgcggcccctgccaaatcaattaaaattttttcattttttctcctctgttaagcctgaaaatgatagaccagttcttgttctagcgtcccgccatagttatcagcaaaaaaataactgttggtcttttctattgttaggaagatggtttgtatccattggcaaagccgaaatccctcacctctcacctgacgtttcctcttacaaaaatggcgccattaacaactgaataacctctgttgcatgttataaaccattcaggttacctcgaaccttctctattagagttttttttacagcaacggggaccatgctcacctttcattacttctctgctggagcttagactgtccgcaaccgttccccctaaatttttccccctaaatgttactatgcagccacgtcagcaagatttcatcccctatattcactcgtcccgcaaccattccccctatagtttcccctatatatccctctactcattaaaaaaccatttccatataactaacttaaccaactttaattttgattttatttaattattttgcacacgtccgacatgttgcgcatgtattaaaaaaatacaattataaataataattagtttacaattacttgcacatataatatataacaactattattttacaatacattcgaaattgcataatttcgtgaaaacgtattatccgtcttcggttctggaatatattttcctgcgaagcaaattccattattattcgaatacggtttgatatttgcaatttcattacaaatattcttgcgctccacggcggggtgcgtggagaccagccaaaagaaccaggagagcgccaccgaggagc

SEQ ID NO: 21544 - DNA, 882 bp, Zea mays
ccgcccttttttctttttctcgtacaaggaaaaaacggtgttctttattgtgacagccaaatacaagcaataatacaaatgcgacgcccaattatctatactcgacaatgctcaaccaatgcggaacagtgacaccacaaatcctgaatgtcgaatgtctgtatccccaaacgccgtgggcaacagagctagatgagccaagattgtcacgcggccgagatgccgtagacggcaacagtcgcgaatgccagcaccaggctcaccgccccccgggtcgacgcggcgccggacgtcaggaacggggccgtcggcgtcgccttcgatccagtgccggttcctgcggtcgatggtacgccggccgacggcgtggccggcgtcgcggcgcccggagcgctgccgccgccagcagagttgcacttgctcgccggcggggtcttgacgttgcacgcctgggggagctggagcgcgcgcgtcttgtcgacggtgacgccgccgagggacgaggagtcgccgctgagcgcggcgcagaggcactgcgggttggtctgcacgacgctggcgagctgcgagcagcacgaggacggcggcgccgacacgttgccgctgatgtagttgaggcacgggtacaggctgatcagcgtggtcgtgcacccggactgcgccgacgccgaggccagcagcgccgccgccacggtggccgccaggagccacgccacgccccacgctcctgctcttgttgctgctgccgccgccatttctctccacgcctcgatcggtaacgcgagagccgagagggcaggcctccccgaggtctcggacaggaagctgaactgccggttcgtgttctttggattcgcccacgcgtccgcggacgcgtgggcg

SEQ ID NO: 21545 - DNA, 2761 bp, Zea mays
  misc_feature (202)..(202): n is a, c, g, or t
gtttctcctgactcccaaatatcagagtctgtttgattagattgtgtttggttgggttgtgaatgcaaaaaaaatgtcgtagactgtgagctataaaaaatatatgggttgtgagttgtaaaaaataacccgaaagtcatggaatttgttgtggttgtgcgagtaactgatgagcggacgctgccactgtcgattggtgatngaaaagaatgaagtagattttttcactttatcagtggcaagcgggtaatatttataatttcacccaaaaaccactaaaagtagatctagacatgctttcaatttttcactccgagaaagtcggttttgagaaaaaagttgttgactaaaaaaatattttttttttttttttgtaaaaatagtgatatgttggtcaatttcgtatttgagcttaacaaggaactaacaaaggttttaaaatgggcatatttaggggttaatgtccattcacgagggagattttccagacaacggagtagtggacatcttcttaaaacgatttgtacaaacaaggaaaaaacggtgttctttattgtgacagccaaatacaagcaataatacaaatgcgacgcccaattatctatactcgacaatgctcaaccaatgcggaacagtgacaccacaaatcctgaatgtcgaatgtctgtatccccaaacgccgtgggcaacagagctagatgagccaagattgtcacgcggccgagatgccgtagacggcaacagtcgcgaatgccagcaccaggctcaccgccccccgggtcgacgcggcgccggacgtcaggaacggggccgtcggcgtcgccttcgatccagtgccggttcctgcatcggttcgtgtggtgtaagagagaagccgtggacagctgaaccgtatgatgattgatgagcacagttgttcgtcgccttacctgcggtcgatggtacgccggccgacggcgtggccggcgtcgcggcgcccggagcgctgccgccgccagcagctgccaaagcaaggaatgcggtcaattagcacgcctcaacaaaaggactgtaggagtatgcaagaatcacgtcgctcggcagccggcgccgccagcagcagctctgcacgcccggagcgctgccgccgccagcagagttgcacttgctcgccggcggggtcttgacgttgcacgcctgggggagctggagcgcgcgcgtcttgtcgacggtgacgccgccgagggacgaggagtcgccgctgagcgcggcgcagaggcactgcgggttggtctgcacgacgctggcgagctgcgagcagcacgaggacggcggcgccgacacgttgccgctgatgtagttgaggcacgggtacaggctgatcagcgtggtcgtgcacccggactgcgccgacgccgaggccagcagcgccgccgccacggtggccgccaggagccacgccacgccccacgctcctgctcttgttgctgctgccgccgccatttctctccacgcctcgatcggtaacgcgagagccgagagggcaggcctccccgaggtctcggacaggaagctgaactgccggttcgtgttctttggattcgtgtgcttgagttgtgtcccctggctttgtgttgatgaggtttttataggactggttcgtttgggaagttggatgggttagttaactttggtgatctgccgcttcctaatctgactgggaaatcatctttttctcttcgactggtgcaggagtggacgagtggttacgagatcgatagtacttaattcggggaatctgctgaaaaattggtgctctgaatttcaacctgacgctggcccttgccgtgttaggtgatgcaagcaactgtataagcaacaattctggtcactgtgagcacgacggttgaccagcacacccgtttcgaatttttttcatcctggatactactacttccactgaatatagaaataaatcatgatattcatatttgactacttttgattaaaatgatgaatggtactaattatttcttttagggcagtttagcaatcttatttttcttaaagatttttcattttcttaagagaaaaatgaactaatttctcttgataaaataaaaatttattgaaaaaatagggttgctaaactagcccttaaaatattaaatgatgctaccaaactcataaccggaagaaatttctaatgattataataacattataaaaaaaagagtccgagttcagttttgatttcgagacagcatacggttgacaactatactcttgttttgaaataaacaggatatttattaactgcaaaacaccccgatacaaaaaagaaagcttccacgtaaatataaaaatattcttttgatttatggacaaccaatttgcatacgacgcaataatataggcacgcatcttagccattctattgcatttataatcttcgcatataggcgatttagagtgtgtttggttaaatgtttatggagaaggatggagggaaagactatagtttttataatgtttggatgagattcacgtaggagcaagataaactcctgagtagtttttggtggcagcgtgatccaaaaaaaattgaatggaccatgtcgccccgtcttatcctactttgacatcaaactaaacacgttcttaatcttcaaaacatgagttctgttcatgttacccttaataaaacagttccaggtatagtcgtgtagttgtacttgttaaactgtgaatatggaaacgtacaaatgtgcactattattat

SEQ ID NO: 21546 - DNA, 1279 bp, Zea mays
ttttttttttgcttccaccaatatcaccactatgtattactccttcaacaagtacaaatagccgctcaaaaactagtataaatagttaacagcactgtacaacttaactaaagatgattcataagtccatatttcaactaccaaaaataaaacgatgaagtacaagctgcacgttccctatgtattttagttaaaacagggacttgtaacatcacgataacctatactggcagtttagtcacagtcagcaaccaaggaagaaacatatgccagcctctgtttgttggcacaacctatccaccggaagtatgcgattgggactttggactatcatcacaaaaataccacttaaaatgcggctctcattgcaccccttgtcgcatcacgcttcatctctgcagcctttccacttccacggaagtacatgtacacttgctggatgacccagatgctgagcaacgattccagacaaaacaatccaaatccaacaaagtagaatatcccaaccaaagcattcacgctgataagatcaattgctggcaaaattcctgccaatgattttccctcaaatacagcaggaggagccacagcagcaaacacgcagaaaagaatatggaacaagtaaagcaagaagaacaatccaaacttcaatgcactatcagtcctcattgcattatacagaggacgataccacaaaacatatgcaccaggaacaccagatatgaagtaaattattgccaataaccagatcttaacaccttcccccttgatccaagctgtagtaactgctatgacattccagaagaggcagcaaaccaacccaagaaacgaggcaaatgcaacatattgcattctttgaaggtgactcggtatctcattgatgatatcatgatggatgagtggcataaaaggaggccaatttttctcctcaatgacaatgccagctcttgctgcagcctcctctctccgttttagttccttctccctcttgtttaattccgcttcccttgcttgcagctccttctctcttttcttcaggtcctttgacgagtcaaggggtatatccactgtagcactgaagtctgccggttcaggagggagcggcgaaaggcgtgaattggatgtcggaggcacgttttgggggttaggcatacccggcccgcctccgccaaagttggattgcccgccagccttgccgcgcgtttgttgcgagaaagggttcacgtcttcctcctcgaaggggttgccgtcatagcgccccgccatgctgccctcgtgc

SEQ ID NO: 21547 - DNA, 1467 bp, Zea mays
ggccgcgggtttgttgccttgccaaatgcttccgccaatatcaccactgtattattgttccaacgaagtaccaatagccgttcaaaaggagtacaaatagttaacagcactgtacaacttaactaaacttgattcataatccattccacatttcaactagcaagaacaaaacgattaagtaaagctgtaaaagctgcacattccccattcttgttagatcaggacggggagtgatataatgtcacttgtaacatcatgataacctactggcagtttggtatcatagtcagcaaccaaggaagaaacatctgctttttgttcggtgcacaacctatccaccggaagtatgcgcttgggcctaggactgtcatcacaaaaaaaataccacaccacacttaaaatgcggctctcattgcacccctcgtcgcatcacgcttcatctctgcagcctttccacttccacggaagtacatgtacacttgctggatgacccagatgctgagcaatgattccagacagaacagtccaaatccaacaaagtagaatatcccaaccaaagcattcacgctaataagatcaattgctggcaaaattcctgccaatgattttccttcaaatacaacaggaggagccacagcagaaaatacgcagaaaagaatgtggaacacgtaaagcaagaagaacaatccaaacttcaatgcgctatcagtcctcattgcattatatagaggacgataccacaaaacatatgcaccaggaacaccagatatgaagtagattattgccaacaaccagatcttaacgccttcccccttgatccaagctgtagtaactgctatgacattccagaagaggcagcaaaccaacccaagaaacgacgcaaatgcaacatattgcattctttgaaggtgactcggtatctcattggtgatatcatgatggatgagtggcagaaaaggaggccaatttttctcctcaatgacaatgccagctctcgctgcagcctcctctctccgttttagttccttctccctcttgttcaattccgcttcccttgcttgcagctccttctcccttctcttcaggtcctttgacgagtccaggggtatgtccactgtagcactgaagtctgctggttcaggaggaagcggcgaaaggcgcgaattggatgcaggaggcatgtttctggtgttaggcatgtaaaacgcaccaccgccgaagttggactgcccgccagccttgccgcgcgcttgttccgagaaagggttcacgtcctcctcctcgaaggggttgccgtcgtagcgccccgccatgctgctccgccccttctgcttgaaggagtcctgccgaacagaggagcgcacacgcgcagcaccgcccccacaccacaccgacaccgactagatggggcgggcgatggcgactcctctttgccgtcttgcgaaggagaggatgaggcgggtgaac

SEQ ID NO: 21548 - DNA, 792 bp, Zea mays
  misc_feature (67)..(67): n is a, c, g, or t
cctcatcgcattatacagagggacgataccaccaaaacacatatgcaccaggaacacccagatatgnaagtaaattattgccaataaccagatcttaaccaccttcccccttgatccaagctgtagtaactgctatgacattccagaagaggcagcaaaccaacccaagaaacgaggcaaatgcaacatattgcattctttgaaggtgactcggtatctcattgatgatatcatgatggatgagtggcataaaaggaggccaatttttctcctcaatgacaatgccagctcttgctgcagcctcctctctccgttttagttccttctccctcttgtttaattccgcttcccttgcttgcagctccttctctcttttcttcaggtcctttgacgagtcaaggggtatatccactgtagcactgaagtctgccggttcaggagggagcggcgaaaggcgtgaattggatgtcggaggcacgttttgggggttaggcatataaaacgcgccaccgccaaagttggattgcccgccagccttgccgcgcgtttgttgcgagaaagggttcacgtcttcctcctcgaaggggttgccgtcatagcgccccgccatgctgctccgcccctttgcttgcgccgacaatggcgatggagattggagtagtgaggaggcaacgaggattcctgccgaacagaggagcgcccacacgcagcgccgcgcccacaggaccacaccgacaccgagtacatggggcgggcggtgtcgactcctctttgccctattgcgaaggagac

SEQ ID NO: 21549 - DNA, 565 bp, Zea mays
  misc_feature (17)..(17): n is a, c, g, or t
aatgacaatgccagctnttgctgcagcctcctctctccgttttagttccttctccctcttgtttaattccgcttcccttgttgcagctccttctctcttttcttcaggtcctttgacgagtcaaggggtatatccactgtagcactgaagtctgccggttcaggagggagcggcgaaaggcgtgaattggatgtcggaggcacgttttgggggttaggcatataaaacgcgccaccgccaaagttggattgcccgccagccttgccgcgcgtttgttgcgagaaagggttcacgtcttcctcctcgaaggggttgccgtcatagcgccccgccatgctgtccgcccctttgcttgcgccgacaatggcgatggagattggagtagtgaggaggcaacgaggattcctgccgaacagaggagcgcccacagccccacacgcagcgccgcgcccacacgaccacaccgacaccgagtagatggggcgggcggtgtcgactcctctttgccgtcttgcgaaggagaggcgggtgaacctacacggaaccacatgtccggccagtaacc

SEQ ID NO: 21550 - DNA, 1514 bp, Zea mays
ccccttttctcggttttttttttttttttttttttttttttttttttttttgaaattactatggtggtaccatgctttatttggagccttaaacaaacaacaatatgttacaagccttgaccctctttgtggggtcccaaaaccaaagaaggtaaacaaaatgtccgacaccagcgagcacaagacttaaaagataatttaacacggtatacaatcgggagaccatttaacctgacgatgtgctagcacatgaacttgactacgataactgaaatgtcgtctttgctcttccgattcacggcctgctccgtcaggtgcttggcagctgcctgcgcgtccttgcaatccttgatctcgtcgacagcctcctggttggacatcaccttccacaagccatcacttgctagaattaaaaactcagtattttcatcgatagtttgctcgaccacatatggatcagagctgaggtgcttcttcaagctccggtctccaaatgcccttgcaactgccagctgcccatcaacacgtggcacatcacccggtaggtttgatacaaagccacccttctgctcgatcgtttgtcgctccatgtttggttcatggtcaactgaaagctgcttcgctacaccgttcttgctaataactgcccgtgaatccccaacatttgcaacaactagtttcacgaacttgtcacttcctattaagatggcagtaacagctgtggagccacctcttcccaactctgctgcgttttccaatatcttctgatccgtaagttggtatgcgtttcggatagcagtttctggatcactcaagaattctggctcactcaagatgttattgaaaagatgggagctcaaaaagtctggaacagtgtggcccaggtgaccatcgaatatagcaaacaatcccaaatcatgttcaccaacttgccggtactctgccactagataatcctccattggatgattagatttgcccttcaccagatggtaaccatgcttgacacgcttgcctgataactttgtcttgcctttccctgtttctggtcctgatgaactaaatgcatctttcaccttgtccttcaccttgtggaggatttccttgccagccattgatgtgcccgcgccctgagcccgcctggctgaaagcttctgcctctgaaatccaacctcctgctagcagaaccagcaatgaactggttccttggaagttaaccccctccccccctccttgatctgccccaccaaaaatcaatacccactagtcgcctcagcttgggtcaatgatgatattttataggtttataattgaagggaggtgggttggtgatggcgggcccctgccgctgccgctgccgccctggtgtgtatgaagcgagaggagagggagaacggagactggatcttgggtagcggcggttgacctgaggttgggggagattgggacatggatgtgtcaagtggggacaggagagaggaaatgcacaccaaaccatggagaaaaagcgtcgt

SEQ ID NO: 21551 - DNA, 3201 bp, Zea mays
  misc_feature (1130)..(1130): n is a, c, g, or t
catatattacattcattacggaatttggtgtttcacaagtctgtacatgagctccaaaacaagacaaagctaggcatgaaatccgacaagcaaaaacagttatcatagcacctgaacatgtcgtgtagtctggaagttggattacccagcgcaaagtttttcacacttaaaatatgcaaaaaaacatgaaacaagacccaaataaaaaaaaaaaattggaacactcaccaaacttcaagagttattacaaggatcgacaagaagtccagatagcagagcactcgccttagctgctgcctgctgctcctccaagcacagagcacccgccatagggtgagtgaccacgtcactgtcaggattcatgaaaccttaacaacatcagaaactaatgtattgaaaccaattccttgtccgaaacatattactcaacaaactctgctaaaagctaagccacagttgaaacacaacgttcttcaacatgtacagctctacagctgattctattctcaactgttgcaaggtttccagatagcagggcacacaccattctgacacacgcaaattttgcttgttaagtgttacatgatccaggggcctaacaattgtcaagatccaaggagtttctagttcatctaccaaggttctatatatcctgattgaatgaagtccgatatgacatatggtgaaggagatatcagcctgattggatggctgcgcgtctatgcgcaggctgccgccgtcctggtcagccagatacgataattttaaacacgataattttaaacgtatgggtggatgcaggttaataacattaaaatgacttattttgcatccactcatgcaggttgtgactcccacatataagcaaccaaacataatctccactaaagtcgacgcatacggtgacccaagatgagatggtgcgggtaaccacccacgcggccgggtggattgtcattttgtagttccttgtcctgtgggagggttggcctcaggcatggcataaaatgcagaagtttctgcatccagtaggatttgcctcagatgcttgtcttccagatgttcctgtaaataagccattatgtgacaaagagatagagagaaaaaataaataagagggtgatgagagncaatgtccatgtaaaatctaaggaaggcttgactcatgtttaacagactcatacaaacatccaccaacaataattattaatgtcagagtgaaagagatctgaaactcaatccctgaacatgcatataaccatactacttctgtatcacaattccgaaagatgcaggacagcattaattcagtatggcagtcaaatactccataagccatgattgtagttggcatgatcttcaaaattacattatgtaaactaaattatttataaaaacaaaggcgttctcataggaaagtcctttctaacaagaatataagggtactacttttgtaccacaaaacgtatacattattgactaatagatgatagaaagaaaaacaaagttagtgcaagtagacaaatatcacgaatatagatcgatttcaatgctgcaagtaatcaatccatttgttttttgaaagatttaaccagtccatcaatttcactgccaagaacattcgactctaataactggttgatggctatttctaatttctatgtcggattgtaatataaattgataatgtcacttactgtgatataaccatagagtgtatagtagtgttcttagtaaccaggttccggatcgatgggatcgaggaacgagaacatggtacgcggtacgctactaaaactaggatttaacactacgagaactagattgttcccacgtttaccggaacgaggaacgtggccaagttcccagttcccggttattccgggttactaaggtagtgctatcagaagtgaacattgttggctctgtgaccttttcaatatatatagtatgcaaactactgagtagagttcactgacaataatagagttgccaggttaatctatttggttctgtagagatttttcttgctcagtaatgaattattcaactaaacccaagtttctatagtcaatttaagcccctggaccaaattaggaacacatacaaaaaggtttttgttgattcacgaaaaggttgcttagaatcgtgataatggtgctcccaaattgaagtaactacatgatcaacgacatctatctaaacgcaaccaccctgaagaattgcagccaaagctacgacagcagagccaagtacgcaatccctctttaaacaagtgcagccacccccggagcacagcccaaccataagatgaagatgaatcgtgctcctgcggccagggagtaagagatgcaaggcggaggcaggagcgcgggcgaggggggtggcgattacctcgaggcaggcgcggtacttgtgccagtggtcggcgcagtcgtccctctgccactgccccttagcgaatttctccgcgtaccaccggttgaagcagtcgtggtacgcggtgcgcagctcggagcacgcagccgccgcctttgagggcgcggatggcgtcgtcgacgaagttgatttgctccggccgaacaccatgcttggaggctagttggatcgatcgaatcagagagcaaactgttgtgttgtattcatgtgcctgtgctgtgtaccccaattgctctgcaattctcgcagaaggaaagggaccacggagcacagagacacgcagtcgccggctggccaaccaggcggccgcccaacgcgcctccgacgactgtgacgcgcggtgccgcggacagcccgtagcggcaagcgcagaggacctggtggcaacgggcggccgcaacccctattgcccagtttccggacgatggtgacgcgatgggcggcgtcgcggcggacggcgggtggagcgatggtagcaggtagcggcgcggcggctagggttcagcagcaatgttgcggccagccgagcagggatgaagtcggattggagcgctgccgcacgctgactcgcgggtttgggctcggcatcgggcatcggatgtcttcctcctcaaggttgtcagtaagaatttggcccacagccagggttacctcaggttaggccaaatattggaaaatatgcggtgggaactatattttggtcatttaaaaattctaaaacttattaacacatcgattgttcatataaatctatataccctc

SEQ ID NO: 21552 - DNA, 689 bp, Zea mays
ggccaggaacaagagaaagcaatcacacagccagacgaccgagcacaaggggagctacctgctacgactagctagataccacgcgcgcgatggcgcccaccaggatccgcgtggccttgctgagcttggcgctgatggggctgctcatctgccacctcgccaccaccgcctccgcggggaagaacagaatccgcatcctcgacagcgtcgacgactcggccggggacaacaacagctccgacgcctcggccggggacaacagcaccgactccgagtcggaaggccgcgtcgtctattccgacatgaagctggctgatgagacgggatctgcgccggctccggcaccggcgccggggccgacgaccagttgaagcgaggaaggtggccaaaactgagggcccggctactatcttttgctataactaaagatagggccaagtttaatttctccgataaattctgtccgagcaaaaagtatgatggggtttttagtcgagatggtaaataatgtatgacgcgcgtgtggaccaagagtcatggcttgctgtacttgtggtttctgagctgcaacactcaatcgactactaaactaaggtaataatatatatatatatcccttaataagatcatacacaatgcaaatgtgctcagggccagtctttgtgagagattcaaaaaaaaaaaaaaaa

SEQ ID NO: 21553 - DNA, 1211 bp, Zea mays
  misc_feature (1199)..(1199): n is a, c, g, or t
cactccatagggcgattgggttcctcgcgcccggccgcgcccgcgtcccccccggccgggagccaggaacaaaggaaagcaatcacagccggacgatccgagcagagaaggggaggtacctgctacgactagctagattccacgcgcgatggcgcccaccaggatccgcgtggccttgctgagcttggcgctggtggggctgctcatctgccacctcgccaccaccgcctccgccggcaagaacagaatccgcatcctcgacagcgtcgacgactcggccggggacaacaacagctccgacgcctcggccggggacaacagcaccgactccgagtcggaaggccgcgtcgtctattccgacatgaagctggctgatgagacgggatctgcgccggctccggcaccggcgccggggccgacgaccagttgaagcgaggaaggtggccaaaactgagggcccggctactatcttttgctataactaaagatagggccaagtttaatttctccgataaattctgtccgagcaaaaagtatgatggggtttttagtcgagatggtaaataatgtatgacgcgcgtgtggaccaagagtcatggcttgctgtacttgtggtttctgagctgcaacactcaatcgactactaaactaaggtaataactaggttagtgcccgtgcgttgcaacggaaacatataatatcatgataatttaaagagaacccagagaacaatcctgattgtactattgtatatattggcaaccttggacatgaggtagaaccaaattactgcataaccatgttcatcgttcccggccgttctagctctccgtggagcacattgtcccttcgtatcggaggacggagaaccggctgattctcaaagaacgccggtggggcagaggaaaaaggacggagggagaactcacctcgacgaaaaccaatgtgacgagggcggacgcgaggtgacggtggagtagatgaacagtcagggtgcgagcacgcctcatttacaaatctctcattaccgatttgggatcctacaggccttaaattctctcccggcaggtagattcccgtactttgggatttttgtttggaagatacatggtagctgcatgctggcgcttatatgacaaccattcaatgtttttggtatcaaccttggtagtggtttaggcaacgacaaaagcaccggngctagcggtcat

SEQ ID NO: 21554 - DNA, 698 bp, Zea mays
actcctataggggattccggcccccctcgcccggccgggaggaacaaaggaaagcaatcacagccagacgagatccgagcagagaaggggagctacctgctacgactagctagataccacgcgcgcgatggcgcccaccaggatccgcgtggccttgctgagcttggcgctggtggggctgctcatctgccacctcgccaccaccgcctccgcggggaagaacagaatccgcatcctcgacagcgtcgacgactcggccggggacaacaacagctccgacgcctcggccggggacaacagcaccgactccgagtcggaaggccgcgtcgtctattccgacatgaagctggctgatgagacgggatctgcgccggctccggcaccggcgccggggccgacgaccagttgaagcgaggaaggtggccaaaactgagggcccggctactatcttttgctataactaaagatagggcgaagtttaatttctccaataaattctgtccgagcaaaaagtatgatggggtttttagtcgagatggtaaatgtatgacgcgcgtgtggaccaagaccaagagtcatggcttgctgtacttgtggtttctgagctgcaacactcaatcgactactaaactaaggtaataatatatatatatatgatatgcttaataagatcatacacaatgcacggccaagcggcc

SEQ ID NO: 21555 - DNA, 1210 bp, Zea mays
  misc_feature (1183)..(1183): n is a, c, g, or t
  misc_feature (1196)..(1196): n is a, c, g, or t
gattcatccgcccgggccccgccgcgccgctgcacacattccgcgcacaccccggcagccgcaaacgccttcgccgtcgcgtcccgctcctccgcccgcccgacgcgacccctaggacctggagagagaggtcggcatggctgccgcagtggtcgacgacgctggtatggacgccgtccagaagcgcctcatgttcgaagacgaatgcattttggtggacgagcaggacaatgttgttggccatgagtcaaagtacaactgccatttgatggaaaagattgattctgagaatctgctacatagggcattcagtgtgttccttttcaactcaaaatatgagctgctacttcagcaaaggtccgcgacaaaggttacctttcctttagtttggaccaatacctgctgcagccaccctctgtaccgtgagtctgagcttatccaggagaactaccttggtgtgagaaatgcagcacagaggaagctactggatgagctgggcatcccagcagaagatgccccagttgaccaattcacccctctgggccgaatgctttacaaggcaccatctgacgggaaatggggggagcatgagcttgactacctgctgttcatcgtccgggacgtgaaggtgcagccgaacccagatgaagtcgctgacgtgaagtacgtgaaccgcgacgagctcaaggagctcatccggaaggctgacgctggcgaggacggggtgaagatctccccctggttcaggctggtggtggacaacttcctcatgggctggtgggaccatgtcgagaaaggcaccctcggcgaggccgtggacatggagaccatccataagctgaaggagtgaggggccgccggccggccggctccgatgacctcaccacctgttgatgttgctgctgctgctgcactgcatgtttatcaaaagttatcgctcctgctcgcggaaagtgagcttgactgttgccggggtggaagtgtcgttttggactgaagatgagtgccgcggaggggtttgttgtttgtttgtttgtttgttcggtgaccgaatcgcgagttggacgcctgtttaatccgtgcttatacatcgtctgagtaaacagcaataagagggacatccgtaagctctttccgtaaaaaaaaaaaaaaaaaaaaaaaggcggcccccgtgcagaggatnccaagaataaagnacgcgtgcatgcga

SEQ ID NO: 21556 - DNA, 1432 bp, Zea mays
  misc_feature (1027)..(1038): n is a, c, g, or t
acattggggccctcgcggcccggcacggctgcacacattccgcgcacaccccggcagccgcaaacgccttcgccgtcgcgtcccgctcctccgcccgcccgacgcgacccctaggacctggagagagaggtcggcatggctgccgcagtggtcgacgacgctggtatggacgccgtccagaagcgcctcatgttcgaagacgaatgcattttggtggacgagcaggacaatgttgttggccatgagtcaaagtacaactgccatttgatggaaaagattgattctgagaatctgctacatagggcattcagtgtgttccttttcaactcaaaatatgagctgctacttcagcaaaggtccgcgacaaaggttacctttcctttagtttggaccaatacctgctgcagccaccctctgtaccgtgagtctgagcttatccaggagaactaccttggtgtgagaaatgcagcacagaggaagctactggatgagctgggcatcccagcagaagatgccccagttgaccaattcacccctctgggccgaatgctttacaaggcaccatctgatgggaaatggggggagcatgagctcgactacctgctgttcatcgtccgggacgtgaaggtgcagccgaacccagatgaagtcgctgatgtgaagtacgtgaaccgcgaggagctcaaggagctcatccggaaggctgacgctggcgaggatggggtgaagatctccccctggttcaggctggtggtggacaacttcctcatgggctggtgggaccatgtcgagaaaggcaccctcggcgaggccgtggacatggagaccatccataagctgaaggagtgaggggacgccggccggccgtctccgatgacctcaccgcctgctgctgctgctgcactgcatgtttatcaaaagttatcgctcctgctcgcggaaagtgagcttgactgttgccggggtggaagtatcgttttggactgatgcatgagtgctgcggaggggtttggtgtttgtttggttnnnnnnnnnnnngttccgtgaccgaatcgcgagctggacgcctgtttaatccgtgcttatacatcgtctgagtaaacagcaataagagggacatccgtaagctctttccgtagctgcttttgcgactcgtctgctgctactgcagttccatttctgtatatttttggcagaagatccttgtgcagcctaggctagcggcatcgtgactgggaggtagggaagggaacgacgcttgtggttgtgcatgttggcttgcttcttgagctctttgcttgtggctgtagctgatttttttaaaaaaataactttaggggctcgtttatctcagtataacatgggggtttgggtttatttgcttgtgactggacttctgtttatgaacttaagggcctggcttatctgatta

SEQ ID NO: 21557 - DNA, 1324 bp, Zea mays
ctcgagccggcggggacaatcaacagcgcgcccggcagccgcaaactccttcgccgtcgcgtcccgctcctccgcccgcccgacgcgacccctaggacctggagagagaggtcggcatggctgccgcagtggtcgacgacgctggtatggacgccgtccagaagcgcctcatgttcgaagacgaatgcattttggtggacgagcaggacaatgttgttggccatgagtcaaagtacaactgccatttgatggaaaagattgattctgagaatctgctacatagggcattcagtgtgttccttttcaactcaaaatatgagctgctacttcagcaaaggtccgcgacaaaggttacctttcctttagtttggaccaatacctgctgcagtcaccctctgtaccgtgagtctgagcttatccaggagaactaccttggtgtgagaaatgcagcacagaggaagctactggatgagctgggcatcccagcagaagatgccccagttgaccaattcacccctctgggccgaatgctttacaaggcaccatctgatgggaaatggggggagcatgagctcgactacctgctgttcatcgtccgggacgtgaaggtgcagccgaacccagatgaagtcgctgatgtgaagtacgtgaaccgcgaggagctcaaggagctcatccggaaggctgacgctggcgaggatggggtgaagatctccccctggttcaggctggtggtggacaacttcctcatgggctggtgggaccatgtcgagaaaggcaccctcggcgaggccgtggacatggagaccatccataagctgaaggagtgaggggacgccggccggccgtctccgatgacctcaccgcctgctgctgctgctgcactgcatgtttatcaaaagttatcgctcctgctcgcggaaagtgagcttgactgttgccggggtggaagtatcgttttggactgatgcatgagtgctgcggaggggtttgttgtttgtttgtttgttcggtgaccgaatcgcgagctggacgcctgtttaatccgtgcttatacatcgtctgagtaaacagcaataagagggacatccgtaagctctttccgtagaaaattaaaagactcggcggccgctactgcagttccatttctgtatatttttggcagaagatccttgtgcagcctaggctagcggcatcgtgactgggaggtagggaagggaacgacgcttgtggttgtgcatgttggcttgcttcttgagctctttgcttgtggctgtagctgatttttttaaaaaaataactttaggggctcgtttatctcagt

SEQ ID NO: 21558 - DNA, 812 bp, Zea mays
cactcctatgggccattggggtccctcgaggccgcccgggaatccacactcgactctcctctctcgcatccgcagcctctcgagctctactccatcccctcgatctcgaagcgcagcagcagcagtcaggcggccatggacgcgagcgcagccggagccggcgggaaggcgaagaagggcgcggccgggcgcaaggccggcgggccgaggaagaagtcggtgacgaggtccgtcaaggccgggctgcagtttcccgtcggccgcatcgggcggtacctgaagaagggccggtacgcgcagcgcgtcggcacgggcgcccccgtctacctggccgccgtcctcgagtacctggccgccgaggtgctggagctggccggcaacgctgccaaggacaacaagaagacccgcatcatcccgcgccacgtgctcctggccatccgcaacgacgaggagctcggcaagctgctgtccggcgtcaccatcgcccacggcggcgtcctccccaacatcaacccggtgctcctgcccaagaagaccgctgagaaggcggcggccaaggaggccaagtcgcccaagaaggccgccaagtcccccaagaaggcatagaggggcgcctttaccgctgtgatgttgaatgctcgtgttcagtagatctttacgtctgtagtgtcgtcgttgttattggaactggttagtagatctgtgcattgtggttgaaacgtgattccctgatttcagaaatctaatttgcaatttgggtgcacaaaaaaaaaaaaaaaaaaaaaaaaaaaaaacccaaaacaacaaaaaaa

SEQ ID NO: 21559 - DNA, 2451 bp, Zea mays
  misc_feature (2449)..(2449): n is a, c, g, or t
tgcatgcctgcagcaatcctcgttgtgagtaaggatgagtttatttgaagattgatttaatttactacgtgaacatgtttttatcaactttgcttggtgttcatatattgttcatataatgattgctttatagattaatttaatcttcaaatacataattttctaacgcctagtatggaaacaaatctgctccgacgttagaattcagaactgttttttttcctatatcgttttttgaacggtaaaattgcgatcttgacaggagtactttcgatcatttctcaatttttgttttctttgggtccaaccgtcccgacgttggcaagatcgtgactgattgttccaccacatcatcaggcttcactcgtgctctctttaagtttagactaatttttcttaaatttatctatctagcttacagaaaacagtatcgatgttccgggccccccctcgcgtttttttttttttttttcataaatattagtatttgtgtatatatttatttataaagctcaaaagtaagactgacattttttacggaggtagtacatacgcgcgcggaacgcaatggacagcgcaggcgcagcggtgtgaccgtgtcaatcaactcaaggtaagtctggagtcggccacgattgggctcctcacgacataatcatggtcgtgggacagccagctcagggtcccctcggcgagctcctgctcgctgctggctccggctgcggcgctcactgtgaccgtgaacgtcttcctctcatttaccttcgtgaactccagctccgccggctccaccttgactgtcaggcctttcggcgcttcgatcttggcggtgtagttcgacctcgctggtccgacgttcgtcaccgtccggttcacggcgaacgcctcagctcgcagcggcaccagtatcgccgggtaattcagctgcgctccggtgacaggctcgagctcagcgcaagtcaagttgctgtttatggctatgattttcagggccgcctcgccgaggagcctgcagatgtagccggcgtagtcgtggacgccgaggtcgtacaccaggccggggtctacggccttcgccgggacaacgtggccggcgccgacggagtagaagctcgccttccggtgctcctcgtccatgatctggttgcccgcgttgtcgacggcgctggacgtggtcatgatggcggacttgatcgcggcggtggaccagtccgggtgcaccttcttgacgagggccgcgacgccggtgatatgcggcgtcgccatggacgtgccggagacgacgttgaagctgctcgactggggggccccgacgggcacctccgacggccacgcggcgagtatgttgagccccggcgccatgatgtcgggcttcagcactccggggctggcgacgctggggccgcgcgacgagaaggctgccacgatcggcgacggcttcaccccaacgactgtgctgttgaacacgatcgttgccgtatggttgctcgtcgacgtacccttcatggcgtagcccattatctttgtgccgtccaccgcggtcacctgcgacatggggaggttgtcgtacttctccacgacgatggtgtatccgaagtccggttcgttgatgaacacaacgccggcgccgccagcattgctgaccgcctcgatcgagctcatgggtggcaccggtgtctcggtgtcgcacacgaccaccatgccggtgatgttggcgtcgaagtaatcgcagtagttcaagccgtttgagtagtacagcggatacactttggagctgaagtccttgtcctgaaccagcgactcgccttcgaacatctcgccgtcgccaagccgcacgctggcacggaagctccggtctacagacccggccgccacggtcaatacccacggcgcttcgttggacagcgtggagggcagagggccactgttgccgccggcgcacactacgaggacgcccttggtcaccgctgcgaacgcgccgatggcgatggggtccttgtccaacggcgtggagatgccgccgagggacaccgagaggacgtcgactccgtccttcacggcggcgtccatcccggccagcaagtcggactcgaagcacccttgggcgtcgcagaccttgtacacggccaggtgagcgccgggtgccatcccggccgccgtgccgccgccgccgccaaggccgaaggccgagactccttccacgaaccggccggccgccgtgccggtggtgtgcgtgccgtgcccgacgtcgtcggtggtggtgttgtccccgacgagcgacgccgcgccgatgagcttgttgttgcaccgaacgggaggctggcaggcgcccttccacctggggggtggcggcggcatgccgtcgtcgtggaacgaagggtgcttctcgtcgatcccggtgtccagaaacccaatgatcgtgccctcgccgtagccagtcgcgttccanac

SEQ ID NO: 21560 - DNA, 1126 bp, Zea mays
gggtccacgcacgcgtccggaagccaccctttttttttttttttttttttttttttttttaaagtggttgacaaaccaccaaaactcagtataaaaatcattgtatcagaatatcaccatcttcccgttgatctacaattcccctcactagcttatacttctggctatgattccacgaatattaaagtaatggatctagagacatcttcttttacaggcctgtacatgtatttgagtgttcatgttcgtgaaatctccttatttacatgttctcatgcagaatcggcagcgaaattccatttaaactataaaaaatgctaaatgaaatagcttctgctatatttcactatatcttttattgggatcctggaggatttgccacgctatttgcatgtacatatgaatgccggagctcactggaaggaccactgtatctcttcaagggttcttcccttcgtctctggtacccaaaggatgacgaagacgagagtcaaagcactcaccgtcatgtaggaggcaaatgtacctgcagcgctccagttcagaagcaaatttgctgtcattgttattccaaaggacgtcaaccagttggcaagggtcgcgaagcttcctgccacacacttgatgctaaccggaaggatctcagacattatgatccatggaatggaacccataccgaaggagaaggcagtgacataagccacgacaccaaccaaggacactattcttaagatgttgtacaagtcagagtcttgtgcaatgttatccttgatgcaaaatacaacagcaactgccagaaggcttagggtcatcccagaagaagaaataatgaggaggattctccggccagctctgtccaagatcgtggttgtgacaccagtggcaagaaccgagatagctccaatgagacacgtgtccaggttactgttcttgagccctgcagctttgaagatgctacctgaataaaagattatacaatttattccacttagctgttgcaacacaagtaggccgattcctagaattagaggcgtgcggtatttcttttggttcaactcttgaaagcttactgtaccacttttgtttgctgatgctacagctatctttatatcattcacttcttcag

SEQ ID NO: 21561 - DNA, 908 bp, Zea mays
  misc_feature (5)..(5): n is a, c, g, or t
ttttntttttttcaacaaaaatgcttgagattttgattgatcaagaaacatgctcgtgtttacatggaatattggacccaaggttcagattttattttggcaagtcttctatcttacaatgttgaagcaaaagtaatataagagttactgcacaagcatttacaagtctattgggggtaaagttataacaacggtgtatgcaatctcatgtacaagaccttttatgaacagaaagaatgtgtggccttcgtcgagtgatttgagtatctaaagcgacaaaactcgaagaaccatttcgcattttgacgatgttggtgctcagcggaacgaccattgtatctcttcgagggttcttccctttgtctctggcacccaaacgattacgaacacgagagtgaaggcactcacaatcatgtaggaggtaaacgtacctccagcactccagctgatcagcaaatttgccgtcattgttattccaaaggatgtcaaccagttggcaagggtcgcgaagcttcctgcaagactcttgatgctaactgggaggatctcagacattatgatccaaggaatggcacccataccgaaggagaaggcaatgacataagccacgacaccaaccaaggacaccatacttaagatgtcatacaagtcagagtcatgtgaaatattatccttgatgtaaaatacaatagcaactacaagaagacttagagtcatcccagcagaagaaataataaggaggattcgccgcccagctctgtccaagaacatggttgtaacaaaagtggcaagaacctgaatagctccaagtgcaaaggtgtccaagtcactgtccttcagaccggcagctttgaagatgctacttgcataaaatagtataccatttattaccccggccgcgaccacgc

SEQ ID NO: 21562 - DNA, 983 bp, Zea mays
ggccgcttttttttttttttttttgacgaaaaatgacattacagcacctctcatgttcgccagacataaagtaacagttacgcctcccagctaatagctgagtctaagaaaactgataaaaacttagatccccccggacgggccaggggtagacttctttaagtctgcatgtggaacacatgagggcccgcctcgaaggaacaaggggtgtataacgccagcatttttatagggtctttaaactccaattttggcgcgccaggcttatctaaaattatttcctaaaattaactaatgctaaatatttttgtattttgtattttattatttttttggtccttaataataattagactaacttacaaactaggcctagcgacgctaaaatcaaatgcgacgaatactcttatccttcgtattggtttgtaagtcaagtggatacgttccaccgaacgactattttaattcgagatagctactcacttgataattaacgcatatcagacgcatagttttcacaagactatgaactcaatggtagctaacgcgtaccagacgaacgctgtggggatgcgtggtttactataggaggtccaagaagaaacccaaaactaaaatcatctccggcagctctataaacgtaagcattagtgtcctgatggaaccgagctataacacgattaaaaccgtttctagcgtcgagtacatcagagccactagtgttaaacgtggttagagttacaggataggaactatagtatgggatactcaattcatggattccttcgtttggtgtcataaacacttcagcacccttgtagtcaggatattcccaagttccatttatgtcgatagttcgaacaccggcatataaggagttagggtttaagagcaaccacaagaggtgaaagcgttgtttataggcgcaattttatatctcatactaaccgcggtagaatgcatataaactcgcaaaccatgaa

SEQ ID NO: 21563 - DNA, 1915 bp, Zea mays
  misc_feature (1899)..(1899): n is a, c, g, or t
aaccacaaggttagttttaattcgaccattatcaacctaacgaagttttttttttacaaaataatcatgtatttcatgttaaatgattctaatcaataaattagattaggtatagacatcaacactaggttaatactcctgatgctcatactgtacacttgcacaggctctaaatgtttacaacctaaataatgaattattttttaagaaacgatggaaaagggttgttgggcgatgtcgtcgccgtgcttcctgtggagtgggaacaacacaaatggtatattttcttttcttttctttcccagacagtgatatgttgcactcaaaactgttgttaggacaactgcaagccagaccatccgtcatgtccagatgcatgatacatggcccagagtggaggcagcaaccaatgtgtatactactccattccgctccacctgagccatcaattctctcaatggatggatggcaggtgaacctagctcttttccaactgcacccgatacacacccccaactgcctccaaccatttctgctttgtgccagggcacttctcccgatatacttgcaacatcagctacatgaagtagcttagcgttgtctttttccttgacccgccttctccatagagatcattccattgcacaagctcgttcatgttactggaatctgaggaaacacttgcacacacctgttcatgcgcatgtatgaaatcacttattcttaatgcacggacatcattgctagtgtgcgacagaggcaatggcctattttctgtttctgctgaagctctctccttcttctccttttcaagaatctccctaataggacgatgagcagcagtaacacaaagattcttgagatcactacccgagtacccttctgtcaagttagctatagcttctagatcaacatcgtctgccaaatcttccttggctagtattacactaagaatctttctcctatttgatgcatctggcaaattcaccatcaacctccttggaagccgcctaataacagcctcatcaagatcaaatggcctgttagttgcagcaagtactaatacacgttctttctcctttgttctcagaccatcccagttcaccataaactcatttttcatcttacgcatggcttcatgttctccagggttctcccgccttcccagcatgccatcaacctcgtccacaaaaattacacttggagcaattttacttgccagtgaaaaaacagctttcacgaatttttctccttcaccaagccactttgaagagatgcttgacatcgatatgtttatgaaattagcaccagcctcagttgccacagccttagcaagcattgtctttccagtaccaggtgggccaaaaagtaaaattcctttacacggcttcataagttgtcctcggttaaaaagttcaggtctttgcaaaggaagcatcactaactccttcagagtatctttgacactttctaaagctccaatgtcctcaaaggtaacaccgatttcatgtggagggataacatctgcaagaagcctcttttcaaactcattttccgtagcaatatccttcagtgatttccttttagtgctgctcttcgagccagactggatactttccaacatgtcaataccatgcttaaggctttcgctggatagaacaaactgcacattactcaaaggggggtctggatttgtacagttcttaagttgatggctcaaagcaaaaccaattattttatcaacacactcatttgtaagaacgcgatccttgaccaatatcgcctcaagatcagtgcattccaaaccaacccttgttagaaaagaacgcattttgaaagtttgcattccttaaggattcaaactcggttaacactggtccacctgaaagctccattctnctgtgggccccggaga

SEQ ID NO: 21564 - DNA, 2539 bp, Zea mays
gggggtgtgtttttttttttttttttttttttttttatcagtggccaattatggggacaacagacaaatcagagaatatgtattctgaagggtgtttgtacatcgcacaggattataggggccgtttggttcatatatttgtaacgtaagggggggggggtaaccttaaatcatgtttgttttagtccaaccgttttctgtttcctctcttttttttgataccagcctattcaaatttgttaccgccagtaatcgagccgaaaccattaccattaccatttgcgttacattttttgaaccaaacagcaccatagttcagtatttcaaggttaaaaaggactcgccacgacgcaacagacctgagacctgttttaaccaaattcagagttcatgcaaatcttgcatatgtttcaaaggatgttgatactggtctatgtggttgataaaagagcaatcacctctcaagctagtaactttgctagttcatctactcttaaggtaccttgatgaacaacatcagaaagaaactcttgtccatggtctgtctgcattgcagatcctccattaacgataaatttattttcaacagaactgctcaacattttattttctacaagatgtgttttagttcttgcatgattgtctggcacatttctcctggcactggacttccttcgagtattctcaaaaaccagtcttcgcggaattgactttgtaaaagcaacagacttttcatagaccagatctgaatcagcaagctcatcttcactcagaacaagtgccctgccactgtgaatggcctgttccaaaagacataacaatccctctactttagaaccgctatttagaacaactgtaccttttgtaccatcgtttcttttcctcttcatttccaaattataatcatccggacaatgttctgacttctctaccagagttctattttcacagttgtttgttgggatacttcggcagttcagggatggatccataatatcacatactggatttaatggggaatattccaatggaatgtctgctgagggttcagttctagatatacctgtagaatggaacaatgcaggaacatcctttgcagaactcagtaccatatcactgtcagtggaatctttaaatttttcttgaccttcatccaagttccagttcttgtgagatgttgcagcactgaccaactcaatctgggccagaacatttcctgaatgtgtaaccttttcattagattctttgccactaaaactttcttgcaccttcgtcacttcataactgttttctaatggaggaagagatgatttccaatcacttcctctccacatcagtatatgctcaaactcaaaagacagtaagatacaaggaactagatcctttagtttagctccaatttttctgcaatcacttttgttaagacctgagcaatcaacacggacaagatcacatgcttcaaatgcttctctgacttgcttcacaaggttggcataaacaccatttttcccaagtttacaaattggtggtaactgatgtcctctcgtgcgcatttctgtggcctcatctggagttaagccacctgggaccttcgtgacaaggcgcgggtacacaggtgcaacgggtttccagagcataagcggaaaacatgggcgggtcctgtaattgtagtttctaccacgaaaaagaaatatgacacccccttggcggtgtattacttttcctccaactttttcctctagctgatggcagatattatccatatctattgtacagacacctttgcactttatcttgcaaactcttttcctcttccaatgtgaatgaatgttctccaacatattgtgtgtcaaaccatccctgcccatattgagttgccgtttggatttgaggctccctttcacgagttcggagacctcttccttggttaggggctccccgagtatgtcctccctggacaccgattggtatctcggctccataccggcgaggaacggacccggtgactgcacgggcttcacccccttcttccccggtggtggcagcacgaacgagtcaaactccggaagctccttgcggctctttggcagcggcttccttcccgtccacgggcgtggcgtggcctcgggcccgaacggcatgaacggggcctcacggagcgctacggggcgtgcgcgtggggcctcagtgtagctatactgaaactcaaatggcgcgccatcgaggcggtaagagatgccgtgatcggtgacgcggactccggcggcgggctcatcggtgtccgcgatgggaatcttcttggcacgaccccgcgcggctgcagaaaaggcaggatgagaagtggcggcgcgtcggtgccgcttggggccggtgggaggttgctcgtgatgagagaggcagaggcggacggaggcgggaagccgtggataggattgctgagccggggacaggagggagcgagagggcaagcgggcagtcgccatggatgtttgctgtgcaaggggacggcgtacggattatctgcttcaggtacacccta

SEQ ID NO: 21565 - DNA, 3759 bp, Zea mays
  misc_feature (51)..(51): n is a, c, g, or t
aacctgccaagaaaacctcaaaacctagagagaagccaagaacaataattnaccttggcacgttgtgtttgatcacgaattcacgatctagtagatacagaggaagatcaccttcttggacatcatcatcatcaacctagggactacaacgcggaggggagaggagggaagcgcaccaaaggaggaaagggatggctagtctgtactcacctgggcaccacaacgcggaggggctcggcaaggagaagacctccggctctagatcctggttcgtgatgcgctcgcctacgagaacgtcgccgcttgagaagcagtcgccccacggctagcgcatcaccgcgttgggattcctccgcagacgaaacgtcaattagataccatgcgacaacggcatcgcaggggcgagggttaggcgttgagggttaagcggcggtgctagggtgtggacgcggtcgcctagggttcggagtagcgagagagaacacacggggggaggggggacgacggctaccatatcaccgaggcggagacgaggggaggggtcgctcgcgcgagggcaggcgggcgcgtgactccatggagatggcggacgtggagagagtcgtgcgcggcgatccggggcaggagaatgtcgcggacgcgggatatggggcggaggatgtcgccttccatggagagagtcggggcggggtttagggacgaggatgtcgcggacacggatctgagagagaccgcggggattgcgggagagatgagagtggggcgaggagagatggcgaacgcgacggcacgagatggacggacggggatgacggcagtgagcggcgattgcggtagacagaggtaggggcggggccgcgggggtgtgcttcaccaaaaaaaaagtggacgcccactctaccatatagagtagtagagatatgaggagaatttagagggaaccgctgcgatagatgaaaaaagtagggataaaatattgactatgtgaaccaaaatagtgatatagaaaaaaattatgaaaagtttacgaaggttaaaaaaattgatgcagcagtagaggctaacggtctaaaaaaataaaaagatggaggtctgcttagtgacgtagactctgggcccgtgctggactcgatgtgtaaagccggcctgctatcctccccacagttggcagcgaggcagtgatcactgctctgttgagccagcctcatcgtcaatgaggtgccgagctttcgctagagctcccgtcagccaccaagtacccaacttgagacgggcagcaagccggcggccaaggcacttgcccatacaccgagtcccaggcccagaagagtcgtaactaaagcgcatccgcaccacccttaatgcccccgcacgggttacaagccctcgctactgagctcggcgatggagcgcggtagggacgaatatttaagctggtacagcggactgcggactggcgcattggtgctaaacgatgagatgagtgcggacaggtctcgtggcaacggtgcctaggagtagtagtgggctttcgttgcttctctttcgactagaatactttgacgtgggcacgtggcccaacggccctgcacaagcacagttttcatcacaggccggacgaaaattgaagatatccactcccccaggcccaccacacaaaacgcatttattcattattattattattattagagcaacgctgtacgtcatattgaactgcaatgcaacatctttttatttttcttttactatgaacaactaataagtaataggcgatactttactaggaaaacagagacagtacctcaacctggaaaacacttgatgaggattttgtataagctttgctccatggcaaagcttagaaacctttcatcttaaaaaaacggtgtttttttcattagttctaatagaccctctagggactaggcttcatattattattggtaatgactctaaacatttttgtcacaacttcaacatcttcgcttgtaggtgttcagtagacccacctgaccatgtcaacctgcttgccagttgccaacagctcaatatacatcacgtggtttttgtcacctgggtgcctgtttggttcatatatttgtaacgtaatgggtaacggataacgttaaatcagtttgttttagtccaaccgtaatcagataccacactaaaatttgataccagcctattcaaatttgttaccgccagtaatcgagccgaaaccattaccattaccatttgcgttacattttttgaaccaaacagcaccatagttcagtatttcaaggttaaaaaggactcgccacgacgcaacagacctgagacctgttttaaccaaattcagagttcatgcaaatcttgcatatgtgttcaaaggatgttgatactggtctgtgtggttaataaaagagcaatcacctctcaagctagtaactttgctagttcatctactcttaaggtaccttgatgaacaacatcagaaagaaactcttgtccatggtcaattgtctgcattgcagatcctccattaacgataaatttattttcaacaggactgctcaacattttattttctacaagatgtgttttagttcttgcatgattgtctggcacatttctcctggcactggacttccttcgagtattctcaaaaaccagtcttcgcggaattgactttgtaaaagcaacagacttttcatagaccagatctgaatcagcaagctcatcttcactcagaacaagtgccctgccactgtgaatggcctgttccaaaagacataacaatccctctactttagaaccgctatttagaacaactgtaccttttgtaccatcgtttcttttcctcttcatttccaaattataatcatccggacaatgttctgacttctctaccagagctctactttcacagttgtttgttgggatacttcggcagttcagggatggatccataatatcacatactggatttaatggggaatattccaatggaatgtctgctgagggttcagttctagatatacctgtagaatggaacaatgcaggaacatcctttgcagaactcagtaccatatcactgtcagtggaatctttaaatttttcttgaccttcatccaagttccagttcttgtgagatgttgcagcactgaccaactcaatctgggccagaacatttcctgaatgtgtaaccttttcattagattctttgccactaaaactttcttgcaccttcgtcacttcataactattttctaatggaggaagagatgatttccaatcacttcctctccacatcagtatatgctcaaactcaaaagacagtaagatacaaggaactagatcctgcgaaggtagagttcatcaacttctgaaaaaaaatccatgactaaagaacattcttcaagatttatcaaacctttagtttagctccaatttttctgcaatcacttttgttaagacctgagcaatcaacacggacaagatcacatgcttcaaatgcttctctgacttggttcacaaggttggcataaacaccattttttcctatataaaattggacaagtggatgagtgtacaaagagttggtaaaagtgcaattactgaacgatatattgcattcaagtgtgctatgttgcagttggatataaatacaatatgcacagcatgaaagaacttcagacaatcaggaggaaccaagagtacaacaggacagagctatcaaatgttccccgctctctctcaaaatgacaggga

SEQ ID NO: 21566 - DNA, 4157 bp, Zea mays
  misc_feature (2199)..(2199): n is a, c, g, or t
ccgccgcgtcggccagggcgccccgcgccaggtcccgggcgcaggtggcggcgctcgccgtgaggaccgcgttgccgaagaagccacgcgccagggcgtcggcgccgaggcgcgcgcggccgttcaccgccgcgttcagcgccgtgcgcgacgcgtcgtcggcgcgcccgcgcgccagcgtgatcttccgccacaggtgcgccgacacggcctcgaaggtcgtgtaccaccggccctgtccctgcggcggcgcagctgaggccttgagcgccgccacgaagtcgctcgggaggtgcagcagcacgttggcgatctccgaagggtccacccgggccggcgccggcctgccggcggcggcgtcctcggcgcgcaggaactcggtgccgcggtgctcgaactcgcaccgcggcggccggcgcggcgtgatggcgcccgggccgtacggcgccggtgccggcggcgccgccggtagtagagtgtcgtgtttgttgttggcgcggacggcgtcggcccacgcgtggaagaaggtggacatggagtagccgtccgcggcctggtggtacgaggacgaggcgatgacgaggcccccgcacgcgaagcggttgatctggagcatgagcatgtgcggtggcggcggagccacgtcgccgccgaccggcacgtgcaggcgcgcgagctccggcgcgggcgcgagcgggaggtggtcggagagcgcggacgccacggtggcctcgacaacgagcgcgcccgcgccgcctctccccgtgacgaagaacgggcgtcggcgctcgtcggcgtcggcgacgacgaggcgcgcggtgaggagcgggaagcgcgggagcgtggcggcgagcgcgtccaggagggcggcgtcggtggggttgggcgcggcgtaggcgaacagcacggtgacgtggtaggcgggcgcgacgaggtcgaacaccgtcagcggcacctccgccgacggctccgactgcggcgcgggtatcacgaagctccgctgcacctgcacgtccatgatgctggctggcgagcttgagctaggtagctaactgctaacccttgtgacttgtgagtacgtagggaagctttgtgacttgagagagtgcaaaagatggtggtggtggtgcccacagtgtgtaggcaatggcagtctatatatagtgtgtgtgtgccgtggaaacctcgtcgtgtctgaacactgaactgaaccctgcatgtgtttcggtctggtctggagactggagtgcgcgcggtggtggttggtgtgccaaatagctcaagctcgccatgcatcgatccgtgcgtcctcgtaaatgcgtgcctgtatacagacagacagagagaggggtcagatcagggagcgagaggtgcactgcagtctgcatgcaatggttgacgtgcttggccgcgatcgtccaaacggtgccaaaggaatagtcggatagggagacgtcacctgaacctgatgaggacgacgcaggaggccaggagcacgaccacccgcgagttcgttcccaatgcatgcatgctgttcttggccctactacgtgcccctggtccacggtcgtctactggccctggcctgggtgtacgcacagtcgtgcatgcctgcgtgcgggaccgggggaccacgacgacaccaaccgcgcgctacgtgtctgcaatctgcatgcagcagaggtcaaacttgtgtgcgagatggcgtcgtcatggtcatgccatgcgacaccaaccactgaactgaggaaaagaaacctgtagggcgtttggtttacatatttgtaacgtaatgggtaacggataacgttaaatcatgtttgttttagtctaaccgtaatcaaataccacactaaaatttgataccagcttattcaaatttgttaccgccagtaatcgagctgaaaccattaccattaccatttgcgttacattttttgaaccaaacagcaccaaagatttaagatcacttttggtagaactccaaaggtcctcagctccatttgtgaaaagagtggttggggccaggatctctgtggtatccgtgcttcacagatggtgaccattgcactcaaaactgcatagggcaactgcaagccaggctagccgtcctgtccagatgcatggcccagagcagaggcagcaaccatgtgtatgtatactatccgctccacctgaaccatcaattctctttgatantggatgtctggcagatgagcatagctttttttccaactgcaccgcctccaactattgctgctttgtgccagggcacttctcccaatatatttataacctaagctacatgaagtagcttagcgttgtctttttccttgatccgccttctccatagagatcattccattgcacaagctcgctcatgttactggaatccgagggaacacttgcacacacctgttcatgcgcatgtatgaaatcacttgttcttaatgcacggacatcattgctagtgtgtgacggaggcaatgatctattttctgcttctgctgaagctctctcctgcatgtgagcaaatccacttgaaactcaattgcaattccttcttttccttttcaagaatctccctaataggacggtgtgcagcagtaacacacagattcttgagatcactgcctgagtacccttctgtcaggttagctatagtttctagatcaacgtcgtctgccaaatcttccttggctagtattacactaagaatttttctcctatttgatgcatctggcaaattcaccatcaacctccttggaagccgcctaacaacagcctcatcaagatcaaatggcctgttagttgcagcaagtactaatacacgttctttctcccttgttctcagaccatcccagttcaccataaactcatttttcatcttccgcatggcttcatgttctccagggttctcccgccttcccaacatgccatcaacctcgtccacaaaaattacacttggagcaattttacttgccagtgaaaacacagctttcacaaatttttctccttcaccaagccactttgaagagatgcttgacatcgatatgtttatgaaattagcaccagcctcagttgccacagccttagccagcattgtcttccccgtaccaggtgggccaaaaagtaaaattcctttacatggcttcataagttgtcctcggttgaaaagttcgggtctttgcaaaggaagcatcaccaactccttcagagtatctttgacactttctaaagctccaatgtcctcaaaggtaacaccaatttcatgtggaggggtgacatcagcaagaaggctcttttcaaattcgttttcagtagcaatatccttaagtgatttccttttggtgctgctcttcgagccagactggatacttttcaacatgtcaacgccatgcttaagacttccgctggatagagcaaactgcacactacccaaaggggggtctggatttgtacagttcttaagttgatggctcaaagcaaaaccaattattttatcaatacactcatttgtaagaatgcgatccgtgaccaatatcgcttcagggtcagtgcattccaatccaagccttgttagaaaagagcgtatttttgaaatgtttgcatttcctttaaggacttcaatatctcggtttaacatctggttccaccgtgaaagctccatttcagcttgtggtgcctcaagtgtcactttattcgggaaaagtttgatcaaatgcttcattgcctttgatgtttctttattattatcatttcccccatcaatgtcctgtaatgtgaggccaagtatagcttggctgtaccggaacttcgaaagagaaggagaactaacatttgccttctctttgcgattgtcaggctggatttgagatccaattataaaagcgccagctggaaaatgttttagcttgctcttcagaccataataggaatcattattcccacaaattttctctgtgtccttcagaaaaaggattaaagggccatgccgaatttcttcagagataaactcaactatcacatcaaatggatgtttgaacgatgtaacctcccatcctggaatgtcgaggcataaagaatcaactggacaaaacaaaccatggtcaacttcgcaattgcctccaagatcgtttcctcccagaattttttta

SEQ ID NO: 21567 - DNA, 2648 bp, Zea mays
gaaaaacataaaactttttataacgtagggagaggagtttcagctggcatatttataatgtttggtgactaaaaataaagactacatgagagtacagatatttttactccctataattaagaggcaattccttacatctgtgtttagagagattttttgcaaaaactactagagatgttccaaggaactgagcatagcatagtcaaccagtgtcatcaggttaaattttcctttttttcccctaggtcaatatggatttcaatatcaagtactggagatgctctaaggatctgagcatagcatattggtcaatatggattacaatatcaagtagaacaaatcattaggaaatcatttgccttgcacaatatgtcaaacaatattaaagtaaaaaaattacagaaatctgtattaacctccacccacccaaaaatgggcaaggcaatcagccttttcgctgcggttttaaatcagctgttctgactgctgtaactgtaattcatagagacaaaataccgtagaaagaaaaagagaagccatcgcttcggattagctaccgttttatcttcgtaccgctcagccaatgagatcgcgcataagcaggcagaggatgcagaactgcacaaagtattgttggctatataagccaacttgataagcatgaaaccccaaccaagtgcagtaattcagttcagaaatatttaacagccgacgagttaggcggtgtttggttccgagacagacaacagcaatgttaatagcatccgagaccagcgctaactggtacagtgaaagagatatcgctatttgtttgattggatgtgctaatggctttcactcccttgattgcggaaccaaacacaaacaacggcacctgatatcgccgtgaatggaatgcagcacaaatcgttcgaaacaaacacattttttgatgtgctctctgcggcgtcaaagaagcactctagaaggccaccaggcagcatttctgcctgttgaacgagttttgtatgagcagttcagtcagtaccagagaaacggaggatcaacaatccatactagcagagtggggccttccgttcacaaaacggaaagtcaaagaacaaagatttaagatcacttttggtagaactccaaaggtcctcagctccatttgtgaaaagagtggttggggccaggatctctgtggtatccgtgcttcacagatggtgaccattgcactcaaaactgcatagggcaactgcaagccaggatagccgtcctgtccagatgcatgatgcatggcccagagcagaggcagcaaccatgtgtatgtatactattccattccattctattccgctccacctgaaccatcaattctctttgatatggatgtctggcagatgagcatagctttttttttccaactgcaccgcctccaactattgctgctttgtgccagggcacttctcccaatatatttataacctaagctacatgttttcgattaggatgttctaggtaatggtctcgtgctctccatagagatcattccattgcacaagctcgctcatgttactggaatccgagggaacacttgcacacacctgttcatgcgcatgtatgaaatcacttgttcttaatgcacggacatcattgctagtgtgtgacggaggcaatgatctattttctgcttctgctgaagctctctccttcttttccttttcaagaatctccctaataggacggtgtgcagcagtaacacacagattcttgagatcactgcctgagtacccttctgtcaggttagctatagtttctagatcaacgtcgtctgccaaatcttccttggctagtattacactaagaatttttctcctatttgatgcatctggcaaattcaccatcaacctccttggaagccgcctaacaacagcctcatcaagatcaaatggcctgttagttgcagcaagtactaatacacgttccttctcccttgttctcagaccatcccagttcaccataaactcatttttcatcttccgctggatagagcaaactgcacactacccaaaggggggtctggatttgtacagttcttaagttgatggctcaaagcaaaaccaattattttatcaatacactcatttgtaagaatgcgatccgtgaccaatatcgcttcagggtcagtgcattccaatccaagccttgttagaaaagagcgtatttttgaaatgtttgcatttcctttaaggacttcaatatctcggtttaacatctggttccaccgtgaaagctccatttcagcttgtggtgcctcaagtgtcactttattcgggaaaagtttgatcaaatgcttcattattgcctttgatgtttctttattattatcatttcccccatcaatgtcctgtaatgtgaggccaagtatagcttggctgtaccggaacttcgaaagaaaaggagaactaacatttgccttctctttgcgattgtcaggctggatttgagatccaattataaaagcgccagctggaaaatgttttagcttgctcttcagaccatgataggaatcattattcccacaaattttctctgtgtccttcagaaaaaggattaaagggccatgccgaatttcttcagagataaactcaactatcacatcaaat

SEQ ID NO: 21568 - DNA, 3267 bp, Zea mays
  misc_feature (1614)..(1614): n is a, c, g, or t
gcagctcttgagctttctctcgctcctgagtgcagtctctctctctgcgccctgcgctctgcgccgccgccatggaggacgacgatgactgccctcctctcgccgttgagctccctccgcgggtgccgtcccctccagagcaatctccctcagacgcctcgccagttggcgtcaccgtcatcaccggctacctcggggctggcaagtcgacgctagtcaactacattctgaatgagcaacatgggaagagaattgccgtgatactaaatgagtttggagaggaaattggggtcgagagggcgatgatcaatgaggggcaaggtggtgcacttatcgaggaatgggtggagctggccaatggatgtgtctgttgctctgtaaaacacagtctggttcaagcacttgagcagcttgtgcagagaaaggatagaatggatcatatattacttgagacaacagggttggccgatcctgctccacttgtttctgttctttggctagacgatcaattggagtcgtcaattgtgctggattctattattacggttattgatgcaaaaaacttcagggttcagattgacgagcacaaaaactcttcctcattccctgaagcatttcatcaaattgcatttgcggatgttgtgatattgaacaaaattgacctagtggaagacagtcttgaggatctggaaaaacatattcgtgatgtgaatgctctggttacagtggtgcggtccgtccgttgccaggttgacttgaatgaagtatttaaccggcaagcatatggtgccaagaattcatctcatctgcaagaactgctggactatagtaaatcagtgccacctagtcgccgtcatgataacagtatttccaccttgtgcatctatgaacagggttctgttaacttggctaaggtactttctcttcttaaatgaaccatttcaaaaaggatcatgtaatgaggtcagacattaagacatttgcatacagaaaacggaggcttgaaagatatttcttattcaaggatacaaacttgacataatgtgcatagtttgctattcaaagtatgtcttgtcttgtctcactgactgttccacatcaagtggcattcttatttcataggataaattcttcctgtctctgatttcgattttgaccacacacgcccgcgcccgcgtgcacacacacacaaagatgttcctcactttctctgtcaggatgccagctggactaaataagttgacaaaatttagtactttgaatggaaactccaattaccagccccatttacatattttctgataccctgttgtggtttgtttttttacaggtggagtcttggcttgaagatcttctttgggaaaagaaatctattatggacatatatcgctgtaaagggattttatatatccatgattcagaccaagttcatacattacaggttgttacatcatacaaagaatctgaaagaactgcatgatcagctaaaagctatcagccattttttgtatttcccttaaacccaatagctagggcagtttgattgattatacttattttgttgcagggattgtcagtactgatgtctgattttgcccttatgcaggcagtganggaggtctatgaagttgtgccggctcgaaaatggtctgagacagagtctcgcatgaacaagatagttgtcataggtaaaacctcgaaagtcaaaactcagcagttcagcacctgcaaattctgaactgagttacagagtctctgcttgcccatgttagctgtcataggccgcaatctggatatcaatgtacttcaagattctttctagtggttgcaagagctgataatgagtatctgtttgccttgcacaatgttagttggccatttttctgtgaggtaaattgcctttatgttggaggttgccattcacactgtccatttccggggcatcaggtgccatcatggatagctttgctgtttgtagcattgagctgccatcatcatgggttgctatgttaacaatgcttgtatactgtttaagacaattcaactcttaacttttgtgtttttgtatataagtttaattttcttacctgtatgctcgcaggtacctctgtgcaagtgaatactgaattggaggagaatcttaggtagggaatatagataacaggcgctccatatataaacttcgttattaggtgctgtatggactatggttcacatatttgtaacttgaacggtaaccgataatgttaaaacatgtttgtttaagtccaaccgtaatcagataccacactactagaaactgatatcatcctaaatcattattgttgcaatttacgttagtggagaatctttagggcttgttcggttattttcaatccatatggattggagaggatcgatacggattggaggggattttgacttaccagggatttaaacccctcaatcccctcaatccatatggattggggtagaaccgaacaagcccttagcgggcagggctagcaactcacaatgtgaagagtgggcgtagccgaacacctcaagactgatttcatggctgtattacatgccaagtgcttttccgacgcaatttgacaattttttttgtagaacctgtttcttcggttttgtggaagaggcatctgtccaattacgggtcgcactctgggaaagaatttcagttttgcttgtatgatcaggaacacattttttttcacaggtacggtacggtgatggaaaattgaaatttgggcgaagtaggaactgtgatgtgttaggcgaattttcctcggtgaattggtggcttcatttgtggtgtgtggtccgtgttctgatcctgcatgcacgctgcggcttatgatttacagagcacataatttgacttgagtgatgatggacagtgaggagcgtgtcgttctcgttcaaagggccatgacgcactattttttattttgatccacgattatcaagtacaaaggactacactatttgcttgaaagtatatttgacggagaagacaaacagatcaactcggtataaccgtataatataaagatttcatggcgtaactgccacaagctgatcgcgactataacaaagaacggatctgttcttggatgaacgactcatcgagtagagcggctagagcacactgttcttgtatgaacaactcatccagaagagcccactattagggataaaaacgggtacccaaattgttaagacaaatctagtattttaaaacagatttatataaaatttgat

SEQ ID NO: 21569 - DNA, 6063 bp, Zea mays
  misc_feature (1092)..(1092): n is a, c, g, or t
  misc_feature (2722)..(2722): n is a, c, g, or t
  misc_feature (2927)..(2927): n is a, c, g, or t
  misc_feature (3132)..(3132): n is a, c, g, or t
  misc_feature (3663)..(3663): n is a, c, g, or t
  misc_feature (6053)..(6053): n is a, c, g, or t
cggcggacgaaagaaaacaagccaaaccaaacggctcgcaaaggactcgctaccttaagtccagcactctcccactccctcccagaccctcccacttaaacccgccgccgccgccgatgccgctccttctcccggtctccactaggctgcgaatgctcggcgcccgcgcgctcggtgaggttagcatccggctcctatcatccatagactccctcctcccccctcatctcttgctctctcgccgcgacgcggagacggtgcttggttgcttgggggtggttgagccgctctcttgctgtgacttccgcggggtacgacaatcgagtttgatgtcgacatgccccctcccgattcaattcgagttgtctcttgtagagtccgagcatttccttttgctgtgtattcgtgctttcgtggtatggtatgtatacatgtagtaatttcaggctaagttatgagtcggcgcttggttctgggaagttaaattgggtaaaaacatttctatgattcagtgcttgattgaaaagatagtttttgaagttttatgattcagtacttgtttggagaaataagaaaataaaacaagttagtattcagtgactgaaatgcagtgcccacgcatatgacgcctgttgtgtcattattatgtcacctctatatgcactccatcattttccaaaagaagcaacacataaaagttcagacctgcatatgctgtttttgactcatttacgtaccatttggcaataatttcgtgctctgtagactgtagttcttcagtttcctgtacgcttcaatgtgtctttgaacatttacgtaccactaggatgcatatgctgtctttgaacagcttctccgatgaagcaacacatacaaaagttaatgtttgacagaacagctgccacaatctggcgacagaagaggagccggttccccccccccccccccccctccagatgtgtagaacaaaaacggcttaagcttcatggctgcttctcgtgcaaagttgtttttttggtagccatttggtagggcctgtagatttgtagaagccggaggtactaaagccggctttgaagctctgccaaaggngcccaaagtggtactagaatatacgaaggcttgtttagcattgactccggcttcgtaccataatgcatggaacagccagagccagcaaagcaaaaattaatggcttcactggtccagtgtatttagagaaagaggtaaaagcaattcttgcctacagtccacagaggagacgaactggctaaagctccaccaaactgggcctaagagtcagcaatgagcaaaccaagacaaagtttatggttcatggtgtattttaatctgcagacactgcagcattgctgcatgggggaattgtctcggtttcagggcacatgtggagacatacatacctaaacgtctcaatattcttattcttgattacatattttattcaaagtagtccctctgttccaaaatagttctcgcttcgtccctaaatatttgtcattctcggatttcgaggagtcaactttttttttttactttgataaaatatatacgaggaattgatcgacataaataccatagcggtaactattttgggacggaggaagtagagtgcatggcctctactctatcacagcatcattacccttttcttttcctgtcaagattcaaggtgctgacaagagttccagagaaaatctggagcctttaaggatggcgttggtgcagactgcagagattcctctgtcacctgtaaatcttggcattattttggttgtccatggcttcatagttattctgtgccatttttttagctttcgcacttgtctgttcagagtaagagtaaaacattcgaaatctgtgctcttgattggtatttttcaggtcactcttattaccattctgccttccattaactgttatacctgaccaaaatgcagttttcagagattgttgtcttttctgcaagattccttttaggagtacatgaggactcgttgatgtcatgtccttatgcgtccatatcgttgttacttgtgttcattggctctgtggacttgcttttattttgtctttttgtctgctactctgctagacttttactattccataccgccaagggctgctctgtccacctcgaatattttagttctctgtgctgattttctttttgtgtaaataaagttggacaagaagaggccataaactgtgcttctcttttgcaccaatctggactaaaagtgcatgcaaaatgtgtctcttgaagttttcccaatgagcatcttcctacagtaatggcaacagcctttttgtatctggtaccccttgcatttaaggtgctgtttgattcacatatttgtaacgtaaacggtaaccgataacgttaaaccatatttgtttaagtccaaccgtaatcactaatcagataccacactagaaactgataccgtcctattcaaacttgttacctctcgtaatcgagtgtgaatctatcatgtggggccgcatgtacagcagacgcaggcacacccgcgacgtgcgtagggcggccgagcgcgcaggccacaaggaggcgccaacagccaggggctgattaggagccggtttgaataagtccagagaataaaatttagatgagagatttgaggagaggtagttagcattagacaagtccaggagagtaagattagatgagagtttttangaagagttggttagcactagggctatttgtaagccgcatggcagcagggaataatcaagcaatttattaccagtctaatcccctctccccagtttccatcaagcctgcggcagagatgactaacctcgctggagaagacggaccgagactgcaatctccgtagtcgagggccagctaccctaggggccgacgcccttgacagaancattaccattaccatttacgttacgtttcgtgaaccaaacgtcatctaaatcctaagggctttagacgctaagagtctcctgaaatatattcattgcagttaccattcctctcaagtattattatgttagtgctagctgaccactattctactgaaattttcctgctcttagagtttacctagtcacctggcaagggctgtgatntgatcgtatggtttatttacttggtttcagtcatacaactcacatatggttcatggagtttcagatctttttgtttgcttttcagggtttcatgttccaaatggactgttttaagctgggtgagctacattttatcaggagaaattgatcaattgatttgaagtttgaacaatgtaccagaatgtatgaaataaagccagtaattgatcacgctcatggagatggtacatatcacttataatctcttttgggcacttcttgagtaggccctatatttattctattacttttgtgacatttggatgtaatgatggagggctacttttaaaaaataatcgcgggattcattgggaataagatctggcatgctgttaaaaaattgtcatcgttcttttttatgttgggataaatcatagatgatactgtattgcattcaacgagtagttcttgttttgctgtttctggcctccgtaaggagtgatttgtatttcgttcttctatagaccggtgttcttcttaatatattttaangtgcagttcccctctgttttcgagaaaaaaagtagttgattgtagtattataccttgtgttttcagataatggcaaaacaatcatttattctgccgttcctactttttattgattggattatttttataagtcaagtttatccaggcactaaccttttactttgtatcatttacatcaaaataccttattcagcgtttctcctctcaggactatcagttcaaagaatcatctcagaattgaagaaaattaccagtcctgttgaggaaaaacttgtgaatgtcatatacaaaatttattttagaattttgtttcctcacacttatactggtgaattttcaactgataaggactgtagggagcttttgatacaacaccgtttgaaaattgaaagggaaatatcactacacctttaaagtggaagtttcgtcgtgcgttgtccccctccccatgtgcccaccgagcgtcatacagtccccgcgtgtgccagcaaataatccaaaaatagagcacgctcgttggggttcaaaccatggtcgcatggaacaagcgcttgcctcataaccacttgagctcgtgttggtttgtgctatataaagggatgtctatctgtatgatatatagaaaccgtagcacgagcaactaactagtatatccctacatgtaaagatttgctattagttagtgctaatagaaaattttctcctgaagtgcctgaaaataatatataaaattgatgtttgccttgatcattgtttgtgatattgcggtttatctacagggtgacgatgacaattcttcaagcagaaaatgtaacacatcatcattaaaaatgttactagagaaggagatgtctaaagaagcagagtcaaagagaagacatccaagtgtcattgccagattaatgggtcttgaggaggatttacctactaaagaaccaactgtacaccataccgtaagtgacttgagtagagatttgaatgccacaaacaacaccttacagggaaaagaacaccatcactttataatgtcgaagacacaaaactaccaatcctgtcatgaaaaaatcgaatacaatgatgtttttgaagtatctgaaggacaaccgggaacagactgttttcatgatagaacttcacagaaaggatggtcttccgagaacaagagtgagcaattcaatattgcacgagacaagatcatggaaccagaacagttagctattgaagagaagctcctttgtacaaaggagttgcctgaagctcttgtttttccatgttcaaatagagatttatttcttgaatttcctgaagaacataaccccacattctcaagacagtcgagtgggcttcatgcaaaccaagcaccgcctcaaacaaaacgcattacagtgctgaaaccaattagatctgttgatattgatggcataagacgacccagagcagaaattggtaagcaaaatgtattgaagatgagaaggttccatcagattcctagtccaaaggaagagataccttcccaaccaagtagaataatacttttgaggcctaccccagggaagccaggtatatcaaaggcaaagctgacatccagggcaacttcatttcagttacctaaccgtaacagtctcaatggatcattagatgataaccaggcatccataggatctgcaggactagtgcatggtatgatgcagtgccggcaagatggatgtcaccaaagagatgattctttattatcttctgcatactcaaatggatatgggggagatgaaagctcattcagtgattcagaagttgattataccagtggctctgaaatcaactatattgaagattgtgataccctcagtgactccgagggaggtagccctctgtcaagacactcatggaattacataagaagatatgaaggtcaatgctcaagttcatcctttagcaaaatatcccacttttctgagtcgtcagttgtaacggaggccaaaaaacagatttcagagcgatggtcaatggttacatgcaatgagatgagtcaagtgcaactgtcgagaagaaaatgcacgttaggtgagatgctctccattaaggaagcaaaggaagacgaggccaccactgggatgttttatgtttccagcaaccagtcatgtggcctggagaatgaaccgactacacgttctacaaatgtaactacttctagaaaaaatggtgacaatggggagagatcttcgaaattgccaagatcaaaatctgttccagtgatttcatccacgtctgataacatgacggtgaacatgcaagcttcaaatcctgagagctgcaaacttaaagtggctgttgtgtcaaataaaggaaaatcagctttcaagggaagagtgtcagatttctccttgtctaanagtaaaaggc

SEQ ID NO: 21570 - DNA, 1588 bp, Zea mays
gcagctcttgagctttctctcgctcctgagtgcagtctctctctctgcgccctgcgctctgcgccgccgccatggaggacgacgatgactgccctcctctcgccgttgagctccctccgcgggtgccgtcccctccagagcaatctccctcagacgcctcgccagttggcgtcaccgtcatcaccggctacctcggggctggcaagtcgacgctagtcaactacattctgaatgagcaacatgggaagagaattgccgtgatactaaatgagtttggagaggaaattggggtcgagagggcgatgatcaatgaggggcaaggtggtgcacttatcgaggaatgggtggagctggccaatggatgtgtctgttgctctgtaaaacacagtctggttcaagcacttgagcagcttgtgcagagaaaggatagaatggatcatatattacttgagacaacagggttggccgatcctgctccacttgtttctgttctttggctagacgatcaattggagtcgtcaattgtgctggattctattattacggttattgatgcaaaaaacttcagggttcagattgacgagcacaaaaactcttcctcattccctgaagcatttcatcaaattgcatttgcggatgttgtgatattgaacaaaattgacctagtggaagacagtcttgaggatctggaaaaacatattcgtgatgtgaatgctctggttacagtggtgcggtccgtccgttgccaggttgacttgaatgaagtatttaaccggcaagcatatggtgccaagaattcatctcatccgcgaggcccgcgccgctatagtaaatcagtgccacctagtcgccgtcatgataacagtatttccaccttgtgcatctatgaacaggattctgttaacttggctaaggtggagtcttggcttgaagatcttctttgggaaaagaaatctattatggacatatatcgctgtaaagggattttatatatccatgattcagaccaagttcatacattacaggcagtgagggaggtctatgaagttgtgccggctcgaaaatggtctgagacagagtctcgcatgaacaagatagttgtcataggccgcaatctggatatcaatgtacttcaagattcttttagtggttgcaagagctgataatgagtatctgtttgccttgcacaatgttagttggccatttttctgtgaggtacctctgtgcaagtgaatactgaattggaggagaatcttaggtagggaatatagataacaggcgctccatatataaacttcgttattaggtgctgtatggactatggttcacatatttgtaacgtgaacggtaaccgataatgttaaaacatgtttgtttaagtccaaccgtaatcagataccacactagaaactgatatcatcctaaatcattattgttgcaatttacgttagtggagaatctttagcgggcagggctagcaactcacaatgtgaagagtgggcgtagccgaacacctcaagactgatttcatggctgtattacatgccaagtgcttttccgacgcaatttgacaatttttttccgtaga

SEQ ID NO: 21571 - DNA, 3223 bp, Zea mays
cattgggacccctcgagccggccgggccgggctcattcattcggaggcacgcactcggctaggcgcagaggctttctcctcccccaagccgaaacaccagagggcgagactcgagagagaagagcggcgcggcggaggacagcactggatggagccctcgccggcggcgggagagcttggcgcgatgcttcgtgcggccgctgacttcgcgtcctacccagggttgcatagtgatgatactgtgaggcagttcctggaacgatgtccgctgcctaagctcttaggtgcattgcagagtgaagcagatgtacctgggatggttgaaactgtcacagagtgtctagacaaaatattttcctcaagatatggagcgtcacttctgccaaactacggtgcatttattcaagctgggttgctcacagactcgaagcaaatcagaaaattagcctgcaaagctgtactccatcttcttgacaaggctgaagatggtgctgctgctgtggaaacagttgtgcagcataatctgtatcctcttctgatcaaatgtttgattgagggagatgaagaaatttcagcaatcgttttggacactgtaaagcgtttagcccaaattcctaaaggagctgaagtcatattcccaccagatggtcaaggatctgtgcaacttggtaaagtggcggctcagtcatcttcattggcacggattcgtattctatctttgatagccaagctcttcactgtttcaagttatactgctactgtcattcgtgattcaaaccttctgagcatatttgaagaggaaataaaagatagaagagatatgcttaaaaccctcagtgcgctggaggtcctatatgagcttgttgaacaccctcacagcaacattttcctgctgaagaccaacttgcttcaactcataattgatatcatcaatgattcctcagctgattctgttatacggtcaagggcagcatcagttagtgggaggcttctttcttcagctgatgctttcacagcaatagataaatcctgcgttaccaatctgcttgtagccatagacagaattttgaagatggaagaaagcaagaatactgatgaaattgagagtgcattggagaccttgggtctaattggtacaacaagtcaaggagcacatttcttgctgacatcatcaaatgttgccagacatgttgtcgagtcatcctttgaccgtcaaggcaggggtagacagctggctgctttacatgcttttgggaacatctgtggtgttggtagacaagaagaccagatgaaactggatagcgaagccgaggaaaacttgaagcgcttggtctatacgactgcagcaaacagtccaaaattaaccccttcagctcttctactatcagttctgcaacaagacccagacgttaggatagctggctacagagtaataacaggactggtcatccgggaatggtgcttaagggaggtttgcttaaattcagagataatcagatttgttacggatccaacaatggagacaacaaaacttggcatggaaacccggtatggctgctgtgtggcaatcaacaaggccctatcatcatcccatcttctgcatgaagcaagtctttctgaactcgttgggaagttgaatgatgcggtgaaacggggcccttacctttctgataggaagcgtgtggaggcacggccggtggttgatactgcagagaggttttaagctgcccctcgagtattcacccaaagtaaacgatcagtctcacagcgtagcttggaggtaactgggcgtgccctgcgtctcatgcggttggcttatgggtaacagacatatatacgatgtacctggacgatggggaggacaatgtgtacctaaacttacaaagcaaagatgttgtttcttctattttgctttgtggatgtctgatgcagcccatacctgcgaaagaaaatcatctgttgcaggaccgtgccaagttttgtggaaaaaaaaaaattgcagatgcagccggcactaatttttcatgtattgaatgctcaatcgaatcaggtaatttctctgtattatatctaaacctaaactgttcctagatttgcaagaactgagtgaacaaaccaaaaaaacatcagcctctgggcacactgtattctgtacaacgtagttgcccacaactgaactttacaccgcggcagcacagacagagagttgatgcgtcgacgacggcaatggaggcctcaaaagtcaagacgtcagtgtccttcagggtcctcttgcactgcgatgagcaacgagtacttgaccttgagcgcaaccttgccgccttccatgcagagcttggcgccggtgacgacccagtagcccggcaggtcgtcggggcccctgctcacctcggtggtgtcgatgtgcgtggccatcttctgaaccgggagtggcaccggcgggcccttggggaatatggcggagttgacctccaccttctcctccaccgccggcggcgccaacaccaggccaccggacagcgcggcgctgatgcgtgccgacagcgacccggacctccgcggcgcgaccagggccccgccccactcggagcggcggatcttcaaatccgcgacaccagagaagccgaggcgtaggaagagcaccttcatgaaccgagaggatggaatcgtctgccgtccatgaatggcagtggatgctccgagagaatggcgagaagggatatgggaattgacggggcgcggtaatggcgagaagagatctgggacctttcattgacggtgaccgagaaagagttgaacgcccgtgggatttgagggcgcggcagatgcacgatttggggagaggaggaggaggtggaccttccatccgtgtgatttagtggcgcaaccttccatccgcgggcgttgcggcggatgcacgatttggcgcaaccttccagttgtgctcgtctgcgtcctccttgtgcgcaaccttccatccgtgtgcgcaaccttccatccacgaggacggtgacggggaatgcgggcgctgggaggggaatcgagcgggcggagctggcgcggcggatatgcgggaccgggggcacgacggatttacgcgcggcagcagccgatgcgcggggaggcagaacaaaggtcctgtgcacgcctacacatgaaaacatatagagtagtagaagattaagtcattttcaagatgagtgggtcaccgcaggaaactttt

SEQ ID NO: 21572 - DNA, 6205 bp, Zea mays
  misc_feature (362)..(362): n is a, c, g, or t
gtgtgtgttttgtgtatgctattcgttggaaaacgctgctatatatgtctctattcattggaaatcggatcgattagggatgtctaaatctagatgtaatgtttagaaattctatcgtgtcttaccgtgacgccaggtagccgtcaggatgccactgccaggcaccagccccctatcggaggctctaataaactaactaaggaattcattttcttgtttttcgtaatatgctcaaccacataactaaggaattcatttgaaaatatttaaaatatcatataattcagatgtctatgacccgtcgtcggcccctgcgtcctgtgtatgatgctcgacacacagagacacaagtgtgcgaacanacagcagctcggtgcattgcgaggtggtgtgaactgatggctgttgctgtgcacaggtttcgtttcggcgcttcccacctaccctaaaccgttgcctccttcaggtattaaaaattctgggatgccccctgtcaagtgattaaccctaaaccctaactactgagtactgactggggttgctattctttacgatgctcgagatagctccactgtcaagtgattaacaatctgggatgccaaccaagtcgtgattaaagaaggttattacagcttacccattattggtggacacagcttgcatagggcttctaaaaatgccacgagcatcacctgatagcttagtttcacacaacgtgggcatcgaggtggggtctactgggtgtgttctccggcctgagaatgagataccctcatctatcatgctgattgctcatgattcattcaatacattccatgatagagtatgtcttatgttgcgattgattttcttatctttctttggcacctagattagcatctactttaacatataataaagtttttttagctacttctatatgcatctaatccttattaggtttatggtgtcgcttaaatgaaatagaaaaacttgctccaaaacttgtacatatccatttctactacggtttaaggcgtgtggcttaaataagatacaaaaatctgccctaaatcctgctactatctctaacatctcaatcttggattttccgcaggattaaaaaaaatccccatttccaacaactctcaaccttgttgggagagctaggcgcgatctgctgttaagaaagctcaagcaccgtaaagaaagttttccgtgggagaggaaaaaaaaaagactctgcatgcactttactgtccttgtccttcagctccagtctgtgttgactgttgactaacagtgttgacgaggtcccacctagccaccacaagcccacaagtcattcacacttcgttgaaatgtcatacacgcatgcccatgccctaataattgatttggatgttgtcgtctgtgtctgtgtggggtcatttagcctttcttttcttgaaataaatattgttttagcctttcaaagggtgttcagcttgcgatcttcgcttggggcattgacctcacccaagtcttcgtcttccttctttggcagctgccagtttcattcaccactatttttatccagatccatccttggatttctcttcattccagatacatcctctctaaagcctaaaccccttgctctcttttcttccgatgtatagttggagagggcagtttcacctgcgaggctgaggtgagcaaccattgttggagagcaagcagccacatggccagcaccgctgccactccggaagcaggcagcaataatcacagtgaagacggcaccacagtggagcttcccatcgtcgtcaccggcagcaccagccaagaatccattgatactccatccaccaggtacttgttagcccctagccatgtatccagctccagcttcaccgcagacattgagctcctgtggagactgcggaagtacctgctgcttcttggcatcttagctgttggtgttacatacaatgctggattgaccccacctggagggttctggtcgaagaacacacaagggcaatctggacatgaagcgggtgaccctgtcctccgggctctcttcttcccacggcacgaggtattcttctactgcaatgcaacagcctttgcagcgtctcttgtcctcatcatcttgcttctgagtaaaaacgtggcaaggcagaggctatggctccgctcaatgcaactcaccatggttctggacctgttcagcctgatgggggcctatgctgctggaagctgcagggcagtgaagtcctccatctacatctgggttctggtgctctctgttttcacatatattatgatccacatcctagtgttcatgaaagttgttccaagatttgtgtccgagaaaagatttgttccaaaacggctgaaagatgtggcgcggtctgtggagcgctggatcctatcccggtgtggtgttcacaggagtgaaaagaacagctctcacgagaaagatctagaggaagctcgcaagttcactctggtgcttgtgactttcgctgcaactgtggcataccaagcagggttgagtccaccgggtggtttttgggctgaaaatgatgagaacaaaactccagctacatctatgcttcgctctggaaaccttcctcgatataatacttttgttgtttgcaactcgacttccttcgttgcgtctttggtcacaatcatactgcttctaagcccagaactgagtcggcatggcatcagatccagagcggtgaccgtgtgtgttgttgtcgacatattgggccttgttggagcatatgctgcaggaagctgtaggagtgtggtcacatctgtctctgctgttttagtggctgttctagtatggatctgctttgcagttttagctgggatctttgttaacagatctgtagcagagtggtttgggaagaagatcaagccagatattatgaggtgcatcgacagatttggccgggtcttttcgtcgaaccatggcagaaagagatcaagaaatccggagggagagaattctattgcaagtcatcagcaaactgaagagagcataaaaggtgaagcagaagcagaaactgctagagtgccagaataccagcttccataccatcagctagctccagatattgaagagggtgaatgccctggggagcagcagagtccaggcaaacaacaacctacaaacattgaggttgtgtccatctcagagcatgcatctgtaaatgagaagcaagcagaaaatagcagcagtgtcatgtgcaagctgggaagtcagtctacagacccaaattcagctgcaaacgaggctatgactgaaactgaaacaggtgatccttttatgatattttagtgaggtacaaatgctaataccaatatgtctaactctgactctcaaccctgcagaaaacatacaagatgcaaatatggaggaacaacaatcttccttggtggatggtcttaaaactcccactactgtggctggtatgtccaatcatgagcatcaatcggtagataaccatgtagttcaaaatttgatcaggcaaactttttctactgaagatcaagaatccacaaccgtggagtgcttgtccgacattgcacccaataaccataatggagccaccaacagtttcaaggaagagaaagaagcttcggagcagcatttgcaagccaatgagattgagagtttcagaaccaataatgtggccagacctgttgaaaatggcaacgttggcatgtatgaagtaactcccagacaagacgacggtgatgtaaatgctggtgccaatccaactgatgaacatctgaagaagtcccggacatacctccttcttctagccattcttgcagtatccctggcgtatcaatcaggtttaaatccaccaggtggtttctggacacaaagaggtaccaacaattcacctaagagcacccatcatcgtccctatcatttaccgggtgatcccatccttgaggatactcgccatcgacgctatattgcattcttctatttaaacgccatcgcctttgtggcatcccttgtcatgatcatcatgctcctgaaccggaggatgagctacaagggcataaaacgatatgcgctgcagatggctatgatagttgatcttcttgctctaacagggtcttacattatggggagtagtagggggacgaagagctccatatacatatggctgttggtatgccttgtgctggtttatgttgctgttcatgttctgatagcaacacatgtaatccctgaagggtgcaagaaggtcgtggcacagaagattgagaatttctcctgcagatacatatggacaaaggcttcgtttcggaaccggggaattgatggtaatggtagtgattgtgaggctgggcaaagccagaggagtgatgccgatgacaagacctgggagcggaggcgcaatctactgttgatgcttgctgttctagctgcaacagtcacgtaccaagctggcatcaaccctccaggaggtgtatggtctgatgatagctcagccagtggtaaaccaggagacccaatccttcagcacaacaattccaagcgctatgatgttttctactactcaaactcactctcattcgtggcatctgtagttatcacaatactgcttgtgaacaaggaatcctgcgagcatggtatcaagtcctatgcgctaagagtgtgtttggtggtgggcttggtgagcctcttgattgcctactctgcaggaagctctaggaaagcaagagaatctatctatctcatcgtcattgctgttgcagttctgattgctcttgtgattcaagtgcttcttctctcctgtacgcaagacagtctcagaggaccaactggacagtttatagaacgtctgctccagctgctttttgggacggacaaggcctggcatggagacacttctaaacagaaagaaagctcaggtcgtcccgagaaaaaagttcggaagaggcacaagtatttgatgctgcttgcagttttagctgcctccatcacgtatcaagctggtctcaacccacccggtggtttctggtccgacgacaatgaaggccatgtggaaggcaatcctggcctgaaaccacctggtgccttgtggtctgataacaaaggtcatttggcaggcaatcctgttctccttgatattaatcctcggcgctacgaaatattcttctgcttcaactctatctcgttcatggcatctattgtcgtagtcatgttcctgttgaacaaatctgcccggaagaaggccgtgccacttgaagtactgcacttgatcatgatactggacctgctggccctcatgactgcttttgctgctggaagctgcagaaaattcaggacttcagtctatgtgtatggtctagtgctcggtgtcgtggtataccttgtgatcgcagttcttttgtcaagtggcattgcaaaatgtctgagacccatggatagaaatagggtttcctctcagagaagtcctattcgcgctcctacagcaagcacaaggatacttggagaccatgcttgatggttccattcctttggtaatagtactagtttaatagtagtgtatgtatttggcttttcagtgtacgttatgttgtgggagtttgaattgaactgaaattcgacgctttatgttgttcatttcttttagaatgtaaaatcagtgcaatcatgaatctacatgtgcatgccgaaggttccaatgtatgcgatggaatgaaaagaaaaatcctagagactatccgtttggttcgtggctaactgtgtcacggtttatctaaggttagttatctaaatagaagaactaactttagccacaaaaagttagataaagtatagcaaattaagcaacaaaccaaacaacatatcaccatcctctgtttgtccatgcccgatgttgttgtatttagaacttttctaagggcctttttgcatatagtcaatataaaccggatatgtgtgcagggagaacacagtatttttctcacaaaaacgatatggtatctagattctagagttaaggtttgggctcaccgccacctccacgttggctgcagcttcgccccttttcacgtcgccgttaccccaagctgttgcatgctgccgatcagctctgtgtgatcaccctctggccgtgggaaggggatttcactccggtgtgagatttccagcgacagtgaggtcactgcggcaatgagcagaggacgtcaccag

SEQ ID NO: 21573 - DNA, 4196 bp, Zea mays
ggcagagctcatgatcgtcgagacctttgataccagattggtagaagctgtgttccctatgctaacgatatgtttctgttgcaacgcacgggcacccacctagtttataatataatattatagtgcagcggatacgtccagataggcctctctccatgccatccatggttgtgtgttgatcaacaggtaaaactaaaagactaaacgaagaagaaaagcagagcgtggattcactgcaatggaaggacggctacggcccgttctggcaactggcatgatgcagtcgtccataaccgtgctggcatggcgaccacagcccgttcaacatacatcgtcacggcccaacgagcgacggttgcatgcgtttgcccggagcccatcgattccggtaccatggccgaaaacgacaatggcccagcaacggtcgtgtcccggcgctcaggcgggggcgttcgaaatttgaaacccctggcaacgtctctctccatcactcacggcacgacagtcacgcacgccgccccgaatctctcccctccacctccaaacaaaaatctctcctcttcctcctcctcctctcccacgatccccactcccaccccaccccctcgatcccaactccacccagccgaggccagcccagcaaatcatggcgacggtcacgcagggggtgctgctgcggctgctgcaggcgatgcacacggaggagcgcgtggcgggggagcaccgttcgccggtgctgcaggtcacgggcgtggtgccggcgctgacggcgtccacctccgacgcgccgctgctcgccgcgccgccgtccaacggcgtgctcctcaacctctccgacggcctccactccacctacgtgcaggtcccgcccgccgacgccgacgcgctgctggccgccgcgcgcccgcacctcgtgggccacctcgtccacctcgaccgcctccgcctcgcgcgccccgtgccgcgcgcgctcggcctccgcaccgtcccgtcctcccgctccctgccctgcgctggcgcgccccagccgctcgtcgtgcgccccgccgcctgcgcccgcggctacgtcatccagcccgccgcgtccgccgccgacgccgcgccgccgctcatgccctcctgccccacctcctcctccgacgacaacgacgccaagcggaccgtcctcgggcccaagaacgccgtcgccgaccccgcgccgccgccgcagcagcccgtcaagcgccggttctcgtcgccggcgccgccgtccaagcagcgagacccgtcgcccgccgccaagcccgcggtctcgcgggcgtcgtctccctccgtcggcaaaagcgcgtcgcggccgtcctcgcccgcgctcaggtccacgcccagggcgacgtcgccggcgccgtccaagtgcgtcgtgcccagcctggtcgccgccagggaggagaaccggagggcggccagggagccggcgatcatcgtgccgtcgaggtaccgccagccgtcgccggcgggcgggaggaggggcgccgcatctccggccgtcgccggtgggaggcgggcgtccctgtcgcctagctcgcgccggctgtccggggaagggaccggcaagaagaaggttggggtgctggtggctgggatctccaagatgacggatctggggagcgggtcggctgccaagcccgggaggaagagctgggacgatcccacgcgcactgtggctgcaacgtccgtcatgaagtctaaggccaaggtggacaaggataccatcctcaggactcaggtctggatcctctgttactcagcttacttgattaataggatcatagctttggtcagatttggttatgcaaattaaggtctgacattgctaaatggtgttggctatggatagcatagtagacaaagaaacattgttgggaaaaaacccaagtatgaagggactgtaaccttaactgttggctgagaaaatcataaccatggtcaaccatgatcctttcagtaataaccattttcaaatggatgtactgtgatatcttctcaatttagaaatctggtgctatgactacgaattaatttgcacgattataacttacacagctattagtttggaatttcaaacataaagctacgaattaatttgcacgattatgtagcatggttgggtaaccattttgcctgtgcacaacagagagtggtgtccttgtagtgtacagcagaagggtgtttgtgcctgtgcagtaaacatttcttctttgtctctatcatcaggaagcaatgtcgaggcggctaagtgatgctacgacggaacaatccagtaacgatgattcatctgttgacgagaagcccaagcagcctcgtaagaagatagacgcccctacctcagtgaaggcaaagaccgcagctccgaaaattacacttcacgaccctaaatggactgacggcagcattcctttggacgcacttcctgataaactctcaaaaataggaaaggtaagcgactgcagttttattttattggcgctcagcctccattcagtgatgctgacttgacctgggtctctaatgtaatttgtaccgagcttcaggaagcttttgagcggagagattcagcagcaactgctgcagctagcgccctgcaagaggcattgatctctgaatctgtgatcaggaacataaggtatttggggatatcttctcttttttttactcaatctaaaagccaaacccgtgcgtttcttcagcaggaaactggtgtgactggtattttgtttacttctccgcttacagcaagttctctgaaatctgcgcgtccgcaagggtctccaatccgttcccaacagtagatctcttccttgtcgtctgtgaggatgctctcaagtggaagaccatcgctgccgagtctgtggtgaccaacggggctgaagaggaggaactgctggagaagaaatcgacttggcactgggtcggcgctgcgttagccactgatctcgaggtcctcaagcttctgaacggtgccactgggcccttctcccggacgcggagcagcggcactaccaacaagccaaatgcatcttcggtggaaccgccgaggacagcaagcatgtcgtcgaagaagcaagcgcatggagcttcagccaaggcgcagtctaaggcggcggcggtgtcaccaagctccccgccgaggtgcagcacgtggaacatgggcgagacagctgagctcgccaaggccctgtggcgcgagatgcgcgcgtggttcctgaccttcgtggacgaggcactggacgtggggttccacctgttcgaagatcaacagaacgtcgctggcaaggggaggcagcacggcggcggacacataacgatggtcctctcgcagttcaagaagatcagcgactggctggaccaggtagggaagatcgcggcggcggaggaggaggagcagaggaccaaggaaaagatcgagctcttgaagcgcaagatctacgggtttgtcattagccacatggggtctgcgttggagagcccagcatccgtctcggtttcttcgaggagctgagggctgttagtggatgcttcatgctctgaagctcgctctctctctctgctcgcagtttctgttcgtactggttcttcaactcgtttaagattgaaaaggccacacagtcatgtagcctgttgttggcgcggttcttttgtgttttctttttgggatgcctaatttatgttgtgaataaattaccgtactgtcattttggatacgtgtctgtttgtcgggtaggattatgaatgaaaagttacttggttcaaaaaaaaaaaaaaaacaccttacccgttccgttttccgcctcattgccaatccccactcacactttatcacacgattcagctgtaactgagcctccccctactattgtctacacccgtcgcattaatatataatgattcatacacccactccctatctggtcacgcccccattcatatcttacttctaccggcttatctttcgtgcgtcaataacaatgagaatacccctccatcactagaaaatgatcagttaactatacccccatgactcagtcatctcatatccccctttaccctaataaaccttccacccctcgaagtctggctctattagtgtctagcaggcatactaacccccatatggatcattcagataactttcacttcacccacaccaattcccacctcga

SEQ ID NO: 21574 - DNA, 4246 bp, Zea mays
ctttggccgcccgtatgactgaacttcaagtctcgggtttttatttataaaaaatcatcatacctttcatagtggtcggttcagtggtgcaccggacagcttgtaacgtctaactcccatgggcgcacgctacacaatggatatcaaacatggcacctagtccagaggtgcaccggaccggtgccatacagatatggaagggctctagccccgatctggtggtgcactgcaccgatccggtgcccccaagtagagcacaattttagcaggttttgcatggaaggaacaaccgctattggactctttgggctataaaaggacctcatatgcgccctccttcagtaccccaagtataccaacaacacaaaataattccaacaatctctcacaacatgttctagtgattttagagaggtcagggcgcatttccaagatgttcttgatattgtatgtgactgagctctcgagatcttgattcttgtgatgtgtagctacttttgtctattgtgtgtgtattctctcctctctctctctctcttatgtttcaagttgtaactctgatttctgtgtacgactgcaagagactataatttgtagtgattcattgcgagagggatataattgatacaaggagatataaagaagattatggcactcagagttaatcttttgatcgcttgagaggggttgatgtaacccttgtccattggaacatcacaacatgaagtagccaaacatttgagacttaaccaaaccacgggaaaaatcatcgtgtctcttgtgtttgtctctttgtgttttttcttcctctccctaagttctccaaaatcatgtgaaatattgctcttaatctatttcatatattgaaagagtaatcaagtgaagagaacttctctcttcttctcattgtgacttgatcttatcttgcactaactattattttggaccaaaattatgtttgaagttgtgttctacaggcatcgcctatttgccttttaggtgctcccagttcgctgtatcgagaatgataacatgagatttcatattcttcaaaggacaataacttggttacttaatcacattggtggtgttcatgcctaaggaggaaggaaattgaccaagataactgtggcccccttttttttttttttttgcttggaattgaattttattataataattgtaacttatacagaatacatttgtatattattgttggccatatgaaagagataattatatgctacatttatactcaaagttgagctacagtgatacctaaatgttctaggtatttgcagaaaaaaatggagggtgtacttctttaatgacaacatcaatgcaagctatatgacttcgttgccctttaatctttacaacttcgttcaaccatggttggataactcagcacacacaatttcttccaccagtgtgatgcatacaatgcagtattctgcgagctggctagttcaccttccggcagttgcgccgcacctgtccgctgctcccggtcaggacaccaatggcgcccatcctgaccatggctgcggcgaagtcgctactgaaccgcgccgagctggccgcgtagctcctgaccagtgcgtccgtggagccaccgttgaagagctcttgatcggagtgcagcaggccctgctgcgcgaccagatcgccgtagtacgcgttgtcgaacgcgttcggcgtggacgcgtccagcggcgcgttggcgccgccccctccggacgccgggcagccggccctcagcgacgccgcgaaggccgcgttgatgttggcgtcgttgtagatcctggcccgggcgttctggcactgcgcttgccccaccgtgtgggctcctgcatcatgcatacgcaaccgctcacgtgtcagtggtgaccagtacgtggcggtggggcggtggcgctgccgcgctggtgctaactgccaagctgccaccgctgttagagtagaggcacaggggaactggtagttgcatggtcacgtcggtgaccatgccataacatcactgtgatgtgaagcccggcgctgcggtgatgactggtcactgatgaaagcgtggtccgtggttgattgatcggtgagggacgcaccagacagagcgaccatgtcggtgctgctgaggcctttcctggcgaatgcggcgagcagggtgctcaggctggacgccggcgaggggaggtcggtgttcgcggtggagaggctcgccgtggtggagtccctcctgccgagctgcacggtccacgatgggcctccgagcgccacgcccgggtcccccgcggcaactgcgcgatgatgttaactgagcgttcacttctcacggatcggactgccggagtctcgtcctcagtgaccagtggatgctactgctctggctcatgactgggatggccattcgttcgtaccgcgacgacagagtcacgggcggcgacggcgaggatgtcggcgcacgacacggtccgcgggcacagcgcctccagcagggccttgacggtgtcgatgacgccgaaccccctgagcgagcccgcgttggggcccgcgctcttctccccggtgaagttgcccgtgtcgtccagcagaacggacgcgtcgcagccctggcgcacagcgcacatacacgggcagacacacgactcgttacatgactttgcagctgttcacgaagtatcgaccggctgctgtggactgtgacttgcctgcacgaagcagtcgtggaagtggagccggagcagggaggcccccatgcggcggtccagcagcacggcagccctcacggcggcgttgatggtgacgagcgcggcagggcacgacgaggcgtagaacgtcggcggcgacagctgagcccgtgcggcggccaccaccgtcgccagcgccaggaccagtaccgggagcttggagtggcgaaagcgatggctgatgcacgcagcagccatgaacaggtgctaaaatccctgaacactctctctttcagtaaataatccctgaacgctcgcgctagtcgctccggaactgaaacgtatctgcgaggatgagctgaggcggtgctcgggttcttgggtgctctggtcactgcctgctttgcctttataatcgctggccttcgttggacctgtccatgcttttggttcaatataatcaagcaaaccgatcgagaatcccatatgttaaattatttgatcgtaaagctctcctcctcctccacacgtactcatcgcgaccaccgacagtttgagaagttaccgaccatcatttgatgtgaaagacgcgtagaactataatttggttgcatgcatgcatacctgaaaaggtcgatcatagaaacaattttgttagtaaaaacaagcactgagcgctataagtaggaggagaataatgtacgcacatggtttccattggctttaatttgagaaggtttacacttgtgctccaaacaagataggttaaaataggagtgtatgaagtgtttggacgagtaatgatagcacgaacgactttaacagttaaaataggagtgcatgatgggtgggcatgactttgtgctgttacctgtttcctgtgaagagctaaaagtgacgactatatgttcaaaacccgcttcccctcttaactaaaaggcaaaaactcttgccatgtttttttaacgcagggtacctacaacaacgaggcacttcgatgcttgtggtcgatgtaatacacagacgctaatttcgttttatctatatgttctctttgtttggtgacttagcatgttgggtttggaaaaaaaatttggtgcagcccggatgcaaaccagcgtgtttacaacccctcacaaaaagaaggataaacctcacccgcagcagcaacaacaactaaaacgttatttggtggatttgcaggtgagatatgtcctcctttttgtgagaggatgtaaacacctgatttgcattcgggctgtaccaaaatttttcccggtttaacacagctgcctagctagacctgtctggtactaaatgactttcttgtatcgtgattactgccgatacccgtcgcagtattttacatgcaacaccttccttctaaattataacttttctagatacatagattttactatgcaattaaaacatatattatatctagatacataacaaaaactacttaggaaaagccaaaacattttctcaatggcttgacagatgagtaccccatctttcttttttaaccccctgaaacacttctctttaatctggcc

SEQ ID NO: 21575 - DNA, 1682 bp, Zea mays
ggaattgaattttattataataattgtaacttatacagaatacatttgtatattattgttggccatatgaaagagataattatatgctacatttatactcaaagttgagctacagtgatacctaaatgttctaggtatttgcagaaaaaaatggagggtgtacttctttaatgacaacatcaatgcaagctatatgacttcgttgccctttaatctttacaacttcgttcaaccatggttggataactcagcacacacaatttcttccaccagtgtgatgcatacaatgcagtattctgcgagctggctagttcaccttccggcagttgcgccgcacctgtccgctgctcccggtcaggacaccaatggcgcccatcctgaccatggctgcggcgaagtcgctactaaaccgcgccgagctggccgcgtagctcctgaccagtgcgtccgtggagccaccgttgaagagctcttgatcggagtgcagcaggccctgctgcgcgaccagatcgccgtagtacgcgttgtcgaacgcgttcggcgtggacgcgtccagcggcgcgttggcgccgccccctccggacgccgggcagccggccctcagcgacgccgcgaaggccgcgttgatgttggcgtcgttgtagatcctggcctggtagttctggcactgcgcttgccccaccgtgtgggctcctgcatcatgcatacgcaaccgctcacgtgtcagtggtgaccagtacgtggcggtggcgctgccgcgctggtgctaactgccaagctgccaccgctgttagagtagaggcacaggggaactggtagttgcatggtcacgtcggtgaccatgccataacatcactgtgatgtgaagccaggcgctgcggtgatgactggtcactgatgaaagcgtggtccgtggttgattgatcggtgagggacgcaccagacagagcgaccatgtcggtgctgctgaggcctttcctggcgaatgcggcgagcagggtgctcaggctggacgccggcgaggggaggtcggtgttcgcggtggagaggctcgccgtggtggagtccctcctgccgagctgcacggtccacgatgggcctccgagcgcgacgacagagtcacgggcggcgacggcgaggatgtcggcgcacgacacggtccgcgggcacagcgcctccagcagggccttgacggtgtcgatgacgccgaaccccctgagcgagcccgcgttggggcccgcgcccttctccccggtgaagttgcccgtgtcgtccagcagaacggacgcgtcgcagccctgcacgaagcagtcgtggaagtggagccggagcagggaggcgcccatgcggcggtccagcagcacggcagccctcacggcggcgttgatggtgacgagcgcggcagggcacgacgaggcgtagaacgtcggcggcgacagctgagcccgtgcggcggccaccaccgtcgccagcgccaggaccagtaccgggagcttggagtggcgaaagcgatggctgatgcacgcagcagccatgaacaagtgctaaaatccctgaacactctctctttcagtaaataatccctgaacgctcgcgctagtcgctccggaactgaaacgtatctgcgaggatgagctgaggcggtgctcgggttctttcggcccggccggcctcgagggacc

SEQ ID NO: 21576 - DNA, 3873 bp, Zea mays
  misc_feature (711)..(711): n is a, c, g, or t
tttgatgatagatgttttctttcaagtttaagatgactcaattccccattagacttaggtttgcaatgatattttcccacgttggagtttatttaccaaacccaatattctcccatggacaactatatgttgcttgtcatgagcaactgcaagaaacaatataaagatacttgcggcaggagaaatggttggaagcaaaaaaaatcgagtgtgacatatacaaataatattatgtataaagaagtcctcgcttcttatactttgtttttgtgatattcgcattatagtacaatttgatttgtatcagttcatttttatattgattgttgttaaaaaaattgtgagatattgaggtcgataatatatgtgttgttcgtttttatataactattgtgcactaatattttgttgaataatttgtgtgcggcgatcatacggacattgtattagtatgttcatagatgtcattggatggacataggacgtcgtcatgtagaatcttcctcgaatgcaatgctggatttttcagcggctggatccagacgtgtttatcttcataatctttggatcagactcgacgacagcaacaagaaacctactgagcagacagttaagccagcggccggcccatgcgtgtcgaggtgtcattctcgaacacagagcaaccattctagatctcatcggaatgcgcatataaatagatggcccttngattgctataggtcgcaatcacacaatcatacgaacatcgttgtagcagtaggcacgaagatggtaagctcacctgattctgtgccggccagatcgaggccgatggcgacgatacaggatcacttcctgtttgtgaccgatccgatgcaaagccacatcaacccggcgcggcggctggcggtgcgcgtcgcggcggcgatgccgaacgcgcgcgtcaccttctccaccgccgtcagcggccaccgccacatgttcccgcacctgacgtcccccgacggcgaggtcgtccagggcgtcgtctcgtacatcccctactcggacggcttcgacggcgggttcaacccggaggcgcacggcgtcggcgcgtacagggagcgcgcgcgccaagtcgggtccgagacgctcgcgtccatcgtcgcccgcctcgccaggcggggtcaccccgtgacgcgcgtcgtgtacaccgcgctcgtcgggtgggtccccgcggtcgtgcgcgcgggcggcgtccccgcggcgctgtactgggtaaagccggccactgtgttcgccgtgtactaccactgcttccacggccacggcgcgctcctggactcctgcgcgggcgacgccgacgcggaccctaacgccaccgtccgcctgccgggcctcccgccgcttaaggccgacgccctcccgtccttcgcgtccatggcctcgccggggagccgcaactacctgacgctcgacatgctgcgcgacatcttcctggcgcttgatgaacacgggcccactgtgctcgtggacacgttcgacgcgctggaacccgaggcgctgcgcgcggtgccgcggttcaacctcatcgccgtgggcccggtggtggtggatgagccgtgcaggccatgcgtggagttgttccagcccaacgatgccaccgcgtgcatgggctggctggacacgatgccggcgcgctccgtggtgttcgtgtccttcggcagcatcctctcgttgagcaagcggcaggacgaggagctgaggcgcggcctggaggccaccggccgggcatacctcctggtggcacgcaagggcaacaatggtggtagcgatggtagcgggaaggggatggtggtggagtggtgcaaccagacgaaggttctgtcgcacggcgctgtcgggtgcttcgtcacgcactgccggtgggactcgacgctggagagcattacaggcggcgtgccgatggtagccgtgccgaggtgggcggaccagccgaccgtggcagcactagtggaggcatctgcgggcgtgggcgtgcgtgcgcgggtggacggcgacggagtggtggagcgtcgtgagctgcagcggtgcgtcgagaaggtcatgggaagcacggacagcgcttcggcagtgagggcacgcgcagagtgctggggccaacgcgccaaagaggcggccgccgtaggggggacgtcgcagaggaatctccgagcgtttgcgtccgggctgtgacttgtgagccacgcaccgatgcgtcacgcatatggtcaaaataaacacggattttaccatgaccattcacgttaataatgtttgttgacaagaaatgagcccactgctcattgacggtagcaatcgacactggacagcgacttcgtcgtctttgtttcttccgattattaattcaacaattcggagactagaataaaacataactagcaaggtggtccacgtaaataaaataatagctaattattttgacttttctagatagataaaacaaccaaaacctatctaaacaagccaaaaacaacatataactagcaacgaagggagtatgaaaaagaaattagaacaaccttgcttaacttgccttggttgctatttatgctcattatttgatacatggcctaatatgactcaaagtctaaatctattataattttaagattctatctctatccttaaccatgtatatttatatctctaaagatgtggtcgacaaatcgtctatatgatcatggaaaacattgttttacactacatagactgcactgcatatagattgaaatttgaaatgggataggaactgcactgcatatagattgaaatttgaaataggataggatgaataagactgcgcccttggcagtgggaagaaagcagacgaccatatgatctaatttgaagtcctatgctgattttaagtcctgtgcttctgccatcttctccacttcattcaatgagcatttcaatatagttttcaggttcgaattttaaaatcaaattcaaatttaaaagataaaaaaaggaatcatcagttaaatttatgctccacaagtaagaaaaaaactgctatgttcaccgggttcggccccgcccttaaggactattcgtatattccttatattgtttaggtgggtattttcttctagtagcataagacaaatccacgagatcaacatttaagtgaaacacatgaatcctccctctagaacataaattagagctgttaccaatagctcagcctcacacttggtatcactcataataatccatgtaaaagttcctaatttcaaacagactgcattaacgttatcctggtcaatctcacaagagatctgtccaattgaagttacaaatcagaaaaggttgaagaatcaagcttactccttgtgctctctgcctttctttctcttccatttgagatatatttggatagagaggcctaagaagaccatcacaacactaccccattgcttcaaagataatggattgccactgatgacggatgaaaccacaatgctcatgaatttacgggtggtagtgattgttgtgttagtaagagagccaaaccggctgatggttaagaagatgaagttctgccccacggcgccacataggcagaataggaaaatgtcccaggccacctctgggttctcctggcaaaatctcaatgcctcaaaaccatttgcatatggccagttactgaatagtaatggcgcaacaaacataattacagcattatatatggtcccccagaggttcatgccaagcattatatcccatgggtttgtttttgggtaccttgactttattaaatcttgggtcgagttaggatctccatctttcctcgtgccttggtataagatagggagaatctaattaccttgactttattaaatcttg

SEQ ID NO: 21577 - DNA, 1746 bp, Zea mays
  misc_feature (264)..(264): n is a, c, g, or t
  misc_feature (268)..(270): n is a, c, g, or t
ccaaattgaaaaaggggggcctgggccctgggggggggggggggggaggtattttggggaccaaacgggggggtttgccaaaggggggggggccattcccccgcttttttttgggtgcagccaaggggccccccaaatttccgggggggggggttcccaccggaaaccgggaaaaggttgttgaatttttgggacctggggggaaatagggttgaattccccgttttaccggggccgggggaaaaggggggggggaaaaaaggncccnnntttttttttttttttttttttttttttttttttttttttttttttttttttttttttttttttttttttttttggcttttgtcttttcttttttttttttttttaggtgaaacacatgaatcctccctctagaacataaattagagctgttaccaatagctcagcctcacacttggtatcactcataataatccatgtaaaagttcctaatttcaaacagactgcattaacgttatcctggtcaacctcacaagagatctgtccaattgaagttacaaatcagaaaaggttgaagaatcaagcttactccttgtgctctctgcctttctttctcttccatttgagatatatttggatagagaggcctaagaagaccatcacaacactaccccattgcttcaaagataatggattgccactgatgacggatgaaaccacaatgctcatgaatttacgggtggtagtgattgttgtgttagtaagagagccaaaccggctgatggttaagaagatgaagttctgccccacggcgccacataggcagaataggaaaatgtcccaggccacctctgggttctcctggcaaaatctcaatgcctcaaaaccatttgcatatggccagttactgaatagtaatggcgcaacaaacataattacagcattatatatggtcccccagaggttcatgccaagcattatatcccatgggtttgtttttgggtaccttgactttattaaatcttgggtcgagttagtatatccatcaaaagctaagttgaggaagcacaatgtgtaaccaagaggtgcattagggttggcaagcttcttaattgtcttggagcttgtcttcaacaacgcaaaggaggacacaccgccggcaacaagaaaggtgcataaatactctggaagtgtgtacttcacaccatagagaagagttcccatcaacattacaggaatcatcttagaagattttgccaacacctgagccgggtagctgatgtacttgagagcctcgatccccatggtcggcccgatggtattggtgacgctgacgccccagtacttccatatcggtgcgctgccattggagctactcccgcccgaccacagcttaatcattatgaaggaccagacgaagcagatgacgttctgcgcgaagttgaggaacgcgaggtgctcgaaccgccgcgcatccggcccgaaccgcttcgtcgatagagtctcctggaggacgccctggtagatgtaggcggaccagatccctgcgacacagaaggcgaggacggccacgcgccccgccatgctcccgccgcggtcgcgggggcggggacggacgacgccgttggcgccgtcgccacggccccggcgcgcagcggccatggtgtcgattcgccggccgttgtcggcgagggatcagcagaatcggcacaagtgggggttcgatgcgcggtggaccggtggtccccggccggcccc

SEQ ID NO: 21578 - DNA, 1427 bp, Zea mays
aggtgaaacacatgaatcctccctctagaacataaattagagctgttaccaatagctcagcctcacacttggtatcactcataataatccatgtaaaagttcctaatttcaaacagactgcattaacgttatcctggtcaatctcacaagagatctgtccaattgaagttacaaatcagaaaaggttgaagaatcaagcttactccttgtgctctctgcctttctttctcttccatttgagatatatttggatagagaggcctaagaagaccatcacaacactaccccattgcttcaaagataatggattgccactgatgacggatgaaaccacaatgctcatgaatttacgggtggtagtgattgttgtgttagtaagagagccaaaccggctgatggttaagaagatgaagttctgccccacggcgccacataggcagaataggaaaatgtcccaggccacctctgggttctcctggcaaaatctcaatgcctcaaaaccatttgcatatggccagttactgaatagtaatggcgcaacaaacataattacagcattatatatggtcccccagaggttcatgccaagcattatatcccatgggtttgtttttgggtaccttgactttattaaatcttgggtcgagttagtatatccatcaaaagctaagttgaggaagcacaatgtgtaaccaagaggtgcattagggttggcaagcttcttaattgtcttggagcttgtcttcaacaacgcaaaggaggacacaccgccggcaacaagaaaggtgcataaatactctggaagtgtgtacttcacaccatagagaagagttcccatcaacattacaggaatcatcttagaagattttgccaacacctgagccgggtagctgatgtacttgagagcctcgatccccatggtcggcccgatggtattggtgacgctgacgccccagtacttccatatcggtgcgctgccattggagctactcccgcccgaccacagcttaatcattatgaaggaccagacgaagcagatgacgttctgcgcgaagttgaggaacgcgaggtgctcgaaccgccgcgcatccggcccgaaccgcttcgtcgatagagtctcctggaggacgccctggtagatgtaggcggaccagatccctgcgacacagaaggcgaggacggccacgcgccccgccatgctcccgccgccgacgccgcggtcgcgggggcggggacggacgacgccgttggcgctgtcgccacggccccggcgcgcagcggccatggtgtcgattcgccggccgttgtcggcgagggatcagcagaatcggcacaagtgggggttcgatgcgcggtggaccggtggtcgccgagtggaagcgggggcgcgtgttatgtaggagcccaacgtaacaggggggaagttt

SEQ ID NO: 21579 - DNA, 2257 bp, Zea mays
  misc_feature (725)..(725): n is a, c, g, or t
  misc_feature (991)..(991): n is a, c, g, or t
  misc_feature (1009)..(1009): n is a, c, g, or t
  misc_feature (1024)..(1024): n is a, c, g, or t
tactttttttctaatttcaaaatatatttataaataaccctaaaattcataataattatactaaaactatttataactaaaatatttatttttggactaataattattatattattaaattggattttcattaagaaggaaatgctattaaaaatccaaaatcaaacatgagcaaacaaaaattattctaaatgtaaataaataaccaacacttgaatgaaaaatttattaccataattatcataataactaaatgcattatttttagttgatgttttaatagtgttacaaactccctctttacctcttcttatcttctaaacaaacagcccagctaggacttatcctttgtggcgcctggcatactgccggcccacaaaggtgtctacaacacggaggcaatataatatcttacgatccgtagtaagcacattgagccaacatgaatctcaataaaaatatccccatccttattcttgctaatgcaaaattataatattgttgagcagggtatgtctcaacttaaaaaaaggaattatctttcgctgcactttatagctttatttactcatcaaaataaattaaattggactgtccaagaacaaaagaacaagtgaccctgggactcaatgtacactgccaatacttttatgtagggatacacatatactatgcagtgtgtttaagtaaatgtaaacttaccggggatcatcttagaagatttngccaacacctgttcacaccaacagaaattagtcaggattgcgtaaagaaacctcgcgccacacattttcgagcttgtcaagagaaaaaacaaattcgttgagcaagaacgatgcttggatcaatgctctctgcaataagatagctaccacgatccaactctaagaattagttgctttatggattcgtttacaagatgtaaggttacattctgaaatacaagacaatcacctagagatggattgccgatggtcgataccgcacacgntcgccagtcgccatatcncatacaatccaatcnatgcaatgttcttcctaaatgttcacttgaggaagcacttccaaagagctccctatatagtcaattaactctatcggaacatctcaatccataagcgtcagtgacaatattacccatgtgcccgcgacaggaacctaacattaacatgacacaatgtccgggacagtgcatataacaaccaaggtgagacggcaatagcaggcggaaccaaacctgagccggatagctaatgtacttgagcgcctcgatccccatggtcggcccgatggtattggttacgctgacgccccagtatttcgataacggcgcacggccgtcggagctactcccgcccgaccacaacttaatcactggaaaagcagcagaaatgtcaggaaccctctatgcagtcgccacccacgcagaggagacggaaccgatcaccacgagtccacgacgttgcgcgaaatgcgcaatcagacagccatgcggcgcgagagggagggagtgagctctcacttaggaaggaccagacgaagcatacgacattctgcgcgaagttgaggaacgcgaggtgctcgaaccgccgcgcctccggcccgaaccgcttcgtggatctgaggacgacaaacccagcaaactgacccccagcttgtaatcgtctggcggagttcggacggcattggagagagaaagggcttacagagtctcctcgaggacgccctggtagatgtaggcggaccagatcccggcgacacagaaggcgaggacggccacgcgccccgccatgcttccgctgacgccgacgacacggtcgcgggggcggggacggacgacgccgttggcaccgtcggcgcggccccggcgtgcggcggccatggtgtcgattcgcccgccggcgatggcgaggggtcagcagaatcggcactggtggcgattcgatgcgcggtgtaccggcggcggtgcccggtggtcgccgagtggaagcgggatcgcgtgttatagaagccctgcgtaaccgtggggaaggagcgaagagcacgtaagagaggtgacgtggcgcagagccgttggagcgttggagcgagcatgccagcacagacggcccattgattagcctataatttctttctatatcagcgacgaataatgcagcaccaaagattttagtctgatgattaatttaacggacgtgactctcttggctttgatcgaactatcgatttcaacaacgctaatcgtcatattggtctt

SEQ ID NO: 21580 - DNA, 4242 bp, Zea mays
  misc_feature (1016)..(1016): n is a, c, g, or t
tgagggtgtagcatacacaaatgctaatatagttctcgtatgagaaattagaacaaagtctatttgcacatttcccacaacaacactcgtttttggaccagtagatgtataatattgtgtaacattgagactcattaagaaccggataaatgccccacacatacaaaacatgcaacattcagtgacaaaaggttcatgaatagtccttgtttttcattagtagacaaatttcgcaacaacgatgcctggggccaatgcatacccagtccaggttgagtctgctcagagttgctagtagttagataatcccaggtcagcgaaggccaattggctagtgctgctaatcaagggtgcaaccagcacaagatggccttcttctctcctaaatggttggcatgtgtgcgactttttaagaagaaaaaaaatgttgaaaatccgacacagcgcaacaaatttattctgtgacaatgcaagagcccgacttcttcaagctcctgctacgcatggagccgtgaactcaaaagaaggtccttccatgcctcgtaaaacatccaggtgacaccggacgttggcatgaccttcagggagctcgccgcccatcctcggaaaagccccttggcaccctcctcttggatcacctcggctaacgccgcgatcatgtggggtgggcacttcccttgcagggatcctaccataaggcgcttccttgccacttcctgagggaagctgatcgtgcttgcagttagacctagaaggttcaaattcccccgtcggggacacgcgcccgccgacgtggaaatataacacactctcctagtctgtttcaaggaggttggtgaattgcatattggctaaccaattgaaacgaagtaacactttacgtgcaactgaatctaacctgaaagagccccgataaccagcagctcaggacggctcaaagatttctttttgtgcgcacggcagtagttagtcttgatggtctcgtacatgaaatagtagcatgtgctatatggaangcatgcccccccccgttgcccagaggccagcataaagaccaccaatgccatcagttcggtagatcttgctgaaggcaatggcaatactaggataagcctcacggttgacagtcatgcgatcctgcgacacgaagaacagcaaaaagtaatcgattaactaaataagaggcctcacaaatttctgtgaagtttgctggtttgccatttatttggaataggcaatagaagtcagaaatataaaccagaccccaaaaagaaagtaaggaaaatgaacctaacattccatgaatagtgcccacagatattcaagatgcggatttagctctgaagtaccttaagaacctcaagaggatgacacaccaaagtgctagctattccagctgccgcacctccaatcgcaatcggcgatagtaagtgaaatggcaactgaattttcaaatcgccgagttgtatctttgggcatccttcctctttccatttctcttgtgccgaggccatactccttttgacacattcaaatgtcccgagctcaattgcttgagttgggataatccggagcatatttattgtattacctgcccagagtccttgccagccattatgttcaacaatctccacaaagctaccaaaaatatgttttgatcctacccctacaaccattcttgtcctgaaattgatcaaagcatatcagattacttgtagatactcttttataagtagaaagagcacttttgatatttatctgaatcaatggcaacatacagcaaaataattgtatattatttagctaagtgtgcttggtgtagtaaattactgcagttagaatagcaagtgggtatcacttcattgaaagatatatattagtaccatcataatataatcggcagagttaaaagaagatcagaaccctcctctgtagtttctttagttcctcctgttgtttttgttccttcctctggagtgtctctctttctttctttgcctcctgatactcggtgctatgaggtctgggacctcattgtttttgttgttggttcaaactcgatttctctcttttcttttgtcaataaatttcagtaggggctttgccagatcattaaaaattgtaaacaaactcatttcctagtgtgggcgacgaactttatcatgcagacccagtgccagaggttcccacatgagtgtcgtgtgggggaaaggataaaccaagacaaccctccccttgcaaatacggagaagctacttcaaatccgtgacctagtaacttagtgagacagctctcacaactgcaccgggcttgcccttctaggaactttctcatgcatccaaactaatatattttgaaatagcaagacaccaaacttaggattatgaatagacaaatctggagagcaaaatatgacaactacctgatagtttctaagggagcaagaacagccttagtcattgcaccagccaatgctccactcacgaattctgcaacttctctattcctcagaaaagtctgcattagatacaagtcttagatcaatgtctcataactccttcagcaattagcaatatttgaaaactcataaggaactctattttcaagaagttccaactctgaaataatcctaagcatctgcaagtgtttatcggggtagaaaatgcaatagagaagatggaaaaaataaactcacatacaatatacagctatcatcattattattccttttgatttacaatgaaagcaacaaagctaatgaacatcacttgtcgttttattagtaagacataggcacttgtgcattcccaggtaacttggtgaatgctgaccaaagctattatgaacctattacttcatgcattttgtcaaaacctaatccaaattgcactattttctttctttaggaaacatcctcagtccgtaactctgaccaagtgaacaaaactgtgaatgactaatgattacacatttacactgcagctcattgggttgcggttgcctagctggtggcatgaaagttcctaggcaacatcacaaaaagctgggaaggttggattgtagttgcttatcaatattagtccaacttggaagttggaagtggacagggaaaggaaaaacaaggtgacttaactaaaagacaggtatacatggtagatgcataaaaagtttaaaacaaggaaaaatactgagttctgacttctgaaggacaaaatatattgtcttttttggaaggaacatatcacacaaacgtggtggaaataaaattgtggaagcaatcagcacccaaaacagctacttgcttcaatgaaattgaaaaatagctaatgatacaaaacggcagcatctgtcggaagcttcctacgcctacagtgcatctatagctttcaaccggtcagcagtcagcaccaggtctatttctgaagaaatatctacctaagataagtacaaaaaaacatccagcaggcatgggacacgaggcagatggcaatgggacccatgcacacaccaacataatcttaccagtagaattccttgacctcatctgatctatatggacaaaaagaaaacaccgatctgaattaactatacatttcatctcaacgagttacaaagcaacagtttgggatgcccgcctagaccgcaagccagtaccgaacttgccaacaaccaccaactgttaaacagccagctaatcaactactattgaaatagataatgaggtgactttgatatatctgtatacgaagatccctggataaggattcgaagtaagctaccaacatgttggttgcaatattttaatagatctaataagtgtggtagtctgaaacctctgcagcaaacagttactagatcggagcaacaacaacaaccttcaagcacgaggggccgtttgccgattgaatcatccacagatatgcatcaggtcacaacaatgaatgaatgaatgaataataataacaataaaagtattgcctttacagcaaggctgatttcaaaaaatcccaatcgcccacaaatcctatcctcatgcgagcaattcagcaaacaggcacccacgctctgaacggcaaagcaaaggtcccgcgtctgtgccccgtctgcggtgtgcccaaaccaatccaatccacacccacatggtcagttaaaactgactaagccaccgtcacactcataacacgccccatccatccagattccagatcataataccaagcacgaagccgagatctgcagacc

SEQ ID NO: 21581 - DNA, 1346 bp, Zea mays
gtgtggtttttgtttgttgtcttttttttttttgtgttttttttgtttttgtgttttttttttttttgttttggttttttgcttctttctgtgacaaaaggttcatgaatagtccttgtttttcattagtagacaaatttcgcaacaacgatgcctggggccaatgcatacccagtccaggttgagtctgctcagagttgctagtagttagataatcccaggtcagcgaaggccaattggctagtgctgctaatcaagggtgcaaccagcacaagatggccttcttctctcctaaatggttggcatgtgtgcgactttttaagaagaaaaaaatgttgaaaatccgacacagcgcaacaaatttattctgtgacaatgcaagagcccgacttcttcaagctcctgctacgcatggagccgtgaactcaaaagaaggtccttccatgcctcgtaaaacatccaggtgacaccggacgttggcatgaccttcagggagctcgccgcccatcctcggaaaagccccttggcaccctcctcttggatcacctcggctaacgccgcgatcatgtggggtgggcacttcccttgcagggatcctaccataaggcgcttccttgccacttcaagagggaagctgatcgtgcttgcagttagacctgaaagagccccgataaccagcagctcaggacggctcaaagatttctttttgtgcgcacggcagtagttagtcttgatggtctcgtacatgaaatagtagcatgtgctatatggaagcatgccaaccaacgttgggcagaggccagcataaaggccaccaatgccatcagttcggtagatcttgctgaaggcaatggcaatactaggataagcctcacggttgacagtcatgcgatccttaagaacctcaagaggatgacacaccaaagtgctagctattccagctgccgcacctccaatcgcaatcggcgatagtaagtgaaatggcaactcaattttcaaatcgccgagttgtatctttgggcatccttcctctttccatttctcttgtgccgaggccatactccttttgacacattcaaatgtcccgagctcaattgcttgagttgggataatccggagcatatttattgtattacctgcccagagtccttgccagccattatgttcaacaatctccacaaagctaccaaaaatatgttttgatcctacccctacaaccattcttgtcctgatagtttctaagggagcaagaacagccttagtcattgcaccagccaatgctccactcacgaattctgcaacttctctattcctcagaaaagtcctagcggcggcgcctacgtcgg

SEQ ID NO: 21582 - DNA, 957 bp, Zea mays
ggccgccccttataagaactgtacgcatctattgcagtcgcagggtaaattcgtgctcaaatacatattgctcaaggtacaatgttctctcgtttcttgaaaaaaaaaagggaaacagaaggacagatgaacagcacgtttgaaagcctgaaatgtgcaattggttgggcacacgcatgttctgaaatccatcttctagctctagcctctcatcaggtgcagcagtctcgtggatccacggtgatatcaaacaatgaacagcaggctgggtagtaatatgtacgtacgctccgggtacagcattcaatctttatgaagagactaaattaccatcactagcccacacatagcatgcttatataaattctgaccctagggtgtgggcacatgcacacttgctaacatgagatggcactagtgccgagctatgtatcgtgttggtgaaagccgcactcggttcagttgaggtggttcctgtcctcaagggtgtacttcacgtcaggcagcgcctgcacaacgtcaggatgcttctgcaacgcggcgacctgcgccggcgtgagcttggcggcgaacccgctagcggcggccttgtagctgtagatcagcgcccgcttggctttctcctcgctgccgagcgcggtggcgaggatgcgcatgtggtacgcctcggagtcgacgccctgggcaggagccttcaccatcaccacgtacacgctcgcggtcgtggccgcttgctggccgcggccatcctcgctctccctgccggcggcattggccagggacaccgcggcggaggagagtagtagtagtggcaggaacgtggtcagggcggcgcaaaggcgcgtcgtcgtcatggcacgccgatgaagggggggatggcgcgaagaggggggtggtgggggtggcgcgtatgccgttcccggccggttcctcgggacccaatcgccctataggagt

SEQ ID NO: 21583 - DNA, 2257 bp, Zea mays
aaatccattacatcaattaagtaacgtaccaatgaatcaataaaaaaagttccctctattaacacaagtaattataaaacattctatcacgtggctacgtttgttcactacaatcaaacatcaactaagctctatatatatttcatataattttttacttccgtcgcaacgcaggggcactcacctagtacaactaaaagaaagaaaagtagcccattcatctgtaagcagataagcccaacacagcctactcaacatgcaaagatatttctcattttctttcacaagtatgagatccataagccataatcccgggtatactccatcccgggcccgcggcagcaacacgaccaaatttaggccattgactggatgcaacgaaagcgtgtggactgtgaccgatatttggctttgatgactctcgcttgctgcttgcatgaccaagtggctcccaagcgtccagatcggggcgacggcgacccaatctgctgcctaatcttggccgggccgggctacgcaggttaggcagggtttatgtgggcacaatccaaacgcgatgcacaactggaaagaaacacaatgtacagaagttagctgatacaccatgcgcgcctgcatgcactttggcagctaatatcacagttctagagcagacttggttcagctttcatcgagttgcatttgagtttcagaattttcaaattaactcccccaaattgagcacagcagccacattaaagttctttttttcttccttctatgtgccacaacttaaaaaaataaatcaatgaaccatgacaaggtcagctaatatacttcagcatctatgaccagcaactgaacctgtaacccagcgtacagacttcaaaatattgagctaatatggatagataacaaaaacagctccgcatcaaagattagggaatcagaaacacaacaaatgaagttcaagcattgttgtgttgagtctttcttacatgatcccagcctcccaggaatagctctacagaacacttgagttcactaatatcatcgccgagctgctgaacagacaatatagcactcactcagttacacatgccaggagcatcacattctccactgcagcaaactttagttgcttgggaagctgcatattttgcttaccattagtcagtccacatgacagccaatgtagataagagcgtaaccaggccgctcatcaatcttcttccttttggacccaaactttcacggtcttgtcattgtcaagcgccccggatgcgatcatgttttccttgggatgacatgagaccgcaatgacagtatcagtatggccttccagtttctgcactattcttcttgactggaggtcccataggtagacacatttgtcctcggagccactgacaatatacttgctattcgtgatagaaaacgccgctgggatgcagtactttgtgttaacatgtccggtatatgtcttcagaaactttccagctgagaaattccaaagcctcaaggtgctgtcaagcgttgccgcgaggataaacttgccattgggggagaacttggcaaaggacactggtgggctctcgtcgtcgatgagggttttgacgcagtgaccggtggccgagtcccagacgcggcagagcccgtcgtagctccctgacacaatcatgtcgccctcgcgatcgaagtccacggcggtgacgggttcagaatgggccggcagcacgcggaggcacttaccggacctgacctcccacacgcgcaccgtctcgtcaaaggacccggaggcgaggacgttgccatgggggctgaaggagacgcagaaggcgtagttggtgtggcccgtgagcgtcttgacgaggcgggcccctccgccgacggcgaggtcccagatgcggacggtgcgatcatcggaggcggaggcaaggaggcggccgtcgggggagaaagagaggtctgagacaccctctccatggccctcgagctccgcaacgggggtgagatcggaggaagaccacacgcgaagaagcttgtcggcggaggcggaggcgagaaggcggccatccggggagaacttaactgttgatacggcgcggcggtgcccctcaagtgtggagcggaggacgtagcctggggatgccgaggcatcgtcggccaccggcgccgccattgccgccgattgaaagggtttgggggttttggaggagtttctccgcgagacggtggtgtggtgtggctcggtggaccgatgccgatgggcccaatg

SEQ ID NO: 21584 - DNA, 1564 bp, Zea mays
gacgcgacgtacgaataccactagattatgattaaacgcgaaaaactatatttccaagatgttttagataaattgaattatcaattagtcacgtctaaacaagaattagttaataagcatgaacgattatagcgaaacaattaactaatgtgtgtggacagcgtgcgatacacgcgaacgacacacggcattgcgcgcgacacgcgaatgacgcgtgacgtcgcgcgccactatgaaacaacgagtggacgacacgcaaagcaacgcgcgcgaacgacgcgcacaagctacatgcgtgacacacgagactcaccagctacactaagcaagtattaaatttaagtattttagtcggcattcatcattttagcatgtacttataagagggcaaataaaactataaaatagttgttactaagttgctactgtagtaaccaacagacaaacaaataattaattaattaaaacattttgaaatgacaaagcaatattttttaacgtgtaaacaacgttaatatgaatctaacgcaacttgtaaggagcaaaacagatttaaaacacgaaatatgtggatgtttaacaaactggacgaagtagttaatccttattggctaggaagtaggaactggtcacacctagggtcataggaaacacatcatcaaatactgggaggcgattccaggaaccaaattgtttgtgcgctgtgtggtgaggaggtcatgcaaatggggcaacgaacgacatgataggtggggtctgcatgcaattctctttctcctttctatctctacacatctcacgcacgagtggagtagttacctttcttcctcacgcacatgcgggcatgagaccatccatggcgctgggtgctcaccggagccccctggctggccaccgcacagccggaggggaggctgactggtctggccgcagccgtgctgcagggggcacgctagctgccggctggccttgcaggcagcacgacggtgatggattcagaggggcaagcagcacgcggaggcacatacgcgcaccgtctcgccgaaggacccggaggcgaggcgaggacgttgccatgggggctgaaggagacgcagaagacgtagttggtgtggcccgtgagcgtcttggggaggcgggctcctccgccgacggcgagatcccagatgcggatggtgcggtcatcagatgtgggggcaagccggcaaggaggcggccctcgggggagaaagagaggtccgagacactctctccatggcccttgagctccgcaacgggggtgagatcggaggaagaccacacgcgaagaagcttgtcggcggaggcgagcgtgcctgcgacagcgcgcacgaccaggcaaggaagggagagacggtttcattttcagtcgtgggatgaacgaggaaaaggggtctgggcgccgcgcatagggaagtggcactggttgagtggagatttagagacgacgaaatgcgcgatggctgacattttacgtggaggcggctcgagcttgacaggcgggtccgagcgacgtgggagacggttgtcgattttgccgcggtcc

SEQ ID NO: 21585 - DNA, 4131 bp, Zea mays
acacgagtatacgctacggcaatggcaaagatttgaaatttttccggacgtcacctcgtcgctctcggctgatggaatggagcaaacagcagccaagcccccttgacctactggccgggtcatttgccctactacgtcatcaccgactgactttaaactagcccactagctaggccggccctgccttgctcttgctgaaagtcgcggcatgtgattccatagtttgcgagtccaatcaggcgtgccccccaattatttaagagatgagacagggggggaggggactgactgatggacagcgagcgctagctacctagccttgtgtctggaggtgttaactttagggcttgttcggttgcaagggattaattcccaagcggatctaatccagagagggattgagtgtatcccttcctttcactcaatccccttgggggtttgatccccttgggggtttaatccatgtctgaaaaaggccattcggttaatccacgctttttgatatatgtacagagctgcatccggcgtccattagcctacctgaagggtcttcagaaaaggcagaactcaaaacagcaaagatccctgacgacgattcagctgctatgactgatgaagttggctcatgtgctggtaactaaagagtttgcctcagggccgttcgtcagtcgtcacggcttcgactttagccttggtatttcaggcaggcaggaagcaagctccatttgaattgattgaaggcgaacgtttgccagctactgctccgtgcttgagagttgagacaaggcgggcagccggtcgtcgtcgtacaacacaaaaccggcgcgcaatacaaaatccgctcgccaaagcaacgtccgtcagcggcacagagggagatcggccacttcctcgctcattaggacgccggagggaagcagagcatccgccgcgatctctcagtggacgaggcccgccggcgtgccatcctcgccgcatttccagccgagggagcagaccgtccgcgtcctcgcttcctcttgggtgtagccgagggtctcgacgagttgcctaccacttgggcgtactccagtggccggccacatcgatgtaaagatctactggtagcaatccgacggcgatgaatggaaagatgcacgcgatggaaaggagaggaggatgtgagtactaccggcgagaagcggacaccgacgggatggcgccggtcagccagtggcgttcccctcgtggacgccggtgagccggtgtagatgtcgccgccagatctcgtgcagacggagctcgtgccgccgcctcctctgtgccctagccgccgccgcctctgtgctgtagaagcggtcttcacgtggcttctttccacgccgtcgagacgaggttttttcccaggccgggatgaggtgggaactgccgggatgggccgggattgaggcccgggcggggttaaacgaacacgattattgtgtgggccgggatttcaaccaagtgggtttgatccatatggtttctttcccaatccagaccattcccggcccaaacgaataaggccttaggttgcgggggcgagatgcatcgtctcgtctgcctgcagtgaaagtgatctcacgaggacgaggacggcacccccgcagacagcgacggcgagtacagaccgccagtgtgcccggcatgtttcacggcagattacaggcagcgcacgctacaaacacatgcgcatgccagccttcgatggacagcatcacggcacggatgcaatggatttagcgcgggtcgttgtcgtgcttgtgctgcccgatcattttcaaattactgtccacctgctgctggatgatgtctcgtctaaccactgttggcgcgtgcgtagacgcagagcaagtggacatgtaaaccactgcttggatttataaggcctttttcttttttttttcaaccaaaacagagcagcagtggcttatcttattgaacagtttttttctctctctctctctgcggcggcttttcttataagaaaaaaaatatttggtaaaactgtgtgtttagaagaagaaaaaaaatgatatcttcagaatcagaactagacaacgcctcaaggactgactaaacccttggcaatctccgccaggagaacgatctccatccagcatccaacgcggtgctttgaagagaaggcagtggacactggtgagtttgtgacttgttgttggtgcacgtgaagagaactttttttttcacccttcgttggacatcgtccccgatccacttctgcggccatatctccggttattaacagaatggccatcgcacgatttgccaggacgttctgtgctgtgccacattgcgttcgcgcatgaaccgcgcatcaaccgtaaccggcgcatcgcgtccgcaggaagcctcgtctcctgccatggcctcgtgtgacgtagcgtaaccagtcggcgacgaacatgttcagtccatcaggagacgaggacgtggagcgagccgttcttggcggccgcgcagacggggcaggcgtccacgccggcctcgcacgcggggcacaggcacaggtgccggcacgggagcagcagcacggacgcctcgccgccgccgcacgacctgcacgccagcttggacctggacgcgcacgccgcgccgccgtcctcgaagcaacacgactcggcgtcctcggcctcaccgccttcctcgcggccgccgccggcgccacagggtgactgcaggagctggtccagcgtggcgcggaggccagcggcggcggcctcgtgcctcctggcgacggccatccacgcctggcactcggcgcccgcctgccgggccttctcctccagctccgcgccgcgccggagcgcgcgctcgaggtccgtctccgacgcgcgcagccgccccgacgcggcgcgccccacggcggccagcagcgcgcgggcgtgccgccgccgcgcctcctccagcgccgcgcgcatcctctctgcctgtgcaccacaagataatgtctcacagatcagacaccgtcggaccatgcgttgttgtccccatatgacgaagaaggaagaagtcggtcgattcccagttattaaccatcaattgacagatgatagatgaagatcacgaccgaacaatggccgcccgtacctcaagtctaacgagcgcgtcgatctccacgccgtggcggtgcgtccacgacgacagcagtccccgcgaggccgccacggtcgcgccacttgccaccctcccactggtggacgccgtgccggaggccgccaccgcccggcggctccgcgcgttgacgaacggtgccacagccacaggcagtggcagcaggcgctccgtgcccgccggaggcaaacccgcgcgctggtcttctgagagaccaccgcccgctgctggcgccgccgtctccaggcgcggccgcttcctcggcaggaagccgtcgtagttgcaccaggcaacctcgacgcgcgggaagtcgctgagcgccgtcgtggcgtccccgatccgggccggggccggggccgcggctggcgcgcacccggcgtactcgtccaggaacaggtagccgcccgccgcctgggctgctaggtcgtgcgacaggtgccgcccctgcacggccatggcaaggcgcaaggcgcaactcaaggacgaccgcgaaggcgttgggcgggcgtgggaaccgaccgccagtgggaggagtgagaatggatggtttgcaaccgatgtggttatatatatactgtcacggttagggaaggcatgccatgactccggctcgggtggggcggaagagcgaagactgtgagccggtgccaacaaaaacacgtagtagggggggcacggcgcgcggatgcgatcgaggccgggacaaaatcggatcgctttccacccgccctggccgggccgggtggggcggacgccgttcgcggttcgcctagcaatagcaagctgctagctaatccccattccagacgggcggacattcactcggtttatttcagcgaaccaacggagtgatcagattttttttaccccgtggtctgctgctgctgctgccaatatgatgggtaggtagtacatactcgatggactgtagtatgtgttattcattttgctttcgctttcacgtgcgtgtatgtgatc

SEQ ID NO: 21586 - DNA, 2307 bp, Zea mays
  misc_feature (19)..(19): n is a, c, g, or t
  misc_feature (36)..(36): n is a, c, g, or t
cgacccagcgtccgcaggnaagcatgagccgcctcngtgcctaaactatttaacatcacctcatgttcttatctggagtgcagtggctgccccccgcgccggcccgggactttttgaggcccaagaattgatggcaaaagatagatttggtcaaaccattcctttccatgctccattcttattaggcatggaggaacgaactgttgctccaacccgccgctggagagatgggagcttagaaagcgatttacccatgaagcaattgaaggaactattcaatgtgaatcatttcatagtaagtcaagccaatcctcacatagctccactattgagactaaaggaaatcatcagggcttatggaggcagctttgctgccaagcttgctgaacttgccgagatggaagttaaacataggtgtaatcaagttctggaacttggatttcctttaggaggattagctaaactatttgctcaagattgggaaggtgatgttacagttgttatgccagccactcttgcgcagtattccaagatgatacaaaacccgtcttatgctgagcttcagaaggctgcgaatcaaggtaggagatgcacttgggaaaagttatcagccatcagggcaaattgtgctattgagcttgcactggatgaatgtgttgccctcctgaaccacttgcgtaggctaaagaggagtgcagaaagagcatccgcatcgcaaggatatggtccagtaatcaggttctgcccatctaggaggattccatcctggaatctcatagcgagagaaaattcaactggttctcttgatgaagaaatgctcgcatctcctcatacaaatcatcaaggacctggaggagttgctggaacatctaccagaaatcagtatcttcagagaaatgcacacgagagcagtgacagtgaatctgagagtattgatttacactcttggacaagaaatggtggccctcttatgaggacagcctcagccaataaattcatcagctttgttcagaatcttgagatcgacacagaattcagaacaattccatcgagggaaaacctaactgatcttgtgacaccaaatgctggtaccttggcagctcatgcagtgagtagagaagcaaccgataggagcttggacatttcagctttagatatccatgataccgctacccctagatcgacatttggccgttcaacaagcatcgttgtttctgaaggtgacttgttgcagcctgaaaagattgaaaatggtattttgtttaatgttgtaaggagggatactctgctggggtctagtagcggagttgagtctcaaggatctcctcgggaaccagatgttgaaacagtgcagacagagtgccttgatggcatttcagcttccgatgacgacgacaaggaactaaatgtcattgttgatgaagcaaccgatcccatgagcagcaataatctacaagatcaggggtcctcactggaagaaaattccgcgggtcatttccccttaaattctgcagacgagacaagcacaaacaaaccagaaactgcatctatttttgatatatgtacagagatgcatccggcgtccattagcctacctgaaggatcttcagaaaaggcagaactctgaaacagcaaagatcgctgacgacgattcagctgctatgactgatgaagttgcctcatgtgctggtaactaaagagttgtcctcctccctctagctttgaggcatcagatgtaagtgatgtactataatctagcatcatgaattggatggtgaagctttatgttgttcaagtttcagaagaaggagatccaatggctttggttcttcgaatgtactgtagttgttttggggaaataaagcgcttcttagaaaaaaaaaaaaaaaaaaaagcccgtgggggcgcccgagcttctttttttttttttggccgagaaattgcccaaagccgtagtctctcgtcagtcgtcacggcttcggccttagccttggcatttcaggcaggcaggaagcaagctccatttgaattgattgaaggcgaacgtttgccagccactgctccgtgcttgagagttgagacgaggcgggcagccggtcgtcgtcgtacaacacaaaaccggcgcgcaggacttatgtgtggtgtgcgcgtgagcatcgccgccgtgtaatggcacctggccaccggcgtcgatcaacgctttcaagcaacttttttttacaagctcctaaatctatttttttatagactatcttttttcattgtaaaggtattttggttattatatatagtcatatgtcatttatc

SEQ ID NO: 21587 - DNA, 1152 bp, Zea mays
gtacgtacgtggggcacctgtgttgtgaacgctgagtttcttcctgttgtgtcaacatccatgcagcatgggctgataagttatttctgcacctatcttcatctaccattaaccatttgatgggcaacacaattatatatgtacaatataatattcttgcattgggtccaactatatagatatatctcttttcaaaaaaaattcccatgtttcctccacaatgtactagtactactgcataaatggttcttatggacatattttttttaagtagcatcagaaaaagtccgtaggttgcaaaccgtttcttaattaagttttcaagggagctaagcttatgttgtaaaccattctaaaaaatatatatttttaacgactagcctaaaaaagacgtggaatataggagcgagtaataattatttttatttaattgtgctaaccagtattttgtcttgtgtctttttgctctggaaccacattaagttccaagcatcaatcaattaacccaaaagtttaagctgatgagaggagatgaacaattcatctatattatactctacaccaatgagaaaccgagccgacgaattgagtatactgatgcgatatatgaagacgctaagcagccttcatattcattcctttggtcttattatggtatggcttgtttttgccagcatgcatgcatatgcgccagcccagcttcacgtacatggtggacagtactagtggtccttgctgcagcatcgacgatcgatcgagaggagccattgcagtcggcggtgtcgctagctgccgagctcatcatcatcggcggcagggtagtgcagcagggtctgcgtgcacaacagccttggcgccgccaaggaacctctccatggcgtcgatgacgtgccgtccatgcgcgtacctcgccaggctcgccgcgttgctacttgccacctccagcagcaacctcacctgccgctcctccgccgtcaccaccatcttctggatcacaaagttcgcgtacgggttgatcatcatgtccacgagatggtccaagtgctgctgctggccgccgccgccgccggcgacgatctcgtcggcgatgagccggcggtcctcctggctcccgaacgccaggcacttctccaccacgttggaggcgaactt

SEQ ID NO: 21588 - DNA, 6395 bp, Zea mays
  misc_feature (609)..(609): n is a, c, g, or t
tggcgcgcgtggggcgcgaagtgatgggcgactgaaggtagcagggatgcctgctcgacgtcttctcttgtgtgcggaagaattaggtgagaaaggcggagaggtgaaatggatagaaagtttttggggctaatataaacgctcgtgttgattgtatggttgattgcgcatgcaagagataaagacttgtcttatttggtgttaggagagatgtaaaacataagacttatcttatcgggttgttagacgagatgttgaggagaaaatagagggggaggggaacaatcgtgctcttcgcgtgtgacgcaacacgatagtcaaaactagtgctttaaagtatagatagagatagagataatcattgtctaatgttgcatctttgtcttatgttcacctttgtgctaacaacttgtttttttctcgaaaacgctggagagccctcatcggcaatattttgtagctccaccgaaacgtccggtgcaactttgtcatagacgcaaacatttcaatgctttcaaatctcccaagctacaaaataacgagagtgttgagacccttctgtagttcctttggcgtcaacctatagaactactccaccacttcataaanctgccattcccggcttgttacctggtcatgctacaacttcacccttgagcttgggtgtgttcttatccacggttatgccacatctcgccggcttgccccttgtgctagggtgtggttagctgtgaggcttattttagctaggtatattattgttgttttagccttttttctggattaattgagcgatgtagggtttgccttgtttttaagcattttaaccttgcatttttcaacctaccaacaataataaattaatttccaacaattttagtgagcgtttactagataataatttgataaacatctgttatccttcaactagaaatcgatgtatcatatgcagtagattagaggggtaacacatgacatagggtttcctacgtttatagatagatatatatattgtttcagacatgagtttcatatggattgagatgaaaacgaacatactttttttgaagaaggcaataaaaaaatatattcgaccataacagtacacagtacattattctgctaagtcctgacgacgaaactgatgaaaggttcaaacaccgtgacaaaaaaaaatgtggtaaaatacagcaggcactgccagttcagaacaccatcgatttagtaacaaacagatactaataattaaatagcagctaataagattcaccaagacactccagtgctccgacgttatttagcgaaccatcgcatcaggtcatgagcgcagctccaattgcaagcaacagtacaaacccagccgtcgctggcgcgtccgagcttgctgtcgaggaggaggaggaggaggcgccgggcacaaccgtcggcctcgtctgcccctggctgaccggcggcgcggccgtgggcgtggccggcgccggtgcttcgtcaggctccggcgctgccgccgccgtcgctggtggtgctgccagtttgaaggtaataaccatgcatgaatggcgttcatcagtaacatttccacacatacacatcagagagagaggttagttctgacaaggtaaaaggtagctaggttcttacgcaacggggccgtggacagagagggcgcaggcgcatctgcgacggggcctggagctgggctctgagctgaggacgcgtctgcaggcaacaagatcatcatcgtcatatcatcacaggattattgatacgatataattctgcagtaatgcatggactggatggtagctagctagctagtcgttcggtgatccacacccacctcggcactgcagctggagagaggtggagttgcacgccctgggcagccggacggcgagcgtccggttgaccgggcacgccgacggagacgctgccggtgaggatgaggcacgcgcagccggtgctggccctcatcagcgcccccagcgaccggcagcagtcgtcggtcggggaggcgctgccgttggtgatgaagttgaggcacggcgtgaagctggtgaccagcgacgccgtgcacgacatggcgcccccaacgacgccgccggggccgggctgcccggacgccggcgccggcgcggccaccaccagcagcgtcgccaccaccgcggccaaggcgagcagcatcggcctactcctcgtcgtcgtcgccatcatgcgcgcgctcgatctgctagctagctctctcgatcacacacactcgacttggagctagggaaattaagaaaaaaggctttaatttggaaaacaaggagcctggctatagctggctgtgatgcgatgcgttgcgttgttgcagatgtgctcgctcgtgttctatatatatacagtgagaaaaagaggagcatgacgcatgatcagaataatgcggtttgcgttggttcgtcagaaagttggtcatggtagcataactaccgtaactaataaatctttttatcttctctcgcgcgcattagtcaaaagtgatactagcgtagcgtagctgcaggatgaaaggatcggaggcgcgcggaccagatcatcaggtaggaagggttcgtcaccaaataaatgatttcttaaatctggtttcccccacgcaaaaacaagctagctagctagccaatttccattttgttaggtacgtacgtggacacctgtgttgtgaacgctgagtttcttcctgttgtgtcaacatccatgcagcatgggctgataagttaattctgcacctatcttcatctaccattaaccatttgatgggcaacacaattatatatgtacaatattcttgcattgggtccaactatatagatttatctcttttcaaaaaaatttgcctatgtttcctccacaatgtactactgcagaaatagttcttatggacatatattttttttaagtagcatcagaagaagtacagtaggttgcaaaccgtttcttaattaagttttcaagggagctaagcttatgttgtaaaccattctaaaaaatatatatttttaacgactagcctaaaaaagacgtggaatataagagcgagcaataattatttttatttaattgtgataaccagtatttttggactcgaggcatatatatagctctgataccatattaagttctaagcatcaaccaatttaacacaaaagtttaagctgacgagaggagatggacaattcacctatattatactctacaccaaggagaaaccgagcggacgaattgagtatactgatgcgatatgatatatgaagacgctaagcagccttcatattcctttggtcttattatgatatggcttgtttttgccatgcatgcatatgtgccagcccagcttcacgtacagggtggacagtactagtggtccttgctgcagcatcgacgatcgatcgagaggagccattgcagtcggcggtgtcgctagccgccgagctcatcatcggcggcggcagggtagtgcagcagggtctgcgtgcacaacagccttggcgccgccaaggaacctctccatggcgtcgatgacgtgccgtccatgcgcgtacctcgccaggctcgccgcgttgctacttgccacctccagcagcaacctcacctgccgctcctccgccgtcaccaccatcttctggatcacaaagttcgcgtacgggttgatcatcatgtcctgcacgtacgtacgtacacagaacacattcacaaacaatacactatggcgtgagtgagtggaatcaaacaaaggaaaatctgtcacagcgcgtgcaatgcaagccaccacgtactaaccacgagatggtccaagtgctgctgctggccgccgccgccgccggcgacgatctcgtcggcgatgagccggcggtcctcctggctcccgaacgccaggcacttctccaccacgttggaggcgaacttgtggtagctcatgccgacgacgcggccggcgaacctcctgaccatcgcggaccgcatggcgccgcctccgtgctccaccagctgctgcaccacgtagttgccgaacctgtccgccgccagcttgttcacgttctccatgatctccgccgtcagcgcgtggtagatctcgtggtctttgcagcgggccagcactttctgggagtcgtcaagttttgaaggatcagatgagacaccgacgacgacgacacatcgtcgatgcagatgcagcgcgagagcaaaaacctggatgacgtggcagccgaagggatgggtggacagcgccttggcccggccgtagaagcttcggaggatggagtggatgtccttggacggcaggcactcgacgcacttctggacgacgtggttcgcgaactggtcgcggacacacctcagcactttgctgccgagctccttggccatcgccaccttctggtcgtgctcccctacgtcgaaagactgagacgacgacagagagacagccaaaaaaaaaagaacagatcaacagccaaatgacgatgagcgagagctctcggtgacgaacttcatttctgatgaatcgatctgaaatactagctagtgaccttctgtaccacccggcagctgtacttgtcaaggcttaggggcaacaaatggccgatcagattactgatgacccctcgcttgcaggacctcggcccatgctcaagaatctgcatgtgcatgcaggtgcgagacaaaaatcaaacagaggtaaaccgattggtaatttctaacatatatatgtatatactggatcagcagcgagaaactttagtattaagtattaaccttctggatggcatggtttccaaacatgtcgacggcaagcgtgcgcacgcagggcatgatctccttgtaaaccatggcgatctcctccggcgctgccgcctcaagcgcctgctgcacgaagcggctcccgttgcgatcggcactgcattgcatgcatgcacgcgtttccagagttacagtaactgaagtatatatatatatatattaagcgtctgctgacagtaagcagtcatgcacaccagaaagctgcgactttgcccttgatgtccacgagccgcaaggcggggctcatgctcatcgccaccaccggagccgccagagcttcctcctcctcccggtgaacggaaggaacaacgccgccgccatgatggtcgttgaatcctctgcaggcgccatgatgctgccgagaggaggcatcagcagagcgagcaattgcttgctgccgaatggccgtagtagtgtctggctgatctgctgggtcgttgttgttcctgttgttcacgtaataatgcgccaccagagcatcgccagcacagtggttcttgagatcctggattgcctgctggaggagccgcctggaactggccaccgtagggtcgatgcacacgcggaagtacgccacgtggacccccatcagatggttgtatctcttcacggcgtcctgctgctcctggctcagcaccggcggcagcagcgcgtcttctccgagctcttgctcaaagttccctagggctagggcacctggaagtgaaacctgggcggcagggacgtggacgaggttttcagcagctgtcctcgctcggccctgctgaacactcagggcagttgcatcctgtgcacccattgttgccagttgagaggagggatcggcgacggtgacgccgcctccaggataaaatgcctggtagttgttgtcgccagctggcctcgggggagcattcagcaatggttcagtaccatcacagtacatgtaacaagaaaccgagtcttgatgcctagcatcatgcatacttgctatatagtagtatatattatcattctcactgcatgcacagtgtgagtcatatccagtattattgaatcaaaggcaattctcaaaggaaaactccaactttgtaaagtagaccaacagttctcataataatatagaacaacaaagttaaatcccagcttcttttttttctcaatcacagagttatgtcatgcaaagcaaaacagaatgccatacacatacagttttttttctctccaaaaatagtactttttcttatgaggaaatatcgtttttcataaactcctagcattaatagagtaaagatctgcacctaaactctgcgcattacatcacagggcaatgaaaaaaaatacctgtaatgaaaccatcagtttggaaacattaaggggcttaaccagatatatagagttagatctctatagcgactaggccggggctaggttacctcatctaccaagctatatctaacatcctcatatgctagcaaaacattaagcgatataccgaacctagatcttagaccaccataaatgaatccttcagtgtagactgctggaatcgatacatccacctacacttttttttgtag

SEQ ID NO: 21589 - DNA, 1021 bp, Zea mays
aacatactctggccgaagaagacaataaaaaaatatattccaccataacagtacacagtacattattctgctaagtcctgacgacgaaactgatgaaaggttcaaacaccgtgacaaaaaaatgtggtaaaatacagcaggcactgccagttcagaacaccatcgatttagtaacaaacagatactaataattaaatagcagctaataagattcaccaagacactccagtgctccgacgttatttagcgaaccatcgcatcaggtcatgagcgcagctccaattgcaagcaacagtacaaacccagccgtcgctggcgcgtccgagcttgctgtcgaggaggaggaggaggaggcgccgggcacaaccgtcggcctcgtctgcccctggctgaccggcggcgcggccgtgggcgtggccggcgccggtgcttcgtcaggctccggcgctgccgccgccgtcgctggtggtggcaatggggccgtggacagagagggcgcaggcgcatctgcgacggggcctggagctgggctctgagctgaggacgcgtctcgggcactgcagctggagagaggtggagttgcacgccctgggcaggcggacggcgagcgtccggttgacgggcacgccgacggagacgctgccggtgaggatgaggcacgcgcagccggtgctggccctcatcagcgcccccagcgaccggcagcagtcgtcggtaggagaggcgctgccgttggtgatgaagttgaggcacggcgtgaagctggtgaccagcgacgccgtgcacgacatggcgcctccgacaacgccgccggggccgggctgcccggacgccggcgccggcgcggccaccagcagcagcgtcgccaccaccgcggccaaggcgagcagcatcggcctactcctcttcgtcgtcgtcatcatgcgcgctcgatctgcaaatgcgttgttggagggaaattaaagaaaaaggctttaatttggaacaaggagcctggctagctgtgatgcgatgcgtcgtt

SEQ ID NO: 21590 - DNA, 878 bp, Zea mays
tgcgatcggcacagaaagctgcgactttgcccctgatgtccacgagccgcaagggcggggctcatgctcatcgccaccaccggagcccgccagagcttcctcctcctcccggtgaacggaaggaacaacgccgccgcccatgatggtcgttgaatcctctgcaggcgccatgatgctgccgagaggaggcatcagcagagcgagcaattgcttgctgccgaatggccgtagtagtgtctggctgatctgctgggtcgttgttgttcctgttgttcacgtaataatgcgccaccagagcatcgccagcacagtggttcttgagatcctggattgcctgctggaggagccgcctggaactggccaccgtagggtcgatgcacacgcggaagtacgccacgtggacccccatcagatggttgtatctcttcacggcgtcctgctgctcctggctcagcaccggcggcagcagcgcgtcttctccgagctcttgctcaaagttccctagggctagggcacctggaagtgaaacctgggcggcagggacgtggacgaggttttcagcagctgtcctcgctcggccctgctgaacactcagggcagttgcatcctgtgcacccattgttgccagttgagaggagggatcggcgacggtgacgccgcctccaggataaaatgctggtagttgttgtcgccagctggcctcgtggaatcattaaagatgccttggtgttaagtcgtgcaaagatgaagacatcttggttgtatccgagaccaaaaatttggtggagagacactagtagattgggggagtacgtgtgttgcggcggtgaagcccgagacgggaaggggagtcccggccggcctcgagggtcccaatg

SEQ ID NO: 21591 - DNA, 6176 bp, Zea mays
  misc_feature (5879)..(5879): n is a, c, g, or t
  misc_feature (5886)..(5886): n is a, c, g, or t
  misc_feature (5888)..(5889): n is a, c, g, or t
  misc_feature (5895)..(5896): n is a, c, g, or t
  misc_feature (5903)..(5904): n is a, c, g, or t
  misc_feature (5908)..(5908): n is a, c, g, or t
  misc_feature (5919)..(5919): n is a, c, g, or t
  misc_feature (5937)..(5937): n is a, c, g, or t
  misc_feature (5940)..(5940): n is a, c, g, or t
  misc_feature (5951)..(5951): n is a, c, g, or t
  misc_feature (5955)..(5955): n is a, c, g, or t
  misc_feature (5960)..(5960): n is a, c, g, or t
  misc_feature (5962)..(5962): n is a, c, g, or t
  misc_feature (5966)..(5966): n is a, c, g, or t
  misc_feature (5968)..(5968): n is a, c, g, or t
  misc_feature (5975)..(5975): n is a, c, g, or t
  misc_feature (5983)..(5984): n is a, c, g, or t
  misc_feature (5990)..(5990): n is a, c, g, or t
  misc_feature (5993)..(5993): n is a, c, g, or t
  misc_feature (6002)..(6002): n is a, c, g, or t
  misc_feature (6005)..(6006): n is a, c, g, or t
  misc_feature (6026)..(6026): n is a, c, g, or t
  misc_feature (6036)..(6036): n is a, c, g, or t
  misc_feature (6040)..(6041): n is a, c, g, or t
  misc_feature (6044)..(6044): n is a, c, g, or t
  misc_feature (6047)..(6048): n is a, c, g, or t
  misc_feature (6051)..(6051): n is a, c, g, or t
  misc_feature (6060)..(6060): n is a, c, g, or t
  misc_feature (6063)..(6064): n is a, c, g, or t
  misc_feature (6066)..(6066): n is a, c, g, or t
  misc_feature (6070)..(6071): n is a, c, g, or t
  misc_feature (6087)..(6087): n is a, c, g, or t
  misc_feature (6089)..(6089): n is a, c, g, or t
  misc_feature (6095)..(6099): n is a, c, g, or t
  misc_feature (6102)..(6103): n is a, c, g, or t
  misc_feature (6105)..(6106): n is a, c, g, or t
  misc_feature (6112)..(6113): n is a, c, g, or t
  misc_feature (6120)..(6121): n is a, c, g, or t
  misc_feature (6127)..(6127): n is a, c, g, or t
  misc_feature (6131)..(6131): n is a, c, g, or t
  misc_feature (6135)..(6136): n is a, c, g, or t
  misc_feature (6143)..(6143): n is a, c, g, or t
  misc_feature (6152)..(6152): n is a, c, g, or t
  misc_feature (6155)..(6155): n is a, c, g, or t
  misc_feature (6158)..(6158): n is a, c, g, or t
  misc_feature (6164)..(6164): n is a, c, g, or t
tgactatgctatttgaattaaaggatagagtcgatgacttgcatcgagctatgttcttatttctggagcaagacgacttgtaaaaatttgtcgtttcttgaaagacactggtggtacaagtgcttttggttcgtgatctccaccaaaatgtaggggcttgtgttggacacctaatttggtaacagtggtactacacaaacgactgctatagtagtacggacaatctgcgcttcagatggtccaacatgctacctcagatagtctgggattagatcagtttaggtcagagtcctgatttctcacgggattctccgaacatctcacgagattttgttggacttcgcttaggaaagagtcaagatatccctttataaatatgaagaggtatgaccggttgagacacacacaatccaatcgaaccaatctatttccctttattttagtcatttacctttttatttttcaactttagatatattccaaccccttctccctctcttatgttctacattgacttgatgagttctaggtggcctatcgatactagaacaaccctaaagtccattctccctgacggggtccctcccgggaggttagatctatgtttacccgtgagctctctactcgttgcggatggtcctgtgacctaccgcagacggtctgccaacccacaaagccgacccaaggttctgcaataggtcatatggttcgttagtatttgtccccaaaaggcgcaaacatatcttttggtgacctaccttagtagacgttctgtcaacccgtagagccgatcctaaggtcttgcacaccgtgcacatgttgtagggttcgttagtattgggctaaaatgacgcaacaatatagtattgttcatgtttagtttagaatgtttatattggctagattatccattaattctaatcctaaccggtgagtacgtattttggcatattagcatgtttggattttgcatacaccaatttatcaagttgtggtatttacttgaacagtttataagtcgttggatcaatttgtagtcacctgttaagttatggtacgatggacataatttgctctaattttttaactatgttgtttactttttatagaggaaaacacataatttctatttaatagtacggtgtttgtgcgttgcgacgacatataagaacaaaaattacactttattttagctaacaagcctagaaaaatatgagttgaaaaagaacctgacccttagcctgttcggttgctcgctcatctttacctaacgagatgatactacgaggagcattgcgctgcgtgcgacgacttctgtcgtgttgggtttgtggggttctcacgacctatttgttcagtaacggccccactaataggggcttgagtggttttaacgatctatctatagggtaacaacccactgatagagaagaagaatagacctacacgctttgcgcatgttgcagaacaactatcgaaactgacgttttatagccgttgagatagagaagagagagaagaggaacctttttattgcgagtgagaagctgaccaggtgattagttgtagcccagcacgagcccataacaaaaccactttccccagcccataacgacccactgcgtgaccgcgtacaccggtcccactgtgcagtgtgatggcatcgcgcacgttcccccccaatgttttcagcgatttcatcccgttccctctccacgattcaaaaatttcccctttcccactcccaaaacccactccgcctcctccgtgtacggtgtaccccatggcgcccgccgcggccgtcatcggcgctggagattccgatcgtctcgcgcgcgaggtggcgcgggtgctggacgagtgccgcgcatcccacgccgtgcaaccgcgtaagctgcgggagctcgcggccctccgctcctcttcaggaggcggcggccgcctcttcatcgcagccttccacgtcgctgtcacgccgctcttcgccctcgcccgccgatccgctgaatctgaccgcgtcgcccgcttcatctctgccttcgcgtccgcttccgcatcatcggccgacgatggtgggaacgggttcctcgaggagttccttcggttcctcgtcaccgcgtccaaggccgcgcaccgtcccgcgcgattccgcgcatgccaaatcatctctgaggtgacctaagaaaaacactggaaacgttgcctccattttagtgaaaaactagtttcccttagtcagcacgctatagaggtgtttatagatgttaaatgtatgttgtgtttaattgtgttctttttctactgagcttaggttcagctctcttgtgcaaatatgcttcaataaagcacttgtccggatgttgcccttgtaacaagttgcctgatttatttagtcatcatcagtcatattttgttctagttgcgccgaagtgttatggcaagtccttcatttgcatattgttgaccccttcgactcagattgcatttgcaattctgcttgcagattataatgcggctgccagatgatgctgaggtgagcgatgagatttgggatgaagtaattgatggcatgaaggtccgggttcaagataagaatgctgcaattcgcacttatgctgtgcgagcattgtcccgttttgcagttgaaggagaggatggtggcattgttgacctattcctcgagaccctagacaatgagccgaatgctgtatgtgatatcgttcttaatagcttactagtattcgacgtgttcatctctctgtatctaattgtggccttgtttcatttttgaaggaggttcggaagacaatagttttttctcttccaccatcaaataatacactagagagcgtagttgaatcaatgcttgacattagtgaatcagttagacgagcagcatattctgtgcttgcaactaaatttcccctgcagactcttaggtgagtaatcacatacattggaattagaacagaccaatgcacgtgcatgaaaagcacaaaacttactgtatcagtgaatttttattctttgttttgttttggtttcagcattaagcaaaggactactgtccttcacaggggcctatctgataggtctgcttcagtaaacaacgagtgcctgaagatgctgaaggatgagtggcttgttaagtactgtggaggggatgtgatttcccttctcagatttcttgatgtcgagacatatgaatcagttggagaatctgtaatggcagtgcttctaaaagatggtgctttgcgagtgcaagatgggcacagtattaggcagtacttcactgcaaatggtgaaaaaggttcttcatcccagtctgtctcctactttcaaactgacctttctccagattttgttgctcagttcatgttcattgtgaatatgaatctctgacaaaggacaaagtaactaactccaatgaaatgaataaacctgaaagataaccccatgcaatctatgttttttcaagttcgtttgtttgaaaacacagaagaatcaagttgtctctgctcattcatcctctttctgctgctcggtatcatcattcttataatattttcagcagaacgagattccaatattcaactcatggatgctgaggttgctctttactggaaaatcatgtgcaagcatttgcaagctgaagctcaggtgaccaccagattattttaccttgttatgcaacatttttatgctacttttggaagaagctaattcttaacattgtattgttatcaactgttcaatgtagtgtagatacacacagaagtataacatttcttttgttgaaaatttgacctttgcttttgctataatagtataattttgcatgccgaagtgtggtatcagtaactagctctaggatgctgtcatgtggggtctcccctataaccgtcggaggcgcgcaagagacggaaggcgcgctgcagagagagcagcagaaatggaaagccaggaaatcagtggctagaagaaggaagggatcacagggcatgcagccgccacctcgaaggaaggccggctagaagaggaaagagattagcagaaatcctaaattatagagatcagtttccatttagtagagaccctaaatcagtggagattagtttcccttttctgttacaactcaggctataaagccctgtagccggctcctatgggagacaagcaataacacagttatttcctccctcatccctaccactctcaagccttcggaagaggggtaaaacctcaccggagaagacggaccgagggtacgacctacgtagccgaggcccccttccctagattctaaggcccttgacagatgcctagtgttgccaaggagttagttgttttttagatgacttagagagaagaaacaatcctttccaagcatcattcatatcatgtcaagattacctgacatgttgtaatattttgtaactattgccatttctcaacaataccagctgattagttgcaggagctgcaaatatgagttgattagtttatttattaagtgaattacctctaggtttctattgttaggcctctactatatgatgacatggttttactctgaatgataactaagaagatggttgattacagaattagtatttctcccttaatggatatgtaaagatacaaatgtgagtagttgtttatctttcagattttgagtcggatattgatatgaatcccatatctgtatcaggtatctgactttgagtacttgacttgaatatggtgttggatggccgtatttagataagggttatccatttaatatctaaacctgttcaaccaatggataatcaggaaatatttgtcctattttcacccgtcttcctctcaatctatctcgatatcttctttgacttaatgacatccctcccctccttcggacgttctcagccatgctgaccatgccttccttatcgttattgaccttctgatcggatgtttggatctaatttagagcaagcatggaactacatgtgttctgctaatttaaatgtcgtaattatcgaaatttatttgctagttctactggctgatattgacttcttcctggatggcaataccattctttaaagttaaatcaatactttatctattataagtcaatggctattctataggtccaaggcgcacaggctgcagcaactacaggtgcggaagcagcggtatatgcttctgaggctactgataaaaacgaccttctcgacagtgtccttcctagcacaattactgattatgttgatttggtaaaggcacacctttctgccggtaagcaggaatagctatcatccgcccgttggatgcccgcaccaggagctcactagtcccccccccccccccattatcacttcacatcaaggcaattattgctacttggtgaaatgcttgagttctctgatactatgaaccgaaagattgcaagttcttttctgcacgagcttctcgtcaggcctcttgaacatgaagttgatgatgatgggaaccagattgcaattggagatggtgtgagtcttggaggagacaaagactgggcgaaagcagtggcggagttggccaaaaaagtgcattcttctgttggtgaattcgaaatggtggtttccactgttgttgaagagctggctagaccttgcagggagagaacagctgacttcatgcagtggatgcactgtctcgccgtgacaggtcttctgcttcagaatacttcaaccttacggaatctccaggccacagcaattgagccttcagaactgcttcactctttgttgcttcccgcagcaaaacaaaatcatgttgatgtacaaagggctgctttaagatgcctttgtctccttggactgttacaagaacagacctaatgcatngttgggnanncactcnncttatcnntcancaattgggccnacttggttactgccatancangcaaggccttnattngactntntacntngcattgngccacacnnaatacntcnagccttggnaanntgatctccagatcctactangaacacatanatanntanttnngtntgcctttcntanncnaacnngataactaacacacgntntcccgnnnnncannanntgtatnnacttcgnntcctgntcanatcnnccaacanacgcacacnacncanaccccnacccctctcacg

SEQ ID NO: 21592 - DNA, 2406 bp, Zea mays
  misc_feature (591)..(591): n is a, c, g, or t
gtcatatgaatcagttggagaatctgtaatggcagtgcttctaaaagatggtgctttgcgagtgcaagatgggcacagtattaggcattacttcactgcaaatggtgaaaaagcagaacgagattccaatattcaactcatggatgctgaggttgctctttactggaaaatcatgtgcaagcatttgcaagctgaagctcaggtcaaaggctcagaggctgcagcaactacaggtgcggaagcagcggtatatgcttctgaggctactgataaaaacgaccttctcgacagtgtccttcctagcacaattactgattatgttgatttggtaaaggcacacctttctgccggaccaaattatcacttcacatcaaggcaattattgctacttggtgaaatgcttgagttctctgatactatgaaccgaaagattgcaagttcttttctgcacgagcttctcgtcaggcctcttgaacatgaagttgatgatgatgggaaccagattgcaattggagatggtgtgagtcttggaggagacaaagactgggcgaaaagcagtggcggagttggccaaaaaagtgcattcttctngttggtgaattcgaaatggtggtttccactgttgttgaagagctggctagaccttgcagggagagaacagctgacttcatgcagtggatgcactgtctcgccgtgacaggtcttctgcttcagaatacttcaaccttacggaatctccaggccacagcaattgagccttcagaactgcttcactctttgttgcttcccgcagcaaaacaaaatcatgttgatgtacaaagggctgctttaagatgcctttgtctccttggactgttagagaacagacctaatgcagagttggtgaagcagctacgcttatctttcatcaatgggcctgacttggttagtgccatagcatgcaaggccttgattgaccttgtaacttggcatgggccacaagaaatagatcgagccattggaattgaatcgccagatcctagctacgaaaaatctcagttcactcaagttgacctctctgatatgaatgatgatgatctaaacattggagttcttgatattttattttctggatttcataaagatcactgggaattcgatctagagggtgacaatcatgataatgtcccaaccattcttggtgaaggttttgcaaagattcttctcctcagtgggaattttgccagtatacctgctgatttgcatactgttatcctcgctaaactcattaaattgtatttctcagaggaaactaaagagctcgaaagattgaaacaatgtatgtctgtcttctttcagcactatccagcactttcagataaacacaagagttgtatctgcaacgcatttgtacctgtcatgaaagccatgtggcctggtttatatggtaatgctgggggtagcactcatgttatttcaaagaaacggaaacttgcggttcaagcttctcgtttcatggtgcaaatggtgcaaacccaattattttcaaccgaaagtatggaccaagcttcaaaaagttctgaaagtgcttcaggtttagcagatgcgtcaaacaattttgacatcagcgaggaaggacttgctatccgtatagcactagaggtagccagttgcccagataagaagaccgcagctgggaaagcatatgctttggccctgtgcaaggttgtggtccttctaagattccggcaatcagaacagaaggccatcaagtgcatgagaggccttgtgaatcatttggctgcttcagtggcttccgacaaggagctcgggaaggagctagctcaaatggctgcacggcttagatcgcttgatgcctgtccagacgaagaacttgcacaagatgacgcagatgccatattcaagaaactaggattcgatgatggcttcaagttggacaccaatcaagcagtgcctcctacaccagcaccacggtcagtccggcctccggctcctgccaggagaagagcgagacaggcaccgtcctctagcgatgacagtgacgaggaagggggagaagctgacgtgcctgcaacatcggcaagcagggttccagccactcccagtatgactgctgctgcacgttctcagagagcaagcaagactgctgctctgagcaggatgtctgcgaaacctgctaccgcgtctgatgacagtgagctggacgggcagtctgacgtcacgagcgaggaggatgcatccgatgaggagtcgtcataggttgctgttgttgtctcgtgtaattgtggactggagtttctgatgacgttgttgagcggaagaaccaagtaatctaactaaattaattacagcggtgacatattgtcactgcattatgcaaaaaaaaaaaaaaaataagtatgattt

SEQ ID NO: 21593 - DNA, 5505 bp, Zea mays
gtctacctccgcagcttatatgccaactgcataatgtgactatgcatgctgatgctgagacagatgaggtgtatgcacagatgacactgcagccacttttttttgttcctttgcagtccacaagagctcaaggacccatttttgcctgctgagttaggcactgccagcaaccagccaacaaattatttttgtaaaacactaactgcaagtgatacgagtacacatggtgggttctctgttccacgccgagcagctgagaaggtgtttcctccactggtatgtgtttcttgcatagttgtttgggtctctttttcagatcaaatagaccaaaccattaggtgttctaaatgctcctttgttaattctgtaggatttcaatcagcaacctcccgcacaggagttgattgcaaaagatcttcatggcaacgactggaaatttcgccatatttttcgaggtaggtatttctggttacttttgttggttcatgatgttgtgattttttgcatagttgcatacagcgctgtatcatacaactcttgaaatagtctcacctgtttcaatgccattctacattcaagtgtcagagtaacttagaataatattattggtgtaggtcagccaaagcggcatcttctgacaacaggttggagtgtctttgttagtgcaaagagactggttgctggcgactctgtcctttttatctggtatgacattttcagcttttcaaaaaaaagaaaagaaaaggcacacactcattttttcgcttccttaagcctagtatcctacagagagttttcctgctgattgtattgatgtattcatgtatgtatttggctgcccaggaatgacaacaaccagctgcttctgggaattcgccgggcaaacagaccacaaaccgtcatgccatcatcagtactttctagtgatagcatgcatattggcctgctcgctgctgcagctcatgctgcatcaacaaatagccggtttactatcttctataatccaaggtaagggcagtttcccacatatatctggttatttatcgctccagtaataaactatttcccatgcattatgcagagcaagcccttgtgaatttgtcatacccatggctaagtatgtgaaagctgtgtaccatacccgtatatctgtgggcatgcgtttccggatgctttttgagacggaggaatctagtgtaaggcggtatgtcaaacctatgtttatttcaacattatttgttacctgggcattgtattggtttatcctcttttcttacttcacttgcctctagcatagtgattggatgtgttcaatgttagatactgctggtgcactgtctatatatgtccatcaagtttcaatctaaattgcttaagtgcccttgcagttatatggggacaattacaggaataagtgatcttgatcctgttcgctggccaaactcgcactggcgctcagtaaaggtaggtctcgaaacaaacacagctttgtttttcttaatgccattctacatgccttcacacttctttaactgcgtcatgagtgaattccgagttagatggtggtctctactttcatacatatagtagtaagcatgcaaccaattttcgcctgaatcatgcaggttggatgggacgagtcaactgctggagagaagcagccaagggtatctctttgggagattgaaccgttgacaacttttccaatgtatccatctccttttgctcttggattaaagcgacccatggcctgcaggcctgccttctttatacggtacaagtgacagttacacacttagcaactcttccagtatacagcattgaacaatggattatattgatactgcttatgtgctaatgtcactagtcttgtttctgattgttttggtaggtggaaggggtgatggcttgacctcttctcttatgtggcttcgagacagggcaaacccgggtttccagtcactgaatttcagcgggcttggtatgagtccctggatgcagcctaggctggataattccttacttggtctccaatctgacatgtaccagaccatagcagcagcagcagcattacaaagcactacgaagcaagttccaccttcagcaatgcagttccaacagcctcagaacattgctgatagatctgctcttctatcaagtcagattctgcagcaagtacaacctcggtttcagcaaatttaccctcaaaatctcaacgaaaacaaaattcaaggtcatacacaacctgagtacctccaagtccaacagcagcttcaacgctgccaatcatttaatgagcagaagcctccgatgcatccacagcaacaacagcaggaaccacagcagcagcaatgcgtccaaacaccacaggatcaacaaatgcaagaacagaagcatctgcacaacttccactccttgccagatgcattatcggccttttctcagctttccccagccactcactccccaccttccgcattgcagacagttccagcattctcgcatcaacaaaacttcccagatacaaacattagctctctctcaccatctactggcccttcaatgcatggcatgttggggagattaccttccgaagcagcttcgagcctcccatgtgtggcaatgaacgcccctgtatcggtatctgacccatggtcatccaagagagttgcagtggagtctgttaacccttgtcgacctcatgtttcaccacatatagaacatttggatatggcgacgtgtaacatgccgcagagctctgcactagcaccattacctggacgagaatgcctagtggatgaagatgggtgctctgatcctcaaaatcacctcttgtttggtgttcacatagactcgcattcacttctgatgcaagggggcattccagcccttcagaatgataacagttcaggcactattccatactcaacctccaatttcctgagcccttctgataacgatttccccttgaatcaaccgctacgcagcgctggctgcttagatgagtcggattatcttccatgtgcagagaatgccgaacaggcaaatcaacagtttgcaacctttgtgaaggttagtgatgtgtctatctcgtggaccatttgctcaacaaaaagttgttccattttgaattctttcccatgaagcaactttgctgacaaatgcgtgcctgagccctataggtttacaaatccgggaccgtcggaaggttgctcgacatcactagattcagcagctacgacgagctccgtagcgaggtggggcgtctgtttggcctcgagggccagctggaagaccctttgagatcaggctggcagcttgtatttgttgacagggaggacgatgtccttctggttggcgatgacccatggcagtaagttccaccaacaagcctaacaagttcctcaccgccttccgttttcgctgtccgtctcctgtttctcatacgtttgttgggctcggtgacgtgcagggaattcgtgaacagtgtgtcctgtataaagatactttcaccggaggaggtccagcggatgggaaagccgggcatccagctcctgagctcggctccttcaagaaggctgggcaatggctgcgacagctacgcgagcatgcaggagccgagaggcctggacgctgggatggcgccggtgggttcggtcgagttctgaagacggcggagggaagcccaccatggccctcgggtcgaggattactctccctcctgtatgtttctgcagcacttgctagctctgcgacttggaacaaagcacgtagatcaaatggagctctgtgctgctccccgtctgatgatgtcttatggtatagactcgtagcagtaactactacatgttgtatacatgccggcacttcagttcttatcgagtagcaataccgctagtttagtccatccaatcaactacgttcttgttcctatgatcctgttgttgcgatgcagtaaaaccttttttttgtcataataacctgtatattgaaactgttcttggctcccacggtatcctgctgacgacgactgacgagggaaactggaatttgggggcatttcacagaattgaaactactgataattccaacttaccgatgcaattccaattccaacttggtcagaccaacattgccgttgctgtcaatgtcacgataattgctaaagctaccttcagtaaaagcaaaaggcagtttgttatgatcctggaaaagttgagagatagatatatagatatgatctctgagggaattcattcaggtgcacctttatgcttgcataatttggcaccacttggtgcagacaacgacgccatggaccggtcctcttcctctcatagtctcatgtgctccctgggtccctatctgactgaaacccctgagtgcggccctcccctggcgaagaagaaaaggatggcctcccgttccctgaggtcagtggtgcatcggggagctgaatgcgacgccgctctcgccatcacagttcacggatccactatccctgctccggcccgcctcccctggggccgccgccgccgcgccgggccttctgggatcgaccggtttggtggctgcctgctccgcctccgcgcggtggatcgtgacaagattctgagtgggagcacgtggagtgcgacggcaatggcggcgtgacacgcgggcgagcacagctcgcccgttcttgtcgacgctctgcgactctgggcagggcgtccgtaggagcgaaccccggtagcttctctggtgatctctccatcgctttcatcatatcttcggctgggcccccgggtttggatcccggacgggtattgccatccccgccaatcttggccggcttttcgcggtggggaaggtagaaatctctgttgcctcccaaaaatctgtgccctttttggatgtctatcgacaacagtaacacgagcagagaccgtcagctcacacatatctatcgacgacagctcgagatgcacgaggctttgacttgttgcagccttgcaggtacatcaggtaaagtaccagccgtatctggaaaattgttggtcacctgctggcgatgggtgatcatggtcatggaaccctgagaagagattcaactgagaacacaaggaaaacgacggctctggacacgctcctgtccggctctggaaccgtgcggccgccgccgccgccgcgcacgcagtccggcaccacttggagcacacgctggccgtccggcaccgggcacgcagccgagcacgaaaccggcacgagcatccccaacgcgtacctgacccaccggccggtcagccgacggcggcgcacgcgcacggaaccgagggcgggcacggcgcgggcgttgggcgtctgcgcgtgatgggccttggagtccgttccgttacgttcacgtgggacgggaaggacgggcggtccaaagctggagggggctacgggcccaagtatttcctgtggaagcaagaaggccgagttcccgctcccgcatgtaaatcagcccagttagcactgcag

SEQ ID NO: 21594 - DNA, 2842 bp, Zea mays
gtctacctccgcagcttatatgccaactgcataatgtgactatgcatgctgatgctgagacagatgaggtgtatgcacagatgacactgcagccactcagtccacaagagctcaaggacccatttttgcccgccgcgtggggcactgccagcaaccagccaacaaattatttttgtaaaacactaactgcaagtgatacgagtacacatggtgggttctctgttccacgccgagcagctgagaaggtgtttcctccactggatttcaatcagcaacctcccgcacaggagttgattgcaaaagatcttcatggcaacgactggaaatttcgccatatttttcgaggtcagccaaagcggcatcttctgacaacaggttggagtgtctttgttagtgcaaagagactggttgctggcgactctgtcctttttatctggaatgacaacaaccagctgcttctgggaattcgacgggcaaacagaccacaaaccgtcatgccatcatcagtactttctagtgatagcatgcatattggcctgctcgctgctgcagctcatgctgcatcaacaaatagtcggtttactatcttctataatccaagagcaagcccttgtgaatttgtcatacccatggctaagtatgtgaaagctgtgtaccatacccgtatatctgtgggcatgcgtttccggatgctttttgagacggaggaatctagtgtaaggcgttatatggggacaattacaggaataagtgatcttgatcctgttcgctggccaaactcgcactggcgctcagtaaaggttggatgggacgagtcaactgctggagagaagcagccaagggtatctctttgggagattgaaccgttgacaacttttccaatgtatccatctccttttgctcttggattaaagcgcccatggcctgcaggcctgccttctttatacggtggaaggggtgatggcttgacctcttctcttatgtggcttcgagacagggcaaacccgggtttccagtcactgaatttcagcgggcttggtatgagtccctggatgcagcctaggctggataattccttacttggtctccaatctgacatgtaccagaccatagcagcagcagcagcattacaaagcactacgaagcaagttccaccttcagcaatgcagttccaacagcctcagaacattgctgatagatctgctcttctatcaagtcagattctgcagcaagtacaacctcggtttcagcaaatttaccctcaaaatctcaacgaaaacaaaattcaaggtcatacacaacctgagtacctccaagtccaacagcagcttcaacgctgccaatcatttaatgagcagaagcctccgatgcatccacagcaacaacagcaggaaccacagaagcagcaatgcgtccaaacaccacaggatcaacaaatgcaagaacagaagcatctgcacaacttccactccttgccagatgcattatcggccttttctcagctttccccagccactcactccccaccttccgcattgcagacagttccagcattctcgcatcaacaaaacttcccagatacaaacattagctctctctcaccatctactggcccttcaatgcatggcatgttggggagattaccttccgaagcagcttcgagcctcccatgtgtggcaatgaacgcccctgtatcggtatctgacccatggtcatccaagagagttgcagtggagtctgttaacccttgtcgacctcatgtttcaccacatatagaacatttggatatggcgacgtgtaacatgccgcagagctctgcactagcaccattacctggacgagaatgcctagtggatgaagatgggtgctctgatcctcaaaatcacctcttgtttggtgttcacatagactcacattcacttctgatgcaagggggcattccagcccttcagaatgataacagttcaggcactattccatactcaacctccaatttcctgagcccttctgataacgatttccccttgaatcaaccgctacgcagcgctggctgcttagatgagtcggattatcttccatgtgcagagaatgccgaacaggcaaatcaacagtttgcaacctttgtgaaggtttacaaatccgggaccgtcggaaggttgctcgacatcactagattcagcagctacgacgagctccgtagcgaggtggggcgtctgtttggcctcgagggccagctggaagaccctttgagatcaggctggcagcttgtatttgttgacagggaggacgatgtccttctggttggcgatgacccatggcaggaattcgtgaacagtgtgtcctgtataaagatactttcaccggaggaggtccagcggatgggaaagccgggcatccagctcctgagctcggctccttcaagaaggctgggcaatggctgcgacagctacgcgagcatgcaggagccgagaggcctggacgctgggatggcgccggtgggttcggtcgagttctgaagacggcggagggaagcccaccatggccctcgggtcgaggattactctccctcctgtatgtttctgcagcacttgctagctctgcgacttggaacaaagcacgtagatcaaatggagctctgtgctgctccccgtctgatgatgtcttatggtatagactcgtagcagtaactactacatgttgtatacatgccggcacttcagttcttatcgagtagcaataccgctagtttagtccatccaatcaactacgttcttgttcctatgatcctgttgttgcgatgcagtaaaactttttttttcatataaaaaaaaaaaaaaaaaaa

SEQ ID NO: 21595 - DNA, 846 bp, Zea mays
  misc_feature (30)..(30): n is a, c, g, or t
agggcctttttttttttttttatgcaacancgatggtaataaagtcatcgcatatcttttgcggttcacagttacatatcatttaccagccccccaggcggctccagcgatgtacacccacgtattgtatctgaaaaaaacatcatctgagtatctgacaactcccaaatccaccaatgctccgtttcttatgagaaccaacgttccggtcatcaagtgcgaaggtaggaccacacaatatacatcatcacacgcagcgacaccacaggggctgcgactgcgaaccttatagccagacagccgtgctgctactttgtaaggtagtatatgagcaagaagacagcaatgaaggatgccaccatggtcgccatcctccggctcgatttcgtctcgaaaaccatcttgaacttgtccaccgtccctgaaagaaatcctctcgaagcatccatgtcattacccattctgtccagcatccggttatggttctccacttcttcatgtatatcgccagtcaatcttttgagaacgctgaccctatcatgcaaactgtccagagcttgatcattctcgtgctcatgaatttcacgagaagaataagctggagctctcaccccaccttcttcaatgccatcaaataaagcagctctatggctacggaagtcccttctcgagttcatcggacgcgaccttcactggccaaagagttctcacgggtgcggagaagccgatggagcctgcctgccggtgcgggtgggcggcgagatctgatgaaagcttgatgcgcctcctccgtccttctggagcaagaccacgcaaatggggtttgagtcagtgggcccaaatcgt

SEQ ID NO: 21596 - DNA, 1198 bp, Zea mays
tgcagctgcgggtgcaggctcaacgtaccatacgctggccagcaaacaggagtaggaccttgatcaatttttagagagtccgaatggatgtgtgcatgcaaccaatcacactgtacgtgtccggatacatgcctatattcatatacttacaatgtgttaaatatctggtatgcagaagggctggcatgagaatattcaacatatatggtgctgactgtatttgactctaaatccaaagaaaacaattatatctggatccatatgcgcattaatcatgccaacagcaacccttgaaaacccaacacagcacactcactgcaagctccgactgtgctactcgcaagttccaacattatgggcctgtttgtgacatgcactcatgtgacagcccagcccacacaaagacatcaggccgcagattacgatctccgggcactcagctcagctgatccgtgtccgccgcatgaactggtcaccggtcagacacccaaccatccaaacgcctcttctcactcccttcccgccacctcaacaggcttcacttcccatccacggctatatatacgccgagctctcattcaccagccagagccccctcctcaccgccaccacgttcgtccgcatccgcgcgctctgccaccgcatggcgcccttcctcctcgccctgctcgccgtcctcctccccgcggcgccgcccagcctcggagccggctacggggaggggggcgcgggcaccatcaacatcaccaagaccctcgccggcttcccggagttcagcgccttcagcgccatgctgaccgagaccagcgtcgcgctcgccatcaacagccgcgacagggccaccgtgctggcgcccaacaacacggccgtcgccgcggcgttcggcggcctgccccacatcccgcgctcgttcctggcggacctgctcgcgctccacgtcgtgctcgactacgtcgacgagcccaggctgggcgcgctggagcgcgggcgcacgggccgaggctccgtggtcaccacgctgctgcaggtgatgcgcgccgttccgcggggcaccggcttcctccgcgtctacgccgggcgcgacgggcgcgccaccgtctcctccgccgcgcccgcggggctccggaacgccaccgtcgagcgggtggtcgccgcgcagccgtacagcctcgccgtgctgcaggggtaccgagctcga

SEQ ID NO: 21597 - DNA, 4674 bp, Zea mays
ccggacagtccggtgtcgcattggacagtctggtgtcgcaccggacagtctgatgtctcctccacagtgccactagaaactagtcgttgggccactattccttggtgcaccagatagtccggcgtgtggcaccggccagtctgttgtcctcgaccgaacagtccgccagtggcaacatatttcttcgttttttggactttgcttgatattctttaatcttcacttgtgatattcataaagtcttcttttgaggtgttgctttcctcaagtcactttagtatcctgtgaactacaaacataaacattagcaaacatattagttcacgggttatattgaccattaaacatcaaaaccttttgagccaaatggcctgaggtctatttttcttactgatccgaagcgacgtgtatttaagaaagctgggttggcaccaactctatttttttcctcttgagactattaatcttgcatttacgttgttttgtgacgagtttttcatttctgaaattgaccttcaaatggaaggattttgggtttgcatctcccaactttaaggctttttattctagcaacatgtcggttcctagcccaatctcagtagaattttatgagaattttataaacattaaatattagcggatatacgaataaagagagagacgatcatagttttataaaagtaaattgtgttccatatgaacgaaacagttcaatgtttctaacatattaggcccaattgagcaatcgtccgagagggaaattaagagtgcatttcataccgtatgtgccgaagctaagatcatcagctttcattgtcatgagtgaaacttccattccatcatcctacacctcttgtaactcactctcagaaataggtaaaaatgatctagctactgggaaatgggaatggccttagcagttagtgcaaaccgaaataatgcccccctagccccctgcttttttttttttttttcattgcaactagaccttatagcatcatcaggccaacaaaccaacggcaaataaaaacagaaagtgctaaatttacagtagtggatttgagactcaacatgttcctggaacacaaactaaatttctagctgttttgcagagagcactaccaaatggtgattatagtttcataggcatcagcgttagaatcaaattgtatgctcagtacagtacaaaaggcaccgaggcctaccgagtggagtgtgtaggtttggcaaggcttggccgaaaccagagttgcccccacacacacactaacgtccagaagagcatgcaatatcaccagttcaatgacggaggtaatcgaattcagccttcgcgagtcagtgggtacccgcagagaggaaggaatcaggaatagcagcaggatccagctcgtagaagccacagagctcgccacccttctctgttgtcagctggaaagagggtatccggtgagaaaacagcaagtcatcctttgttggcacctccagaatactcctctcattgtctggcttgaatacagttttgtagccatctacctgagtcagaaataagactttcgtgctagcttcattgcgctcagttatctcgccaatggcatattcgcaggtatctttgctaggaacccagccaggtgaccaattgtggtagatcgcccaaatttcccctacttctgggtggatttcaaagttccgcttcgaaccaccttgtgtttctactacatgagagaatgcatcgtttatgtcgtacttcatcctccagttatgaagtttaaatgtcccacagctcacgggtaagtcatgctctaaccatgtgttctcatgctctgatcgagggcaagcttccagccaagtcaggtgcactccaaatggatctgaatcaacttttgtaacccaaccatagtatttgggaaggccatcaaaatcactgtaaagagcccatatctgtcctcgttcaaacttattatatgaccggtcttcttcaaagttgtagaacaatgaatctggatatgtgaaaacagaggtggatgcacagacttggggagcagaataaccagacatgctagcaaggcgggcattatgctgctgagtttgaacggattgttttctccacttgcctgcatttctatggttgcccttatgagcacttcgtccatttccatggctgggtgtagtattgtcagtcaaatcaacagactcgctgcccattgttctattggtagccacacatgaatcaagatcaacaggtggaaatgctacgtccaggttactaggaagcgatacggtatctagttcaagaaacccacaagggacaccaaccttctcgtttcccactgttctgaaaaatgggatgctgtgggaaaagcgaagtagttcacttgatggtataacaaatgatggtttgtcctttgctggtgcaaacagactcacaaaacctttaaccttgaccaaggggataacagtcacaccagcttccactgtgaagtttgaaaggacctccaccacttcatactcgtaggatctatgactgtctgcatctgagacccactgcatactccagcccttataaagagcccaaacctcacctatatttggatatattacataagaacccctttttcttcctttaacccacgaaaccatgtgagaaaacatgaggggatcttgtgactcctctgtgtttcctaacgtaaagttcccacaagccacaggaagtttattatcaatccatttttcctcatcatcattcactgtagaatgctccagccaagtgtacttaactctgaagttggtggtattaacatgtcttattctagcatagaatcttggcatggcatcgaattcatcataaagtgcccatatctgatcaactgcaaacagtttgacatctctgcacttgtcgaagtcaaaaaattctgggtcagggtacgtgaaactcccagtattccaaggcttctcagcaggtggatcacaagttgttttagtgtttcttttattgccttcattgacaacacaactatcttgattatctgttttgctagacacatgaggttcactaacatgtccatcagcatgggcaacattatcatcaactactttattagaactggaggtagcatttgagaaccaatctttgggtgtccgactctttttctttggagaattcaggatgttgttggcatcagcacaagcctttctcctagaagatctccgtggagtagggatttctgcagaacctggccctgctgatgtatccaccccaccacctaggtttttcctgtcaccaaaatctggtacagtagaattctttgctgaaaatttaactccttccatcacaggcccctctttgttctctctagaaaagatatttgtagagcagccttgctgcgcagcactatttgctgtttttgatgagaatgcagaaggcacatcctctgtacttgtctggtgtgcaaagaaattctgcctgcaattctgacagcggatctgacgattgagtatgtcaccatggtacttatattttgttttacagtgaatgcatacggtccaaaatgtccaaggtccatatcctgctgcactactatttgtgctatttttgttgattggctctgtagtccacattggttgtgtagcctgctttggctgtgcagcctgctttggtttagcaacatgctttggttttgcatcctgtttctgttgtgtagcctgatttggttgtgtcggctgtgtagcctgctttggtgcaactttgggagcagccctccatttgacatcatatgcatatcgtttggttcgatcagacaatgttgagtatgcttctgcaacaaacttgaaagcagattctgcaccagcataactgtttttatcagggtgaagtgagaggacaagcttacgatattgcttctttatggtcacctcatctgctgttccttctacttggagaattccataaaaatccaacattccatttacttttgcttctgctgcacaatgtacttcacagacagttaacagctggggtatgttctctatctctgggaaaatcctctgtgctttaagggcaatccttttagcaccaacaaaatctctgctttccaacttcttaacagcaatttccctggctttcaaggcttcttctctgttgcactccattgtactgattaccaaattggttcccaaaatcaatcgctgtcagacaaatatgttacccgtgcaatgcttccaggccctttcttaaagcatccaaaaagtatatagacaccttgaaacgattcacttctttctggtgcagatagacctaaggcatgtggggtcagaagcatagatcactgtgtaggtggatagtgcaaaccatgtgcgtggctgcatgcaacaatttttcacgatgaagcagcctggtgagtgctcgtcaccagcgaagagaccggcgaaggcctcggcacccggcgtagggcggcggcggctgcagtagcccacccagtcgtcgcagagagagagcgcgcaggcggggtgaaggtgaacggatgctgcggacggcggtagactagtccgtggttgcttggtcaggggtagcgcacccgcaggggcctccagtgttctgtcagggcaaacgcacccgcaggaacctccggtggcggaggtctgcaacacagagtgcgaggagggaaggtaggttgcccg

SEQ ID NO: 21598 - DNA, 448 bp, Zea mays
aagcagtggtaacaacgcagagtactttttttttttttttttttttttttttttttcctcatcatcattcactgtagaatgctccagccaagtgtacttaactctgaagttgggggtattaacatgtcttattctagcatagaatcttggcatggcatcgaattcatcataaagggcccatatctgatcaactgcaaacagtttgacatctctgcacttgtcgaagtcaaaaaattctgggtcagggtacgtgaaactcccagtattccaaggcttctcagcagggggatcacaagttgttttagggtttcttttattgccttcattgacaacacaactatcttgattatctgttttgctagacacatgaggttcactaacatgtccatcagcatgggcaaccccgcgtactctgcgttgttaccactgcttaagggcgaatctctgc

SEQ ID NO: 21599 - DNA, 1157 bp, Zea mays
  misc_feature (1)..(1): n is a, c, g, or t
ntttttttttttttttttccttttttttttttttttttttttttttttttttttgctcttgttgtctctgctacaacaaccaaccagggttcagctccttttttttcagaaacactccacatggttcacattcatttttgggcatatatacaagatgtcaatgtgctgagggaacacatacatccatacataataaactccgtggatgctgatcgaaatgcgtagtagcttttccgaaaatccatgcgcgtggaagagacaaatcccaaggttccctggaagaccctagcctcgtcataaccttaaggaagaaaacagcctacggactgcttcaaatatttcatctgcagtacccgtggcatttatcttgtgaacttttccccttgaagagtagtagtcaacgacaggaatgttcaaactttcaaacacttttagacgcttcttgattgtctcaatgttatcatcaactctcccctggttacggcctagaaggcgtttaaccatctcatcctcaggacagtcaaagaaaatcacaatgtctggttctgttccaacaatcctttcgaaggcgattctgttttcctcacaccttgggaagccatcaataagaacccttttagcattgttcatttccatcgcttttctgatgagttccacagttatctcagacggaacaatcctcccttcctttatgatttctaggatcaactcccctttctcactgccagatgctatttcatgtcggagaatatcaccagcgctcagatgggcaaatccaaaatccgaagcaatcttagtgcactgtgttcctttgccactcccaggaccacctaagacaaaagcaataaagggcttctgggtatcgccaccatcacttccagcctgggacgtgaagagcctggcaagacggttgagagcaagaggttcctcgctggggagaagatggtggcggcggctctggcaggccgaggaggccgaggaagaagttcgtggagatcggagaaggagggcgcccactcgcctccgccacatctcgtcgccacgcacacgctagcggatcgtcttcttctctttcctccctccgatggcgtcgttgctctctcctctcgcctcttgctttatttttgttctcttctttccccccggccggcctcgag

SEQ ID NO: 21600 - DNA, 1322 bp, Zea mays
gtcgtcttttgctctaacgcttcgcctttcgaccccttctttcctccgacttctttcagcagcatcccctagtcctcgcctggactccgcggagtctttggttgctccgagttcctcgcctggttttcggcaaggccaaggaaaggtggtcacttcacttctgtttttttttttttactgccgccgcaaacctccgctcctgtgccataccgccattccattcttaatctgggcgccgaagaagagaggacgggagcgaggtccggtcgaagaatcgtagcggattgggggaggggggagcggcggcggcggcggcggaggccggtcggtatgattcaactgctgttcctcgtgctgttcgcggagggcgcggtggcgctgctcctcatggtgaaggtcgggccgctgcgggagctcgcgatgcgcggcgtggaccaggtgaagacgggcaagggcccggccacggtcaagacgctggcgtgcacgctctccgtcatcctcatgtccagcgtcgccagcatcctcaagatccagaacagggggctcaagctcggcaccgtcagccccatggaccaggtgctctggaggacgcacctcctcgaggcatccctcatcggatacacgctattccttgcatttgtaatcgaccggctgcaccactacctgcgaaagctgatgacactgaggaaaacatccagcacatccagagaggaggtggagaaacttcagatggagaaccggtcgctccgcgaaaaggaggagaagtcctccagtgagacgaagaggcttcagcgagagattgcgaggctgaatgagggcatgaagaagctgaaatctgagaccgaagagcacgagaggaaggcgtcggtggcagaggcccatgtcgacgcgctgcagaagcagtcggaggagctgctcctggagtacgaccggttgctggaagacaaccagattctgcagactcagctacttagcagaggctaagctaaggagcttggtttgttagcaagactcctttaccaggtagtgtcgtagagccaaggacttgcccgattctgaatgcttacatgccgcggttctaaatttcggcatgtccattgtggttcttggcgtccatgctgttcctaacttgtgatcttgttgatgtatggatgcagcgtgtatttttagagttcatgtttcttccatttccgatagatggaggtacatgatgtaaggtccaggaacgacgggacgtccttgaggaattcggtagtcaaggctctcagaatgtgcttgaaaaaaatcggagtggcatgttacgcagattctgattcgtcctg

SEQ ID NO: 21601 - DNA, 1323 bp, Zea mays
cactctcacttccacactcctactcctccccgcccccgtcgccttccgccgccgtcttttgcgctaacgcttcgcctttcgatcccctttctgacttcttatagcatcatcccaagtcctcgcccggactccgcagattctctggttgctacgagttcttcgcctggtttttgggcaaggccaaaatttctgatttttttccaccgccgcaaacccctttgctgtgccataccgccattccattcctaagctgggcgtgggcgggtgaagaaaggaagcgaggccggctgtttcgctgaaaccccgccgcctttttttccttttcttttctggacctgattgaagaaccgtagcagattaggggagggaggagcggcggcggccggtcggtcggtcagtatgattcacctgctgttcctcgtgctgttcgcggagggcgcggtagcgctgctcctcatggtgaaggtcgggccgctgcgggagctggcgatgcgcgtcgtggaccaggtgaagacgggcaagggcccggcaaccgtcaagacgctggcatgcacgctctcggtcatcctcatgtccaacgtcgccagcatcctcaagatccagaatcgtgggctcaagctcggcaccgtcagccccatggaccaggtgctctggagaacgcacctcctcgaggcatccctcatcggatacacgctattccttgcatttgtaatcgaccggctgcaccactacctccagaagctgatgacgttgaggaaaacatccagcacgtccagggaggaggtcgagaaacttcagatggagaaccggtcgctccgcgaaaaggaggagaaatcctccggtgaaacgaagaggcttcagcgagaggttgtgaggctgaacgagagcatgaagaagctgaagtccgaggccaaggagcatgagcggaaggcatcggtagcggaggcccatgtcaatgcgctgcagaagcagtcggaggagctgctcctggagtacgaccggttgctggaagacaaccagatcctgcagacgcagcttcttagcagaggctaagctatgagctggtacatgctgcagcttcagttgtttgttagcaaggttcttaccagatggttctgagtgatgacatgcagagcggttcttggcgttcctgacttaattatgatcttgttgatgtctggatgcagcgtgtactttagactttcatgtttcttcctttctggatggatgtaggtaggtacatgatgtaagagccaatggatggattgtaggtacatgatgtaagagccaatgaattgtgatttaattatagaaggtcagact

SEQ ID NO: 21602 - DNA, 1705 bp, Zea mays
tctctcactctcacttccacactcctactcctccccgccgccgtcttttgcgctaacgcttcgcctttcgatcccctttccgacttcttttagcatcatcccaagtcctcgcccggactccgcagattctctggttgctacgagttcttcgcctggttttgggcaaggccaagaaaaggtggtgatttcatttcctgcccgtctccaatctcactccccacaaaatttctgatttttttccaccgccgcaaacccctttcctgtgccataccgccattccattcctaagctgggcgtgggcgggtgaagaaaggaagcgaggccggctgtttcgctgaaaccccgccgccttttttttccttttcttttctggacctgattgaagaaccgtagcatattaggggagggaggagcggcggcggccggtcggtcagtatgattcacctgctgttcctcgtgctgttcgcggagggcgcggtagcgctgctcctcatggtgaaggtcgggccgctgcgggagctggcgatgcgcgtcgtggaccaggtgaagacgggcaagggcccggcaaccgtcaagacgctggcatgcacgctctcggtcatcctcatgtccaacgtcgccagcatcctcaagatccagaatcgtgggctcaagctcaccgtcagccccatggaccaggtgctctggagaacgcacctcctcgaggcatccctcatcggatacacgctattccttgcatttgtaatcgaccggctgcaccactacctccagaagctgatgacgttgaggaaaacatccagcacgtccagggaggaggtcgagaaacttcagatggagaaccggtcgctccgcgaaaaggaggagaaatcctccggtgaaacgaagaggcttcagcgagaggttgtgaggctgaacgagagcatgaagaagctgaagtccgaggccaaggagcatgagcggaaggcatcggtagcggaggcccatgtcaatgcgctgcagaagcagtcggaggagctgctcctggagtacgaccggttgctggaagacaaccagatcctgcagacgcagcttcttagcagaggctaagctatgagctggtacatgctgcagcttcagttgtttgttagcaaggttcttaccagatggttctgagtgatgacatgcagagcggttcttggcgttcctgacttaattatgatcttgttgatgtctggatgcagcgtgtactttagactttcatgtttcttcctttctggatggatgtaggtaggtacatgatgtaagagccaatggatggattgtaggtacatgatgtaagagccaatgaattgtgatttaattatagaaggtcagactagtgcagtggcgagagctgtgtcgttagatcaggcctagtgcagttgtgaaagctgtcattgaccatgctatgtcgtcggtttgaagcagcattttcttatagattgcctcagtttattcttcttttctaacaaaaaaaaaaaaaaaatggagtctggatctgccgtgcatacaccaaaatggcctgtacaaaagattgtagcttttgaattcagcacaagcagaagagtcaatcgtcgtacttgtgagcctctgccgtgcatgaaccagactggcctgaccaaaagtagatgctctttgaatttggcacagccctattctccacgctacagcacatgtacaagtcaag

SEQ ID NO: 21603 - DNA, 3634 bp, Zea mays
  misc_feature (215)..(215): n is a, c, g, or t
  misc_feature (272)..(272): n is a, c, g, or t
  misc_feature (850)..(850): n is a, c, g, or t
tgtcactggtgatgacaggacaggagcgtcgccggctatagcctgtgtctctgtttggcacgtctttcgtcttcgggcccagtcctgaggggagatgtttgtgccctcgtcctcccagcttccaagtctaggagctcctgctccttgatgctggcacagtgggataaaataaaaatctacatcagacagtggttggcaaattgatctgtcttccnaacaggccacaggcctcatctgctctggcctctggcacggtggtcactgcagtgctnactcccgtccagcatggctcgaacctgcctgtcgcctttactcacccctgtgccgtcatgctgacggcgctctcaactcagggttaacggggccaaaacccaaaaggatataattaaattacatccattcgcccattttttaaaagaaaacaaaataaattaaatcaagtttttttagatgaaaaaaatgcaaatgcattgctcgtaactttttttaactaaaatccctcgaaagcaaagcatgccggaggagactttcgggatcacattgcatgccaaggcgccattgttaatccaaaagaacataaaaggcacactcctaatatatctctctctccacgtcgcctttcgccgtcgtcttttgctcaccaactccagcagtgtgcgactccgtatccctaaaacgcgcggccgacacattctctctcctctccgtatccggctccgtttccagcaacactccccatcccactccgcatgcagtctatgacacctgggccccgccagcaggcgcgcgcgcacgcagagagttgcggagaggagagagaaagtgtggaaatggggagcgcagggacacngcgtccattttgcggagagggatgcggagtctgctggagcgcgcaacagtgcctcagaccgcgcaaaatggggatgcggagtcggatacggagtcttgctggagttggtctaacgcttcgcctttcgacccccctttcctccgacttctttcagcagcatcccctagcccccgccgcgccgccgcggggtctttggttgctccgagttcctcgcctggttttcggcaaggtgagctgctcctttcgccgttcctctgggagtttccccggttgcttgttgcttcccgttttccttctcggtctggcaaggccttctgattgctggcggctcaccttttcgcaggccaaggaaaggtggtcacttcacctctgttttttttttttttttactgccgccgcaaacctccgctcctgtgccataccgccattccattcttaatctgggcgccgaagaagagccccccggcccccccgccgcccgaagaatcgtagcggattgggggaggggggagcggcggcggcggcggcggaggccggtcggtatgattcaactgctgttcctcgtgctgttcgcggagggcgcggtggcgctgctcctcatggtgaaggtcgggccgctgcgggagctcgcgatgcgcggcgtggaccaggtgaagacgggcaagggcccggccacggtcaagacgctggcgtgcacgctctccgtcatcctcatgtccagcgtcgccagcatcctcaagatccagaacagggggctcaagctcggcaccgtcagccccatggaccaggtgctctggaggacgcacctcctcgaggcatccctcatcggtgagcatcccactccgcccttctttgcttattcctcactcacggcaaaatgccagtagcttagcgttgacaagtggggtttttttagaagattattaatggactggtggtatggatgctttgactcagtagtggttggctgatcgttgctcaaatgcgtagcgtaggtggtagacaaagtagaaatctagcacccaatgtttctggattcagttgccaatctagaactcgattctcagaagggcagaaatcgcaggctctctgatccacattttgtattggacccaggggtcttgcctagtctgaaatcttgattacaagggtcttactttaccgtcaaggattgctgcttttagtaatcactgtttagtagtacagtagtcagcagccatctcatttgtttacctggagagtcaactgttcaagaataggaggttagaatagtctattaggatactataagaactcccactagattgcatttcgatgactcttgttccttgctccctagtccctaggcaaaaaagaaagatggtaccatgctgtagcaacaactttatcttcagtaattgtttcgttctgttggaatttaactatagtcgttttttacaagttcttggtatggatgaactgtccgcttacaagttcttggtaattgtctcagtcagtaatgttaaggagatactagataaggtgagttctcaatgtaacgtttgtcctccaaaccaaacctttgtaattactctagtgctgtttgctttagttagtgatctcagtcaaataccagtatggcttagtaatctcagttatagcttactttttcagaacggtgatgtgcaagctaaaaaatagtttggcgcttggggggaatcagtagggaagaatttgtttcacattttacaatttaggatctgctaaaatatttcgcattttacagtttaggatctgctaaaaatgatacaaaggagaatttccgtttatcagagagattcctatcaaaaaaatggtaaaggtaggcctcagaggatatttgaagttcccattgaacctatactttgatgggaatgtcgaacacatacaattttagcccagcacaatgttgtttcccctttctgaaaaaagtagcgtataatctttctagttaacaattaaatctgacactgtgttctcatacatttcgtttggtttctccttgtaggatacacgctattccttgcatttgtaatcgaccggctgcaccactacctgcgaaagctgttgacactgaggaaaacatccagcacatccagagaggaggtggagaaacttcagatggagaaccggtcgctccgcgaaaaggaggagaagtcctccagtgagacgaagaggcttcagcgagagattgcgaggctgaatgagggcatgaagaagctgaaatctgagaccgaagagcacgagaggaaggcgtcggtggcagaggcccatgtcgacgcgctgcagaagcagtcggaggagctgctcctggagtacgaccggttgctggaagacaaccagattctgcagactcagctacttagcagaggctaagctaaggagcttggtttgttagcaagactcctttaccaggtagtgtcgtagagccaaggacttgcccgattctgaatgcttacatgccgcggttctaaatttcggcatgtccattgtggttcttggcgtccatgctgttcctaacttgtgatcttgttgatgtatggatgcagcgtgtatttttagagttcatgtttcttccatttccgatagatggaggtacatgatgtaaggtccaggaacgacgggacgtccttgaggaattcggtagtcaaggctctcagaatgtgcttgaaaaaaatcggagtggcatgttacgcagattctgattcgtcctgaacttgaagcctgcatgaatgaaccaaagttgcctgaaaaaaaaaaaaaaaa

SEQ ID NO: 21604 - DNA, 1153 bp, Zea mays
taaattctgattcagtcttaagagattcccagaattatcatagtatactaaagtttaaccacaccgtcacaataatcgtttgaattatctcactgtgtggtctttctgataaatggatcttgtggtacaaaccttgaaacttggtggcgaacatgagacatcaaatgtgcagggaaaaacactccatcgttctgcgcaaacccgcatctaccggactggttttccagtaaccaacacaggtaatggaaaagcctagggtgattcagtgcaccttggaatttagctcagcaccctggtgtggtcgcgatggctctactgtctattctactacatcagagccgaagtcgattttgtctaggccgcaggagctctgctgtcctccaaaagcttcagttccatacaccatccatcaatctttttaatcttttccagcgtttcagatttcaatttttcagggtcgccttgtacttgtgcttcagctaagcgtatcttctttttcagtgctcgaatcttcttgtctatgtctggagcagatgattctggttgcgaattgtttatagtatttgtggacggcattgcatgtgactcagaaatagcaatgccactcatctgctttgttacactttccacggaatccttctgcttatccgttttggaagaaaggaccttgtcggtttctccagcatcagttccctctatgttcatactctttcctttatcatttgccaaactggcctgctgccgtttctccttccgtcgctcgttccgtttggccgccttcgtcttgggtttggcgtcggccactagcgccgggtcgtaccccggcggcacgtcgggccctgacttcctcattagggcgcccttggactggtagatggcgacctcctcctggggcacgtaaccggcgcggatgcggatggccttgcggagcgtgccgtcggggcggcgcgtgggcgcgatgatgcgctcgccttccttggggatggagaggaggcgccgctggtcgccgccgccgtcgctggaggtggccatgacaggggtgggacgtggcgtgcgtgattcggatgcgggggaggacggaggctgcgtcgacggcgggcacacaatgggtttaggggagtcgggctccggcctcggcctcccccgcccgcac

SEQ ID NO: 21605 - DNA, 1230 bp, Zea mays
tttttttttttttttggtctaaaaatgaactagccagcgataaatattattaagaacggaggtagtacatgtgatgaagagaggcagggagccagagacataagaattccggcacttccagtcagtttcaaccgtgatataacagctaattgaacaatggtggtaaagccggagatgaattcgggccgtgagagcaaaagtaaattctgacccagtgtctaagagatccccataattagcagcggtctttcttgcggtacagatcttgaaacttggcgccagaaatgtgcggtgaaaaacttccatcgttctgcgcaaacccacatctactggactgctcttccaataaccaccacgggtgacggagaagcctatggtgattcagttgcaccttcgaatctggatcggcaccatggtgtggtcgcggtggctctacatcagaaccgaagttgattttgtctaagcagcaggcgctctcttgtcctccaaaagcttcagctccataagccatccatcaagctttttcatcttttccagtgcctcagatctcaatttttcagggtcaccttgtacttgtgcttcagctaagcgtatcttctttttcaatgctcgaattttcttatctatgtctggagcagatgattccggttgtgaattgtttgtagtatttgtggacggcgttgcatgtgactcggaaatagcaatgccacttatctgctttattacactttccaccgaatccttctgcttaaccgttttggaagaaagagccttgtcagtttctccagcatcagttccctctatgtccatactctttcctttattatttgtcgaactggcctgctgccgtttctctttccgtcgctcgttcctcttggccgccttcgtcttgggtttggcatcggccacttgcgccggatcgtaccccggcggcacgtcgggtcctgacttcctcattagggcgcccttggactggtagatggcgacctcctcctggggcacatagccggcgcggatgcggatggccttgcggagcgtgccgtcgggacggcgcgtgggcgcgatgatgcgctcgccttccttggggatggtgagaaggcgccgctggtcgccgccgccgtcgctgtaagtggccatgtcaagggtcgcgtgcgtgattcggatgcggggatggaggggagggcggccgcccccgcggcgcccggcgaaggtttagagtcgagatcccga

SEQ ID NO: 21606 - DNA, 2435 bp, Zea mays
cccttttaggcttcccgcgttgtaatttgtggtggaaatttgaagcgggtaaccatttccccccgggaaacagctattgcccctggattacgcccagcttggaattataccttccctaaaagggaccaaaagctagctcccccgcggtggcgggccctttagaaataatggattccccggggtgcagggcccccccccccccccctgttttagggatttagtggattcataccatacttgatgtatgtgttttgtatatatatctagattaatcatcatccacttgaatatagacattaaaaccaagagctgaaacgactactattttaggacggatgtagtgttttttttttcttctttacttttttaataagcttatgtcccaatggaatgttttgccttcttttaagtttcttgacaaggctactattttgtcacattggtgcatgtaccttttaagtgattactaaaactctacgagactttagtttatttctattaaattttcccatccatacatagtcctcgtagcaactaatgatagttgtgctctgatttgatttcttgtctgagcagaaaaagaggcaccaccaactagaaattgttctatgtggaagcagcaagttgttgtctcatggccacatgcccacatggtcactgctgttggtggccacaacggttatccagggggcaaggtgttcgtttctgcggaacaggtcagggagaatctgtcataagcgctgatagtcaaattgtcaaagattggtccattctcctttccctgctcactcattatagcttcagtctgttccaaatttggcagttaggtcatggagattactctgcctcacgcacaaaagtatttcgcatggtgaatactcttggagtcaacaatgaagccaagcaaacaatacaagtactgcaagctgaactaaatgaaacaaaagagaggctgcacacagttgaagaactgaaaggacaaactgcacattatttgtattgttcatgaccctatggatttctgttttaatttatttccatatgtagaaagttgtttactacttctgtttactgtaatctacaatgtatttgcgtcgctatggtaattccttgtagttataatcgtgctttgatcatgatacattaggttcagaagatatgttgtttcgagtttggtcatatttatctgattttttgtatttatatgttatataaaatatgtagcgaacaacaatccctgaaatctggaaccatagttggctcctgaagaatcttcctgctgatctgatggacgatgatagcatgagcaaccaatatgaggagcttgctcagcaattgcaaaccatggatcagatcatgcagcttttaacacaggccaccataccacctacctatacgagatgaattctatgtgtttgtactttccaattcaacctgccttcaaaatttagatgtggtgttctatgaaattttggcattatgatcattattattgctcgattgatgcatgtgttaatttgattgcagcacaccataatatatagggatcgacggacccaccaaggcctaggccgagacccctcgattcagagaatcaaacccaggaacgagtttcgtctcttcaaattccacgcgcacgcgcgccgcaacggatagcccgcggtccgtcgtgtcccgtcgcattaactcccgcctgcggcccgcttatcctgtccaactgacacaagccaacgggcgccgctccacctcctcagggtaagcgcatcaaatggtgtgtctctctccctctcctcttttgttcatccacaggtagcagggaagaggtatcccctcggactcccttccgtgcaaaggaagtaaggcccgagcctcctactgatcaagggttcgaaggttaaaccctcggcatggttcgataactgccccagagcacacgggttccgagccctttactgatcaggggttcgtaggttggcccctcgaaaaggtccaacaactgccccagagcacagagtcagggatgactatgggtacgtccgtacatggccgaggctcgagctacaatcccgaggtaccctaagacatatccgagacccctgagagcgattcgtgactgtatcccgtcggagggaggcatcgagccctcggaccccatcgaacggatccgggatcaggcgaatcacccgcaggtacttttggggcgtgtcttcggaccactagccgacccctatgaaacgaggctcgggcctccgctcggatcacccattaacagctcaccagagaagtcatgctcgttgcccaccgagggtagaatgacgctttttcccctcttcctccttgcaggaaggcgatgaagaggcatatcattaaaaagtcaaggtgtttctcaatcgtcctctcgccctgtgcggaggctcgagggggggcccggtact

SEQ ID NO: 21607 - DNA, 1613 bp, Zea mays
  misc_feature (1284)..(1284): n is a, c, g, or t
  misc_feature (1448)..(1448): n is a, c, g, or t
  misc_feature (1469)..(1469): n is a, c, g, or t
acaaagaggaggaagccatgtcccccaacctgcatagcgccatcaagagtcaggtgtcggcgctgctcctgaggtgcctctttagggtgtccgggccgggcaaggccaagaagttccagcagatcctggtgctgatggggaggcggtgggtgttcatgcagacggaggcgagccgcgttctcggcatggacctggaccgcggggacaacacgcacaccttcatacgctcggactcgccgccactgctcacccggaacagcatcaaccagagtccgaagttgctccaccccgtgcctcagccctgtctccaaggacttcgagcacaaggactgcagcggcctggtagagatgctctgctgctccatcagttgtgcctagaaaaagaggcaccaccaactagaaattgttctatgtggaagcagcaagttgttgtctcatggccacatgcccacatggtcactgctgttggtggccacaacggttatccagggggcaaggtgttcgtttctgcggaacagtctgttccaaatttggcagttaggtcatggagattactctgcctcacgcacaaaagtatttcgcatggtgaatactcttggagtcaacaatgaagccaagcaaacaatacaagtactgcaagctgaactaaatgaaacaaaagagaggctgcacacagttgaagaactgaaaggacaaactgcacattatttgtattgttcatgaccctatggatttctgttttaatttatttccatatgtagaaagttgtttactacttctgtttactgtaatctacaatgtatttgcgtcgctatggtaattccttgtagttataatcaaaaaaaaaacatgatacattaggttcagaagatatgttgtttcgagtttggtcatatttatctgattttttgtatttatatgttatataaaatatgtagcgaacaacaatccctgaaatctggaaccatagttggctcctgaagaatcttcctgctgatctgatggacgatgatagcatgagcaaccaatatgaggagcttgctcagcaattgcaaaccatggatcagatcatgcagcttttaacacaggccaccataccacctacctatacgagatgaattctatgtgtttgtactttccaattcaacctgccttcaaaatttagatgtggtgttctatgaaattttggcattatgatcattattattgctcgattgatgcatgtgttaatttgattgcagcacaccataatatatagggatcgacggacccaccaaggcctangccgagacccctcgattcagagaatcaaaccccagaaacgagttcgtctcttcaaattcacgcgcacgcgcgccgcaacggatagcccgcggtccgtcgtgtcccgtcgcattaactcccgcctgcggcccgcttatcctgtccaactgacacaagccaagggncgccgctccacttcctcaggnaaagcgcatccaatggggggcttcctctccctctcctcttttggtccccccccgggtagcagggaaaaagaatcccctccgaactccccttccgggcaaagaaagtagggcccaagcctcctacctgacaagggtttcgagggt

SEQ ID NO: 21608 - DNA, 1315 bp, Zea mays
ttttttttttttttttggtttttttttttttttttttttttttattgaaaccatagaacgactacatttcattccttctcttctcatcaatatctcttacatcaatttctaggtgtgatttgcttgggatgctattgattgctcctggatgtaactgcagaataccaacggtgccccaaccgtatcaattgatcctgattccaggacatgtttctcgactgctaatgctaattcagctgctgccagtccagcatcatttcttgcaggcatcagcactgctccagcatgaccgccattcccttcaaagtccaccttaagacttgcaggagcagcaattgcagtaacaatgccaatagggataccctccttttctaagatgggaccctgctcaatgtgcagttctataaaagcagagtatttgtctgtctttaaaaatacgctatgcaggtcctctagattcaacttatagccagcagattctgcagcatccaaaaatgacacattctgattgtcaactacttttcggagggattgagcaagttcttcaatccctgccattaagcggcttcccaagcagctaattccaaatcgtgtaggctcctctgatgtaaacataataacctccaaagatctttttggcaggaaagcagaccttttcagcaaactaattgcctcaagagcacccagaactccaacaacaccatcaaatttgcctgagaatggaatggcatcaacatgagatccagttgcaactgctcctagtccaggctcggaaccctcccagcggccaaatatgttaccaacagcatcttctcgaacaacaaggccaagttgattcattatcccttttatataccttcgagcctgcacatccttgtcggtgtacagaacgcgggtcacggacggcgcgggcgagtcggagaacgaggccagttcatcgatctgacgctggaggccctcggagtcgacgtggaagtcgctggaagggccctcgccgtcgtcggaggcggggaagccggcgaactgctccatcgtccgccgcgccgcggcgtcatcgttggccgcggcggcgctgatgacgaggaggaaagcgaggaagacgaggcgcgacgcggcgttcggcttcgacggcatgcttcgttgttcggctggctgctctgctgggttcgatggaacagggagggctacttgcctacttcgggaggctagggagatttgaacggcgggcgggggaggtgggagttgggacttgggagtgggagacaacgcgacggcactactgctgttgctgttggtggtgacctgcctgctgcgt

SEQ ID NO: 21609 - DNA, 3599 bp, Zea mays
  misc_feature (622)..(622): n is a, c, g, or t
tatatgaaaagtaaggatattaaacttgtaccaaatgtcgtgctagctactcgcaggagtacattatttatctcccagaatgtttgagctattttaatctacttattaatgcatatagctatgctatgctatgctagctttgatggatgttcaattcggaacgatgagctgaaccgtgtgcatttggttctttcgtgtccttccagattgggttcttgttgtgttctcagttgcatctgggcagcgaatgattaatcaagttttcagttaaatcttcgactgtgaatagataccaaagtattcagtctatacttagaatataatattagtgttaagatgatatttttctacacagattttgcatattatagtgacaattatcgttacatatttatgttttatataaatttttaactctcgtgacaacgtacgtacacatatctagtagtattcagggcaaataccgtctcggggacgacgaccaaacaaacaaaccaaaccaaacagtgcgggaatccttgctgattcataggccgggaacggcgaatctgtccaaccggtctcccgatccggagtcgaaggatagtgctcctatttgtttagatgagaatctttagacaangaaccgggatcaacgaaatcatcgccacgtagccatagaatatactacggaatcctccatggatcagctttactagcagccgccgccgccgcggcggagagagacgccagacacttcttctgggcttctctctctctatctctctgactctcttacaaggaggggagtcgagagacaaatcgtcttgaggtatcttcctcccttgtatggttcgtttatttcttggatgttacggtggtgatccaccgcctaggagctcgatcgccggcgacgtcgtggccgtgtgctgtcgttctaatgcggctaggggtggatctagaataaaatatgactgatagtatacttgtgaggacgagtacaaaaatatcagaacaaagacagttaggttgaggaggtgatctcatgataaatattagagcttatttgatttgctgactaacttgttatattttatctaaattttctgtttgactttaatatttaattcgaatgattaatcttagtcaaaatgtgatgcaattagacacgaataaaacagtcctttaaattctactagttacaacagataaaaagcggaggtctgtaccctcgctgcactagccctaactaggtccgcccctcacggtcccgttgggttctgaaaactcaaaaagagagagaggtaatttgggtaatcaagtctgtgtatgattactagaataggtacagtatatataggctaagccactagccgattatagaaacagatcgggagggcagtcactggttagccaagattacagcacggctgattagccaaaattacagcagcagttacaggagaggatatcctctagcaatatactgtcaaagctccaacgccattggtgaacgaatctcaaggaggtacgtagacagagacagacgccgcaagctcgcgttcgcagtgccagtcaaactggtggtgagcaagttggacttttcagtcagtggccttgttggctctcttcctctccggttggttcttggttcagatatcgggggtgggtcttcgtcttcccctgcctcgcctctgcttcactgcaggtggtcgaagaagaagaaggccctcgatctcctgccctccactccaccagagccggtgcgatcccggtcccgaccgacctcagcacagcatgttcgtggtcgaggacaagggcggcgccatcgcgctgatgctggcgtcgctactgttcctgggcacgtggccggccgtgctgacgctgctggagcgccgaggccggctgccgcagcacacgtacctggactactccgtcacgaacctcctcgcggccgtgctcatcgcgctcaccttcggccagctcgggggcgccaggcgcggcacgcccaacttcctcacgcagctcggccagcccaactggccttccgtgctgttcgccatggccggaggcgtcgtgctcagcgtcgggaacctctccacccagtacgcttgggcctacgtcggtctctccgtcaccgaggtcgtcagctccagcatggtggtcgtcattggtatgttgctagcttgtttgaactcctgatttctgaatgtttacatacacccagcatgacgaatcatcaatcatgtgtgctgtgcttttcaggcacgacgctgaactacttcctggacaaccgcatcaacagggcggagattctgtttcccggcgtggcatgcttccttgttgctgtcatccttggctctgctgtccacgcctccaacgcagctgacaacgaggagaagctcagtgcctccacaaatgcctaccagcttgggtaactgatcattctactttttcctccaatgcatctgggactgctctgaccgtgatttcgcacaacgttacagtaggacagctggggctgcggaaccaagcaagcatgtccgagacaaaggtacgctgcagtaatgtgtgaaaactgctgcttctggtttgttttgtttttcagatgctcattatctgaaggagaagacaaaaaaaaatctctgatttcagatgttgccaaggacttggagaatggagtctctggaacaaagcaagctgacaaagcggaggcaggcaccgcagaatacctcattcaactcgaagagcggcggtcaatcaaggtatccgtccgtccatccatccaatactcatccatactcatggggataaacacagacgacctcatttaatttaacacttagttctgaaagaaaaaaaaacattttttttcttctcaaaactggaacgtaaaaatggcttgcacacccacgcgggcaccaggtattcggttcaaacacgttcatcggtctggggatcgtgttcttcgcgggggcgtgcttctcgctcttctccccggcgttcaacctggcaaccaacgaccagtggcgcacgctcaggggcggcgtgccgcacctggtggtctacaccgccttcttctacttctccgtcgcgtgcttcgccgtcggcgtcggcctcaacgtgctgttcctctaccgccccatggccggggtgcccaggtcctccctcggggcctacctcggggactgggacggccggcactgggcgctcctcgccggcctgctctgcggcttcggcaacggcctccagttcacgggcgggcaggccgcgggctacgccgccgccgacgcggtccaggcgctgccgctcgtcagcaccttctggggcgtactgctctttggggagtaccgcaagtcgtcgcggaagacgtacctcctgctcggcttcatgctcttcatgttcgtcgccgccgtcgccgtgctcatggcttcgtcaggtcacaggaccacagagtgatcctggtcctgtcagtcaggctgtcacgccctaacatgcatgaaatcttcggtacaaagggatggagatgtacataaaaatgtttctgttgtgattgatcaggtatatagcaccatataaaaattaaagctatttatattcttccaaagacaacaactggc

SEQ ID NO: 21610 - DNA, 2009 bp, Zea mays
aattcggcacgtggttttccacggcgatgacgagttgtgcatcgctcgtccgttccttcctctctcctcctcctcctcctttccctgctccctccaaactccaactaaacgccattggtgaatggatctcaaggaggtcaaactgatgcagagcaagttggacttttcagtcagtggcctggccttgcagatggctcccgcgaccgcgaggctggccgacgaggcaggggcttgttagtagtccagtcgctgctataaaatagagcggccatgaaccgtgttctcgcgtgtgcgtcttctctgctcacatgccgcgaggtgctccaggaacaagtgtcgtccaccagatccaggctcggcatgttcgtgatcgaggacaagggcggcgccatcgcgctgatgctggcgtcgctcctgttcctgggcacctggccggccgtgctcaccctgctggagcgccggggccggctgccgcagcacacgtacctggactactccatcaccaacctcctcgcggccgtgctcatcgcgctcaccttcggccagctcggggacagcaggcgcggcatgcccaacttcttcacgcagctcggccaggacaactggccctccgtgctgttcgccatggccgggggcgtcgtgctcagcgtcggcaacctctccacccagtacgcttgggcctatgtgggcctctccgtcactgaggtcatcagctccagcatggtggtggtcataggcaccacgctgaactacttcctggacaaccgcatcaacagggcagagattctgttccctggtgtggcgtgcttcctcgtcgccgtcatccttggctccgctgtccattcctccaatgcagctgacaatgagcagaaactcggtgcctccacgaatgcctacaaactcgggacaagtggaactgtggaaccaagcaaacaagccgtagacagagatgctcccaaagacttggaggagagtggagcctctggaatccggcaacctgacaaagctgaggcaggcactgcagagtacctcattgagcttgaagaacggcgatcaattaaggtattcggttcaaacaccttcatcgggctggggatcgtcttcttcgcgggcgtgtgcttctcgctcttctccccggcgttcaacctggccaccaacgaccagtggcacacgctcagggacggcgtgccgcacctggtggtgtacaccgccttcttctacttctccatctcctgcttcgtcgtcggcgtcggcctcaacgtcctgttcctctaccgccccatggccggcgtgccccgctcctccctcggggcctacctcagggactgggacggccgccagtgggcgctcctcgccggcctgctctgcggcttcggcaacggcttccagttcatgggcggccaggccgcagggtacgccgccgctgacgctgtccaggccctgccgctcgtcagcaccttctggggcgtactgctcttcggggagtaccgcaagtcgtcgcggaagacctacgtcctgctcggcttcatgctcttcatgttcgtcgccgctgtcgccgtgctcatggcttcgtcaggtcacaggagcacagagtgaattgcaagtcttgttcgtcctctgcttgttgcaagcccttccacttgcgattgatccacggaaagatccatcgtcttcgtgaagcaggggaaatccattccttccagccattaatgagatcttcagaacaatggaatggagatgtacaaaaaaatggttgttgtatgattgatcaaatgtatagaactatttatattctttccaagacaattggctgataggataggaactgttccaggggtggaaaaaatctctatctttatgaacagggtaaaagcaatgttcagaaaaaagtagtttgtgcctagtatgacagattcagaatggtatcagtactcccgctgttttggaatgttcaagagaaaactagtggatgctctccaaatcctaaaaaaaaaaaaaaaaaagcggcc

SEQ ID NO: 21611 - DNA, 1804 bp, Zea mays
  misc_feature (1426)..(1426): n is a, c, g, or t
cataacaaaagccatatataaatatgtaacaaaatccgtatgccttaaagaaaacctagaatggcttggaacagtaggattgtaacaagcacgtgtgttacatgtagttatactgtgctacattcatgttttgttgaaatgcattcgagaagggtacgggggcgcccgccctggttttttttgggttttggttcataaaaattgctgctcatataaccttaagattgggccattatagtaagaaatacaccaagaataccagcaactagaccggagtatcgctcgccctcccatctcttcagcgatagcagcagggcgtgcccatctctacaatacaacgatggtatccccgtcttcagctcaacaccaatagtattctctatcgctatatgtacatcccctctgtctctgaaaatgttggtctctccctgcgctccacatcaacattcccagcccgtttgtagcctgacctgatcaacttgctggaatcatgtcgctgctgcgcccccaccgcatatgttcagcctgctctcctgacaatgctgtctaccatccatcgtcgctcaaagctccgtctttagcttgctcgccggggtttgctgggctccagagcttgttagatcatagccgaagagagagggactggagttgctaaacacgggaggatggccatccccacgcttttcccactgtgaagccacttggtgtggatgtgctaaatcgccatgccagaactgctgttgaagttgcatcagctgccttgctccatgaacacccatttctggccaggttacctgctccaagtcgattccgttcttgcagttgaagcctgctatccttccacactctgtggtcagaaagctgtctagcccaccaaaatcgacccttgggtttacagctgcgagcctcattgacaagtactcaacttgcctttggagagactgaacatgattgatgatctcatctagcaccaatgctgttcctgataccttactgcagccggggaccagctccttgagcagctccatcctcgcattgatcttctcgcgtctcgcccgctcggcgaggctgtggctgtccgtggcctggccccgcctggcccgcacgtgcacgtacgccggcttctcgtcgtcgccgtcgccgcccgcgagcttctcctccgccgtcttccccttcttcgccgccttccccttgggggcacggtcgacggggtcggccttgcgcttgccggcgttagcggcggcggggaggggccggcccgcccccgtggaggatggggacggggacgggggcgcgaacgtggataagcgcgcggcgcggtccacgaggtgcgggtcggaggggaaggttggcgcgggcgctgtggctagggcggggggcgtcgtgcgggggaggagcagctccccccccccccacgtggggagtncccagcagcgccgggaaggagcctccgcctccgtgggcgcccgcggaggaggcattggcgggggccagcgccgcctggatctcgcccctggcgacggggagctcctgcggcggcgaggcgcggcgcatcggctcggcggaggcgtccgggacaagggaacgaggggaggaggacacgggagcggaggcgggggtaggggagagtggcgccattatttataggggggcggcgctgaggcgagaggtggtgtcactcactggtgtgccgtgcgcgcgtgagctgctgctgctgcgttcgcagttcgcactcgcacgccctggctcctcctccgctggggtcaaggaaggagaagattggagaggtagggacctagggaga

SEQ ID NO: 21612 - DNA, 863 bp, Zea mays
gcttcttgtgcgcctcctgattgcccctgctattggaccaaagatgggtcttaacttcagtgtactcaacacattcggagtcccagggctgaggggggcgactaccaagcaggtttatgagcggcatttcgcgaacaaggaaaccaaggagttcaaagatttccacattgcctacgtcgagttctgcaagtatttcaccacggtgatgcccggtcaggattttgacactccatctactacggtgattcagaaattctttgaagacgagtggaagccggagaagaacgaggaggagaggaagaggaagttcctggagttcatgaggaagaaggtgagggaggccaaggtggacgacagcttcttcatcgcggcggggctggcggtgccggtggcggccgtcatcggcaagagggccagcgggcagatcccctacgtgaagagcgtgaggctggacctggtccccaacgtcgtgttcgtgccgttcgtgacgctgctcggcatcatgggcgccaccgcgtggcagatgggcaacaagagcgctgtcgcccaggaggacgaggacgccaacgaggaggagaagaagaaggagacgatgaagcgcgcggcggggcagcagcagcaggaggagcaaaacaggtcgccttgattgatggcttgttcttcatgcatgcgtgcatgcatcgtctcttggttgatgaatgcgtgtgtactgtatgcatggatgactctggatcagtcactcgtttattcacccaataaccatgggattattatttgttcatcgatgaaacattttatggcgcataaacaataatctcatggatgcaaaattgtcaaaaaaaaaaaaaaaaaaaaaaaaaaaa

SEQ ID NO: 21613 - DNA, 867 bp, Zea mays
  misc_feature (812)..(813): n is a, c, g, or t
gccggccggttcgggcctcctggggcttcttgtgcgcacgtcctgattgcccctgctattggaccaaagatgggtcttaacttcagtgtactcaacacattcggagtcccagggctgaggggggcgactaccaagcaggtttatgagcggcatttcgcgaacaaggaaaccaaggagttcaaagatttccacattgcctacgtcgagttctgcaagtatttcaacacggtgatgcccggtcaggattttgacactccatctactacggtgattcagaaattctttgaagacgagtggaagccggagaagaacgaggaggagaggaagaggaagttcctggagttcatgaggaagaaggtgagggaggccaaggtggacgacagcttcttcatcgcggcggggctggcggtgccggtggcggccgtcatcggcaagagggccagcgggcagatcccctacgtgaagagcgtgaggctggacctggtccccaacgtcgtgttcgtgccgttcgtgacgctgctcggcatcatgggcgccaccgcgtggcagatgggcagcaagagcgctgccgcccaggaggacgaggacgccaacgaggaggagaagaagaaggagacgatgaagcgcgcggcggggcagcagcagcaggaggagcaaaacaggtcgccttgattgatggcttgttcttcatgcatgcgtgcatgcatcgtctcttggttgatgaatgcgtgtcagcgtgtgtactgtatgcatggatgactctggatcagtcactcgtttattcacccaataccctggggattattatttgnntcatcgatgaacattttatggcgcataaacaataatctcatgcatgcaacatgg

SEQ ID NO: 21614 - DNA, 2162 bp, Zea mays
gattcacaggtgcctccagtcacttttaaccctcgggggccgctggtttttggctttttttgtcaacaaagatatttcttttttctttatttcttacaatctatgggcaaatgatttgccaatgtaaggctattctctggagctaaaaaaactttgatcaagatacacagggaagatcaaaatttttgaggttgcaccaaattattaatctaaaatactgcactgcatgtcccacgttccagaaatcaattgcaggccctccaaatggaattaaaatgaagagattagacataggcatgtaagaagctacatgagaagttctatcggaccttcagcttagcctaaaatgcccgtgggcagaagttacccatcaaggagtaaacagactcagcagaatttgccttctttatccttccttttggtcaagatgtacagttgataatgtaatagccctggtatgtcaacaactcatcacagcacaattgtacacaaagcttccggaacggcgggtgccaatgatcttccaatctggcagtccattattgggtacccaggaacaaatttcaatcaccccgctaccaccagcactcattgcaccaattacaatgagcatatctccacaactacggaaagcaatgccccagccatgaactgatgtatacctcccgggtaacaatccaagagtgatccatgcattattttccttgtcatatttcctaacctccttcgttgcatagtcagcagcataaagttcattattcacaacagcaacaagaggtggagcaccacttccaccattaagaccctgtgccatatctgggatcaagcgccaggtgctgctctccaagtcaaactcctcagcacaactaaggatctcattgtgcctctcagatttcccaccgatgacatagaacttgccatccatgaagaaaccagagcacatctgccgtgccctattcatgcttggaagagtggtccatgtctgcatctcagaatcataaagctcagcagagtccaatgtaccgttctggccaataccgccagctacaatagccttctcaccgaagcttgcggagccaaataagcaccttggtgtgttcatcatttctcctgtagtccaagagttagtgagaaggctatacctcagcacaacatgggcttccaccctcttcccaaagacgaggatgttggtgcccacggccagggattctttatcagcaagtgtgaagcattctatgggaggcatggaagggatgctgaaccaccgttggcggcgcggatcaaaaccttcccactcgagaacattgcatgagcagtagatcatctgctcgacgatcccagcctcacgcctcaacctgtaaagctccccaaacctcacaagggagtagaaagatcgattaacacatgccacatcataatagtaagaccggggaagacggagcaggcatgaaatggccaactccctgccgatcccgccgatgaggtcgcccgtgttgacttctccaccctcatcagaaccctccatctcggaggaccaggctctggctgcaagattcctcgaaccactgccggtcttgttcttcttcttgctataacaattcaccagaccctccacctgtcctcccttctgcgcccaccccacctgcaggcggtcgatcacgcagctcctgctcacagaaggatcctcttcagcgcgggtcaaatcaggggcagtgcttgatgaggttgccgagtctaagcccagtatcatgcgctggtcccccaacatgacctgagcacccttcggatttcacagcgaatctaccgtgatcctaaaggctgcaccaatcctccggcagccaaatccacagaaaccagcaggaaaaccagtcgcaggggcgggcgcagttaagggcctgggctgggtgtacacatgtacgcctggtgcggctcgtcgccggcgaaggggccgaagaagacctgccgaagggcccgacggggactgggcggcggcggctgccaggggtgcgggcgcccagtcgtcaccacagaggagagagagagagagagagagctcacgcggcgaggggaacgggagaagagaagaggcagggccgcagcccgcagggacaaacgcagaccggggtccgggtgtgtcgcccggcccctcgagggacccaatg

SEQ ID NO: 21615 - DNA, 2643 bp, Zea mays
tttggacagaaggatattagaccattgtcaacagaacaaacaggcagtcaggcacaaacttccacacaaattacagtaaataaatgtgatttctgtgcaccacttaaagcatctagttcaagccaacataaaataatttcaacatcgtagccatacaatatagactgactacaatacaccacgttcgagacataacatcacagtagtatatactgacgttgctgtgaattatttagaaaaccacaaagctacaaagtcataactcaaaggaaatgatcaattaatcagaattattgcaagtctaaatggaaactaatgtcccaagacattcacttgttccaaaactaaaatgttcattcacatatgaccaaaagcacatttccgcactcaagaagccaaattgagacaacattaacattatcagataccataggtaggataacaaggcacaactgatgagtgttcatactctacaggtcttgcaaaaaaacacattgcctccagtcacaattaaccaagaaaagacaaagggaaaatgcaacaattgtccacaaagacatttctttcctcttttatttcttacaatctatgggcaaatgatttgccaatgtaaggctattctctggagcttaaaaagaaaatttgatcaagttacccagggaggcagggaagatcaaaatgtttgaggttgcaccaaattactaatctaaaatactgcactgcatgtcccacgttctggaattcaattgcaggccttccaaatggaattaaaatgaagagactagacataaacaagtaagaagctacacgagaagttctatcggaccttcagcttagcctaaaatgccagtgggcagaagttacccattaagaagcaaaacagactcagcagaatttgccttctttatccttccttttggtcaagatgtacagttgatgatgtagtagccctggtatgtcaacaactcatcacggcacaattgtacacaaagcttccagaacggcgggtgccaatgatcttccaatctggctgttcattattgggtacccaggaacaaatttcaatcaccccgctaccaccagcactcatcgcgccaattacaatgagcatatctccacaactacgaaaagcaatgccccagccatgaactgatgtatacctcccaggtaacagtccaagagtgatccatgcattattttccttgtcatacttcctaacctccttggttgcatagtcagcagcataaagctcattattcacaacagcaacaagaggcggagcaccgcttcccccattaaggccctgcgccatgtccgggatcaagtgccaggagccattctccaaatcaaactcctcagcacagctaaggacctcgttgtgcctctcagctttcccaccaatgacgtagaacttgccgtccatgaagaaaccatggtgccgatctgccgcgccctgctcatgctcggtagggtagtccatgtctgcatctcagaatcataaagctcggcggagctcaacggaccactctggccgataccaccagccacaatagccttctcaccgaagcttgccgagccaaacaagcacctcggcgtgttcatcatctctcctgtggtccaggagttagttagaaggctatacctcagcacaacatgggattccaccctcttcccgaagacgaggatactggtgcccacggccagggattccttgtcagcgagcatgaagcactctatgggaggcatggaagggatgccgaaccaccgctggcggcacgggtcgaaaccttcccactcgagaacgttgcacgagcaatagatcatctgctcggcaatccccaccgcccgcctcagcctgtataggttcccagacctcacaggggagtagaaagaccggtcaacacatgccacatcgtaatagtatgaccggggaagacggagcaggcacgagatggccaactcccggccgatcccgccgatgagctcactcatgttggcctcactgttttcatcatcaccccccatgccagaagcccaggatttggttgcagaatcccacaaaccactgccagtcctattcttcttcttcttcttcttgctatgacaacaattcaccagaccctccacatgtccccccttctgcgcccgcgccacctgcaggctcccaatcacacagttcctgctggaagctctccggagagggtcgaatcaggggcagagcttgatgagctaaccgagtctaacgcctgtatgatgcactggtcccccaacatgacctgagcagccttggaatctcacagcgaggctacagtgatcctgaaggccgcatcaatcaatcttccggcagccaaatccacacagaccagcaggaaaccacttgcaggggcgggcgcagccaagggcatgggcgtacgcatgtacacctgatggtgctcgccaccggcgaaggtcccgacggaggctgagcggcggcggcggctgttgcccggtcgtcgggactcgggagagagggagagagcgcgtgtcacgcggcgaggggaatgggagaaaaggcagggccgcagcccgcagggacaaacgcaggccgtaccatcggggtccgtatgtttttcgattaggatgttctaggtaatggtctcgtgc

SEQ ID NO: 21616 - DNA, 1949 bp, Zea mays
ctgctcatcctcctaccaattttgttatgtttgaatggaccattacacaaactaaattacacaatcacctattatatgctaaacatatacatgactaatcactacacctataagctcatgaagacaatgggttatcatccaacttgtgtcctcctagatagcttaccttcagcttagcctaaaatgccagtgggcagaagttacccattaaggagcaaaacagactcagcagaatttgccttctttatccttctttttggtcaagatgtacagttgataatgtagtagccctggtatgtcaacaactcatcacggcacaattgtacacgaagcttccagttttttttttttttttggtcttccaatctggctgttcattattgggtacccaggaacaaatttcaatcaccccgctaccaccagcactcatcgcgccaattacaatgagcatatctccacaactacgaaaagcaatgccccagccatgaactgatgtatacctcccaggtaacagtccaagagtgatccatgcattattttccttgtcatacttcctaacctccttggttgcatagtcagcagcataaagctcattattcacaacagcaacaagaggcggagcaccgcttcccccattaaggccctgcgccatgtccgggatcaagtgccaggagccattctccaaatcaaactcctcagcacagctaaggacctcgttgtgcctctcagctttcccaccaatgacgtagaacttgccgtccatgaagaaaccagagcacatctgccgcgccctgctcatgctcggtagggtagtccatgtctgcatctcagaatcataaagctcggcggagctcaacggaccactctggccgataccaccagccacaatagccttctcaccgaagcttgccgagccaaacaagcacctcggcgtgttcatcatctctcctgtggtccaggagttagttagaaggctatacctcagcacaacatgggattccaccctcttcccgaagacgaggatactggtgcccacggccagggattccttgtcagcgagcatgaagcactctatgggaggcatggaagggatgccgaaccaccgctggcggcacggctcgaaaccttcccactcgagaacgttgcacgagcaatagatcatctgctcggcaatccccgccgcccgcctcagcctgtacaggttcccagacctcacaagggagtagaaagaccggttaacacatgccacatcgtaatagtatgaccggggaagacggagcaggcacgagatggccaactcccggccgatcccgccgatgagctcactcatgttggcctcactgttctcatcatcaccccccatgccagaagcccaggatttggttgcagaatcccacaaaccactgccagtcctattcttcttcttcttcttgctatgacaacaattcaccagaccctccacatgtccccccttctgcgcccgcgccacctgcaggttcccaatcacacagttcctgctcacagaaggaagctctccggagagggtcgaatcaggggcagagcttgatgagctaaccgagtctaacgcctgtatgatgcactggtcccccaacatgacctgagcagccttggaatctcacagcgagtctacagtgatcctgaaggccgcatcaatcaatcttccggcagccaaatccacacagaccagcaggaaaccacttgcaggggcgggcgcagccaagggcatgggcgtacgcatgtacacctgatggtgttcgccgccggcgaagggcccgacggcgacggaggctgagtggcggcggcggctgttgcccggtcgtcgggactcgggagagagcgcgtgtcacgtggtgaggggaatgggagaaaaggcagggccgcagcccgcacggaccggccgcgtgggcccccccggtaattcctgaccg

SEQ ID NO: 21617 - DNA, 1813 bp, Zea mays
gacaaatccccactccatccctcactccccccgcagagaaccctaatcgagaattcccgttgtcattcgtcagcgccccccactcaaccccgtctcagcctagcgcgccgccacaatgcaggccgccgccgccgtccgccacccgcgcctattcccgccgtccccgggcagctccgcgcagcaccggcgcgcacccagcaccgtgcgcatggcgctgcgcgaggacgggccctcggtggccatcgtgggcgccacgggcgcggtgggccaggagttcctccgtgtcatcacggaccgggacttcccctaccgcggcctccgcctcctcgccagcgagcggtccgcggggaagcgcctcgcctttgaggaccgcgagtacaccgtccaggacctcgcggccccgggggcgttcgacggcgtcgacatcgcgctattcagcgccggcgggagcgtcagccggaagtatgggcccgcggccgtcgccagcggcgccgtagttgtcgacaacagctccgcgttccggatggagcccgaggtgccgctcgtcatccccgaggtcaaccccgaggccatggcgaacgtccgcctcgggcagggggcgattgtggcaaatccgaattgctcgaccatcatctgcctcatggctgccacgccgctccatcgccacgctaaggtgttaaggatggttgtcagcacataccaagcagcaagtggtgcgggtgctgcggcaatggaagaactcaagctgcagactcaggaggtcttggaagggaaggcgccaacatgcaacattttcaaacagcagtatgcttttaatatattctcacacaatgcaccagttcttgagaatgggtataacgaggaggaaatgaaaatggtgaaggagaccaggaaaatttggaatgacaaggaggtgaaagtaactgcgacttgcatacgggttcctgtgatgcgcgcacatgctgaaagtgtcaatctacagtttgaaaagccacttgatgaggatactgcaagagaaattttgagagcagctcctggtgttaccattattgatgaccgagcttccaatcgctttcctacacctctggaggtatcagacaaagatgacgtagcagtgggtaggattcgtcaggacttgtccctggatggtaaccgagggttggacatatttgtgtgtggtgatcagatacgtaaaggcgccgcactcaatgccgttcagattgctgaaatgctgctgaagtgaatgtgacctaaccctcttgtccctccctccctgtccctaattgctctgatcaaatgctggactgtactctgattagtttgtcctcaattttggtcgcctgttctgtattctgccgtgctagtgcaataattgtgttatgggcttgagttatctgctgtacgcataagtgggctcctaaactgggaaataatgggccgtccttattcagcattccggtttatatcttgttcagattcgtctaacagcccagcagtgccgggttctgtggatcacagggcccaaagtgtcctacgggatttacactttcatgtgcaagaatagggtctgattgtaacctgacccagaaggtactgggaagttctcttgagcaggaagcatctgttgcaggtctgaaagaaactgtgcaacgataagacattagagttgagaggaaagagggcgggttagcccgtaaatttctgtgatcgcatgatgtgttgtttgccagtatatgtaatcctttgtttcaagtggatttaggttgtttgtggtggtccttaaaaaatataaaaaaaccccccccccccccac

SEQ ID NO: 21618 - DNA, 1537 bp, Zea mays
gactcttgacctttagataatttagatgacacaaatttaaatatcgtaagatttacctattgagagcgatgaaaggatttatatattttgaggtttagaaagcgttggattctcctctcacaacgacttagcgaattctccattcaaccgatttttacatagtgttttttatagaagcgggatttttacatagtgacttttatagaagcgggctaaaacgtgagataagaagcgaagctttagctaatataaaaactgattctgacgataaatcaaaccagaaaacaaacatgaccaaagccagtttcgtgacggcgctcacgacacatcgcctgtcagataccggctgtgaacatggcatcgcagaatcaagttgcagcagcaaaaacccaaactgatgttgtcttcttcgagagttcacggattagtgcgcgcccacggcccacaaatgacaaaaccccacttgggcccccacgccggccgggaaaaccctaatcgacattcccgttgtcattcgtcagcgcgccccctcaaccccgtctcagcctagcgcgccgccacaatgcaggccgccgccgccgtcgtcgtccgccacccgcgcctattcccgccgtccccgggccgctccgcgcagcaccggcgcgcacccagcaccgtgcgcatggcgctgcgcgaggacgggccctcggtggccatcgtgggcgccacgggcgcggtgggccaggagttcctccgcgtcatcacggaccgggacttcccctaccgcggcctccgcctcctcgccagcgagcggtccgcggggaagcgcctcgcctttgaggaccgcgagtacaccgtccaggacctcgcggcccctggggcgttcgacggcgtcgacatcgcgctattcagcgccggcgggagcgtcagccggaagtatgggcccgcggccgtcgccagcggcgccgtagttgtcgacaacagctccgcgttccggatggagcccgaggtgccgctcgtcatccccgaggtcaaccccgaggccatggcgaacgtccgcctcgggcagggggcgattgtggcaaatccgaattgctcgaccatcatctgcctcatggctgccacgccgctccatcgccacgctaaggtgccactgtgggctctctccgccctcctgggacgtcggaactccgaagcaccatccgtttctcaataaatttgatttggatcgacagaatgctgatgctgaagaactgtgtaatccacatgtcatttgacggtggaaaccaaatattgatctctggaattatgcttcctaatacgtaataccgaactgaagtgcgatatttacaaaataaaagtagacatctgtatacagtacccgcatagatgaagcagtacatatagtcaaacatctgacagtctaattttagttttaatcagtcttgaggttcgagatcatagtaacattccacaatattgtaaccacttactttccagatagtatttgactgtgttctgaatcttcaacattgcagtgaaattctagccagcaaaa

SEQ ID NO: 21619 - DNA, 3990 bp, Zea mays
  misc_feature (3423)..(3423): n is a, c, g, or t
cactgtagatttttccgataagtagaaaccaaatatttcaccgccacaaaaggcttcatcccatcagttacccatgtagcaaaaccaaaatacttgtgtgcgagaggccaagagcccaaaccaccgccaaggaaacccccagcccaccaggcgccttcctctataaataccctaactccggtggccgaagttcctcacccattcactcactcatctcaaggcctaggtagcaccgtagcagctactagaagcagctagccagaacaactcgtccatggcgatggcctccgcggcttgctcatgcacggacggcacgtggtgggtgtacgcgctcccggcgctgctcggctccgacaccctgtgcgcccacccggccctcctggctggcctgatctttctggccaccgtctcggtggctctgctggcgtgggccacgtcgccgggcggtccggcgtggacgaacggccgcggccgcctcggcgtcactcctatcgtgggaccccgtggtctgcccgtgttcggcagcatcttcgcgctgtcccgcgggctgccgcaccgcgccctcgccgagatggcccgcgccgcagggccccgggccaaggagctcatggcgttctccgtcggtgacacgcccgcggtcgtgtcgtcctgcccggccacggcacgtgaggtgctcgcgcacccgtcattcgccgaccgccctgtcctccggccggcccgggagctcttgctcgcgcgtgccatcgggttcgcgcccatcggcgagtactggcgccgcctccgccgcgtcgcgtccacgcacctattctccccgcgccgggtcgcctcgcacgagccgggacgccaaggtgacgcggaggccatgctccgctccatcgccgccgaacagtcggcctctggcgccgtcgccctccgcccgcacctccaggccgccgctctcaacaacatcatgggcagcgtcttcggcacgcggtacgacgtcacatcaggcgccggcgccgcggaggccgagcatctcaagagcatggtgcgcgaggggttcgagctcctcggcgccttcaactggtccgaccacctcccctggctcgcccacctgtacgacccaagcaacgtcacccgccggtgcgccgcgctcgtgccgcgcgtccagaccttcgtccgtggcgtcatcgacgagcaccggcgccgccgccaaaactccgccgccctcaacgacaatgctgacttcgtcgacgtgctcctctccctcgagggtgacgagaagctcggcgacgacgacatggtcgccatcctctgggtaaagttcaaatcgatcgctttcctagcttgtttaactgcgcatacttctcagttctcaactgcgcatacctgtcggttctacagttttgtgtcgggctgtcggttgttcccggaagggaaaaaaaagaacaaagctctgtcgctgaaaaaaacatactgtacatgcatataatttgtttttgcaggagatggtcttccgcggtacggacacgacggcgcttctgaccgagtggtgcatggcggagctggtgcgccacccggcggtgcaggcgagggtgcgcgccgaggtcgacgcggctgtcggtgccggaggttgccccaccgacgccgacgtggcgcgcatgccgtacctgcaggcggttgtgaaggagacgctgcgcgcccacccgcctggcccgctgctgagctgggctcgcctcgccaccgccgacgtgccactctgcaacggcatggtggtcccggctggcaccacggcgatggtgaatatgtgggccataacccacgatgccgccgtgtgggccgacccggacgcgttcgcgccggagcggttcctgccctccgagggcggcgccgacgtggacgtccgcggcgtcgacctccgcctggccccgttcggcgccgggcgtcgcgtctgccccggcaagaacctgggcctcaccaccgtgggcctctgggttgcccgcctcgtgcacgccttccagtgggccctgcctgacggcgcggcggccgtttgcctcgacgaggtcctcaagctctccctggagatgaagacgccgctcgtcgccgcagccatcccccgcaccgcctgatccgtcctgccgccgacgcgtcacgtcacgcgttgtttgcatggatgatggtatctttgtctgtctgtgtggtcttcgctaaagtttgcttcttctcgatcgtcggttcgttcgtgcctccaccttagcctagggtttggtttcttgcaaggtagtgagtgtgtcttagtctcaccatcaccggggctccaattttggaaagctgcgtgttaggagttaacccctagacatgtttgcgtcttgatcgccaccacccatcagtatcagcgcagaaactacatatagatcagtgtttgtcgaccagtcatggaagtcgtgtgctctcaagtctgatgtattatatacatatatatgtattgtaatgtgattatcaagaaccgtgctatttacatattgctgtttaattgaacgtaattaactaaatgtcccttatatatatgtccagatcggccactaattaactagttattttacaaatatttacaagtcggtcgtcttaagaaatcaacgcacttcaacagtattgagccgtctggtgtcaaatgagacttgcgttcactaaagaacttaatcaggttctttttgaagcacgtatttcgattgcctgctgctggctgtaatatatcaattcaagcacttaaacaggttctttttcagtgcaacaagggatgtagaggtgccatggtttgggtaagcactcatttctgtggtttatagttcgtgagtagttccttatgtgtttgcctgcccctggttgtaatatatgataatgcagaacaatctcttgcaatactatagggccctccattctaatttatagattgttttggcctagtcgattaactgttcatgaacatctttattggatggactaaccaacgtcggcctaagtctaggggaaaaggcccaaccagcgccatgagtagatcagcctgcaccagcgtgaacagtgaaggcaggcccaaccagcgccagcatcagatcagcccgcaccagcgcgaacagtagacgagtgaatagtaaccgagtgaacgaaggcaagagctaaataaatatgacagtttctatatttgtatatttatcttaggagtcaagttgattagtttctatatccattggattagagtttaggtaagttaaatatgtaacttgaggaccaaattgatgcctgccaaggctatataaggacctagattatactctcttaaattgagtttcaatccaatctgatgacaaaatcacggcacagaccaccgaggtgtcctccctgaaagtcgaccaggttgtttgtattcacatcgccgtcaacaatatncagtcccaaacaagtggatggtaagcacaggctcactacggaccacatcgcctctgccagcaacacctacgcaaggtacaaggttgtcgtcaccttcatcaacagtactaaccacaagctatgcttttcccaagtaggacggcatgagaataatggcgatgcgaggagagggctctacgggctcactaaggtggaaatgagaagaagaaaacgagaagggcatgaaaaggtcaaagttatatggcgacactttaaatgagaactgaaaaacacctttaatacaagttcttagacgtgtgagcgtgaactccaaagggaaattgaaagtgaaattggtactaaaaacctttagggtcgatttggtcacaaggggctcacgggggattggaggggattgagtgaaaaataaactaattttcctcttaatatccttcaatcgccccgtgattcatggacaccaaatcagctcttaaagagaaatttaaagtgaacatttagtatcggttcatgaaaaaactgataccatagggggtctccagagagatgtcagacgaaagaggggtgttc

SEQ ID NO: 21620 - DNA, 2270 bp, Zea mays
  misc_feature (2212)..(2241): n is a, c, g, or t
  misc_feature (2251)..(2257): n is a, c, g, or t
acccattcactcactcatctcaaggcctaggtagcaccgtagcagctactagaagcagctagccagaacaactcgtccatggcgatggcctccgcggcttgctcatgcacggacggcacgtggtgggtgtacgcgctcccggcgctgctcggctccgacaccctgtgcgcccacccggccctcctggctggcctgatctttctggccaccgtctcggtggctctgctggcgtgggccacgtcgccgggcggtccggcgtggacgaacggccgcggccgcctcggcgtcactcctatcgtgggaccccgtggtctgcccgtgttcggcagcatcttcgcgctgtcccgcgggctgccgcaccgcgccctcgccgagatggcccgcgccgcagggccccgggccaaggagctcatggcgttctccgtcggtgacacgcccgcggtcgtgtcgtcctgcccggccacggcacgtgaggtgctcgcgcacccgtcattcgccgaccgccctgtgaagcggtcggcccgggagctcatgttcgcgcgtgccatcgggttcgcgcccaacggcgagtactggcgccgcctccgccgcgtcgcgtccacgcacctattctccccgcgccgggtcgcctcgcacgagccgggacgccaaggtgacgcggaggccatgctccgctccatcgccgccgaacagtcggcctctggcgccgtcgccctccgcccgcacctccaggccgccgctctcaacaacatcatgggcagcgtcttcggcacgcggtacgacgtcacatcaggcgccggcgccgcggaggccgagcatctcaagagcatggtgcgcgaggggttcgagctcctcggcgccttcaactggtccgaccacctcccctggctcgcccacctgtacgacccaagcaacgtcacccgccggtgcgccgcgctcgtgccgcgcgtccagaccttcgtccgtggcgtcatcgacgagcaccggcgccgccgccaaaactccgccgccctcaacgacaatgctgacttcgtcgacgtgctcctctccctcgagggtgacgagaagctcggcgacgacgacatggtcgccatcctctgggagatggtcttccgcggtacggacacgacggcgcttctgaccgagtggtgcatggcggagctggtgcgccacccggcggtgcaggcgagggtgcgcgccgaggtcgacgcggctgtcggtgccggaggttgccccaccgacgccgacgtggcgcgcatgccgtacctgcaggcggttgtgaaggagacgctgcgcgcccacccgcctggcccgctgctgagctgggctcgcctcgccaccgccgacgtgccactctgcaacggcatggtggtcccggctggcaccacggcgatggtgaatatgtgggccataacccacgatgccgccgtgtgggccgacccggacgcgttcgcgccggagcggttcctgccctccgagggcggcgccgacgtggacgtccgcggcgtcgacctccgcctggccccgttcggcgccgggcgtcgcgtctgccccggcaagaacctgggcctcaccaccgtgggcctctgggttgcccgcctcgtgcacgccttccagtgggccctgcctgacggcgcggcggccgtttgcctcgacgaggtcctcaagctctccctggagatgaagacgccgctcgtcgccgcagccatcccccgcaccgcctgatccgtcctgccgccgacgcgtcacgtcacgcgttgtttgcatggatgatggtatctttgtctgtctgtgtggtcttcgctaaagtttgcttcttctcgatcgtcggttcgttcgtgcctccaccttagcctagggtttggtttcttgcaaggtagtgagtgtgtcttagtctcaccatcaccggggctccaattttggaaagctgcgtgttaggagttaacccctagacatgtttgcgtcttgatcgccaccacccatcagtatcagcgcagaaactacatatagatcagtgtttgtcgaccagtcatggaagtcgtgtgctctcaagtctgatggtattatatacatatatatgtattgtaatgtgattatcaagaaccgtgctatttacatatcgctttcctagcttgtttaactgcgcatacttctcagttctcaactgcgcatacctgtcggttctacagttttgtgtcgggctgtcggttgnnnnnnnnnnnnnnnnnnnnnnnnnnnnnnctgtcgctgnnnnnnncatactgtacatg

SEQ ID NO: 21621 - DNA, 1638 bp, Zea mays
ctgccgtcccgcttccagaaagaaccgatctaaaacctccccgccacgcgaagcaaaatcgcgtgccttcccctcgacagattcacttccctccttcccactccaagcaccaagctaccaacccgaactgcctcccggccgcgccggtcactgcttccgccgcgccgcgtcgccactcgccaccccgcgcgcactagtctttgccatggcgctgcgtggcagcatccaaatggatacgggaagcgggcccgcgctccagtacctcctgtgcctcgcctgggtcgcggcgaccctccccatcgccgccgccgcgctgccgatccccgcggccgctggcggcaggttcatccacggcctgctctgcgccttctcgtcccgcgggaagacagtcaggccctcgtcctcgtcctcgtccaaggcgaggttcaccgtttcacaaaaatgcttcttgcatttttacgtggtgggtgcggttgtgacgactagcttgctacttgcaatatggttctatgcatacatgaaaatgacacctttgatgccagaacaatcgagttactccacaattgctagtcatcttgttggtggttcaaattcattccatttggcaaatttctggtcatcacgccccatggaacacaagtatcgtgtctggcgtactgtatttgtacttatattgatggaaattcaggtcctgagacgcctatatgagactgaacatgtcttccactacagtccttcagctcaaatgcacatcataggatacctaacgggtattttctactatgtggccgcacctttatcacttgctagttcttgtcttcctgaagcaatacagtatcttcgatatcaaatagctgagttcatagtgaagggtagagcaagaatgccagatctatcaattgacccatcacatctcttgaagcctcttctaaagttggggtggtgccagtggattggtgctgttattttcatctggggctcactccatcagatccgctgccatgcaattcttggatcattgcgtgaacacaaagattctgatgaatatgtaattccgtgcggtgactggtttagtcgtgtgtcttgccctcattaccttgctgaactagtaatatattttggcatgttggtggctagtggtggatcagacattccggtgtggttcctgtacctttttgtgataacaaatttgtcctttgcagcggtacaaacacataaatggtatcttcagaaatttgaagattaccctcgttctcgctacgcaatcgttccatttgtatgctagatgtccccataaatgccaacagcatttgttgtctgttttcatctgcttgcaccagtcaggcatgcaacagatattgatgtaaatgtgactatgcaatgttgaacttaagtagttccgatcattctgaatgtgcttagaaggttataaggttatgtttgtgtatgtagattataacacacagatatttgatgtaaagtagtattaattaatactttttagcattaatgaaaatgaagtccttcagaaccagaggcttatcaaggactagtgaccatctaactgatagtgaaacaaatggtgttattgttcctcataaaaaaaaaaaaaaaaaaaaaaaaaaaaaaaaactcgag

SEQ ID NO: 21622 - DNA, 1475 bp, Zea mays
tggtatttccctaccatgattttttttctgatacactaggaaagtaatatcattgtagtcttattaaaatattaaaatgatgaaccctgccatttgtacacttctttactgaaatagcatcatccccaatgaaacgcgaggaataaaaaagcaatggtatacagagtatctatacagcacaaacgaatgcccatttttcatgcctctgcaaatctgcgctgcctatactacaacagtacaacttgtgcacctctctcttgagagagagagaaaaaaagttcatacggcaatcaaagttacagcatgatcaggcccatccacttggacaacccgcccggtgcatggtgatggtcacacaaaccatatcaagcaaagagccgccgccttctccgcctgcctgccgccttcatctccgggccgtcggcagactccccatgcaccacctcgtccaccagctccttgaataccgacctctcgatctccagcaccatcccagggagctccctgctgaagctcgtccatccctgcagcctctgcaggatctctgcgtcaggtatcacgcctccttccatctggcaggtggacgatcgctccgtacccatgccttcgatttctgaagatacaaacttcagcagttgctgcccgctaagagcctttgcaggtggatgatccttcgctccggtggaggaactgaccgcgtaaactgtggtttccttctcaaacttctggaggagaagctcgttcgcggtgtcaaacaccagcttccggtgcgctctcttgggatcagacttggcgccgctcctgctctggtggatgccgtcaggtatgctggcccatcctgcctttctttgctccagcacgtggaacaagtcagggttgatcgggtagccagaggagtggagctggagctggaggcctgcctgtcctgaacctagctctttcatcagaagacccgaggccagcagtatctcagacacgtaacggtggtccgggctttctgtctcgcacaggaaagccatatggtcgaccggaggtgcgtcctcatccttgctcacgctaagctgctggagcttctgaagcaggctcacgacattagcgagcttattgttcttggactgcatgcccacctctgttggctttgtaacagaaggtttccagggttcacctaatgtttgacgctcgtcatctgcagcaagtggggttcgatgcagaagtcaatgcctgggtgacgacaaattcagtaaacaatcatgcgcgcgctagttaatcgttctagcacgtctcagtttacagatagcaagtgaagttagctaagagctcaaacattctcctagtctttttcatttagggggtctctaatgttgctgtcgtgtaaatttcacttactgttgtcaaatttgtaaactataacctatgcaatacttgagattgaattcacactgcatggactgatttatttacacgtccttaatgat

SEQ ID NO: 21623 - DNA, 1972 bp, Zea mays
ttttttttttttttttacgaaacggtcaggtagaaaccagacacaacggacttcacaaggtaatacagagtatctatacagcacaaacaaatgcccatttttcatgcctctgcaaatctgcgctgcctatactacaacagtacaacttgtgcacctctcccttgagagagaaaaaaaagttcatacggcaatcaaagttacagcatgatcaggcccatccacttggacaacccgcccggtgcatggtgatggtcacacaaactatatcaagcaaagagccgccgccttctccgcctgcctgccgccttcatctccgggccgtcggcagactccccatgcaccacctcgtccaccagctccttgaataccgacctctcgatctccagcaccatcccagggagctccctgctgaagctcgtccatccctgcagcctctgcaggatctctgcgtcaggtatcacgcctccttccatctggcaggtggacgatcgctccgtacccatgccttcgatttctgaagatacaaacttcagcagttgctgcccgctaagagcctttgcaggtggatgatccttcgctccggtggaggaactgaccgcgtaaactgtggtttccttctcaaacttctggaggagaagctcgttcgcggtgtcaaacaccagcttccggtgcgctctcttgggatcagacttggcgccgctcctgctctggtggatgccgtcaggtatgctggcccatcctgcctttctttgctccagcacgtggaacaagtcagggttgatcgggtagccagaggagtggagctggagctggaggcctgcctgtcctgaacctagctctttcatcagaagacccgaggccagcagtatctcagacacgtaacggtggtccgggctttctgtctcgcacaggaaagccatatggtcgaccggaggtgcgtcctcatccttgctcacgctaagctgctcgagcttctgaagcaggctcacgacattagcgagcttattgttcttggactgcatgcccacctctgttggctttgtaacagaaggtttccagggttcacctaatgtttgacgctcgtcatcaacagcaagtgaatttggattcctgctgctcgggaacaaatcctcatgatcaaatgaagagtccaacacagacattggactgggccgttccgaaataccagctgaagggtctacagatggcacgtccttgcttgcatcatatgaggttttcactttttgtgggttccttccggatggagttccaatgccttgatcaaaattagaaatatcaacttccgtagatctgtcattgcttataatatccagctctgaagcaacagttatactgccatctgaccttgtggacatatcattgccatgctggttcaggctccttgtcctgttgttcaatccactcggcatgccatcatcaccttcttgtggacacaaaagtttccttctgaatttgcttcggggtgacactgtttctgcattattcctatctccagattgcctttggcttttgttagactcagcacaaggaataggtggtctagccctccgctctgaaccaagttttctctgttgtaaccttggggtagtggaatgtttattctttttcatacttatgctactgtcccttggtagctgctgtcttctggatgagctctcagtaaccagtagtgaactagatttttggttgttgctgctatcgtcattccttacatatgatctcctgtcataagaaacaaggggttgagaagtaggcacctttgaactaaattttgcatgtggctctttagctgttctatttctcgttgaagctttccttctataggtgctattgcttgtttgtggttgtgggggatcagatgaaccccataaggggaagacagaagaatcaacttcgttgaaaaggtttgcacattttgaagatttcatgcccggccggcctcgagggtccc

SEQ ID NO: 21624 - DNA, 6068 bp, Zea mays
  misc_feature (282)..(282): n is a, c, g, or t
  misc_feature (325)..(325): n is a, c, g, or t
  misc_feature (1310)..(1310): n is a, c, g, or t
tcggttgtgccactaggtccccaactctcaaaacgaattttgaagtccctaaacttgttcatggacacgccacatgtccaaacagatctaaacttgcgtcatgagcctacgtggggctactgacatggataaatgatgacgtggtgcatccttcaggcactagattttttgttggcgtcaagtttcttttgacaatttgactcccgaattgctttataaaattttaaggtatatataagtataagcatggcaccaaaactaatttgacaaaatttatagccnatttttaaaacaaattcaatttttatacagtatctcaaatganatattttataccatattatcataccataaatttatactagaattgcatgtgaaggattatgccggaatcacaaaataaatatgaaccaacgtatttgttataaatatgactacaaataattcacattatcaaaccagaaatgccattaagtgtgctgagcgacggctccgagatcgctggtagtcatatttatacctccacacttcttcatatttgttttgcgattatgatataatcatccacacgcaattctaccataaatttatagtatgataatgtggtaaaaaaatatgtcatctgagaggagtacattcttcatatgtttctcgttattgtataaaattcaaatttgtttttaaaaagtttaatataaactttgtcaaattagttttggtgctagactcatgcttatatataccataaaaaatttgtaaaacaatttaggatttaaattgccaaaaaaacttagcgccaacaaaaagtctagtccttataggatgtgttacatcattggttatccatgtcaacagcaccacgcaggcccatgctacgggattggatctgtttggacgtgtagtgtgtcccggaacaagtttagagacctaaaaattcgtttaagagcatagggacctagatgacatggtcgaacaagtttcgagaccttgggtacgaatgacacgattgaataagtttagggatctatagtgtactttacttttttccatgacaactttggtctttcttagtggttttttctattgctactgcaccttaatatcccctatgcctagtgcgtttaaagatctctgttggctatgtctaaattatattaaccggtgttgaacaagtttctggttttttctattgctattgcaccttaatatcccactatgcctagtgtgtttaaagatctctgttggctatgtctaaattatattaaccggtgttgaacaagtttctctttaaatatagctaatccgtagcntatcatgtatgtcactattctagactcaatctctttttatatgaccataaattcaatgcaatatacaaatttttacaacacttatctgctgaacatgttatcttttttatagataaatattatgcatcatacaacatagtggtctactcatcatcgtatataatttgccttttacatggcaaaaaacaactgtcattcgtccattttttttactgaaatagcatcatccacagtaaatcacaaggagtcaagaaacaatggtatacatagtatctatatatagcacgaacgaatgcccattttcgggtctctcaccaaatctgcgctaccccctctctctccctcttctcttgagatgaaatagggtctcactctcatggcaagacaaacaaagttacagcttcacaaatcaggcccatccaaatggtggatggcgatggtcaaacaaaccgtatcaagcaaagagccgccttctccgtctgccagcagccttcatctccgggccgtcagcagactccccatgcaccacctcgtccaccagctccttgaatatcgacctttcgatctccagcaccatccccgggagctccttgctgaagctcgtccatccctgcagcctccgcaggatctctgcatcaggtatcacgctgctgtccttctggctgatggacgatcgctccatatccagttcttcaattcccgaagatatgaacttcggcagctgttgcccgctaaaagtctttgcaggtggatccttcgctctggtgaaggaactgagcgcataaacggcggtttccttctcaaacttctgaaggagaagctcattcacagtgtcaaacatcagcttccggtgcgctctcctgggatcagattttgtgccgcttctgctctgatggatgccatcaggtgtactgacccatccagccttcctttgctccaacacgtggaacaagtcagggttgatcgggtagccagaggagtggagctggagacctgtctgtcctgaacctaggtctttcatcagaagaccggaggccagcagtatctcagacacgtagcggtggtctgggctctctgtctcacacaagaaagcaatatggtcaaccggaggtgcatcctcatccttgttcacgctaagctgctggagcttctcaagcaagctcgcaacatttgcgagtttattgttcttggactgtatagcgacagatggtttccagggttcctctaatgtttcgcgctctgcatgcctgcaggtttcagggaacaatgcttaagtcaatgtctggctgacaaaaaaattagtaaacaatcatgcacagtagttaatcattctagtacatctcagtttacaaatagcgagtgaacttagcaaaaaagagctcaaacattctcctaggcggtctaatgttgctgtcgtgtagatttcactcattgttgtcaaatttgtaaatctattataacctatgcaatgcttgagaattgaattagcactgcacaaactgagttatttacacatctgtgatgatttgatgaattcaattatagtccacgagtatttatgcactactagtaaaattttagagtgtgtgtccacaaagctagatggttcagtatcactgaacttacactgccaagaatttaactgatgcattgtgcagtatattgtgcttcaaacacacagagaaaagccatgttgatgtaaaggatataggagaacattgatttggtaggtgcaaactgcaaagtagagtagtttttgcttctgttgccactttcattctttccatctaaaggacttgtaaaggttttagttgctgcttatgcaacattaaactaaccaagatggcatgtgctataaacatgtaccacgaaacccctgtgatgcttgactagtgtgctagtaaacactgccatctacaaattttggcatcaaaatgtgcataatattttacagtggggtcagtataagcatttgggatgtacaaaatggagtacacatggaactttgggttcaaatgttgctaggacagtacaatcggcaactagaatagacaataggtaaattgaaacattaaagaagtgaaacaaagaaacatatttgagcttccagttgctatggttgacaaaagaagtatggagagattgtaaaaaggttatcataccaacagcaagtgaatttggagtcctgctggtagggaacaaatcctcctgatcaaatgaagagtccaacacagaaactggactgggccgttccgaaatagcagctgaagggtctacagatggcacgtccatatttgcatcgtatgaggttttctgaagacacaaaccataaaaatgagacatgcagcatcgtatgtcatgcgatttaattttccattctcgtttcctggcccaacaacaactagcatttggagagagattaatacaagaccaaaaacagatactatttccattacatattattattttctccatagtagttaagtattggaaatatacattatcatcttaaattagtgaagctttagaaagaaggcataattgcaaggaaattctttaccactttctgtgggttccttccagatggagttccaatgccttgctcaaagttagaaatattaactcctgtagatctgtcattgctttataatatccagctctgaagcaacacttatactgccatctgaccttatggacatatcattgtcatgctgatacaggctccttgtcctgttgttcaatccaatgggcatgccatcatcaccttgtgggcgcacaagtttccttctgaatttgcttcggggtgacactgtttctgaattgttcctatctccagattgcctttcgcttttgttagactcagcagaaggaataggtggtctagccctccgctctggatcaagttttctctgtagtaattttgggctagtggaatttttgttcttttgcatacttacgctactattccttggcagctgctgtcttctggttgagctctcagtgaccagcagtgaactagatttttggttgttgctgctatcatcattccttccatatgatctcctgtcacaagaaacaaggggttgagaagtaggcacccttggactcaatttcgcatattgccctttggcggttctattaatcgttgaagctttccttctatcagtgctattgcttgtttgtggctgtgggagatcagatgaacctcctaatgggaagacagaagaatccactttgctgtaaaggtttgcagattttgaaggtttcattatcacaataggcgatttgaaagagctttcagcgttgctctcttcaggcatccacatgttgttggtgttacggttcagtctcatgttcgcactggccatctcttggtcatcatggtttccattatatagctttggcataaatgcttcctcccgtttcttattttctaatagtccttttgcagaatccaaaatctgtttaagtgctctaaggtcttggtggcccggccggcaatcaagatccttcagctggttccatggtgcagcaggttctcttccgtgggctccttttgatccctttggcagttttcgtggaaggacaatcctttcttgttgcttccatggtgcagtttggacagggaacttagagttgggtaaatttcttacagttgaatcaggattcctttcttgttgaggagcatgctcgtactggtaggagatgctcaaggagttcaacatggcatcttgcttgttctcttgaacggtattgcatgcatgtgatgatgctgtactttgattatgctctggcaactcttccaaacccatgagctttgcaacaacgctaggaagccgcttgcaggcaggctgttcctgctgggtctcgaaagctgcattggacccagtaacagtgttgctgtttctgtctgcagaactcaagcttgggtccaacctagagtcaatttcacgattccaaaggtgaccttccttgatgtccaatgacaacctcggtacctccctcaattttgatgttgcttcctttccatcgtatgagaaccgaggagcatcatatgagagtcttgcatgatgaacagattcaggaggagtccacgaggcttccctgagcttggctagcactcgaagcgattcgttgatgtccatgagacccttgctttttccttgtgtactgtcatggtgaggcccattcaattgcataggttgatctccacagttggatgggtgatcttttacttcttcttcagtgctaattctgactgacaattcatggctatccttgtagattgaatccttcacaagatttcttataccaagagttggcaggctggattgaactatgggcatgttcttggacttggtaagcgcatcatcagggtagtcgagtccattgtcactgtcaaaagaactcttgagcttcggcgagctcttaaacggcctctctggaaatagcattcggtcagtggatgataggtcttgttgtgttgacctgttgccatcaagggatgagaatgacgaagagggtgatgatgaatatgaggtttgagatagttctgttgctggtgctctttggctatcagcccaagttttactcgagttcttctcctggatgcagtttgcagtaactcaagtcaggatttgtgtgccagtaaaaaacatatataactactctactgcagataaaattcagaaacttaccagaacaacctggggtgaatatctcgtgcattctccccctttgcttggattgctgggtgca

SEQ ID NO: 21625 - DNA, 5220 bp, Zea mays
  misc_feature (1234)..(1234): n is a, c, g, or t
aattcggcacgaggccgcctcggtcccttctctcctgtcgttcccccctcccctggcgattagctcccgcccgcctcccgccccgctccccaccgcgctcgctgcgctgcctgtcctggcgctgcgtcctgcggcgccgcgagagttggagggtgctcgtggcgggcagatccggcgtcggcgtcggcgtcggcgtcggcagacaggctcggaggtgagatcggcgtcggtggcggcggcggagcgcgcgaggtggtcgagggaggaatcggtggcgcgcggaggcgaggacgaggctgaggaggacgtcgagctcggctggtgctgcatgggggtatgaagcgcggcgccagagacgacgcactcatggggtcacagctcaagcgcccgaacgttggccgatccgatccgtcggctcagccacaacacatgcctgtgcccggtttagcgtctgcagccgcaccgccgcctcaagctggtgctgctccgccggcgcagccgcaacagacatccggcgcggccttgaccaaccagaagctgacgacaaatgatgcgctcgtctaccttaaggcagttaaggataagttccaggacaagcgggagaagtacgaggagttcctcgaggtcatgcgcgacttcaagagcgagaggatcgacaccaatggagtgattggccgtgtcaaaacgctggtcaacgggtaccctgaactgatccttgggttcaacgccttcttgcctaagggctatgcgatcaagctacaagaagagaagaaacctgtcgattttgtggaagctatcaatttcgtgaacaagataaagaatcggtttcagcatgatgaacaagtttacaaggcattcttggacatcctcaacatgtaccgcaaggataataagtctatccaagatgtttaccatgaggttgctatgctgttcaaagaccataaagatttgcttgaagagttccagcacttcctgcctgatacttcagtggctccacaagcagtggcctcaaagggtggtttggttaagcgggaggacaggagctctttagtgcctcctgcaaataagatccttcacaatgataagagggacagagtttacctgtcacatgctgaccgtgattttagtgttgaccgtcctgatgtggagcatgatcgccagagaagacgtcttgataaagacaaagaacggaaggtggaaagggacagaagggattatgagagagaagacaggnatggtgaacatgacagcagagacctggagctaggacagcgtaagcgaaagcctttttcaaggaatatcgaggataatgtaggtgctgagacacaccaaggaggccccagtgagaatcatggaatccacagtgtatctgcttcatcatatgacgataaggatgcgctgaagagtgtatacacacatgagttccatttctgcgagaaggtgaaggaaaagctggcccgggcgccctcctccgagtttttgaaatgtctacacatctacagccaagagattatcacgagaagtgaactgaagaacttggtgaatgatatactccagcattatccagatcttatggaagggtttaatgaattcttggaacattgtgaaaatatagatggatttcttgctggtgtcttcaacaaacgcccaacaacaaggattgttaaaactgaggataaagaaaaggatagatcgggacagggaggacagggatagagatcgggaaaaggaaagagagaaggaacgagaaagactcgataaagggtcaacattcaattcaaaggacggttcttgtcacaaacctcctatgttttctggcaaagagaagtacaacctatccaaaccaatatcagagcttgatctctcaaactgtcaacgttgcactccgagttaccggcttctacctaaaaattatcccatgccccctgccagcaacaggactgatcttggagcctctgttcttaatgatcactgggtatcagtgacatccggaagtgaagattattcatttaagcacatgcggaagaatcagtatgaggaaagcttatttagatgcgaggatgacaggtttgagttggatatgctgttggaatcagttaatgcagcgactaagcgtgttgaagagctgatagaaaagatgcaggacaactcagtcaaacctgagagtccaatacgcatggatgagcatttaactccgttgaacctgaggtgcattgagcgactgtacggtgatcatggtcttgatgtgatggatgttcttcgcaaaaatgctagtgttgcattgccagttattctaactaggctcaaacagaagcaggaggagtggtcaaggtgccgatcagatttcaacaaagtttgggctgaaatatatgccaagaattatcacaagtcacttgaccatcgtagtttctatttcaagcagcaagatacgaagaacctgagcacaaagtctctcctgacggagataaaagaaattaatgagaagaaaagaaaggaagatgatgtgctccttgccattgctgctggaaataggcgacctatagttcccaatatgtcattcgagtatatagactcagaaatccatgaagatctacataagatcattaagtactcctgcggtgaagtctgcaattcttcagatcaattagataaagtgatgagaatatggacaacttttgtggagccaattttgggtgttcagcgaaaacatggctccgaggatcctgacctagttaagccaaagagccgaacaacaaaatcgggtattgcaaatgttggggaaagcaacactggagctgggattgtctccaagcataacaacgatgatgaaagtgaacaagggctgccgtctcgggctagaatagcaaatggagttgcagccaacgctcaaaatggtttccatgatgcagatcgaattgcccgtagaggtgaagaatcattaaatgttacacttaatggaagagtgcatggtgctgcctctgcagacgaaacaccttcactaagcacacaaaatattgcttctactgagcgaccagcagagaatgcagctgctgttaggactgaacaacataaggcaaatttggaacttacgccaggcgtgaatgcttctagaagttctcatgatgcagttgaggtggctggtgaaggcaaggctatcaatgaaacattgccttctgctgtgggaggggaaacaggtaggttgggaccatcttttaatggcatcagtgagggaattaaagggcgcctaaataatgatggttctgcaccccatatttcaaaagttgaaagagaagagggtgaattatcgccaaacggagattttgatgaggaccattttgttccttttgaagatggaacatctaaaggaaaggaaggttctacaagcagatcattccagggtaggcatggggaagtggtgccatctgctgaggcagctggtgagaatgatgctgatgctgatgatgaaggtgaggaaagtgctcagaggtctactgaggacagtgaaaatgcttccgaggctggtgaagatgcgtcgggcagtgaatctggtgatggtgaggaatgctttcgtgaagaccacgatgaagaagaagaggatatggatcatgatgatcaggatacaaaagctgaaagtgagggcgaggcagaaggaacaactgagacacatgatgtggaaggaggaatatcactaccactttcagaacgctctctgtactcagtaaaaccacttgccaagcatgtacctacagctttacatgatcgagagaagttctcacgtatattttatggaaacgattcattttatgtcttgttcaggctacatcagatcttatatgagagactactttcagcaaaaactaactcttttaccgctgaaaagaaatggaggaattccaaggatacaaaccctcctgatctatatgcaaagtttatgagtgcgctttacaacttgctcgatggttcttctgacaacacaaaatttgaggacgactgccgagctattattgggactcaatcatatgttctctttactttagataaattgatttataaagttgtgaagcagcttcaagcaatagcaacagatgaaatggacaataagcttctgcagctatatttatatgaaaaatcaagatctcccgggaggttttttgacctagtttatcatgaaaatgcccgtgttctactgcatgatgagagcatataccgatttgaatgttgctcaagtccgacaaggttgtctattcagctgatggaatatggtcacgaaaagccagaagttaccgcagtatcaattgatccaaatttttcttcgtatctttttggcgagtatttatgtagtacgtcagacaagaaattatctgaaggcgtctaccttgcaaggaataagcggaaatattcagataatgatgaaccttcagattttttgaaggcaatggatggtatcaaagttgtgaatggtctcgaatgcaagatatcctgcaagacctctaaggtctcgtatgtcctagacactgaagatttcttgtcccggcttcggaagagaaggaaaattttgcggggtgggagtgtgtctgacagttcgcagttttcaaaaatatatgctgcaaaagtgcagcgcttcaataggttcctatccaaagcataggatcatttggcatacaaaatgtctcatcattgtatctaaacctggagatattgctgggaccccagttgctttgcttcttcagtgataatatgcaggagttggaagatggtgacgtcatcgacaattcgtcgcagaatgccctttttgaataacagatggggagatctatagggtaaatacagcaaaacgaagcgagcatgtaggccacagcagtcagctctgttgtgcggaaagatgtgtatatatgtattagcaacatgtttgttctgatgacctttttaatgcttttcgatggtaggtctgttccatcaagtatttaactaatcatcatttgttgcagttggtataggtcttctgttctttttttttttgccgtcgtttttcattgaggatgttgccaaaattaaaacctgtgtcaaacagttatgtagtcttgtcttggttaatcttacagacgccgtaatttctcagcctcttgagtgaggtgcttgtacaccctttcattaagcttttgaggcgtggttgccagcaaaaaaaaaaaaaaaaaagcgcccgagggggggcccggtacc

SEQ ID NO: 21626 - DNA, 2298 bp, Zea mays
cccacgcgtccgcggacgcgtgggctcgggctagattagcaaatggagttgcagggggcagtcaaaatggtttccatgatgcagatcgaattgcccgtaaaggtgaagaaccatcaagcgctatactaaatggaagagtgcatggtgctgtctctgcagatgaaacactttccctgatcacacaaaacattgcttctaccgagcgaccagcagaaaatgctgctgctgttaggactgagcaacataaggcgaacttggtacttacgccaggcatgaatgcttctagaagttctcatgatgcagttgaggtggctggtgaaggcaagactggcaatgaaacattgctttctgccgagggaggggagaggttgggaccatctttaaatggcaccagcgagggaattaaagggcgcctaaataatgatggttctgtgccccacacttcaaaagttgaaagagaagagggtgaattgtcgcctaacggagattttgaagaggaccattttgttcctttcgaagatggaacatctaaaggaaaggaagattctacaagcagaccattccatggtaggcctggggaagtggtaccctcttctgccgaggcagctggtgagaatgatgctgatgctgatgacgagggtgaggaaagtgctcagaggtctactgaggacagtgaaaatgcttcagaggcgggtgaagatgcatcgggtagtgaatctggtgatggtgaggaatgctctcgtgaagatcatgatgaggaagaagaggatatggatcacgatgatcaggatgcaaaagctgaaagtgagggtgaggcagaaggaacaactgaaacacatgatgtggaagggggaatatcactaccactttcagaacgctttctgtactcagttaaaccacttgccaagcatgtacctacagctttacatgatcgagagttctcacgtgtattttatggaaacgattcattttatgtgttgttcagactacatcagattttatatgagagactactttcagcaaaaactaattctttcactgctgaaaagaaatggaggaattctaaggatacaaaccctcctgatttatatgcaaagtttatgagcgcgctgtacaacttgcttgatggttcctctgacaacaccaaatttgaggatgactgccgagctattattgggactcaatcatatgtcctctttactttagataaactgatttataaagttgtgaagcagcttcaagctatagcaacagatgaaatggacaataagcttctgcaactatatttatatgaaaaatcaagatctcctgggaggttctttgacctagtttatcatgaaaatgcccgtgttctactccatgatgagagcatataccgatttgaatgttgctcgagtccgacaaggttgtctattcagctgatggaatatggtcacgaaaagccagaagtgactgcagtatcaattgaaccaaatttttcttcgtatctttttagcgagtacttgtgtagtacgccagacaagaaattatctgaaggcgtctaccttggaaggaataagcggaaatattcaaataatgatgaaccttcagattctttgaaggcaatggatggtatcaatgttgtgaatggtcttgaatgcaagatatcctgcaagacctcgaaagtttcatatgtccttgatactgaagatttcttgttccggcttcggaagagaaggaaaattttgcggggcgggaatgtgcccgaccgtttgcagatttcatcaatatctgctgcaaaagtgcagcgcttcaataggttcctatccaaaccataggatcatttggcatacaaatgtatcgaaacctgttgctggggtcccagctgcttggcttgaacaatgattccatcgacgtcgcggagtcccctttcggaataacagatgggaagacatagggtaaatacagcaaagcgaagcgagcatgtaggccacagtagtcagtctgttgttccgaaagatgtgtatatatgtattagcagcatgattgttctgattatctttttactgattttcgatggtaggtctattccatcaagtatttaactaatcatttgttgctgttggtataggtcttttgttcttttagccgtcgttttgcattgaagatatgtagccaaaattaaaaacctgtgtcgaacagttatgtagtcttggctccattaatcaaacggacaccaaaaaaaaaaaaaaaaaaaaaaaaaaattgccagcacctctcttgtgtatccattcattgaagtataggatgtgttaaaaa

SEQ ID NO: 21627 - DNA, 1437 bp, Zea mays
caccccgcgcctcgcggcggggaaacatagtgcagcaagcaactgcaaagcagcaagctctactcttcttctgtactgaacgtgtgactagataacaataagcgtgaaccatggcggacgagtacggccgcagcggctacggcaggtccggcgccggcgacgactacgacagcggctacaacagcaagtccggcactgatgactacggccgtggcgaaggtggctacaacaagtcgggcggcgatgacgactacggccgcagcggcggcgatgggtacggcaggtccggcggcgacgactacggccgtggcaccggcggtggtggctacaacaagtccggcggcggcgacgactacggccgcagcggcggcgatgggtatggaaggtccggcggcgacgactacggccgtggcaccggcggcggcgggtacaacaagtccggcaacgacggctacgacagcgggtacaacagatcgggcaccaccaacgacgacgaatacggccgtggcaccggcggcgggtacggcagcaagccctctggcgacgacgcgtacgccggcggcggcggtggcgggtacggcaagcagtccggtggcggcgcggacgagggcggagagtacggctcctcccgggacgactcggagaagtacaggaaggaggagaaggagcacaagcacaaggagcacctcggcgagatgggcgccctcgccgccggcgccttcgccctgtacgagaggcacgaggcgaagaaggacccggagcacgcgcagcggcacaagatcgaggagggcgtggcggcggtggctgccctgggcagcggcggcttcgcgttccacgagcaccacgacaagaaggaggccaaagacgcggcggaggacgccggggaggaggaggagtccggccgccgcggcgaggggaagaagaagcaccacttcttcggctgatcgggctgctgctcgatcgatctacttgcgtacgtaggctgctccccaggaccagaaggagcatgcatggagggcgaacgaagtcacgggggtttgattgcccgtctatgtatatcatgtgtagttactgatgatgtgtgtgcatggtacttcgtacgcgtgtttggtgatcgatgtgtggtgtgtgtgtctctgcatggacattttcctactctgcgttttttctctctctactgatatagtatatatgtggtgtgtctatatatgtgtgcacgtggttttcgctcggctttttatcaacgctttgagaataaaagctttctcttcatctgtatattttatttttaatgaaagaaataaaccactatatatttcgacactcttaaaaaaaaaaaaaggaacaacatccaaggccgccaaacttacaaactcgtgcaatgcgactaaatacgttctctatagcggcacccaaaattcaattccatggccggtt

SEQ ID NO: 21628 - DNA, 1384 bp, Zea mays
tgggaccctccacgccggcccgggaaacatagtgcagcaagcaactgcaaagcagcaagctctactcttcttctgtactgaacgtgtgactagataacaataagcgtgaaccatggcggacgagtacggccgcagcggctacggcaggtccggcgccggcgacgactacgacagcggctacaacagcaagtccggcactgatgactacggccgtggcgaaggtggctacaacaagtcgggcggcgatgacgactacggccgcagcggcggcgatgggtacggcaggtccggcggcgacgactacggccgtggcaccggcggcggtggctacaacaagtccggcggcggcgatgactacggccgtagcggcggcgacgactacggccgtggcaccggcggtggcgggtacaacaagtccggaaacgacggctacgacagcgggtacaacagatcgggcaccaccaacgacgacgaatacggccgtggcaccggcggcgggtacggcagcaagccctctggcgacgacgcgtacgccggcggcggcggtggcgggtacggcaagcagtccggtggaggcgcggacgagggcggagagtacggctcctcccgggacgactcggagaagtacaggaaggaggagaaggagcacaagcacaaggagcacctcggcgagatgggcgccctcgccgccggcgccttcgccctgtacgagaggcacgaggcgaagaaggacccggagcacgcgcagcggcacaagatcgaggagggcgtggcggcggtggcggccctgggcagcggcggcttcgcgttccacgagcaccacgacaagaaggaggccaaagacgcggcggaggacgccggggaggaggaggagtccggccgccgcggcgaggggaagaagaagcaccacttcttcggctgatcgggctgctgctcgatcgatctacttgcgtacgtaggctgctccccaggaccagaaggagcatgcatggagggcgaacgaactcaataaaagaatcagccgggggtttgattgtccgtctatgtatatcatgtgtagttactgatgatgtgtgtgcatggtacttcgtacgcgtgtttggtgatcgatgtgtggtgtgtgtgtctctgcatggacattttcctactctgcgttttttctctctctactgatatagtatatatgtggtgtgtctatatatgtgtgcacgtggttttcgctcggctttttatcaacgctttgagaataaaagctttctcttcatctggaaaaaaaaaaaaaaaaaaaaaaaaaaaaaatgaaataaaaaaaaaaaaagtaataaataataataaataaaaaaaaattagtaatatgttaaaaatgttatttgttaaagtaata

SEQ ID NO: 21629 - DNA, 2252 bp, Zea mays
ctacaatatttttatttcagagcaagaatgtacagagcaaggagattacagggttaatttacaacgtttgtaactaggttctaatgtcttcggctatctaatctcttattttatatatgataaggagcaactcctttttaacatatctttgcataactgtattgttggaaggacaccctcgaagatctagtcattcctacacttccagatacatgcacgctctgtattgcattgcatcccaggtaaagtaagaagaatttcggtgcagaacttagtcccattctgataacgaaccgcgatgactttattaatcctatgctccaccaacttgatgatattttcgaagcaagcatatccatctccactcgtagaattttatctagttaattattcacttttttctgagcgaaaatgtcagagcaaactgtggcggctcttgtttgattatgaaaaaaatctatatatatatatattcactttcctttttctaagaaagttcccctgttcactttccttgatgcaaattcaagaaaataaaagattcggatttgagggaataaaccctcacccattatttaacccggccatggcccaaccagatgatgtcgacaaccaagcaactagccaactagtttctgtcgggggaaaaaaatatctccatttcgagataaagacaaataaactagaattaacaactacctgtaagatatggttaggacgtgtgcggcatattacccatgcgtcaccagaggcgttgtttctccctgcccttctataagtaccctttccattgctgtgcgctcggaaacatagtgcagcaagcaactgcaaagcagcaagctctactcttcttctgtactgaacgtgtgactagataacaataagcgtgaaccatggcggacgagtacggccgcagcggctacggcaggtccggcgccggcgacgactacgacagcggctacaacagcaagtccggcactgatgactacggccgtggcgaaggtggctacaacaagtcgggcggcgatgacgactacggccgcagcggcggcgatgggtacggcaggtccggcggcgacgactacggccgtggcaccggcggcggtggctacaacaagtccggcggcggcgatgactacggccgtagcggcggcgacgactacggccgtggcaccggcggtggcgggtacaacaagtccggaaacgacggctacgacagcgggtacaacagatcgggcaccaccaacgacgacgaatacggccgtggcaccggcggcgggtacggcagcaagccctctggcgacgacgcgtacgccggcggcggcggtggcgggtacggcaagcagtccggtggaggcgcggacgagggcggagagtacggctcctcccgggacgactcggagaagtacaggaaggaggagaaggagcacaagcacaaggagcacctcggcgagatgggcgccctcgccgccggcgccttcgccctggtaacgaaccaacgtccatcgtttccttccttccttgcacacgcacgaactgatgaacgagctgacgccgtgctttgtgattgtgactgtcgcgcatgttcttcgtgtcactgtgacaactttcgtgacgaccatgtgcatgcatgcatgatcgaccggaccgacgcatgcagtacgagaggcacgaggcgaagaaggacccggagcacgcgcagcggcacaagatcgaggagggcgtggcggcggtggctgccctgggcagcggcggcttcgcgttccacgagcaccacgacaagaaggaggccaaagacgcggcggaggacgccggggaggaggaggagtccggccgccgcggcgaggggaagaagaagcaccacttcttcggctgatcgggctgctgctcgatcgatctacttgcgtacgtaggctgctccccaggaccagaaggagcatgcatggagggcgaacgaagtcacgggggtttgattgcccgtctatgtatatcatgtgtagttactgatgatgtgtgtgcatggtacttcgtacgcgtgtttggtgatcgatgtgtggtgtgtgtgtctctgcatggacattttcctactctgcgttttttctctctctactgatatagtatatatgtggtgtgtctataaaaaaaaccaaatgcttttcgctcggctttttatcaacgctttgagaataaaagctttctcttcatctgtatattttatttttaatgaaagaaataaaccactatatatttcg

SEQ ID NO: 21630 - DNA, 1245 bp, Zea mays
caccagttgcgacagatattaacattttcttaacaaatcttacttcagtttctataatgatggacaatggctgctttgccttcaatccagcgtaatatacttgtcctgtgggcaaatgttgagcccaaaagtgtagagtataatcaaattgatgaaatgagaaaaggtaacgaaaagttacacattacaaaggttaagagcacacacgaagctttacactacactcttgacgttcctccatgctccttctcaacatgctccacaagcaacacaggatcccggaacgccttgctgcattttgggcaaacatcaatcgtcactcggccatgacttggttgtgagttgatctggtgggatttctcaacatgttcaattaaggcccccacggtggaaaatcttgctgggcagtgaacacattgctccacaaggtcaccactgctgctgctgctatttggggcgatcccatccttagccttctggaaggcttggctagtcacggtgctcagcttctgcattccagcttcggctgatgatttgaaattcgttgctgcattcacaagactggagctccaccacgaagaaccattgttgttactgctatttgagcgtgtctccgctttctgacttctccttagcatgcttacaaagggaaagccagaatccacttttcttggtcctgggcacttatgatcaggcccaaatctgtgctttaggcagtgttctctggtgcaatctttgcatctgatggtgttggaaaatgtcagtgtctctctgcacccaggaacagggcatttctttttcttcatcactttttggtaatttgatggatcacaatcagtgttaacatgagtatcccaggtgatatttgggtcttcacttggattgaggcgaacacctttagcacagagtgggcagatgaggacagtgacgtctttcatgtttgcatttgggcattggtgtgatgtataacttcggtgatcaaggcaaaagacatggtcgcagcggtcgcaggtgaaggggaggaagtcgatctggttgcagtctccgacgctgcagtgctttcccaggttggggaactccggcgtgcccatcccgccgaaccgctccgggagaacctaggaccggcccgcgcgagtcgttgccgccaccgccgcagcggcaggaagggagaaggaaactggaaaaggggggcagggctcggtcgtcaaacggacaggacacgaaatcgaataaacataacgtttt

SEQ ID NO: 21631 - DNA, 1503 bp, Zea mays
ttttttttttggtcatccaaaatactattttgcaccgtagacttattgttcgcagaatggaatttaaatatgggtaagaggatgggtaagcataaccttagtatcaagtatttctctacatctttcactctacttcaaaagggaaagaccgtcaaatatgccacatttgccttgcaggcaacttgggggtgaaaaaaaaatgtgcacctttgtgcaccttatagctaattagctattgtgaattcgtcttgctttcggggcttcttactggattgaaatacgggtgagccatggtttccttggctgtaggccttttctggtgatcataccggaggagtttatctaccaaatcaatagcctcaggtgttgcaagatgtctgttcctagcattcacaaacttgggccatggtttcctattatgtcttccaataagtctttcaagctgtgggtcaagctggaggccatatttttcaaggtagttatacaggtctcctgtgccaagaacctcagctattttcactaattgatcataattatcctggccactaaagaaagggtccactcggaatatcattgctgcgaacatgcaaccaagactccacaaatccaatgagtaatcataatctaacaaatccacaagtagttcaggacccttgtagcatcttgaagcaactctagcattgtattccatcttgggatgatagaactctgcaagaccccaatcaataagacgaagctgacgtttttcatggtcaatcatgacattgtggggtttgacatctcggtgcattataccacgtgaatgacagtaatctagtgccttcaataattcaaaaatatagtatctgacatcataatcagataacgcagggtagagtactttgaagtcagtgttgttgacatgttcaaagatcagactaggtgtctttgattcatcatctctgacaatatcaagtagttttacaatgttaggccctccatataagttctgaagtatctttatttccctctttatcttcttcttcttcacgggcttcaggatcttaatgacgcatctctcatcgctcccggcccggaacccttcgaacacctcgctgtacttccccctccccaccttccgcagcacctcgtacccatcctgcttcccccactggatgtcgagcgactcgtagtcccagtactccttggggcgctgggcgttggcgtcggcgtagacgcgcgccaccgaggcggcgccaccgggttgccgcgtggcccgcccgaagcgcggcgtcatggggagcggcgcctcagccgcagctgccgctgcggcggcgtaggccgtgggggcggggcggcggcgccggtggtggtgcccgtggtgcgggaccgcggtggagagaaggaagcgtaggaagagaccgtggggcgcggcggtggcggcgggtgccgggagcggaaggacacggctgcgcagggcgccccaggccatgaaaccgcggcgcgggcgtgcgggggagattt

SEQ ID NO: 21632 - DNA, 531 bp, Zea mays
agaggaagccctccgccgcgcttatgataactcggctgttcggcagtctatcaagtttcctttactgttaccgatgattcgaatccggattacaaacatcgtcaccgaaggacctaaagaacacacgaatcccacggcatctagaatccaagatcagtgggccacggtaaggcctccggttccctgagaaattccacggcgatcgatcaggacgagcagcacaggaagtccaggatgctggagcagcaatcgtagcagcaagagcaacactcgtcgacggccttgtcctggaagtcgtcagtcgcggacatcgcctgggcggatgggggctccatggccagcagtttcttgcgtctgcggggggagcggcggagtccgagaagaaccagatgcagcgaagaacgcgggtagcagagccagcggcggcgagaggctattgtagtaggagtaaacaagcaaagcgcaaaggcaaagcaacaatcaagctcgctggatggaatgggaatcaaacggtgagcacatcccggccgg

SEQ ID NO: 21633 - DNA, 3308 bp, Zea mays
aaggtttgatgtaaaacttttcaatgtttacttctcgtagatccatgggttctgttttgttttgccaatcagcaacggtctgcggttcatttcatagaaccatttcagggatctcaatattatcaccagccataggaaaatacgggcatgccgtgtcgagccttcgttattttccctacactttttttttatatttggaagttacattcgtcggaggaacaacaacatacacgtatgttcagaaagttttttttttttttgctggtgtttagttatgctgagcgaactgcagagtcctggtaccggttcagctctccccagaccaggttctcaacgtcctcccaggacgttgcagccctcatctccttccacaggctgaatatagctcccaagacgttgtcctcgtgtaatatacagtagcacatcgcgcgatatgatgccctgctgaacttcgagtttcgcactgatctgtagacatcggtggttgattcccccctcagaaggggaagttgatagctccgtagaaattccttgagaaggtcactatcaccccggaaaatatccaagtgcagcggaattatgtcacatataggatccccaatggacagatcactgaaatcaatgatgtgaattgcatttattttgtcccgatctgagtcataaactctttccctctcaccagaagaactcagttttatgatcccctcgataagaatgttatcgtccattatatctgaatgtatccaagaggggcatgggtacagcaactcaccatcatccttaacaaacttgatgaggaagcccatattcggagggagatattcttcagccttttctactagaacttgtggaacagagtccccccagttagctaggtgcttttttacattctgcttcctcctatttagagtagagacaagttgctgccattcaggtagaaccgtggtatcatcacatgttcctaccacttctttcacatcattgttcccagattcaggtacatgctccacgggtggcaggggtaataaatgtatgtttcgcatttgaactcccaaggatgatgcaagatgaagaatatcagtcttcgacagcatatcgcggatgcgagcaaaaatatctcctttgcactttcttgttaccatgtaaggccaaattggtctgtctgaaacatcagccgaactacacatcccaaatcgttgcttgctccaaagcccaagaggaaagcagctgttcgcacaagaaacctccaatgagtagtacttaaccaaaatttctggtattccttttccattccacggaaccgtgctgtagatatcatccttatactcaaggaagccactagcaattatctcaggaatgtgattgatcaaaggtgaaccacttttttgcaggagatcatagaactcaagctctgtgcccaaaccatggacagaataaaccaatcctccttcagcatatattttaatcacattgcccgagacaatgaagactgggttgctaccagtgccaacaggaagcttctcatcctctgtaggtggtggtaaactatggcatgcacatatctcctctaagcatgaataccatttgtcaacatttattgcaaggcatgcacccttccatattagttctctcagatcaggtttcagaacccaaagccttcgcagccattctcttgcttctctctgcccaattgaattagttggactccagagagaagaataatggtccctttctttctcaatgaattgtgacaaaaaatcaatatcatatgagaaatcttgattctccaaactctcttgaacacctgagaactcaaatgcagaacaatgatttatgctatttgagattcttagtgcttcagaacctttaagccttttttccttacgactcatatcagggtggttccatccactcattgtgacagattgatggtttttgttatctttaacgaattttcctggaacagcaagtaagccagcacggcaaactcctttgtgtctgtgaccaggtgccatatccaaacatacatgctgaaaattagactggtttacaaagttctgtgtaactgcaattgttgtctcgagattcagaacgcaatgccaccacccactaggaacaaaaatggtctctcctggcaattgtgtgcattccaatggcttctcatgttcaggaaggtgtggatatatatcaagccaccattgcaatgatgtcggagtttcaatgtcaacatcaccgtcttcatcatttacatgtactgtgacaccaccaggcactcttcctggagggtacaatgcccatctttttcggccacaaagaagagtattccatgcacttgtcagtccaggatcaacatgccaagaagcacctgatctctctggtccaataataagccatctgaatgctggtcgttggtcataatccaagatatcaaaaaagtcttcttggaataaatgagggacactataatcttcaagtaatgttggtgctgattctccaaacttatcatcaaatatgtatagaggatcttcatcatgctggagttccatgtaagaaacataatcctttagtttcattgttatcttctgagggcttctttgtgatatcctgaatggaacttccccaaaatcctttgtcagttgctgcagtgtccattttgtcctcgcaggccaggtttcggccaacttcgtaaccaaaactgggcattttccatcatactgagaacgaaactgatccaataaaaagtcatctttcctttccacatgtccatcgtcaaacgaaaaactattcaaagtagtaaaacatctataccatctccggtatagatacaaagaattaaagccatcgaactgacgaggcttctgccaaatctccttattttctgaacatagaccaagcctacatagtgccgtcttcttccaggaaactttgtattcaagaggacccccgattgaaagacatttgctcatccagagaggttcttcattacaaagtatgtacatgacactgctgacgcacgcgaggcgtccgatgtcagcgggcgagaggatgtcgacgacggcgcagagcacctcgtcagggagcacggagagggcgcctagcgccgcctccctccggtcgttgcccgccgcttccatcgccccccgccccccggtcgggctggtcggtgggttgggttgaggcgttgagcagagagagagagacagagcccaaggccgggcgtgggaattgatcggacttttcagatcagtaggaaattgcgcgtgggaaacaagcagggggacgcgctggaccacgcgtccacgcggcgc

SEQ ID NO: 21634 - DNA, 5639 bp, Zea mays
  misc_feature (1540)..(1540): n is a, c, g, or t
  misc_feature (4433)..(4433): n is a, c, g, or t
gattgagtgaatagagggagagatagtgttatccgttggagtaaagtaggatataggagataaaatttagaagtaatcgtttgaatatagccttagtacagtataatgcttgatacgacgacacataaatatttaataaaatttctgaccacaataaatacacaaaactgactacagtggttcgagacccttcccgatatgtgaaggtaaagacaagtaaaaaatgtatgtacaaatagggttggttgggttttgaaccttggtcgttggcatatccacatagtcaatagaacacgtatttttacgacttattaaaacataatatacttatataatatacagaaactatcaacctaattggtgttaatatataacagtttgagaataaaacgctcacgataattgtatggttggttacacgtaagataaggaataggtacattaacttcacgcgacacacgatgtctagtgctttataataataaagtagagatagatatatagaccaagaccagtagaggatttgggtcgactatagatatttaaaatacttttaatctaaataataaataaaactatttatctaaatctataactttaacttcgtaatttatttaggacatggtctatcaaccttactgagttgctcttaaggtgttctttttaggcctagtttgtttactctagtattgagctcaatccacatgtattgatttggattggagttgctcttaaggtgttctttttaggcctagtttgtttactctagtattgagctcaatccacatgtattgatttgaattggaatgtaatttaaactaatttacaccttaatccatctcaacgtacatagattaaatcaatactagagcaaccaaacaaaatcttagtgtgtttgatttctagagactattttttagtcattcattttattctattttaatctttaaattgctaaatataaagcttcagtctatatatttattaatttaaaaactaaaaaatagatgtccatagaaaccaaacatcttttgacacagtctctgtagtggactatgtatggaactatggatggtaatactgtgtgtgagttgagtttcgtgtgctccgtcgcgaaacggacgagtgtccgtacacacaaacggtctcgccctttgcgagttgcgattgcgacgacttgttcccgcaaaagccaggaacggaaccaaacagcagcaacctcctcccgtttcatcgtcgtcctcttctggaactagaaaaggcgaggagcgatccgtttctccccttctcgcgcagccattattgcccgcccagtctgacgccgccgtatcctcgcggcgccatggttttatcattgcgtccactcctcgcctcaccttccttccacgctgagggttttcctttttttgtctcattctaacatcacagttctacacgatctctgatcgattgattcggccaagataatctgagtcttgtgcttatctactacacctcttcccattttcttcatttccagttttttcgggggcttcatatntcccacggcacgcgtcacatcttcttcatgcgttgtgtgccgagtcgaggcagacatcggaggcgcgcgactgactggttggtttagctcgcgttttctttatccggtaccctgcgctactcaatttcgattcttttagctcggatttgagtagctgaaggccttcggcggcgatgacttgattgatgcgaattggggatttcttaccgtttcctctattgatgtcggtgctgaagagctcaaaccaatttgggttttgagggttttttttcccttctgctgctgatcaagctcacaaagatcgctagctccatctaccaatggacgagtccggggaagcgagcgtcggctccttcaggatcgggccgtcgacgctgctgggccgcggggtggcgctccgcgtgctcctcttcagctcgctgtggcgcctgcgggcgtgcgcgtacgccgccatctcgcgcgtgcgcggcgcggcgctgccggtggcggcgtcctggctgcacctcaggaacacccacggcgtcctcctcatggtcgtcctcttcgccctcttcttgcggaagctctccggcgcgcggtcgcgggcggcgctcgcgcgccggcgcaggcagtacgagaaagccatgctgcgtgccggtacgtacgaggtctgggcgcgcgccgccaaggtgctcgacaggatgtctgagcaggtgaggcggatttctacgacgaggagctcatcagggacaggcttgaggagatccggagacggagggaggacgggtcgctccgggacgtggtattctgcatgcgtggcgatcttgttaggaacttggggaacatgtgcaaccctgaacttcacaagggcaggctagaggtaattgacaaagtaactgtaggttctactaattcactcactctgattcgtagtaatatatttgtttgctgatgttttgtaattgttgatggccttgagaatacaaaatgacctcttacttagtttcttacaacaagaaattcagcatggccaaagatcactgaaactctgaattcagcatcaccatcataccagtaacacggctgatctgtcgcagtgcaggttcctaagcttataaaggaatacattgaagaggtttctactcaactaagaatggtgtgcgaatctgacaccgacgagatactattggaagagaagcttgcctttgtccaggagacctgacatgcctttgggaggacagcgctgctcttgagtgggggtgcttcactagggtctttccatgtaggtgtaggtgtagtgaaaacattggtcgagcataagcttctgcctcggattatagcaggatcaagcgttggttctattatatgttcgattgttgctactcgaacatggcctgagattgagagcttcttcacagactcatcacagaccttgcagttctttgatgggatcggtggattttttgcagtgatgaggcgtgtcaccacttacggcgcactgcatgacattagccagatgcaaaggcttctgagggatctcacgagtaacttaacatttcaagaggcttatgacatgactggccgtgtccttgggatcaccgtttgctctcctaggaaaaatgagccaccccgctgcctcaactacccgacgtcaccgcacgttgttatttggagtgcagtaactgcctcttgtgcatttcctggactttttgaagctcaagaactgatggcaaaggatagattcggcaacatagttcccttccatgcaccctttgccacagatccggaacaaggtcctggagcatcgaagcgccggtggagagatgggagcttggaaatggatttgcccatgatcagactcaaggagttgtttaatgtaaaccatttcattgtgagccaaactaatcctcacatttctccactactccgaatgaaagaacttgttagagtctgcggagggcgctttgctggaaaggtatgtctgtgacaatattttgagtagggactagggacctttaattatgttagtctcatagcctatgattgtggttgaacttaaaatgcaggcccatagttcatgttgcaaatagttgttttattttctccagtagtggtttgtcttcaacaactccgcacatgccgttagactattgatggttatcacctcctgcatatgcatgtagtatctagtgggattgaagagtttattcagtgctatgaatatgataggacttagtgagaataatttgttgcggatatccaagcagtgctctgtatttatgttgaaaacatttgtgcatgttgtttaatgctgctggttttatacatttcttgaacaatgtgtttgttatctttcaaaatcagtttaccaggcataactttgatctgatatgtgtagcttgctcgtcttgctgagatggaggttaagtatcgatgtaaccaaatcctagagattggtcttccaatgggagggcttgcaaaattgtttgctcaggactgggagagggtgatgtcaccatggttatgccagcaacagtagctcaggtattattctgagttctgagtcggttatttaggtgaaatacaaacagcttgagctcaagaatttcccctcacatccctccaactttcagtatttgaagatcattcagaatccaacatacgctgaactccaaatggctgccaaccaaggccgcaggtgcacatgggagaagctctctgcaatcagagcaaactgtgccattgaacttgtattggatgaatccatagcagttttaaaccacaaacggaggctaaaaagaagcatggaaatgacagcggctgcttcgcaggtccattctaactatgttcggctcaaaactccaaggaggataccatcatggagctgcatcagtcgagagaattcttcagaatntctctcggaagagatgctgctcttgttgtcggcgcaccaccaacgactcttgctcaccatgctcccccctgtccgcacgacggaagtgagagtgagtcagaaaccattgaccttaattcctggaccaggagtggagggcctctaatgaggacagcgtccgccgacaggttcatcagtttcatccataacattgagattgacacagaattaagtaggccctgtgctgtggaaggtgatgctgcaggtattttgtcagaatctaccttcccaaacggttcacgaccgaacaatagctcaagtgttagtatgccaggtagatgcacagaaaattctgggaccgagtcgtgcaacactgtcaacaccagagcttctactctcacgagcatggctgttcgtgaaggagatttgctgccgcctgaaagcactactgatggtgtcctacttaacattgtgaaaagagacgccctgcaggatggtgtaattgaattggtggaaagctcctgcgctgaaggatatgcggcaaactgtgacaccgtctcagggctagactgctgaaggtaacaagacgctcgctgctgacttgagcaatcaacatttagctgatgattagattcttcttgattttgatgatgaaaggtcatttatatgtagctcactacagcaacgcagtgtaggaaaattgtacttgctcgatttaaactttaaagagcatgccatgagtagctttgttaatgttaatattcacatccattgtggaattgttggttgatgcatttcttagcacgtcgagcaaccatatgcgtgagttcggcactgatacttggaatgtctaaatcatctgttcgctacatgtaacatgcagtggggcccctgtcttgcagacacttcatactacatcttgttccttaaaacctcaacccagttgccttctcgcccgcgtttcacgcaccttgtgtgccttcgcgacgtgacgcgtggcgtaaggcagcccgtgggcaacaccccgtttatctcacccacgtgacactcgcgtgagcacacgggccgtcgcctactcgctcaccccgaacacgcacatcttggctccccaggacatcgcctactcgctcaccccgaacacgcacatcttggctcgccaggacatccgaacatttgtctcctcgtcccgttcatcgcccgcaccttccgcgaaaaaaatgcgctgca

SEQ ID NO: 21635 - DNA, 2735 bp, Zea mays
gaagctcaggaactgatggcaaaggataggttcggcaacatcgttccctttcatgcaccctttgccacagatcctgaacaggtcctggagcatcgaagcgcaggtggagagacggctgcttcgcggtcgcgtggcccgtcgcgtggcttaaggagttgtttaatgtaaaccatttcattgtcagccaaaccaaccctcacatttctccactcctccggatgaaagagcttgttagagcctatggagggcgctttgctggaaagcttgctcgtcttgctgaaatggaggttaagtatcgatgcaaccaaatcctagagatcggtcttccaatgggaggacttgcaaaattgtttgcccaggattgggagggtgatgtgaccatggttatgccagcaacacttgctcagtacttgaagatcattcagaatccaacatacgcggagctccaaatggctgccaaccaaggccgcaggtgcacatgggagaagctctccgcaatcagagcgaactgcgccattgaacttgcactggacgaatccatagcggttgtaaaccacaaacggaggctaaaacgaagcatggagaggacggcggcggcttcacagggtcactctaactatgtccgacccaagactccgaggaggataccgtcatggagccgcatcagtcgagagaactcttcggagtctctcgcggaagagatctctgcggttgctgcttcgtccatgcagcaaggcgctgctcttgttgtcggcgcaccaccaacgactctttctcagcatgttcggcgcagttctcacgacggaagtgagagtgagtcagaaaccattgaccttaattcctggaccaggagtggagggcctctaatgaggacagcgtccgccgacaggttcatcagtttcatccataacattgagattgacacagaattaagtaggccctgtgctgtggaaggtgatgctgcaggtattttgtcagaatctaccttcccaaacggtccacgaccgaacaagggctcaagtgttagtactatgccaggtagatgcacagaaaattctgggaccgagtcgtgcaacactgtcaacaccagagcttctactcccacaagcatggctgttcgtgaaggagatttgctgccgcctgaaagcactactgataatgtcctacttaacattgtgaaaagagacgccctgcaggatggtgtaactgaattggcggaaagctcctgcgctgaaggatatgcggcaaactgtgacaccgtctcagggctagactgctgaaggtaacaagacgctcgctgctgacttgagcaatcaacaattagctgatgattagattcttcttgattttgatgatgaaaggtcatttatatgtagctcactacagcaacgcagtgtaggaaaattgtacctgctcgatttaaactttaaagagcatgccatgagtagctttgttaatgttaatattcacatccattgtggaattgttggttgatgcatttcttagcacgtcgagcaaccatatcacagcatgccatgagttcggcactggtacttggaatgtccaaatcatctgttcgctacatgtaacatgcagtggtttattagtcttgcagacacttcatactacatcttgttccttaaaacctcaacccggttgccttcacgccctcgtttcacgcaccttgtgtgccttcgcgacatgacgcatggcgtcaagcagcccgtgggcaacgccccgtttatctcccccacgtgacactcgcgtgagcacacgggccgtcgcctactcgctcaccccgaacacgcacatcttggctccccgggacatccgaacatgtgtctcctcgtcccgttcgtcgctgcctagagtatgtatggacgtcaggacgtgctcgccccttcggccccttcggtgaggccggtcgtcgtagtccgtagacgggcccagcgtcacgttcacttcgacccaatgcccttcgcccaccgcacgggagacgctctaccgctgctatggagcgtcccacacacaactgcagcgagcagaggacacggttcgttgcgtgaccgtcgtcgttgtacccgccacccgatggctgcgcatgggatccaggtttgaacagtgcggcgacatggccaccgttcgcggacactgttgtcctactccgacccaatcgcgcttcgtccaccgcacgggaccgctccaaccttctttgtccacacgagagccaatctaccacagctatggtgggctctggctccatgcggacccacacgcagctgcagcgagcaaagggtgcgactcgttgcgcgatccttgtcgccgagcccggcacctgcggctgtgtacaatctctagatcttagcactgcattgacatagtcgtcgacgttgttgtcctctccacagacacctttctccaatttattatgtgtctcccccaaacacccgtcccctcttgcattttagaaacctacatctatcgtcgtcctcagtcctgctttctttgttgtggggttctcgccaaacaccattctcaagactccctcgctttgccgctgatggcgttcgtgttctaaacccctctgtgtgactaggttagttcgcctattgacatctacttgtgcatcttgttgatctggttgttggaaacctcattacttgtaatccaagaattttttatttgaatgcctggtatcaggttcgtgctcttcacccatccagagttcatactag

SEQ ID NO: 21636 - DNA, 1367 bp, Zea mays
ctcgtgccggcttctcgtgccgttttttttttttttttttcttttttttttttttttttttttttttttttttttttttggcttaaaagaccgcttgagcggcatggcctttagaggagatagatagaccacttgagcgtcgaggaattattggagtgccgagcacaaactacctgaaaactacgctgcctttcagagttcatacgcataaatttattcttccacaggcacagtacgccttgccagtggcaaaattccgtcactcagctcctcccagtcaggacagttgttcagatctcgccatcccaaaactcctcgatggatttgaacacgccgtcgggatcaacaaagaagcccgcacgaatcagccgttcctgctcgatctcagagaacttggcgagcaggtcctccggcaaggaccagccgaagacgtcgagattcgccctgatcctcccctcgtcggtgctcttcgggagcacgctgtgccccatctggacgccccagcgcagcgccacctgcgccggcgtcttccccagcgtctccgccgccgagacgacggccgggtgctccagcaccgcgcccgccttcaccgtcgccgtgcccggcgagcccagcggcgagtaggcggagaggtgtatcccttgggaggcgcagaacgcgcggagcctgccctgccgccacaccgggtggcactccacctggtcgacggcggggcgcacgcgcgccacggccagcaggtccgccagcttcttgctcgagaagttgctgacgccgatggcgcgcgccttcccggcgtcgtacagctcctccatcgcggcccacgtcgcggggatgtctgacgggacgacggcgtgcgggccgaagccggcgccttttttcatcctcaccggccaatgcatgaggtagagatccacgtagtcagtttgcaagtccttcagtgtgccgtccagtgcaaccgggacgtcctccgccgcatggttagtgttccaaagcttggaggtgatgaagagatcttcacgcttgactatgccctcgtccagcactctcctgagaccaaacccgacctctttctcgttgttgtatgcttgagcacagtcaatgtgcctgtaacctgccttcacggcggcatagacggcgtcgccgacgagcccgttgtcggcctgccaggtgccgagcccgaccgacgggatcttcgcgccggtgttgaggacgaagtaggtggccatacgctcgctatcccggctgccgcgtataccaacacttcggtgccccgtgcccgtgcccgtgcctccaaaggtttgagccacagaatatctgcgtccgtcgacaccgacagtgccaaatggaaagcagtcgcgtcggacgat

SEQ ID NO: 21637 - DNA, 2277 bp, Zea mays
gacctgcagcatttttgttttgggagtttgttcgacacctccacaacactggaagacccagatgacattgctgttcctcttaatcctgcaacaacctaactaccacatacagtagagtatacctttttctctaactcccccatccagtttccctaaaaaaacaagaggacaccataatgtgcataagataatatacagcagctgtcaaactcaaacccagacccaactagggaagagatacgaaagccgtttttacctcactggtcaagcaacactattcgctctttgatgcaacatgggaagctttatttcctgaagcactagctgggaagtcagtgagacgaaagctcacaagggcaggtccaagggcactgatcttcccagcacctgcaaacgctgcctcagcatccatgcgcctcttgaagatcacctgggcagagctggcactgtttgcaacatctgccttcacttcattgacaggaccgtattggctaaagatcttgataaggtcacactgtgatggaacagcgcatggcctgctgaagtgcagcaccagtccagacagaaagcaattttccatctcttgaccaaatttggttccggcgttcagttgagatccatttgcagaaaacaacttggtttcgttcctaagttgttcctcatttcctgtatcttggttgccttcactccttggctcgtctacattttctgcagtcgacaatgaattaacaggaggtttcttaacctgaggtgccttcttgtttactcttttcttactctcatctatcttctttttcaggttagatagcggctcctccacattaatgagaatgtcagcccaatagtcatcctgcatatgatcagcaatgggctgttctgaaagagtggactcagtgttggctgccttctcaggcatcccctcattgacatcagaactagaaaatttgttctttctaaaaccggtaaagaagttaacacttgtaggaacgattttctctctctgctgaagaccacatgctgctacagagagctgccatagcatttctccacaagatagagactccttactaacggcttcgctgttcccctgattcaccttcacaggacatggagatttgtctgcagcatttacttgcctgtacttagcccttcgtggttttgtctgagacactgcactattagctttgacagcaggtgcagcctgtaacatgctgctcccagctactttgctcatcagttctccaacctttgtggacttcttacgagagagaggctctgacagtgaagacaaatcccccaatgtgttgagcttctttcttttcctagtcatcaatgtatccttagagtgatgttcaggatcctcagttttctcagctgaatcatgcaacgaacgcttccctcgagttttgctcttaccactagatgcagaattaggcttgcctgtctctgccatgagttcagaaagtttcttcttcttcctaccatgctctgagatgggcactcgtttgcttattgagttttcgttatgtcccaatcttctcttgccaggaaaaatgggatccttggcattgctatctccaagtctatgatacccatcctctgtgattctacccttcttgtgtgcagagcctgccccatgcccctgatttttttctttaagaatgggggcgtctttgcttttccctgttaattcctgaattccatcctttgccagccttttcaaaccctctaaagcatcttccttcttactcgtggatctcagtgtgcgtccagattttctctcactcaaagcatcacctactgccttcttggccaatgttctgctgtcaagcaacagaaccagttttgagtccatctgaatgcttggaaatgtcagttttcttcttcgatgaactcttcatgcgctttgactttttccctcgactcaatgtatcatctccatctgtgtgtgtcatttctgtaatctcatcagtgccctcaaacatctcaaactcagggaggtcccttgagccccttgagcgattcaaggccctcagctgtgcttttgcggtagcaaggtcaagaagatcagcacccgccagtggtttctttcccagttccctacccatcatcaatcatcatcatccatcaccactcgccaccgtcccagcccgccatggtctcgctcgctggctcccaaatcccctcgccttcgcgggggcagagcccctgcgcggccgcgcggccgcagcgccggcagggacactccatgcgcaccatccgctccgcgctgctgca

SEQ ID NO: 21638 - DNA, 1400 bp, Zea mays
ccgggtataaataccctgcaacacccaccttgccacacccaacccccccctcgtggattgattacagcccgttcatccttccttcccccgtcgaatcccaccttccttcccccgcccgttaagcagccgagtcagcagcaatggcggccgtgctgaggagagccgtggcgcagtgcttcgcgtcgtcgtcgtcgtcgtcgccggcgacgttcgggctccggcggttcctgcaggagcagccggcgttccgccccgccgtgccgcccgaccgcttcatgcccctggccgaccggatccgggacctcggggtcggcgtcgcattcccgcggatcaacctcgacggcctcgtgccgcccgcgccggcgccggcgccggccaagcgggagccggacgcggcgctgcccgcggcgagcctcacggtggaggaggcgcgcaaggtgctgcgcgccacacagatggaggcggcccgcgcgcggattcgggagtccggcgccggcgccgtgccgtacgccgacttcctgcgcctctgctgcgacgccgccggcccggacgcgggcccctccgtcgcgcgcgcgctcgacgagtccggatccgtcatcgtgctcggaaagaccgtcttcctcaggcccgacatggaaaagattcaaagaaagggcgctgttctaaaacgataataagagatgttgccacccaaagtttgggcaattttactccgctccaagatgggagtttttcttctctcaaaaccaggagataaaaaccttaattttaactccccctgtccaaatcttagaggatacaagaatctgaatctgactccgatgaatgaacatgaggagaattcacctaaccctcttctagacaccattaatttcgaaataaagaagttagtatttcatttggtaaatatatattggcaaagtgtagtatttcaatagacaatttacagatgtagccccatcacatgccagtggtggagggtcgaattgatgaatctgttaacttgtataaacttagttaaaaataagttaagtatataagtaaaaaaagtttattgtagagtaaaattgttaatctgaatgtttatgccactttgatttgattttaagcgtaggggaatcttctgattttgcggggagtaaaccactaaaggttcattgtttgatttttcattatatgtggcacagaaatatcttccctttgataaaacaactaagggagttctatttttttgacatcagacgaaaataccttttcacctttcctgtttgtgttacatcctatgtttatcagaccatgctgttctagttactaacttactattgctaatcattttttttctcctagctgaatgcattatcgtcaccatccatttgaataataggatactgatgcagggc

SEQ ID NO: 21639 - DNA, 1058 bp, Zea mays
gaaaaaatcagccagatcgaatgcgcgtttgctcggtccaggatgcgcccgttcccgcccaaattttgaagccacacacacccagccaccttgaagcttacaggcacaacttcaacagatccagggcacccagtagcgtgatagcgtcgatcttcctagcttagtgtgtgaaaacacgcgggatcgatcggattcaaaattttcgaaaaggaacgagatacacagagacagcggcgtttagaagcaaaagtccagagacttgtgactctctgagaggttttgtcactttgcctgcccctgctgcaccatcgtctctcggccacgtactgggtggtctgctgggcaaacggctgctcaccttgaagctgatgttcttagcgttgaaatagttagctaggatggttactgaggcggtgttgtaggtgcggagcggctgcccgtcggggccgcggtcgctggcccggtcgtgccacttcaccaccgtcacgtcgcgcccggcgccctggaacgtgacgtacggcttcgacgccggcactaccaccttctctatgtacgtgccggcgttgatctgcacgacgacgcgcacggtgttgccctccggcacggagtcgacggcgcgctggatggagacgaagtcgccggcgccgcccgcgtccaccacgatcttccgcacgcccaccgggtgcctgtaccggtggccggagtgctttctgtactcgcacttggccgccgcctgctggctcgcgacgaccggcggcaggaggaggctcgcgatggttgagcagagccagcagcacgaggatgcgagccatatgtaccgcttcgcgaaactaattaacgcggattcttgctagctcgttgcggcgccaataataatgtccttgatcgagtagcttgcgagcgatggtgaggttgctttggtatgcgtggccttcgcttcaatgcgtcttgtcaacctatcactctactagtttttttctcgctcgtcaccttctctctctctcttcacatgcacaacatacgctgagacgacggagggcgaggcgggggcggggtac

SEQ ID NO: 21640 - DNA, 992 bp, Zea mays
ggagggctcttatcgcaacaaggacgaggaaataaatacgtgtttcctcgtagagcggctaaccctggtcagactcgggaatgaaaccgatgggccgtcgagtgcagctcgcagtcctcgtagagggagcgggcgtcgcagaagacgaagtcgatggagccctcgatgtagcagtcgcggaagtagtgccggccggcgtcgtcgcacagcgtgtcctgcgcgccgtagaacccgcagccgaagaagaaggccttgtcgccggagatgcggaacgccaccgcctgccctccttgcgtgccgggcatcggcgccggagctgtgttcttgaagctgatgttcttagcgttgaaatagttagctaggatggttactgaggcggtgttgtaggtgcggagcggctgcccgtcggggccgcggtcgctggcccggtcgtgccactccaccaccgtcacgtcgcgcccggcgccctggaacgtgacgtacggcttcgacgccggcactacaaccttctctatgtacgtgccggcgttgatctgcacgatgacgcgcacggtgttgccctccggcacggagtcgacggcgcgctggatggagacgaagtcgccggcgccgcccgcgtccaccacgatcttccgcacgcccaccgggtgcctgtaccggtggccggagtgctttctgtactcgcacttcgccgccgcctgctggctcgcgacgaccggcggctggaggaggctcgcgatggtgaccagagccagcacgaggatgcgagccatatgtaccgcttcgcgaaactaacgcagattcttgctagctcgttgcgacaataatgtccttggtcgagtagcttgcgttgcgagcgatggtgaggttgctttggtatgcgtggccttcgcttcaatgcgtcttgtcaacctatcactctactagcttttttctcgctcgtcaccctctctctctctcttcacatgcacaacatgagacgacggagggcg

SEQ ID NO: 21641 - DNA, 1708 bp, Zea mays
  misc_feature (2)..(31): n is a, c, g, or t
tnnnnnnnnnnnnnnnnnnnnnnnnnnnnnntttttttttttttttttcgcagattcaaacataatggaacaacttgaattgcacatccaaggtctcctatgcagagacataacagactcactgctcactgtctagtttacactgcacatgacgaagttttggaaactattttttatagacgaaatgaatcttgaatctgacttctgcgccagtggatcactatacatattcagtggcttgtaaatggtgtcttattctgtctttatgctgtacgaataaattaatctggtttgctgtaatcgatgtgtctcctgactctcgcgcgtgtgtttgtgtgtttttcagacatcaggtgtgagccagtggtatccgttgacgaagctcttgccgaggaaagggcgggcggcgaagtagtcgagctctcgcgcccaggagacgccgtgcacggcgtcgacgccggggccccagttcctgtacatcccgaagaacgccgtcatgctcttgttgctggtgtggtcccagtcatcccagccgcctggcgcgatgacgctgtcgaagtaggtgtaggcgtagacgatgcgcgagtactgccccatggcccgccccacgtagagccgccccgtgccggtcacccggcagttgacgaaggcgaagccggtgcgctcgcacgggtcgcgccgcccgtgcgccgccaccgagccgaaccgctgcgccgtcgagtgcagctcgcagtccttgtagagggagcgggcgttgccgaagacgaagtcgatggagccctcgatgtagcagtcgcggaagtagtgccggccggcgtcgtcgcacagcgtgtcctgcgcgccgtagaacccgcagccgaagaagaaggccttgtcgccggagatgcggaacgccaccgcctgccctccttgcgtgccgggcatcggcgccggagctgtgttcttgaagctgatgttcttagcgttgaaatagttagctaggatggttactgaggcggtgttgtaggtgcggagcggctgcccgtcggggccgcggtcgctggcccggtcgtgccactccaccaccgtcacgtcgcgcccggcgccctggaacgtgacgtacggcttcgacgccggcactaccaccttctctatgtacgtgccggcgttgatctgcacgatgacgcgcacggtgttgccctccggcacggagtcgacggcgcgctggatggagacgaagtcgccggcgccgcccgcgtccaccacgatcttccgcacgcccaccgggtgcctgtaccggtggccggagtgctttctgtactcgcacttggccgccgcctgctggctcgcgacgaccggcggcaggaggaggctcgcgatggtgagcagagccagcacgaggatgcgagccatatgtaccaccgcttcgcgaaactaacgcggattattcttgctagctcgttgcgacaataatgtccttgatcgagtagcttgcgagcgatggtgaggttgctttggtatgcgtggccttcgcttcaatgcgtcttgtcaagctatcactctactagcttttttctcgctcgtcaccctcttcctctctctcttcacatgcacaacatacgctgagacgacggagggcgacgcggggtaccaccaacacgggcaagagggcggggcatatatagaggtgagtgagaggagcgagctgaggtcaagaaccaacggaaat

SEQ ID NO: 21642 - DNA, 1049 bp, Zea mays
agcaaatagttaattttcccctgtagacccgtccctgtctccaacttcagagcatccaatcgctcaacagcgccactgatgagcctctgtcgtcgtcgtcatcagtgaaccaggcgaggcgacgatcggacccgggtcgtaagcggtaagcccaccggctcaacagcaggctgcagatccccccaccccccacgcaactccatctcctctccgcctccacctgcacccatcgagcaccgaacggcggcggcatggaggctggcggcgaggagttcgcgatcggcgtggtgatctccgcgaagaccaccctgggggaggagttcgagggccagatcgtcgccttcgaccgcccctccaacctcctcgttatccaggagggcgtgggtagggcggagaggggggagcggaggaacgtgagggtcctcaaagcgaactacatccgggagttctcggtggtcagtaagggtgacgaccctctcgatcctgccagctgcatgctggacctcaactccatttatgcccgggaggatgctgcactcaggcaagcagagattgaagctgagagaattggtgttggtgtcaccccagaagctcaaagtatatttgatgcgctgtccaagacgcttccggttcagtgggacaagactgacattgtcgtaatgaaggaggttcgtgtacgcagtccgtacctgcctgaaaatgttaatggaggaacagctgcagcaaatgaacgcgttaagaaagtgattgactttgaaaggaaaagattacattcacgtgtacctggccaattctcttgattaaaaggcttgactattttttacattagcctcgtgttgtatttctaatactgcatccagttttcttattctcatcgatgcggttttctataaaatgtttcagcaaaaatctgtcgtaataatcacatcaactagctagatctgtactgtttggtagttattcagatttttataaaaatattttggatccaaaaaaaaaaaaaaaaaatggcccagaatcatttgatgaggccgttgtgctttttgttt

SEQ ID NO: 21643 - DNA, 1019 bp, Zea mays
gtcgtcatcatcagccccgggtgtggcgctggtcggctggtgaactgggccatcttgtctcgtgacgatcagccccgggccgtaagcccaccggatcaacagcaggccgcagattcccctgtttccagaactccgtcgaatcctccccctcctccacgcagacgcagctcgctctcctctcagcccccacccatcgagccgctagcgccggcgcccggcggcggtatggaggctggtggcgaggagttcgcgatcggcgtggtgctctccgccaagaccaccctgggggaggagttcgagggccagatcgtcgccttcgatcgaccctccaacctcctcgttatccaggagggcgtggggagggcggagagcggggagcggcggaacgtgagggtgctgaaggcgaactacatccgggagttctctgtgctcagcaagggagacgaccctctcgatcctgccggttgcatgctggaccttaactccatttatgcccgggaggatgctgcactcaggcaagcagagattgaagctgagaaaattggtgttggtgtcaccccagaagctcaaaatatattcgatgcgctgtccaagacgcttccggtgcagtgggacaagactgacattgttgtaatgaaggaggttcgtgtacgcagcccgtacctgcctgaaaatgttagtggaggaacagctgcagcaaacgaacgcgttaagaaagtgattgactttgaaaggaaaagattacattcacgtgcacctggccaattctcttaacctaaaagtattgatttttttttacattagcatgtgtttctgatactgcggcccgttttattattctcatcggtggggttttccataaaatatttcagcaaaaatgtggtaataatcacatcaactagcttgtttatgaactgtttgatagatgacttgttgtaattgaattgattataagccctctgtatttaggactgttagattgataataatctcctcttttttgaaaaaaaaaaaaaaaa

SEQ ID NO: 21644 - DNA, 1417 bp, Zea mays
cttgcgacctgattcgccatgccctgcgtgtcctttcgaaaacggctgtcgacactgcccctctcgctcgctttccactcgattccagcaggcgtgcgtggcccaagtacccaacgcaccaccaggtggggcatctgctccacccccactccacttccactagcaccaacaccaacagcctcgccgccagccgcagccacgcgacacgacgcgacgcgagacgcggagcggtacaaaaggtggactgggtgggtggctggttccgtggttcaactcctaccactaccacagcaccaacgacggaccgggcaggcagagaaaaagcagaccagacgagacctctcgcgttccgtcctcctccctgcccctgctgccgttccccttcttcctcagttctcccgcccgctgctgccctccgtccgcgtccagatcccgccaccaaccgatccggcgccctccagcatggcgggggcgggggcgaaggcggcgggagccctggctctggcgctcgtgctcgcgctcgcgggggccaactccgagggcgacgcgctctcggcgctgcgccggagcctcagggaccccggcggcgttctgcagagctgggaccccacgctcgtcaacccctgcacctggttccacgtcacctgcgaccgcgacaaccgcgtcacccgcctagatcttggtaatttgaacttatctggtcatctggtgcctgagcttgggaaactggagcatcttcagtatctggaactttataagaataacattcaaggaacaatcccttctgagcttggcaacttgaagaatctaataagcttcgacttgtacaagaacaacatttcggggacaatacctcctgcccttggaaagttgaagtcccttgtattcttgcgtctcaatggcaatcatttgactgggcccatcccaagggaactcgctggaatatctagtctcaaagttgttgatgtttcaagtaatgatttgtgcgggacgattcccacgtctggaccatttgagcatattcctctgagcaactttgagaagaacccgcgcttggaaggtccagagctacaaggcctggccatatacgacaccaactgctagagggcaccacgaagaaaagaactgctagaaagtaacgagcgaacaaggttaccagaaattgggcgatatagatttactaggtctggatctgtaatcctccctgcatagctcttattcgtaactcgctgtcggcacgaaagttggtgtgtgttttagcagaatgctttctgtccgtgaaagtaaacttgaaactgcttattacgactgaaatgatattgtcgttccccccaaaaaaaaaaaaaaaaaaaaagcccaggttaaaaaaaaaaaaaaaaaaaaaaaaaaaaaaaaaaaaaaaaaaaaaaaaaaaaaa

SEQ ID NO: 21645 - DNA, 1260 bp, Zea mays
cggaccggcacccccgggtcgacccagcctaccaccactaccaagcaggcaagcaccagcccgccacccgcccaccccaccactccaccgggcaggcatccagcgacggaccgggcaggcagagaaaagcagaccagacgagacgtcgtgcgtcgcgtcctccctgccgttccccttcttcagttctcccgctgctgctgccgccgccgctctccgtccgcgtccagatcccgccaccccaaccgatctgccggcctccagcatggcggcgggggcgggggcgagggcgaaggcagcgggagccctggcgctggcgctcgtgctcgcgctagcgggggccaactccgagggcgacgcgctctcggcgctgcgccgcagcctcagggaccccggcggcgtgctgcagagctgggaccccacgctcgtcaacccctgcacctggttccacgtcacctgcgaccgcgacaaccgcgtcacccgcctagatcttggtaatttgaacttatctggtcatctggtgcctgagcttgggaaattggagcatctgcagtacctggaactttacaagaacagcattcaaggaacaatcccttctgagcttggtaatttgaagaatctaataagcttggacttgtacaagaacaacatttcggggacaatacctccttcccttggaaagttgaaatcccttgtattcctgcggctcaatggcaatcatttgactgggccgatcccaagggaactttctggaatatctagtctcaaagttgtcgatgtttcaagcaatgatttatgtgggacgattcccacatctggaccatttgagcacattcctctgagcaactttgagaagaacccacgcttggaaggtccagagctacaaggcctggccatatatgacaccaactgctagaaggggcaccacgaacaaaagaatcgctagaaagtaatgggcgaacaaggttaccatatattaggtctggttctgctgccactctgtaatcccccctgcatagctcttatttgtaacttgctgtctgcacgaaagttggtggatgttttagcagaatgctttctgcccgtgaaagtaaacttgaaactgcttattatgagtgaaatgatgatgttatttcccttgccaaaaaaaaaaaaggccccgtgtttttttacccgaacttgtcggtagtacgatttaagcgaaccagtttatccctgctgtggcaaatttatggaaggacggtcatgatatcgatcgacttg

SEQ ID NO: 21646 - DNA, 1086 bp, Zea mays
cctcgaggccggccgggagtgggtcccaacacgacgaagtagcgtcctccctgccgttccccttcttcagttctgccgctgctgctgccgctgccaccctccgtccgcgtccagatcccgccaccccaaccgatctgccggcctccagcatggcggcggcggcgggggcgagggcgagggcgaaggcagcgggagccctggcgctggcgctcgtgctcgcgctagcgggggccaactccgagggcgacgcgctctcggcgctgcgccgcagcctcagggaccccggcggcgtgctgcagagctgggaccccacgctcgtcaacccctgcacctggttccacgtcacctgcgaccgcgacaaccgcgtcacccgcctagatcttggtaatttgaacttatctggtcatctggtgcctgagcttgggaaattggagcatctgcagtacctggaactttacaagaacagcattcaaggaacaatcccttctgagcttggtaatttgaagaatctaataagcttggacttgtacaagaacaacatttcggggacaatacctccttcccttggaaagttgaaatcccttgtattcctgcggctcaatggcaatcatttgactgggccgatcccaagggaactttctggaatatctagtctcaaagttgtcgatgtttcaagcaatgatttatgtgggacgattcccacatctggaccatttgagcacattcctctgagcaactttgagaagaacccacgcttggaaggtccagagctacaaggcctggccatatatgacaccaactgctagagggggcaccacgaacaaaagaatcgctaggaagaaatgggcgaacaaggttaccaaaaagtgggcgacatagattattaggtctggttctgctgccactctgtaatcccccctgcatagctcttatttgtaacttgctgtctgcacgaaagttggtggatgttttagcagaatgctttctgcccgtgaaagtaaacttgaaactgcttattatgagtgaaatgatgatgttatttcccttgccaaaaaaaaaaaaaaaaaactcgagcccgggtcgttt

SEQ ID NO: 21647 - DNA, 2120 bp, Zea mays
ccggccgggatcctgctagtaacttttactcggccccagatgctgctataccttctgtacatccaagcatgtctgtcttagggtcaacacgtcaggctccccgccgccctggccctgccgaatgatcatggtcggctgcctatttaccaatctattctcccagttatccctacttatagtgccccaaaatgttcaggagaacttgagtttcgtgttttatgccctggtggaaaaattggcttggttattggaagaggtggggctaccataaagaatataaggcaagagagtggtgcaaggatagatgttgatgatgcaaagaatgacaaggaggaaagtatcattaccattatatccactgagtccaccgatgatgttaagtctgccgctgtggaagctgttttgctgcttcaagccaagatcaatgattctgaggatgatagaatgaatcttcgccttcttgtgccaaataaggttataggctgtcttattggcaggggtggttcaatagtcaatgacatgaggaagaagactaaggcaaacatcctcatttcgaagggcgataagccccggagagcatcttccagtgatgaacttgttgaggtatctggagaagcagacaagctgcgtgatgctcttgttcagataattttaagacttagggaagccgttctgaaagagagtgttgaaagccaaaattctgacagggatggccaactaactgttgctgcctctgattccttatatggaagcagtcttcctttgcctgcattattacctcacaaccaacaaattgcccccttgggctatgatagaagaggtgaacctgagcgagctctggaagtattccctcgtaccagttcgtatgggtatagttccatgcaggtcacggatgatggctatggaggacttccatcctatgcatcaaaggcatatgaagaacatgtaccacgtttggaaatgactgtacctgctagtggcatctcaaaagtaatgggaaaacatggcacaaacttggacaacattagaaagatttctggagctcacattgaaattattgaaccaaaatcctctcgtcatgagcatattgcttacatatctggaacctctgaacagaggcattcggctgagaatttgatcaaagctttcataatgtctacctaagattccttctgtggtctgagaacaccatttcatcaatttgatctcttttgacttctgctatccatagtttccctgggtttgtgaacatcaaacgtagtgttttctcccacctgtccaagttcccaatgaatactgggcatatctgagcaaggtgtactccagtggtagacaaggcactctatgttccttagatcttcaactgttacctatttatgttggcatacttatcataattcgcgtgtcttactctaaattatctcaatgactggaccagttgctgcttactgatatctctttctattgtcctgccaatactgagttgattattccttcacaactacagtagaggggcctgtttctcaacctcaacgtctgattcactttctgcttagtgtagctcttataatttcatcccatcagactgctatctgattcattaggttagtagtaccaatgccctatttggaatttggaatgcgagaatgaacctttcacgaaaggcttgtccaaaactccttgagattcctgtgtttcaaacactctttggaattcccagtgaatgctgttggctgattcatttggtgcttattgagtttttgtatctctactctgcctatgctgctagctgtgaccttagagaggatcttgttccttgtcaatctgactagttcacccattgcttgcttcggtagttcggttcttatatctttgtcatgtcattaccttactctttcatcatcggttccaaagagttgcttgtttttctgctaactctgctgaggaaccataagttctttgtaaacttgcctgaaaacccctagaggcctagacttttaggagcaaccatgtacataagcttagtcacgttcttggatcacaatatgcagatcaatttttttgccttctgcaagtgttttgtgatcatgattggtgggcgtagacacagggcgcgcaaa

SEQ ID NO: 21648 - DNA, 1620 bp, Zea mays
tgggtacaccgccggcgacggctgcacgtcaagacctccacgaccacgactggaccgccgccgagcggcgacggcccctccctcctccattcccccgcgtccctctgccggatcctcccgtccccgccgctctccgcccgggcgcggacgttcgaaagattccttccgtgcacccttgttaactaaacaatgaggcagcagactggtaagcgtccctcccaacacagggaatatgaaagagaagaaaggaaggaccaacacaagaggccgtttccccgtgctcaggaaagctctaataatgatgggctggttctttaccgtatactctgtccagacagtttgattggtagtgtcataggaaagcatggcaatgtgataaatgctatcaggcatcagacaagtgccaaagtcaaggttgttgacccgtaccccggtgcagacaaaagggttatcttggtatattgctacgtcaagcatagagaccttgatgctgagggtgatgacaatgagcctgtttgtgcagctcaagatgcattacttagggtgcataatgcaattgttgatgcactgcagacattacataagaatcataaagactctgataagaagagcacagaggaagctaacattcttgtgccagctagtcaggcatcaaatgttataggaaaatctggtgctgtcatcaagcatcttcggtcaacatcaagagcattcattaaagtgagcccaaaagatccaagtgaccctacacattcatgtgctatgagttttgataattttgttcagataactggtggtgctgaagctgttaaaaaagcactgtttggagtatcaaccatcatttacaagcacccatcaaaagagaacattcctcttgaaacttcaattcctgatcctactccaagcattataatcccttcagaacttcctgtctatcctgctagtaacttttactcggccccagatgctgctataccttctgtacatccaagcatgtctgtcttagggtcaacacgtcatgttcccgaacttgctgtacctgccgatgatcatggtcggctgcctatttatcaatctattcttccagttattcctacttatagtgccccaaaatgttcaggagaacttgagtttcgtgttttatgccctggtggaaaaattggcttggttattggaagaggtggggctaccataaagaatataaggcaagagagtggtgcaaggatagatgttgatgatgcaaagaatgacaaggaggaaagtatcattaccattatatccactgagtccaccgatgatgttaagtctgccgctgtggaagctgttttgctgcttcaagccaagatcaatgattctgaggatgatagaatgaatcttcgccttcttgtgccaaataaggttataggctgtcttattggcaggggtggttcaatagtcaatgacatgaggaagaagactaaggcaaacatcctcatttcgaagggcgataagccccggagagcatcttccagtgatgaacttgttgaggtatctggagaagcagacaagctgcgtgatgctcttgttcagataattttaagacttagggaagccgttctgaaagagagtgttgaaagccaa

SEQ ID NO: 21649 - DNA, 3195 bp, Zea mays
aattcggcacgaggttccgaccgattgaggcggcgcaaagcaaaggaaaaccccaggccgcaaccctcgcaaacactcgagtcctcgtctcttccgcaccctcctcctcttcaactccagccgccgtccgctcgggctcggaccgagcctctccgccgactccgcgcctccgctgctcattgctcaggcgctccgcccgccgtccgccgtccgctcgggcttggagcctcggaccgagccgctccgcgactccggcgcgccgtccgccgttcgcccgacagcccgagaaggcgagcaggagcagctccgcacctcagcccgccgtccgctcggccggagcacgcgccgttgcccctgtgcctccgttcgccggtcgagccgctgtccgcgtccctgtccctccgtccgccgagctgctgtgccttccggcttcgccgtccgccgagcagatccgtccgcgagcgcgacacgccgaccgccgagccatacctaattttttttccgtcctccgccactgatcaggaccaccaatgggccatgacacttggaaatcctatgcttgggccatgaccaccaatgggccttcgccgagcatcgagaagcctccgcgcccgccgcacgccggaggaaaggaagtcaccccatccccaaattcccaaagccaacaccgccgagaaggacagagactggaagcgcaagagcaggcgccgcgcgtgctggcgatggagagggacgtcgtgctctccgcacccgaggccgctgggtcctcgtcctcccccgcctcctcgtcgtactcctccttcgccgagaccagggtcatctgccgcgtgtgtcagaagcagttcgcgcagtacacttgcccccgctgtaacgcccggtactgctcgctctcgtgctacaaggcttgcagcaggtaggatatggtaatgttgcactggtgtcaatagtcttccctgacgacatcttggcaccccctggctctgataccacttgtcaggaaccacgccggagagacaaccttcagcaggttgccgacaaactcctacctcccagggtcatagtgttcaatgcactgaatccttcatgcgtgagaatgttatgaacgagcttaagcagatgcaacctgaggatgaatcaaagaaaaagatgctagatatcctcaagcggctccacttggaagaagagatggcatcagatggtgaagatggtatgttctgcgtgctacatgttcctatgccattgatctatcttactttctttaataataacactagaggtgcacataatttcatttttttttatattgtgataactgctaatgaggacaaaactacagatacctccatgccagtggtggattcagacatgagacaagagaggagctaaatataattgaaccataaactaaaagctataatttatataataaagaataactatgtaaactaacattgttcaagcaacatgtaaaatatttttcagctgcgagagagggagaggctggctgtgtcgttgttaggtcgggtggggctgggccttcaaacctggaatttccctgggctgctgaggtgaaaattacagggggtattctcatttttcttgggctcaccccgggatgagcccccctaccgcttgggctctagggctgcccctgctccatgcgcagtatgctacacttacgattttactgtttggtacattaagttttcctgtttataggtagttttcccgtgctggtggcttgtctgttatgaatgtatttcctttcggtattacggataaattatatgtcatcttgtagataattggttgtacatatttatatagtagactgagaaacggcaaacccagtgccggaggtctccacatgagtgggtccgggaagggataaactgtgacctggtgactttgtgcgacagctctcaccactgtaccaggcctgcccttcaatattgctttagtagactgctgaagattttatttttgacatgtacctttttgtcctgcagagtccatgttatcagaggagcttattcaaaaagttatgtctggggaagagataaagctggaagacctctctgattgtgaaatcaaacgattccgtcaagctctggcctcaggtgagctcagtaagatgattgaaccgtggccgccttgcccggcgtcgccccccgcctccgctatttcccttggcctggatggaagtcagcttatcagacaagtaaacgcagaagacactgctgtaccatatccagatccaaatactgaccaagaggctagcatcaacgaaatccctgaagggccagaatctcctctcccgtcattgaaacagttaacaaggacagagccatctcctttgcttgctgtccacttggttgacattctgtacagttactgcttcacacttcggctctacaacggtgattggcactcagatcctttgggtgcttgcactgtcgccctgtcgatgtcgaaagtcatgggccaggatgctaaacctgagactgtacctgaagcactcgcagcctgcatcgaggagacatgctcaccagcttacaggcatactggtggtttcaggtttgctattggactcgtggacgatatcatcgccattctctccttgggacagaacgcacttatttgtgccttatgcgacttccatcgactcattgaagttggtaagagcatgctcaaggtggagaaagtgggcaagacggagagggcacagaactctccgaagcttcgtagtgcagctaggaagctattcttcatgacttgttgggtccatgagcagccagatgaggcgtggccatctttagctcacatcgtccaggtgcagaaagcatctatggaggagttggagaccgggaattggaaggcggatagaaagagcaaaccacaatccgcggttcttatcgaggagctgtaggcatatggatgtaccactggaaattggatcgcgaggctatgtacccttgtgtatcgctcaggatgaatccaacgagagaccgtccttgtaatgcagttagttgcttctgtgtacacttttttttgaaaaaaattgtatttgtatacgagtttgaaatcctagttgaagcgatcctgctttactttgcttgttaagttgtgggctgatttaatccatgcgttggagcttatgcagttcagataaaaaaaaaaaaaaaaaaactcgag

SEQ ID NO: 21650 - DNA, 1784 bp, Zea mays
cattgggaccctcgaggccggccggcggggggaactcccccgtccccaaattcccaaagacagtaccgccgagaaggacagggagtcagagactgagagactggaagcgcaagagcaggcgccgcgcgtgccggcgatggagagggacgtcgtgctctccgcacccgaggccgctgggtcctcgtcctcccccgcctcctcgtcgtactcctccttcgccgagaccagggtcatctgccgcgtgtgtcagaagcagttcgcgcagtacacttgcccccgctgtaacgcccggtactgctcgctctcgtgctacaaggcttgcagctggtaggatatggtaatgttgcactggtgtcaatagtcttccctgacgacatcttggcaccccctggctctgataccacttgtcaggaaccacgccggagagacaaccttcagcaggttgccgacaaactcctacctcccagggtcatagtgttcaatgcactgaatccttcatgcgtgagaatgttatgaacgagcttaagcagatgcaacctgaggatgaatcaaagaaaaatatgctagatatcctcaagcggctccacttggaagaagagatggcatcagatggtgaagatgagtccatgctatcagaggagcttattcaaaaagttatgtctggggaagagataaagctggaagacctctctgattgtgaaatcaaacgattccgtcaagctctggcctcaggtgagctcagtaagatgattgaaccgtggacaccttggtggaaaaaaccctcagccagatctatttcccttggcccggatggaagtcagcttatcagacaagtagacgcagaagacactgctgtaccatatccagatccaaatactgaccaagaggctagcatcaacgaaatccctgaagggccagaatctcctctcccgtcattgaaacagttaacaaggacagagccatctcctttgcttgctgtccacttggttgacattctgtacagttactgcttcacacttcggctctacaacggtgattggcactcagatcctttgggtgcttccactgtcgccctgtcgatgtcgaaagtcatgggccaggatgctaaacctgagactgtacctgaagcactcgcagcctgcatcgaggagacatgctcaccagcttacaggcatactggtggtttcaggtttgctattggactcgtggacgatatcatcgccattctctccttgggacagaacgcacttatttgtgccttatgcgacttccatcgactcattgaagttggtaagagcatgctcaaggtggagaaagtgggcaagacggagagggcacagaactctccgaagcttcgtagtgcagctaggaagctattcttcatgacttgttgggtccatgagcagccagatgaggcgtggccatctttagctcacatcgtccaggtgcagaaagcatctatggaggagttggagaccgggaattggaaggcggatagaaagagcaaaccacaatccgcggttcttatcgaggagctgtaggcatatggatgtaccactggaaactggatcgcgaggctctgtacccttgtgtatcgctcaggatgaatccaacgagagaccttgtccttgtaatgcagttagttgcttttgtgtacacttttttttgaaaaaaattgtatttgtatacgagtttgaaatcctagttgaagcgatcctgctttactttgcttgcgaaattgcgggctgatttagcccccgcgttggagcttatgcggttcagat

SEQ ID NO: 21651 - DNA, 1139 bp, Zea mays
ttaatttttaagggaccccccaaaaaaaaaaattatttatctttccatagcaaccgggtaaataaaatttggttccttttaaaacgacccccccccttttttttttttttttttttttttttttttttttttttttttttttttttttttttttttttttttttttttttttttttttatttttttttttttttcttttttttttttttaaaatattggaaagacattctctcattaatcttaggtcagattcgaaatacatagtccaagaaaactacaaaacaagttaagtttcatgctctgatgaaacaactattagagcgaagatttcatcgcatcattccctccaccgatgaccacaatcagggctgcagcacacaaagaacagggtcatcccctcctcccctcttgctgcggcctggaagaaaacagcctctccatgcccacagagattgcagcggacagtcttggttctgggaagagttggatcagaagctacatcctgcaagacctgtgttcgctccccagcagtatggtgcacctcgttccgatagacacagttattgtcagagacctcctgatgctcgcagttgcgacatgcaaagaacagggtgcgcctgtccctgtcctccttggggtacagaatgttgttgcactcgcgacaaaacttcatggtgctcatggttgcagcagtagtgtcttcttaaagcccagagttcagggttccaaaatgcttccgccttggtggagcagcggctgctggctcccgctgccctcgagacgcgcgcagcgctgccgccggggccgggcgccgttgacgatccaccggaggcgggaggagaaaggcaagcacgcagggtcaccggccggtgtgcagaggaccggggccgagggcgcgcggtgactggcgagaggccggaggggaagccgctgacgcagtcgcagagcccgagcctgagcgccgcagccgccgcctgcgtgccgatcgcgagtaaaaaagggagggaagatgaagcgccggcgctgcgagattgaagaaacggcggcggctctgccctcgatggagtagcgaaaagttcagggtaaagaaacgtgtattgggtctgtgctgaactgatcccggccgggagcctcgaggg

SEQ ID NO: 21652 - DNA, 779 bp, Zea mays
cctcgaggccggcaaggaggggggggagagagagagagaaagtggtggggattcgccatggacatcatcacgcagctgcaggaccagctcgacgagatggccgtgctggccatcaacaccttcggcacgctgcagagggacgcgccgccggaccgcctctccagcagctaccctgacccgctcaaccccaaccctaagcccgaggacgactccaaaccccaggtccaggcccagcccggcgcgccgccgccgccaccggcgcaggcgcagccgcccgcgcctgacctcaccgagcaacccaaggctatgagccgcgcccttgtcctcgcggccaagaagtttgatgcacttgttgcagcagtgccactatcatcagaagaggatcaagtgaaaagaatccaagagctacaggcagagaatgaagtcgtgggactggagctccagaagcaacttgaagctgccgaaagggagttgaagcaggttgaggtgctgtttaatgaagcaacagacaattgcataaattttaagaagctagattaattacgttaatgtttgctgaaaggaaactgttcccatggatggacgagtgtggaggatgaatgccagtaagaactttatattccgtcttttcagattctctactagtgaacaataattgcacttagcttttgtgtactggcattctgatctgccggattaggattgacctttagttgtaaggtgcaatgtttttagtatgaacctgacgcttgaactgtggtggcccttttaaaaaaaaa

SEQ ID NO: 21653 - DNA, 3085 bp, Zea mays
cggggactggccgaggccgatgatgatgtgtgaacgtactacaagctcttcggatcggttgatccattgtttttaaaacttgcaacctgctctgccagtgtgcgtgccatcaccggccgtatcaaagcaccagtactactaaacaacggggggcttaccacagctcacagatagctagactactgctaccaatacaaaatacgcgcaggctagctcacgttaaactgacatgctaagtgtgtagtttataggatcagaggaaaagattggacttttgagcaggctttgcacagcagtatttttctacgtactagtacgctatacgtccgtgtttggccagatacgctattgctatcctagacagacaggacagccgacacatactcgtggtgtcctgacgcctaaccatgaggcgcggtggggatctgtgcgcaactggctgctgcctgcgaggcgcgaagtcagagcctgccggagtcaacccggataatttgctccgagcaaagtccatcctccggatcaaagcacaaacacaacacagacgttcatattgcatcggacagatagaggagctgaccgtgggacatggtggagatcgatcagtgcacggggccagctagccgtgacggacgtgagtggtggggtggggtggagacgtcacgtggacgtggagtagaggcgcgatggcgggtaatgatgatggtggtggctaggttgggatcggtcgctggctcgctgttagtgcggtgtagttgaccggccgtgtctgtgtcgtcgctgcgggctgcagcagagccgtagcgtgcacacaaccctccaggctctgatagcttctcgtccgtcctcccgttgcgcttgccttttgcgtttccaggccgagtgggatcggccaggtggcgccgcgcctcggtgcggtgcggacgtgcggtggtggtgcctcccgtatggtcggcggcagatgcatgaaaacccatccggttccggtcgaccatatcgccgcttcttttgcgctgtttttcctttgcggccaaggataattactagtagttgtagttgcattgcacacaggggagtgcttcctcgcaacaaacttctgttcagatctcgggctccatgaacagttggtccggtgacgagtgttgcttctctttcatctcgtgcatgcatgcatctatcttcttcggatccacgtctgggttgacaggaatgtttctagctccgtcactcggccggggatggaaacggaaggaagcgccggcttgcattgacctcggtttgaacgggagcagagacctgaatgctgatgcgtcaacgccaggtcgccagcaggagatgagatgaagcggatggctcgtaacttgtacacctcaaaatggtcgattagtattttggcagcaagtgtcagcggagcgtaggatgttatgcaacacgtgaatttagttagtggaagtctacaccatttgtcgggcgcatgaaaataccaaacagaggtgcgaccgatgcgtgtatgaagacgcatgccaccaacgttcatggttggggacacaatagtggtacatcacaaagataaaattggtatcaattaattaattatcaattaattaataaattaacaaatcaatattggtatcaaataattgacaaccatgtaagcaaaagagtctctagctaatgtaaccaccccttcggttggtcttttgggagtgccaaaacaggttgctttgcatgcacatactacatgtatcaaatggaagtgccaaaaccattccataattccgctcacaaagcagatgatttcagtatagagaaccatccaaattcagattacatcccaaaaaacatctaattatagtacattgatggcctacatctcattacggtgccaaagtggcaggcaacctattcttgtcagactcagacacatctcaatcacatccagttcccaacctgcagctagcttccatcctcgtaaatggtttgcttcctgtgctactccatccgcgagcgtaaccctacaacgcggatcttcccattctgcttatttctctctgctgaaggttagaaagggcaacagcaatgttcgcaccaataagagcattgttcttaacaagtgcaatattagcttccaaggaagatcctccggttagttcttttactctttcaagcatgaagggagtgatcgcatttcctattatccttttatcccctgcctcttttagagctgtctgtattgcagactctataattttccctgaagttgcatgctgcttggggatcggtactgcaataagaatcccagaaccaagacgtaggttcttgtttgcatatattattttggcacactcttctggagaatcaacacgacatggcacctggcatccactaatttctgtgaagaacgcgggaaattcattggttctgtaagcagcaacagtcaccccttcagtttccaggtattcaagtgtccgcggtatgtccaaaatggacttcacacctgccgatacaacagctacaggagtctttccaagttcagttaagtctgaggagacatccatagtttgttcaccatgtctatgcacacctccaatgcccccagtaacaaaaactggtatgccaaccttgtgagcaaagaacatagtggccgaaactgttgttgcgccgttgccaccagatgcgatgacatggacaatatcccttctagccgtcttctgaaattgccttccacttatagccaatctcttcaattgttcgttgttaaggccgacgtgagggactccgtccaggacggctatggttgcagggatagccccgttgtccctgatgatggcctccacctccatggccatctggagattcttcgggtacggcataccgtggcagatgatggtggactcgagggcgacgaccgcgccgcggctcgcgagagcggtcgcgacctccgatgccaccacgatcgacatctgcggactgcggcggctgtgccggttctctctagactgtacggcggcggcggcgaaggcgaaggtaagagtatacagcaattggcgaccgagatattcgtggccgtttgacgtgctaaactttt

SEQ ID NO: 21654 - DNA, 1840 bp, Zea mays
aacaacaaaaaaaaacgcatatcagaaactagaacaccacatgttgacgggccgctttttttttttttttcttcgaggagccttcttcagattcttcccctatcttctaattttctatccaaaagaatacaacagtaactgtgtcgctgataacgggtcttgtatgccaccgtggtgtcttttttgtatcaaaatctggatctaagcccattctgggcatttcgagatgtataacataagttcccccaatactctacaccggtgtctcaaaaaaattacatggggagcggtgcctttaccttttggaatcctaaaatacaatctacaaaggtgtgtatcaaatgaaagaatggctgagcatggcctttgaagaaggatcaccaaccattatagcgttgatcgaaacgattccgttgccctcggtgatctgagcgggatgccttcagcggatctgagagggattccttcagctccatcgtcctcatgtttaggaatccggacaggtagagttggcgggaggccatcaaccatgtcttttgtcttgtggagaagaaacgtccccgaaagaatggtaacaaaaccacacatctctgttacaatttgagttggattttgacgatcccagtccttgaacattatcacgctagccaaaatggttagtgacgtgaacattgtatagtatatcggtgatacaactgctgtgttgaaagtatcaagagccttgttcaggtagttcatctgtgttactatacatgcaacaacaacaatggtgaacaaccatgtttgtggataaattagctgattcatgccagaaaaggtcagtttcaaggctattccaagagctttcacactcatgaccgacagagatcctacaagggaacaaacaccaatatagaccatgatgtgtgtctgaccatatcgtggaataaagtagtatatgaggacaaatgttgcagcaagaacaatggcagcataagatagaaaggctggttcagtagcaagatcccacacttctgctacagattcaattgtgcgctcctgaggggcatgaagtacaatagttgttgaacccacaacacaaagaacacacccaagtataccaaatatatgcagcttttccttcaacataatgtctgcaagagcagcactaattatgatgctaagggcaccaagtggtgtgaccaagatagcaggagcaaaagcatatgctgcaaagttagccacttctccaacaatcattgtaatcattcctgcccaccataatggttcatacaagtaagagtaaccaccaacacctgcgcggacgccggacgcaccggccttcttaagccccttcttcttgacgatgaagctggccccgatgaagaagctggaggagagcgcgagcaccagccccttgatgttgtccgcggacatcccctccaccccgaccccgcccgccgcccgggtagacgcctccgttgccatatccgccgcctgaccacaccgggcccctggagctctaccctcctgcggggcagcgcgcagccgctagatcgcgcgacggcggcggcggcgcattcgagatccggacgcggcgcggggtccggtaggcgcggacactcaactaacccggcagaagcagggtaggtcagtcggtcaccaaaggcgagtgttccgcattcggcggtggcagggattgcgtgggcggagaacgggaggagagatcgagcttcgagcggggggaagaggcggggccggacggtgacgccggcgaggcggaggaggcgaagaagagatgggaatgggatgcaggaatggagagtggcccccgagtccacgccacgcggatatttcggtg

SEQ ID NO: 21655 - DNA, 2303 bp, Zea mays
tgcatgcctgcagctttgcactgaatgagagaggcaattaataaagatatacatacatttttttggcacgagtgtcagaagagaaagaatgcgaaccatgtacagatttccatacatgtgaatagttcacggccgcgacgcgtttaggattctcagaacccaggcgcacagccgaacacgagagcgcaggtacacgagatcactgtcctcgtctccaccgtgttgtggatcggcgacatcattgccactgccaccttggtcaatgagcttgcattcttccttcaccattgatgctcaggtaagctgaattaaagagcgcgctgaaaagggtccgcatttcgatattcttgacgtgtgagttggacacgaaagaatggatcgcttccgcacgagtagagcgaggaagtgctttcccctcacacagaagcaacgaacataagatgaatgaattaacccaaaaaaaaaacgcatatcagaaactagaacaccacatgtggatgggaggtaaagaagtttcttcgaggagccttcttcagattcttcccctatcttctaattttctatccaaaagaatacaacagtaactgtgtcgctgataacgggtcttgtatgccaccgtggtgtctggtgtctatcaaaatccggatctaagcccattctgggcatttcgagatgtataacataagttcccccgatactctacaccggtgtctcaaaaaaattacatggggagcggtgcctttaccttttggaatcctaaaatacaatctacaaaggtgtgtatcaaatgaaagaatggctgagcatggcctttgaagaaggatcaccaaccattatagcgttgatcgaaacgattccgttgccctcggtgatctgagcgggatgccttcagcagacctgagagggattccttcagctgcatcgtcctcatgtttaggaatccggacaggtagagttggcgggaggccatcaaccatgtcttttgtcttgtggagaagaaacgtccccgaaagaatggtaacaaaaccacacatctctgttacaatttgagttggattttgacgatcccagtccttgaacattatcacgctagccaaaatggttagtgacgtgaacattgtatagtatatcggtgatacaactgctgtgttgaaagtatcaagagccttgttcaggtagttcatctgtgttactatacatgcaacaacaacaatggtgaacaaccatgtttgtggataaattagctgattcatgccagaaaaggtcagtttcaaggctattccaagagctttcacaaatgaccgacagagatcctacaagggaacaaacaccaatatagaccatgatgtgtgtctgaccatatcgtggaataaagtagtatatgaggacaaatgttgcagcaagaacaatggcagcataagatagaaaggctggttcagtagcaagatcccacacttctgctacagattcaattgtgcgctcctgaggggcatgaagtacaatagttgttgaacccacaacacaaagaacacacccaagtataccaaatatatgcagcttttccttcaacataatgtctgcaagagcagcactaattatgatgctaagggcaccaagtggtgtgaccaagatagcaggagcaaaagcatatgctgcaaagttagccacttctccaacaatcattgtaatcattcctgcccaccataatggttcatacaagtaagagtaaccaccaacacctgcgcggacgccggacgcaccggccttcttaagccccttcttcttgacgatgaagctggccccgatgaagaagctggaggagagcgcgagcaccagcccctttatgttgtccgcggacatcccctccacccagatcccgcccgccgcagaggtggacgcctccgttgccatatctgccgcctgaccacaccgggcccctggagctctaccctcctgcggggcagcgcgcagccgctagatcgcgcgacggcggcggcggcgcattcgagatccggacgcggcgcggacactcaactaacccggcagaagcagggtaggtcagtcggtcaccaaagggagtgttccgcattcggcggtggcagggattgcgtgggcggagaacgggagaagagatcgagcttcgagcgggggggagaggcgggaccggacggtgacgccggcgaggcggaggaggcgaagaagagatgggatgcaggaatggagaggccccgtggtgcccgagtccacgccacgcggatatttcggtgtcccggccggtcaggccggcctcgaggtacccaatg

SEQ ID NO: 21656 - DNA, 1509 bp, Zea mays
cctcgaggccgtccgaacactgggccggccggttgtccgccgcatccccttgcgttgcgttcacggttctcctctctgtctctcgcgcaagggatctcgttctccgcggcagctggtgtttcgctcccttctcgccctccgacggctggtgggctgccggcgccggcgccgccaaacgccaggtgctgaggccttcgccagtgtcttcgacggcgacgagcacgtaccagcaccaagcatcatgtcggaaagaggtcgcctggcaggacgattgattgataaccgcagcagagggtaccatgtagtccctctagttgaggatcccagaggccatcctgaagtcctcgtggatggggatcggaggggctactctgacattcgtggggttcagcagcgtcggggctaccctgacacccatctgcttgaggaacctaggggctaccctggtgttcgtgtggtcgaccataggggctatcctggcagtcgtggggttgatgaacgcagggcctatcctgagctccatcaaggctcacgcatgagggcggctcctcccccttacccagctgccttcgaggatgagcttgagttacaggaagttgaactccggaggctttcggcacataaccgtgctctagttgaggagcgtgaactgttaagcagggaaatacaagctggaaaagatgaggtccgccacttgaatgtgatcattgctgacattaacactgagaaagaagcttatatcagtaagcttatggacaagaggaggaagcttgaagctgaacttggagcaagtgagcacttgtgtgatgaggtcaggcatcttcgtggtgaaattgacaagctcgttaccgctcggaaagactatctgcagaggctgcatctctcgtggaagagctgaacagggagcatctgttaaacagcagctacctgtgctgaaaacagaaattgatggtctgcaacaggaacttgttcacgtgaggactgcttgcgggttagagcagaaggggaatttggaattgctggaacaaaggaaggcaatggagaagaatatgctttctatggcacaagagatcgagcagatgcgaggcgaattagctaattttgaagttagaccaaggggcccaggtggagcatatgggatgcagattgggagttcggaagtgaccttcactaagaacccatatgaagatggttataatgcttatgtgggggttcctgagaaagatcctttgcatcctcctgaatatgcttcgtgggggacatatgacaggagtcgccttcagtaccgctaagaccagaacttagtcattggagaaagaattgccttctaggttttaatggccatgtcttgtcgtttacagtaccgaagctttatgcctgctgcttggttttccattaagagttgtccttttcaatgcttctaatcataactttttccattacaaactggctagattattaaactattggtaccaagatgtccagcaatgtgcggaaagcaccttacat

SEQ ID NO: 21657 - DNA, 1579 bp, Zea mays
gtccgaacactgggccggccggttgtccgccgcatccccttgcgttgcgttcacggttctcctctctgtctctcgcgcaagggatctcgttctccgcggcagctggtgtttcgctcccttctcgccctccgacggctggttggcagccggcgccggcgccgccaaacgctaggtgctgaggccttcgccagtacttttgttgtttttttccatgccaaagcaccaagcatcatgtcggaaagaggtcgcctggcaggacgattgattgataaccgcagcagagggtaccatgtagtccctctagttgaggatcccagaggccatcctgaagtcctcgtggatggggatcggaggggctactctgacattcgtggggttcagcagcgtcggggctaccctgacacccatctgcttgaggaacctaggggctaccctggtgttcgtgtggtcgaccataggggctatcctggcagtcgtggggttgatgaacgcagggcctatcctgagctccatcaaggctcacgcatgagggcggctcctcccccttacccagctgccttcgaggatgagcttgagttacaggaagttgaactccggaggctttcggcacataaccgtgctctagttgaggagcgtgaactgttaagcagggaaatacaagctggaaaagatgaggtccgccacttgaatgtgatcattgctgacattaacactgagaaagaagcttatatcagtaagcttatggacaagaggaggaagcttgaagctgaacttggagcaagtgagcacttgtgtgatgaggtcaggcatcttcgtggtgaaattgacaagctcgttaccgctcggaaagaactatctgcagaggctgcatctctcgtggaagagctgaacagggagcaatctgttaaacagcagctacctgtgctgaaaacagaaattgatggtctgcaacaggaacttgttcacgtgaggactgcttgcgggttagagcagaaggggaatttggaattgctggaacaaaggaaggcaatggagaagaatatgctttctatggcacaagagatcgagcagatgcgaggcgaattagctaattttgaagttagaccaaggggcccaggtggagcatatgggatgcagattgggagttcggaagtgaccttcactaagaacccatatgaagatggttataatgcttatgtgggggttcctgagaaagatcctttgcatcctcctgaatatgcttcgtgggggacatatgacaggagtcgccttcagtaccgctaagaccagaacttagtcattggagaaagaattgccttctaggttttaatggccatgtcttgtcgtttacagtaccgaagctttatgcctgctgcttggttttccattaagagttgtccttttcaatgcttctaatcataactttttccattacaaactggctagattattaaactattggtaccaagatgtccagcaatgtgcggaaagcaccttacatacatgtgattttgcgtgtctgttgacttcaccttctaccataacgtggatgaggatgtgcatagcttccttgtatccc

SEQ ID NO: 21658 - DNA, 3946 bp, Zea mays
tcaaagacataaacaatattctaaagtcatatgctttatccaatttgaggtagtgatagtactcatgtcgagcgctaagaacagtgcgccgagcaaagcatgcatgcatggcgctttgcggacttgcggcacctgttcctcctctaggtagcatatccacccttcaaaaaggtgacttaaactaataatctaaaaattaaaatgctacataatttaaagtatttaggacactaaaaataaattgcactctaatacttaaaccctagatcatgtttttaggaagtaaactacattattagaaatgaaagtattaaaatgatctaggaaacaaaaaatatgacataaatatagggtatactacatccgttcacaaatatatgacaccgttgacttttttgaaaactttgatcactcatcttatttaaaatatttatttaaaaatgtaaaattttaagtcaaactcaaactaccaaaaaaacaaaattacaataataacttattattatttaaataagttaagtggtcaaagtttttttaaaaaaatcatcggtgtcatatatttataaacagatggagtagtatatttgagtcactgtattgtggcacagttaaagctgttttttataagttaagccatacgttttaggatagagcattgatttaacacaatgtccttacgtgacgcggcctcgtttctgcttctagttgaggtagaatgttatacacagatgtcgcggtagagcaaaatacagttcagttaaccagcacgattggaggcaataacctgttggaagtctgaacggataataagcgccatcggcaacagaactgataggagagaggacagaacccatacaaggttgcctagatattaccctccagatcttcagatattgcaagtcccgttacttcatgtgacagacaacggcactgcaccagagatctgaatacaagtatcgttgcaaaacgagatctgaacaattttttttttttttttgcgactatgtttttctttttcttttttacgtatacataggttctatacattcgcatcatagccgatcgatccaacgaaggcctgaaagcagacacaagggccaatgggccagcgtgcatcttgtatgcaagcaaactcagcagcgcagttcaacaagcataggcacaaccgtaaaggtataaatacaaggtgcagagcatctggatcacaagttcacaacgtcgcacacacctcatcactgggccgccttccccagcgccgcctcgagccgcttgcaatcgacgaggtaagcgaacccgtacgccatgttggcgagcgtggcatcctgcaggtcctggctggccgtggccgtggcgtcggcggagaagaacacgcggaaccccctgacgaaggcgtcccgcgcggtggtctcgcagcacaggttggtcatcacgccggccacgatcacctccccggcgcccatccgccgcagcgtcgcctccagccccgtgcccacgaaggcgctgtacgtgcccttctccaccacgaggtccccctgggcgcggccggcccccgggagcagctcggccgcgggcgtgccggcgtcgatgcggtcgccgggccaccactcgccgagcgggggcaggcgcgggaccgggtccacgtggcgggtgtacacgaccggcacgcccgcggcgcggcacagagcgacggtggacgcgatggccggcatgatcggggcggccagcgaggcgaagtggccctgcacgtcgatcacgaggagcacggccgcgcgggggtccggatctcggcggcgggtctcgtacttggtgtacgtggtggcgagaggcggcatggtgattgagcggcgggcggtgcgatccccgctacacgctacgtgcgcggataggatgaggccggaggacagctgttgcagagacgcgattgagggaatagctggttcctgcgcggacttaacatccgtcacccggttgcttagagtaggtccggtgtcatctgatgccacgtgaagcacgaggtatattctacggtcttcctccgattttaaaaaaaaaaaaaaaacatctgcctggccttatacgctgctcacgtttcagcactctccacatctccgagttcgacgaaccacccaggcacccacacgccaacacggtggccaccagctcgtgcacaacatccgtgtgcacatccgtccgactcggccacgccgccggcccaaacgctgtgttgagtggtactggtacagcgtggcccgagccttctccattccatcgtgtgtgctctttctcttccatgacaatgactgggcgccgacctacgccaggtggtggtcaggtattcgttaggcacttcgccacatcttaacttgccacttagagcaagtataatataataatcgattttttaaggtggtgttctagttttgctgatgtccttattttacctttatttgtgtttttgctcagcatgtttatatataacatttttagttgtagaggagatggtctctgacgcaagagtccggtactacaaaggctcaagacaaaatgatggagagaaaaagataaagaattaatcgaagagccaatcttatagacttatagtcagctttattatataagtgtatttattgttgattctagatgatatgtccaatgagttagaaccaccaatagactctattattaaactggctcttataagcaaagagaactaccagctgtgtcaaattccttctcttccttactatggagcaaaacggagcaccaaaaccctcttccttaagtaaattatctgcatcgactgcgaatagcatgtgttatcgacagattctgaaatatgaccacattgcactgcgagaatctaagaatgtacacatcattcaggaacatatgttacatatagatgtattctgtgccaaagggggttatcttggagcctcgagtacttagcagagctcacctagatgatatctacactccagaatattgaggaaaaagattcaggagtgaagcttgtaaccatgtcactggcttgcttctcgccactgaacagttctaccgtgctgggttgcagcagacagggcagggaaaatatgttgagaccaccagataactagaatcaatctgaaaccgtgacatgttttcagtgtacgtactgaacactggcattagaatttcatcccacacgaaataacagtttgcgcggtggcagggcctgtttgtttccgtgtttctccaacgcgcgtctaagcgcagcgcggtcagaaaacacgcgattcttgcgtcgtttcgcgattctcgtgtttcagtataaaatctgcctagtttatgaacccgcggccacgagaatcgacagaaacgcgaggcgtttttcgtcattctcgtgtttccatatagaaacaccaattttaattgaatccaaacaggcccggcccatagtttaagtgcaccagatcgccttcccgtgcttgaagcccagacaaggtacaaatccaggcaaaagaaattgaactaacattatcaaaggaaataatcttgtttatgcttgcaaggctaatagtcaacagcatacaagagcataaaacactgataagtgatcttggatctcaacatctggaatgaatggtaaaaaaactgcaaaatgcatagctattgcatataaaaaataataatttggcacatcagtaagcatgagaataagaactgctaaaaccaaactgcataagagtgatggctattagggatatgtgcattctgaaaccacaaaatcaaatcaattcatgtatgcaattagaataatcagcgctattcgaagtcatgtatgcaagcatgtgtgatacttatcctatcgcggttgcgaagtgtgtagaaatgtgagttagaaatcagggtcgggattttcgacttcgggaagacgccatggtggcttaggtgtagagcggcagcg

SEQ ID NO: 21659 - DNA, 3212 bp, Zea mays
  misc_feature (633)..(633): n is a, c, g, or t
cctggcccagaagtgtttcagaaggtagacataaaggttgcagcttctagaacagtggctcaagctttagataacatattttgggtaagagatatcaaagccctctccttgatcagtatacagcaataccttctcctgtgggatactgttgatgaggtattgctgaatgacgaggacgatcaacacatatgaagagtggagacatgaaacttctggagtttctcttctaaatcctgctataaggccgtccgcagcagatcatgtaaaataaaaggatttgtactgtagattacactgtttacagagtgaagtttgaaatatggaatgagataagatagctgtttgaaacaacctaaggttcttttcacgggctctatcatttttgagccatgggagaggttatgggaaccttgggcgtcccccaaaagtaagacttttatttggctgaccattaaaaacaaatgttggacagcggacaggttgcaaaaaagggggctgtccattatgtgaccaagaacaagagacaattcaagttcaacacctctagacctcatgtgtgtttgctcggcagttttggtacaggattctagccccctttgggttggggcacctgacacccagtgctaacaacanttcctttgctgaatgacggtgagaggtttgtaacagtattcacaaagataagaagggtttcaacagcatcgtcatcctgggcgcctgttgattgtggttgcagagaaaccgggttgtctttgatggggagtccccctccattcaaaaggtgttgcaaggttttctggatgagttagcttgttggactatggctggagccaaggagctgggcagcctgggttcagctgggtcttttagggtcgctgggtcgagttattttgatgctatgtagtctttcttttatgtgggtgttttggcccaacctagctgggtctttcttgcaagactttttctttctcttctctaatttataaagatgtgcagttctcctacgtgttcgagaaaaaaaaaatgaagaacttgccgcgcaagcgggacccaacttttaccacatgtatttctaaggtgcaaatctgatagtccacatgcacaacgttgacatattgagctatttatgttcaaagttgaaaaggtctaggaatcgtttagtgtaacagagtcctgaattcttgatttatcagtacaggcagtgaaatggacacacttttggatggacaaccagagatctaggtaagttccagtggtaaataaggaatttacttgtgaaagttagtatgttacctcccacaccaccaacagttaatattgattgaacagctataccacaagcttcagcaagacccattactcctagtccaatcagtcccaatgaagaaaccttatcaaatgccgatatcctgtcgcgatcaacacttgaggcatctagtttggtcatagctttagcaatgaagttggttttccacctctgaaggaaccatacaaaagacagaacaaatgcacctctccatgcctgtggaaggtaagttgatacgcttggtgcaataagtgttgccctatggaagagaaactaccacaaatataagcatctagaatagaacattatatgtgccactttttcaccgagaccaataattactaacgtcatggtagagaaaaaaacattttgtgcaccagcatggcaacattaataaacaaacatgaatcaacaaggtaaaaaaacaatgtatattgtgatggaacttagacaacattgaagaaacatcaatttcaaaatgcttattctggtagcagttgcatatctctagcttcttcagaaaagaacaaagtgactacagcaatactgaactgctacaagttttcttaaaataagatagaacttgacattcaattagctctaaaatgcgaacgtttgcaaaagggtatctaactgagttggttaggtggtctgagtagcacacttcaagttctagttttgactcctcgtgggagcgaattttaggctggattagaaaagaagtcactcgatggtccccttggtcggcagcatgggtgaaccgacctatggtgggcagagaaataccatgggacggtcttcccccgccgactgcttttttaaacaatgcaatggtctgaagaaaatatctttagcacagaacacaactatcaggagttcagaacacagaaaagacaattttctttcacaaagttaaatagaaacctacatttctgaaaatgccatgaacgtgatcagatattttgcaggatcctctaatgcacaccagagactagtttggtacaaaacatcattcttggtggagttccccagaagtgctgatataggactttgtgatgcgtacttgtgaagcctccttagaatgataggcatgaccaaccatgccatcattgtaccacatattgttccgccaagtggaacaactaccttttcaagatttggatatgtatcaaatagctgctggacatgaggtgcaactgcatcagtcagctccttaactttcttgcctgcatcagtggtagcatctatagtagacttgcgagcattgtccaagatttcaatccatgaacccccaccagcacctgcagtgccaacctcagagctttctgtagaaggaagattagagacaccactctgcgaagcttctggcttgattccagtatctgaggagtatccacgatagaagcttgaaacacctaagaatcctggcaatgcaccatgtctggactttgaagtaatcaaccaattagtgtccatacggcatgaaaggggcaaccttctgatcgttgacacataattaactgcagaagcagaatgcaaatccaccaccctgatatggttagcaacagaaaattcaggttttcttgagtgcttagtgccgctgctgaaccacctcagaacaccagaagatacagatgggccaaaatatgtctccattagaatctgactagcagctaatggacatgaccgacgccaaattgctgtgatccctgacataccaacttgacacgaatatttctggaaacaaaaatatgccaggaaaattcttttcctagtgggtcgtcgtcgccggtgaaaagaccgacgaaggccttcagcacctggcttagggcggcggagcggcggcggagccggtagcccaaagagagagcgatcccggatcgcggcctgaaccgtgtctccgtca

SEQ ID NO: 21660 - DNA, 863 bp, Zea mays
  misc_feature (12)..(12): n is a, c, g, or t
gatgcgtactgntgaagcctccttagaatgatagccatgaccaccccatgcccattcatgtaccccatattgtttccaccaagtggaaccaactcccttttttccagatttggatatgtatcaaatagctgctggacatgaggtgcaactgcatcagtcagctccttaactttcttgcctgcatcagtggtagcatctatagtagacttgcgagcattgtccaagatttcaatccatgaacccccaccagcacctgcagtgccaacctcagagctttctgtagaaggaagattagagacaccactctgtgaagcttctggcttgattccagtatctgaggagtatccacgatagaagcttgaaacacctaagaatcctggcaatgcaccatgtctggactttgaagtaatcaaccaattagtgtccatacggcatgaaaggggcaaccttctgatcgttgacacataattaactgaagaatgcaaatccaccaccctgatatggttagcaacagataagtcaggttttcttgagtgcttagcgccactgctgaaccacctcagaacaccagaagatacagatgggccaaaatatgtctccattagaatctgactagcagctaatggacatgaccgacgccaaattgctgtgatccctgacataccaacttgacacaaatatttctggaaacaaaaatatgccaggaaaattctttcctggtgggtcgtcgtcgccggtgaaaagaccgacgaaggccttcagcacctggcttagggcggcggagccggtagcccaaagagagagcgatcccggatcgcggcgtaaaccgtgtctcctgaagcatgcgtggagtcgtggagaac

SEQ ID NO: 21661 - DNA, 1437 bp, Zea mays
tcgacggccgcccgggcgcctactatgacagggagcttttctggattgatcaatgaagtagaagtgagtcctatttcaaccaccttgccttctattgaccccgcctttatgtagtcgttaactgagaatggcttagaaaattgcaaggagaacccactaagaatgttaccaagaacatctctagcagcaaaagcagtagcaacacctcccacaccaccaacagttaatattgattgaacagctataccacaagcttcagcaagacccattactcctagtccaatcagtcccaatgaagaaaccttatcaaatgccgatatcctgtcgcgatcaacacttgaggcatctagtttggtcatagctttagcaatgaagttggttttccacctctgaaggaaccatacaaaagacagaacaaatgcacctctccatgcctgtggaaggtaagttgatacgcttggtgcaataagtgttgccatttctgaaaatgccatgaacgtgatcagatattttgcaggatcctctaatgcacaccagagactagtttggtacaaaacatcattcttggtggagttccccagaagtgctgatataggactttgtgatgcgtacttgtgaagcctccttagaatgataggcatgaccaaccatgccatcattgtaccacatattgttccaccaagtggaacaactaccttttcaagatttggatatgtatcaaatagctgctggacatgaggtgcaactgcatcagtcagctccttaactttcttgcctgcatcagtggtagcatctatagtagacttgcgagcattgtccaagatttcaatccatgaacccccaccagcacctgcagtgccaacctcagagctttctgtagaaggaagattagagacaccactctgtgaagcttctggcttgattccagtatctgaggagtatccacgatagaagcttgaaacacctaagaatcctggcaatgcaccatgtctggactttgaagtaatcaaccaattagtgtccatacggcatgaaaggggcaaccttctgatcgttgacacataattaactgaagaagaatgcaaatccaccaccctggtatggttagcaacagataagtcaggttttcttgagtgcttagcgccactgctgaaccacctcagaacaccagaagatacagatgggccaaaatatgtctccattagaatctgactagcagctaatggacatgaccgacgccaaattgctgtgatccctgacataccaacttgacacaaatatttctggaaacaaaaatatgccaggaaaattctttcctggtgggtcgtcgtcgccggtgaaaagaccgacgaaggccttcagcacctggcttagggcggcggagccggtagcccaaagagagagcgatcccggatcgcggcgtaaaccgtgtccccg

SEQ ID NO: 21662 - DNA, 884 bp, Zea mays
taaaccaatagatccccaagtccgacaaatgcaaaagacatcagtccaaaaaagttcttaagaggcgccatccgacccggaaggtatccagtaggatttttccatatggttttcccctcgatttccaaactagcaagtgacggatcacagtgtataaagtacatattgtatatcccagttttggtaattggaatggtccttgacggtagtgtcgcgatcagatcacttccatcaaaagatgctacaaacaactttggccaaccaggatttacctgggatgggcggtagatgacagaaccttctgtgcaagctcctaacttcgcaagatctgaagtacaacaaatagctttctgacctccatatgctgatccaccaatcatttcacgatcttctatctcaaaaatgagtacctgaaccttagctgaactagtctcctttacagaattattagtatcctctgatcgcctaaaagtaatcttgtcaaaccggatgaaggcttcggccactgcggcggcgtcctcggcggtggtgttggcgtgggaggccgcgtagaggccctcgctgccggcgtggaggatgaaggcgttgcccttgttggcgaagctgagcccgcggtactcgtgcacggacgcatccccagggcggaggaggagggcgacggcaacgacgaggaggaagcgagcggccatgggggcaagctggtggccggtgaggttggatctggcgtgaagcgaagcgcagcgcctccccctgctgagctcggcaggagccggagggcaaaaccgggacaaaagccaaagaatgcccgccggcctcccggcacccggtgatggggagggaaggagtgaaagaaagtgccccggccggcctcgaggtacccaatg

SEQ ID NO: 21663 - DNA, 883 bp, Zea mays
agatttcatgtactgataaaaccagtagatcccaagcccaacaaatgcaaaagacatcagtccaaaaaagtcttaagaggcgccatccgacctggaaggtacccagtaggatttttccatatggttttcccctcgatttccaaactagcaagtgaaggatcacaatgtataaagtacatattgtacatcccagttttggtaatttgaatggtccttgacggcagcgttgcgatcagatcacttccctcaaaagatgcaacaaacaactttggccaaccaggatttacctgggatgggcgatagatgacagaaccttctttgcaagctcctaattttgcaagatctgaactacaacaaatagccttctgacctccataggcagatccaccaatcatttcacggtcttctacctcaaaaacaagtatgtgaaccttagctgaactagtctccttcacagaatcgttagtatcttctggtcgtctaaaagtaaccttgtcaaaccggatgaaggcgtcggccaccgcggcggtgtcctcgtcgtcctcggcggtggtgttggcgtgggaggccgcgtagaggccctcgctgccggcgtggagaatgaaggcgttgcccttgttggcaaagctgagcccgcggtagtcgtgcacggacgcatccccggggcagaggaggagagcgacggcaacggcaaggaggaggtggacggccatgggggcgagctggtgaggttggatctggcgtgaagcggagtggagtagagcgccgcgcttcccctgctgagctcggcaggggccggggggcaaaaccgggacagaagccgttggttgtggccccctcccccgccggtaggaaacggggagggaaggaaagtcccggccgg

SEQ ID NO: 21664 - DNA, 2094 bp, Zea mays
  misc_feature (19)..(21): n is a, c, g, or t
tgacattcatagcatatgnnnttttcacaggaaccagaagcaatatggtgccagtaatacaaatattatacatcagactaattgtttctatcgtaatttattctctgacattcataacatatgtcgagttcacaggaaccagaagcaatatggtgccattattataaatattatacaccagactaattgtttctatcatataccatcattaagactatgaagataacagcataactcgccatgtgaagaactactgtagtggtaacgaatcgaagaaataacatcgagcggagtgctccattaataataactagcatggccaatcctctcctaaataccaaaattgctctagcacacacttcaaaggatctcaaatataccctccgtaatcaaatcgacagtacattctactcccttttgttttcctcatcatcaccttcaaaatctgctacggtattcacatcctttgtagctttgggctctggtgtagaagataaattccatccattcttggatgcactgggtgctggcctaattaatgagatattatcctttcgatcaaagaattcacttgcatcataagaaaatctcattgagttttgtgaaggtgcccacaggtagcaaatgacacaaagaagtaagaaagacaagacatgccagaaggcaggaataatccaggcatgctgccatcgttcattaaatacatctgttgatttggagtaaatctcatagccaatccacccaacagacaccagaacagatacaatcaatgcagttgcaaatttcctataaatgtcaagtttggccatcaaccttcttgcctgaagtttaccgatggtcttagctaaagaaataaatatccaaacaacaaatgcggcatctaaaatggccactggatagaccaagaacagacgagcttttccagatagatcattaacagcaccaagattttctaccaactcaagaatttctgttgctagaaagaacgttcctccaagcatgaccactttcgatgtcaagccacccaaggtaggcgcgacaacaccatatcccattgagacaatgaggacaataacttcagcagccgtcctcttcacagttccaaacgtgacagcccaaaatgtgataccttttggccgaactccagtctcattgaactcagcatactcaaaataccacaatgccatctcaaacatgcccagtgtaatcacaagagtaatacagttctgaagtggaagaacctctttccaagatttcatgtactgataaaaccaatagatcccaagcacgacaaatgcaaaagacatcagtccaaaaaagttcttaagaggcgccatccgacctggaaggtacccagtaggatttttccatatggttttcccctcgatttccaaactagcaagtgaaggatcacaatgtataaagtacatattgtacatcccagttttggtaatttgaatggtccttgacggcagcgttgcgatcagatcacttccctcaaaagatgcaacaaacaactttggccaaccaggatttacctgggatgggcgatagatgacagaaccttctttgcaagctcctaattttgcaagatctgaactacaacaaatagctttctgacctccatatgctgatccaccaatcatttcacgatcttctatctcaaaaatgagtacctgaaccttagctgaactagtctcctttacagaattattagtatcctctgatcgcctaaaagtaatcttgtcaaaccggatgaaggcttcggccactgcggcggcgtcctcggcggtggtgttggcgtgggaggccgcgtagaggccctcgctgccggcgtggaggatgaaggcgttgcccttgttggcgaagctgagcccgcggtactcgtgcacggacgcatccccagggcggaggaggagggcgacggcaacgacgaggaggaagcgagcggccatgggggcaagctggtggccggtgaggttggatcccgcgcccggccggccgcagcgcctccccctgctgagctttttgctgtgggcgtactgcacgggcgtggctttgccacaatcggatcccaccgtcggcccggccggc

SEQ ID NO: 21665 - DNA, 1850 bp, Zea mays
aaacctaaggctgaattactactactcctaggaaattggaaagacaatgcaaataaggtaaaattgataattagatttgattggatcgattgtgaggtgtacaatcggtcgtatatcgtcatctatataaagggtggaagtctagattcattacaaattgtttcttatattaatcccgcagattttactaataaatcacactataaatccagaaccataactgattctgcacacacgcggattgttcgcaggctacgaccgtttggcatcatggccgtccgcccctcatttttttgtgctgaacagatatacataggttttttttctgctgtaaaagcagaacacaaaacgaaatctcttttattaaaagtaatactggaggggtgcttttgaggtgcatatttcttgaaaactggaaattcgatctagttcatcggacgttttgtggaacatgcaaatcattatacttaccctaaacacaatataaccgagtccttgcccatttggtgtcgcggggggccctgtaagtccccatttttgggcgaaacaatactttatttattgataatgatatagtaacatccttttattgcttttctttgtgtatacagctggtcctctctgttgatgaagttcacggaaccacattactactactatattatatacaaagcttcgctcactcataaacgaatgactccagcaacaacttggagcatctaccatggaatatacagcgaaactacgatccccgtcgcgtgtaaacaaaacgaaagaacggcatgcttttttcacaggagcaaaacaattcggacaagtacatcgacctggaagtttgaccagagacaggatttcgggaaagcctatcagcgaaccttgtttttttttccttttggcatgctcatgtatgtgtgattagtaagggcagcttggcttcctcgcttgatccctttctgatgtaggcatacagcagcaactgtacgatacccaatatggttccaatgccatttggaatatatatgaagccatcaccaagcagcactccgtatatgacgaaggatgcactcatcagaaacatggataatgacaagtagaagggcatgtattccacgctcttcgtccggatgaccagattgacgattgacatgggggacgcgaacatgcatacgagggacgcgacgctgagatatccgacgaacacctgccgggctttgtgatccaacaaagccagactaacaaacacaatcagtccgaacaccaggaagacagcggccaggagagcagagaccttgagcctctgcttggcgtcggcgaaggcgatgaacacggcggtgtaggcgagctggaacacggcgccgatggagttgacggtggcgacgaggacgacgccgtaggagacgaaggggaggccgtaccacatgcagatgaggcagttgagcagcgagtagatgtacggcgtgcacgagaactgctccgtggatccgttgcggacgatcctcttgaatgtggggagcggggagacgaagagcacgaaggcgaaggcgttccctgcgattccggccccgtagcagcagaggtggcggaaggacaagtcggcgacgaagctcgtcaatgccggagcatcccaatccatggtggtgcgtcctcccttgcctgcagcacgggagtgctctgctcgaatctgaatacctattactattagcagaagcaggaccgcaggcagcagcgggggcggcgccgtcaccagccggggtggggatttgaggatttcgctgttttgctcggcgtgttgcccgtgctgctttaattcgccccggccccccccgtcgttcccgttgtgtcccggccgg

SEQ ID NO: 21666 - DNA, 1709 bp, Zea mays
tttcttgttgtctctcgtgttttttttttttttttttaaaaagttgagggggagggtcccccacctaagatttcattaccagcaaacgcatacaaacaacagtctcatacttgtactaacaagtcattgagtcctcaaactatcattgtaccgagttgctgaaccagtcacggtggccgggctccgacactgatgctacaaccgcaaagatagtctacaacactgcaggcaccctgacaaactgaagatgatcaagagcatcaggacttgtgtcgcacacatgaaacatgcatcacatatagcctacaggtggatttaaactctactgattgagtggtatccactccagctccagttccacctcccccgattccacgttctgcagcctcagagagacctcctgcttgaccttgccaccaacgacattgacggcgctgtcccttgccagcgcattatctggggacctgagccacttgccgatctgcatgtccgcgagcagatcagggtcgccaaacgctgtagctgcactgatcatcggctgcaggtcaatctctgcgtcacccatctcgtcatccttcgatagcatgtcgtggtcgaacacttgctgggttgggtcatgcttcagaggcccgtactgctggggaactgacagcttaagctcttcattccaaacaggattcagattacgtttactcacagaagtttttgctttctgctgtcctagggtcagtacaatataggggtcactactcatcaggtctcttacagctagtttagtccctcttatcactttaacttttagtattccaatgaactcaaccattccagcctcactgctgaaactagcagaaagagacacagtattgtccttatgttttcgagagctggtactggtagcctctaaagagcccttattgctggaaactaaccttaggcttggcttcaggaattcttgcaactcatacttcgacctgatgaaatcagctctctcttcttggctagaatctggatgcggcttctgatagccctctggcagaaatgcttcatatatagcattggcataagagtttccaccaacttctatcatggagttgatctcatcatccgtccattgatctagtgtgactgacagcacctttgaaacatgtgtcccgaggcttctgtgaacaccagaacactttaggcaaatgaatactccaatgttagccgatgcccatttgggatcaggtgcgccgcagtcggcacatacgcggttgtcgctcttctgcagcaactctctcagcttcctcatcatatctccctcggtcagtgtcagcagagtctctctgctgctcttcttcttcgccgccgccgaagctctgccctccaactacaccagacaccaaccgccccttgacacaggtaaccaggatgcaactggaagaagaccagcaccagaagctgaagcgacaagaaattgattagactgtcgacctgcagctgcgtgcagttcgcctagctgcgtgccggggtttcgatctccagagtttctccgctgcgttttcccagggggttctctgccatgagcggagcacaggagcggggtgcgggggatctgtttggtcgccttttggattcactaatctctggactttggagctcagccacagaacgacagaacgtagacggtagaccagggcggaaacggtgggagtgggaggccgccgccg

SEQ ID NO: 21667 - DNA, 1624 bp, Zea mays
  misc_feature (20)..(43): n is a, c, g, or t
cccgcggtctttctagaagnnnnnnnnnnnnnnnnnnnnnnnnattaaaaagttgagggggagggtcccccacctaagatttcattaccagcaaacgcatgcaaacaacagtctcatacttgtactaacaagtcattgagtcctcaaactatcattgtacagagttgctgaaccagtcacggtggccgggctccgacactgattctacaaccgcaaagatagtctacaacactgcaggcaccctgacaaactgaagatgatcaagagcatcaggacttgtgtcgcacacatgaaacatgcatcacatatagcctacaggtggatttgaactctactgattgagtggtatccactccagctccagttccacctcccccgattccacgttctgcagcctcagagagacctcctgcttgaccttgccaccaacgacattgacggcgctgtcccttgccagcgcattatctggggacctgagccacttgccgatctgcatgtccgcgagcagatcagggtcgccaaacgctgtagctgcactgatcatcggctgcaggtcaatctctgcgtcacccatctcgtcatccttcgatagcatgtcgtggtcgaacacttgaagcttcagaggcccgtactgctggggaactgacagcttaagctcttcattccaaacaggattcagattacgtttactcacagaagtttttgctttctgctgtcctagggtcagtacaatataggggtcactactcatcaggtctcttacagctagtttagtccctcttatcactttaacttttagtattccaatgaactcaaccattccagcctcactgctgaaactagcagaaagagacacagtattgtccttatgttttcgagagctggtactggtagcctctaaagagcccttattgctggaaactaaccttaggcttggcttcaggaattcttgcaactcatacttcgacctgatgaaatcagctctctcttcttggctagaatctggatgcggcttctgatagccctctggcagaaatgcttcatatatagcattggcataagagtttccaccaacttctatcatggagttgatctcatcatccgtccattgatctagtgtgactgacagcacctttgaaacatgtgtcccgaggcttctgtgaacaccagaacactttaggcaaatgaatactccaatgttagccgatgcccatttgggatcaggtgcgccgcagtcggcacatacgcggttgtcgctcttctgcagcaactctctcagcttcctcatcatatctccctcggtcagtgtcagcagagtctctctgctgctcttcttcttcgccgccgccgaagctctgccctccaactacaccagacaccaaccgccccttgacacaggtaaccaggatgcaactggaagaagaccagcaccagaagctgaagcgacaagaaattgattagactgtcgacctgcagctgcgtgcagttcgcctagctgcgtgccggggtttcgatctccagagtttctccgctgcgttttcccagggggttctctgccatgagcggagcacaggagcggggtgcgggggatctgtttggtcgccttttggattcactaatctct

SEQ ID NO: 21668 - DNA, 1607 bp, Zea mays
ttttgaatgtatagacattcacgttttttttttttttttatgatctatccttttatgtcataccaataatgtcttaaagaaactaacaccatatatcacataaatacagcaggcaataacatcatcagaccagtatcactaacaacagcagcagatgcatataacagtgagagaaaagaaaggaaaattattcataatttaacggttataccatatacttctaccctgtctaaactccttacagctaaacatagcacaaaactgtacactcgcaaatctaaagggggcattaagtgtttatgcctggcttctccggcagaaattgcttcatctcctgatcttcactcccgtcgacaacactggggaatccaagagatagagacagtggttcatcatctacaatatctgaaccagaaagattatgcttcgttgccaccatggatagggaaagtaacaataaagcggaggagccctcatctgccttcagtgatgccttatttaagctagtactaggttctggggaatcttcatcgtcagatgaaagcacgttgatgatatgatcaggtactgtttttttaagagagacaggatctgaaggacacctgtgacaatgtaaaacatcgactggattatcctgtccagccggtaagggatgtatcttcgacaagcatttaataggtggcatttcatctccaaaaatgcaagtagagtgtttcccataagtcttctgccttttgttggtgaggtgagaatccaaagaacccatatctgaacttggagtcgatttggtttgatcatcacatatctttgatccactaaaatgacaatgtgaaggcagaagaccatgtttcttaagttttatctcatgtgagatcgatccaattgcacctggttgctgtgaaaaacaaaagagagcttcattctgatctgctttctccattttgtttccacctgctgttcctgtgctatcttttgcagcagccgaataatccggaacgatgtcatgaactcctgttgagatagtgggaagattagttacattgggagctacagaaggttggccccatataatttgtcttgtgccagcagtttcttcatgatgtatttcacttgcattcagatttctatcctcgtgtttggactctgataaaacattataatctacagatgcaccaaattctcactctctgatccaagtgaaagagctggatcagatatatcatcattagggcactcattcaaatctatacccaaaggctgaagtgccttagatgaacccatatcatgctggataacaggtccattggtttgttctaatggacaattatttgtaggaagctctagtagactacttgctttccgggcataaaaaatgccccaaaagaaaagtaaaccattccaacgttgaatcctctcaggcaacttatcagatggaaaaataagaagttcaatgttatcaatatttgctttgagggataaatcaccaagaagcatgttatccaagagtttcccatatgccctttcgtaactttcaacatctttagcaaagaaaaaaagagcaatattatcttcagttggatttacttcattaaattgcagcggccatg

SEQ ID NO: 21669 - DNA, 2414 bp, Zea mays
  misc_feature (47)..(47): n is a, c, g, or t
gtccagtctgtgaactctgctgcgtcggaagcccagactgcgggtgnggttagagtgttaggcctgttaaggctagacccatgtggcccacgtaaaacactatatagctgacatgttgggttaaccctaatctattgaataatcactttaacagaacggagggaatacttcccggcaaaacaaaatgcagagtacaccaaataataaaagctgtcatattgtggcaaaggcagcttggacagacgacacatgcaaattaggataggatacacccttgtcttgccacgggatagaaaatgcaagttaaaccatgacaaaatgaattcacaaacattcacattttgatctatccttttatgtcatacccataatatctcaagaaactaacaccatatatctcatagatatggcagatagtaacatcatcacaccattatcactaacaacggcagcagatgcatataacagtgagagagaaaaaaatgaaaaatattcataatttaacagctataccatacttctaccctgtctaaactccatacagctgcacaaaactgtacactcgcaaatctaaaggggcattaagtgtttatgcctggcttctccggcaggaattgcttcatctcctgatctgctctcccaccgacaacactagggagcccaagagagagagacagtggttcatcatctacaatatctgaaccagaaagattacgcttcgttgccaccatggatagggaaagtgagcataaaatggaggagccctcatctgccttcgatgatgccttatttaagctagtactaggttctggggaatcttcgtcgtcagatgaaagaacgtggatgaaatgatcaggtaaaggttttttaagagaggcaggatctgaagggccccgatgacaatgctgtaaaacatcgcatggattatcctgtccagccggtaagggatgtatcttggacaagcatttcataggtgtcattgcatctccaaaaatgcaagagtgtttcccataagtcttctgccttttgttggtgatgtcaaaatccaaaggacccatatctgaatttggagttgatttggtttgatcatcacatatctttgatccactcaaatgacagtgcgagggcaaaagaccatgtttattaagttctatctcatgtgagattgatctagttgcacctagttgctgcgaaaaacggaacagagtttcattctgatctgttttctccattttgttgccacctggtgttcctgtgctacctgaaatgaaaatataatgattaaacaataagcaaggataaatccagaattgatctgtagctttatcctacggaaagatgccaccacctttagcagcagccagataatcctgaatcatgtcatgacctcctgttgagattgtgggaagattagttccacaggaagcaacagaaggatgccccggtataatttgtcttgtgcctgcagtttcttcatgatgtatttcacttgcattcagacttctatcctcacgtttggactctaatacaatattacgatctaaagatgcaccagacttctcactctctgatccaagtgaaagagacagatcagatatataatcattagggcactcattcaaatctatacccaaaggctgatgtgccttaggcgaaccaatatcatgctggataacaggttcattgatttgttctaatggacaattatttgtaggaagctctagtggactacttgctttccgggcataaaaaatgccccaaaagaaaggtaaaccattccaacctgtaaaatgtcataaagaatccattaaaaggaggcaacgagcaaatcctgccacgagacagcaacattagcaaagataaacttacgttgaatcctctctggcaatttatcggatgggaaaatgagaagttcagtgccaccaatatttgctttaagagacaaatcaccaagaagcatgttatccaagagttttccatatgccctttcataactgttcaaggagacatgagacctcagctagtgtacagaggattgaaactcatgaaacagtgaaatggcgaagaaagtaatacctttcaacatctttagcaaagaaaaaaagagcaatattatcttcagttggatttacttcattaaattgcagtggccttgaggaatgccgtgggacttctgctagctgaattttgtcaggtaattgttcacctaccttccacgtactttggatgaggcgcaagtagacaagtaagcttgaaacccatcgaacatttcaggggagtttccatgtcctgaaacctcaaacccaccctgccagatgtaagactgcggacgcgtgggctgaaataaaaggaattcacagttaaaactcttaactagtaaatggaagtaaagggagaagaggagggtcgtactg

SEQ ID NO: 21670 - DNA, 2738 bp, Zea mays
  misc_feature (4)..(4): n is a, c, g, or t
cttnggaagccgaagacggccagggtactgactctctcacttttttagactggagaggtacctttgcaattgcaagacaaactcccatacaccatctcgacttgtgtagccctcattgttccgacgcatggaagcaactcatggccaccaaactacagcccatacagttacaagttaaatgtaattcgcaggattcttttcaacagcaacaacatcctttgtgacatgaaaaaatgactattctcattccgatagctctggccagagtgttgcagggcatctgattttggctgtggcaaaatgctcacgaaccacgacaatgccatactaagatgccaggatcactcatcgccatctccagttttttgcttcttccatttgtaagcagcttctaggatcttcaggtttggtgctagagcaacttcatcagggaaaatgtaatctatatactcctcatatgctatagtggagccatcttctgtagggattggtctcttccgcttgacttttcttggtgccttcttttgcactaagctgacatctccaagatcaccaaagttcacctccttattaagccattcttcaagaagcatagctctttcctccttcaactctggggcactggttctgaagtaatcaaatgccctttcaaagacagctctacatttttgaacccgctccatctgctgctcctgataactaacttcattctttttctccttgtcttcaccgtcttcaccgcccaagccagcagaggcctcaaactcagcataactgatccataccttcaaatgttttgtcctatcaagcagtctctcatatagttgccttgtcctctcaaattcattttcatcaatttcaaactgcaagtactccttccatagaacctctggtgtatcaagggctggttgtgcaatagcaagttcatatattgatcgagcacgatcagtctcactaaggttcttctccaattcggcatacttcctccaggcataacagtttgctggggaccattcaatatatttctcataaagagtcctacaacggtcaaagttgcccagataaagctcaatttcaatatatttcttgaatatcttgccctttggggccattccaattgcatttccaagaatttgtcttgcagcctttagatttctctgccgtatctcaaactgggccgccatgagccacatctttgcaaacgtgaatttcttgtgaggaatcaacctcaggcattccttgtaaacctctcttgtccgttctctgtcttgtgcgtctagctcctcatagagtgcatagttaatccagaggtatatgtacctctgccagtatcgcttctcctctgcagggggcacgttggcaatggccctctcgtacacctccctgatcctgtccttattcccaacactctcctccagcctgatataatcaaaccatgagtcgtagtttagtggattcttcctaacctcatcctcgtactgaaatctcctcttgcccacaatggcatcttctattccctcacggtcaccaaactgtttctcaaatgcaagaaacttcctatacagttcctcagcacgacccttgggcaccctgtctagagcatacttgtatattgcacgtgctcgctcgacctcgcggcacctctcctcaaactctgcaaatgccacaaataacacttcagcatcctcatcatcagcaagcaggtctgctgcacgctcatacacccgacgtgcccgctcgacctcgccgcgcttcatctcaaacttagcatagcggatgaaggtatctggccttgggtgctcagctacaaaccgctcatagatagccctggcacgctcgacctccccgtaccgcagctcaaacttgatgtaagaattccagccggctgtgtcgggtcgccaagacatccagcgctcgaacacctggcgcgcattggcaactgcaccaagcagctcctccatgtggatgtacttgtaccagagctgatccacccgggggaggagcgacaccgcgcggtcccagacattccgggcatggttgacaaaccggttccgcatctcgaattcagcatatttgagccagagcgtgtggtcgcggtgggcgacgtcgagcgcgcgctcgtagacggagcgcgcgcgcgcgaagtctcgctgctgctcctcccaccgcgcgtacttgacccatgccgagacgctccagcgcacgcggcggatgacgtcctcgaactccttccgcttacggaggcggtaatcggagagctcgtgggggtctgtgatcttctgtttgggcgggcggatctcaggctcctgcctctccctggcctcccggaggatctgctcggccgtaatctggatcggcgcgggggtcttgttcttgacccgcgttgcgcggggtagcttgacctcggtatcgcgcttggtgaggaagccgaggctggggtcggaggcggacggcgccttcgcgggatccccgccgccggcgccgccccgtgtagtgagcgccatgacgtattagggtttggggtggagccggggaaagtaacgggataggggattgggaagggagggagaacacggtgctgcacaatctgctgagacagttgaaggagggaggcggttacaaacttaacgggtttagagtttagacacaaaaaaccaaaaaaaaaattatgagagagataagtaaatactacattagcagcgaagagctaactattagagcaaagtataataacggac

SEQ ID NO: 21671 - DNA, 2713 bp, Zea mays
  misc_feature (302)..(302): n is a, c, g, or t
  misc_feature (359)..(359): n is a, c, g, or t
  misc_feature (1008)..(1008): n is a, c, g, or t
accacccctagtggcggttgacctcgacacataggggcgcaacctcgccctgtcatacagccatcagcatccgcgccggcctgctgtctccaagtgcgagcatggtgcgtgtcccgcaggtgacacacttcaactctacaacaacgacggtagggaaggcactcccctccttgtcatcgacgagggagcactgcttagcaccaccacattccgctgtcgaccgccacgagggctcctccgctggtcattgttgtgacctattctaggtggccatccatgtgctccactttcgtccagatggngtccatgggatccaggtggctgcacacatgcaggtccatgcgcggagggtgtccgcnttagcttaaagggtcaaaaataaagagtcatggtctaattcagattcggaataataaaataagccgagatgtaaaagacttcttcgtaggtgtttggtttgtgtctagcggagtcatcgttaggttgcagttcgaggacgacctgtttatccagaaggggtgtaatatcagggcccaagagggcccactatagtgacagcggtactgtagcacgcccttaggttggttagataaagataaggctaacttgggataagattagaattagagataagattagatctagtgcttacaggtcaagtaactctatataaggagagggattgtataagcaagagattagaaggaaatcccttctctcttgccagccgtggggaaaaccctgcggtcggcctccccagcgcccctaaccctagctgtcaccctcaaaccctcgcagtcatctgccgcccataacagtaaggctagagaaaaaacccaaaaaaataaacaaaattgcacattaacttacacaaaagacaaacaaactacagcagcctaggcaagcatgtgtaagattaaaaaatgcaattcgaacaaaacaatttataatcaaataaactaaggaattccaaaactgacatagcagagcaaaagtacttccataaantagctctgataacataggtttcaatgtagaagcattgatgaaattatattttataaatcacacctcatgatgtctttatgtctagtaatggatataatacgaaagaagatatccaaactacacatttgacagtagaaaagttgtgccaagaaaaaaaggatcccggttcaggaacagtaaaaaggaaatataaaaatgtataccgtttttgcttgagacacactaattttaggacgttacagcccaatttatagacctccaaaatccaagaaaggtcaaagtctctaataagcatattgtgcagttaaccatcatggcattgatacaggaatagacatgatcaactaatatcttacagagcttttcatgtctgaacaatacattgtcagattcaatgctttcatgctcaattagaatactaccgataccaagagatgagttaaatttaggctacaagtcagaaacaatactgggcaacaatcaaacagcccaataacatttgtgactatccaccagaccacctccatggaaagggatagagagaaaatacaggacactaacaaatacaagcacataataaagaaatgtttctgcaggtctgattgggttccacgaactttcagcagagatagaataggtaacattgcaaacaaattagcgaataagagatctgtacagcaacttattcttatctgaaagatggtgcgccccttaaagacacctaaaagagcaatggattgctcactaaaaatgagctctggtgattttagtaactatggcaatgtaatagctatttaaaacatcatttataacactagatcagttggtttagcaataataataaaataaatgcgtctacaatacatcactaccatataattaatgtgcataatccaagaatgcaaccgcaactctgcaagagagcataccttccacagaacctctggtgtatcaagggctggttgtgcaatagcaagttcatatattgatcgagcacgatcagtctcactaaggttcttctccaattcggcatacttcctccaggcataacagtttgctggggaccattcaatatatttctcataaagagtcctacaacggtcaaagttgcccagataaagctcaatttcaatatatttcttgaatatcttgccctttggggccattccaattgcatttccaagaatttgtcttgcagcctttagatttctctgccgtatctcaaactgggccgccatgagccacatctttgcaaacgtgaatttcttgtgaggaatcaacctcaggcattccttgtaaacctctcttgtccgttctctgtcttgtgcgtctagctcctcatagagtgcatagttaatccagaggtatatgtacctctgccagtatcgcttctcctctgcagggggcacgttggcaatggccctctcgtacacctccctgatcctgtccttattcccaacactctcctccagcctgatataatcaaacccatgagtcgtagtttagtggattcttcctaacctcatcctcgtactgaaatctcctcttgcccacaatggcatcttctattccctcacggtcaccaaactgtttctcaaatgcaagaaacttcctatacagttcctcagcacgaccctgggcacccgtctagagcatacttgtatattgcacgtgctcgctcgacctcgcggcactctcctcaaac

SEQ ID NO: 21672 - DNA, 2380 bp, Zea mays
tttttttttttttctagatgaaagcatagtttttattaaatttagcctaacttactatatttttttttgttttttttcttgtacatctaaacttagatataaaatattacaaaaattgaggtggggtcatggcccccattgccccaccctggatacgcccctgacatcagcatcatggtgacgatgacagtattttacaacttgaggacacgaaactctcctcagtcaccctcacctaccctttcatcatactcactcatgccatcacaaaacaccgtgattatgtatacaacgacgattcaggccttcaaaatgtcataaaatgcagagggtcgctttcgtttcttcagacacagctcctccactgcagaagccaccctcagtaagcttgcctcgccccatggacgacctatcagttgcaaacctataggaagcccctgcttgtcatgaccaacaggcacagttattgctgggagaccaagaaggttccctgctatgatgaatcgcatcaagtaagctgacacaacataatctgactctcctgacttcagagcacttggaggtatttttggagcagtaatgccagttgtaggagttgctatgacattgaccttcttgaaagcttccatgtgataatgcattatcctcctccttatgctttgagaagccacataatcagttgcagtgaaagacccaaaaagtgccaaacttgttcgagtatccaaggtaaactcagtttttcttcctgctttgtaatgaggattcaagtcacagaatgattctgagccaattgagacaacatgagcagtacgcatctcttcaagctctggtaatgttatctcttctacttgacatccgaaagcactgcagagaagtttaagtgcatcgtcacatgtacccgatatctcatgaccagaaacatcattaaaccactctgtatactttcctattttaactgatcccaggatattgctgttttctggagacaacaaatttgggacacatagtggcgatggtctaagtgtaagcttatccataggtcttgaacctgctattgcagaatacactagtatagcatcgtcaactgatgatgtaagaggagaagcaacttcaacagtcccagagtcacatagtaccccagtcatatctgtcctaccatatgttgtcttgaaaccaacaataccacaaagtgcagatggaattctaactgaacctccaccatctgttccaattgctatcgagcataatcctgatgatactaatgcagcaggaccagatgaagaaccaccagtatatctatcaactgaatgtggatttcttgctgtcccataatttggattgtttccagttactccaaggcctagctcatgcatgtttgctttcccaataaagataactccacatttccgcaaccgagccacacagactgcatctctctccacagtatggatttggtcaaagaatgttgtagcaccctttgttggatatgggaagcagtcgatgtcatccttaatggcaacgaagatcccatctaaaatggatatcggatttcctcgctgaaatctctttgtggaagcctcagcttgcttcttgagatcttctgcattgaaatagatcaacattggcattgggggcttcttgttgttccactcttcaatgcctgcaataacatactcggcaacaactgaaggagttgtgatccccgagctgtaagcgtgtgcaaagtcacggatcttccaataaagaaaaggggggttctcctcggttgtccaacgcactgacggatcatactgcggaaggcaccgcagtgcttcatggactctttccaccgggtccctatcttcatctacaagaacaacttctggctctgggtcctgcagtgggaactccggatagtacatggggcgctcgggtatcaccgtctgctgcagcatctgcggcatgttgttctgcgacttgaggacggaggtgatgagccggccgagcagaggcgactccatgagccagacgaaggccctgagggagaagccggtgaggtgtggcgcctgcagcgcgggagacttgtacctgacggcggagatgtccacctcctccacgggcggcatggcgcgcgggacggacccggacctcctccccgtggaattcgatccgcccataccgatgccgctgtagcagaggcagagccgcagaggcagggtagcaccgtagcaggaagggaagaatcacgccgcccgcccccccgagggggggtttaatgcgttggtgccttggtgggcggagacgacaaaggctggcagagcggggcaggggcaggacagggtcacagggatgcaatgcaagagcaagacgacgatggcgtcccggcccggccggcctcgag

SEQ ID NO: 21673 - DNA, 3858 bp, Zea mays
ctttgtacaaccaaaagacgaacaattatgtcttttaacaagggagaagtgtcgtgtacatctttttctccttcgtagctttcttgtcgtcgcatctgaagatgtcccgatcctaatcaagtttcatcttctctctttcggcttgctatttgttgggaaacccttcgaagcccccaatctatagatggtcagtggaagcccacaatccaaataaatagttagcccccaatctatagatggtcaatcaaagcccgcaatccaaataaatagttcgaaggtatcctctgaaaatacacaaatgatagtttttttgttaattctggaccttcggctattttatagccttctctctaacgcagttttgcattttggatgcatggaaacagagacccccataattaagactcataattgacttgaactagaaagttagaaaaaaaaagagcaagccaggaggccagcaaactgttcgcgcgtgcaggtccatggggctggattcccaagccaggatgccttccctgatccttcagatctgcggcccacctaccgatgcaccgtttcatcagccatattcagaacttgactctagttcacaaaaaaacatgaaacggaggacatcccaaaattgcaaactagatttgagccttcaacatacttgccattgcaacgcaaaccgtcaaaaagaaaagggctaaatagtcaggtgaatggtgaatccatttgctactgccactcctgtttccacgttcatcaggattgctgttttctgcacaagccaatgacgtcaataaaaactgatacgaaaacaatgcacctcagcaaatgatacatgctcagaaagttcagatcttcaatattacatgcaaatgcaggaaaatgtgctaatagatgatgatcacaaagatcataggtacagctagatacaatgcatgctcccgccagctacttccagtaatataatccccacatgtccgcatcagcattagcagaaaagcagaactactcaccgtcctttctgggcacactgagaaacactaatcgatcgataaccacaagaataatctgaagacttaaaaacgctgtaatagattgataaccacaaggatcaacatccctccacattatttattcagctatagttccagataaatctcgcaaccctcttcacccaaaattatgataggaaacgatctgccaattacaaaggagtgaactgaaacagcaggaaacatggttgatatgaaaagcaaaattgctaagagaaacgatgtgatcatgaaataattaaactgagactcctgacaagctaataagcaaaggatggttcactgggccggaaactccggtaaatggaggctgcaaccggtacgagacccagaagtgcaatctggacctgctctgaggtgcttgtcctgacggtgatctgcccactcagcttgttgttcagaccaagtcgaactgccatcttcgacccccttccgatggaaaactgggactgcaagtttgcgcccagagcaaggtcccgacgccacttcatcagagagagacccaaggttgagagggactgggctatcggatagtctttgtccttcaagcgtgcctccaggttagctccatatgcagtgtccccttgggctcgcatcgcgccagtgctagcaactagtgacaacctcttcccaagggagagctggtcctcaatcttcagtccagttgccacaatgtcgcccaggaaagttactgagaaccctcctgtggttttgttcttcttgatattcttgatttttgtctccccacggagaatatatgcaagctgccgcccaacagtctggatatcaaaaccagcaagagatgatgtgttctctccatgctttgctgcgatggaagagtccaaatggatgctaaattccttcttgtccttggtgacctgaactgctacatttgctgggaacctgctaaggatagctagtgtctcttcaacgctcactccatcataaccacagtcatgatcccatccatgcgcatctaaaacaggtcttgctaggacagtcgaagttggctctagaaagcggtaccggtatgtgggattgtcacaatcaaatgaaggaggcagtaccatgtcaggtaagggaactgacacattctctggaggaggatcctgatcgtcctcaccagtgatattagcatacccataatcatccagatcagttttccccctcttcttcatctcctttaacctgcggatctcatccttccattgtttcttctggagaagcttaaccctgtagtcatactcatcaaaataagcattcttctgctcctttgtgagccttgcaagctgagctttggtcaagggcttgaagggtggaagctgatcatattcttcttcttcatcatcttgttctacatcagagtagtcatccaattcaatatcagaatcgccctcattgccaccctgctcagcagaaagtttcgggtgggctctagactgcaagagtgaggacaacaagaaaggaagaggtggtgagcggaaacggaagccaaaaagctttccaggattaggatcctgaagcttcagaagtgagttggcttctgataatatctttgaggagtagcacaaaagcagcatctgatgcctccagctttggccattcggaagcactttctggccctcacggtttttcctgcacgaaggatggttctcaacaagggctactgggttcatcaagcgcatatctccagcagcctgcctgatggactgctggatgatgtgggatctctgagccatcaagacctcatatgtcatgggagcaccattgaggccttcaggaggagcagacgcagcatgtgtgagggcaacaatggcattgaaccatatggatgagccaagaacagaggtaattgtcttcagaagaggcaaatcattgagatcacggctcagactatccagacgatccacatatagaacaatatctggcggacatttcttggtatatttcttgacagcagcaagaatctttctgtttgatccttggtccataacgttgggacgaaggccaggtgtatcaatgattctaatcttgacaccatcaacatccccaatgatttcccgcacattagtggttgctgagctaaaagcatcagttttggacttctcttcaccaaatacagaattgatagttgcacttttgccaactccagtctttcctagaacaagtatgttgcatgagaagttcagatcctcctttccctctgcttcaagaagtaaggcctttctccgtgcattatcaaggctgaatgctcgatttgtctgcctaccatgtcggataccctcagcaaggctcagacgatacagcacttgtgctgcaaccgtttcttcaggagtagctcccagcctgtaaaccagacgcagaaactttactctaatcaactcaaccttgtcgtgtagcttcttctcttcctctgtcatctcttctgtagggtcagcagtaactgctagctctgaggggctgaataggtttgacctggcaggttggcgaggtgcagtcggcctgagagaaggggctgatgaaccaagaccagcaggtcgatccatggtgaatattctagaaccatcttgtgaagcaactgtgacattcccatctgaggatccaccagttgccgctttcagaagggccgccaaggcagcagaatcaaattccttctcatccccatcatcatcatcctcagaatcatcaagcataatctgcccatccatgctattggtgaagtctcttgagacattaccactagaggagccttctgtaagctccttcatgatcgtgcttcgcggcttcagagctctctaagattgcaacccgt

SEQ ID NO: 21674 - DNA, 3457 bp, Zea mays
ggaattcaatttcggcgacccggccgggccccgaccgatttttttttttttttataatcagaatagacgctgcaatagatattgataaacacaaggatggtacatttctcgacattatttattcagctacagttccagataaatcgcacaaccctcttcagccaaaattatggtaggaaacgatctgccaattacaagggagtaaactgaaacagcaagaaacatggttcatgtgaagaagaaaattgccaagagaaaccacatggttatgaagtaattggactgagactcctgacaggctaataagcgaaggacggttcactgggccggaagctcctgtagatggaggctgcaaccggtacgagacccagaagtgcgatctggacctgctccgaggtgcttgtcctgaccgtgatctgcccgctcagcttgttgttcagaccaagtcgcactgccatcttcgacccccttccgatggagaactgggactgcaagttcgcgcccagagcaaggtcccggcgccacttcatcagagagagacccagcgttgagagggactggccaatcggatagtctttgtccttcaggcgtgcctccaagttagctccatatgcagtttccccttgggctcgcatcgcgccagtgctggcaactagcgacagcctcttcccaagggagagctggtcctcgaccttcagtccagttgccacaatgtcacccaggaaagttaccgagaagcctcctgtggtcttgttcttcttgatgttcttgatttttgcctcgccgcggagaatataggcaagctggcgcccaacagtctggatatcaaaaccagcaagtgatgatgcattctctccatgctttgctgcgatggaagagtccaaatggatgctgaattccttcttgtccttggtgacctgaactgctacatttgccgggaacctgctaaggatagccagtgtctcttcaacgctcactccatcataaccacagtcatgatcccatccatgcgcatccaaaacaggccttgctaggacagtcgaggttgactccaaaaagcggtaccggtatgtgggattgtcacaatcaaatgaagggggaagcaccatgtcaggcaagggaaccgatacattctctggaggaggatcctgatcgttctcaccagcgatattagcatacccataatcatccagatcagttttccccctcttcttcatctccttcaacctgcggatctcatccttccattgtttcttctggagaagcttgaccctgtagtcatactcgtcaaaataagcattcttctgctcctttgtgagccttgcaagctgagctttggtcaagggcttgaagggtggaagctgatcatattcttcttcgtcatcatcttgttctacatcagaatagtcatccaattcaacatcagaatcaccttcattgccaccctgctcagcagaaagtttggggtgggctctagactgcaagagtgaggacaacaagaaaggaagagacggggagcggaaacggaaaccaaaaagctttccaggattaggatcctgaagcttcaggagtgagttggcttctgataatatctttgaggagtagcacaaaagtaacatctgatgcctccagctttggccattcggaagcactttctggccctcccggtttttcctgcacgaaggatggttctcaacaagtgctactgggttcatcaaccgcatatctccagcagcctgcctgatggactgctggatgatgtgggatctctgagccatcaagacctcatatgtcatgggagcaccattgaggccttcaggaggagctgaggcagcatgtgtcagtgcaacaatggcattgaaccatatggatgagccaagaacagcagtaatagtcttcagaagaggcaaatcattgagatcacggctcagactatccagacgatccacatatagaacaatatctggcggacatttcttggtatagttcttgacagcagcaagaatctttctgtttgatccctggtccatcacgttaggtcgaaggccaggtgtatcaatgattctaatcttgacaccatccacatcaccaacaatttcccgcacatttgtggttgctgagctaaaggcgtcagttctggacttctcttcaccaaatatagaattgatagttgcacttttgccgactccagtttttcctagaacaagtatgttgcatgagaagttcagatcctcttttccctctgcttcaagaagtaaggccttcctccgtgcattatcaaggctgaatgctcggttcgtctgcctgccatgtcggataccctcagcaaggctcagacggtacagcacttgtgctgcaaccgtttcttcaggagtagctcccaatctgtaaaccagacgcagaaactttactctaatcaactcaaccttgtcatgcagcttcttctcttcctctgtcatctcttctgtagggtcagctgtaactgctagctctgaggggctgaataggtttgaccgggcagattggcgaggcgcagtcggcctcagagaaggggctgatgaaccaagaccagcaggtcggtccatggtaaatattctagaaccatcttgtgaagtaactgtgatatccccacctgaggatccaccagttgccgctttcagaagggccgccagggcagcagaatcaaatcccttctcatccccatcatcatcattatcatcatcatcatcctcagaatcatcaagcataatctgcccatccatgctattggtgaagtctcttgagatactaccactagaggagccttctgcaagctccttcatgatctgcttcgcggcttcagagctctctaaaattgcaacccgtgcaggactcgtgtcagagtttgtcccgtcgtcatcgtcctcagcctcattaccatccccatccgcatcatctggcacagcctcaattatgtcattatcagcagcctcctcttcatgatcaacaacctcagtggcaccttcaatctcaccagtaccattagtttctttgattgattctggagccaattctcgagagaggataccatcagcactagtagcatcaacattttcaacctctgtgggcttgtcaacaccaacatcttccaccacttcaccggcaacggcctggtcttcagcgctctgctccttctgaggactatcctcacgcacactgtctatgatctcctcagcacttgcaggggcaagctcctctatgcttccatcattcataacctgggtttgtcatcatttgagttgtttacatcccgactagaatcaaggctactagtgacaagatcatattgaggatgctcacttaccactgcagttgcctcactcggtggctcaggcctgatggcctcatcttcaacatcagcatccttcttggtcgattcttctagggcttcttcacctccctgagccaccacatcatc

SEQ ID NO: 21675 - DNA, 1099 bp, Zea mays
tccaccgcggtggcggccgccctttttttttttttttttaagagggcagaagatactatattgcataaagcatgatatttagttttttttcgggaggtggaagacagaagatactctgaaccacattgtcgttcaagaatacatgccagacaacaaaggcggtagttaggaaaacttggaagatatctatagccatcaccttgcaataaaaaaacagctagcacaggcaaatgtaagcgtggaagaattcaagcaacactgccacgacatgatgcttcactcctatgcagttgcttactacaatgccaagttaccaaccatccactgcaacatctctgtccaaacgggactatacaagttagtagaatgaaatgctgtatgcaagtctccgcttgtgctgcttctcaaatgcagtaatcaagtcatcaattatgtcctcccagtcaccatcaattgcttcaagcttctggcacaactctacagcaagctttgccccaacaccagcttcttcatggttatctttgacatccatatttattatcagcacacacttcatcaacctcggctcgcggttattcatatcttcaacaaccaagtcaaagaccctctcctcaaaggtcattatcatatcaaacaccccgtcgccggcattgtcctgccaccgctgaggcgccagcttcaccgaggtgttcctcttcagcataggcagcaacccattcctcttgtacagttcggggtccttgcggcggaggtcgtcgtagatggcgccgtagggggtgccgaagtcgtagacgttgggctcgtggagggaggggccggggagcttgacgtgggtgcccgtgccgtaggactcgacgtcgagccccgcgcggcccagctgcgagtgcgcctccatgctccggttcatgttcgaggagcagaccatcgcgaaccgccacctctttccctcggccatcgtcctgttcctgtcctccgccggccccgaacgtcgccgtcagcgagaggtcgagctctctgccgacctgacctgctcgctgctgcggcttctggacggacgtggtacgctctgggattcgtccgccgcctcgaggtcccaatg

SEQ ID NO: 21676 - DNA, 5200 bp, Zea mays
gtcaacttgggcggtgtgccttgttttagctggctggtgcctggtagaaagtttctgcccccaaccaccacgctgctatcaccatgtccgatgggtaaaaaactcagaaaccatgtcaagcagggcattttttttttttttttgagctgaaaagtgaaaactatctatctcattgggtaaacaacatttatcactgttctgaacaacatgtctggggtgacagaataaataggggatatgtaacagcaaaattacagaccaacaaccacacgattcatctcaaactacaaatttacactcctgccgtggcgtcccacgaccatgtcggcgacgacctcgtcaagcagcgagcccagtacgtggttctccacctccacaccagcctcgaactcctccaccaggaagtcgacccatgtgcccagcccgctgctcatgtccttgtcgacaagctcatcctccgtccagtctcccatgctcttccagctggtgatctcactgcagacttgggcctcaacgccccggatcagcgctgctgctcccttgctccatgctgcatatcctgcccggaagtaggccgtgcgccttgtctccaggcactcatttacgcagtcgaacaacagccgcctgtaccctccacggcaaaagggctctttcccttgtttgttgtacacatgcatgttctccaatttctggaagagggacgagtccaaagctggtctatcctgatcgacaaagagtggtcccagttcatctgttgtcaagttgacactgcttaacacgtctgcaatgtagtccagctctgtgtgtcttgatgttttagaacattgggtgacatctgaaatatctgatgtatctacggatgcggaagaggctgagtctgttgttgtctttgcctcgatatcaactgatgctgggtcaatcaagaaattccctttggcattcttaacatcaaaaattgatgaataactcttaccccctgtcatgaggcaagaatgattaatcttcaggggtacaaaaatgtcaacagttcaagaatatatcagaaattcatgttaggtgaattaccaccgctgctgcctgaacactcggaagaccagcaactctcacttagagaggttggttcaagcacagataggggacttagctcttcattttcatgttccttccttgcattacttatgctgctgcattcttgttcttccacctaaatgcatgtgaaatattgtattagaattgcatctacacctaggaagtggcacataaggattcatgcagaatgtaagtcttaagtagctaaggaacctttagcacatcccccaaaaaaacaactccctgccattatcattattctacatgctagaataaaaaaaaaactccctgcattttcattattccacatgttaattcttcctccttgatgggttcagcagacagggtctctgtgtatatttacaaggagctgtaactaaagctgagaggcaagcaccacagaagaaatatacaactcatgattatatgtcagacacaatacactgatgaaatccatttccagatattaaagttgccattagaatagtcaccacagaacagctacagaggtgccttaattcttttgcaagaagatttcattaatgatattaagctacaaacaatcaaacacattgagcggtgagcaagcacatgaagtacactattctactatgacatagaattcttcacaaaatccacttctcaaagaaataattggtgcaaaatgtaaaatgatagttcctataattagattgtattggcgtgctatcaaattattcacaaacatactcaacatattcatgaattgttggtgtgatataccataaggtaatgcgaagaaatatgtacctttattttactgcctcggaaaatttggccttttgctgaagggcagtaatcatattgagaaggtttgacttcagaagggctacagtcaaatactccactttccgagccccaattgctgcatgaagaggttggtggttcctccaaggtaaaagtagcaggcacaaatgtgtcacctctcgtaaaggtgattgatggatcaatttttgatgttagctccttcagcttcttttctaggagaaggctcaatgcatcaccatttacaaagttcagccccactgatgacagaccttcaaccttgttatctgaatcatctttatcacatcctgcatccatatcaaggttgcttcttgtatcccacttacccaccagtctggacagtcctgccgacggtttgaccaagggtgaggtgaaagtaaatgacacgacatctgtagtatccttactttccttgttccacttaatgtgctcatccataacaacattaggttgaacctgcttcttaagtttacccactggtttttcaggaacaaatgtacccttctcgtttgtggagttcctctctatcaaccgtttcttctgtgggaagtccttgttgtttgatgacgatccttctctatcaccacttatgctttccacaatgtcttttctgccaccaactttagataccttgcttccactcttgatcttcccagaagaggaatctcctgccattagttttctgccttgttgtgttgagacggtcttgtttgctggcaccttgcctctggtcaccaacgaattctgtttctgattattttgccgaaggacaggggaagaagtgccagacgacgatggcttctttctctggagattagactgagtcctaaatggttggtttgctctttgctcatcatgctctttttgtactcctgaattcctcccagaaccagttacaccttccctcttctggacattgttctttgcctggactgccaaagaaatagactttcccttgtttttcgaacaactcggattattgatctcataagaatcaattgaaggtctgaatatgacaatatcttcctcgctattccagcttcggttcatctgttgcgctctagagaacctcacatctggcagctcaggagcggtcctggatgattgcggcttcagaggcacagttctctgagaaggaggaatgctctcccttggctccgaaactctcaaaggaatccgtgccgggctaaaagagcagattttctccctagagctggcttgtgcccttggctgaagaatcttggctgcttcctccatgatctgggcagcattcctcgctgaactgaaacctggattcttgatgggggacaacaatctatggtgagacatgggtaggtgctttgcggaccttggtggcaatgcttccatctggaacctttcaatcgggctgcttggcatctttggtgctcggagatccaatggcttcctgatatagccatcgactctttgaggaacatgactgaactggtcattcattgagtactcagggctcctcttgaggctgtggctgtccctgaacaatcttgtgtctcggaaaggtgtgcagtacggttctggaacgcccgaggtgggcatggcgtccaagcccatgagcctggccaccacacctggcgccttcatctcacgcacttcctcatcggtcactgaagacgcacagctgtagtcgctgctccccttgaagcttgatacaccaattccttcatcatcatcaccctacacaaatgcatccacctaaacgttagtgaacgcaagccccttcacacgtataacagcaacaacgatttgctgttcagagcaaggttgaggacgccaaagataactcaccaagtggagacgccctgatagcaaggtttcttcgctcctcttaacaagcttggacccctctgcgaacagatcacgagatcagattaagaaagcattagccaggtagagaagctcttcccggaagcgaggcattcttacaaacacataccgggcgagttggagaacagcttcttgcgcgactttcgcttccaatcaaataggttgaagatcccgccgccgccaataaccttcgctccacccttctccgaccccatcgattctagaaaccctctacacctcgatcaaaactcgtcgtcgctcctcagcgttcgctccgcagcatccccccaaaaggaagagaaaatcacctatacagcctgcttcagatcgaacaagaaaatatacctgagcggaacagactatgaactcatgaatcttaaggttaatggcagggtacggcgccctcgaatcgaaagcattcgtctactcgtgaagctcaccgacgcggtctcgagctcgaggcagccgcgcagcgcggacgaagcggaggcggcggagaggaggggcggaggcggccgggagcatcggatcggggacgccgctaaaggccggacatttatgctgcctgctgggagagtcgatccgagagtggtacattaaaaacgcacgctagaattggtgctttcgaacttggggagccggtgggccccgttctgccgttcgatccaagcggcacgggaggctgaggcgcgggccaggagctggactgggccccacctggctgtggtttggaaacgggcaacggctctttttaaacacggcattttcaaattctggtcgacgcggcatgcgactcacgagagggcacacgccgcgcggatcttgatgcgtgcgatggacggttgtgacgggtggtatagcggagtggttgggttgtctccgtacgagaaaagctgtcgctctactagtctactacgatttggaacagtaaacagtgtggccactggcgtggcctcacgcgattgggtgacccggctagcgattcgacagagctctgtgtggactgcggaggcgagatggtgagaactgagcccgactagtttgaaatcattgtgctgggagtacgtacgaggtgtggctctatgacagcgggggcctatctagctgagccgttggagggagccggttggtttgcgtggcaggtgggggctgcaccacgctcgttgctgcatcagcagttcaacaatcaacacccaccattgccaccagcgagatttgaatctgaactactggacccaataggttgaagagcgaaatcaagcgatcagacgatatttattgaaaagtataaaattttaaatcatgctcaattgctgaaacaaccttaagtgataaaaaacaaatcacaacaataaacgatgactcacaattttttagtaagactagtctgttcgcttggctttaatttgtaccgtcttatact

SEQ ID NO: 21677 - DNA, 1842 bp, Zea mays
actcgctcgccgacctcggaggcgcggcgagggagatcgaaagcgcaccagaggtcaagaatctgggaccatgggcaaaggggctgctgaaaggcatgccgcaggcagcggcgggaccggcagccatggcgcctgttgcgaagtatccgctggttctggcagaggaccggacgcggcggccgggggttccccggcgccgcccggggtatgaaggagggtggaacgtcaccaataagcactactgggcgtctgtttcattcacaggtgtttctggatttcttctcggtgctttgtggttcatatttttcgggatagctgtggctggacgatgctattttggaacaagaatgtccaaaagaaaggtttcttatgcagatgtagtaggtcctgtgttgcttggggtcttcacacttgctataatagctgggtgcattctccttctgtatgggcagagtaaattccatgaagaagctacgcggaccgtcgattttgttgtgaacccaatctgatttcactattcagacactaaggaatgttacagaatacttgtcatttgcacagacgatcactgtggcagcactctatcttccatcagatgttcaaggtcaaattgacagtttgaaaggggatttgaacaaagcagctgacacaatatctgtgaagacagcagaaaattacaaaatgataagaaaagttctccatatcatgtcagttgtattgatttgcatagccgtggtgctgcttgttcttgtgttccttggatacggcctagagaagtatggaccgagatatacagtttacatatttgttaccttatgctggaaagctgtggcggctctctttatccttctagggattttcctgatactaaacagcgctgcgcaggatacctgcgaagcaatggaccagtgggcccagcaccctcaggcagagacagctctgagcagcatccttccgtgtgtggatgagagcacgaccaaccgaacgctgtaccagagcaaagaggtggtggtgaggcttgtggggatagtgaacagagctatctccgctctttcaaatcgaaggccgcatcacaagcacccaggacagttcatgccttacctgtgctccccctacgactcaaacctcaacgacagaccgtgcaagtatagggaggccacgtttgaaaacgcgacgacagcatggttgaactacacgtgcatggctcaagacacggacttgtgctcaggcaacaagaccttaacctacgacatctacggccaactcgtgctggctgcaaacgtgagctacgcgctgtaccactacgcccccttcctgctgaacctccaggactgcaagttcgtccgggccaccttcagcgccatcgcctcgcggtactgccctcctctggggcacgacctcgtgctggtctccgcgggtctggcgctcattgcctcggcctttgttctctgcctcgtctggatgctcttcgcggaccgcccccgaagggaggaggtgtccgatctggcgtcggggtcgaggatcgcgccggtagacagctctccgtcgtagaagcaagcaagcaagcggcgcaacgggatgtctatgactatgagtgaggctgcttggtcgcatggtgaccagagtttagtacagttcccttccatggctatgtaaaatagtttcggtatagcgagttccgggagacgtcgttgaagtgcggagaggagggggagaaaccggaagcacttcgggtgggggacaaaaggccccattttgcagtggagagagttaggtggaaacgagtgctctgcttccttctatcggatgaaaaatcgatgcacccatggggtatgttgctgc

SEQ ID NO: 21678 - DNA, 2401 bp, Zea mays
ggggctaaaatcttctctctattcaaaactaaatagaaaatagaaaataaatttaagtcacaaaaaggacaagtatttgcagttcacatcatatctatgacactatgaccagttaagttctaacactgcttcagcccagcccctaaaagcgaactgctatatcagagggcagctctattaagcaacaattccagcgccactttcttgcgcctcaggggatcaatgcaaagtctaactactgcacacacgacacaaccaggaagagttaaaacaactcggaccaaacaaaagcccccatgcctattctacaacctttttttttctaatcgtgaccattggtcctgctgcttctcttgcagcagggccagtcacgtataagctcgacaccaggtaattatggctaatgtacaaaatttagcacgaggtgctgccttttataagcccgccccgatggatgtcatgccaccatcgagtcattgtcgttgggcggacggagattgctgcacctgcactgctgggaagtaccccatgcctgctgatggctggaagaaccctgctgactgctgcggcgctggtggctgaggaggagactgctgctgctgctgctggggttgggtctgagccggtggaagcggaggtggaggtggaccgcttggcgctggaaaacctgctggcatgatgctggacatcggcggaggaggcggcatggagccagccatcatcccgaacggtcccatccccatcattcctccagcgctttgaccgaactgttgcaggagcggtggcagaagaggcggcaacggtggtggtggaggcggtggtgcgaatgggcctggcgcttggttcatctgtgccgctgcttgtgtgggcatcgctccaaccggctgctgcagccgtggtgcttgcacggagaatggaggcgcgcccatgtcgctggccagcacggttctctcaagcctgggcctcttttcgacctggaagcccggcggtgccccggagagttggtctctgggaggagatccgctgttcatggaagatagcgaagcgccgtgtgtggcgacgaaagatgagaagatggagctcaggacctgcaccggcgctgacagagatgccagcttgtcggccattgctgctgccgttctcttgggctcatctccggctgcaccgattggaggggcgagtgagggtgctggattcagcgactgtaactgaggagacatcagcagcggactagaactagatcctgtgccatttgcgacaacggcaccaccaaaccgttgcctaagttgaatggcatgttcagcctctgctcgagcaacttgcaactggctgcgaagaacctctgactttgactcctgttcggtgagagcttcttttaattggttgcccagacagcggcgggccgcatccaacacttccaagttgtgcaatgcagtgcttcaggattgtttcctgttcttgtaggtcagaaatcattgttgaggcaggcggatcacctttggtgctagcatcctctatatctttctttagcatttccagaacactaacagtactcttacacttgttcaaagctgcgtcttcatcaaaatgctgatcaaacacagattggtatgcagtcacaatcttttcaggcataccaccaacagtcagtttttttagtactgtactggaatctttccttccaactttggaatttaaggggttagagctaggatttgaattattattattcccactgtgatcgaatataggagggttgtcaccaaaaatgccgtctttcagactttcaatacgggttccaaaaactttgcggtcatcccaaattcctattagtcttgccaccagtttctttgcttcttctcccccattttcgtagaaatgtttcaataatctgggtagaaccctccagaactcatgcacataatctcctcccttgcgcttactgttttgcaagatatcatttgatagaaacaggaatgatattttcttatcatttgttgcagtactgaaatgcttttcccatgtgtccacaatccttctggccctcttgcggtgaaaaatgcaccaatgtgaaagtgtctgaatgctcgctgttgtgttgttgagcttgttgagcttatcaacaaacctctcctcgctgaaggagccgccgccgccgtccctcgtttccacgtctacgcccgacttcgcagcagccatcacgaagtctccaactaatttaccttcctcgcggataggctaaaacccagatcgaaacgacctcggtggcgatgagctcgagcttggcgccgcagacgagacggggaaggggaagcacgaagcaggagggaggacgaggcagagagggtttggtttgcggcttccacctccaccctttccttccttggatgtcttttttttt

SEQ ID NO: 21679 - DNA, 2314 bp, Zea mays
ccgataataaccataataaataaatttaagtcacaaaaaggacaagtatttgtagttcacatcatatctatgacactatgaccagttaagttctaacactgcttcagctcagcccctaaaagggaactgctataacagagggcagctctattaagcaacaattccagcaccactttcttgcgcctcaggggatcaatgcaaagtctaactactgcacacacgacacaacaaggaagagttaaaacaactcggactaaacaaaagcccccatgcctattctacaatcttttttttttctatcgtgaccattggtcctgcttatcttgcagcagggccagtcacgtataagctcgacaccaggtaattatgtctaatgtacaaaatttagcacgaggtgctgccttttataagcccgccccgatggatgccatgccaccatcgagtcattgtcgttgggcggacggaaattgctgcacctgcactgctgggaagtaccccatgcctgctgatgtctggaagaaccctgctgactgctgcggcgctggtggctgaggaggagactgctgctgctgctgctggggttgggtctgagccggtggaagcggaggtggaggtggaccgcttggcgctggaaaacctgctggcatgatgctggacatcggcggaggaggcggcatggagccagccatcatcccgaacggtcccatccccatcattcctccagcgctttgaccgaactgttgcaggagcggtggcagaagaggcggcaacggtggtggtggaggcggtggtgcgaatgggcctggcgcttggttcatctgtgccgctgcttgtgtgggcatcgctccaacccggctgctgcagccgtggtgcttgcacggagaatggaggcgcgcccatgtcgctggccagcacggttctctcaagcctgggcctcttttcgacctggaagcccggcggtgccccggagagttggtctctgggaggagatccgctgttcatggaagatagcgaagcgccgtgtgtggcgacgaaagatgagaagatggagctcaggacctgcaccggcgctgacagagatgccagcttgtcggccattgctgctgccgttctcttgggctcatctccggctgcaccgattggaggggcgagtgagggtgctggattcagcgactgtaactgaggagacatcagcagcggactagaactagatcctgtgccatttgcgacaacggcaccaccaaaccgttgcctaagttgaatggcatgttcagcctctgctcgagcaacttgcaactggctgcgaagaacctctgactttgactcctgttcggtgagagcttcttttaattggtttatcagtgatatcctcgccgcatccacacttccaagttgtgcaatgcagtgcttcaggattgtttcctgttcttgtaggtcagaaatcattgttgaggcaggcggatcaccttcggtgctagcatcctctatatccttctttagcttttccagaacactaacagtactcttacacttgtttaaagctgctgtcttcatcaaaatgctgtatcccgcacagattggtatgcagtcacaatcttttcaggcataccatcaacagccagtttttttagtactgtactggaatctttccttccaactttggaatttaaggggttagagctaggatttgaattattagtattcccactgtgatcgaatataggagggttgtcaccaaaaatgccgtctttcagactttcaatacgggttccaaaaactttgcggtcatcccaaattcctattagtcttgcaaccagtttctttgcttcttctcccccattttcgtagaaatgtttcaataatctgggtagaaccctccagagctcatgcacataatctcctcccttgcgcttactattttgcaagatatcatttgatagaaacaggaatgatattttcttatcatttgttgcagtactgaaatgcttttcccatgtgtccacaatccttctggccctcttgcggtgaaaaatgcaccaatgtgaaagtgtctgaatgctcgctgttgtgttgttgagcttgttgagcttatcaacaaacctctcctcgctgaaggagccgccgccgccgtccctcgtttccacgtctacgcccgacttcgcagcagccatcacgaagtctccaactaatttaccttcctcgcggataggctaaaacccagatcgaaacgacctcggtggcgatgagctcgagcttggcgccgcagacgagaaggggaaggggaagcacgaagcaggagggaggacgagcccgg

SEQ ID NO: 21680 - DNA, 4246 bp, Zea mays
  misc_feature (2908)..(2908): n is a, c, g, or t
ctgagtactggctgcacggcgaatggtgtttcttcgtagacgagaaagggaattaaaagtatgcattggttttttaacatgtcgtgctcatcgttgctggtgcgtgcatgtcaacctggacatccgccatatgtttgatgaaatgctcctacatgtcgacgagcgtgcttatgtctaggaacatcctccatggctgttctgtcgtcgtccccgaccaacacggtgtgaaacacccttcacgtcttcagttttatactatccatctacaatggctcacctaaaacactgttttacaatatagaatatattattcacatagtgaagtttgaatatgtggataaaaatagataagctgctgaaaatagtcttaggttaccatcgtgtaaaagtcagtggcgaaaccagaatttattagagctctggacctaatttatgacaaaagccaaagaaagatagttcaaaaattccatgacaacgtaacataaacatagataaggtataaaaaattattattgtaaacaatatatttctttttttttctttacctatttcaggttcggaaatagaacctagtataaaattttttaaaaatactaaatattcgaaacatgtaataaagatagtataaattaagatttagaacataggctatataaatatcatcagaataaggataaattaatcatgttatttcttatattttgagggggttaagaagaatttagatcacgccttgggctcatgcggaagttataggcaaaattgcagcccgggaaacttgaaagtagaacctacaacctagaggcaaaggatgaacgagtacgttttcttgaaaaaaaaaaatcactaatgaagtagttattagcgtttttttacatggcagtaatggaatttagaaataatcggcacaaccacaatactaggaaacaaagtagatccatgatcaagcacgtaaaaacctgtattataaaggggtgacaacgctaaggtcttgttattgtaaagtttacagcttatgaagtgatggtaatattcacaaaccgaccttagactcagggggtagagcggaggactgtagtgatcgcagaaaatccttaggtcgctggttcgaatccggcaggtcggatttttttttttgtggccagtggttcgaatccggcaggtcggattttatttatctatttattttattttattttttgcctttcagtcatcattcttcttttgtcgttgtaggagtatttttctatcaaaggaatcgtttgcctcatcaaaccatacacggggccggttttactcacacagaacatgcccgttaatttttaaaccacaccattcctcgatccaaagtagcacttgtaactgtcaactctaaagaaaccagcaactttgcacgcaaaaaggaagctgtactaaaaaataatcataataaataattaaatttaaataacaatagaacaagtatttgcagtttacatcatgtcaatgacagcacgatcagtgattcagtgggcaacaattccagtgccactttcttttgcctcaggagatcaaagcaaacgggggacagagacacaacatctaactactacacagaacaaggaagagttaaacaactctgaccaaaacgagagtcatcacaaaagcctattctacagtttttttttctaaccgtgacaacggtcctgcgcctctcttgcaggatcagccacgtataagctcgacgctaggtgattattggttaatgtacagaagttagcacaaagtgctgccattatagcccgatgaatgccatgccaccgttgagtcattgtcgttgggcagacggagactgttgcacctgcactggtgggaagaaccccatgcctgctgatgactggaagaatcctgctgatgtgggtgattgctgtggtgcctgaggagactgctgctgctgttggggttggttctgggccggtggaagcggaggtggaggtggaccgcttggtcctggaaaacctgccggcataatgttgggcaatggaggcggaggtggcatagagccggacatcatcccgaaaggtcccactcccatcattcctccagtactttggccgaactgttgcagaaacggtggcaaaagagacggcagtggcggtgcaaatggacccggtgcttggttgatctgtgttggtagctgtgtgggcgctgctccagtctgttgttgcagctgcggtacttgcacaggaaagggaggagcacccatgtcactggcctgcacggttttctcaagcctaggcctcttttcaatctggaagcccggcggttccccggagagttctccagaagccggtccactgttcttggaagatagcgaggcgccatgctcggcaacaaaagatgagaaaatggagctcagaacctgcacaggtgccgacaaagatgtcagcttgtctgccattgctgctgccgttctcttcggctcatctcccactgcactgactgtaggggcaagcgaggttgctggattcagtgatttgcaactgaggggccgtcagccttactccagaaccctgtatcatagcagctgtctgttctgttggggtaatcattagcaggctagaattagatcctgtgccatttgagacaacggcaccatcaaatcgttgcctaagttgaatggcatgttcagcctctgaacgagcgacctgttatggcaatcagataacggattaacaataatgtcataagacagctaaaagattattacaccatagacagatttcagccaaaaaaaaagaatttgtgatccattaccgcccctagctatactgctatgaaggtgctatatggctcagaaacacacaaactcatggcttactagtgcaggtcagcaggtgctatttatgaaaacaagaattcagttggnaatgaacagattaggtctctctactttaagttctacacatcctctaatggtacccactttcatagcgctggacagacttgactatgcaaggaacaacaatagatgaaaagccaacatgcaaatagggcataaagaataattcttacttgcaactggctgcgaagaacttctgactttgactcctgttacagaaataagacagacaagtttgaaaagcacgaggcaaatgtattgagatgaaacttttggaaggtaatgaaagtgtgctcaaaacctgttcgacgagagcttcttttaattgatttatcagcaatatcctcaccacatatacgctttcaagttgtgcaatgcactgcttcaggattgtttcctgttctgggaggtcagaaatcattgttgaggcaggctgatcaccttatgaaaaaacacgcaggccaaaaaaaagcaggacaaataagtatggtgtcaaaatttcttcaacagcagatatccacaatgctaataattagtgagcaagataaatccttacctttggtactagcatcttctatatctttctttatcttttccagaacactaacagtactcttacatttgttcaaaactgtgtcttcatcaaaatgttgatcaagcacagattggtatgcagtcacaatcttttcaggcataccaccaacagtcagtttctacagaagaattcaacgagttactctcatatccaattcaatatgtttccacccaaaaaggagagtgacataggataacaagctcactttcttttagtactgtactggaatccttccttgcaactttggaatttaaggggttagagccagggtttgaattatttttattcccattgttatcgaatataggagggttgtcaccaaaaatgctgtatttcagactttcaatacgggttccgaaaactttgcgttcatcccaaattcctattagtctagccaccagtttctttccatcttctcccccattttcgtagacatgtttcaatgatctgggtagaaccctccagaactcatgcacataatcacctcctttgcgcttgctgttttgcaagatatcatttgatagaaacaggaatgatattttcttatcctttgttgcactactgaactgcttttcccatgtgtctacaacccttctggccctcttgcggtgaaaaatgcaccattgtgaaagtgtctgaatgctcgccgctgtgttgttgagcttgttgagcttatcaacgagcctctcctcactgaaggagccaccggcaccgccgtcccttgtttccacgtctacacccgctttgcgccgacagcaacggaattcgag

SEQ ID NO: 21681 - DNA, 1506 bp, Zea mays
caccggcacacggctcctccaggatcgagagctgtagctgcaacctgcagcagacgcatatgtccgtcgccgccgccgccgccttgggccgcgccgatgagctccgcgcgctggacgacaccctcgccggcgtccgcggccttgtacgtctggtgcgaagcaagttcctcacatctttcgcgtcccctacccggaggagctactccaacatgaacaaccgccagcggcggcgaccgtcccggtgatcgatctcagcggcgaccgcgcagccgtgatcgacgccgtccgtggggcggcggcggggtgggggttcttccaggtcacgggccacgcggtgcccgagcaggtgatgtcagcagccgtggcggcgatgcgggcgttccacgaagccgacggcggggagggcagcgacaaggcgcggctctactcgcgagagcccgggagggcggtcaagtaccactgcaacttcgacctgtaccagtctcccgtggccaactggcgcgacacggtctacctgcggatggcacctgaccctcccgccgccgacgagctgccggagatctgccgcttaacaaacaaggtcgcgtcatctacatacatcgagatccttatagtgggcgagcgactcccaatttgctcgagatgcactgtttgaatacgccaaacaagtgaaagatttggggcacaggttgtttgggctgctctccgaatccctcgggctcaacccgagctacttgacagatattgagtgcggccagggacagattatacttgggcactactaccctccatgcccccagcctgaactcgccattgggacaagccggcattcagactccggcttcctgaccatactactgcaggacaaagttggcggcctccagatcctccatgatggtcagtgggtcgacgttgcaccgacgcctggagcattcatcgtcaacataggcgatctcttgcagctggtctctaacgacaagttcagcagcgtcgagcacagggtggtagccaagaatgctgaaccaagagtttcgatcgcgtgctttttcagcacccatttccatcccgcttcgacaagaacgtatggcccaatcaaggagctgctgtccgaggagaaccctcctttgtatagggaaacactcgtgagagagtatgttgcacgttactactctgttggcttggatggaaaacagaagactgctctagctgatttcaggttgtgaattctgaacgacatcttatttaacagcaagatgcaaatgttggggcggtatgtatcgtgtgataataccaaggggaagattagctgcttgtaacattccctaattaatgtaaatttatgctcgatcgccacaacagaagtacacatgtttgtatgagcctgaatttgaattgagtttggagtttggactctggacgtatattactgaaacacataataagatgtttcttctatgccaaaaaaaaaagaaaaaaaaaaaaaaaaaaaaaaagtcgacgcggccg

SEQ ID NO: 21682 - DNA, 1356 bp, Zea mays
gggcggacgcgtgggctgataatcgagactgctaactacccagagactctattccaactgcttatcgtcaatgctggtccgggcttgcggttactatggaacacccccgggcccccccgcgtccccaaaacgaccgccaagcatacatgttcttgggaacaaataccaaagtaagctgcttgaaacaattgacgctagtgaattgccagaattccttggtggcacttgtacctgtcctgaatacggaggttgccttaaggctgaaaagggaccgtggaaggacccaaacatacttaagatagtccaaagtggtggggttcattgtgctcgtcaaattgtaactatttccaatggtgaggaaaaatttattacttacgccaaaccgaagcgccacgcaatgagagggagtgacacatcaactgctgagtctggttcagaagctgatgatgctgtgtcccccaaagctctcagaagttacatatcacatcctaagttgaccccagttcgtgaagaggtcaaaatggtcagggctactagcttttctactcgtgtccctgaatatgatgtacctgttgttgacaaggccgtggatgctacatggaagagagagcaaccacgaaaggcaccatccgtgccccaagatgcagactcatctgtgaaaactgcatccaagccatctggccgcccctgggataagatcgctgcaactctgatggcttgtcttatggctattgtaatgttggttcgatcagtcaaagatcttgccacaatgagattgtcatctaaaggcgggtcagaagaaagctactgtacattgtatccggactccgtccagaaagaggaattccgtcctccttcgccattccctgggttcgctgaagccgacctattcgccgtggtcttgcaaaggctgggagagcttgaagagaaggtccagatgcttcaagaaaagccttctgaaatgccttgcgagaaagaagagttgcttaacgctgctgtgcgtcgtgtggatgcattggaagctgaactaattgtaacaaagaaggctttgcacgaggctcttatcaggcaagaggaactgctcgcgaacatggacagcaaggagattgccagggctcagagaaagaagaaaacaatgttctgctattaggagttaggacaacacctgcttccgtgaggagatgacaaacgcggcgtctgagatgtaaccagcgaccccttcatttttctgacacttgtgaatcaacaggtttccgttgtaaatcaacaaaattctgacataaataaaatgttttttttttaatttgctttgcaatcctgagcattgctgcctcctcctgctcttcgcatttggtt

SEQ ID NO: 21683 - DNA, 1277 bp, Zea mays
  misc_feature (1233)..(1233): n is a, c, g, or t
cccccctttcttgatcccaaaactaccgccaagatacatgttcttgggaacaaataccaaagtaagctgcttgaaataattgacgccagtgaattgccggaattccttggtggcacttgtacctgtcctgaatacggaggctgccttaaggctgaaaagggaccatggaaggacccaaacatacttaagatagtccaaagtggtgaggttcattgtgctcgtcaaattgtaactatttccaatggtgaagaaaaatttattacttatgccaaaccgaagcaccattcaatgcgagggagtgacacatcaactgctgagtctggctcagaagctgacgatgctatctcccccaaagctctcagaagttacatacaacatcctaagttgaccccagttcgtgaagaggtcaaaattgtcagggctacgagcttttctactcgtctccctgaatatgatgtacctgttgttgacaaggctgtggatgctacatggagaagagagcagccacgaaagataccattcatgccccaagatgcagactcttctgtgaaaactatgtccaggccatctgattcctcctgggataagatcgttgcaactctgatggcttgtcttatggctattgtaatgttggttcgatcagtcaaagatcttgtcacaaggagattgccatataaaggcgggtcagaagaaatccactctacgctgtacccagaccccatccagaaagaggaattccgtcctccttctccgatccctggatttgctgaagccgacctgttcgccgtggtcttgcaaaggctgggagagcttgaagagaaggttcagatgcttcaagaaaagccttccgaaatgccttgcgagaaagaagagttgcttaacgccgctgtgcgtcgtgtcgatgcattggaagccgaactaattgtaacaaagaaggctttgcacgaggctcttatcaggcaagaggaactgcttgcgtacatcgaccgcaaagagattgccaaggctcagagaaagaagaaagcaatgctttgctactaggacaaggagggagatacttctgcttcctcagaggagatgccaaagatggcgcctgagatgtaaccagcgatccccttcattttcctgacacttgtgaatcttctacaagtttccgttgtaaatcgagaatattctgacatgaataaagtgttttttggcatcaaaaaaaaaaaaaaaaaaaaaacaaaagtnaaaaaaaaaaaaaaaaaaaaaaaaaaaaaacctagcccgagcgg

SEQ ID NO: 21684 - DNA, 626 bp, Zea mays
gcccctgggataagatcgctgcagctccggcccgacgtcttatggctattgtaatgttggttcgatcagtcaaagatcttgccacaatgagattgtcatctaaaggcgggtcagaagaaagctactgtacattgtacccggactccgtccagaaagaggaattccgtcctccttcgccattccctgggttcgctgaagccgacctattcgccgtggtcttgcaaaggctgggagagcttgaagagaaggtccagatgcttcaagaaaagccttctgaaatgccttgcgagaaagaagagttgcttaacgctgctgtgcgtcgtgtggatgcattggaagccgaactaattgtaacaaagaaggctttgcacgaggctcttatcaggcaagaggaactgctcgcgaacatcgacagcaaggagattgccagggctcagagaaagaagaaaacaatgttctgctactaggacaacacctgcttccgtgaggagatgacaaacgcggcgtctgagaagtaaccagcgaccccttcattttgctgacacttgtgaatcaacaggtttccgttgtaaatcaacaaaattctgacataaataaaatgcttttttttaaaaaaaattgcaatc

SEQ ID NO: 21685 - DNA, 1187 bp, Zea mays
tcgaggccggccgggccgtggcattgtcattgtgtgtgatacctgctaccaccaccagctagctctataaattggtgcaactattggctgcccacccatcatatcgatcagctcttgcaaccttatctccattgcactgcattgcattgcattgcattagtagagggagatccatggccagagaaatggagaaggcaaagaaggccacatcttcccctaagagctcaacaattagtactggtcccaagagcccggtgaggaatggaggaggatctccccctcataagaaaaacactactactgctaccgaggcacgtggacggaaacatgagcagcaaaacgttcgaaaaggaggagacacgttgtctcatgacgagagcaaaccacgacgttcttcatcaactgcggcacaaacctcacccaagagatcaccgagacacgaacaacccctgagctacaacaggctccacacagaggagagagcaataaggcgggctggctacaattatcaggttgcaagcaagataaatacccaggaaatcattcgcagatttgaagagaagcttgcacagttgatggaggagcgcgagataaagctgatgaggaaggatatggttcccaaggcccaactgatgccagcatttgacaagccattccacccacaaaggtcgacgaggcctctgacggtgccaaaggagccgagtttcctgaggctgaaatgctgcatcggtggggagttccatcgccatttttgctacaatggagtcaacaacaaggccatcaagtcgtagtccatacataatacatgcacgcagagagatatacacacatgtgcctcactacactgaagctacaatatcgatcagcattctttttgccgccgccgttgcatacgtttccaacagaactactgtataacacccacgcaagccatgcatatatacgtagaagttgcacatgtgcgcacaaatttttcacgtacgtagcacacacacagatgtggttaatcgcatgctgatgatgtaattaaatttcgcctaccgttcccccacttctttttctttgtcttttacatttttcatccctctaagttaagttctcttttcctcgtttagctagcgtgttccatgcatgtatatttctgctggcataaataaaaagttttcatatcaaaaaaaaaaaaaaaa

SEQ ID NO: 21686 - DNA, 1484 bp, Zea mays
  misc_feature (43)..(43): n is a, c, g, or t
  misc_feature (45)..(45): n is a, c, g, or t
  misc_feature (49)..(50): n is a, c, g, or t
  misc_feature (54)..(54): n is a, c, g, or t
caagcaaaactgtaataacttgttcttatttttagtttctatnanaganncgcnaaatatcatcaatagatgagtacttttttttttttttttttacattacttaaggctctcaacaggtcgtcttcctgagagagaaacttatatcatgaccaatctttttggttcaaatattacccatgcagtaacgcacaagaacagtggtcaattcgtacaccatatttcaagaatgtcgccagtgctgcctggcaggcaaacaaaaacaatgcctcacgccgtgtacaacctctaccctcacaagcacaaatcgacaaaactaagacaagcacgccacccaatcagccaatccacgccctaattatgtactgttgtcgccgtcaaaacatagcgtgatcacttcatcaggtgccttggtcgcctgggccagcgagagcgatattgcaattcgaagcgaacttgcgagcaatcataatcgcagcattcctgtccctgtctgtttcgaaggctagagtgtaggacgagcctttcctagggtgccagaaaactgccctagctgcagcattaccaccaccacggctcccgcataacttcatcgtagtggaatacgactctcttgcttttgtggaccatccttttcgaagttttattctcagctttccaatgtgaaatacatgaacagaattcgacgagtaatccttcccattcatttgggttactactacattgaactcaatatccgtccttttcattagtgagtccacataacgttcaagtcctgcagcgttatctacagggccatctgtctgaactataattttgtctgcattcaaaactatctctgcttgcaacaatcggccaacatcaaacggttctggggcatacataaattttgttgctcctgatatgagttctctagtgcctccagaaattacacgataccactgaattggacagttcgtgatgtttgaagcaccatcaactcgcgggataatacaaagctgtgatccaagggtattagaaccttcaagctcaaagaggccagaactatcgtcttctaacctcttgatcatggcaagctctttctttagctgattgcatagctgagtcttctctgagatgagagtccgcagtgcctgaagctcaaactccatgtccatgaccttgcttggctggtgtagcatttttattctcctagcctctcggacctctttcctaagttcctctatttccgccttatctctgctacttgacgcaaaatcatgtacacgccatgctttctcaactttttcgatcgcagctctagccttttcaatttcagccagtgcaagggccctttcctcttcagccactttgcgtgcatcttcagtagcctgcttaaggaagttagccaatttttttacttcagccttctcataaattaactccccttctcgttgtgtcaactggacagctagtgcctccaccagtgagatagcttcctcagcg

SEQ ID NO: 21687 - DNA, 2161 bp, Zea mays
  misc_feature (2160)..(2160): n is a, c, g, or t
cccctgagtagctgacagcagtgaaatggacagacagttagacactaagcaaaaaaaaaattgtttcttatcattactactatatcaccctcagcccttgaggttccactacatagtaaaatctttgcagttcaagtcattgctacaccagtgaatttttcatgtttagcaatggacaataaaatcagctctcctgagtaaattaacactacatcactaactacttaccaatgttgccagtatgatcaaatgtgcgccgtcaaagccccatcaggcctgccatttacccatgtgaaattcaataagccggtaaaatggtggtttggttggaaatactcgaacattatagagtatataccatttgttgtctgtgcaaccactactggtgtggaatggtcaggatgttgggtgcctacaaaggaaattgcttgactacttgaagcaacagtgtgatttcccatatcaggatagcttgtgtgtagaatatcatccagatgtttctgaatagcatttgactgactttcgatgtatgacatcacatcctcggatttggcagctcttgaagcaatcaagctagccaaccgacacatgttactgaatcgagcttctgaggttgatcgcatgacactgccagacccataggtaggttcctccccaatttgaacagaacgagcatctttcctccatctcttcaaaatatattgttctggaagttctttgatattcttgagatccagcactttcagtacatgacagcattgaatcccaacagcttcaaacttcttgcagctgcaagtggtcgagccatctagtgcatcaaatttgacaaaactctctgatggcttctcatcaagcacaatcttgtactcagagatcgtgccaaccacaccgcaggggaaggacatgcaattcatgtaagcctcaaactctccctggaacatcttgaaagcttcaggtgtataagcatttgatgattgttttagcattcgcaacgatgggataggcagagtaacctggctgccatcaacatcagcatgcaatttctttgatcgatgctcttccagaatagactcataacgcctgaagaactgcaggatatcttcttgctcactgaggtctcgtcttagttcattaatcatgttatccttacgaagggttgagagtatatcagcagaaaacatggttctctgataaggtaaagccccgttgctgtcgtccaggtaaagtctgctgagccactcactctcaccaatgtcatgtttctcaactagcttttcccatgctgacaagaactcaatctcatcctcacattcaaagagacaatggttcaaagcattgctgaaactttttgagctttcaaacacctgcttcaagtgcctctttgaattatggtagatatgccacacccctgtgcagtgattggtgccaggccacacctctgctgctgcaatggcacactcaggacgttcatcaatcaaaatagtttgtgggtgcctagcatgcatggcatcagcaaacacctcaaatacccatttcagcgactgaatgctctcatcatagagcagtgctgcgccaaacacaagtaactgcttatggttgtcaacaccaacaaagagtgcaaatggccgtccataaatgttcaatgcatatgttgtatcaaagcaaacaacatccccaaaactcctgtagtcaattattgattttgcatcagcccagaaagaaatccacagcggatttcccatcaggccccactcctaccgcgtaataaactgaaggattttctacctgcaactcctccaagtattgcaatgctgcgccaacatccccaagctgcacacccttcccttgcttccttcgatgcatttcccctgctccaagctcatgtgcacgggctctcattttatgagaccgcagcttatgcacgctgtctggattggccagaggatggttatgctctggaaaaaactttgctacacggtatgttcggcagggggtgatctttatcaccattcttgcctgacatccggtccgtgttggcggcggacctggcctaggtgtgcctgctgaccctgcaccaccatttgcaatgactatggctccacctctgcttgggcggccactgacaccctcgcgagaacaaacaaaaatacgcgacactanc

SEQ ID NO: 21688 - DNA, 3139 bp, Zea mays
cattgggtacctcgaggccggccgggaagtcacttttaaccgaaggcctaaaggcgggttcccttccgggccgcccgggcggccgggcgacaaaccctaaacccttttcctccaaattcacgcgagctccaatctgtgtgggtctccgtcgtcgtctctctcctcccggccgccggcgcgatgaggcggttgctcggccacctacacccccatgcccagagcctcttcgcttccctgcctcgcaaaccgtccatcgccaccaagctccccttcctcctctcccgccgcctcctttccgatgccgcctcgcctcctgccccctcgctgccgcctcctcccccgccctctgccgacgtcacgaacacagagttgaagaagaggttggagacttactatggggtggatgaagaggctgaattaccatctgtcgctaaggctgttcttgagcggaatctcacgggtgcccatagtgagactgatgatgaccttattgaggagctgcgtagtaagccactccctgaagtccatgaccgggactttgagtctgattttgaggagatgcatgatactgatgaggagctgaatgacctgtacaatacaagggagtatgttgagaagaagatcaagagtgatgagttctttaacatggatgacacaaagtgggatgccatgatcaaggaggccacagacaagggtcacttaactaacatgaaggagtgcgaggaaatcctcgaggacatgctctactgggacaagctacttcctgatgagatcaagcaaaaggtggagaccaaatttaatgagttgggagacatgtgtgagaggggagagatggaacctgagcaagcatatgagatgttcaaagaatttgaggataagatggtcgctgagtgcactgaattaattgaatcaaagatgccaactgacgctgatgaactgactgaatcaggaggtaagaaagttgagttagatgatctacctggcgagggacctgttctaaggtgggaatcacggattgtatttgttcctagtggagatgcatatcatcccaaaaacagaaaagtcaagctcagtgtgactgtgaaggaattgggactttcacgacatgctttccgtcggttgcgtgaggttgttggaaagaggtataattctgggaaagatgagctcacaataatcagtgaaaggtttgaacaccgggaagagaacagaaaagactgcttgaggacactgtatactctaataaaagacgcaatgaaagctgacaaacttgttgaggatgccaggaattcttatgttaaaggaagacttaaggctaatccacaatttatggagcgattgaagaggaagacagataagttgatggcagctgcataaggtgttacagagctccttgttttaacagctcctctctttccctcatcaacatggtgattattctgtattttcaattttattgttggctgtcgcacggggagaataatatgttgtatgcacttagctttgccttctttaatgtcttggcttcttttgtagggtcattcttagtcataaatatatgttgagcatctcgaataacaatgtcaacacacatccccagcctatgcctttttggaaatcttttgctgctttcctaaattgaagatgcttaatttccatagtttgctgaggaaagtagctactgaggtgtaaattttggagtcaatatgtcgcttcttctgaagtcacagaatcatgctggcaggactggaatctaatctcaaccttgtgatctgtacaattgattcatttaaagggtaatttctgccttgtttagataacttaaagtctgtacgttctctatggtaattatcatgccaagttagctacttacgatgtgctctgtagtgtatgcgggagtatgtttgatgcaagaactatgagccatccatcaggcatgagcaggaccaccacggtcctcaccgtgtcctcctacagcggctcctacagcggcgtggcggcggcaaacaccgtggatgacttgtgcgacatgatccgtggcttcgtggacgtgtgcgtcgcggctacggtccgtgcctagcgcggccagtctgtggacaggcacggtcacctcctaatggttgcagacatggcggtcgcgagcaggacgtcgcccgcgaggatggcacggcgcgaggacaagggaggggaccttcccagttcctctcgattcttcccatttcttctcaaaaaattaaagattgtccacatgccacgctggagcaggggcagatttgggttccgggccacctgggccgtggcccgagtcgtggcccaaatatccacttatacttaggttttttcagcccaaccatttatccttcctctccacttgaagcctgggcgtatggcggctgcaaccctgatcgacctagcctcaaccttgccctggcggcgacttgaggtcgacggccagtcaccagtgctccctatgacaagctcgacggccgctgcgcgccctccatggatctagcaactagcgaaccgggcagtcggcgacctcctcacctccctgcggccctgcgccttgcttcctgcctccctccacggttcgtcgcgggcctgtgttttccgcccctcgccggtggctcggctcctccacggcagtcggcggcgtcaccaactccggcttccacaggtcagccacgctgacactggaacaggatgtgcgctgaagtttccacacagatgtcaggcaccacattcttgatgatgagattcgcacgacattgtaagcacccgcggagggccagccaaccaaagaattgcacccatatggcggcgccctgcttctccagatgaaacaaaccagctccttcatccacggtcgtccccccactgcgcagcacttgatagaacatgctcgaccgaagtttgttgtctctagctgcagcgaaacatcccaggacgatctagttattgtcccattgcatattattctcgattggatgatcttgtgtcgtaggccatttaatgaagtttgcaggagcaacattctcttcagctggtagaaagttcatataaaaaaagttgaaaggtgactcgtgcagtggtcctcatcatggtcctcatcagtaggaagcgcaacaagcaagttttgaag

SEQ ID NO: 21689 - DNA, 3619 bp, Zea mays
ctgggtgtgaaagggccgtgcgggaagctaaccaccgcgaaagcgcctctgggggagtcagacgaacgaagcaatccaaccgaacgaaccgacctaggtcgtcgtcggctcgtcccctccgcaggaccggttcgccgtctcgtcccgatctcgccgcctgcccgccgcgccctattaccgccatggaggcgctgtggaagcaggcctccaggctcaaggaccaggtctctcggcagggtgtgttcaagcagtttggctacgggaattctgataatgcgtttacagatgagtcagaggttaaactgcatcagagattggaaaagctttacttatcgactcgtgctgctaaacattttcaaagggacattgttcggggcgtggagggctatatagtcacaggatctaaacaagtcgaaatagggaataaattgtctgatgacagccagaaatacggtgttggaaacacatgtacaagtggtgatactttgtccaaagctgctacatatttcggaaaggcacgctcacagatggaaaaggagcgtggcaatatgttgaaagcatttggcacacaggtggcagagccactgcgggcgatggttatgggtgcacctttagaggatgccagacatatggcccagagatatgacagaacgaggcaagaagctgaagcacaggctgtcgaagtatcaagacggcagaacagggtgagggaatctactgggaatggcgatatggtatcaaaattggaagctgccgagtacaagcttgaagaactgaagtcaaacatggtgggattagggaaggaagctattgcagcaatgtcggctgttgaggctcagcagcaacggttgaccttacagcgtctcattgcactggttgaggctgagagaacttaccatcagagagttctggagatacttgacaaattggaagaagaaatggtgtctgagcgccaaaaaaattgaagcacccccgactccagcagctgaaaattatataccaccaccagcaccaccatcttatgatgaaattaatggagcatttgcatccacttctgttaacgagtcagtccaatctgtcgatttcttccttggagaggcccttgattcatttaatgctgaaagtgagtttgagcttaccttgtcagctggtgacattgtaattgtccgaaaggtaatatactttttcacagccgtagtttttttaatcttcttccatgttgctaatacaattttgtgttttttaaatgcattcctgtagcagataaacacaccaccacttagctgtcgttaatgttttctaaaccaaagttttttttttcctttctgttcatcgacgttatgggttttttttaaaaaaaaaaccatttttgccagcagctccattaagaatgtgtatgatcatttggcctgcatttgtcctctcttttctctgaaacacaggatctcaagcaatggttgggcagaaggtgaatgcaagggcaaagcaggatggttccctcatgcttatatcgaaaggcaggaacgtgttctagcaagcaaagttccacatatattttaggagtttctggcagtcgcattacacggttttcatttctattgttgggagctggaactgtatccatgttttcacttcctcttagtttccgcgatgtaattactggctgtcatgtgcatagattaaatttacttccctttttttagtctggaaaaggttttggatgtaacatatttttgagagaccaattggatatgggttaccttgatattgtgaaagagttaaaaactagctgttttataagatttttcttacctggacttcatcgcatgtttcttatagaaaagaacatgggccgtttttttctgggtaagactatttcacttctggagtctcaaggtgaaatggtcaagttgcatggaatttgaagctcctgctggataccttttttttaaaaaaaaacgaaactgctgctggaccgttgcgtgcaaaccaaaagatctgttcatgcgaaccggaagacgaataaaccaatcaccaggagaggggttgcgtggaaaccaaaagatctgttcatgcgaaatcaatgttgaagtagatggaggcatggagctactcttgttacgaaaccaaactttgggtccgttgtctctgacattggaagctaggcttttgtactggagcgatgaacctaacgttggttgctgttgcccatgcccttgcactgtctgcagtaatgggcaacgtatgcgaagggtagtcaaagcatcccggtttgcagggctattccaggatcacctataatttcaacgaatcggttgaaagttggtttgctgggctggtacaggaccccccggaattccaaaaaaatcggtttattttttttctgcagagttgcagctgtagggtgaagcctatgacaaataaggatcacatgggcctctcagagtctcagttgggctatggtatatactggccgcatgggccgcagttaaaaagtaggaaggtaaacatagataaattgaaactggggcctcacagttaaataggcctgtcagagtctcagttgggctttaacaaataatggccgcatgggccagttaaaaaaactaaatatataaaaaatggggtgttgcgagaatcgaactcgcgacctctcgcacccgaagcgagaatcataccactagaccaaacacccaatctgtttgtttgagtgaaagtactatattaataccattgtaaagattaagaaaaaattacatcccaacgggaaaaaaagatgagaggaatcacgatccagccctcgctttcggttccggcaacacgaattacatcacggtggcaaccactcggtgcccgggtgacgctgccgtccctagcaggcaattcatacacatggcgaccaggccgccgtgacctcagtgtggtgctggtgtaggtgagctaccggtatctgctaccttgtcccgtggtgggtaaaccgaaatcggttacattgtcgtactcgtacgcagcgcagcggcccagcgatccggccaaatctcgattgatcccctcgacaaagttgatccaaaaattcacgccgacgagcaagccgccgcgcgacggtgcaacctggcagctataggctggcagcgacgccggcccacggcccgtcatgtcggctacgtgtgaccggtgctcacctcagctcagattaaccgctctcatatccatatttagagagcgttcacagatcaacttctagctataatcactctcacgcagctaaacggtaaaaaaaataaactgcttcacgacaggagtggatgaatctagtcaccattttgtaccacagagtgggagcaaaaaaatatgtttcacgccgctgccgctctcaacgtgctccgcactctataatccttaagaatcacttggcacactatttgacaaaaagtttttgtaagatagatttactcctactagagaatgttttggaatcactctatcaaataatcagctttcgaatttaaagaatcaaggaacggacctctaccaaacgagctcttaaacttcactccacgaacagtgtattttacaacacaaaatagtgttttatatagctattttggtgaactgctgg

SEQ ID NO: 21690 - DNA, 8430 bp, Zea mays
acttgaaatccgtacaaactactggctgcctataaatagttgcagtcgactgacaaggcagcacgtaattggagttagtccagttcccacatgtaaaatgtaataaatatatcaagaaaagaaaaagaaaatgcagctaatttgaggtgaccgcgttgttctgtatccctgcctccctggtcatttcttcttttccgtcaaccttctttctcgcgcccaaacaggagttctctcgttctaaaaaaagattgcgaaaggacatgaatgtatgttcaccacgtcgagttgtccagccatttttcttttctcggattctggattcatttccggcccgcgtttcgtttattctgccgggaattgcccattcattcatgccgttcgtgcccacgcatgcagcccatgaggatcgagcatatggaggagcctagttcttgatccaatctcccagcatgcttgacgaacgcgaagacgaacgtggggcgaacgctgcatgctaacgcggttgatcttattcctaataatccgtagcgattcgggagattgatttttgatcatgcacaagcgatccaaatcctgcgagccgtacaggaagatggaggagcgcgtcgggtgcagcaatgccgcgacgtccttcgacgactccgccaccggcaggacggcgggcgccgcggcggcgcagtgctccacggtgtcggtgttcctcgccaagatcaacggcgccgcgcgccacgtcaccgccgtctggagcaagagcctcatcaaccagtccttcaccgtctccatcgaacggccgggcgacggcgacgggccggtcacccacagggtggagctgaagccgtggccgttctggagcaagaagggcggcaaggcgctcgacgtgggcggcggcgaccgcgtcgacatgttctgggacctgcgctcggccaagttcgcggcggcgggcagcagcccggagcctgccggcggctactacgtcgcgctggtcagcaacgacgaggtcgtcctcctgctcggcgactgcaagaaggacgcgtacaagcggaccaaggcccgcccgtcgctggaggacgccgtgctggtgtgccgccgggagagcgtgttcggccgccgcagcttcgcggcgcgcgcgcggctcgacgccaggaggagcaaggagcatgagatcgtcatcgagtacgcgctcgccgccgcgggctccagcagggacccggagatgtggatcacggtggacggctccgtgctgctgcatgtcaagagccttcagtggaagttccggggcaatgagacgctgctcgtcgacgaggagccggtgcaggtcatctgggacgtgcacgactggctcttcgccgggccgggcacgcaggcagtcttcgtcttcaagcccggcgcaccgccggagatccaagaggacagcggagggaacgccatccagggtgacgggactgacttctgcttcttccttcaggcatggaggacggaatgaggcggtgaaatttgaagggcaaggcaatgatcttgtcctcgcgctactgatctgttgatgtgaatgacattgaaagcgtatccagctttacaaatttgtaaccaggaacacttcgtcaatccaagtttctgtcactggaaatttaatcttttttttttttttttgcaactttctttttacactgcaatggaactgacgtaagatatcaggtacgtaagcaactgcgaagtgtttataactcatagcagatacaacaagagcacaagattcatatcgttggccctgatggccacatacattcactccaccagaaaagctgtgtagagcccaaagaactgcttattctagaacaagtcatgactatcatcatagcaactaatctctactctccatctctcccttgttaccaacgtagctgtgaactagtctatttcctccatctgcacagtggcactgcaatgtgcaatctcaaatacctgaacatggcaacaaaaatatgaaacaaaaaagaaggcgtgatgtctagatgatcatctatcattcactccatcacagcaacaccgccagctgcctttatctttgctatgatcgcttccgcttcctcctttgtgagcgattgcttcagaacgactggggccttctccaccagctccttggcctccttcagccccagatccgtaaacgtcctgatctccttgatgatcttgatcttcgcagcagcgtcgaacttctccaacctgacgtcgaagactgtcttctcggctttcttctcagcctttccagaacctgccccagagccgacctgggcaccgaaaccgaaaccctggccagataccgcctgtggcggctcctggttcagtctgaggagaagggctggagcaatctgtttgatctcctcgggagggagagcagcgatgcgatcagctagttccacgactttctccgaaggcggcggcataggcccgtaggggtcgtatacatcggggtacttgtacttcttagcacccatgtcctttgcagcctcagtgctgtatacatgagccccaacccccgcggccccgctccctggggatggttttgaaagacatagccgtcgtgctattgtacagagactcatcctaatatcagttattcagttatgtgagcgcaatattcttctcctgcaccataacaagcaagaatcagtacaaaatgagactttgaagaaaaacttccagatcagattgcaccctgaatccatgaacatctcgtagcatgcatatataagcatgtataggcatggtagtttaaagggatcagctacatataagtcacaaagccagtactgctagcgctaggtgacgttccggatcggagtcgccattttacaagtttttaaggtatctcatttaaaccaataaatagcataataagttaataacttgcgccagaaatgtatctctttcatatcaaaatttccccatccttttcccaacctcccagtttctgactttctgtaatctgcaccgggagcacaccgatatgcagtgcagcgagagcaacaaatacagcgaaactgcccaaggtcatctattcacgagcacgggatgatccagtacaggacatctgtggacatatgtgcaaccgataaagtttttttctcaaaaaaaaaacgaagtttctgcgtgtatacaaaacgtacgtatacgactgcgtcagatcccaatacacggagattaaggtttagggtttgggttactcggtttcggacagagcggggagggaagagaccggaagggcgtaccggagggatgcacgtcgccggtgaagggcgggcccgacgaagagggcggcggcgctcgcccagtcgccgccaggaagccacgagagagcgagagaggcagtgggactgggagccgggaggtgaacgacgggagacgtaggcggactcgatcggccagcgcccagtaggcccagcctggaagtaataggtacggataggagcactcgtgggccgtggcaaataaccagcccgttttccttattttctactttctgtttctctttttcttgtaataaatatctgcggttagtttgagtatttaatacgtagtaattttcaagcaaacaactactggtaggaagaaaacaaagtcattttcatgtctgaaatgaaaccctcccctcaattcagctgtcagagctcgcgcgatggtggctccggttcgtctgtgtgttggtagagtatccaaccatgacaagtgggtctcaaatgtcagtgactatttaagatcccctaatttaagaactgctgctctagagcagagatacaaaaattaaatcaaactatcaatataaaagagagccttaaattaagaagtaggaaatccattccaggccccagcactggagacattcggctgctgctgctggctgctgcagtgccacgaacatctatgccgagtgacaggttttcggcagtatctgcaaatggtcatgaggaaatccacacaaaaaaaaaaaccattcgcttttccattccagagcagaaccattctgaagtgaacggcatttcgtttccaaaggaagaacatttaagttcacaacgaactggccacgacgatggcaccatgaacgcagcatcacaggaccttgagcaactgaacctcgaacaccagcggctccttggcgtgggacagcaggcttcgcctcggtccaaactgcaactcggaaccaagaagaagaagaagcagaaagagcgacggtgagccagccgtgtcgttatagatagagacgcatcagaactgcagaactgcactgcacctcctccggtatgggcttcagtgtctcgctgacgtagcctgcttcaggagggatcagagccctcctcttgcctgcacagcgcaacaccaagtcatcaatcatgaaaaaaactgaacagactaggagctaagctggtgtccaaaattacctccggacttcatcccaatcaggacgtctctcaggcctcggatcatctgaacacaaacaaattcacagagctagaaacaactgcacctagagggtatctatacgcctgaagaatgtggggtggggtgggtagagaaattcaggagtgaagcttgtgacctcttcaccgccgagcgcgagcgtcaccggcctgctctcgccgctgaactggtccaccgtgctgagttgcggcagagagggaaaccacggtgagctagactgagtgagaccaccggataccactggacgcgccgaacagcaacgctacggcgtctatctgggaactccaccacgcacctgtgcacgaagtagccgttcgcgcggcggcacacgtagttgaactgcaccaggtcgccctcccgcgcctcgggcccctccccctccacgacatcttcagagttcagatcaagaagcgagcgcagttcgttccatgagccatcagaattcagaaacacagctcaaaaccgcgagaaacatgtatgtctgtctctgcgaccgctaccgataccttcgagtatgactccactccccaccttccggtacctgaaagcttcgagaaacggaagcagcaggtcaggtggttgcaagtggccaccggagaaatctgtatgtctgcgacgacgacgacgacgcattacctggtgacgtcaggctgctctgctagcgccggcgtgggcgtggagagggccactgcgccgacaaccgccatgtctgagaccgccctccgcctggagagcgcgcaggtcgacttcagatacggagccctgctgcggcgcgccggccggatcttcttcttcgggtccggtggacgccggcatctgatgcaaagagctcccggaacgggaccatcacgacattaaaattatgataactgaactcgattttttttcttatgttgactgtaggtggagacggcgttccgcattacattggagacggggaagcgtacgggaatggattggcgagtgacttgagctccattgttgcagcttccaggaacctctgaggaactgcataacctgtgcgtggggctggagagaaggtaaagggataacgatacttttacaaatgaagtgatgcatacaacaaaacatttatgtaaaaacaataagcaagatgacgagatggccgagttggtctaaggcgccagattaaggttctggtccgaaagggcgtgggttcaaatcccactctcgtcaaatttttttgttattttttcaaaccactctgtttttttttcatatacgaccttcactccttcagggttcaggctaaatcctgtatttttttcatatacgaccttcaggctacagtttcccgtcaagtcaatttgtttttttcttcatgtacgaccttctggatagagtttttcaagctgttttgtatttttttttcatatatgaccttcaggatggaatttttccctatatatggcctccagaaatattccctataaaagtcattttgtactttttttatatatgacctccaggatacggttttttcctgatatggccttcaggaatattcttttttattttagatactaattttgtttctccttataggtatggtatggcttctaggaacgtaattctttaaaagattttctatatactgattttgttgctccttgtacagatgacttctaggaatataattctttaaaagatttttcgtatgacctttaggaatactcttctttgattttagttaccacgttttctcctatatagttaagccatccctcatcttgttacttcgtaaaaaaaagaacgtttttccttgtagttatcatctctaggaatgttatcctttaaataactaaaatatttaaatataatgtaaatgctagattatggtatgttttttctatatgattagtcattgatctcatttaattaatagtttatcctgaataaataactaatgtgggtcttagagagaaaaaacatcacaaacctacaagctcaatataaatagctaggttaagataggcacttgagtaagctggatttagctcaatagcgtggcaagatattaaaaaccaacttcagtgactttcatgtaaaggcaatcaagatcaagtcaatcaatgaatcccccaccatcagcaaatctaactatggcctgctcattgcatgagctaaaacaagctgactaaattttagctcctacttataagctaaaaatgactggaaggatttttttctcatcattttagtcaattttagttgttcctgtttgaatctttaacttctggattgattaaactttagccactttttccttagttactgagatccaaattgtctctaatgctctgtttggaagtcgatattgtagaggatggaattgaattggtttgaatatcaaattagacatggtattaaaatgagatgtaatttcaattatattgtttcgatatcacataattatagtttggaattgtgtggtctaatttcacgcaataccgagagatgagactttgtattgggagagagagagtttctagttatagtctaatttcagagaattaggtttctgatttcaaatcgcaatttcatgtgtaacaaacaataaaatttaggaaatctgatttcaattctcaattctttgcttcaatatctatatctaaatgtggcataaacaaaattttggcgttgtaaattatgagtgcaaccctaaacttgctaactcgggggttaacttgtgtgtgctatatattatgttttaaataatattgtgtgtggccaccggagaaatctgtatgtctgcgacgacaacgacgactcgtgccgccgcgacgtcaggctgctctgctcgcgctggcgtgggcgtggagagggccacggcgccgagattaaccgccaggtctgagactgccctccgcctggagagtgcgcaggtcgccttcagatacggagccctgctgcggtgcgccggccggatcttcttcttcgggtccgatggacgccggcatgtggttcaacgggctcccggaacggaaccaagatagattatgaaaattgaagacggttttttttttctcgtcttgattggaggagcggatggcattacgcgttacaatgtagacggggcagagcaccggaatggaccggtgacttgtgagtgaggtgagcgacgcggactctattcttgcagctttgctttgaggaacggtatagtgtgacaggcggtaatggatcatgatcctaatacttgcttcacaaactaacaaggcccttaattttgttagttcaaaattatattgttttatgatccggtcctaacttgactcgatccttaaatttgctagactaaattaaatggcccgttaccacctccaactcggttccggaggatgaaaagggacaacgatgcattcgcacaataggagacgtgactttaaacacataaatgtacgtgaacgttttacccaacacgatgagatggccgagttggtctaaggcgccagattaaggttctggtccgaaagggcgtgggttcaaatcccactctcatcaaaatattttgtttttttcatataccgtctgcatagtttttcaagccattctgtatttttttttctcatatatgaccttcaggctatagttttttccatgaagtaattttttttcttcatgtatgaccttctggatagagtttttcaagacattttgtatttttttcgtatatgacattcaggatagagttttcccctatatatggcctccgttgtagtttttttatatgacctccaggatagggttttctcctaatatggccttcaggaatatatacctttttattttagatactaattttgtttctccttgtaggtatgacttctatgaacgtaattctttaaaagattttctatatactattttttttgtttctccttgtaggtatgacttttaggaacgtaattctttaaaagtttttctatatactaa

SEQ ID NO: 21691 - DNA, 1263 bp, Zea mays
ggaccgggactgactgggccgggcggccttcctttttttttttttttttttagccgtcaatccaagtttctgtcactggaaatttaatcttttttttttttttttgcaactttctttttacactgcaatggaactgacgtaagatatcaggtacgtaagcaactgcgaagtgtttataactcatagcagatacaacaagagcacaagattcatatcgttggccctgatggccacatacattcactccaccagaaaagctgtgtagagcccaaagaactgcttattctagaacaagtcatgactatcatcatagcaactaatctctactctccatctctcccttgttaccaacgtagctgtgaactagtctatttcctccatctgcacagtggcactgcaatgtgcaatctcaaatacctgaacatggcaacaaaaatatgaaacaaaaaagaaggcgtgatgtctagatgatcatctatcattcactccatcacagcaacaccgccagctgcctttatctttgctatgatcgcttccgcttcctcctttgtgagcgattgcttcagaacgactggggccttctccaccagctccttggcctccttcagccccagatccgtaaacgtcctgatctccttgatgatcttgatcttcgcagcagcgtcgaacttctccaacctgacgtcgaagactgtcttctcggctttcttctcagcctttccagaacctgccccagagccgacctgggcaccgaaaccgaaaccctggccagataccgcctgtggcggctcctggttcagtctgaggagaagggctggagcaatctgtttgatctcctcgggagggagagcagcgatgcgatcagctagttccacgactttctccgaaggcggcggcataggcccgtaggggtcgtatacatcggggtacttgtacttcttagcacccatgtcctttgcagcctcagtgctgtatagatgagcccaaattgctgaaagacgactgccagaggatggttttgaaagacatagccgtcgtgctattgtacagagactcatcctaatatcagttattcagttatgtgagcgcaatattcttctccggagggatgcacgtcgccggtgaagggcgggcccgacgaagagggcggcggcgctcgcccagtcgccgccaggaagccacgagagagcgagagaggcagtgggactgggagccgggaggtgaacgacgggagacgtaggcggactcgatcggcccggccgg

SEQ ID NO: 21692 - DNA, 1045 bp, Zea mays
  misc_feature (54)..(54): n is a, c, g, or t
  misc_feature (65)..(67): n is a, c, g, or t
  misc_feature (70)..(70): n is a, c, g, or t
atcatagaggattcaccaagacccttccagatcattggtatggccctgatgcanccatccattcnnnttnccccaaataagtgtgtagagcccaaagaactgcttattcttaggacaagtcatgaatatcatcatagcaactaaatctctagtttccctctcgccttggttaccaacgtagatgtaaactattttctccatcagcataaaggcactgcaatgtgcaattcaaatgcttgatcatggcaacaaaaataggaaataaaagtgtgttgtgtcgagatggtcatcccttcgttcactccatgacagcaacaccgccagctgcctttatcttccctatgattgcttctgcttcgtcctttgtgagcgattgcttcagaatgactggggccttctccactagctcctttgcctccttcagccccaaatccgtaaaggtcctgatctccttgataatcttgatctttgcagcagcatcgaatttctccaacttgacatcgaagactgtcttctcagctttcttttcctcagcctttccggcaccgacccccgcaccaccctgagcaccaaaactgaaaccctggccggagatagcctgtggcggctcttggttcagtctgaatagaagggctggagcaatctgtttgatctcctcaggagggagagcagcgatgcggtcagctagatccacaactttctctgacggtagcgacataggcccgtatgggtcgtatacatcagggtacttgtacttcttagcacccgtgtcctttgcagcctcggtgctgtatagatgagcccaaattactgaaagacgattcacagaggatggttttgaaagacatagtcggcgtgctattgtacatagactcatcctaatatcagttagatgagtgtgatgctctcctccagatgaatgctcgtcgccggtgaatggcccgacgaagagggcggcgccgccgccaggaagcaacgaccacgagagagcgtgaggtaaacggcagcgggaggtgaacgggagaggtcccggccggcctcgagg

SEQ ID NO: 21693 - DNA, 1026 bp, Zea mays
ttttttttttttttttatcaaactatcaatataaaagagagccttaaattaagaagtaggaaatccattccaggccccagcactggagacattcggctgctgctgctggctgctgcagtgccacgaacatctatgccgagtgacaggttttcggcagtatctgcaaatggtcatgaggaaatccacacaaaaaaaaaaaccattcgcttttccattccagagcagaaccattctgaagtgaacggcatttcgtttccaaaggaagaacatttaagttcacaacgaactggccacgacgatggcaccatgaacgcagcatcacaggaccttgagcaactgaacctcgaacaccagcggctccttggcgtgggacagcaggcttcgcctcggtccaaactcctccggtatgggcttcagtgtctcgctgacgtagcctgcttcaggagggatcagagccctcctcttgcctccggacttcatcccaatcaggacgtctctcaggcctcggatcatctcttcaccgccgagcgcgagcgtcaccggcctgctctcgccgctgaactggtccaccgtgctgtgcacgaagtagccgttcgcgcggcggcacacgtagttgaactgcaccaggtcgccctcccgcgcctcgggcccctccccctcgacgacatcttcgagtatgactccactccccaccttccggtacctggtgacgtcaggctgctctgctagcgccggcgtgggcgtggagagggccactgcgccgacaaccgccatgtctgagaccgccctccgcctggagagcgcgcaggtcgacttcagatacggagccctgctgcggcgcgccggccggatcttcttcttcgggtccggtggacgccggcatattggagacggggaagcgtacgggaatggattggcgagtgacttgagctccattgttgcagcttccaggaacctctgaggaactgcataacctgtgcgtggggctggagagaaggtaaagggataacgatacttttacaaaat

SEQ ID NO: 21694 - DNA, 684 bp, Zea mays
ttttttttttttttttttttaatggaaaccctttcattagctcgtctatatatataagcaaaacatcccatcagtaaagagattagagattcgtgtctctcgcttttgcttcgtactcaaatagatatatcgtgcgtggcatgcgtcgctacttgggcggtggctggatccacgtgtcgccgaggacgtagtgtgtgccgacgaatggcttggcctgcgcctcggtgaggtccagcgcccaccccaccctcttcttcttcttggcgtcagcgccggggccaaagcacttgaactcgccgtagtagatgccgctgctctccggcttggcgatctgccagccgtcccagcccacggggaccacctcctcccccatcttcgtgtacgagtagaccacccgggaggagtccccccaggcgcggcccaggtagatctggccgcccttgacgccgccgatgctgcagttcttgaacgagaagccggtgtcgatggcgccctcgatggacttggaacgctgctgcgccgtcagcaccgccacctccttgaccaccgactcgatgcggcagtcctcgtagaagctgcggccgaagccgaacccgaagccgacgctgccccggatgaggcagcccataaagaagtgcaggcccttgtggtcgtacagcgtgtcccgtacgcgggggtttgccc

SEQ ID NO: 21695 - DNA, 1676 bp, Zea mays
atgatttacgctaaaatttgtatgcatttactggtttggttcacattttacgtaaaattcgcccgagccagaacacgcgcgcgatttttacgccgtaattttttagccttattcgtggttatgaaacagatctatggtttacactaaaatttaatatcatttacgatagtttggttcacgttttacgctaaaatatgtctgaatcagaaccccccccgggcgtttttttttttttttttttttttttttttttttttttttttttttttttttaatgaaaaccctgagctttcattagctcgtctatatatatatataagcaaaacatctcatcagtaaagagattagagattcgtgtctctcgcttttgcttcgtactcaaatagatatatcgtgtggcatgcgtcgctacttgggcggtggctggatccacgtgtcgccgaggacgtagtgtgtgccgacgaatggcttggcctgcgcctcggtgaggtccagcgcccaccccaccctcttcttcttcttggcgtcagcgccggggccaaagcacttgaactcgccgtagtagatgccgctgctctccggcttggcgatctgccagccgtcccagcccacggggaccacctcctcccccatcttcgtgtacgagtagacgacccgggaggagtccccccaggcgcggcccaggtagatctggccgcccttgacgccgccgatgctgcagttcttgaacgagaagccggtgtcgatggcgccctcgatggacttggaacgctgctgcgccgtcagcaccgccacctccttgaccaccgactcgatgcggcagtcctcgtagaagctgcggccgaagccgaagatgaagtcgacgctgccccggatgaggcagcccttgaagtagtgcaggcccttgtggtcgtacagcgtgtcctgtccgccgtcgatggtgcagttgtagatctgcgtcttggtcccgaacagccgcaccgccaccgcctggccgcccttggcgccgggcttggccagcggcgcgtcgttccggaacaccacgccgtacgccgtgaagtagtccgactccaccgccagcgtggcgctccccaccgtgcccaccggcttgccgtccttgccgttcgtggccgcagtgtcgttccagaccacgacggcgggcttcttggggtccgaccggaacgtgatgaacggcttgctgatgttcaggaacagcttctcgcggaactgagcgccgggcttgagatccaggatcacgcgcttggtgttgctcaccgggatatcctccagcgccgcggtgatgttggtgtagtcgcccttgccgctggggtccaccacgtacgtgaccttcttcttctccgcctccgacagcttcttgtccaggggctccttgcccccgtccccgacggacttctgcgcgtacagcgcgtagctctgctggttcatcgccacccagttgctgaacgccccgccgggcgcgttcgcggcggccggcgccgcaccaaggagcgcggacgccagggcgaggaggaggaggggcttattagtcgtcatcgtggccaccgctcgctgcgccatggtggaccaccgaagcaatgcacctaccgaaggacggggagcgcgcgagggcagtccccgccgggtctaggtagtggtctcgtgccgcccataggagt

SEQ ID NO: 21696 - DNA, 1294 bp, Zea mays
  misc_feature (14)..(22): n is a, c, g, or t
tttttttttttttnnnnnnnnnatttcttttctttcctaggtaattggatcgtagtgttctttcgctgtggatgttcttttttttttttttttatgcaattacctggcttacattatatattaattctttcgtgtaaaagagcatgctcttacatgagacctgatggtcaatttctcgggctactaatttctgataacttgaaactgtcatatattcaaatttatataggaactatttatatacgtatcaagtcaactatatatatggaagcatgcatgttgtagagaggcacgcagctgctaataaatttgatcttgtgtgcttatatgaactataaatgacgatgctgactggatcggatcattcgtggccggcctccattcagattcaagttgctcatcagggcgacaaggctgctgaagtcggcttctcccagacgtcaggaatgcggccgacgagcggcgcggtttgctgcccagtgaagcagatgtagaggacctgtggcggcagcacgacgccgcaggcgatgggcaggtacatcatgcgcacggggtccaccggcttgggcagcatcttgttcacgtccccgaggatgacggggcacaggcaccgaaggatgcggtcgtcgccttccgccgccgagctggagctgttgaggaacgccccgagacccgcgcagcactcgctctgcggcgtgggggtctccggctcgctccccgtcaggaacgtcccgcacgtcatcagccccgcgagcggggtcacgcagtcggtcggcgacgacggcgtggagccgccgcccacgctgcccgccggcaggccggggaagcccggcagctgcggcaccaccgcgccaggcctggcgcagggcgccggtgacactggacccgacgacgacggcaggccgggcatgggtgacggcaccaccggggaggacgagccgctggacaccggcggcgacggcctcggtctcgggtaccccgggaacacggggttacgcggcctgctgcccgggcggcccgggaaccggagcgcgtcggcgtctgccgggttgctcgccgccaccgatggctgcaccgacgtgagcatggccgcgacggcgagcatggtggcaatgcacttggccatggatgctgctgtcgcctccttgctactgatgatggcttgcattgctgtgacagttcagatcaaccacaggaccggagcgagcagatgaaatgcagctagaaggtagctagctagagaggtctgtgctatgccggtgcccatccgatgattcactgcctcgtctttatt

SEQ ID NO: 21697 - DNA, 1739 bp, Zea mays
  misc_feature (1304)..(1304): n is a, c, g, or t
ggccgccccttttttttttttttttttggtcttgtctcttcaagatatcccttaataggttgtagagacatcttttgaattagacctttaagcctcctttgtatatatataagcaaaacatctcatcaataaagagatcatagatttgtgtctctcgcttttgcttcgtactcaaatagatatatcgttggcatgcacgcttggctacttctacttgggcggtggctggatccacgtgtcgccgaggacgtagtgtgtgccgacgaatggcttggcctgcgcctcggtgaggtccagcgcccaccccaccctcttcttcttcttggcgtcagcgccggggccaaagcacttgaactcgccgtagtagatgccgctgctctccggcttggcgatctgccagccgtcccaacccacggggaccacctcctcccccatcttcgtgtacgagtagaccacccgggaggagtccccccaggcgcggcccaggtagatctgtccgcccttgacgccgccgatgctgcagttcttgaacgagaagccggtgtcgatggcgccctcgatggacttggaacgctgctgcgccgtcagcaccgccacctccttgaccaccgactcgatgcggcagtcctcgtagaagctgcggccgaagccgaagatgaagtcgacgctgccccggatgaggcagcccttgaagtagtgcaggcccttgtggtcgtacagcgtgtcctgtccgccgtcgatggtgcagttgtagatctgcgtcttggtcccgaacagccgcaccgccaccgcctggccgcccttggcgccgggcttggccagcggcgcgtcgttccggaacaccacgccgtacgccgtgaagtagtccgactccaccgccagcgtggcgctccccaccgtgcccaccggcttgccgtccttgccgttcgtggccgcagtgtcgttccagaccacgacggcgggcttcttggggtccgaccggaacgtgatgaacggcttgctgatgttcaggaacagcttctcgcggaactgagcgccgggcttgagatccaggatcacgcgcttggtgttgctcaccgggatatcctccagcgccgcggtgatgttggtgtagtcgcccctgcccgctggggtccaccacgtacgtgacatatattaaactccgcctccgacagcttcttgtccaggggctccttgcccccggccccgacggacttctgcgcgtacagcgcgtagctctgctggttcatcgccacccagttgctgaacgccccgccgggctctttcgcttttgccggcgccgncaccaaggagcgcggacgggagggcgatgaggaggaggggcttattcgtcgtcatcgtggccaccgctcgctgcgccatggtggaccaccgaagcaatgcacctaccgaacccacgcgtgcgcaaatctgtacagtcgaagccggagaacgcgaccgagacctgcatctatcatggcgagggcatctacggggtgatggatgggaaacagatctacattggaaacgaaaggatcatagcaaggtcctcgtgtcgtcatcatcaacatgctggccaccaagaaacagacggtctcaaaggcgtgttcatcggacacgtgatctgcgacagcgatctggtgcagaagttctaaatgtccgacacctgcatgacacttgcggtcgaggcgatcctgcagctgatgtcgatggggatcaagtaggtgatgctgaccggt

SEQ ID NO: 21698 - DNA, 2355 bp, Zea mays
ctgcagagttggcgcctttctgataagctgctccacacaattaaccctaagaattaacccaagcggaagcatttcaatacattcactcatacagatagacaaacatttatcaatacatagatgacatgtttccttaacaagaaaatgtcgatgagcaactaaaaacaaaacgagatgaaacacaggacaacttttcatttccagtacactattaaaatcgggcccctagcatcgatgcctttacttcttgccttcgatagggagtatttccaatccagccatccattcaagtaatgcaagccatttctgagataaatagccattggtttctctccttgtctcctttggataaaagccctactgccgtcgccgctttctcgtaacttcctttgggaacttgagaggggctgggagcgtcatgaaagtagacttaaaagcaccttctgtcacagatttgcatcccaactggtcatagtatggtttaagattttggcgggtcattttaaggtcctcacatatgtcgctggggttggatctgaagtcatcggcaaaaagtgttaggaccaatatgtagttggtcagaagctcttttttctctgttggcatgacactggaccccggttctgtaaacatgaacagcagcctgcgatatacagcctgcggggttgctggtccatggcttatctggttttcatttctgcctttccatttgcgattggacatggagccattccgcgccaatagagataggagatgttggatgtaggaaagtatccaagcaaacctctttttatcttcaccctgaagctcctttaacttgtgcacacgttttgagacaaaactcccatagccttttgaggagatttctcctgattcaaaatgacggacaatttccaaaagatgctcccgcatactctttggaataatctcgtccaaaagatatgcattttctgatgtatctgcggtaggatcataaggtggaatgttccgaacaagtacaggttcctgcctatcattggcgttgacattggtctctgatattccaagatcaatgtcctcataagcggaaggatcattcctttgttcctttaacgatctccacttattgtccttgtccctgtccgtcttggctccatacatcattgtcagatcctgaaccttcaattcatcatttcctgcagctgaagccgcttctgatgccacctcagagtgctgcgaatgcgctggatgctgcacttcaagatgtggctctagcctcagaatctttttgccagcgatgggcacgatcctgagagtgccggaggccttgtcaaggacgccaagcgcgtagtcgcagacctgcggcacggcggcctcaccggcatagctccggccaacgaagtcgtgtccgccgccggggctccggaccacgaggtccacccaggtgggatgcttctcgtgccggaagagctgggtgccgggggcagactccgccccggcagcggtagtgagtgggtcgtacccggaggggaagtagccgaccacgggggcggccgcgacgtaggaggaaccgcccataagggatgcgtcgacggtgacattggtgggggcgtcactggcggccttgtgcttcttggagtgtttcttcttcttcttggtggaggcagaggcaggggcgggcgtggctagggtttcgaggtccgccattggtgacggctcaagggttttggaaagtgaacaaacggggctgtccatcttaagagaagagaactgcaagtttttgcacgcaggccctccttaacttttgcacttacaatcaccagaattttttcctatattaataggactattcgtgtttggatctaccctaattaaactttagccaactaatctgatcactgaagtttaacaacctaaagtttagctggtggattcaaacatgacattaacaatttacataaaaaataaggaatgcatcaacagccaaactctattccttatttttctatacaatttggacaattttcttccattattgttgttttgttctccctcagtcatagaacttactattattctgattctccgtcagttataaaatttatcgtttaggacatgttgatttcaaatcttaaaattgcaatattaattagtttagaattatttagtttaaaacatgttaaagcccacgcataaaaatgtattagtggtaaaaaaacacgcatcaaggaccttgcacaaataaatagcaacatgagtaagcaactcaataaagataatgtgacatactagaacaatgacaagttttttgattagcagaaaataatgatacttatacttttcgtacatataagcacattagctgcaggcatgcaa

SEQ ID NO: 21699 - DNA, 2748 bp, Zea mays
gactagttctagatcgccagggcgtcggagcgagctcattctcaactcgactcaagagctctgcctcctccatcttcccttctctggcctccggagccacgctgatcagagatggaggcgaatccgaagaacaccttcacgatcaaagtggaggacgggaagcccgggaaggacggccggctggcggtcggaccggtgttccggagcgttctggccaaggatgggttcccgcagcttgagcctgacatgaagacatcatgggacgtgttcaggtaacagtaagacacgcacggcggctggctgaaacaacagccaagaactcgctcgcacgtctagctactctctctgtttttctttattgctctttggatttttcagttacagaatctgtaaaatatcagacacacgtagattatctatacagtgctcagaaaaatcttggtgatggttggtgtgtttataattttatattatatgcacttgtgcagggtagcagcagtcaagtatgccgacaaccggatgctcggatggcgtccgttcaaagatggagtggtatgcaaacttgggttaaacgacagcaccatgagtagtgttctacatcagttcaggtcttccttagctttacaatttccatctgtatggctggtaaaaaccgctacgtttccgccttctagccagggccctacttgtggaaatcatacaaggagatctacgacgaggtgctgcaagcgggcgctcccttgcccccccccccccccccccccggttcccgggtggggatctacggagcgaactgtcctcagtggatagtggcaatgcaggcttgcaatggctatagtctagtctgtgtcccactgtacgatactttaggtgcgggagctgtcgactacatcatcgatcatgccgagatcgatgttgtcttcatacaggacaagaaaataaaagagatactgtccccaaactgcaagtctgccaagagactgaaagcattggtggcgttcacttcggcgacaactgaacagaacaaagaagcggatcaaattgggatcaaaatgtatgcctgggacgatttcttgaaagtggggaaggataatcctcgtcaaccttgccctccgcaagcaagtgacatctgcactgtcatgtacacgagtgggacaagcggacagcccaaaggtgtgatgctgacccatgaaagccacgccatgtatgtgaaaggggtggacctcttcatggaccagtttgatgataagatgacaacagatgatgtcttcctgtcgtttctcccgcttgctcacatccttgaccgcatgatcgaagagtatttctttcacaaaggggcctcaattggctactaccacggagatctgaatgccttgagggacgacattgtggagctgaagccgactctactggttggggtgccccgagtgtacgaaaggatttatgaaggtatcttgaaggccattgcggaactcagacctctaagaagggtcatctttaatgctttgtacaaccgcaaactggcaagcatgaaagcaggctactcgcacaaaaccgcttcacctttcgcggacatgctggcttttcgcaaggtcaaggcaaggcttggaggtcgtcttcgcttactgatttcaggaggggctccgttgagtaatgagatcgaggagttcatgagagtgaccacctgtgcatacttcatccaaggctatggtttaacagaaacactgggacctagcactgtctgctacatcgacgacatggccctggtcggaagcgctggtgtgcctgccacctacaccgaaattcggctggaagaagtgcccgagatgggctatgatccactcggcgttccttcgcgtggtgaaatctgcatccggggaaaatccctcttcgctgggtactacaaaagtccagaactcacaaacgaagccatcgttgatgggtggtttcatacaggtgacattggagagatgaccccagacgggatcttgaaggtgattgacagaaaaaagaacatatttaagctgtcgcaaggggagtatgttgcggttgagtacctggagaaagtttatggcttccctccactcgttgaagatatctgggtatacggggacagtttcagatcaagtttagttgcagtagtcaatccacaccaagaaaacacaatgaagtgggcagagtccaatggctacaagggttcttttgatgaaatctgcaaacttgaaggactcaaagagtacatcctgaaagagctggcagccgttgcgcagaagaacaagctacgaggcttcgagtacatcaaaggcgtagtgttggatcctgtgccttttgacatcgagagggatttggtgactgcaacaatgaagaagaagagaaagaatatgctgaactattaccagtctgagattgacacaatatacaaaaagctggaggcgcagaagagtgctgccagagctaagtgaagagatgtgccctattcgaccatcagctgaaaacaagggaaacgacaccgttgtaaatttcacattaatattgcgaagtaacaactcagggctatgagtaaggaataaaatgtatattgtgcctttgtctatagtatcggatgattcccaaatctcaaaaaaaaaaaaaaaaagtgaaggccgtcaccaacaagatggcaatctggaccgaacctcacccgctcacccccactactgttcaaaagcatagcatcctaactgaagggggtgtctggatatcgccact

SEQ ID NO: 21700 - DNA, 2736 bp, Zea mays
  misc_feature (2622)..(2622): n is a, c, g, or t
  misc_feature (2659)..(2659): n is a, c, g, or t
cctgccggggcatatatagggcagggggacccctcgggccggccgccatcgccagggcgtcggatcggagcgagctcattctcaactcgactcaagagctctgcctcctccatctccccttctctggcctccggagccacgctgagagatggaggcgaatcccaagaacaccttcacgatcaaagtggaggacgggaagcccgggaaggacggccggctggcggtcggaccggtgttccggagcgttctggccaaggatgggttcccgcagcttgagcctgacatgaagacatcatgggacgtgttcagggtagcagcagtcaagtatgccgacaaccggatgctcggatggcgtccgttcaaagatggagtgccagggccctacttgtggaaatcatacaaggagatctacgacgaggtgctgcaagcaggctctgcgttgcagaagctgggagtgcagccaggttcccgggtggggatctacggagcgaactgtcctcagtggatagtggcaatgcaggcttgcaatggctatagtctagtctgtgtcccactgtacgatactttaggtgcgggagctgtcgactacatcatcgatcatgccgagatcgatgttgtcttcatacaggacaagaaaataaaagagatactgtccccaaactgcaagtctgccaagagactgaaagcattggtggcgttcacttcggcgacaactgaacagaacaaagaagcggatcaaattgggatcaaaatgtatgcctgggacgatttcttgaaagtggggaaggataatcctcgtcaaccttgccctccgcaagcaagtgacatctgcactgtcatgtacacgagtgggacaagcggacagcccaaaggtgtgatgctgacccatgaaagccacgccatgtatgtgaaaggggtggacctcttcatggaccagtttgatgataagatgacaacagatgatgtcttcctgtcgtttctcccgcttgctcacatccttgaccgcatgatcgaagagtatttctttcacaaaggggcctcaattggctactaccacggagatctgaatgccttgagggacgacattgtggagctgaagccgactttactggttggggtgccccgagtgtacgaaaggatttatgaaggtatcttgaaggccattgcggaactcagacctctaagaagggtcatctttaatgctttgtacaaccgcaaactggcaagcatgaaagcaggctactcgcacaaaaccgcttcacctttcgcggacatgctggtttttcgcaaggtcaaggcaaggcttggaggtcgtcttcgcttactgatttcaggaggggctccgttgagtaatgagatcgaggagttcatgagagtgaccacctgtgcatacttcatccaaggctatggtttaacagaaacactgggacctagcactgtctgctacatcgacgacatggccctggtcggaagcgctggtgtgcctgccacctacaccgaaattcggctggaagaagtgcccgagatgggctatgatccactcggcgtcccttcgcgtggtgaaatctgcatccgggggaaatccctcttcgctgggtactacaaaagtccagaactcacaaacgaagccatcgttgatgggtggtttcatacaggtgacattggagagatgaccccagacgggatcttgaaggtttgacagaaaaaagaacatatttaagctgtcacaaggggagtatgttgcggttgagtacctggagaaagtatatggcttccctccactcgttgaagatatctgggtatacggggacagtttcagatcaagtttagttgcagtagtcaatccacaccaagaaaacacaatgaagtgggcagagtccaatggctacaagggttcttttgatgaaatctgcaaacttgaaggactcaaagagtacatcctgaaagagctggcagccgttgcgcagaagaacaagctacgaggcttcgagtacatcaaaggcgtagtgttggatcctgtgccttttgacatcgagagggatttggtgactgcaacaatgaagaagaagagaaagaatatgctgaactattaccagtctgagattgacacaatatacaaaaagctggaggcgcagaagagtgctgccagagctaagtgaagagatgtgccctattcgaccatcagctgaaaacaagggaaacgacaccgttgtaaatttcacattaatattgcgaagtaacaactcagggctatgagtaaggaataaaatgtatattgtgcctttgtctatagtatcggatgattcccaaatctcaactagagttgagaagagtgaaggccgtcaccaacaagatggcaatctggaccgaacctcacccgctcacccccactactgttcaaaagcatagcatcctaactgaagggggtgtctggatatcgccactaaattttaatccctactgtggatgctagttagaaatattaaataatctaattatacagacgaagacgggaactaaaggacaagatgaacctattaaactcaattagtctatagattgctcatgcgtggtgctatgacaagtatttgccgattatggattaattagaattaataaatntatctcacaatttaatctttatctatacaattagttntgtaattgaagtatatttaatacatgtgactggcattcaaatttttgatgtaacacataccaacatttagttaggtg

SEQ ID NO: 21701 - DNA, 1157 bp, Zea mays
tttttacatttttttccccctcttttttttttttttattgacactaaatagtactcctttcatctcaaaataatagctgtttggtttttatgtctatattcaaacatatataaaacaaatacatcgggaggtagtgtattaacccattaatacttacatacatacatggaaagtatatatataattgacaagaataacctgcagtgatgatgatacatgcgcatagcatggtcgagcaacggtggagaagcttggtggtgtggtgtgttcctcagtcggaccgttccctatgaatctcatccagtatcacaacaagagcagcgacgaacacgtagtcaacgtgcgggaacacagtgacgccaaacgtgtcccttccaagcagcacattggtgacggtaaactggcggttcatctgggcgatcatgctgctggagttgccgaggtagaaggcgcacgacctctcgaagtagctgcccttgatcttgaagtcgcacgcctgctgcgcggtgttggaggccaggaagatgtccatctccgtcttcagctggaatatcgaggatttcttcgcggtgaagagcaggtcgctctcgttcgagctgtcccctctgaacacctcccatctgttgtgcatgctgaataccttctccagcatggtgaggatgggctggccggcggcgtcaaggaggacgcggcggtggcggatactgaagacggcgcccttgacctgcagcacggtggcgccgttggcgtcggtgatggtgaagtctccgtcggagaggctgatggccttcttggtcaccgtcaggggcaccacgtacggcgcacagaactgcggggacaccaccgccacgggggccggcgccgccggcgccgccggaggacctccgtagtaggccgccgccatcgtatatcgcagaccgaccgaccgccgccgccgccttggcagctcggcggccgcgcgcgattgctcggtggatttgatcggcggccggcacgtgctcttgccgctctcttgacttggagtcgttggggttggggttgatgtttatcttgttttgcctaccccgccccgcccggccggtggtggaggaagcaaagggagcgcgggccctgcccaggcaattagtatcgtatattcgtactggtagtgtcggcag

SEQ ID NO: 21702 - DNA, 1056 bp, Zea mays
  misc_feature (7)..(31): n is a, c, g, or t
  misc_feature (42)..(44): n is a, c, g, or t
accgcgnnnnnnnnnnnnnnnnnnnnnnnnngggtttttttnnnactaaatagtactcatttcatcccaaaataatagtcatttgatttttatgtctatattcaaatggatgaagaaaaacttatacatcaggagatagtgtattaactcattaatacttacatatacatacatggaaagtatataattgacaagaataacctgtgatgatgatacatagcatagcatggtcgagcaacggtggagaagcttggtggtgtggtgtggtatgttcctcagtcggaccgttccctatgaatctcatccagtatcacaacaagagcagcgacgaacacgtagtcaacgtgcgggaacacagtgacgccaaacgtgtcccttccaagcagcacattggtgacggtaaactggcggttcatctgggcgatcatgctgctggagttgccgaggtagaaggcgcacgacctctcgaagtagctgcccttgatcttgaagtcgcacacctgctgcgcggtgttggaggccaggaagatgtccatctccgtcttcagctggaatatcgaggatttcttcgcggtgaagagcaggtcgctctcgttcgagctgtcccctctgaacacctcccatctgttgtgcatgctgaataccttctccagcatggtgaggatgggctggccggcggcgtcgaggaggacgcggcggtggcggatactgaagacggcgcccttgacctgcagcacggtggcgccgttggcgtcggtgacggtgaagtcgccgtcggagaggctgatggccttcttggtcaccgtcaggggcaccacgtacggcgcacagaactgcggggacaccaccgccacgggggccggcgccgccggaggacctccgtagtaaggcgccgccatcgtatatcgcagaccgaccgaccgccgccgccttggcacctcggcggccgcgcgcgattgctcggtggatttgatcggcggccggcacgtgctcttgctgctctctttgacttggagttgcaggcccggcggttggggttgaacccggcccggccgg

SEQ ID NO: 21703 - DNA, 2033 bp, Zea mays
gctgctacatagttaaaatagatccactattccatgtgccacatcaagtaaaatgtctgattagacgtgttactcagaagtcatctttggcttcttacaggaaaagaaaggcaggctacacttgcatttcaataatacccggattcaataaaaaatattaggggtaataacaatttacatctacaagttttaagcctacacaggttatgaactgaggaagccaacaatcttccattatggatctgaactctgagtaataacactagatttccaaaaaaaaatactggatgggaactgcatctctatggaatgcgaacgaaatgctgctgcaccaatcatgtttcttttcatgatgcttcggtaaacaccgttattataaaatttgcaatggtgacactatttgaatggccttctgacaataaagaatggtttggctcaaatctgaccaacactgacaggagaacgacggcgatatctgaacaaccttctcggcggtggatcatgtcaggccaagactgatgggggaacattgctcaactatcattgaattccagagttcgatatgtgcaggagagaggagctttgcttgctcagtttctggtgagcaggtaatatcagttgtccatgacagcttatgcagtgcaaggaggtagtgtgccgacatacccaaaaccaacaacaaggaacgccgtgccttgaaggaagagaaaaatgtagtatcccttatttgcaaaaagcaggtcatagaaaccacacaggattatgcaggttccaacgaaaagttctgagcagtggtacctctcccaaaatcttgctcgcctcttcactagcttcggaacaagcggttctgttagcttcacatctatcacctttacagcagtgtctgatccattggtgccaggctttgccttgctggtgtcgcccaacttctcagtgacaacccactcattgactcgcccaccagcgtccagaagcccacttactgcagccttaatccggtgcaacgacatgacattctcaaacaggacccagaggatcaccaggtgaaaggaactgcgcggtgtgccaagagccttcaacagggttatgactgtcgggacatagacaactccccagagagggatctggatctcagggaacagaacagacacagggatcgcgaagcagtagtagatgaatgtcaccgtatgagcagcgactttcccgacgaagaagaaatcgtaccataggtggattttactccacagcgacactctcttgttttctaaaatctctaccatcattttcttgaacaggttcgccggcccacatgaccacctgtgctgctgaaaccggtacgccttgaatgtgctaggcagttcgctcttgaccttaatgtcgccgacgtaaaggaacttccatccctgcagcatcgcacggacagccaggtccatatcttccactgtcgtccggtccttccagcccccagcatcatcgatcgctgagatcctccagacaccagctgtcccattgaagccaaagaatgaatacacggaggagccggcctcttgctcatacttgaaatggtagtccaacgcggacgcgtgggatcttgtcagcagacactcgtcagaattaacaaacttccagcgagcctggacgagggcgatctccgggttgtgcacgaggaacgggatcgtcctgaggaggaagtcagagtcaggctggaagtcggcgtcgaacatggcgatgtattcgcagtctgcgacgtagtcgtgcttcagtccttccttgagcgcgccggccttgtaccccttccggttccccctgacctcgtactttatgttcacgcctttgctcttccacctctggcactccgtctccaccaggtcgggtggtggacacacaggcagaagacgcccgcgcccttatgaggcgcgcgtgacaccccgccgcctggccgtgacgccctcgagatcccggcgctcgcgcgtcgtgccatggccggcgttggcggcggggcctcgccggagttcgtctagggcgagcgagcc

SEQ ID NO: 21704 - DNA, 6004 bp, Zea mays
cgtcgatctcgctgcaccaacagaggcaaaacgaccggcggagtccacccttcggcctctacactgcaggacgaaggtctacgacgaggtcgccccgtcccacgccctcacccaacctggaggcccacgtaggattcggcccattgatgcaggccccgcacggagaagtgtattacgggcccgatttgcaatggcttttctgtaatgatagtctgtaaccctcccttatgggaatattccggggatagtccaggtgcctgagggcacatacgtccttacgtcaagacgttgggcactcaggcacttataaatacccccgtacagtgcccttgagaggcaaaatgaacagagcaattgtcatctcgagctaaaaccttgtttgcgttactttcactccccacttggatcaatttgcccaggagagcaagttccaataattcacaacttcaatcatgcgtgaccagtaggaccaaatggttgctgctacatagttaaaatagatccactattccatgtgccacatcaagtaaaatgtctgattagacgtgttactcagaagtcatctttggcttcttacaggaaaagaaatgcatgctacacttgcatttcaataatacccggattcaataaaaaatattagtgttaataacaatttacatctacaagttttaagcctacacaggttatgaactgaggaagccaacaatcttccattatggatctgaactctgagtaataacactagatttccaaaaaaaaatactggatgtgaactgcatctctatggaatgcgaacgaaatgctgctgcaccaatcatttttcttttcatgatgcttcggtaaacaccgttattataaaatttgcaatggtgacactatttgaatggccttctgacaataaagaatggtttggctcaaatctgaccaacactgacaggagaacgacggcgatatctgaacaaccttctcggcggtggatcatgtcaggccaagactgatgggggaacattgctcaactatcattgaattcaagagtttgatatgtgcaggagagaggagctttgcttgctcagtttctggtgagcaggtaatatcagttgtccatgacagcttatgcagtgcaaggaggtagtgtgccgacatacccaaaaccaacaacaaggaacgccgtgccttgaaggaagagaaaaatgtagtatcccttatttgcaaaaagcaggtcatagaaaccacacaggattatgcaggttccaacgaaaagttctgagcagtggtacctgatatagataatattgcttataagcatttggagacactagaaagtatgcaatcaacactatgcacattctcaatttctcataaatgcataaaaagtagtacggtagtgttatgcacattctcataaatgcataaaaactaaactagtgttatgcacattctcataaatgcataaaacctgcactagtgttatgctaactttgagaaactcttaagggcttgttcggttagaagtggatcgaaagagattagaggggattaaattatttgctagtcaaaattgatggaaagggatttaatcctctctctctgattcacttgcaaccgaacaaggcctaatgatgataataggtaaacttacctctcccaaaatcttgctcgcctcttcactagcttcggaacaagcggttctgttagcttcacatctatcacctttacagcagtgtctgatccattggtgccaggctttgccttgctggtgtcgcccaacttctcagtgacaacccactcattgactcgcccaccagcatccagaagaccacttactgcagccttaatccggtgcaacgacatgacattctcaaacaggacccagaggatcaccaggtgaaaggaactgtaacggcgagaagcttttcaggtcagcagcaggcgttagacgatgaaacaacagtagtgtcgctcaaaaacttgagctttggcgtacttaattacctcggtgtgccaagagccttcaagagggttatgactgtcgggacatagacaactccccagagagggatctggatctcagggaacagaacagacacagggatcgcgaagcagtagtagatgaatgtcaccgtatgagcagcgactttcccgacgaagaagaaatcgtaccataggtggattttactccacagcgacactctctacacaagagaagaaaaaaaaaaaggcacaccggccagtcaatgctgtgatgtgttggcgcttcgcttgtaaaaggcagtctgaaaaaacaaagtagacaaacaaacaaacaaacaaaccttgttttctaaaatctctaccatcattttcttgaacaggttcgccggcccacatgaccacctgtgctgctgaaaccggtacgccttgaatgtgctaggcagttcgctcttgacctatataagcacacacacacagatgcagttaccctgaggatcgttagattcgtctccagttatgttcctgagtttcctacagggcaagcgacggacggagcactggcgtaccttaatgtcgccgacgtaaaggaacttccatccctgcagcatcgcacggacagccaggtccatatcttccactgtcgtccggtccttccagcccccagcatcatcgatcgctgagatcctccagacaccagctgtccctaaaagatgaagaagaagaagaagaaagaaaatatgctctcgtaagactcgcagtcatcagaaagctttaagcttactgatactcgatatcacaggacatgactgcaccattgaagccaaagaatgaatacaccgaggagccggcctcttgctcatacttgaaatggtagtccaacgacatctcttggaatcttgtcagcagacactcgtcagaattaactgcgcacatgtgggggtcaaaagacggtttaggacaagtagagttttatcatttacgatattccacagcaggggagatggtgtctgagctaaccaaacttccagcgagcctggacgagggcgatctccgggttgtgcacgaggaacgggatagtcctgaggaggaagtcagagtcaggctggaagtcggcgtcgaacatggcgatgtattcgcagtctgcgacgtagtcgtgcttcagtccttccttgagcgcgccggccttgtaccccttccggttccccctcacctcgtactttatgttcacgcctttgctcttccacctctggcactccgtctccaccaggtcctggaaacggtggggagggcggacagagacagattcaggtctctggattgcattgtcctcacgggtggtggacactggacacacaggtcgcttgtccaagggtatttcagaataataacgccatactaaaacggcatgcagagtgcacaagagttaccccgacggcccatcgcattgataaaattaagattttttgagaatttaacctacggacgaatcggagggcatcctgacggggcaaattctctccaggatcggaatcaacaccgctgagaagccgtctaggtaactaataataggttgcacgagcaagacaggctagccagcaatcccgtgaaccctaaaagccacaggcggcgccatacctccgacagcaaggcagcagacgcccgcgcccttatgaggcgcgcgtgacaccccgccgcctggccgtgacgccctcgggatcccggcgctcgcgcgtcgtgccatggccggcgttggcggcggggcctcgccggagttcgtctagggcgagcgagcccatgagtacacgctaagcttgcagtacagcccacatccagcccagtaatacgtctggggcgggaggggacccaatcgtgcccgcgcgtgagggacttgcggcccaagcctttgtttttgacgagccgcggcgtcccgtaatccggcaaccctattcttctagggattttccatttttttttgttggaaaaataagaatctctaaagtcgtcttttaattgaaagatttctaaaattagttcgttttataaggaaactaagaatattttgtgtcggtttaggagcactcttcattaaaacttgtgccaatatatcttgccccatcgcgacgtaactgctccacccggccaataacctcgaacaaacaaacaaagaaagaacagtgatcgatttcagtggcagccagaaccggttgttgtaaggaaacaggtccctgtggactgtgggagacagccttccctgcattccatgtgaggcctcgcagcgagtcatgagccatgatggcccgcccagtcccagtgggcccgcaatgcacgagaacgagcactcaaattcgtcgccgtgcccggccgcacggcaggcgcaggcgcaagtggaagaaacctgccgccggatctagcgagcgaggaaaaaagaaaattgctccccgggccgggcgtggtctgttccttccttccggccacgccacgccacgccacccacgacgcgacgcgattattctgtgccactccagcgggaagggggggtgacgtggactgcttgctgcccgcgcccgtgggtagcggtcgccgagcacgtacgattacgaacaggtacgtacgtatctttcactccccccccggcccggaggccatgccatacgccgagcgcgtgtacatatggtggttgtggttccggccggcggtgtcgtcgtcgtcgctgttccagactgcaggacggccggctgcgtctggttgggttgggcgcgtcctgcgctgcaggacggacggcctccactcgctcgctccttgttattattccaccgctagattcttagcattgaccaggaatgcaaatatgcaaaacaaaacaaacgaccgcgactagcgagacacagcataaggtactggtggtctggtgcactagcgacgcgaccacgaccgcgacgggacggaccggacgcttgccgcccaccatacacgcgacgcgaggccagtaggcagtaggccacctcctccggagccccgtccgtccggcgcgttccataccatacccgttcgtgcgtacctggcctttggccttcaccttgccggtggagcatgcattgggggccggggccggggcccgggcagccgggctacgctccgtctcgtggcagtggagccacgcgcatggcctgtggtctgtctgaggacggcgggcagagctgccttgcgttggggcgcggcacggcagtggacgactgcgctccgcaactccgcccgccacgctcgggcccggccatctcattgtgtccgctccacgcgtgagtgcgggtgcctggctgactttagctagtgcgcctagtcggcactgacgacggcgccgacgtacccactgacagacgtcctacgtactagtatataggttgccaaacaatccacaagtggtaaatctcaatccttattacacacatggagacacatgggggcacggagacgagtgtattcacgtgcccattggatgcatatgaatgattgattggtttgctcgctgtggcctggccacgaaggtcgtcgcaaaaaggtcgtggtggtgcccggtcgagagaaagagagagagtgtgtgagtgaggggaccagatcaggtcgccggcgtacctttacaacggggtccgtggagtcgtccagcacctggatcacgaagcgctccggcggccactccagcgcacatgccgccccgatcgacagcttgtacaccttccattccattcgccggcgcccgacatgcacggttcacagaaaacaacacggcatcttccatcagtcaccgcgccaacgcgacatgcacgcacggtcaaaacactagtaatcaattctctctctctcgctcgctcgctcagttaattcactctctgcttgcaaccaccagctcatgtcagtcttgcccactactactactactacgcgttatgtcgccagctcatgcccatgctcatgctcagctggctcactcactcacctcccgctcgttgtacatggggatctgcaccagcaccacggg

SEQ ID NO: 21705 - DNA, 1167 bp, Zea mays
cattgggtacctcgaggccggccgggggataagcccccgcgccggtgcctacacagtacacactgaccacgtcagtttcgccatggctacctcctccaccaccgcgctccactcgcagttccggccaccgctgcgcgctccccgccatctccgtccgcttccacactcgtattcctcctcctcccgcactcgcggctgcgctcctgtccgggcctcagcggcgtccgcatccgcgccggcccagcgggagatcgccgcgggcgtcccgtggggctgcgagatcgagtccctggagagcgcggcatcgttggagcggtggctcatagactcgggcctaccggagcaacgcttggccatccaacgcgtggacatcggcgagcgcggcctcgtcgccctcaagaacatacgcaagggggagaagctgctcttcgtgcccccttccctcgtcatcaccgccgattcagagtggggtcgccctgaggtgggagatgtgatgaaaaggaactccgtgccggactggccgcttatcgctacttacctcataagtgaagccagtttagagggctcgtcgaggtggatcagctacatagcagcgttgccgaggcagccttactcgcttttatactggactcgtgcagagctagatgcatacttagtggcctcaccaatcaggaaacgtgcaattcagaggataactgatgtgattgggacatacaacgaccttcgagaccgtatattttccaggcatccagatttgttccctgaagaggtgtataacatagagacatttctatggtcctttgggattctgttctcacgcctggttcgcttgccatcaatggatggaagggttgcactagttccttgggcagatatgcttaatcatagccccgaggtggaaacattcttggatttcgataagtcatcgcgaggaatagttttcaccactgaccgctcatatcaaccaggtatttatatcttatgggaagaaatccagtggtgagctattgctttcatatggttttgttccaaaagagggaacaaatccaaatgattcagttgaactgttggtgtctcttgataagtctgataattgctataaagagaaattacaagcactgaagcgaaatggtttgtcagaatctgaaagtttccctttgcgggtca

SEQ ID NO: 21706 - DNA, 2523 bp, Zea mays
gcccgccccttttttttttgttttttggtagtacgaagaagatttattcaggtcacgagcttattgtcgtaattcgtacagcagctaagggcgtgcaagtacgaacgctagccaagtacgatggccctgcgcaatcacacacatacataaggcagctaggcaggctgggatgggtgtggatctcgaccgtgcagcatgctcagtaggccgtcgccgcctcccccttgagcgtctcctgggacgcgccgaagcgccggcacaccacctccaccgtcgcgccggccacgctcctggacacgttcgtctcgaacccggcgcggcaggggtcgcagtacacgcgccccgtcaccacgaacccgcccgccttctccgcggacgccacgccggccagggacgacgccgccgccacggccagaactacggccacggcggcgaccagcgtcgtcgtcgacccgttgccgccctgcgtcgtcattcgttctacgcctagctagctagcttcttttctttgcttgggggacggagagggagagggagaggatcgttcgtgaactccccccgccggggggccgccatgcgccctttatagatagatagatggagaggagaggcggagctcgtttccaggctcgtccgtcggcgcctgtgcgccgtccatgatccccacccatccctcgctagctattcctggtttttttttgctgcaacaggatatatattcagcttttgctcgcgttgcaatcgtcaattccacccattcccagacatgacttaagcatcttggatcaaagactaaaaagaaagtttaacacatcggcaaaacacaggcacttcagttaacagagcaactcggcaaccgtttcatcccgtcaaagactaaaaagaattctctatagcgacgccaatgttcagccttgctggcatcgcaattatcttccttgatcaaccggagtttacaggtactgatccagacaacgaaccatgcatgactcaaatcaaaccttacccttctggtcttcgattttctggaacgaagtgaaccaccgcttccaggaggcgtcaccctgctgctcaatccacgacaggaagcagctgtccaggaggcagaacaagttcacatacaggagctggtaccgcacgggaacgaagcggaagttcgcgatctgcacagcaggccagatggttccgcctaacaccagagccggaatgaagtccctcttcacgtcctccttcacctgctctatgctccttccttgacccagaccaacatatgagaagaacaggaggaggtctagtggtccgaagaggaatccatccgcggcaacttttgaggcgacgaatttgaacgtgttaggctgaaacctccgccggatgatgcgatccaggtattcataccagtaatgcccaactggaccaacaaaagcaaatccgaaggagcttgtgatgcccaccctctcccaacccactggaaatcgatatccaacaaaaccaaagccttagtgacagatattgatgctgccaacaacatctcatatagcagtccaattcacaatagttcgcccgtatttttcactccaaaaaataaggagagaactgctttcatctctttttttttctcgaaaacgcgggagaactgtgcatcattatattaagaagaaaatttgggccctagaggggcagtacagtacacccgtaccacaagatcttacctaccttttgcaaatgaacaaattgcagcagtaagtgatgagattgtgggatcaacatctgtccaatagcaaaaacccgtgtgatcatatttttttatctgtgttttcatacagtcgcgcggcctccccgagctcgaagtcctccttgcacacggggcactgcgagccgtccgacaggtgtgccccggtgatccgcaccgtcgggagcgagtcgatggccgacggcggcgccggcgccggccccggccggtcgttctgcgtcagctcctcgatgaggttgttcaggtttggccccgtgaagtagttcccgaggtcgacggccggggccgtggtcggccgccgcagtaccggcggcggcggcggcggggagggcacgcgccgtcgaaccggcgccggtgcaggagcaggaggcgtggcgggtccctgcgccggcgcagcaggctggcggaacgcgcggcctggtaccgtcgtcgccggctccccgccgtatatgacccagcggcgcgggtggccgtcgtgctggcgctgcgggtggaacgggtgcggcagaaagtgcggcggcgggaacgcggggcgcgccggcaggtccatctcgtggaggaagcggccgaagcagcgcgggcagaagacgtcggtggacgggtaggagatgatgcggagcgcgcggccgcactggtagcaccagtacatgtggcacgtccggtggcgcgcgggcgccgtcgtcgacgacatcggcgaggcggtggttgcggttccttgcgttgcgtcgggttggtttgatggtgccctggctgcctgcctcgatcggcagggg

SEQ ID NO: 21707 - DNA, 1134 bp, Zea mays
gcaacaggatatatattcagcttttgctcgcgttgcaatcgtcaattccacccattcccagacatgacttaagcatcttggatcaaagactaaaaagaaagtttaacacatcggcaaaacacaggcacttcagttaacagagcaactcggcaaccgtttcatcccgtcaaagactaaaaagaattctctatagcgacgccaatgttcagccttgctggcatcgcaattatcttccttgatcaaccggagtttacaggtactgatccagacaacgaaccatgcatgactcaaatcaaaccttacccttctggtcttcgattttctggaacgaagtgaaccaccgcttccaggaggcgtcaccctgctgctcaatccacgacaggaagcagctgtccaggaggcagaacaagttcacatacaggagctggtaccgcacgggaacgaagcggaagttcgcgatctgcacagcaggccagatggttccgcctaacaccagagccggaatgaagtccctcttcacgtcctccttcacctgctctatgctccttccttgacccagaccaacatatgagaagaacaggaggaggtctagtggtccgaagaggaatccatccgcggcaacttttgaggcgacgaatttgaacgtgttaggctgaaacctccgccggatgatgcgatccaggtattcataccagtaatgcccaactggaccaacaaaagcaaatccgaaggagcttgtgatgcccaccctcttccaatcaactttaaactctttattgtctttattatctttatcctcggggtcgggagggctgctgtcgtggccgcgacggtcggggctagcggagtagtaggtgacggtctgggcgccgatgtcgccgaggccccagaggatgccggagctgacgacctgcgtgcgcaccgggtgcgcggccaggcactgctggtaccaccgccatagccgccgcatccccaccgcaccacccaccggccaagcgaagacgaagagggaaagaaggaaggaggaagtgtgcgccttcctccctctctcactttttatttatttttatttttattattcccggccgcccccgcggcacccattggcccggaaacccgagggtccccaagaag

SEQ ID NO: 21708 - DNA, 2000 bp, Zea mays
tttttttttttttttgggctgcggttacgtgactttgatccaagaaaagcaaagcaaacggtcaccaaatcgttcaacaggacaccttataataataataatccataatgagaaggcagggtggtcacttcttttcggacaactatacagactgccataaaaacatttgctagccctaagtaaaattattttccctttgaataatgtgccttcacgtgcagccatcacgtcaaacaaaaatcatcccgattccaatagacccgctcgctgtacatcagtccatcacgccgtgatcaagacttctattcattcagttcccccaatatggcatgcagctgcatcttggcatctgaacctgatttactagtggacggccttaatgaagcagccattccatccaatcattgcgcctccggacattatctccctgcacttccaataactcagaaccacggatagcatctagtatgtagttggtgtccaccaaacctgtaaacgccctcatccggttgaaccctaagattaggtcaataggtacccatccttgattgttcatatgtctcctcaagaatgtgtcatggcatagattatttgtgctaaaatagaactctatctgattcctaatactatcttggagatttggttgatcctgatgaggaggaacccaagcaggctgcatgggtggccgaagaagatgcatgttctgaaactgttctactggtgggaggtagacaggataaggttgcacatcagcaaggtagggaaatgatgggacataaaaatgctgtggcaccatgaaatgggcagccggtggtggtggtcggtgaaagggcccaggctggtagatgccaggctgctgctgctgttgatatggcattaccggaactcttgggaagttcctaggggagaaattagccccctctctcatggtcacggcgacccccggtaaccaccacgacctccaacgccattgctactactactatttcggggattattattccagtggttgctgctaccactgctatttctattgttcccatcaccaccaccaccaccacctcgtatgttgtggttccagtggccattgccagaaggatttctgctgctgtcattgtcattcccacgggcacaacgagtgccagggacattatcatccaaattgatgggaccatcgccattgctgctgttgcaaccgctgtcagtaccaaggcttccatcattccagttaccatcaccaccactgccactgctcccgtcacctccgctactattggcagccctgacgccaccattgctaccatttccacggttgccactgcgccgaactggaaatgtctgggttgtggcaccgttctgctgagaggaagccgcaggcgtgcgaggaggtatggaggtagggttttgggcagtgggaatcggattagcccccacaactggatgtggaagtaccgatgaagcagcaattgtatcctcctgcggaggcgggccggaaacatcggagagggcattgagggagtcggacgagcccgacttggggcacgcgcgcgtcgactccacgagcgccggccacgaggcgtccccgccgatgatgccgccgccctctggggtcgcctccgccgcggcggcgggggtctgcgccagcacgctccacgttgtcttccttgccgccgcattggtgggatcggccccctcggggtgggccggtggatcctgcgggacgcctcgggcgccgaacggccggactccggcggtaccgcgatcgcctgcggaacggcggccgctgattgcgctggcctggcgcgggcgcggggccaccagcagccggcgacatcacggggcgagacgactgggaatcgagctgggggtttggggcgggggaatgggaaggcgaggacgaggaggcaggaggagagacgagagatgaggggactgggaaggcgggggccggagaggaggctctcctcagtttcccaggtcatccacccgaaccggccggc

SEQ ID NO: 21709 - DNA, 1375 bp, Zea mays
caaggagagtcaaatacagggtatactactcaaaccacaaaactaagattccaagaataaaccctaggtagcaccaaatcgttcaccaggaccaataatccatgatgaaaaggtaggatcacacttttttttttttttttttgcacaccgcaaaaaaagtacttttaagtaaatttatttcctgttatttatcccctcaatagtggctttacgtgcagccatcatgtccgatctaaacaaacaaaatcttcccgcttccaatagacccactgtacatcagtccacggatccggtacccggtgcccatgatcaaatcacccaagacttagaaaataaaatctatatcctgcaaaccgacgcgtttatagtacgatcttgatccatgccacatgcccttgtgcaccaatctcaaactagatcaagccttcccacgtttaagagccagtgagccaagctacagagctagccaatatacaacatggagtcgacctatcgatggcctgggcagggacactggctcctaaacgtgccaagatttgatctagtttcacattagtacgcagagacgtgtagcatgcatcgagattgtcatgtaaatgcgtcaatttgcaggactcctccatataattttccacaagacttctattcagttccccgaagatagcatgcggctgcattttggcatcttaacctgatttgctagtggacagcgttaatgaagtagccattccatccaatcattgcgcctccgaacattatctccctgcacttccaataactcagaaccacggatagcatctaatatgtagttggtgtccaccaagctcgtaaatgccctcatccgattgaaccctaagattaggttgataggtacccatccttgatcgttcatatgtcttctcaagaatgtgtcatggcatagattatttgtgctaaaatagaactctatctgattcctaatatcatcttggagatttggcagatcctgaggaggaacccatgaaggctgcatgggtggtcgaacaagatgcatgttctgaaactgctctactggtgggacgtagaaaggatagggttgcacatccgcagggtagggaaatggtggagcataacccggccgggcccccatgggttccccagcaggtggcggcggtcggtaaaaaggtccaggctggtagatgccaggctgctgctgctgttgatatggcattactggaactctggggaaattcctagggaagttagcccctctctcatggtcacggcgaccacggtaaccaccacgacctccaacgccattgctactgccactactaattcggggattattattccagtggttgctgctaccactactatttctattgttcccccg

SEQ ID NO: 21710 - DNA, 1133 bp, Zea mays
ggtaccgggccccccctcgtattttttttttctttttttggcagtatcaaagacctcgccaaccctgtgattgaacgacgaagcgttaacagcgattgcacaggtctgaccctgcgaaatccatgtgttgctgtatgcattgctataatgagacatcttgcaggtgttacccctggagtgggaccaactctccctgtacccaccaaaccagctctaatcagaaagtcatcttctgcctcatccatttcgtcgcggaccatttctctcctttcagaacagggcacccgctgtggatactgtttgggtctgtgttaccatccaatcccatgctccagaagagaacagcgtcccctttgtttggcttaacacacaatcctttgaccacgtttcctccacagctgcactctccatctcctgcctgcggaaagtgagtttcaccacctacaacgccatctgtcaaatacataagcattgtagcaacacgctgccctccgcgcttaaggttaaaagtgtcagagaagtaatcatgatgtggtctataatactgactagcttcatacctcaatacttgaatgagctccccattttctttaggtatttgagagaacacagatattcgcttctctatagcctgaacgactggagattttctttcttcagaattcacaaacataccagaactcgtccgaacatcactttttacaccctttcctgttgcaacatccactacagtggatatttggagtcttggtctagcaattgccattaggtaatcacactcctctgaactaagaaaattatggaaaacaattatccttggcgtccagctgataacttcaggcttcacatatccaaggcgaagaagaacagcctctggatcactatctgcatgcactgaatagccatctagtcgatgaagaagtgctaactgaagcaaagatccaaggatcatgccgagtgtgacgaaggtggccagaggcagcaggcgccgcgcccgccaccgcgccatccccgccgaatctcgtcgtgcccgtgacacacgggtgcccactatggagcagaggtatggcgcttgagtcaactggctgtgctcagcaggcgaagatttcccggccggcctcgagggacccaat

SEQ ID NO: 21711 - DNA, 992 bp, Zea mays
  misc_feature (16)..(16): n is a, c, g, or t
ctcgaggccggccggngaagccaagctgtcactattgattttgctcgggccaccaacctgttggtgattactcctacgtacagtacctcaacacttggagtgcaccgcaggtacctgagtcttcaccaccgcgagcggcgcggcaacttctgcctgttcatgccggcgctggacctggcgggcgggacgctggacgagagggcgtgggcgctgcagcgcgcggcgtacgacggggggccgggcggcggcgcgctggggacgccggagttcgtgttcctggcgcacgtggtggacatgatgtcgtcgatgcacgtgccgttcgcgctccggtcgctcagctccaccccgttcgccaaccacttcatcctgctcccgttctggcccgtcgccttcggcttcatgctgctcatgtggtgctgctccaagaccttcgtcgtcagcttctactacctccgcggccacctccaccagacttggtccgtgccccgctacggcttccagtacttcctgccggcggcgaagaagggcatcaaccagcagatcgagctggccatcctgcgggccgacaggatgggcgtcaaggtgctcagcctcgccgcgctcaacaagaacgaggctctgaacggaggcggcaccctgttcgtgaacaagcacccggacctgcgcgtgagggtggtgcacggcaacacgctgacggcggccgtgatcctgaacgagatccccagcaacgtgagggaggtgttcctgaccggcgccacctccaagctcggcagggccatcgcgctctacctctgcaggaagaagatcagagtcctgatgttcaccgtgtcgtcggagaggttcgtgaagatccagagggaggcgccgtcggagtaccagcagaacctcgtgcaggtgaccaagtaccaggccgaacagaactgcaagactcggtatcgtgggcaagtggctgtcgccgcgtgagcatcggagggcgccgtccgggacgcact

SEQ ID NO: 21712 - DNA, 2424 bp, Zea mays
gcacgagaccattacctagaacatcctaatcaaaaaattcgagttcgaggcgacaggcatcgtcgtcccacccagcagtgcagagactctctctccctccctctccccggccacctctcgctcacgagcaccccatcttcccggccagggcctgggtatgggtgctccgctcgcctcctggccatgggcaagcctcggatcatacaagtacctgctgtacgggcctctggtggcgaaggtggcgcacgcgtggagggagacggggagcctgccgctggggtcgtggtgcctccacctcctgctcctcctggcgctccgctcgctcaccttccagctctggttctcctacggcaacatgctcttcttcacccgccgccgccgcgtcgtcaaggacggcgtcgacttccgccagatcgacgccgagtgggactgggataacatggtgatcctgcaaaccctggtcgcggcggtggcgatgggcagcgcggcgttcccggccgtgtcggagctgcgggcgtgggacccgcgcgggtgggccctggccttgctcctgcacgtggccgtctcggagcccgccttctactgggcccacagggcgctgcaccggggcccgctcttcagccagtaccacgccaggcaccactcgtcccccgtcacgcagccgttcacggccgggttcggcacgccgctggaggcgctgctcctgacgctggcgatgggggccccgctggcgggggccttcctggcgggcgctgggtccgtgagcctggtctacggccacgtcctcctcttcgactgcctccggtgcatggggtacagcaacgtggaggtcatctcgcacagggccttcgccgccttcccgccgctcagatacctcgtctacaccgccacgtatttgagcctgcaccacagggagaaggactgcaacttctgcctgttcatgcctctgtacgacgccctcggagggaccatcagctccagatcgtgggggctgcagagagaggtcgaccaaggcatgaacgaccgggtgccggacttcgtgttcctggcgcacgtggtggacgtggtgtcgtcgatgcacgtgccgttcgccttccgctcctgcagctcgctgccgtgggccatgcgcccggtgctgctcccgctctggcccgtcgccttcgccttcatgctcctccagtggttcttctccaagaccttcaccgtcagcttctacttcctccgcggccggctccaccagacgtggagcgtcccgagatatggcttccagtacttcatcccgtcggcgaagaagggcatcaaccgccagatcgagctcgccatcctcagggcagacaagatgggcgtcaaggtcatcagccttgctgcgctgaacaagaacgaggctctcaacggcggcggcacacttttcgtgaacaagcacccgaacctgagggtgagggtggtgcacggcaacaccctgacggctgccgtgatcctcaacgagatccccagcagcgtgagggaggtgttcctcaccggcgccacgtccaagctcggcagggccatcgcgctgtacctctgcaggaagaggatcagggtcctgatgctgacgctttcgacggagaggtttctgaagattcagagggaggcgccgccagagttccagcagtacatcgtgcaggtcaccaagtaccaggcggcgcagggctgtaagacatggatcgtgggcaagtggctgtcgccgcgggagcagcggtgggcgccgccgggcacgcacttccaccagttcgtagtgccgcccatcatcggcttccgccgggactgcacctacggcaagctcgccgccatgaggctccccaaggacgtcgagggtctcggctcctgcgagtacacgatggagcgcggggtggtgcacgcgtgccacgccggcggcgtggtgcactgcctggaagggtgggagcaccacgaggtgggcgccctcgaggtggaccggatcgacgtcgtgtgggaggcggcgctcaagcacgggctcacgccggcgtgagcgggagggcgcccggagcgggagaccgagacggccggcgcgcgcggccccgcccggaaataacgcgtcgtctattcgttgtcgcatggctgttgcgacgggtgggtcggtgtgctaccgtgtactactactaccagctactagctaccatagtccaagactgctgcaagcgcaatgcaacagagttgataggctggttcgcatataccaatactcttatgtacgtaccgaatactgcaatattgcacgaggcatgggcttccgttacttatggccaggcctgcgacctagtataaaaaaaaaaaaaaatctgtactgttcattgggctctaaactggattgaaagtctgggccggaccaactgggcccacccaagcatggtacaaaagcaatagccc

SEQ ID NO: 21713 - DNA, 2414 bp, Zea mays
aattcggccccacgcgaccggaggcgaagagagcagcccaaacacgactactgcattacacacacacacaggataggagtacgtgtctgcttctctctccccgctggcctcctcctccagtacttcagacagtgcaccgtgctgcggcctctttcatccctcaaggccggccgcccccagaaccagagtcggagcgaatccatggctcctccgcccctctcctcctggccatgggcaagcctcggccagtacaagtacgtgctgctggggcctctggtgtggaaggtgctgcaagaatggcgggagcaggcgggcctgccgctcggctcctggtggctgcacctgctgctgctgttcgcggcgcgcggcctcacctaccagttctggttcagctacggcaacatgctcttcttcacccgccgccgccgcgtcgtcgccgacggcgtcgacttccgccagatcgacgccgagtgggactgggacaactttctcgtgctgcaaacgctgattggggccacggtggtcaacagcccactgctcccgggcctgcggcagctctgcctgtgggacccgcgcggctgggccgtcgccctgctgctgcatgtgggcttctcagagccggtcttctacctggcccaccgggccctccacagggccccgctcttcgcccgctaccacgccgcgcaccactcctcgggcgtcacccagccgctgacagccgggttcgggacgccgctggaggtcctgctgctgactctgggtgatgggggccccgctggcaggggccttcctggtgggggccggctccataggcctggtctacgtgcacgccctcgccttcgactacctgcgcgccatgggctacagcaacgtggaggtcgtgtcgcccagggtcttcgaggcgttcccgctgctcagatacatcctctacacgccttcgtacctgagcctgcaccaccgcgagcggtgtcgcaacttctgcctgttcatgccggcgctggacctggcgggcgggacgctggacgagcgggcgtgggcgctgcagcgcgcggcgtacgacggggggccgggcggcggcgcgctggggacgccggagttcgtgttcctggcgcacgtggtggacatgatgtcgtcgatgcacgtgccgttcgcgctccggtcgctcagctccaccccgttcgccaaccacttcatcctgctcccgttctggcccgtcgccttcggcttcatgctgctcatgtggtgctgctccaagaccttcgtcgtcagcttctactacctccgcggccacctccaccagacctggtccgtgccccgctacggcttccagtacttcctgccggcggcgaagaagggcatcaaccagcagatcgagctggccatcctgcgggccgacaggatgggcgtcaaggtgctcagcctcgccgcgctcaacaagaacgaggctctgaacggaggcggcaccctgttcgtgaacaagcacccagacctgcgtgtgagggtggtgcacggcaacacgctgacggcggccgtgatccttaacgagatccccagcaacgtgagggaggtgttcctgaccggcgccacctccaagctcggcagggccatcgcgctctacctctgcaggaagaagatcagagtcctgatgttcacggtgtcgtcggagaggttcgtgaagatccagagggaggcgccgccggagtaccagcagtacctcgtgcaggtgaccaagtaccaggccgcacagaactgcaagacttggatcgtgggcaagtggctgtcgccgcgtgagcagcggtgggcgccgtccgggacgcacttccaccagttcgtggtgccgcccatcatcggcttccggcgggactgcacctacggcaagctggccgccatgaggctgcccaaggacgtgcagggcctcagctcctgcgagtacacgatggagcgcggggtggtgcacgcgtgccacgccggcggcgtggtgcacttcctggaaggctggggccaccacgaggtgggcgccatcgacgtcgaccggatcgacgtcgtctggaaggcggcgctcaagcacgggctggcgccggtgtgatcatatcgcatcgtcgagccgcaccgcgcgcgcggtttgttttgcagcggctacctacctagctgcatatgcttgccaggccggggtccagccgccgcggttctgtgtgcatgcatgcaacagcccagcagaccacgggctaccgtgcgtggctaattcttgtactagtactactcctgctgtatgtaccgtgccgatggggcgatgggttaattaaagtcctctcgactacgctacgaccatgcatggacttctttcgtgccaaaaaaaaaaaaaaaaaagccccctgaataagaaattaaacacagaggcttaagaaacctcgtgc

SEQ ID NO: 21714 - DNA, 2517 bp, Zea mays
ttgtctaattcggcacgaggccgcaacctgaccaacctcccttctactgcccgcctagggtctcccttctactgccgccgcaacggcgcaacctcccttctactgccgccgcaacctcccttcttcgagtcccatccgacctagccctgcaacccgccggacgacgagcagtgaggcccgcggccgagatggaccggtacctgacggtggagcggccacggaacgagtcaaccatcgaggagaacgggatccgcatcaccgcgcagggcctcatctgcaactatgtctcctacgctacctccctcctccaggtgcctgggcttgtcctcaccatcgccgtcgtatcgtattgtacttaggatgcgctgttctgttcgagtcccgtccctgtcgattcgaagagatccccagcaacgtgagggaggtgttcctgaccggccccacctccaagctcggcagggccatcgcgctctacctctgcaggaagaagatcagagtcctgatgttcacggtgtcgtcggagaggttcctgaagatccagagggaggcaccgccggagtaccagcagtacctcgtgcaggtgaccaagtaccaggccgcacagaactgcaaggtacgggtgcttgcatggttacatttactatagtatagggtagtatataataatcatgcatggtaataacgacggcggtgcagacttggatcgtgggcaagtggctgtcgccgcgtgagcagcggtgggcgccgtccgggacgcacttccaccagttcgtggtgccgcccatcatcggcttccggcgggactgcacctacggcaagctggccgccatgaggctgcccaaggacgtgcagggcctcagctcctgcgaggtacgtactaaattacgaatgcgtctttgttccgccttcgatcgatcgatgatgcccatgccatgcatgatctgattctgatgcgaccacgcagtacacgatggagcgcggggtggtgcacgcgtgccacgccggcggcgtggtgcacttcctggaaggctggggccaccacgaggtgggcgccatcgacgtcgaccggatcgacgtcgtctggaaggcggcgctcaagcacgggctggcgccggtgtgatcatatcgcatcgtcgagccgcaccgcgcgcgcggtttgttttgcagcggctacctacctagctgcatatgcttgccaggccggggtccagccgccgcggttctgtgtgcatgcatgcaacagcccagcagaccacgggctaccgtgcgtggctaattcttgtactagtactactcctgctgtatgtaccgtgccgatggggcgatgggttaattaaagtcctctcgactacgctacgacgatgcatggcttctttcgtgccaaatcgctggtttaaatcctcaccagaataagaaattaaacacagaggcttaagaaacaaattatttatatacaaaataatttcttgttcataatctttaaacaagccattaatttttttttccaaacaacgtctggtttggtaaaaaaacaaatttcttgttcataggtcttatttgggcgccaaataagcccaacgaacaaaaaaattgttatttaaataaatatgttttcaaattcaaacatggcaaaaatttggcctggtcaatattgggctcaatccagaaggcctctgttatgcacctggcacaccagatgatgccttttatggcccaagctcatttttgcaaaacatgccttcaatggcccaagcccattttcgagagaacagtgcacaaaaaaatcaaaaagaatttccgttgccgggacttgaacccgggtctctcgggtgagagcaaagtatccagaccaactagactacaacggaatatgtcttttcagatttctcaaactctataaatatgtaatattgttggacgaattatgttgtttcgtgcgtggccagattatgcaacgtttggaatgattatatgtatctagctacaagattcgcacgcatacggtacgaccaaatcatgggtcaacacagttcacagcgcgttaaacacgtacgtccatatgcagtcctttttccctgatatgggaaaaatatatatacatgcagcattcttggatttcttaaatatacgtgtgcagtgtactcgtggtgctgccggtgcaccagtgtgcgtcttcccggccaccgtcgggtcgtgctgctccctgctggtgcctggtagggatgttgttcatgatccgacggatgcggctatgcaggtatggatgaatattttgatctgagagtgtaacttgtatctaacccatattttcacagttgtaggtacgagtttctattttaaccggtgggtcacgttcgatctgaaatttggttcattttttattttatacaagaatgattaagatatgatagcaattattttgaataaatgacttgtctaatctctactataccatatgctgccctcggcaagcgcccaccctcgccccatccccgcaaatgtcgtgtctgcccgccc

SEQ ID NO: 21715 - DNA, 1431 bp, Zea mays
  misc_feature (615)..(615): n is a, c, g, or t
  misc_feature (1405)..(1405): n is a, c, g, or t
ggcacgaggactgaacgcctctaagtcagaatccaagctagcaaccggcggcgcgctggggacgccggagttcgtgttcctggcgcacgtggtggacatgatgtcgtcgatgcacgtgccgttcgcgctccggtcgctcagctccaccccgttcgccaaccacttcatcctgctcccgttctggcccgtcgccttcggcttcatgctgctcatgtggtgctgctccaagaccttcgtcgtcagcttctactacctccgcggccacctccaccagacctggtccgtgccccgctacggcttccagtacttcctgccggcggcgaagaagggcatcaaccagcagatcgagctggccatcctgcgggccgacaggatgggcgtcaaggtgctcagcctcgccgcgctcaacaagaacgaggctctgaacggaggcggcaccctgttcgtgaacaagcacccggacctgcgcgtgagggtggtgcacggcaacacgctgacggcggccgtgatcctgaacgagatccccagcaacgtgagggaggtgttcctgaccggcgccacctccaagctcggcagggccatcgcgctctacctctgcaggaagaagatcagagntcctgatgttcacggtgtcgtcggagaggttcgtgaagatccagagggaggcgccgccggagtaccagcagtaccttgtgcaggtgaccaagtaccaggccgcacagaactgcaagacttggatcgtgggcaagtggctgtcgccgcgtgagcagcggtgggcgccgtccgggacgcacttccaccagttcgtggtgccgcccatcatcggcttccggcgggactgcacctacggcaagctggccgccatgaggctgcccaaggacgtgcagggcctcagctcctgcgagtacacgatggagcgcggggtggtgcacgcgtgccacgccggcggcgtggtgcacttcctggaaggctggggccaccacgaggtgggcgccatcgacgtcgaccggatcgacgtcgtctggaaggcggcgctcaagcacgggctggcgcctgtgtgatcgcatcgtcgagccgcaccgcgcgcgcggtttgttttgcagcggctacctacctactagctgcctgcatatatgcttgccaggccggggtccagccgccgcggttctgtgtgcatgcaacagcccagcagaccacgggctaccgtgcgtggctattcttgtactagtactactcctgctgtatgtaccgtgccgttggggcgatgggttaattaagtcatcgactacgctacgacggtgcatggcctctttcgtgccaaaacgctggtttaaatcttcaccagaataagaaattaaacacagaggcttaagaaccccaaaaaaaaagtaagggcggccgcagncaggtgagctcgtcgaaccgggaaat

SEQ ID NO: 21716 - DNA, 761 bp, Zea mays
catccctcaaggccggccgcccccagaaccagagtcggagtgaatccatggctcctccgcccctctcctcctggccatgggcaagcctcggccagtacaagtacgtgctgctggggcctcttgtgtggaaggtgctgcaagaatggcgggagcaggcgggcctgccgctcggctcctggtggctgcacctgctgctgctgttcgcggcgcgcggcctcacctaccagttctggttcagctacggcaacatgctcttcttcacccgccgccgccgcgtcgtcgccgacggcgtcgacttccgccagatcgacgccgagtgggactggaaaaaaattctctggataccgcctccaaacaaccaaccgtggagcccctcagacaccggcaacgcgcaggcccacctagcaggaatcggaagacttttcttcttgcggctcgtcccggcgtttggctagctgctccgtctcaaatatcaaacaaatcatcggctaagccgatagacttccaaatttacttgccccatcgctaaaaatagaagacatgaaccaggagactcaggcatacataatttggcacatacagaaatcccttgatgtgcaggttcagcaacatataaaatttggcgcagcagtatgcaaccaattgtatattgtacgatacacaatgtattgaatttatttgagtaaaagaaaaatgctactacatggttgtatcaaaaaaaaaaaaaaaaaaaaaaaaaaaaaataaaaaaaaaaaaaaaa

SEQ ID NO: 21717 - DNA, 908 bp, Zea mays
aatttgctccgcaccggccagctgactgcgtgcgaaccgaatagcgcgccgccgccgctccctctccacctctattttctgcccctcgcctcccccataccggggcccggtaaccagcatccctcggcagccgctgccgaccgatccgtgtccgtgcgagacgcgggagggattggcgccggaggctgaccgggatgttctccggcgactggacgccgccgtgcggcagctgctgcaccaagaaatacgcgagcctcgtgcagatcccatggagggtgttctgcaagaaggggtgcaacgcggacggcgacacctgggacgagtgcataggaaaatgtactgaaatatgctacaaagatccggtgttagaagatcgccagtggagcgcttacattgaccgatctccagggcaggatagttactctttggaatgcttcaatgcttgtgtgtctggctgtggattcagatttgacatcccaacggagaaggtcgaagaaatcaagcccaataggccatccaaaccatcagctcctgaacctgaagtgaaacaaactaggaatgcagattgtaatgaagatgtgccgtgcacgtcagcctagtttgagtgttggcgtgcctcaaattttgtaaagccaatgtgcttctccgttgtatttctactcgtcctattttcccatggaaaactcacgggaaactttatctagcttagctctagtttggaaactcaaatcccttcgtggatggaaggggtttgagggacaaattagtttattttcatcttaatcccttccaatccccgggtgatttgagtttacaaactagcctttagagtaaagatttaccacattggcaatgaaagatgatggcctgtggcctgggaactgaaaaaaaaaaaaaaaaaagcggcc

SEQ ID NO: 21718 - DNA, 2677 bp, Zea mays
  misc_feature (6)..(7): n is a, c, g, or t
  misc_feature (10)..(10): n is a, c, g, or t
  misc_feature (2557)..(2557): n is a, c, g, or t
gctgtnncancaaagtatgtatgagtcagatatattacatctgttctcgaatatttatcgtctgaccagttcatttttgaactaaaatgcgacaaatataaaaaaatgaagtgagtatttatttatctattcagtcaagcgagcgttattttctaaaaattaagcagaagtctatacataccacaatacagatggtaattgattcaacatagatctgcaaacaaaaataaactttgaaaatactgaacatagaaacagaatgctaggagactcagggggcaaagcgaggatttgagattgcggtgacaaatcagattgtgagggctgttagaaggtattttacattatttatatggtgattagctaaaaattttagtagctcctataaaatttgaggagggttagactatcttcaatagactccatatcccattctctatctcactccttatttcaaacttcaatcctgcaaacagtgcaatttacagtgtaaaatagtactttgcacggccgtttacacagcctgctagagatggccttaggtgggacattgccccctccgccccatactagaatcaccctgaggagaccgaaaagaaactgcagtattgacttattgtgtaattcttaaccctttggaaaattgctcgactcatcagcacaactctattaattacactaaggccgggttcatttaggacaatgtcagaagcaccacgggctgcgtcagtagagtctgctattgcaataccaatatccgccttttttaaagttggggcatcatttacaccatcccaagtcatgccacataaatgtttttcatacatgtgttctatcaagcattaacaaaatatgaattagacataagtactgcctatatatgttgaagaactgttgagcctatcaaacaggagtaataaaaaaaaggcaatctgcatagttgtacctggaaagactctagcaaagccatcagccttctcggtcaattcatcaattggcaatgaagcaagtgactcatccttacatttagtacccattcccaaacgacgtgttgtttccttcccaatagcaagttgatcacctgaggcgagaaaaaagaccggttaatattacagcacaacagttcagttgcagtagtcatatctacaaacatattactatagacaagctagcaggaatgtgatggaactccagatttagagcaatcaactgaaggtacacatgaataaatatggcaaacctgtaatcatcttgtcattgacatcaagattgagtggccctgcactatcatggcgtgggggggggggggggggggatggcaagaggataatgaaatgtcatggtccttcatgactcccttttgtaccatctggcacttcatgtacatgaattttgcatcaacgtcagctccgcctcatacctcactgtcaccacgcaggccatgccggcggcacgaaacaccaacgaacgcaaagagaagggatctgaccgattgggcagcgatgggcgcaagtaagggatccgaggagtctaggagcttcatacccttgcaaccttggagagcgtgggccagcgcttagcgtcgacgactgcggtgcagttcggggcagggtgcttccaggtggagtgcttggccagggagacggagggagatggggacagggacagggagaggtgctacggcgtcggatcaggtgaggaggtggcggcgggatgctccatagccggctagggtttggcacaggggataggatggatggatcgctgctccttttgggcgatggcgggtgggggaggccgggagggacgtccccatggctgacccaacatgagacgtgtcttttttcctcacttgtgtgtcatcctccagattctagaaggctcgcgtcgttcgcaagccaaggctggaggccgactatagccgttgattcacaatcgggtggagcacagaaaaaatgaccacgtggatggcgtcatagcttctgttttgaaccggctttaaagaaatagctaataatagctggtcgggctcgtccagtaaggaacgacatcccgctcaccggcttggagcttagtggatgacgatacatccaaataaggaagcaaatgaaataccgctcagatgtcagatggatcaaaaacatattccctgtttttagtgaggcagcaagtgttgcgtgagcatttggacttccatgtactgcggatgacgacatgaatggacggtgaccagatgaacgagtgattggagcagtctttgatacctcggtggagggaagaaagcggttaaggcccattaccctgttttcaggctttattagatctttttctcagtccctgtctattccaaacgggctttttttttcttgggcttcgaagcacctcccactaggattgtttatgttgtgggaaggaaacaaacctgctgattccatttctctacagaaatagacaacacactcgccaggcgcagagtgtaccgagggcgcgctgctactgctagcctccacgtggtcggagaggtggtctgtagtgatcgctacatcagctatcaatnatactattccatcctttttttttatttctcacgttttatttaaaataaactaatagacgataaatatactatagtcagcgttaattcctatctatcggtacatttatcggtaattagtag

SEQ ID NO: 21719 - DNA, 1044 bp, Zea mays
  misc_feature (1044)..(1044): n is a, c, g, or t
ttttttttttttttttagcttaaaataaatatagatagacacagattttgtatattatagtgaatagatggtgagagactatgcattgagacatgcaaattaacaagactcatacaagcgcgttcgagccccagcctttgcatatcatacacatgctcaggtcttaacatgtttggcttccgagcaaactttctccagatcccaaaaaatataatatccgatcaaatatgtgtcgatgctcatcctaacatactcccgttgcaacgtacgggcacacacctagtatatacataaggacgaggttccatgccctcctactcagcgtatagcaggatgaggaaattgatgatgcgcagcaggaagtagaagacaatgatgtagagccatttgacaccggcccagccccatccaatgcccttaatagcagcaaatgcccagttggcatatacaacaatcagagtggcattctgcaaacaccataaaatgtaaggagacgcggaaagaccacatacaacagtaaggtatggaactagagtcggatgactcagcagctgcgccaccaagaaggcaaaggttagcaagaacctaggacggtacacaaatgaccagttgcgagcgtgcgagaccgtgtaagttaagggccctgattgattgtgctgacttgaaggtacatggcagaggaaagcgtatgaaaatcaccctgggaaattttctcaaggctttcgacatggaacaatttctgtatattagcaaccatgaaaaggatgggcacactacgatgatttctcaaaactttaaataatgctaaaccagccactggcccataccgagaagaagtcagtcttgtacgtagcccagaagaaaaaatgacagtcatcacgaccaaataacttccaactgtcaggttgtgcaggtggttttactatgtccttcgagatagccacaatggtacttattcatgtcgccaggttgatgttgttagtttacctaatatgctgcttgtacgtcattgaggatggcaatgatctggacggtaaatgtggn

SEQ ID NO: 21720 - DNA, 2348 bp, Zea mays
gcaggggatgcagtaacatatgccactacagatgcacatgcaagtagattcgatacagtgatttaggaaccaggagcataagtataaatttggcaagggaaggcgaaacatactcaggtactcgtagcatactatcattgaggtaccccaagctgatgagctgaaaaatcttggacccaaccctctgtacaaacctttccatccatcttcagcaatcaatcttttaacaacttccccagcttttggcttattttcattatccataacctaaatgaaaagaaacaaaattcaatgtaatcatctgtagtaacaaatgcagagggagagaaagcacaactgtcaaaatatagagttgtgccttgtgagaactttcagggttggtagttatattatcagtttaccgctacaaacttaacatgtaacatttggagatatgtgaaatttgtcataaaaatgcatgacatattcctggcatactttactcagtctgaatgtgctaacttttgttactataaataatgatgtcatagatatcaagttttccaaatggaagtttccttttttttaccttataacagaaaccatgacaaactggtcctggtttgtcagcagaaggaacagctgtaaacataaaagtatatattgtttaatatagacattattccagtttaccacctcaataccccaccattggaggaaatatcagtataaaaaatcatttaggtcttcaaatctgacatctgagtattactcccgaaacaaaatatccattcccctaaacttagtggcattgcattgataaggaatcaaattatagacaaatgagcagcataaatgtaaagacaagaatcattatcataaggtaagcctcacaaatcaaattacaagactaatcagcaaacagaatgtcacacagtacctgcagcctggtcttgattgtatctatgggagtcgtaacaaaagaggtcacagcaccagcaaaaatcccccctgatgcttgaacaccaactattttcaattggctaggagcctcttctttgttatgcaaatggccaagggcactattccaatatgtaaaaagagtaatagttaattacttcggctaagttaacaaggcaagaaatacaatctttcaactatcgaaaaaaatatgcatcttgacatgaaaaaacaagcattaggaaacaaaaatgcaattataactgcagtttgaaaaggtcttgtacagatcgaaaatacaaattcaaatcaaataactattatgtagaaatgcatcactgatccttttctcttaaacattgcataacgcacagggctaagaggtccacaatgatgaaccaatcagataggctaacctccaaattatgcgctggctagaaccataactcgcccaccacacagcactcgatggtgcataggtcataacagagagtccaaatcctctgtagagccccctaatgccatcagcctttatgaccttgcgagcaacatctattccacctttgtatctgacattaccagaatacccttgaaccatcaatttctggctgatctgaaacattccaatgcacaaaacagtgagcacagtagtctagaattctaattaacatttaacagcaacttactgtaagataacttttgtctgtacaacatcatgtcggaggcaaatgagaggcataccacatcaattgggacaaaaatagcctgcgaacatgtagatgccgacagaccggcaaggccattggcaaaggcagcctgcaccggctctgacagcttgaagggctcaacaagcttgagagaggctgctttggttgtctcaagcgccgtgaggaagatgatcctagttggtacagccccaatgataacagtaggaaacccccggtacagccctggcacgccgtccaccttaaggatgttcttgaaggtagccagtgcgttcctccccatggcgtccccagaggcaacctgcatccgggtcttgaccaccgagacagggtacagcgccacggtgaccccgctgaacatgcctgcgcccaccacgtagagcttggtcttgtcgaggttatcccagttgatctccgtctggtggagcgacgggatcttggcggccctagatgttgtatccatggccgcgccgctcaaatcctcccctccaccaatccgcgacccccgaggtgacaaccgaagggggcgccggaggcgtgacgtcgactcgaatcggcaagaatggcgggcgggcgagcgggcaggctggctgcgagtgtggttggcttgccccccgttttctctacccactttcgtgctctttttgtccacaacaactcagcaagaacagcggagagagcatc

SEQ ID NO: 21721 - DNA, 1619 bp, Zea mays
gggtaccgggcccccccccgggtgggtttttttttgggctaaacagcatctcccgggaaacatcgttccgtgtcattacaactggtctcaatcatccagactggtcataatcatacagcctcgctaaaatagccttcatgtataaaagaatgagaagtgtgtacatctgatatcgtttatactcacctaaaataatccgccaaacccatattcatcatatgagcaaaaaaatataggcccctacattttttgagatatagcccagagaagcaaagtttgtaaagactattgtctagcaccaaatgaagtacaccatcaaacatccatgttgaatgctttcacctacgtcagcaagaactgaagcttccggtggtgtcaatgttgtcgacatacagcattatttcacttcttctaatacaaaacttccagaatagtaagaacagaagtcagacctcttcaactttagcacacaagcgcttcaggtactcgtagcatactatcattgaggtaccccaagctgatgagctgaaaaatcttggacccaaccctctgtacaaacctttccatccatcttcagcgatcaatcttttaacaacttccccagcttttggcttattttcattatccataacctgcagcctggtcttgattgtatctatgggagtcgtaacaaaagaggtcacagcaccagcaaaaatcccccctgatgcttgaacaccaactattttcaattggctaggagcctcttctttgttatgcaaatggccaagggcactccaaattatgcgctggctagaaccataactcgcccaccacacagcactcgatggtgcataggtcataacagacagtccaaatcctctgtagagccccttaatgccatcagcctttatgaccttgcgagcaacatctactccacctttgtatctgacattaccagaatacccttgaaccatcaatttctggctgatcacatcaattgggacaaaaatagcctgcgaacatgtggatgccgacagaccggcaaggccattggcaaaggcggcctgcaccggctctgacagcttgaagggctcaacaagcttgagagaggctgctttggttgtctcaagcgccgtgaggaagataatcctagttggtacagccccaattataacagtaggaaacccccggtacagccctggcacgccgtccaccttaaggatgttcttgaaggtagccagcgcgttcctccccatggcatccccagaggcaacctgcatccgggtcttgaccaccgatacagggtacagcgccacggtgaccccgctgaacatgcctgcgcccaccacgtagagcttggtcttgtcgaggttatcccagttgatctccgtctggtggagcgacgggatcttggcggccctagaggttgtatccatggccgcgccgctcaaatcctccactccaccaatccgcgacccccgaggtgacaaccgaagggggcgccggaggcgtgacgtcgactcgaatcggcaagaatggcgggcgggcgagcaggcaggctggctgcgagtgtggttggcttgccctacccacttttgtgctctttttgtccacaacaactcagcaagaacagcggt

SEQ ID NO: 21722 - DNA, 933 bp, Zea mays
tttttttttttgaaatttcccaaatttatggaaacaaagttatattttcaaagcacttatcttgtgctgattattgatatttgtgtgggccgagattggactataaagtgaatacattcgaaccatataaatgtcaggcgaatgtaaaatcgaagcactgtactgggaaatagaacgtccatactcttgtcagttagtcagatccagtagctacggctggaaacacaggtacacaacatgtactgaatcactgattaagttgtacagtacttgcttggcccgcttgcagtgactttgaaaggataatggtggcttgtttgaaaaacttccaagtcgatcggagaggaacgttccagccataaaccatctctactgcaggtggcgacgaggagcgcagagatccagcgagggcgccgccgtgtggcccggtgcggggtgtcgagtgcggctccgcgcagcctggcgtggggcgccgccttgcggcatggagcgcggtggcgagatcagctccgtgcggcatgcaacgagcagccgggtcgtcgagcgtggctcctcgcggcctggagcggggcgtctagcatggctccgcaaggcctggcgagggccaccgtcgactgtcgtatgacctagagcgaggcgtcaagcatggctctacgtggcttggtgaggggcggctcaaatcctgctatcctgggtccagcggtggccaccctcggtgagaagattcggcagtgtgacggtggggaacctagcagcgggacatgaagaggcgcgggacagggagggaggggaggggagaggataggatgatgtagtatgattttttgcgggaaaaaaaaacaaagccagagggaatcgaaccgtggccgatggcgcttgcgtggggagcttgaggcggagggaggggagggaccagggggttaggggggtgag

SEQ ID NO: 21723 - DNA, 928 bp, Zea mays
cagctgtggagcactagtagcacatatgtacctgttagctcctgcagatcacatcatgctagtctcccatcagccgttgagcactattagcattggtcggtcgtttcagcaaaccaaagaacctctgtagaccacaccatcgtcgtcgttattcctgttgcgccctgctccccagcgcctagctcccggcgcggcggcgtccctctcctcgctcggcaccacgctccctagctcgacgccctaaatgaaatcaacccaacagttgcttctcctaaatatagttgtaccaagactacaatagacaatacaatatacaatgtgttccattcgtatgatgtttgtagttgctacatactaaatacagcaaactagtagaatcgaggacataaatagtcacaatccgaatatcattgtcctatagcgcccaaaatcttgggtgccaattctcataatctgagtcatctgtgtcatcactttcagatgatgaagctgctagatcttcaacgcgcaatatgtatttagcaactgtatcaggtaacagaggtcgtagttttacttcatggtgtctattcttagggcaatggtgtggagaagcacatgtgaggttgctcagccaaataactgatctgcaatgcgcacatagtgctctatttgatacaaatttccatgacgcgcattcttcatacttagtgtggaaggactccttccagctaaagcttggataatttggcactgaattcatgctgtattgcacaccagatacaggaatgttgttgccactcaaatggctgaggccaaagaaaatcgagtaattcatcttccacagtttgttgtcatttgccgctgaattccaagaccttcagcagacaagacctgctgctaccaaagaatgcatgtccaggaaactgaagatatggacaagtatatc

SEQ ID NO: 21724 - DNA, 2841 bp, Zea mays
aatcctagatatagcaagttctcatataatatagggggaaaaaatcatctcatccaacatttctctatctattactttctaaatatgttaaattttaattaacatgacgctagtttgagtaggaccattagtgatgacacatttaattggtgagttatgttggcttttttatttactatcacaattgtttattcgtttatttctaacatgtgcacgtgcggctattgcattggcaattggttaatctctagttgactacctgccacaattttacatcgtcggcgtccgacgaatgtgctctgttaatatatctctactacaaagtgaaaaaacaccaaaatacaaaagttatcgtcagttttttgtttaggaagttgataaatggttgctaaatgtagggagaaattgagattagatgagaagtagctaaatttagaaaattcatttaagagagttgttggagatgagtttttagtttagctacctaaattatttattgatttaaggaatcttttggagaactactagagttgctctaatagagttgctctaaattatttaattttatactcttaagaaaaccgtaacaactgtaattgtagtttgcatatcattccttaattatatttaagtcagactctacacggcatgcaactttctcttcttttggcccactaattcaaccaaccatctaccaacactttcatttctggtggtgtactttcttcgacgttacatctatgaaagagaattttgatccgaaatgtttcgataaataaaaaaccgcatagctatacctctttagtatagccgcccgccccctggaaataactgaaggagaaattgggcactggatttttcgtgggccgtcgcatttccacgtagcccaaaacaaaccacagacagactttaatgaacatatagagcccaaacaagcctagacaacgctacctaaagagagaatcgacgagcgccagaggataacattagcaaggcgatagataagaggaaggaaagaacataggcagccgaagcgactgtcgcgaggcaaggccatcgtccgccatgacgctctccccctccgcccgccgaaaacattagcaaggcgatagataagaggaaggaaagaacataggcagccgaagcgactgtcgcgaggcaaggccatcgtccgccatgacgctctccctctccacctctttcctccccatccccgccgccgcgaggaccaccgcccgcaccctacgctccgtcgtcccctcccaggggatgcgctgctcgatgcgcaagaaggggttgcacccggagatctacgaggacgcgaaggtgtactgcaacggcgagctggtgctggtgacggggggcaccaagccggagtacacggtggacgtgtggtccggaaaccacccctactatgtcggcgacacctcggcgctcgtggtcatggacagccagatcgagaagttccgcaagaagtggggccacatcaaggagtactggcccgaggaccagtggagggagatgcacccagacggcgacccggagttcgagcccgagggggacaactgattgatggctccccgtcttcctcacccggtgcgtggtcaccggtccagtttacatttgccctcttgaatggaatcgagactctgtctgttcgcattgctctccaggtgttcggttaatgttcggaatggaaaatgtacaattactactacttcacgagatagggtcttgttgatcatgggcccccaaatacaatgtgctttctgcaatgcactctagggtaggatggtattgatcaaacaagcaaatgatcctggttcgaggaaatggatatttctcactaggagtatacgctgatgcttgactacagcttgagtcgtctgctgataacctgataccgcatactgtttgatcaaactagcctcctgttgctaggtgatccaatttccgagtcatagttttatacaaccaatttttccatgcgactgaactaattgagtgtccatgtgttgcatgatatataaaacatgtcgtgacatacggccatatgggtggaatagaatatttgtaaaatctcatgccattacaaacaattagcaccaacatataattcaagctaatttctataaaataaaacaaaatgactataatattattggcttaatctagacaaaagaaaagtaagtaattttattttgttattaataaaccgttgaagataatatcatacactagctctgattcactctatttcctacgttgatagaaaatgtggcggaaataagaatagatagcgacaagcaaatagatactccctccggtgttatattatttgtcgttttggataatgttcgagtcaaacttataaaattttgactacaaataactgttatttatttagttttgaaacataatttatcttaaaaagtaattttataaaagtataaatgcattaagattttatttgtattctaacaaaaaaatattggttaaagttatattttaaagactgtgtcgttatcctaaatgacaataatataacacctaagggagtaggagatttcacgtattccaataaactgagtgtattacatgtgggatcaaatactagtggtaagataaattactatttttattcttctcacagctccacatcagatacctatttgagtgaggcattgcgtacataataagggaaagttgtgtgcgatgtagagtctcctttaagtgcgataggtgccatccatgtatattagggcatgaccaccattgcgatggatatatcgcgatcaggcaattgcgtcttcagccaggtagcactgcgaaatcactact

SEQ ID NO: 21725 - DNA, 978 bp, Zea mays
catcgggtcctccctcccggccggccgggaaagagagaatcgacgagcgccagaggataacattagcaaggcgatagataagaggaaggaaagaacataggcagccgaagcgactgtcgcgaggcaaggccatcgtccgccatgacgctctccctctccacctctttcctccccatccccgccgccgcgaggaccaccgcccgcaccctacgctccgtcgtcccctcccaggggatgcgctgctcgatgcgcaagaaggggttgcacccggagatctacgaggacgcgaaggtgtactgcaacggcgagctggtgctggtgacggggggcaccaagccggagtacacggtggacgtgtggtccggaaaccacccctactacgtcggcgacacctcggcgctcgtggtcatggacagccagatcgagaagttccgcaagaagtggggccacatcaaggagtactggcccgaggaccagtggagggagatgcacccagacggcgacccggagttcgagcccgagggggacaactgattgatggctccccgtcttcctcacccggtgcgtggtcaccggtccagtttacatttgccctcttgaatggaattgagactctgtctgttcgcattgctctccaggtgttcggttaatgttcggaatggaaatgtacaattactacttcacgagatagggtcttgttgatcatgggcccccaaatacaatgtgctttctgcaatgcactctagggtagggtggtattgatcaaacaagcaaatgatcctggttcgaggaaatggatatttctcactaggagtatatgctagctaatgcttgactacagcttgagtcgtctgctgataacctgataccgcatactgtttgatcaaaactagcctcctgttgctaggtgatccaatttccgagtcatggttttatacaaccaattttccatgcaaaaagcggccctaaaggccccta

SEQ ID NO: 21726 - DNA, 1047 bp, Zea mays
ccggccggggaggattcaccaccatggccaaccacctgtgcggcgccggggagagcatgagcatggcgcactcctcatagggaagggttccatcgaccccggcgggcaccacagcaatattgcccctcgctcgtttctcattcagcgcccgtacagccaccactcaaccgagccatatcgaaagttctcaacatcgcttcgtgcagcctgcatcgatcgacgagggctgcacgaacgatggggtccgcctccgcctcagtgatgacgaccagcctgctggcgctggcgctggcagcgctggctttcgtctccagggccgcggcgcagggcaacggctgttccagcgtgatgatgaccctggccccgtgcatggacttcatctccagcaaggcgtcggagccggggatctcctgctgctcggtgctggctggagtcgtgcagaccgacccccgctgcctctgcatggtcctggacggcaccgccacgtccttcggcatcgccatcaaccagaccagggcactggagctccccggcgtctgcaaggtcaaggcgccgccgctcagccagtgcacaggcgtccctgcggcacctgcaccgacgcctcccgacgaaccagcagcggcagcggaggaagaagccgacacagctgcagatgccccttcagcaaatggagcctcaagctccacaaactcaaagaatgcagcgagcttactgcttctcatctgcgcattgctgtatgccttctaataagtggtgatacaacttcgctggccatgtcaccgtgcaggaattaggtctttccctgagtcctgactatgtacttacccatgattctcggcaaattttttgtatggtatggtatgggtttctgatgtgccacatcaaacaacattgcttttcgccaaatgagaaagatcagttctcgcccattgtttaaaaaaaaatattggtgattggcaccacatggtgatcattatcaagaataagaacaccacccatcagattgcagtgaactctatttcaatgtaaaaaaaaaaaaaaaaaaaa

SEQ ID NO: 21727 - DNA, 1006 bp, Zea mays
  misc_feature (946)..(946): n is a, c, g, or t
  misc_feature (950)..(950): n is a, c, g, or t
cactccatagggcggggattgggactctccacgccggcccggccgggcaatattgcccctcgctcgtttctcattcagcgcccgtacagccaccactctcaaccgagccatatcgaaagttctcaacatcgcttcgtgcagcctgcatcgatcgacgagggctgcacgaacgatggggttcgcctccgcctcagtgacgacgaccagcctgctggcgctggcgctggcagcgctggctttcgtctccagggccgcggcgcagggcaacggctgctccagcgtgatgatgaccctggccccgtgcatggacttcatctccagcaaggcgtcggagccggggatctcctgctgctcggtgctggctcggagtcgtgcagaccgacccccgctgcctctgcatggtcctggacggcactgccacgtccttcggcatcgccatcaaccagaccagggcgctggagctccccggcgtctgcaaggtcaaggcgccgccgctcagccagtgcacaggcgtccctgcggcacctgcaccgacgcctcccgacgagccagcagcggcagcggaggaagaagccgacgcagctgcagatgccccttcagcaaatggagcctcaagctccacaaactcaaagaatgcagcgagcttactgcttctcatctgcgcattgctgtatgccttctaataagtggtgatacaacttcgctggccatgtcaccgtgcaggaattaggtctttccctgagtcctgactatgtacttacccatgattctcggcaaattttttgtatggtattggtatggggtttctgatgtgccacatcaagcaacattgcttttcgccaaatgagaaagatcagtctcgcccattgtttcagcggaattattggtgattggcaccacatggtgatcattatcaagaataagaacaccaccccatcagattgcngtgnaaaaaaaaaaaaaaaaaaaaaaaaaaaaccaaaaaaaaaaaaaaaaaggggcggcc

SEQ ID NO: 21728 - DNA, 3967 bp, Zea mays
ggggtgatttagtgcagcgcataggcgcatagctgaacagatgggctctgttcagaaaaaagaaccgagactacatctggacagtgaattcagaatcattgtgtactgatattatatcggacaagaggtttgtttttttataaagtttgcattcacaaattttgtagaatctttttattagattttcaaggtcttcaatgagtgtttattgcagttgaatagtttgtgttcgtcttccttacataataatcgatccacctaactgatgctgaaatgcccaagcccaagtgaaaaagatgcatttaatctctacttactgtgattttggaactgcttgtttacaattacaaccttcaaaatgaaaaggttttcgcttgagataaaacggttataccaatgaacaaacctgaggacttgtattatcttagcatatactacttgcttgacataacaccggaatttaaacttttcttctgtacaacttgacataaacgcttgcaattctttatttataaattagaccattgcgtattatctggttttaaaacaatgtttcaatcaggtagatgcagcaacacatgctacaacgaacagctaaacaggcacaaattcgtgggaatggggggactggggagaggacagcgccacggaccttgggagaggaggctgaccgtctcgttggggtccatgccctatctaattgaccattgtgtattatctggttttaaaacaatgtttgaatcctctgcatctcatactcttttctattttcagcgtgcctttttgatgttttttacattatttgctttaaaaaatctacaaccatgcgacttcactcatgtcacaaaacctgtttccatttaggatattaagtctggaccagtgagcaatcttttttatccctgtgctacaagtgtctcgtttaacagatactttgatgtgaagcttttaagtttaactaatttatttcactttagaatttaaatttgtactatcatctttttccatgtgttcaggtgcctgtagttgatggatactcttatccacatctgacatagagcatgaatgtagctggaaggcatataacatcttatcttgttgacctactctcaaggaaagggtaatacctatcttgctctgaagatgttgtcttctgcagttgctggtacattatttttctaattcaatcaattctcccactttaaaaggtatgccatgaataaatctgctgattttgagactgtcagagaaataaaagagaaactgttctatataaggtaagttgctttatttttcttattattgtttctatctatgtggtcatgatagttaaattatatattgttatgattacaaacgagaataccagctaggacttgagaccacaatccatgtgaaaagttacactgtaagttgtcctgcttgcatttcttccctgttccttttcttactgtaagcttagtttttgtgatcagcttccagatggaagagttattaaagtaggctcctgaagctcttttcactcatgtaagacttccatttctgtttctgcatagtggtactatgaatagtacacataaattccatcaatttgttatctgtgcacttttagattgaatgcaaatcatgctgagcaccaagtattatgcattgaaatttgtggataaaaatattaaaggatcgcaagtcattattatgcaacattgtctatgcacctgaacatattgtattgtatccatgcaccatgcttctagcgaccctaaatgcgtgatggtcctttatgagcacctatgactcacatagcgctcacctaaatctcttcaatttcaatgtttgcccatatttacagcaggtcgcaacttatggggcctaccaagattagggcattgtagaaaccatataaaataaaatattttactcgtcaaattatgtttctgtaaatatataactgtatcagtagtaagaccaccagtatatttgcaagttaaaaatgtaaatcaagaataaagaaacgtatcctgctaggttcttactaatctcttgcaagtgaatgtggtcccattatgagcacttacaaatcatttaatagtcaactaaattccatcaaccctattctttgtccacatttacatttacagaaagaagcaactcatgaaacctgccaagaatgaggcgattaagttaagagcgtatagaggtacatatttactatttgaaggctataattgcaaaagagaaagagtgttgtgatatttatgtttttcatttctttgtagtttcaacgcactaccatagggcgcgcaacgcgcgcctattgatctagtatatatacaatgcaaaatcaacaaccaccaacccagagccagaaaagaaccaagaaagaaccgagtggctggatcagcctgagacgagctttgagcaaccaagacccttccatttattttccataaataggatgctgcaagcgaaggccaccaggattcaccaccatggccacccacctgtgcggcgccggggagagcatgagcatggcgccttcctggtaatagtagggttccaacgatacaggatcgcaccacagcaatattgcccctcgctcgtttctcattcagcgcccgtacagccaccactctcaaccgagccatatccaaagttctcaacatcgcttcgtgcagcctgcatcggtcgacgagggctgcacgaacgatggggtccgcctccgcctcagtgacgacaaccagcctgctggcgctggcgctggcagcgctggctttcgtctccagggccgcggcgcagggcaacggctgttccagcgtgatgatgaccctggccccgtgcatggacttcatctccagcaaggcgtcggagccggggatctcctgctgctcggtgctggccggagtcgtgcagaccgacccccgctgcctctgcatggtactggacggcactgccacgtccttcggcatcgccatcaaccagaccagggcgctggagctccccggcgtctgcaaggtcaaggcgccgccgctcagccagtgcacaggcatgtcatgtgtcaggtcatcgttcaaatgcaaaccattgccagtttctgttgccgcttagaatcctagtacgtacctggtctcaggcgtccctgcggcacctgcaccgacgcctcccgacgaaccagcagcggcagcggaggaagaagccgacacagctgcagatgccccttcaggtgctttcgtctcagatgcttcacatgccccctagatgataaaacttcaaagattacgtgcagtagtttgcatgcttacaaacagtatggagaccggcctagctatacaagaatgtatatttgcactaacctggcaacggtgttctatttgatgcagcaaatggagcctcaagctccacaaactcaaagaatgcagcgagcttactgcttctcatctgcgcattgctgtatgccttctaataagtggtgatacaacttcgctggccatgtcaccgtgcaggaattaggtctttccctgagtcctgactatgtacttacccatgattctcggcaaattttttgtatggtatggtatgggtttctgatgtgccacatcaaacaacattgcttttcgccaaatgagaaagatcagttctcgcccattgtttcagcggaattattggtgattggcaccacatggtgatcattatcaagaataagaacaccacccatcagattgcagtgaactctatttcaatgtatatgttcccaaaagtttccctgcctgctactttgagctaaccatttcggaataagaaaatggtagacgatggtaggcaataaacaatcttcagaataagaaaatgagctgcagcatggtagatgtggcattaccagctgggtatgcagattttagagagtgtcagcattttgttgccctgaaaaaaaaatgccatgctaaattgatgatgacctgattgctccctg

SEQ ID NO: 21729 - DNA, 933 bp, Zea mays
ggccgctttttttttcttttgttgctttttgttttctttttttttttaaaggcaatgaaaggcgctctacctcgtttcatgacatactaatgaataaatagttgcaggtcaggaacaaatacatagagttactcaatatatataactcataatttcaatgaattcttaattaaatgaaaaatgaatgcaagcattccctgcatgcgatggcacctcacgctggggttgcatgcgtggttcatatcatgtttgcaagagccatgcagttgttggccatctggttgagctccttgtcaaacttccccatggggttggggacgccggcctgggtgaaggggcggtcgcacgagtcgaagtcctggacggcgagctgcagcatgatcttggcggtgccggtgtccttgaacgtgatggcccgctgcgccgcgccgatggtgtcctgcgtgttcatgtacatggtgtcgcagaacgtgagcgcctgcgtctgctgcggcgggatggtgcgggccgacttcgcgacgtgcttgcgcgcctgcgcggtgcgcttggcgaacgcgtccacttgcatgttcagcacggccaggttgtcgatgaccgggtacttggacgcgtgccgcccggcggtggacgtgcacacctccgggaacggggtgcgagagcagatgccggcgacctgcgggttgacggcgccaccgtgtcccctgcctcccctacccttacccagcgcctgcgggaggaggccggcggacagcagcgccacgacggcgaggaggacgagccgtgaggcttgccccatgatttttattattctgtgagattataattgctcgatggcgatagatagatatatatttatgggccagcgaggaagtcaaggagcggatggtcccggccggggccggcctcgaggaacccaatcgcccataggagtga

SEQ ID NO: 21730 - DNA, 1200 bp, Zea mays
ataaccccattaaaggaaaaaaaactgaggttgaggccggccgcaaattttttttttttttttttgaagcaaccgctagcaatcaatggccatctccctcatttcatgagcaacagaataaatgcaggtcagggacaattacacagagtttgctcaacgtaactcgtaatttcaatgaattcttaaatgaaaaccaagtgctcatcatgtccaagcattccctgcttgcggcgcgccgccacctcatgctggagtgtaagaacatgccaaacagtcgtccccggccgcatatgattcatatcatgtttgcaagcgtcatgcagttgttggccatctggctgagctccttatcgaacttacccatggggttggggacaccggcatgggtgaacggacggtcacacgagtcgaagtcctggacagcgagctgcagcatgatcttcgcggtgcccgtgtccttgaacgcgatggctcgctgtgccgcgccgatggcgtcctgcgtgttcatgtacatcgtgtcgcaggtcctgagggcctgtgcctgcggcggtggaatagtgcgggccgccaccgcgacgtgcttccgcgcctgcgctgtgcgcttggcgaacgcggccacctgcatgttcagcacggccaaattgtcgatgaccgggtacttggatgcatggcgcccggctgtggccgtgcaaacctctgggaatggggcgcgagagcagatgccggcaaccagcgggttgacggcaccgccgccatgcaccttgcccttgccgttccctaacgcctgcgggaagaggccggcagacaacaacgccacgagggcgaggaggacaagccgtgggtaggcttgccccatagtttattctgttaggtaaattgcgcgggcccggcgggcccgggcagccccattcccccttggaggtggtctcttcggcctcgcaaatggcggttggcctcataatttggagctgataatatccaaatgctttattggttagagttttctaagtcagtcatgctcatcggccaatcatgggtgctgaaattagacaaacatgtggcgtacatagaaattccttgaccttaatattgtttacggcatgtataaccatatttaatatggctctctagagagatctctaaaaatttaagtatatctgttgggggccttcggctcccaggtcctcaaaaacatagttt

SEQ ID NO: 21731 - DNA, 899 bp, Zea mays
gcaaagggtgtatataaatttttaaaaaaggccgctgtttgtagcaaccgctagcattcaatggccatctccctcatttcatgagcaacggaataaatgcaggccagggacaattacacagagtttgctcaacctaactcgtaatttcaatgaattcttaaatgaaaaccaagtgctcctcatgtccaagcattccctgcatgcggcgcgccgccacctcacgctggagtgtaagcacatgccaaactgtccccggccgcatatatatgattcatatcatgtttgcaagcgccatgcagttgttggccatctggctgagctccttatcgaacttacccatggggttggggacaccggcatgggtgaacggacggtcacacgagtcgaagtcctggacggcgagctgcagcatgatcttcgcggtgcccgtgtccttgaacgcgatggctcgctgcgccgcgccgatggcgtcctgcgtgttcatgtacatcgtgtcgcaggttctgagggcctgtgcctgcggcggtggaatagtgcgggccgccaccgcgacgtgcttccgcgcctgcgctgtgcgcttggcgaacgcggccacctgcatgttcagcacggccaaatggtcgatgaccgggtacttggatgcatggcgcccggctgtggccgtgcaaacctctgggaatggggcgcgagagcagatgccggcaaccagcgggttgacggcaccgccgccatgcaccttgcccttgccgttccctaacgcctgcgggaagaggccggcagacaacaacgccacgagggcgaggaggacaagccgtgggtaggcttgccccatagtttattctgttaggtaaattgcgcggcccggccgggccccccgaatcccacccccccgtgggggg

SEQ ID NO: 21732 - DNA, 794 bp, Zea mays
cggtaccggcatatcccgggtcgcccagcgtccgccccgcgtccgcccagcgtccgcccagcgtccgctttcagctccatagcgaaacattcttcagagataatgagagtgaggtcctgagggatctgtcatcaatgcatcggttggttgttgcaaccggaggtggtgcagtgatccgaccaatcaattggagttacatgaagaaagggctgaccgtatggttagatgtcccactggatgcacttgcaagaagaattgctgctgtaggaaccgcgtctcgaccactcttgcatcaggaatctggtgatccttatgcaaaggcttatgcaaaacttacatcactttttgagcaaagaatggactcgtatgctaatgctgatgccagagtttcacttgaacatattgcattaaaacaaggccataatgatgtcactatacttacacctagtaccatcgccattgaggcattgctaaagatggaaagttttcttaccgaaaagaccatggtcagaaactgacctctcgtatgagagggaaaggatgctgacaacatgtggcccttgtttgtttaattgtacatatacctttgcataaactctttctacagtgttgttggattattgttcgtgcagcatgaaagaggaccgtttgagtttgtatttatgcaaatgaataagtaaataattttcagttaaaacaaaaaaaaaaaaaaaaaaaaaaccataaaggcccgaggcggacattagggcaaaaaaaaataaatcttgtgactgggccaattctccctataggga

SEQ ID NO: 21733 - DNA, 609 bp, Zea mays
gcccacagcaaacaaacccacccgcgagtcacgagtcacgaccgcttcggccttgcctgtgtataaaacgcccgcaagccaccaaacgccgcctactgattcctgaacacaccctcgtctccgcacggaggccgtcctctcctctcctctcctctgcgtccgccactgccgcccaccgctcgcccacgcgcgctccattacctcggcgggcgatggccgacctatccaacaccggctccacctaacacgagcagcgcccccgcctaggcggctggctggtcggtcgtcgagcagctagcggcggcagcgcccggaggccgtctcactctcctcgtcggggcggcaggagatggaggccatcgtgggcgtccgcgcgccgccgcgtggccgtgcctgggccggcctcgagaagccgccgcgcgccgcttgctgcgccagagtcccgacggcgaggctcgcggtcgcggcggacaggccgcggaggctggtgctgctgggcgccgatacgcggagggccgcggattatcctgccctccgttgcgccgcgcaatctgcaggaatgatggggtcaggcaaaactacagttgacgctctcatactacagcaaaa

SEQ ID NO: 21734 - DNA, 1506 bp, Zea mays
tgggtacctcgaggccggccgggctcctgaacacaccacccctcgtctccccacggaggccgtcctctcctctcctctgcgtccgccactgcccaccgctcgcccgcgcgcgctccattacctcggcgggcgatggccgacctatccaacaccggctccacctaacacgagcagcgcccccgcctaggcggcagctggctggtcggtcgtcgagcagctagcggcggcagcgcccggagggaggccgtctcactctcctcgtcggggcggcaggagatggaggccatcgtgggcgtccgcgcgccgccgcgtggccgtgcctgggccggcctcgagaagccgccgcgcgccgcttgctgcgccagagtcccgacggcgaggctcgcggtcgcggcggacaggccgcggaggctggtgctgctgggcgccgatacgcggagggccgcggatcctgccctccgttgcgccgcgcaatctgcaggaacaggaaaggtccactactctgctgatgacgctctcatactacagcaaaaagcccaggatgttctgccttacttggatggccgttgcgtttatcttgttggaatgatgggttcaggcaaaactacagttgggaagatactatccgaagtgttaggttattcgttcttcgacagtgataagttggtagagaaggctgttggtatttcatctgttgctgagatctttcagctccatagcgaaacattcttcagagataatgagagtgaggtcctgagggatctgtcatcaatgcatcggttggttgttgcaaccggaggtggtgcagtgatccgaccaatcaattggagttacatgaagaaagggctgaccgtatggttagatgtcccactggatgcacttgcaagaagaatcgctgctgtaggaaccgcgtctcgaccactcttgcatcaggaatccggtgatccttatgcaaaggcttatgcaaaacttacgtcactttttgagcaaagaatggactcgtatgctaatgctgatgccagagtttcacttgaacatattgcattaaaacaaggccataatgatgtcactatacttacacctagtaccatcgccattgaggcattgctaaagatggaaagttttcttaccgagaagaccatggtcagaaactgacctcttgaatgagagggaaaggatgctgacaacatgtggcccttgtttgtttaattgtacatatacctttgcattattgcctaaactctttctacagtgttgttggattattgtttgtgcagcatgaaagaggaccgtttgagtttgtatttatgcaaatgaataagtaaataactttcagttaaaacaatgacaattcgttatttatcgcaaaaaaaaaaaaaaaaggacattagggcattagcatggtactgtcatttcaatattcactatgtcagatatcagatggtgaaacaagaaaatgacatgaatccatgctttcgaggcaaattgcattacagaattatttct

SEQ ID NO: 21735 - DNA, 1825 bp, Zea mays
  misc_feature (4)..(4): n is a, c, g, or t
gcangagaccattacgttcctcaggcactctctctccttccccgtccctgtcgccatctatcactttccccgtttgcgttttggcccgaatctccgtctccgtctccgtctccatctccatctcctagccgccgcggctccactcctcagtcctcagtccgaagcgaactctccctccgcatccactgccaccatgagccgcgatcgctacttccaccgcctcctcgacctccacctccacgccaacgacgacctcttcttccccttccctacccctgcctcgtcctgcccctacatcaccgcctcctccgcccaccaccgcttcctcctcgacgaccaccccttctacccaacctcctgcccgctcggcatcacctcccgctccccgatcgacgacaccttcgacctcgacctcctcctccccctccccctccacgccgccgtctccgcgcccccgtgcgcggccttcgacttcgaccccttcctcctcgacaccctcggccaccgcatctccgtcctcgagcgcgcgctcgccctcgccccaccccgccgcaagtacacctacgccgccgaggccaacggcaggaagctcaagtggaccgccgaggacaggcccgccgggggccgcaacctcaagtgggaggccgagctcaggaccccgcacaccgacggcttcgaccgcaagtggaagtgggagtccaaggagtccgccaccggttccaccaaggtcaagtgggccaaggagatcaaggggaagggctgcctcgagccttggtccaactcctactccgtcgaggagacctacggtgaggatgaccatgccgacgacgacagggagaagaagaaacccactggcgtccagaagaaagtcaagggggaaaacaagcagcagcagaagaagcagggcaatgtggagatcgtcgagatcgaggacaacactgccggatgcgtcgccatcagaaaggcttttgaaatgaaccactgcaagggcaagaggaaggaactttccccacaggatgccgcactgctcatccagatgaactacagggcgcacctggcccatcgctcccaggtgctccgttgccttcgcgacctcgccgtcgccaaggccaagctcaaggagatcaggtccttcttctacaacatcacataccgccgccgcatcgcatatgacaatgaagagcgccagaggtttgctgagaagatcattgtcctgctactgacagttgatgcccttgagggaccggactacatggtccgcaacgcaaggaggtccatgctggaggagctggaggggatgctggagatcgtggagcctcagccgccggggaagccgaggacgcttagccgcaggaggttcgatctcccagaaggcggagccatcgaaaaggagacgagggaggagggcaagtgaagtgcatcggtgggtggtggcatgcttgggcagtttggtatgcgcgatgcggactatagagtttgagtttgtgctgctaccgaaccgtggaccaccttaccccgttgagatgtttgatagctggactttttgtgctgttgtatttgtagaccagaacgttgttctttgtaataaattggcgtgtgctgctttttgctaatattcgcttggctttaatctgtaccgtgttctactacctgaacaatgtttttttctcggtggactgaagtatcagtttgaatagctagctttaatttgaagcgaacaggctttgtacttttgaattctggcatcttgaatgaattttcttgaagtaccataaaaaaaaaaaaaaaaaaaaaaaaaaaaaaaaactcgagagggggccggtcc

SEQ ID NO: 21736 - DNA, 1688 bp, Zea mays
  misc_feature (762)..(862): n is a, c, g, or t
cccctgattctcttccagtagctgcacaccatgggacgggatgggggctatgggggcaaacagctagccaacacatgggaactggtacgtacgtgttgagtgagcaaaaaaaggacttccgtctcgacttgccacactcgttcagaaagaatgaccacatgacccttgtgtcctgtgagaactagcacacaaaagactgaatgctgagttcattccatcttatccctcggcatttcagaaaacagatactaacacaagcgtcaagcgaggctgttgtgaactagtataagctgtgacaaaaaaaaaaccctactaccatttattgccctctgaatttgacacaggtctatacttgagaagagtgatagaacgtggtcgaatgccagattctaggccaaattcatgaactagattctaactccaaccaaatgaaagaatccgaacagaccgacagagattaatcttttatttgacctagtgtttctcgctacttccacactgaatcgctgaggaatcggagtgcagggacgcctttcacctccatatcaaggagcggagcctggatcagcttcaggccgccgagttctcggtcctccagtatcgcacggaaggcacgtgcttcttccctccgttttgcagcacagaatctgcagtccgacgcagacggtggcaacacctgatttatgacgagccttcttgtgtgtgcaccatccttctttaatgactcgtgaaaccttgatgactcagtaactgccatcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattgcacgtcctcaaggttcatattaaacgatggcatggacgaagccacttttatgcccttaatgctcaaagtaaggaacatttcaatccaatcagaagctgacagaagcttaagtgtatgtccagtggatggagcatccagcactaaacgccgaagtatatcggcctcttgcacgtcaatagattttatcacctttgatagtacaagcgcttcttcaagtccagggggcattccatccagcatctctctaatcatagacataatatcagaatgtgttccaagccccatctttccaagtaaattgttgataaaagatccaagatcttcaggttctccctttatcttgaactgaccagcctcaactgcaaaaagagagtcaaatccagtgatgcgtacagttttgccgccaacacccatgtcttgttcaaataaatcaccgagtgacggagatggttccgtcgaaacaatagctgttggttcaccatggttggcaaacttcacagcaagcgacgccgccatgcttgttttccccacaccacctttgcctccaaatacatagcacctccgtgtagaggcaagcatctcgctgaatcctccactcgcatccaccaaactggaattgtgtctttgctgcaagttccggtgatacacgaggggcagcacgggcttctctaccgccggtgcagagatccggcggcaggcgaaggcggcgagtcggcggtatatagggtttatgagcgccgccattttgttccggctcagggttctgtcctttctgtttaagtaggagaacagatgttttgcccggccggcccgagggtac

SEQ ID NO: 21737 - DNA, 684 bp, Zea mays
aacacaagcgtcaagcgagggttatccattggtgtgctgttgtgaactagtataagctgtgaccaaaaaaaaaaaaactactaccatttcttgccctctgaatttgacacaggtctatacttgagaagagtgatagaacgtggtcgaatgccagattctaggccaaattcatgaactagattctaactccaaccaaatgaaagaatccgaacagaccgacagagattaatcttttatttgacctagtgtttctcgctacttccacactgaatcgctgaggaatcggagtgcagggacgcctttcacctccatatcaaggagcggagcctggatcagcttcaggccgccgagttctcggtcctccagtatcgcacggaaggcacgtgcttcttccctccgttttgcagcacagaatctgcagtccgacgcagacggtggcaacacctgatttatgacgagccttcttgtgtgtgcaccatccttctttaatgactcgtgaaaccttgatgactcagtaactgccatcatcgttggaattgtcacgacgatgaattctgttgattgtggatcaaacaaaatctcacgcactctgcgaacctgctgccttagttcctctagcctggcagagatgaattgcacgtcctcaagatacatattaaacgatggcatggaccccaacaaaat

SEQ ID NO: 21738 - DNA, 1930 bp, Zea mays
aaagcatcactactttaatctaatcaaatttggatgactagaactaggatgcatggatatctatggggaacaaaccattccattttactttcatttcatgtggtaaagaaggatgtacagaactcgtataacaaaaaaggtatgatatataaactggacaaaagcatctgtgtcaggacagcattaatctgccctcagtcatccatctttccatctctattgcattgtccaaacagcgaaagaattaccattttagcaattgataaggctaattaactggtgtatgaactgccaaccaatatctcaaatactgaaagtaaacactacactgttgatgccaacgtttgttgtcatagctaattaaataaatagcacgaagtgaagtaatataataaccatttagggtgttcagatgcatcactaaaattcaccatggcaatactaaatttgaagaacttggattcttaaaatcgtagctgaagataacagaatcaggataaacgttccagtttcatattactaatgcaagcatgctaatccagacgatgataatgctattggaaaatgggcagactaacgctagtttcacgaaaagacttacatgctgtatcaatttcaaggaacacataacagccatagttaaaaaatgggtgcattgcagtaattcctgccagtaaaaaaaggtatgaattttaaccagcagggtatcagaatacacgcacctgaaagtcattgtcaacctagcttcatattttccaactttgtcgcaacgctagcagtgttgtcaacttgctgcatatctacattcgtttgatcctttttgtaatcacctccaccattaatttcatgctgaaaagaagtggctggaccaccataaccagctctatgtataatgttatacaccggatacatttgagggtatgttccataggccggaggaccccgcctaggccccatgccaggaatgtttggcatgacgccttgacctgggtatccactcccatagggatagccccccgcagcaaaatagggggcaggaaagtagggatgtgtgggagcaggttggggcatgtagccattgtaggggccagatctagcattgtatgtttggtacatgaaccctccatagccaggagcggcaggatccctcccgccaaaggagcgtgcgccacgccctctgttgcggtaatactgctcgtccttggggatagcaatcttggcctctaccttggtcccgttcaagtcgtgaaagctctgccgcatcaccttccctactgcttcctccgaatcaaaggtgacgaagccgaaccccctcgaccggttcgttgcgctgtcatatatcaccgcgacatcccttacagtgccaaacgtctcaaagtaggcccggaactcctcctcagtggtggtcatcctgcagtccgccaacgaagaccttttttgaaccgtagttcacgttgtcaccactgtccgcggtgccgttccccatggggtactgattgtcctggttcccctggtctaagccttgttcgacctgatgaggctgggagtgctgctcgcgctggtttcgtggagctcttgccctggccctcttaacgtccaccgcgcgcccgcagaggaagtgcctgggcctgtccgcgtcgcccagcgcggcggcggcggcggcggctgccttgtcctcaaactcgacgaagccgaagccccggccgtggcccgtctccctgtcgcgcatgacgacgacggagcgcacctcgccgaagcgcgcgaagtgggcccgcaggtctgcctcctgcgccccggccgggatcccgccgacgaagagcttgcggctctcggcagcatcctccatcgccgccgacagacagagagatagagagagcgctagggttttgcgggaggggagcctagccgcccggggtgggccgcgggtgct

SEQ ID NO: 21739 - DNA, 1534 bp, Zea mays
ggcccttggggacgagcaaagcagtcgattagggtcgattctggattgtctgattaagatacattaaacggtcgtaagaatttaacattggtacaagaggagaggagaggagaggggaggtgaggtcaacagccagccagcgactcgcatgctttctgttttacaggcagtggggataggaacggtacgtaagtttgaagaattctaatgatgtacttgtcaaccaaagaatctctcagctcaaagtcttcacagttgcgggttcccaaacaatagactactccagtgtcatcgttgtagaagtaatagtcctgaaagtcattgtcaacctagcttcatattttccaactttgtcgcaacgctagcagtgttgtcaacttgctgcatatctacattcgtttgatcctttttgtaatcacctccaccattaatttcatgctgaaaagaagtggctggaccaccataaccagctctatgtataatgttatacaccggatacatttgagggtatgttccataggccggaggaccccgcctaggccccatgccaggaatgtttggcatgacgccttgacctgggtatccactcccatagggatagccccccgcagcaaaatagggggcaggaaagtagggatgtgtgggagcaggttggggcatgtagccattgtaggggccagatctagcattgtatgtttggtacatgaaccctccatagccaggagcagcaggatccctcccgccaaagggacgagtgccacggcctcctctgttacggtaatactgctcatccttggggatagcaatcttggcctctaccttggtcccgttcaggtcgtgaaagctctgccgcatcaccttccccactgcttcctccgaatcaaaggtgacgaaaccgaaccccctcgaccggctcgtcgcgctgtcataaatcaccacgacgtccgttaccgtgccaaacgtctcaaagtaagcccggaactccttctcggtgatattatcccgcaaaccgccaatgaataccttttttgaatcatagctcacactgttgccacagtcagcggtaccattaccagcgggcgcctgattgtcttggttcccctgaccccggccttgctcagcctgctgaggctgcgagtgctgctcgccctggtttcgtggagctcttgtcctggccctcttaacgtccaccatgcggccgcagaggaagtgcttgagcttctccccgtcgccgagcgcggtgccagcggcagcctcgtcctcaaactcgacgaagccgaacccccggccgtggcccgtctctcggtcgcgcatcacgatgacggagcgcacctccccaaagcgcgaaaagtgggcccgcagctcgggctcctgcgccccggccgggatcccgcccacgaaaagcttccggctctcgccggcctcctcctcgccccccgccgccgccatcgccgcgaacagagggagacagaggtagagagcgctagggttttgcggggagcgggaggggggttgctggcgccgcgcgggcggc

SEQ ID NO: 21740 - DNA, 3391 bp, Zea mays
  misc_feature (3281)..(3281): n is a, c, g, or t
ggacccccctgatcgttcaaaatccccccgcccgccccccccgggttgcgccacttgtccttgaggtcaacattggagcggaggcgcaggagcgcgctgaagtccgagtcccggaggatggtgcgccacttgccgggcccgtgcttggcgacgccggccttgagcgcggcctcttcctccggcgtccagcgctgcttcggcacccccatcagcagcaaatcgagaagaccaagggacccccaccggagaatccaaccgcctcagacgtgcgcgcgcgcgcgtgtgagagagtttggtggtcggaggcgcacgcagagaggcggttcggcccggaattccacgcggaattccggtgcaggatccggggcgggcgtgtcagggggcgaccagggacatgggaatcctaaagaggggcggcggcgagggttctagggcaagtaggcaacgcagtggcgtgagatggagaggaagccattaggcttgttttgttgtcgggtaggagaggaccaagaaaggtatcaaaagggtgtaacacgtataccattagacagacctcatgcataacaagaaagttaggagaaagcctggtccactgtcattagaactgtgtagcaaagatagccatcagtgagaactgtgtagcaagatttcttcaaattttcctcgcttttttcagggctgttctccagaccatgggatgggatgggcccgctctctgcaaagcaagcatacctcagatggagatatcagttataaaaccaactcacataacaagaactgcccgtgttgtgtacatactgctgccccgtgttcattcggtttacaaactacgctgtcgacttgtatgtatgcgattttgaaattacatatgcaaagcgtagagaaaaataattaaaaaaacggaaaatgagctgcggaattgctgagcgggtatgccgcccgccacctagctactacgacgacgacacgaggtgcgcatagagcatctggttccagacgtcgggaacgccggggaggcaccagtggatgcagtcggcgccgctgctggggtcgcgcgccctcgcttccagctccgccgccgtgggcgggctccactgccgccggtgcacggacgggtgcgcgtccttgcggtgctccgacagcggcgtcacgttgagcacccgcacggcgacgccgcgcgcgcccagccgcgccacctgcgcctccaccgcgcgcgcgaacgccgggtccgtgtcccgcccgcggtgcccctccgccgtgatcggctccatttcgccgtagcatcggtggttgccggcgccgctcccggacccggccgcctcctcccactcgtcggagtggaggtgcgtcggagaaatgctcgtgaagaagagcccggtgcgggcgcggtcgacgtggcgctccagccactccgaccacgtcttcatcgacatctcgaacgcgcgcaggctgtcggtcacctcgtacgccgccgccgccgccgcctcgaacgaacccctcctgcacgcacaccgccaccgaacgcatgcacagtcagcgtgcgcgttagccgttagccagccagacagacagacagaacacacacactcacaggactttcatgctcgggcggcgccaccagaggtaggagttgaagacgagcacgtcggcgtcgccccagtgcctggcgtgcttgtcgatggagccggcgcgcacgacgcggtcggccacccggtggtgaaccggatggtccgagttcgattccactagcagcggcgaccagtagaagtccaccgacgcgttgtactcctgcagcgcaacgccgaatgtgacggcgtcactcactcactcactcatccaatccatatgcagcacgccaagccaagatgtgcacgtacatggatcctgaaggaaacgagggagctgtcgttgccgccggccatggacttatgcagcatcggggtggcggtgtcgatgaggcagaccatggatatccactggttccggttcagcgagtcgccgacgaaggccaggcgcttgccgcgcagcctctcgagcagcttcaccgcgtcgaacctgcacatagagtcccggccgggcgggcggtatatattatccatctgaccgagctagcaggaaacacgtgagctcctcatacgcatgcggcgcgcacctgggaagatcgcagccgtgcggctgccacctccagtgctggtacttgcgattcgtcctcccgaacttgccgcacgccgactggtccgacatgaacttgcacgcgctctcctcgtacagcgggtacgcagcgccgtcgtacacccaccggccggacgacatgttgcactcgccttgcccgccggcgcgggcgcgggcgccatccgcaggcggcggcgcggccgtcgtcgtcgtcgtctcccgctgcttggtggtggtggtggtggtggtgaccgaaatggcgaggacgacgaacaagacgagcagcagcagcacgaacgagttgaagtggccgtggtggccgcgggtgccgaagctgacggtgacgacgccccacgccgcagccctcgcgtggagcttcttggccggcgccggcgcctccgccaccagccacgcctcctcaaggccgccgtcgccggccgtgctccggcccttccgcggcggggtgcacccggccatgatctcgacgtcgtcgatcgggccgaggccggaaatctgcagggttgccgccggttactcgcaagcactgggcagtgggcactactgcatatgcgcgatcaaatagcttgcatgcatggtataagtaagtttccttctaggtgaggctgagagagttgttgccccttgacctcgtaggttttggtgcacctatcgacgcctcaatcccactccaaaccatggcgcgaaaacgtacctgctgtagctctgtgcgtgtatatacaaacaccgaagacgatgaggagaggttagatgaggagaggttagggagtggttttgaccaaattaatacatgatgaacagctgaaagccagtatagtgccagtagtgcatctgcaaagtcagagctgccccatctggctacttagtggctggcatgcgaaggtctataataaacttttggagaactctatgtggagcagatgacatgtaattaacgactagcgcatttctgggctctggtgaggcctccgccccttcagtacttgctactagcactatctgcaagagactgattgtggatcagtagctgggaagtagcattcactcacgaactttaagctagctttgtttatagaattacagtgcatatntacatagcaatacgtgtcacgtccgattagttagggtttccgttgtgtattcctttctgtgaagaaataaggtgtctcttcactgccatcacgaagtacagataagaaaa

SEQ ID NO: 21741 - DNA, 1680 bp, Zea mays
ggaatgtaatttttttttttttttttagctaatcatatctagaaacatactatcacagcaaattgaataactaaggtggctatctgacattttcttttcactacagttgttctactagacgacacaatttcaaataactaaacgaaaaggctagagtttaattacaaagcaacacaatggggagaaaacaaaagtaaatgaagactactttcaagataactcttgttatcatattgtcgattgtctaaaggctgcaacgacaaaggaccaacagcaagatgttaaaaacccctccagttgatgcgtcgtgatctataaataaggctatacaagaaactcatatatccagaaaatctttgcagcagaaacaccggtgtgctgctggccaaaaccatatgaccgcatgggtaaaggatcagcaagctcgaagcatcatggaagcagcattcctgtttctcattgataaagtgacagcatcaagaaaagcctttgcagcttcagcatcattttctgcagcctctgcaactcttgctgcttcctcagcttccgctattgctacttctgcctcagcaactgccttggcagcaaaggcagctgcctcttccttggtcatgcctttcatcttctccagctcagcaatcacttgatgcttagttagccgtttagcattattattttctgccttcatgccttcagcagaggataccttagtgcctattctgcccgaggggggtggacttggtgcaattctgtacttttggtttaccttgattaattttccggaattaaccaatgccttcagttttgtagatagcaggcgctgaaaatcagcaggtggccagtattggtcctcaatgtatgcagcaatggctgccttactggacccagaaggctccttaagcttccttatagcttctaatatgagatcatcgagcctagcaactgacttatctggactttcctcagttggcaaggactcgaaagccattgctaaaggttccacatcaatggctgtgtcatgagcgtcatccatattcttcacatctacatccattggctcagcagtaagcttaggcaccacgcgtctacctttcttcaacgccatccttgccttctctctagacccataacctcctgcagtgacgctcaagttgcgccacttgtccttgaggtcaacattggagcggaggcgcaggagcgcgctgaagtccgagtctcggaggatggtgcgccacttgccgggcccgtgcttggcgacgccggccttgagagcggcctcttcctccggcgtccagcgctgcttcggcgcccccatccacacacagcaaatcgagaccaaggaaccccaccagaggatccaaccgcctcaggcgtgcgttcgcgcggcgtgagaatttcttgatcaggggagcacgcagggaggcggttcgatttcgatcgggtccggaattccacacggaattccggtgcaggatccgggcgggcgtgccagggggcgatcggggcgggcgtgccagggggcgatcggggacacggtaatcctaaagaggggcggcggcgaaggttctagggcagcgcagtggcgtgagatggagaggaactgaggaagccattacccattaggcttgttttgttgttgggtggagaggtggcggagccggccggcctcgagggtcccaa

SEQ ID NO: 21742 - DNA, 1570 bp, Zea mays
  misc_feature (1566)..(1566): n is a, c, g, or t
tttttttttttttttttaatcttaaacgctgtcaccatataatcatttctgcaaaaatactatcacagcaatttgcattaactaaggcggctttctgacattttcttttcactacagttgttctattagacgacatcacttcatcaactaatgaagggaaaaggctatagtttaattacaaagcaacacaatgggaaacaaaaaaaaatgaagactactttctcgatcattcttgttatcatgttgtcgattggctgcacagcacaggacaacagcaagctgttgaaaacccgccatgatctataaggctatacaagaaactcgtctatccagaaaatctttgcagcagaacatcggtgtgctgcatgggtaaaggatcagcaagctcgaagtatcatggaagcagcgttcctgtttctcattgacaaaatgacagcatcaagaaaagcctttgcagcttcagcatcattttctgcagcctctgcaactcttgctgcttcctcagcttctgccattgctacttctgcctcggcaactgccttggcagcaaaggcagcagcctcttccctggtcatgcctttcatcttctccagttcagcaaccacttgaggcttagttagccgtttaacattattattttctgtgttcatcccttcagaagaggataccttagtgcttattccgcccaaggaagaacttggtgcaattctgtacttttggtttaccttgattaattttccagaattaaccaatgacttcaattttgtagatagcaggtattgaaaatcagcaggcggccagtattggtcctcaatatatccagaaatgactgccttattggacccagatggctcgttaagcttccttatagcttctactatgagatcatcgagcctagcaactgacttatctgggctttccaaaaaaggcaagggctcgaaagccattgctaacggttccacatcaatgactgtgtcatgagcgttgtccatatccttctcatctacatccattggctcagcagtaagcttaggcaccacgcgcctgcctttcttcaacgccatccttgccttctctctagacccgtaacctcctgcggtgacgctcaagttgcgccacttgtccttgaggtcaacattggagcggaggcgcaggagcgcgctgaagtccgagtcccggaggatggtgcgccacttgccgggcccgtgcttggcgacgccggccttgagcgcggcctcttcctccggcgtccagcgctgcttcggcacccccatcagcagcaaatcgagaccaagggacccccaccggagaatccaaccgcctcagacgtgcgcgcgcgcgcgtgtgagagagtttggtggtcggaggcgcacgcagagaggcggttcggcccggaattccacgcggaattccggtgcaggatccggggagggcgtgtcagggggcgaccagggacatgggaatcctaaagaggggcggcggcgagggttctagggcaagtaggcaacgcagtggcgtgagatggagaggaagccattaggcttgttttgttgttgggtgcccggncaag

SEQ ID NO: 21743 - DNA, 5767 bp, Zea mays
  misc_feature (4033)..(4033): n is a, c, g, or t
  misc_feature (4117)..(4117): n is a, c, g, or t
  misc_feature (4154)..(4154): n is a, c, g, or t
  misc_feature (5088)..(5088): n is a, c, g, or t
  misc_feature (5106)..(5106): n is a, c, g, or t
  misc_feature (5571)..(5571): n is a, c, g, or t
ctgttggagtcagcctaaagacctatttagttcataatttatttaactttttctgtctaagattagttgttcaatttgatcgattaacttcacagaagttatagcaaaattagccaaaaaccaaacaaaagttacataagaatacacaagcccctttgtttcgacttctggatgaattctggccatcgaaatcggtttcagacaaccaaacacttcacttcttagcacttttctatgaaaattgacaattcaatttgaatgcaaactccaagttgtcactatgtgagaaaaactatcgctatgtttatcttcctccacatgtaagcccctttctcatattcttgtgacagctagattatttagaaatttaaattttcatagaacccctttagaaaaaagctatcccaaacatgtccatagctatgagaaacgagacatcatttgtgctgaacttttttgtacttttgttggtgtcccgagccgaatttgtaaatcttacatgcttttcttaaaagaggtaatctctatagaaaaaaacgaaacagcaggaatgtaatcttaaacgctgtcattagctaatcatatctagaaacatactatcacagcaaattgaataactaaggtggctatctaacattttcttcattttcttttcactacagttctactagacgacaccatttcaactaactaaacgaaaaggctagagtttaattacaaagcaacacaatgggaagaaaacaaaaataaatgaagactactttcacgataattcttgttatcatattgtcgattgtctaaaggctgcaacgacaaaggaccaacagcaagatgttgaaaacccctccagttgatgcgtcgtgatctataaataaggctatacaagaaactcatatatccagaaaatctttgcagcagaaacaccggtgtgctgctggccaaaaccatatgaccgcatgggtaaaggatcagcaagctcgaagcatctgcattcatccaaaggtgttatcagtcaaagagtttatgtaccagctatatactaacaaaggctgggttcactataccatggaagcagcattcctgtttctcattgataaagggacagcatcaagaaaaagcctttgcagcttcagcatcattttctgcagcctctgcaactcttgctgcttcctcagcttctgctattgctacttctgcctcagcaactgccttggcagcaaaggcagctgcctcttccttggtcatgcctttcatcttctccagctcagcaatcacttgatgcttagttagccgtttagcattattattttctgccttcatcccttcagcagaggataccttagtgcctattctgcccgaggggggtggacttggtgcaattctgtacttttggtttacctacaatcatgattcaaatagtatgcagcttgaagtctgtccccactattattcctaaaaagacaacccagggaaggagggagggagagaccttgattaattttccggaattaaccaatgccttcagttttgtagatagcaggcgctgaaaatcagcaggtggccagtattggtcctaaatatatagacaatttaagttaaatccatcggcaaaagaaaaatcactatagcattgtctcaagttagcaaaaaatcagcagagattcttcatacaaaaggatgagacaaatattcccattacaggcagcagtgaccagaaaagaaatagcagggcagctgacttaagttaaacaaaacacaacaagtgagcacactataaattgatatccacaaacctcaatgtatgcagcaatggctgccttactgggcccagaaggctccttaagcttccttatagcttctaatatgagatcatcgagcctggaaaaatcagacatacataaagtcacatggatgaccaagcatcaagaggatatgctaacatagttaaataaactaaataataaggcaaccgctgaagagatatgctaacatagttaaataaactaaataataaggcaacctctgtaagaaattgaacattagaaagggcacacattggaactcagaggatgtatgtgtcaacattatattccaattcacaacaaacagtttccttttttgtttacttgaaaactgtggtacagagtcgagatgtactgcagacaccataggaacaaataaagacactacccgaacatctcaatagagcacagaccataaaggaggcaaaaatgttaaaactgttatgcagtatcagaagatgaataatacatgtggatacatccaataatgtcccgaagttggctttactgaacgtaatcaactgacatgtgttgcatactacaaatagcaagatatatatgtttgttgcttaatccttgttacacataatcacaggggttagggtcgggcacgttctgcatccccaggacatcatcccaaatcaagggttgggtcaagcaagattgttatgactggtgtcatctaagacattagggtcaccatgcagacaattaggaatgaaacgtcaaactttgactgacaatttgtcgtagactatgacgcttcgcaagcaagtttcggcaccgttctccaccaagggctggtcccctagccatcttcagctgacccttcaccgctcttcatcacaagctagctgcatatgagtgtgaactcattggtctggttcaggctgtgcagcattggcggccatacctctagagtcgctgcttcctcgcctgcaccgaccactacagcctcaagccctcaagttcctcttggaccagcgactcaactattccccaacactagttgatcagcaagttgtctggcttcgatttcgcagtagagtaccgccccggtcgcctcaactcggtgatgaaagccctcatgctgcaacaccgacaccaccgaggacttcacagagctgcacaccctctttgggccctcgttccatgtacttaaccagatctgttgtaacaccctaattttttaatcaacatttttttttgaaaatttggtttaacttgataagatttgagtggtctagaatcacgcattatggttttatattttttatcaactaaaacagatcataagtgtgaacttggtgtggtagtgtgttgcattcataccgctgtataatgtttttaagtacaaaaggtgtttgaaacatgttaacataccccgtagaagtctccgataatttttcgtatttttccgagtatttttcttttttccaaaaataaaaaactatttatttgaggcacttaaaacatttttgtaggctctaaatgtcatggggcggcaacctagggcatggaggcccatagagataggctcagggttaggattagtggataaatattatattagaagattgagttagttacttgggattagattagggcatcacacctatgactcttaggacgtgggacgccatcccatgctgggcacacgctccacgctccgactagcatgcttgtgtccatagtagcacggttggtagtcagtgacagagcgaacaatggacgcaaagccaccggcattggacatcgtcgtgtatccctaaccggacgtcggtgtcaccacctcgtatcaatgggcaatagctgccgcaggtggggactggtgactcgggagctggttagttggtggcttggtgcgaatggcagcttgcagctgccacaactcgggcgctcggcggctgctagagtacaaaggcgtatggacacagaccaatggagtgatgtagacagacgctggcagcttgtgttgttgtgcaaataacccgtggcccgcgactagggttccaaattttggatggatggtcgagatttggtagactgaaatctaaaggtcatgtatatggcatggcattatttgtaagatttgaacttgttattttagtttcgttgccagttgcgtcaacccaaaattctcgggaacatgttcctcgttctagtatattgttccagactgtcatggttctcgtttcacttgtcgaaaaaacaatacaacaaggtgtacncccttcataccatggttctaaaaaataatgttttgtattctgtgttcccattccaagaacatggcttcttagctcaagttgttntgtgggaccccaggtgactccttcgcctgtgccaccnatacaggatggtcgactactgcctaaagcagaccatgtgttgcgcccaactacgccagggcacttggcatgtcattcaatggtgtggcggcgactgacaccacttaggagctgcttcagcaattcaaggacctctaccccgatatctagctcgagcgagttgttcagagaggcgaggagatatcttataactggtgtcacctatagatgttggggtcaccataaggacaattagaaacaaaatacaaaataatttcctttagatatttcacatttgtttccataaataagatcataattgattcttgattaggatcatgattgattcttgaatagggtcatgattgattcttgactaggaggtttccataaaaataagaatagcttacttagggctaaagtaagcatctctatataatgagagatgtatcaatctaagtaagcaagacaattatcttgcttggcctcaagggccatctaccacgtctctttctcgctcgcctactccttatgcgcgaccacagcatcggggtacacgctctagccatcgatcttccatacataaaacttacatagtcgcggtaggattccaaaacggcaaaacctatcaaaggtcaacaactcgattctgtctggatcaccactccactgcgacagtacaccacagatccaaagggctataatgaggtacagggagaggagaggacacgaagatgatgtgagtttatgttattgtgaatttgtgacatgagagacaactagagttgatcatggctaccaacaattgtggacatgacttcgccaatgaaactaggagcacaaaagagaagagaacattgcaggcaatcaatttcactactgcctagtgtgagatgttggctagcagtggttgattcgtgactagcggcatcaggttgcctgagtagagagaaagngaggaacaagaaaggacnaaggctgcatgatcgagcatgactatcacaccacacaattattaggtggttagcgtgttggatttgtattatttgtattgaccttttgtaactatttgtgcatgtcatcgaccccaaatcaaattatcaacccagattgattgggttccatcgttccatacaaccaccttcaactcatgtttttagacactgatgaccctccctgctccaataagattttttgtgactggcttaaacatagagcttgtccagcttctatagtaagagtatcagtcaggtcaacatttattaatatgttctcttttaatgactctgcacatagctcaccattgtcgcactagccataagagtttaacatgtgcatagcctcctgtttcaattacgatgaccatataacttcatttccgatgcacagttaccatcaactcagagacaaggtccctccattcagttttagcgagcacntttatttgggaacaaagacaaaaaaaaacttgctaatctgactaaagtgacccaagtaactacacattactactgtgtacatacatgaacacaacaaagagtcattcacactggttgcatgcataaatgctcaccgtagctattactactctgttgctttggtacaaacaaattgagttggggagaaaaaaacaat

SEQ ID NO: 21744 - DNA, 1903 bp, Zea mays
ttttttttttttttttcctgaaatgctccgagtagctgcttgtaatagccctcgtttcttttttttttttttttttttgcaaaatactgtgttttatgaatctcttcagaaagattctagtacactagttacaacagaaacttctcagaatgcactaaataaatattaagccacacaaaaaggattcgactgcagtcgttttcaatccagcacatctggtatcttgcaggattttagttctaacttagaagtttcaaagaacatacgctcaaatatagagaaataaaaatgatctctgaaagcaaatcctagtaataaccaaggtcttagtttcaccggatgcatgtatattacgtataatattgacaagttgcactgcagggcaaaccgaacttcagcaatcttccagttctcttctcagctgctctcgatcatacgaaaaaggccgagagactaaaccacttctagattcttaagctgaagtaagacttggactcttccagcggtcattcagagttgagttggcctggtggaaacaagagtgagtaggttcggtgaaacctgaccatcttggttctacaggttagaagctgcaggctgcagcattgtccaaggaaaagcttctgggcatcacatcttgttgacccatacaacacaatggtagcgatcgaaggcgatgcacccgatagttctcttcagaagtgtagagttgaggaaacagcagcttaatgttcatcagtctcacagtgaatcacgacgcggtgtctattcggtcgtgctttcttttgttaggccgggagaaaaagcagaactgagcccaggtcttctttgtcttcatcggttgtgaccttgtggctttcttggcaacatattcagccatgtattgaacagcggcctgagctccctttaaagctacatctcttggtggcacttggagagggttctcttctgcgcggagcacacggagacgctgcaggtttccaaaagaatcaggaagcaccctaatctgattgttgcttatatccaactcttccagcatctcaaggttgccaatggaacgaggcagggattgcaggtcagcgaaattattcccgacgtttagtttgataagagaagtgacgaagcagaagttctcgggaatagactcgagctcattaaaacttgcatcgacccccttcggctcggggagagatgccattgttgttggaaggcccctatcccggtcggcccccacagagaggacctccagagactctagctttccgacggcctccgggagggccttgaggtggttgtatcctacccgcagttccaccagtgacacacaattgccgatagtgtatggcagctcatcaaggtcgtttgtctcggcgatcaacttcttcaggcgtgtaaggcttcctattgagtcggggagtgaggtaagatggtttgcactcacatcaagctcctcaagcttcaccagcctaccaagactggccggcaatgatgcaagctgattgcccctaaggtcgagatatatcaggttggaaagatccccaatcgactcgggaagctgagcaattctgttagcgtgaaggtcaagcttggccaaagaagaaagcatcccaattgcttccggcaaggccaagatccgattctccgaaatgtcaagggtgacaagtccagtgagctttccaattgaatcagggagccactcgatctggttcatgagtttgccttgcaggttgagatcgcgagcgcctttctttgcagccacttcaatcatgctagctagcttaatgagggtcaatttctggttgtcatctccatagccgccgtccacaggagtcgccacggagtttgcagaaactgctcctcgcggcatatggggccgccgcgccgccgccccgcggtcccgcac

SEQ ID NO: 21745 - DNA, 1225 bp, Zea mays
ttttttttttttttttttttttttttgtcaggaaaagcacatgatagtatatatatttgtctccagagtagtcgtcgtacgttaagctgcttgtccgcccattggcaagctaagggcagagacaagagcagcgtgcaaatctacaaaacaacaactcttaggacacgtctgcaacgtagaaactgctatagtagtctactgcaactgcaactacaagctaccagtacgtggtacctcgccggttaatacaagtccatatatatctctactaaccccaaggcgtggtacacgatcgagaggatcgagagccctcttggtcatcctcttctgaacgaaggctccatccagctcctcgctctcaaattaattaaacacggaaacacacacactcacacacaccggaagaagaacaaaggaacataattaaggtcgtcgcgttgtcgtcgtcgtcttcagtgcagctacgctggctgctgcagctagctactagatggcaggcagaatcgaagagggccagccccgcgcgcgcgcgcctgggcggcatggccgggtcaccggaggaggctccggatgatctcggcctgggggctgtcgttgtccatggtcgacatgagccccgacagccgttccgagaggtcgtccacctcccggtgcaggctcttgatgtaggcgcacgtctccttgagaagcttcgacgccgacgaccggctcgcgttccggcggcgtgaggactcagggaggagcgcctggagcttggagatgagctcgttgatctcgtcgtcgctgatcctgccacgtcgccccgacgacatatttccggcggcgacgacggcagtagcttgctcggagacaccagccgcgctcggaagctacagcccctggatcgtttcgtcctcgtcgtctctgcctcagcctctctcgcggctcgcctatttgtgcagtgtacgtgtgcgacctcgggtcaagagcaagcgtgcaaacggagataggagtgaacggccggagaacgaaaaagaaaaggtgagagagacctgaaaggatagggttttaatgcctgctaaaaccgggagctagctagctggtgaaactccggggagtgttgttactgtgtgtgtagtgtgcgagggagagagcacttgcactctggcagagagaagcgagtggtgagcggaggcaactgggaagcgatcgagaggtagaagcagattattgctaggggcgagtg

SEQ ID NO: 21746 - DNA, 1184 bp, Zea mays
ttttttttttttttttgtaaaagaactattgcaaaaaaaatgacggagggatggagtaaattaccaagttacatcaggatggagctaaagagaggaaaatcacgtgatagtgtatatatttgtctccaccagacagagtggtcgtcgttcagctccttgtccgccgcccattggcgtaacgccgtaagctaaggacgacgacagagacaagagcagcatgcaatctacagaacaacaacaactctttggacgcatccgcaatgtagaactgctacagtagtctactgcaaaactacaccctactaccagtagtctactgcaactacaacctaccagtacgtggtacctttagttggttaatagaagtccatacattatctctactctactaaccccccctggcgtggtacacgagaagatcgagtagagcacttttggtcgccttcttctgagcaagggctcttgctcttgaactaattcaacacggaaacaaacacgcacccgaaggaggaggaggaggagaaggaggagaacaaattaagaacaaaggaatacaattaaggtcgtcgccgtaacaaataaacgagcgaacaagcaagctcggccgtacgtcgtcgtcttctccttctccaatctcaagtgcacctgcgctggctgcggcagctagctagatggcaggcagcagaagagggcggccgcgcgcgccggacgaccggggcggcaagcggcatggctggaacctggactctggagtcaccggaggaggctccggatgatctcggcctgggggctgtcgttgtccatggtctccatgagccccgacagccgctccgagaggtcgtccacctcccggtgcaggctcttgacgtaggcgcacgtctccttcagaagcttcgacgccgacgaccggctcgcgttccggcggcgtgaggattccgggaggagagcctggagcttggagatcagctcgttgatctcgtcgtcgctgatcctgccacgtcggccgcccgacgacatatctccggccggcggcaacggtaggagcttcgctcggaagctacactacaccacctcgatcgctctggcttaattcctcttcgtcctcgtcggtcgtctctctcccgctgctcgcctatttatgcagtgtacgtgtgggagctcgtgtcaagactcttttcgattag

SEQ ID NO: 21747 - DNA, 1233 bp, Zea mays
tgtttctctggtgtcatatgctaaccaaccagatgtttcactggagtcaaatgctaaccaagtgaaagtttgcaggaacttaccttcattccagatctgaaaaggccatcgacaagtggtacttcttgacacaacacaacacgctacttcacataatttagttgcgcgccccaaatgagcaaaccaatggaaggaacaatcatccaaggtcatccgagctagaaattgtctgaagaacacgtctcattactaggataatgagatgctaggacctaactaggccttgtgcctcttggtctttgctttagaagctacaaaatcatcgtcgtcgtcgtcatcatctgtgtcatcacttgccttccttttcttctgagacttcagctttccagcactgtttgaaggcataactaacttctttgcagatgaaggcagtgtcttggctggagaagaaggaattctcttcgccacaattgctttgactggtgacttaaccttctgaccttgtttcttctcaaaacattttctagccacatccaccgggagcaaaccccattccatcaaccaggttgcagccatgtcactggtggggacctgctcatagagtgattcatagaatatcctcaatggatccctttcttcaggaggatcatgcttctgccctggcaaaccatacactttcctctctttcttaaccttctctccctttacaatggccaaggccaactttgcctcttctttgacacccactcgtttcttccttttcttgtcctccttgagatcttccaaatcttcatctttaatttttttaaccttgggtgtcttggcattacttccagcagcacctgcacttttcttctgcgccgttggttctttcttgactttcgaagaagccttcatattgctattgttgcctttctgcttctcgtttcccttcttagccctggaaagtgcgagcggaacgttgtccaagtcgtcgtcatcgtcctcctcctccttcttgaccttggaggcgctcgcattacccggtttcaaaaacatggaaagtgccacccccccgttgtccaaatcgtcgtcatcttcctcctcctcctcctccttcgggggcctcctcgcggcggcggcgtcctctccggccatcgctaactcgcgcggcgagggttcgcttcgctttccttgttatgctgcggtttctgttgcctatcccccgcacccggaaatcctcgtgccgaaata

SEQ ID NO: 21748 - DNA, 1509 bp, Zea mays
cctttggttttttgtttaggataagtgagtgcatgggatattttccctgcaaatacagtcatccaatcagatgtttcactggagtcaaatgctaaccaagtgaaagtttgcaggaacttcttgacacaacacaacacgctacttcacagaatttagttgtgcgcgccccaaatgagcaaaccaatggaaggaacaatcatccaaggtcatcccgagctagaaattgtctgaagaacacgtctcattactaggataatgagatgctaggacctaactaggccttgtgcctcttggtctttgctttagaagctacaaaatcatcgtcgtcgtcgtcgtcgtcggtgtcatcacttgccttccttttcttctgagacttcagctttccagcactgtttgaagccataactaacttctttgcagatgaaggcagtgtcttggctggagaagaaggaattctcttcgccgtaattgctttgactggtgacttaaccttctgaccttgtttcttctcaaaacattttctagccacatccaccgggagcaaaccccattccatcaaccaggttgcagccatgtcactggtggggacctgctcgtagagtgattcatagaatatcctcaatggatccctttcttcaggaggatcatgcttctgccctggcaaaccatacactttcctctctttcttaaccttctctccctttacaatggccaaggccaactttgcctcttctttgacaccgactcgtttcttccttttcttgtcctccttgagatcttccaaatcttcatctttaatttttttaaccttggatgtcttggcattacttccagcagcacctgcacttttcttctgcgccgttggcatgacaaaatcatcatcagaactgacttctttcttgactttcgaagaagccttcatattgctattgttgcctttctgcttctcgtttcccttcttagccctggaaagtgcgagcggaacgttgtccaagtcgtcgtcatcgtcctcctcctccttcttgaccttggaggcgctcgcattacccggtttcttggccctggaaagtgccagcggaacgttgtccaaatcgtcgtcatcttcctcctcctcctcctccttcgggggcctcctcgcggcggcggcgtcctctccggccatcgctaactcgcgcggcgagggttcgcttcgctttccttgttatgctgcggtttctgttgcctatcgcggggaagaggaaatactgaggcagggccacggcccgcgactccgtccggactccggagcctgaagacgagcatggcgcggctcggcgaaccggcccatatagaaacgatcctgtaatgggcccccttcggacccacagaggtgcttaattatggtcagtggaccagaagcgcctggaaccttgacagtcgactgcctctgtaaatccctcggcccaaaagaagaagaaaaaaaggacggtatcttttttgattaggatgttctaggtaatggtctcgtgc

SEQ ID NO: 21749 - DNA, 1732 bp, Zea mays
catcccgatcaaattggcgagaggagcgagagagaacccaaacggagagagacaatcgagagagatggcaaactgttttggtgacgtcgtggacaattacaagctagacacaatccccacgcgtccccccacgatcaaattggcgagaggagcgagagagaacccaaacggagagagacaatcgagagagatggcaaactgttttggtgacgtcgtggacaattacaagctagacacaatgccaagatatatcggcaaaaagaagactcgagaagaccgggcacgagaggcctcctatctcagtaatgagaatgagaagtacaagaaagctaaagactatgtgaacatgctgaaggactggtacggcaatggagcgtcgacgctgtgcgtgatctacaaccagacgggcggaaccctgcggtacgtcgacgacaaggactggctgggctacccggggccgacgccctacccgacggagatcggcaacgggcagtgggcgtccttcctccacgtccacaagaccggcgcctcgtcggggtccatggccgctgtcgtctaccgcggcaaggacggcggcggcagcgagcgcgacttcgccatggcctggagcaccccctggggcgcctccaagaacagggcctactgcgagatcggcaacgtcggctccttccagtcgcagtgggacaatctctacaaaaaactcaacaaggccggatacactaccaacgcaagtggtaccagctcgtctatttccgccgcaactgccaagggcagctcccccgacttcaaagcatatgtgaagatcccttacagcgcatgatgtcaaatcggatccgtcatccacatcgtatcgcgtcgttctgcttgtactctgcttcttcctctatgtattaataatcccagcagcttgaaataataacaatgcatgcatgcatccatgatgaaaattagaaataatgtttatgtccccaaccacgcctacttatgctctcgagttacttatttgctgctgtctctcaactgcatgcctatgtaatatatatacaataaaagagttctagctagtactgttcgtcactcctcctcttgtaagatactccatccgtttataaatgtttgtggctttggtattcgtgtcggtcaaactttcttaagtttgactggaattataacatatattatcaatatttgtatcttcaaataattttactataagcataattcaataaaaggaagatgttgttatgatataaaatgtgcttttttgaatatatatactaccctagttaagataataattttatgtacattgtatgttaaaataagcatgtgcttcatcttaaaattactaataaaaatagttataataaataggaccagaagctgaaaagataaaatgttagcaagtagagatagaaatttagaaaaaatatattaaatagtttagaagttcaattagaagatctaagaagtatgatatatctcaataatggaaataataagatctacgaaaagtttagtggcaataccaagttaaagatcaaatgactatgaatgaaaagaatgataatgcaatgcaattaaaacatgccataataaatttaggtagcaaatatgtagttagattgccatttaaataaaatgtaggaataagagtacctaaaaagtaaaattaccatttattatctcttataagatatttccctagtagatactagttgtataaagaata

SEQ ID NO: 21750 - DNA, 880 bp, Zea mays
  misc_feature (766)..(766): n is a, c, g, or t
  misc_feature (776)..(777): n is a, c, g, or t
  misc_feature (817)..(817): n is a, c, g, or t
cctcgaggccggccgggccgaaaaattggggagaggagcgagagagaacgaccgaaacagagagacaatccagagagatggcaaactgttttggtgacatcgtggacaattacaagttagatacaatgccaagatatgtcggcaaaacgaagactcgagaagaccgggcacgagaggcctcctatctcaataatgagaatgaaaagtccaagaaggctaaagactatgtgaacatgctcaaggactggtacggcaatggagcgtcgacgctgtgcgtgatctacaaccagacgggcggaaccctgcggtacgtcgacgacaaggactggctgggctacccggggccgacgccctacccgacggagatcgggaacgggcagtgggcgtccttcctccacgtccacaagaccggcgccgcgtcggggtccatggccgccgtcgtctaccgcggcaaggacggcggcggctccgagcgcgacttcgcaatggcctggagcaccccctggggcgcctccaagaacagggcctactgcgagatcggcagcgtcggctccttccagtcgcagtgggacaagctctacaccaatctcaacaaggccgggtacaccaccaacgccaatagtacccactcgtctatttctgcagccactgccaagggcagctcccccgacttcaaagcatacgtcaagatcccttacagtgcatgatgtcggtcgatgctgtcaaatccgatccatcagggcattcgttctggttgtactacttnctccctccanntataatcgtatagcagcttgaaaatatattgcatgcattncagcatgatgcaaattagaaataatatacccatagcagcagcagcagtagcctctacactgct

SEQ ID NO: 21751 - DNA, 1234 bp, Zea mays
gaaatatgtaatgataattgtcgcagtaaaatatgtcatgatactttcaagtcaaatatgacgatacattttagtcaagaagcgagaacaatgacctatctgtgttagggaagaagttaaaagcacgagcactctccaactgcaactgtaccatgttattttgatatcaacaaaagtaaaacctttttttctagtgcaaataagtcatctaatgtatatggaaaatatcggagaccagtactatactactatctttaggtgttgcctaactgcctatcggtccagggccaatgtcttgtcgctagctcgtagctctgtctgtttttgagaaaacagtgtccttgcccattcagtcagaggtacaaaactacaaatgacatatatctaccgccaaaagatggatataaggtttcaatttcccttctcccttgctcatccatctaattagtaaaacataatcgatggataaaggttttattagattttttctcaggtatgaaggatgcatggaaatgattggcgccggcccccccctcgaggcttttgcttttccctttgaccgctaataagtgcatgcgaattatgaaggtgctaacaatcaccagcttattaacaatgtctcaagtgccggtcagcacttgaatcatgataaatgatgggctctcccaacgcataatcatgttaggttatggagacctgatcattggttttctcttaatcaatagtctacaaaaaaaactccctaagaaattaaagagagctgaaatccccacatggaattgtatgatgcaaagatcctgtgaataaagcaaagcatgcatgccgcgcctgggagcaatcactgaagttcatctgagggtgacctcatacaggaccggcactatgtaagacaaggtgagaaaattgcagcagctcccatggacagaaaggatccacagtcaatcaaaaatttcttcagttggtggtcttggccgatcacccacaaggtagcccacatggcagcatgtgtagaactaacacgaccagatggcaggggacgtcgcattgtccttttcattttagcatcattatttatctcaaatactttcaaatacctccagttgctcgtgtagccgcttctgaacttccatttgcatctttagtgcctcattgatttgcaatcctggtacataatcctcgaactttcttgccgtccttgaaaccttcagcatgagagtctggacatacctttgca

SEQ ID NO: 21752 - DNA, 2947 bp, Zea mays
  misc_feature (2093)..(2093): n is a, c, g, or t
  misc_feature (2258)..(2258): n is a, c, g, or t
ttttttttttttttttgagctgaaatccccacatgggctcgcgcgaagcgcgagtctgtggtcaatgtgttcacatatatatatatatatatataacactataaaggttgttgatataaacatatagagatattagtagtcaagacatattgatcaatagggatcatctattttataataataataataaagcaaactgaatggtagatgaaggcaataacaatgttctctgccaccacattgagaaggagacgaaggtttggaccataagcctagcctttatcttctagaatagccaaagggcagccatctagaagcagtttatctccagaagcatcttaggtgtccatgaaattcatacttctcacgatgaggtcctgatcagcaccctcagccagcacgatgaaccacatgacccttgtcctcacgtcgtctctaaatgaactcgaggagtcgtctcttcccttcgaggtagaagggtgactctgggattaaacaacaatccacataacggctagctagagaagcacactgcagtaaaacctgcatcaattgaaaaggatttaaaacaatttagttaattatgtaattatcatagtactgcaaaatatgcatgaattgacagtagatgttgcagtaagtttgaatagggagataaaaatacaacagttgtgacccattagcttcacaacaccaatgccattgtctacactttcagcctcgacatgagcggcattgagggccctttgggcctcctccacagcagcgtgaaatccaaatgacttgtcaatcacctgcacaagcagttcaagatgaagctacattcacgaataaacaatatgttgctgttttttcaaagatgcgggaggagcagaatgcagaaagtatcgcaatgctgttatcaatattctttgggacaccaacaatagaacacttgagacttgtctccagacttcttaaaaccatgtttcaggaattttgcgttacacatcgtatcttcatttgaaaactatcacataatcatctagatgcatgtgttatctcaaaaaattacagaagcacctttctgaatgccatcgccttcgataatataaatctggttagtatcacggtcctgaagacaatcaatgattttcgcagtgtcatgccctcctcttgaggttccgaggacaaacccgtctctgttatggatgtcgttcaccatgaatctgtaataatatattagtgacagatagtacagtatttttagaatttataagctgacttggatgcagctagaccataattatgtgatatatatggtatttgatggagaaacatttttctcggtacaaaccaacgcccgtgaaatcatatagcatgaatctttgtaatcgtccaatattaagcgatgggaacacaatgcaagcatggacataaataaagtttattggagcacccccgtataactttcagtatactgtgaaggcagtatgcaaataaccatggtgctccagatgcaaaagtgcagaggtgtttgggtataggaagcaagaacaacatggacatgaataaagtatattatcattaccgctgcatcactttcaatatgccaggaagatgttaagcaagtaggcaaagtgctccgagaggtcttcgacatgtggtaaccgggggtacctcttcaaggcacagcggtgtccgacattcctaaagagtgagcacgcgagtggagtagagcagatggagtgggggccatcgaatgcatgggggaggaagacgaccagaacgcagaccttgattggcatggaggagggcttcaagtcatagcggtggcgggaggtctttgaggccgcgaccggcgtactcgtcgttgcctgagacgggccaccacgacgaacagcacggcggtcttcaaggtgcggcggtggtcggcaatttctactaaggagtaaatgttgaagagtaagcacgcgattgaggagagaagacagagtgggggctgtcaaactgaggggagacgaacagagctctatcgacgacggaggaaacgatgctcgtgtttcctttctccctcgtggacccggcggcaatgtggtttactcatttgctgnacacacaatctgtggacttgcttctggaaaactctcgtggcatcggatagagcgtggacatgaggagaattcgcggtttgcatccatgatcgtggagatgaaatcggacagctgaggcatttggtgaagacgtggacgcgatgggtgtgaagctttatgtcacgntttaatatatagtaataatatgcgaaaaggtggcagccctccatggtttgccgtgggacgacgcgatcgtggaaaaggttggccagcacacacgctgacttttggcatccaggtccagcgtccagccccaacgatgatatttttcgagccgaatagaactgacgcgaagtgaggacacatgctgattttgataggacctcggcaccatgattcatagcgccgagctcgaccacgtcggtaccgcgttagcctattatggacagcggagcaagcacctcggcaccaagatctgcagcgccgagccatgttatctcggcgtcatggtctttggcgccaagcaaagggtccaaaaatgagattaagtcatctagaggtctaaccgtgaatattttcaaaaaaaggttaaaatacaaaaaatacggcgcacggaccgttgagtgggaagaaggagctgacgatggtcgtagaaacgtcggcgatgatgatgctgcctacaactagacctgtttggttcatctttttcctgatcaccttttctgagaatttagctatggtgaaaatctagctgtgaggagaatctgagtatcataaagattgcgtgcgaaaaatataaatgtgtctataggattcagaatctagaaagtgatagatttctactattgaaacgactcgactaattatgtgtttac

SEQ ID NO: 21753 - DNA, 1646 bp, Zea mays
ctcttttagagttcctagctagatatttattatctctacctttagctatttattatctcgcttttctttttttttttgtttattgcgaaatacggcatatattccgaacaaaagcatccattggcacaattaattattcatgaaaatggggaatcgaaacatagcaacagtgacacatggatcgtctggtccaatcgaagtgaggcgcgtctcactcgtcgtcggcgacgcggacgagctgctttccgacgttgcgaccgtggaagagtcctatgagcgccttgggcgcgctctcgagcccctcggcgacgtcctcgacgtaggcgagcgtgccgtccctgatgtacggcagcacccacgcctcgtactgcgggtagaggtgcttgtggtcgggctcgatgaacccctgcaggcggaggcgcttggagatgacggcggcgaggttgcgcacggcgtccttctccccgtccgccaggttgtactgcgagatgagcccgcagacggcgatccgtccgtgcacgcgcatgttgagcaggacggcgtcgagcatggcgccgccgacgttctcgaagtagatgtcgatgccgtcggggaagcagcgcttgagcgcggcgccgaggtcgggctcctccttgtagttgaaggcgtcgtggaagccgaacctggtcttgagcagctccaccttctcccgggacccggcgctgccgacgacgtggcagccggcgagcctggcgaactggcccaccagctggccgacggcgccggacgcggcggacacgaacacggtctcgcccttcttcggcgcgcagatctcgtggaagcccacgtacgcggtgagccccggcatgccgaggatgccggtgtagtaggacagcggcacgcccgccccctccccggccccgtggtgggagatcttggagaggagcctggtggcgggcggcgtcacgacgctgtagtcctcccagccggtgatgccccagacgaggtccccgggcgcgaggcgcgggtcggaggagtcgaccacgcgcgcgacgccgtagcccgtgatggtgtcgcccgggacgaaggcggccgtgtaggactcccgcagcgggcgcgacatcttgggccgcatgtaggggtcgcaggagaggtagaggttcctgacgaggacggacccggccggctcggcgcccgtcaggcggaggggaacctcggcgccccggagcagctccatgtgctcctcgcgagggtatccctccacgtactccttgaggatcacccgccggttcgtcgccgtcgtcgccatcggggcctgcttgtgctcggatctatccctctgcgactcgctgtgccgtgctctgctttcctccgctgaggatgattgagttcagtgtagtacttttgtttggatcctgcgatccgccgggggccgcaatatcccggcctgtgcaaatgcaataagtgatggtgaattattgggggacccgggcgggctgcgcagccttcaacggggcatgattagtgggtccttttggatacagatactagagatgttgcaattgaattagatataatactaaaactgtttagtactgaaaataaattttaataaaaatatcttgtttggatgtatttagaatttaattccatccaatacactaaag

SEQ ID NO: 21754 - DNA, 1181 bp, Zea mays
  misc_feature (170)..(170): n is a, c, g, or t
  misc_feature (202)..(202): n is a, c, g, or t
  misc_feature (307)..(307): n is a, c, g, or t
  misc_feature (1167)..(1168): n is a, c, g, or t
  misc_feature (1174)..(1174): n is a, c, g, or t
gagctgctttcctcgttgcgaccgtggaagatccttggggggggggggggcgctctcgagcccctcggggacgtcctcgacgtaggcgagcgtgccgtccctgatgtacgggagcacccacgcctcgtactgcgggtagaggtgcttgtggtcgggctcgatgaaccccntgcagcggaggcgcttgggggggagggcggcnaggttgcgcacggcgtccttctccccgtccgccaggttgtactgcgagatgagcccgcagacggcgatccgtccgtgcacgcgcatgttgagcaggacggcgtcnagcatggcgccgccgacgttctcgaagtagatgtcgatgccgtcggggaagcagcgcttgagcgcggcgccgaggtcgggctcctcccttgtagttgaaggcgtcgtggaagccgaacctggtcttgagcagctccaccttctcccgggacccggcgctgccgacgacgtggcagccggcgagcctggcgaactggcccaccagctggccgacggcgccggacgcggcggacacgaacacgggtctcgcccttcttcggcgcgcagatctcgtggaagcccacgtacgcggtgagccccggcatgccgaggatgccggtgtagtaggacagcggcacgcccgccccctccccgacccccgtggtgggagatcctggagaggagcctggtggcgggcggcgtaacgacgctgtagtcctcccagccggtgatgccccagacgaggtccccgggcgcgaggcgcgggtcggaggagtcgaccacgcgcgcgacgccgtagcccgtgatggtgtcgcccgggacgaaggcggccgtgtaggactcccgcagcgggcgcgacatcttgggccgcatgtaggggtcgcaggagaggtagaggttcctgacgaggacggacccggccggctcggcgcccgtcaggcggaggggaacctcggcgccctggagcagctccatgtgctcctcgcgagggtatccctccacgtactccttgaggatcacccgccggttcgtcgccatcggggcctgcttgtgctcggatctatccctctgcgactcgctgtgctgtgctctgctttcctccgctgaggatgattgagtacagtgtagtactgtttttttcgtacctttcgcccggccggnncctcgnagggtac

SEQ ID NO: 21755 - DNA, 1130 bp, Zea mays
ttttttttttttttttgtttacttttaacttttaagcatccagcaagacattagtcgcaagaacaaatgtgtcagtttccaaaagaagctacagacaaatagaatgcaagttggacaaggcatcacgctgtcaataataaattacagtgacacaggactacagatcatactaaaaggaccaccgtcatcacgcattctaaactcttaatagtccccatcctctaattttgatttagcttcagagtcaaatgtcttgcatagaatctcatagcttttttcaagtcctatctgagggtccactcgcgatggcgaggtactagatatcacatatctcaacttggtatagaaagccatcgcttgagtgttagctttctgaactgttagcatcacagctcccatttggttcttgcaagcgatctgttcaatcaactgcatcataaacttccccagccccttaccctgagcagaaggctccatttgtagctcatacacataaagaacaggaagctcctcttccacaacaaatctatagtgtacaaaaccaagcaagcagctttcaggacacactgcacacatatgttccacctccgtttccttcatggaactttcagtaataaacccattagaatattgcttcacaaatatatatcgtgcttctgggaccaccatctcccgacgcttaactttctcttctaaaagccattctggtccataaggttcctccatgttaaccttaagaagattttggatgtacttcctcattggttttctcagttgatgaccacttccagactctaggtacacatttctctgatatttatggaaatcagataattgagctagatggtccttcacagctacagcttttcttataagctcatatgtggccttcttcctttccaaaatctccttcctacttggcttcttctctgctccactgctgagcctgggcctcttgttctccgccgtcgccatgaccgcttccccgtcgtcttcaagataggaggcaggcggcagaggtgagtttgatttgaaggttgtgacgggacggcagaggtgatttgaaggcgtgggttcgtccaaaggagaatacgctcaccagaaacgggacggatcgattctcccagatc

SEQ ID NO: 21756 - DNA, 1475 bp, Zea mays
tacttcttgtgatttcatatattttggatgtaattatcaatactttcggaaaatactccatatactttggagtaaataaaatttagttcatcacttcatgtaggacttccacaggatgtaatgtgccttctactaatatgcaatgtgcttcacgttgtatgcataaaatgcaacgtagaatagttcatgggatattctttgtatgactttccataatatgctttacaatttacttcttgcaaatgtaaaagtattctaggccttctctaaaaatatattagtatataaataaatatatgtctatagaataatttcctgttgcactacagggataatacaaattcataattcaaaggaaaaattataataacatgctaagtaaataaatataatttatataaatgcataagtaatcccaatttatttatattgcatgaaaatatttcttattattttcagcatttttatggtttttttaacttcttctaccgttcaagaggtagtgttgaaccttttttatggtttatagtgtaatgtataattttccaatgaaaatttacaaagcctctaaggccttcgaggcccatttcaaggaacgaggggtaacggtattacattgggcccctcgaggccgccatctatccttctctcctttttttattcttctttccttgtcagccgcacgttccctctccccttttttctctccttcatttccgctcggtggatggacgactgaggctgtggcggtggcgctagccagcctcgcatgcgttgttccgggccggtgatggcagtgcccgcacgcgcctgctcccagacgacgacggcagccaccccgcgcgcctgctttggggccgcggcatggccagagcgcgtgctcgcctacccatggcgatgacgcagcccgattccgcagcgtggccagatcccgtgctcgcctgcttgcgcggcgggggcggcccgcgcttgaccgcatctgctcgaccagcgctcacatgcctgctcacggcggtggcggggacggcctgcgcgcctgctcgcatgctgggcggcaggggcgctcgcccgcgcgctcgcggccatggcggtgctcgcacgtgtgcttgtctgcgacagcacacgcctgcgcgcttggttgtggcgacgcccgcttgcgtttcgtgctcgttgtctgctcaaagcgcggcagcatagcccggtgctggcagcagcagggaccgacttcagtgtctgcgaagcgtaagcatgccttctcgtggcagtgggacgccggtgctcaagtagaaaatttgtgtgtttggcatctcagacagcttcaagctgcgataaatctgcagagatgtttttcttttattttctatgtgtacgtatgtttatactcgaaggtcgaaagaagctgaaaatatagaaattacttagtgcgagtgaaaaaaaaaaaaaaaagcggcccgcgcgccccggctgcaagagca

SEQ ID NO: 21757 - DNA, 1988 bp, Zea mays
ttttttttttttttttgtacaatcacaatttaacacctgtacctttcccctgaaaaaagcgaactgcacaccgtctactgaccctcagcctgtcagccaaacactattaagattactaacctgggtgtacaccaaccattacatgatgtacccccgccagaagttaaatggtaattataataattattacatgatgcaaccagatacatcgttatcttgctttggcaaccagccaaacagcagagcagtgtgactgacctgagcgacacatcaggcggtagtcacatctccaggtatcggcaggcaacacctaattttgctatacaattaaaccaaacaagcatcaagcaaccaggaccacactgctcttcttacaacagaaccgggttgtcatcgatgcacctttccgcgctgagttgagcgaggccttggcgaagcagatgccatgtcgtttagatcttgtaatggtgtgagttgcttgacaacttcatccatcgatgggcgagacttactgtcacgggtaaggcagtagtggcagatctgagcgaccttttgcacccctttgacagagtagttcagccccaagcgaggatctacaagctgatagagccttcgccgatcatttaggtaaggccttgcccatgcaaccaggttctgctcccccgtaggccgcttcttgtccattgatcttctcccagtcaacatctcgagtagcacaactccgaagctataaacatcactcttagatgtcaagtgccctgtcattacatactctggtgcagcataaccataggtgccaacaacccgagtagatacatgagttttatcaccctgaggaccagcttttgctaaaccgaaatcagatagttttgcgttgtactccacatcaagaagaacattcgatgtcttaaaatccctgtaaataacaggtttgggacctccatggaggaaggctagtcctttcgcggcacctagagcaatcttcatcctgttggaccaaggtaggggaagagcccttctgaaaagatgattttcaagacttccccgtgccatgaattcatatacaagtaacctttgatcatcctcaatacaatccaatcagcttaacaaggtgtttatgatgcaactgtcccagaaagtcaacttctgccacccattctctatgaccttgaagcgcatctggcttcaaacttttgactgccacagtaacccctgtgccaggttttgcaggagcagtgctgtttggctcaatccaccccttgaatacataaccgaacccaccctccccaagaatactgtctggcctgaagttaagcgtggcagatttcaactcttgaaaggtaaactgaagtagcttgggtgttctcttttcaattgatgcatcaacaccattttcaccatcacgttttgtctgaaaatgatcaccaagctcccgattgctagcattcagatatcttgtctctgctgcgtcgtgaacgtggctgcccttggccgagccgccgccgtcaccgtccgccgtcaccgccggccggaagcacgccccgcggaggccccgcgcgacggcggccaagcatccgcacccttcccgccctgctgcccgcttcggggaagtcatctcctccttggtgccctgcaggcggtgaggtcaacgagatacagctgctactcgtaaacacccatcggcacggcccggtgtgattcttctctcccagcttgcttcccttttctcgccccactcgaccccgtccagtccaaatcgcccaaggaagcagataagtgcgatgcggggcgcaaaagggaaagcgaaagcgaaaggtggcgcgcgcggtaggggtgcacaagtcggagaagcaagcgggggcgaggcgggagtggagttgccgagtctcagactcagtggcggtgggccgcccgttcagcgcgactgcgcgagcactggcactccaccgcccgttcagcgacactgcggagcactgcactcccggccg

SEQ ID NO: 21758 - DNA, 1755 bp, Zea mays
cttgcatgcctgcagcttcaggtcaagaaggcgatgcacgcactagacctggcagtggcaggtagaggagatggaacccgattctcgtatagaatagaacagcgagacatggaatcgcgcgagccggggccgcgcaccccggttcgttccactgcgagtcgggatggatgcagcgtgctccacaacagtggcataccacacccaccgagtgttcggccgctcagcccagcgctgccacggctgcggaatcgcagtcgctgtacaatggctgtctcacagcgctgcaaccattttttttttttttttgacaaagcaagcatacagtatctcaataacctcaggcaaacatctttgggagcctaccatcagattttctgagtggcaaagaaacacctatccattctcagaacagagtaacagaccaaacacagatagattcgacggccctgcctgttggtcatgacacctcgaccgtggagcagaccttgaggaactcgtcgatcttggcggagtacacgtgggggaagctccggtagtggtccacgtgcggcgacgagacgaagtcgtgggcgaacacgctgcgcccgagggacctctgcgactccacgaagcgctccacgcactcccccgggatgactcggtcggccgagctgtacaggtagaactgcgggcaaggaggctgctgctctgaaagcaccgagagaaccttgcatagccgcttgtttacatcaggtacgtaaagaacgatctcgaagaatttccgcagagttgacagaagaaaacattcaccccatgaaggttgggtcacattggagccaactctgttcaaggtgccatttacaacaggcccatcaagagattcagtcgtaggaccagtcatggaactgcttttctttaacattgcagcagagaacccggccgcccagacctctggtcttatctctagaactggtgcagagtctacaatacatcctcttattctctcagttaggtcagctcttgattgtaaattctccagtacagcaccataggcgagccatccggtgttgctgaaggtgtggaagaggagcgtgcggcgccgatcggcgtcgcaccacgcggcgacctgctcggagaggtcggcgaccctgcgctcgacgcggcggccgaggtcgaggccgacgagctcgcgcacgggcacgacgaaccgcaccgcgccgaccccgcgctcgcggtagaggtcggcgtagcggcgcaggtgcttctggcgcgcgccgagccagccgagcagcacgaccagcgtggcacccccggcagcaccgccgccagcgagcggcgagggggcggagtcgcccgggggcgggtcccactcgatgaaagggtcggagtcgggcggcaggaggttgaatggcacggagcccggaggcgcggcgccggaggggacggatagagaggcggcggcggggcaggcgaggctggccctgccgcgaaatgtcgcgggatggcgcggcgggaaggagagagaggcggacaccggggcccggacctggacgcgcctgaacgcgacgcgctggtgcgcagcggcggccgtgaaggccgcggcgaggtggcgggcgggggccgcagccatgggcggatgccggaagcggactgggtggagccaaagcggcggcggcgaagtggcgagggcgacgaggaactgaaacgagacgaggtccggttaggatgttctaggtaatggtctcgtgctcccggccggcctcgaggtacccaatg

SEQ ID NO: 21759 - DNA, 3151 bp, Zea mays
actattttattaatataatcggcagccctgcctggttcgtttcaaaaaacaaactccaccccgtcggatctgctcttgtcggcgaggtagcgcactgtcggccatgggtggtgacatgccatcacaccgtcgacccgatcgccgcacgccatcagcgtgggaggcctccttcttggaggatcgacagctctccctcgccacgctcgagtttgggctaccgttcgagctcgcttcatcccaggagttcctcgcctacggggcagatgggaagcccatgtcagctgtttactcttccaaggagtttggtcttctgccgataccggagggtccccgctacggtagcatcgagtcttacattcttccccacctcccgctcggagatgcggctgctctccgcgacgcgggcgcgggcggcgcgaggttccgcatcgcgaaccttccccgtcttgaggcaaagctggcggctcgcaacaagcttctgggggtgacacgcgagatggtgcagttccacggctcgctgcagcaactcctgccgcagctcgtccaccaccgagccaaggtcgctggtcttctcaatgcggatgcggacacagaacttggcaagccagctgcccgcctcgagcacttccagaccgaggagatgcaggacatgatgtcgaggtgggagcaggacctgcagcgggctcgtgctgctgccacagctgcaaggcggagactgattctggcggttcaccacgccaccatcctcttcgtttcagataatgttcatgcaggcgaagatgttcacgacacattgcttatgcttgcgccagagttgcatgagaggctatttggtgacccttgccacgccgatccctgctcagagcccctcgtgcaagatggccaatggaaggttcgagagaaacgtacagatgttgccattcagcaattcatgaggtctgtgggcatggagatgaaacctgaagagtttgtggtgttctcactggcccggagtcggcgtgatattgttgagagtgagggggaaatcaccaggcaggagctcagactctccgtgatgcgccccatccaggatgtgctagtcgctgtgggctcactgcaggatgtccgtaacactttgaaggatcattttacatacccaaccctccttggaaatcaggttgatcctaaacaggagaatttacctatggactttcctttctacccgacatatgctactttgtccacccaggaacttaagcatgctgttaggcagcaccacactccgtccttttgagtatagagtgcactgagaagaggcagagaacaagtgttggtataatatctccttatactgctcaagtgattgcattgagaagcatgactttctatctgttaagagtaaaatctattgatggatttcatggtggtgaggaggacattattttgatttcaacagtttggtccaataaagatgggaaagtaggctctctgattctgagagaatcaacgtggctttcacaagagccaagtatcttgccctagactccctagtatactgaagtcacatttaaaacactcttccactgcatttttagttcagtaattgctatatttctgccataatagttcagtagtgcctttggattcttggaaatggaaccactttactggctagcaattcaatatgggctgatttagtctgtgtcgttagcactgaaaaaaaaaaaaaaacaagtggaagtgtgtttttcttcttctaaaagatagaatgcagatgcattttagccatgaatcagttgttatttctgccatattagatagcacactgaatgcatgatagtctttgccgagtgtttttgacactcggcaaagaacacgattccggtagtgatagaataacacaacatcgtgttgttgcctatttctactttgatatgtttaccgacaattaagtcaggcttctgaaccggaatgcttagttagctatacatgttctgcatgttgtcaacaagactcgctagtggtttgattgtaatacccccatagaccatagtatgttgtcaacaagagccgctagtggcttatctctagctgttcgtcgtcgaaggacttaggtgctgtttggttgacgaaatgtaatgaaaatggtaatggtaacgattgacactcgaataccggcgctaacaaatttgaataaggatgtattcatttgtagtatgatattgattacggttgaactaaaataaacataatctaatgttattggttacccattgcattaccaatatatgaaccaaacggcatcttagcttgtttagtggctgctattaaaaagaccaaagtatatccgggtgcggtccaaacaagccatcgttgtttgtgttgcctgctaggagtattaaaaagggcgcaaattaaatagtgctcaataatacagcaagcacatcaatcagtggactccattactacttgcattggtccagtccagctatggccgtacgtacgagatatcgcgtcatcattttcatgggcgtgcactcctctcctatcaactaaccgttccttgtatataatcattacatggcgacgacagacaacacacgctccatatatctcatctgatagaagatggaggatgcttaaccatgcgccatgacgcgatggatgttgctgtctcgggaaaagctgtttttgactgagaatatcttggagatttttggaggcagacgttttatttatggagatggctattatctatggaggaggtcagaaattcatctctcctaaaattgattcacgggattgaagatgaactcgagcaattaataatcttggtcatacgtaccatttctcgtacggcgggcggattaagagtgcaagtcagccagacccggctggcgtaagtcaactcggaggctagagagccgatcgagctttgagttggagtttagactgtctctagcagcgtcctctatatacatcctctatatccgtcctttacagtcttctctaaaagatttcatcttctatatctactttctctccaacgacgtcctctaaatcacgtcctctatatgtaaatatctatattaaagacatttttaatttttaaatttttgtacatacgtatttgttatactgtcaaatgtattgcacatattttagttttatt

SEQ ID NO: 21760 - DNA, 2193 bp, Zea mays
  misc_feature (18)..(52): n is a, c, g, or t
  misc_feature (2158)..(2158): n is a, c, g, or t
tttttttttttttttttnnnnnnnnnnnnnnnnnnnnnnnnnnnnnnnnnnnctttttgtgtgctttttttttgttttttctggaagaagaaccgggctgcaatttgagaaaaaggaggccgtactacatgaacaatagacctttcattttctgtatgtacagtaagaatgctcaggccatgccaactcttcgtccatacgactaaccgactaagcgcagcagggatggcgacgtctctacctctgaatacgccgaggcaataataatcaaatcacgatgtcagctggctcgcctgctatctacgtgagccagtgccgaaaatgagcatatgcacaagcatggtgacgatcccggctggtatcaagctcttgtaagatgcgcgccgtgcggagccgttcacgtcgaactgcccagtgttcacgtactggttcttccctgatgacgtcgtcacgttcaccgacattgaacaatcgtaatccgcccagcccatgcgcatgtttgccaagtcatacacgaatatcttatcctttaaaacaagatctccgagtatagttatttcttggccctggttcctttgccaaccaatgcaccacaatacactgttgtcaacagaagcctgctgcaaaagatagttctctggcttcaccgacatcgcaacaccacccataaaataaagggttacggttggaaacgatgagtcaacgctgctggacgtgataaagcattggcttcctttgctgactagagaacgcacagatggagagactgcagcagctatcgcactaacaaatggatcgtaggctccatctgcaaggtatgccaatgttgttcctgaatccacgattgttccttgtgtatttgatgttgtaaacaaggaggaatcaatgggcagcttttgaccattgacagcaatgctttccagatttaagttgtaatgaggctgtgatggaacaagtggagtatacactaatcctggctccacaatttcaccaagcacaagaatgccaccaccattatccgaacctttcaggcaatgagagaacaccttaggggacaccccaagagagttaagttgcgaaattacagacagttgatgctgtccgaacccaaaaattccatcaactgccctatctgcctttgtcaggtctcctgactgtgagttgctacatccgaaaacaatagaggcagacgaattggcggtctgctcgtttcccatgacagtttcgaaaaacatcgtgtcagacacatagtaccctgatgtgccactcccatcaccataggtgaaagtgtacccacaagggctgctttgggaatttgaggtttgacagattgcttcccctgtttggaagccagctgtacatctgtcatcagagcatgttattctggatgctgttgatgaagagtcagggttgaaggactctagctggatattgagtccacttgatgtcgggcaaccagtgcaaggactgcaagtgacccacaatatatcactcccagtgtcaatctggacgaagaattcctttgccgggtttcctaatttcacccgggtaaaataaagcccgaccatgtacggattggcggagccctcgacggggaagtccaccacgccggctacgcccccgagcagcctcctcctcgaaacccggtgccgcgcggcgtcccgccgcctaagttcctccaggggcacccccttgtgcggaaccgcgcgctgcagccgcagcgccgccggtaacggcgctgccgactccgccgcggccgcggccacggcggcagccgccacgagaagaagcgccgccaccgctacctccggcggcctcatcgggagagccagccgcagcgggtgccgggcaggaggggggcggtccccgacaccagacgcggggagcaggaccgagcgcgtcgtggcgcggctgctctgctgctcgtgtggcccgtagcaaagttttgcggctccttctcgcgacgagcccctcggaagagacgctaattctacggcacggcgtatataacgcctcctcgagacccgaatttgcgaaggagttgggagttgagagggttaagtgtgaaagggagggggaaaggattacgtgtgggctgctgtgtacgcgcccggccccggccccgcccggcttcgttgcgccacttttataataaggnctgcttttcttctcttctgcatatgacccggccgt

SEQ ID NO: 21761 - DNA, 1126 bp, Zea mays
caggtaagaactcaatgtcaactggagagtctgcatacatcagctgcatttctcttgccacaagttagggcacttcaacggacaacaatacacgaattctctgcgaggggctttcaggagcacaggtcatgggattgctaggcacactccacattgttttcaatatcaaacagactgtcccatatgacaattgcaggacaggtaatcacaatggctaatgaaacgtccagctcccagactcaaatgaagcgtagcttcttccttgccacctctgtatctcaaatcctcatgatgcttgtgggtcggttcctgagttgtcgtccatgggcattcccagttcttttgcttcaagtttaagctggtcaatatgattctgcaggtcaacacaagcagcctgaatagctatatttttttgacacagctcctgccattccattttcagggcatgcagctgtcctccagtattttgctggtggaacttcctctctcgattgacattttctatcctttcattgtattctacagccatcttttgcatcctagacagaactgattccatttgtctgttctggagcttccaaacatctacgccatatttcagcataagctcgagattctctatccttataatttgatgctgcaactggctctgagcattccgtagagcctgcctccaagcgccaacatcattcctcttgttcattggaggtggctccaaaccatagcgagacatatctagcataaaaggaggtttgccagccctaacacgttcatattctttagcaagcataggatgattctcgaatccggcggtgggaacagggggcaggtcccggaggaagtctgcaggcttgcgcttccctcggcgcatctcctcctcgacgaggcgatcgacctcccgcttcaccgccgcatcgccgtagtcgccgtcgatgtagggcagcgcgtcaatggcctccgcgcgccagggccccgcagcggggtcggacggcggaggcgcctcaagcatgagaacctctctcgtcgccgacgaggccatcgcgtcaggctgtagcggcgcagtcgagagtcgagactcgagagagagagggaagcagtcgcgtagggcggcgcggagaaaaagcgg

SEQ ID NO: 21762 - DNA, 2000 bp, Zea mays
taactaaagtggaataaaatgtagggactaaaaattagtccctagaaaccaaacaccccctaaatggtttgcaggtaaaatgtaaaggggttgtcaactaaaacttcaatttcatatgcaatagttaattagttataaagtctaaacaatgcagagatacattgacccaaccaagttaatttacttaggcggtctccaaccaatttaatagagggaagagggaggtatttaaatatgaatagagaatgtgaatagggggatttgagagggggaatggttggattcagccttagagctccacaaaatctaaataacgaaaacatatatttataatccatccagctaacttggttcactgtgacctctacaactgcaaaccctagctcccgcacgaccctcctttgaaccctaaacgcagatcgcacctgctaacatcgacgaagctgcaaccttatgctaagcccctaacatccgcggagaaaacgtaatgggttcgtatacgccatatttcagcataagctcgagattctctatccttataatttgatgctgcaactggctctgagcattccgtagagcctgcctccaagcgccaacatcattcctcttgttcattggaggtggctccaaaccatagcgagacatatctagcataaaaggaggtttgccagccctaacacgttcatattctttagcaagcataggatgattctcgaatccggcggtgggaacagggggcaggtcccggaggaagtctgcaggcttgcgcttccctcggcgcatctcctcctcgacgaggcgatcgacctcccgcttcaccgccgcatcgccgtagtcgccgtcgatgtagggcagcgcgtcaatggcctccgcgtccggcaccgcgcgccagggccccgcagcggggtcggacggcggaggcgcctcaagcatgagaacctctctcgtcgccgacgaggccatcgcgtcaggctgtagcggcgcagtcgagagtcgagactcgagagagagggaagcagtcgcgtaggccggcgcggaggaggaagcggaggtgggaatggccggatggagatggaggaaaaccggcgcacgtgggccgtttggcgttttggattgagcacggttcgaaaggcccgtgtctactgttttttttttctctctagggagagaacccgtcagcactctattgaaccattgaactggtgtgaatgaacattctttttttgttgaaagctagaaacgagatatccatgcatcacatcgtttctatctgatatctccattgtatatttgtcgttaaaactgaaacctatccattaacttacttcaggtttgtttcaactcattgattatataattgttggcacagatctgagtgctaatcaatgggatttgtttcgcttgactctctgcggcggtgcggacggtccacgacctgacggcaggagcaggtttcgctgcatcgagtcggacgatccacgtgtgcgcaggagcgtggcgttcgctaacagcacctagacctcgcctactgggagggacccgtcagagaggactgatactagggtttatcttggggtcggcaggccacctaagatgccttcagatgacgtagagtcaaagagatgtgaggattgagataaataagactacgttactggctacttctagggcaaaaagtaaaggaacggaagatatattgatttgattcgattgttagtgtctacaatcgatcgtataccttcataaatataagggatgtctagactcattcctacgcgttcgccaacagaatccacggttttaaatggataaacacgcacggaaaaagggcttatccgcctcatctaacctaaccatggatcatctgtgtctatgagcggaccattcgcggcccgaatgtccagctacaaagtcagaccatttgacctctccagggggcacatatggtgctcaacacatgaaccctaccttttggaaaagctgaggaaccaaaagcatat

SEQ ID NO: 21763 - DNA, 1314 bp, Zea mays
ttaaatcaaacagaagcttcaggtaagaactcaatgtcaactggagagtttttttttttttttgcatacatcagctgcatttctcttgccacaagttagggcacttcaacggacaacaatacacgaattctctgcgaggtgctttcaggagcacaggtcatgggattgctaggcacactccacattgttttcaatatcaaacagactgtcccatatgacaattgcaggacaggtaatcacaatggctaatgaaacgtccagctcccagactcaaatgaagcgtagcttcttccttgccacctctgtatctgtagtagcaacagcataattttgtaaacatgacggaagcaatggctgtctcgtggcgtctcaacttaactggacggcacataaagtacctcaaatcctcatgatgcttgtgggtcggttcctgagttgtcgtccatgggcattcccagttcttttgcttcaagtttaagctggtcaatatgattctgcaggtcaacacaagcagcctgaatagctatatttttttgacacagctcctgccattccattttcagggcatgcagctgtcctccagtattttgctggtggaacttcctctctcgattgacattttctatcctttcattgtattctacagccatcttttgcatcctagacagaactgattccatttgtctgttctggagcttccaaacatctacgccatatttcagcataagctcgagattctctatccttataatttgatgctgcaactggctctgagcattccgtagagcctgcctccaagcgccaacatcattcctcttgttcattggaggtggctccaaaccatagcgagacatatctagcataaaaggaggtttgccagccctaacacgttcatattctttagcaagcataggatgattctcgaatccggcggtgggaacagggggcaggtcccggaggaagtctgcaggcttgcgcttccctcggcgcatctcctcctcgacgaggcgatcgacctcccgcttcaccgccgcatcgccgtagtcgccgtcgatgtagggcagcgcgtcaatggcctccgcttccggcaccgcgcgccagggccccgcagcggggtcggacggcggaggcgcctcaagcatgagaacctctctcgtcgccgacgaggccatcgcgtcaggctgtagcggcgcagtcgagagtcgagactcgagagagagagggaagcagtcgcgtaggccggcgcggaggaggaagcggagggggggatggccggatggagatggaggccggccccgagggacccacccaatg

SEQ ID NO: 21764 - DNA, 1415 bp, Zea mays
  misc_feature (1184)..(1188): n is a, c, g, or t
  misc_feature (1329)..(1346): n is a, c, g, or t
aaaagggggtttctcatcacgcatttaaaattgggaaggcccgggttttttcccagtacccggtgtaaaaaaaggggccattttttttatttttgggtccccaaaaaaaaaaaaaaactccccaacccccctttaatataaatttgccttaaaaaaaaacccccccctttttttttttttttttttttttttttttttttttatttttttttttttttttttttttttttttttttttttttttttttttttttttttttttttttttttttttttttttttttttttttttcttttttttttttttttttttttttttttttttttttttctgaaaatcaaacagaagcttcaggtaagaactcaatgtcaactggagagtctgcatacatcagctgcatttctcttgccacaagttagggcacttcaacggacaacaatacacgaatttagattcttcctctgcgaggtgctttcaggagcacaggtcatgggattgctaggcacactccacattgttttcaatatcaaacagactgtcccatatgacaattgcaggacaggtaatcacaatggctaatgaaacgtccagctcccagactcaaatgaagcgtagcttcttccttgccacctctgtatctcaaatcctcatgatgcttgtgggtcggttcctgagttgtcgtccatgggcattcccagttcttttgcttcaagtttaagctggtcaatatgattctgcaggtcaacacaagcagcctgaatagctatatttttttgacacagctcctgccattccattttcagggcatgcagctgtcctccagtattttgctggtggaacttcctctcgcgattgacattttctatcctttcattgtattctacagccatcttttgcatcctagacagaactgattccatttgtctgttctggagcttccaaacatctacgccatatttcagcataagctcgagattctctatccttataatttgatgctgcaactggctctgagcattccgtagagcctgcctccaagcgccaacatcattcctcttgttcattggaggtggctccaaaccatagcgagacatatctagcataaaaggaggtttgccagccctaacacgttcatattctttagcaagcataggatgattctcgaatccggcggtgggaacannnnncaggtcccggaggaagtctgcaggcttgcgcttccctcggcgcatctcctcctcgacgaggcgatcgacctcccgcttcaccgccgcatcgccgtagtcgccgtcgatgtagggcagcgcgtcaatggcctcaagcatgannnnnnnnnnnnnnnnnncggacggcggaggcgcctcaagcatgagaacctctctcgtcgccgacgaggccatcgcgtacaggctgt

SEQ ID NO: 21765 - DNA, 1954 bp, Zea mays
aaagtacaaacgaaaatgtaaaccctgtatgaagccaaggcatttgtaacgaagccgtggaaaatggtattgctatattttctgaaaaaattcaggtacacaacttgagataccaatccccagaaaaatccatagaaatgtatccttcgggaatgaagagtgtggtcctgtttgtgtataagccagtcgcatgattctcaatgagtgtagctattcacgctgcacagtaacagctcaaattcacctgaatatgtacatcctacttcaactgctgctgtttgcatatccttttgtttcttctgctacctttgtccatatggtagcaaaatgatccgagtatgtggcctgatccaatacaaagccttttagcatctccaccaaatcctggcgcctttccttgttaaatcttttaatttcattcatgttattttccttgataagttccaattctttaagtgcacgtgtttttgcatcttccgtggctcttactgtttctttcaattcttctatcttttgataccttgatctctcctgatccattcctctcgctgatacagattcaagttttcctgcccgggtatgcaagaaatatagatctgctgacaaattttgcacacgaagcaaagcattggaacgatcagtaaaagcattatgaacagaagccattgtctccatgtactcatggataatacccagatgttttacaatttcagtgtttagttttgtctgtgatctgctaactctaataacagcactggcaaaattactgatgtcagcagctcgtcttttctgagaactacacgcagcctgctccttttcaaacatagccagtttgatgaatgacattcccaagagacctgtcgttgatcttagatcgtcaaaagctttaacaaatgcctctgcctgctgagatgctgtcaccagatgtttctccaagtcctcaagcttggccttgtgcacaaggtactttgtgtcaatctcctcctccactagaggcggccttaccgccacccacccattcgtcactgtctgcttcaggcccttgaacaccccaaaaaagtctctcccactcttggtaggcgtcactggagcggaagcagccatggacgtagcagcactcatcgcagggctccacctgggagactcaccgtcggaagtggggatgccgctgggctcggtgaggaaggcgtggagaatggggttgcggccgacgacggggtgcgcggcgaggcggcggaggtagcgctggagggtgacgcaccgctggttcacgaagtcgtgccgctgcatgacctggccctcgacgatgctcttgtcgggccgcgccggtacaaagaggccgcggtgggtctccgcgaggcggtcggcgagcgccacgacgtcacggaatcgccgacgcacgcggaactcgcctccgtcgggcacctgagtggcgatgaggtaggagacgtagctggccgagccgggaatgacgcccacggctccggtcgcgggctccgcgtgcttcctaggctcggagacagtgatctcagcgaaccacggtgacgcctcgcgggacttcgtcgcggccgtagcggcatggggagccagcggaggcgtgaagtcatccaccacgtcctcatcctcctcgtccagaaacgcgccatggttctcaccggcggtgggagagaaggtggacgaggggggaggtgggcggagcagcgggtccgtcgtagccgcgagagtggaggaggagtccaggggtagtgtttcgacgtcctcgacgagattccccggggacaagggctcggtggccatcatggccaccgtcggcggttagggttggggcgagaatgagatctggcggggaatcccgcggcggagtcaagtgactcaagtccggttggaaggtgggcgccgtgattcgccgcgcgtacgcataagcaaaagcgaaggcaaaaccatttcgtgctat

SEQ ID NO: 21766 - DNA, 2034 bp, Zea mays
tgatcttagatcgtcaaaagctttaacaaatgcctctgcctacaaatgatgccatggtagtagattagctagtttactccactagtacacagtacagaaaacttatgatgcataaaatgtatctttctgcaagtagcaaatgcaagtgtatgggctgctccaaacaagcactaagaagtcagaagtcaatcaccttatttatttatttatcctgtttttctgcctttagaacaacaatgataccaatgaaaacaagatacagagtctccagcatggaaactaaatattcgcaaatatgcggttacctgctgagatgctgtcaccagatgtttctccaagtcctcaagcttggccttgtgcacaaggtactttgtgtcaatctcctcctccactagaggcggccttaccgccacccacccattcgtcactgtctgcttcaggcccttgaacaccccaaaaaagtctctcccactcttggtaggcgtcactggagcggaagcagccatggacgtagcagcactcatcgcagggctccacctgggagactcaccgtcggaagtggggatgccgctgggctcggtgaggaaggcgtggagaatggggttgcggccgacgacggggtgcgcggcgaggcggcggaggtagcgctggagggtgacgcaccgctggttcacgaagtcgtgccgctgcatgacctggccctcgacgatgctcttgtcgggccgcgccggtacaaagaggccgcggtgggtctccgcgaggcggtcggcgagcgccacgacgtcacggaatcgccgacgcacgcggaactcgcctccgtcgggcacctgagtggcgatgaggtaggagacgtagctggccgagccgggaatgacgcccacggctccggtcgcgggctccgcgtgcttcctaggctcggagacagtgatctcagcgaaccacggtgacgcctcgcgggacttcgtcgcggccgtagcggcatggggagccagcggaggcgtgaagtcatccaccacgtcctcatcctcctcgtccagaaaagcgccatggttctcaccggcggtgggagagaaggtggacgaggggggaggtgggcggagcagcgggtccgtcgtagccgcgagagtggaggaggagtccaggggtagtgtttcgacgtcctcgacgagattccccggggacaagggctcggtggccatcatggccaccgtcggcggttagggttggggcgagaatgagatctggcggggaatcccgcggcggagtcaagtgactcaagtccggttggaaggtgggcgccgtgattcgccgcgcgtacgcataagcaaaagcgaaggcaaaaccatttcgtgctatactctcaatggcaggtgggccaggtcatctctttcgtttcacttcgcatttcgcgacggcgtcccactcgaacactagagactactactacaaggaaattttttttaaaactttttgaaaactatttctaatgctagtttggaaacctattttctaagtaatttttattttttaaaaataaagtagttcatttttcttaaaatagaaatttcttggaaaaataaagttctcaaactagccctagcaggtttttttaaatttaaaccatctcagttataccgtaccaatcagtctaatatgaccttggtgcttgtcgtgactcgagtgcactagctatcacctaggggtgtttcggactgctatgctctagaaaattttaactccactacatacatcagttgtcaaacactcctaactcaaatcagctccgtttctggaaaaagagtgaagtttaccttaactccaccaatttagcggagcagcaaaagagatgctctacaaatttatgattttgtgaagttggtatacaattacctgccataccagtgattacacgacttaacgatttgttatgttctattttatccacgtgcaggtggtttcttattcgtaccacgtcacgtctcgtggaccatcgaggcgttttcggcctccgcttcggagttgtcgcctgacgcg

SEQ ID NO: 21767 - DNA, 2068 bp, Zea mays
tccactaaatcacccacactcataatctctactaaatccaaaaaattgcacataaatttaacacaccatcaaaactaattgttcaaatcatttggataaccatctgttcattactcactcaaatttaataaaaatattgtttggattatttttcatttctcatcctcctctctccctcctcgatcctctccctccccacgtccctgtcgccgtcaactcctctcctcataccatcgttgaagtcgatctcttccctaacgttagcataagctttatgctagtcatagattaacttgtcaacgcagagcgaacaacaatttcgacatagggtgtttttttggtcctgcctgtttttgtgacaagaactagatatgcaaactggatcgcagcctaaggccgaacagtgttaggacctgtttcatcaaaatacatatgaattgaaggtgattgagtgagtttcaatccatagcaattaaaattattttataatttttttctaatcccttctaatctatgagacataggaataactcgtagataattgctgcactaaatcaggcacacggtattcagatgctggccatggtccttgccaggctccacctacgcaaacgtctccgacagcttgcagaagccgagcttcctgagcctgctggtcatggggttaccgcacttgacgtccaccaactcgacgccgtacacgccccccttcttcttcgccctgcctccactcggggtccggacgtccacgagcgcgccgtccgagcgcagcatcggcgagtcgaacgtgttcctccgggagaccctcctgggcttgcagcaggcatcttcggcgctcacgcggtcggccctgctgccgccggagatgtccgaggagcttttcctcagcacggtcttccgaggagtagcggctccgcacggcaccgagacaggacagccttggtggcgcctcaggcgcgggttgcccgcggctgccggtggcggcggcgcgaccttgacggcgtccagttctcttgtcatgagggagccgatggtgcccgttgtgcctactttgatcgtgcctccctcgccgtggacgacggcctcggtggctgcgcgaggcatggtctgtttcagccaggcaggagaccaccagcgacgggttagctttcgtacaatacaatacatacaatacaagcagcggctgagcaaagcttgaagcaacagctggacttggatcgagcatgcgagagctggtgagtggtgagaggctggcagtgtactgctgctgtggttaaaagcaagggaaaaaaggttgcgtaacaagagggaatgaaatcatggcaattttctgtaagtagtgtgcaggatgatgagaaggggtgaaattgcaggcaattgtctgccatgattgctgtttgatataaaacaaagaaagaaagcgataagtttgcagttattcaactgccatgacagcacagcgtcaacccaactgtaagtccacacaagcaaatgtagcagatatttcatatctttatatgatacccaaacaacatctatccgtaaatattagtgccattgcgcctcacttttttttatgcccccctcccttttgcagaaaagagcgtcaggtcgaaattacatgatatgttcagtgtttacacagtgagagacatactgcactgttggaaatgcatcgttgatcagttaatttaacactacaatccaatgcagcgcagatgagtatttcacatagactgggaaatccttcagcaatatcagaagctgtaggtgagtggcgaccctgaaacagcaggagacggccatggaaaacgatgtgccgtctgcgtggtttctaaggcctagttcgggtcgcccggagttatccaaactattccagttgacaaaacttatataaattaggtaaacaattcagctaggaaccattccaggcgacggttacgtaagaaccgaacgggctctaaaggaattcagtagaggatcccaccaacaaactgaggtgtaaatatccaccatgccaaacgctgctcggtggctccccctttcttttcctcccctcctttctgcc

SEQ ID NO: 21768 - DNA, 885 bp, Zea mays
gctctaaggccggacaaggggagggtgttagggccggtttggttctccaaaaatacatacgaatcgaagtggattgagtgagtttcaatccatagcaatttaaaacattttataatttttttctaattccttctaatctatgagacataggaataactcgtagataattgctgcactaaatcaggcacacggtattcagatgctggccatggtccttgccaggctccacctacgcaaacgtctccgacagcttgcagaagccgagcttcctgagcctgctggtcatggggttaccgcacttgacgtccaccaactcgacgccgtacacgccccccttcttcttcgccctgcctccactcggggtccggacgtccacgagcgcgccgtccgagcgcagcatcggcgagtcgaacgtgttcctccgggagaccctcctgggcttgcagcaggcatcttcggcgctcacgcggtcggccctgctgccgccggagatgtccgaggagcttttcctcagcacggtcttccgaggagtagcggctccgcacggcaccgagacaggacagccttggtggcgcctcaggcgcgggttgcccgcggctgccggtggcggcggcgcgaccttgacggcgtccagttctcttgtcatgagggagccgatggtgcccgttgtgcctactttgatcgtgcctccctcgccgtggacgacggcctcggtggctgcgcgaggcatggtctgcgcacggggacgggaggtggaggaccggaggggcagctaggttgcgagcagaaacgaagatgaagagcgaggtgaagtgaaggggaagtcctgtcccattcagggcccgttggttctctcccgtatagaaggatcctcgaggtacccaa

SEQ ID NO: 21769 - DNA, 4650 bp, Zea mays
gcttattcgtgccgggccggcccgggccagcatataaccgggtcgtgccgggctcggaccgggcccaaaaaacgggcttcgtgccgtgctcgcgggctttgtgcttattggacatctatagaggcacttgtcacatcatggcagagtcagagacgccagtgtcacgcacaattacataagagatctacaagaatataacgacggtaattcacggcatagcatgatccctccaagacgatgcgtggaggattgggggaaggggcttcctgacgacgcctccaaggaggctagtggcgccgagggcgtcgtcgcctacacagacttcgtatggcatggctttcgcctgggaccccaaaacccctgctcaagctaccggttataccacaacgaacacaacaacatacaacaggagtgggggttataggagtggctccgaacttctaacgtcgatgatggagacacaggttgtgcttcacctaggggctcgaggccagctatgcaaccaatggtggtggcgctgccttcaaagggaggggtgcgagggcccaaggtgagcctgatccaatgaacccgatgaccgccgcacgctactgccaaggtcaagccgcgcaccgcgggcgcactacgagacgcagacgttgtcccttagtggttagctgcggccaccattgggagccagcgtcggaaaccgcccaagcgtgaaaggggcgccaaatccgatcgtgcctagggtagtggagccaaatcccctcgcggcacaagtacagcgcgttgaggtgggctcaaagggaaggcacaaagaagagtgtggtgatacctctacatctaaggccatcgaatgaggaaagtcaatatgagcccgggtagccacatccggtcgcactgtcactggtcgactaccggcggacgctccggcgaaagaacacacgtccggtgggagagagatgagggaggaagaagaaagcaatcgagagagagagggaggaggaagaagaagaacctagctgtcgccttctttgccctccacctgaccaccgatgtcgtgcttcggtgacggctgggcagcgaatgcgtgagggaaggggctgggggcggcgacggtggagtgccgctcgaggcgctagcttaatggtgagtcccttgtccttgcccatccctagcaatcatgccggcgacagcctctaggggcttatgatatcggcaaggctccaccgctggtaagacccgagtacgaacaaacagagaagaagagaggataatgattcattttgagatcttgattgatttgttgggagggtatccacaagaataacataagacaaaactaggtaagtcacttttttgatttcaccattccaatataaaggggaaaagtgtttttttagcaaaactcatttcccaaactactgtttgatacgacttaaggaaaaaacgaaaccaaagtaaaagccgatgctaaaaagccataccaaaggacccctaactcctgtcggtaaacttggcagccaacgaaagttagttaattaccgttgacaaagctaggttagctgacgaaagttaatggaatttttatgggcttggagttaattaattcttgttggcttgatcaaagtccgatgagaattatcgaagccaacggaaatggccccgggaattatccaaacctatgggaatgtctccgattcctttagtgtttagaaataaatattcttaaaaaaacatgctgaaatatataatctggattaaattgggggcctttgttttttttttttttttttttttagcaattaaacacaccagtgaagcttgttttatttattggataacacgtacaataacaagatgcaagcgagcagggtaaactcaaaaaagggaaacatacatacgtaggctgctttcgttatctgcttatccatcatcaaccaggcagttcttattgtatatatgatcgcagtcgcagccaaatccggagactctgcagtgcagaagttcaagggatgggttcaggttcaggttcaggttcagggaccttgtattcgttgaggtagggcatggtggtgagcgctttggtcatgagtggctccaccatctcccacgcccacacacgttcttcttcttctgtccccttggctttcttctcgatgacggtgataatgtcttcctcgacgctgtacctcatgctgccgatgatctcatccgcagctgggcccaggtcaacgcgttcaatctcgaagccgccatcttttgtagtgctactattgacacgaacgagggttgggccactgaacaggttgtgcttgccagcaatggcctcctggtacgccccggagacgagtacggccacgtagtagccaccgaggctcggctcgaacaggtgcagcggcaatgtgttttcgcggctgatgaagttctcgatcttcccgtcactgtcgcaggtgatgtccaccagcgtgcccttgagagtcggctcctcgttgaggcggctcaccggcatcatcgggaagagctgcccgatgccccagaagtcaggcaccagcgagaagacggagaggttcatgtggtagttatagacggtgttggcatcggcgacgaccctcttgccgagcttcttgccaagcttgtacatctcgatgccgtgcttcttgaggtctgcggcgtgcgagtaaacggccgccgtggcgccgccaaccggagctctcggctgcttgtaagataggtcctggatcctgttcaacagctgctcggaggtgtcctcgtcctgcggctccgggatcgccgagagcgtctcgaggatgatcatggagtggtgcgacgccatggcgcgcccgctctcggtgcacacgaccgggtgcgcgacgccgttgtagtcgcacttgagccgcaccgcctgcacgacggcggaggcgtactcctgtatcccgtacgccaccgacatgtcggagtcgcctgaacgggtcccgtcgtagtcgaccccgagcccgccgccgcagtccagcgtggccaaccacttggcgccgtgctcgttcaccaggttgcagtagatgccagcggcctcgctcaccgcgtcgtacactttccccgtcgtcgggatcatggagccgatgtggaagtgcagcagctggagccagtgcaacttgccctccttgccgagcgtctcggccacctcgtagatctggtcggcgagcatcccgaacttgccgtgcttgccggccgtcgaaccgaagtggcctggtagcttggtgagaagcttggcgcggatgccgatgaccggctcgaacttcttgcgcacggcatcgtcgtctggcagcttctgctgcagcttcttgtactggtcgaggacgatggcaagctcctcctccatctcgagcacgatgatggggttcaggcccatggcccgcgccgagagcgcgagcgcgatgtagtccgcgtccttgtagccgttgcagatcaagtacggcttgggctcggcttcggtgacggggaggcagctcatggcgatgagcagttctggcttggagccagcctcgagcccatagttccattgctggccgaacctaaccatgtcctgcacgacgtgcttgttctggttcaccttgatcgggaacacgccttggtacctggacgtgtacccggtggactccatggcgctgttgaatgcgttatggagcgtctcgatacggttcttgagcacgtcggggaagcgaaggatcatggggaactgagatttgctggtgctgtcgttgggttgggtcgctagagcttccacgatgaccgagtgcacgtcgatctcctgcccgggctccgtccagcggccgaaaggcttcacgctgaggtgcccctccgtgttcaccgcgaagtactcctcaccccatccgaggatgttgtagagttcaccgtagttcttatccatgatgggaaaaagtgctctccagctgaatttggggagccagagatgaatagactttagtgctgtggtgtgtttttcgccggccccgagacacccatggccgaccggatccataaatatgcatgcatgagatgttgtctgctagttttaagctagttacgatgttcaatatataatgaagcttgttaaactatatagtgaatgtcgtagtaatggtatgttacgtactttcattttttgagaagtgaatggcctcacaaaagctgctctttttgaagcaatattagtggtcatcttagattttaatcctaaatatgaatagttatctatgtagtgtttaatatgcacatcatactacattgtcaagcagtaataatgttatttacttctgtaccggtccctattggtgcgatggcagcttgatcgatatgaagtagggtctgtgcctatctaatgacaagcttcttaaatactctctccgtccaaaaatattaatcattttaactcttgatttttatgtttatatttaaataaataatgataaatctagacacatatataaaaaaataaattaattattgtatgaatcaactaaaatggataaaacaaattttattttgggactagtatgtctcaacattttaacgtgtggtgtcatagccatattccatattgcacacacaattaaactttgcaaagcttcaccatgcatgtgttcataatatcggtaagaattatgtgaa

SEQ ID NO: 21770 - DNA, 3358 bp, Zea mays
  misc_feature (625)..(625): n is a, c, g, or t
ttggctctggattgtcatagaagcaaatcttttgttagtaactctgttcatttaaatggtcgtttagcttgtttaaacatcatgtaaacgctacactgtgttttttccatttagtgtattttatcccttttatttggtagtgtagcccatttaacgatctatttagtttgaataacgactaaaccgataggtgaccgactgtttaccattcagcatttaagaaaatatttgttagtagtgtggtagcttactggtagtttaccaggtaggcgtaaaagggaggctagattatgaagtgtcataatttgggtctcgttagggaggttttgggtctattgtttgtgctatataaggggcatttaccttgcacctagattgaagcatagcgccctagtgtgttgttgcctactagtagcaattgtgataagtgatgaaaccctaccctaggaaggtgtacaccttttcagagtttgattaagctgttatcacaggtgtgcaccctcacatgatcagaatggatctcatttgaagatgatttatgaggttgatgttaacctgctcatgaaatttatttaatggtttaagatcttttacttagtatagtaaacatgttattctaaaaaanccttggcaactaaaaatgctaactgcattagccctatgttagttattacctcttgttatcaaccttgcatattaaattacttatgcacttgttgagtatgacatatacacataacccttgtaatctctaaataaaaaaagggttggatgctagttagatgttgtgtcgtgtcgtagaccttcctatggcttggtggaatcgctctatcgttttcatctgacgcccgtttggatcttggaattgaatttcattctaataatagtaatttatgcatatatcaattaagctaattcagttttatacaaaatatatttgtatactattattaacaagatatcggagatatttatgtgctgtatttttattatagagaagtgatccgaaaagtgtcctataagttgtagattagaaataaattctactgatacataaaataatttcacatcctccatctcatgaatttgagatagtcctatatctgaactttgaaagtagtggaatgttaaattccaagctaaatagtttactttattaagtaaattctaattcctgcaaaatgaatggattcaaacgccccgtgatagtaatgtcgaacactacattttatgtttccaatgaacgttgaggcttctaataatatattgtcacttatttatttcatatattgtattacctctgttcttaaatatattgacattattattattttttttaaaaaaatttgaccactcgtcttattcaacaaaaaaatgtgaaatgttatttattttattataatttgttttatcacttatggtagtctgagtgtgatttaaattttggattttcgaataagacaagaataagacgaatggtcaaagttttttttaaaaagtcaacgacgtcgtatatttaaaaacggagggagtatttggtttatagtaaacatgtttttttgggcatcacaagtttgaactggtgtgtctctgctagttttgtcagcactgctgctgctgggaaggtagggtcgatcgaggtgcagcagcacttgacttgtccgtcccctctccaatcacagttctgtacgtatatccatctcagcaccactcgtttatatatgcacctggggatcaataatcatttgtctcttccataagcgtagacctaccacagggctgggccaaccagtcccgatcgatcagccagcatggcgtcctcctccaaagggtcgctgccatgcgtgctcctcctcctcgctgtcttccaccacggctgctcgtcggcgagggcccacagacgtgccggcgacatggagaggagcatgagcaccgacgacagctcgatgatagagcggttccagcggtggaaggcggcgtacaacaagtcctacgccacggtcgccgaggagcggcggcggttccgggtgtacgcgcgcaacatggcgtacatcgaggccaccaacgccgaggccgaggcggcggggctcacgtacgagctcggcgagacggcctacaccgacctcaccaaccaggagttcatggccatgtacacggcgcccgcgccggcgcagctgcccgcggacgagtcggtgatcaccacgcgcgcggggccggttgacgccgtcgggggcgcgccgggccagctgccggtgtacgtgaacctgtccacctccgcgccggcgagcgtggactggcgagccagcggcgccgtgacgccggtgaagaaccaaggccgatgtggtacgcacaatccgttaccgacaccatcatcattccgcgcgtccttcctggcacctgtcatttgccaccagctgttgctcttgcctgtcccacatgcatgcatgcttgtcactgcgcaaaacgcacatgcttttgtcctggatggacgggtgacgggatcggatcgtgcacgcagggtcatgctgggccttctcgacggtggcggtggtcgaaggcatctaccagatccggacggggaagctggtgtccctgtcggagcaggagctggtggactgcgacacgctggacgacggctgcgacggcggcatcagctaccgcgctctgcggtggatcgcctccaacggcggcatcaccacggagaccgactacccgtacacgggcaccacggacgcctgcaacagggccaagctctcccacaacgcggtcagcatcgccgggctccggcgcgttgccacccggagcgaggcgtcgctggccaacgccgtggcggggcagcccgtggccgtgtccatcgaggccggcggcgacaacttccagcactacaagaagggagtgtacaacgggccctgcgggaccaacctcaaccacggcgtcaccgtcgtcggctacggccaggaggcggccggcggcgacaggtactggatcgtcaagaactcgtgggggcaggggtggggcgacgacggatacatcaggatgaagaaagacgtcgccggcaagccggaggggctctgcggcatcgccatccgcccgtcctatccactaatgtgacatggtgtggtgtacatctgttttcgttttaattatcattttattttattaaacaataaataagtagtcaacatatggatcgactcaaacttttgcagttacgtgtaccagtacacttgttgtaaataataatccatggcatctcgcgtgtaaactttattctggtgcgaaaacgacttcttcaaatgaaggtttgtacgtgtaaaattttgtggtcactatcaagcaaaacaatcgtcatttactc

SEQ ID NO: 21771 - DNA, 2694 bp, Zea mays
gacaaaatatcgattttttccaccccacacccccaacccaacccagagcccgaactcttcacgtcgcgtcggccggcaattggcattcccactgcgccgccgtcggatcgactgggtcctcgccgccgatgggcttcttccgccggatcgccggcttcctaggcatctcgcgggacgacgccgaccacccggactccccgacctccgtcggcggcgccgcggcggcggcggaactccctcatgacagggcggcggcgcacggggtgaggcaggggttcagcgtcaaggttcctgtccatgtcgagcggcaggtgcccgtgcccgtgctggtgccctgcccgcagggggacggcggcgtgcagggttttaggtggtacacaaggaggcttaggatcgatgaagacggcgacgtggctgacgagttcttggatgaaattatcccggaaggctcaatcagcaacgacaaaagcgcaaggttccaagtgaaatataacaataaacctgctgctgtagcgctgaggaagcaggtcatcgctgtcgacggtgacatccgccatagcttggaacaccaggggcaactgcggtgggtgtgactgagtcggagcagataagtgaatcctgagctctgctccatcagtgtgcgttgagcagagggcgggcgcacacaggagcggagcgaatgacccaggttcttcatctctgaagtggatctagaggtagttcgttgctgatgtatccattgttcttcgttcagtgtgttggtatgcttgatctcatggcgattgagacgccttgtaccactagcagttgtacattattgaaacagctcccgctgtacatgttgaatgtgcttgcttggcaatggatctgccagactggtgaaaaattggaatgtgacacttcagccttcagcctttaagcatggctacaaatttagagcaagaatttgtcatgctaaggaatagtttttttttactctgtaatatataaaggccatatctggtagtgctcttgtggctctcgctcctttcatttagtaactgttatatgaccaattagtgttatttttttaaaaaagaacaagggtaaacttgcactactatatttcgttctttttttttagaaaaaaaaaatcaaaaggttcacacaccacacgtccaatttattttaccttttctccccttcccaataatttaataataattatttgatggagacaatattatgcagtatatcatgtagctatatatcactagttagaatgaatagtgacgaatattctagaaggtgtggccaggctgcaaagacggcggttgcttgctgcgtcgctcgaggtgggccccagccaggcctatccacccatccaattctcctataccaatcaaagatcgtcgcggggctggctgggtcacgaaaggcccatgctccaatcatcatcgccccttcgtgggccccacgcccgcttcggttggagacggcccatacggtccaccgagaaccgtgtccacgccatcttcctcctcctcccctactctgacctctcgtcgtcgacgaaggaaggattccgcccccgccccggccgccttcgccctcgccgctgcattttccggtggcctctccacgtgcggccgcgagacgcctcgcctgcctagttgtctcccgggggggggggggagggggggggctgggacttgtgaggcgagtacgtgctatgaccccgctctgctgggtcatctctcgctttccctgcattccatatttccatctacacgtttatatgctgccaacagccggtcatctcgaattcggtgtagcggttttcttgctgcccatcggcggagtgtttttttttttcgttttatttggacggggctttggccggcggacaatctgataccactcctactacattagtgcatgatttttgtgagacatagattcttattaaagcacgcctgtttttaattatggtttcatatcacatgatgacattataatggagtaattgttggataaagacatactttttcctctcgagccccaaacctcgtcctaacgagatggaatacacgttgagatttcaaacgaagagtgagggagagagtatctgtttcctgttaacataatttcttattgcctctcaatgtttgtttcttttgggttcgttcaacattcaacaggaagccttacacctgttctgttcaagacggcaggtgttggtgtttcggttgcaatagagtgattggggaaactgatcagccagaattgttggtcaaccgatgggaagcaatgaccctaacacaccctcgaaggcttcaaaggcgtcagaacaagtacttcaaacagtgataacacgcttttatatttgataaataaatggcactgtcagtgattaactgtgctcctgttattttccttaagagacaatggccacttttttccctactagtgcagtaaccttagggtgtttactagatataatgacacttttttaatactccgtgattttgctgcggccaagtttggaaacatgttgaataggttttgcatgacatggattgatgctttgattatggattaataaaaaaatacaagtaccgaattctgtttctattgtgaaaaaacacacgatgcttttatttctattgtggcagaaggaaatatccaactaggccaaaacatgatgctttgttc

SEQ ID NO: 21772 - DNA, 903 bp, Zea mays
  misc_feature (49)..(49): n is a, c, g, or t
acatactcagatgttggtcctcaaagaccgctcttcaccatccaccagncaatgagtccttgcgcaccaccaagtgcaaaaagagccgacagcctgatccccagttggcgagtaacataacctcttgcaatgaagtatgcaaaaggacccgcaaatacaaagcccaaagctcttccccacattctgtgtgcatactccatccagtatataaatttgaaatcttcaaggctcattcctttgttcacccttttgtactcaggtgactgcttgtatttctcaaattccagctgccatgcttcgtctgtcattggaggtatttcccctgtgaacttccagtcagtcattgacagcccagaacgtgtgagccgagtaatacctcccagtatgaccaagctgaacacccaggcagcacaaccaaagagccatatcccgaccgccttctgcgcatgagcccctttcgtaacaagcagcttcaatcctgaatttgctgctccactggccacagttgagttcagtgctgtcgccgtagttgacattctccttgtgcattggccaaacatggccttgggagcgagggatcggaaggcgtggaagttgccgaaccgggaggcgtaagagaaggcccccgatggccccgaccttggcgggaggaggcagcttccgccgccgccgccgccgccgccgcaagaggaggcagatccaaccctatgcggtggagccggagcgagggcgcttctcggcagacgaggcgtcagcagggaggatgccaggtacctgccccgccggatcagcgccgctgccaccctgctacccatcgcggccggcggcgactggcacggcggcttgcggaggaagtcgagctgtggggaaggaaagctggaacggaagcacacgccccggccg

SEQ ID NO: 21773 - DNA, 975 bp, Zea mays
  misc_feature (970)..(971): n is a, c, g, or t
cggaatcaaacctggctccaggcagtgaattttattagcatcttgtccagggaggctcaacatgcaactcactaactcagtgtcaacaatgcaatgtagcaattactaaaagaaagggctagggggtatttctaacacttggcactagaaacacattgagggcaagagcttgcatgcctttccagcaattccgaaacgctacagcagtgttaaggtggtgcaaagaaacacggcaccattacatgttactctagtattcaccttcacatgtattaagatggactagtgtgtaagttaaactaatttacaccccaatccaccttaatacatgtagattgtagtgaatactggagtaaccaaacaaagccttagggtgggaaaaggaaaaaaaaaacaacaactcgtaactatacgatggtagaatccaagaaatggtatcaggttgatttcacagcagttgcgatcgacttaagacgagctggcgacggccttctcagagtgtgaaccagaaggatcgtaagtgacagtagagtcaacgctccagcttggtgcgctgagcccaacgaggttggaacgtacgtcaatagcgtagatatgcccaatgtaacctggagagcagccatcccaagcgtgcttccgatcagtgacttgactgctgggtgcatgtctattttccttgcagccaaccataatccacccacagagagtaatgttgttgcggcaagaattcgatgattgagctgtactgtagatgtgttctcaaaaaagttgcgaacgaaaggctccatactaaatacatcttcaggaatccaactgggtcacccatcttcgggaatgaattgggtatgcatgtcccgcatcattgcccgcaacaaatgctccagcccgcttgtcataacagtaataaactcaaagatgagagagacgcaacgtaaacgcagactatcaagggcagaaactacgaaacacnnacgc

SEQ ID NO: 21774 - DNA, 4485 bp, Zea mays
gaaatcaaacctggctccaggcagtgaattttattagcatcttgtccagggaggctcaacatgcaactcactaactcagtgtcaacaatgcaatgtagcaattactaaggccgctttttttttttttttttccaacacttggcactagaaacacattgagggcaagagcttgcatgcctttccagcaattccgaaacgctacagcagtgttaaggtggtgcaaagaaacacggcaccattacatgttactctagtattcaccttcacatgcattaaggtggactagtgtgtaagttaaactaatttacacctcaatccacctcaatacatgtagattatactggagtaaccaaacaaagccttagggtgggaaaaggaaaaaaacaactcgtaactataggatggtagaatccaagaaatggtatcaggttgatttcacagcagttgcgatcgacttaagacgagctggcgacggccttctcagagtgtgaaccagaaggatcgtaagtgacagtagagtcaacgctccagcttggtgcgctgagcccaacgaggttggaacgtacgtcaatagcgtagatatgcccaatgtaacctggagagcagccatcccaagcgtgctcccgatcagtgacttgactgctgggtgcatgtctattttccttgcagccaaccataatccacccacagagagtaatgttgttgcggcgagaattcgatgattgagctgtactgtagatgtgttctcaaaaaagttgcgaacgaaaggctccatactaaatacatcttcaggaatccaactgtcacccatcttcgggaatgaattgtatgcatgtcccgcatcattgcccgcaacaaatgctccagatattgcagtaatgcctacaacagcactgacaggaattgccaacttcctgatttttgctgcaccgtttacccaactcattgatccggttggaggatcaggcatcactactgacaaagcagtccacaatatgccacagtatataataaatgcagatgtcaggtgagttgccagcctgtaagggctaacccttggttgaacatactcagatgttggttcctcaagaccgctcttcaccatccaccagccaatgagtccttgcgcaccaccaagtgcaaaaagagccgacagcctgatccccagttggcgagtaacataacctcttgcaatgaagtatgcaaaaggacccgcaaatacaaagcccaaagctcttccccacattctgtgtgcatactccatccagtatataaatttgaaatcttcaaggctcattcctttgttcacccttgtgttcctcggccgcggccgcgcttgcattagcagaaatatggcattcaaagcagtatctcttaaggatgggaacttataagaacaaacaccaggggataaacatttatctgtttaagggaaagtactcaaagttgttgagagtccatgtgaactacatattctatgttgctatcagattcatatcaattgctaccccccacccccaaaagtatagttaactttagttttgtcctaaggcatacttctctaactttgaacgggttttttagaaaaaattatataacatctacagattcaattaaatgctatgtcaaaacacatttcatggaaaatataaaagaaactagtttgatgttggtgtatttttctactaaattggtcaacaattagagaagtttgacttaggacaaagctaacgtgaactataatttggaacataaggtagcacaaaacagtattcttccttttttttcctttgatcttgcatactgttgtttattacaatgttctaaactttcaaaaaaaagtactgataatgtgtgtcaaggttacacatgtgagaactatggggatttctggtttggtgcacatgggagctaaagttaacataaggccattacctagttacactggtgaccataaaaaatagcagacaaatgtaaggtaacgtatgaataaatgtcagcggttgcatccttgccttttgtactcaggtgactgcttgtatttctcaaattccagctgccatgcttcgtctgtcattggaggtatttcccctgtgaacttccagtcagtcattgacggcccgcaacgtgtgagccgagtaatccctcccagtatgaccaagctgaacacccaggcagcacaaccaaagagccatatcccgaccgccttctgcacatgagccccttttgtaacaagcagcttgaatcctgaatttgctgctccactggccacagttgagttcagtgctgtcgccgtagttgacattctccttgtgcattggccaaacatggcctaaaatggaacaagcgtatgaatcagctgtaagtttgagaattccattcagcacgccaaggtgaagtaatgaatggtatattgcaatgcataccacgacttctaaaaagtttaataaatggactgtgaagtgtgaatttcacatatgcaaaaaaaaacatttttgtagtaatttctgcgactgaagcatagttttctatttaacagttcggccgtgcagagattggtcctgctcgctattctatcctatctaaaaacccggaagacatgtccagccaagactcaatgtagctaattcgctatatcaatcagacaaacctgtcatcccaagatggttctatgttagtcgaaaagaaaaaagggacgcaccctacaaataacagtgactgccccgagccattcccgtcgaaagcggtcgaattacagaaggtccagcaagcaattcctcgaaaatgaggacattcaacatttactcactcaagagggagacgcgagaagagcagagaggctcgctgaccttgggagcgagggatcggaaggcgtggaagttgccgaaccgggaagcgtaagagaaggcccccgctggcccagaccttggcgggaggaggcagcttccgccgccgccgccgccgcaagaggaggaggcagatccaaccctatgcggtggagccggagcgagggcgcttctcggcagacgaggcgtcagcagggaggatgccaggtacctgccccgccggatcagcgccgctgccaccctgctacccatcgcggccggcggcgactggcacggcggcttgcggaggaagtcgagctgttggggaaggaaagctggaacggaagcacacgcgggtcgcgtcggggtccctgtttggattctgatttcacggcaatgacggcagaaaacagtcatagcagcatcctcatcggtttctgatctcacggtcctccattcacctgttacacgcccaacaagcgacgtgtcttcttctatttgacacggctgctttcttatttgacaccggttatcttatcctctaacatgtatcactaactatctattataatagttagacacgtatgttaactaacaagaataaccgacaccaaagaagaaagcaatcgtacaaataaaaaagaaaagtcacatcgctttttgggcctgcatttcactgcagggttgtggaaaaggtaggtgaatggaggggcgtgagatcagacacggatgatgatatgaatcttgttagcggcaggaagctgccgtcggcgatcgaagtcacgacgacgcatcgtgagtcctaaggctcctaacggtggctaggttaagagtgagaaatatttgcactcacatagtcttgtgacgaagatgaaactttattcttacaaccaataacagtgttggctaaattattcacgactgcacatctaatttggttttaagatattttggagcaacaacaaaggatttcgaaaaaaatgtaatacaaccctaaagttaacaactataaatttgacaatattttattcatcttttctaagagtgtcaaacgtgctatatatagagataaaaataaattaaattttatcactatgtatatcatatattttaaatttagaattcataaatcactaatcatagtcagcacgatggtgagcttgaccgtgaagtctgcaaaggtgttgaagcctctaggtcttgaataagttcacggactcgacatctgagcatggatagcggttgacaacgaagtcggagaagtcaagaacataggtggtgaccgcaagctacaaacgatcatattagcaacgctatgtccactcttattacatctccacccttcttacgtacggacggacaattgatccgattatctaatacaacagtggtatgatttgtttgtctccaatatcttatcaagttataaaactggttgtagatacatttattttattgggaggtgatgaatatgaattgtcatggtatataagagtatttcagtgcagatacaaatatttgggtgggaggggatgaacatgagttgccattgcatttaggagtatttaagtaggagggaatgttgtaatgaacagtgagtgatatttaaagagcaagtatattgtgatttgtgaggatagaatgcatgaatgcagaacca

SEQ ID NO: 21775 - DNA, 865 bp, Zea mays
ctgccagtacaatagaaattaaagaagaaaaagaggggccttttttttttttttttttgaaatcaaacctggctccaggcagtgaattttattagcatcttgtccagggaggctcaacatgcaactcactaactcagtgtcaacaatgcaatgtagcaattactaaaagaaagggctagggggtatttctaacacttggcactagaaacacattgagggcaagagcttgcatgcctttccagcaattccgaaacgctacagcagtgttaaggtggtgcaaagaaacacggcaccattacatgttactctagtattcaccttcacatgtattaagatggactagtgtgtaagttaaactaatttacaccccaatccaccttaatacatgtagattgtagtgaatactggagtaaccaaacaaagccttagggtgggaaaaggaaaaaaaaacaacaactcgtaactataggatggtagaatccaagaaatggtatcaggttgatttcacagcagttgcgatcgacttaagacgagctggcgacggccttctcagagtgtgaaccagaaggatcgtaagtgacagtagagtcaacgctccagcttggtgcgctgagcccaacgaggttggaacgtacgtcaatagcgtagatatgcccaatgtaacctggaatagaatggttaacattaatatcggtgttgtgcactaattcgttaggacttcggttatactcttcaatgttcctcagaaattaacttgttcatgtgatgcaataagccaataacttcatctggcacacacattgcttggattgtgaacaacaattgatagttaagttactaacaaaataagcagggggatgctcta

SEQ ID NO: 21776 - DNA, 2623 bp, Zea mays
gaccaaggccggcctgccgaggcctctccgcgcaggcggcggcgttggcattgtctggccggcggcgttgccggaccacccattccacaagaagcaggacgctgtctggccggcggcgttgcctgaccacccattccacaagaagcaggacactggcgggcctgcggcggaattgccggaccacccattccacaagaagcaggacgctgtctggccggcggcgttgcccgaccatccattccacgagaagcaggacgttgtctggccggcggcgttgcctgaccacccattccacaagaagcaggacactggcgggcctgcggcggcattgccggaccacccattccacaagaagcagggcgctgtctggccggcggcgttgcccgaccatccattccacaagaagcaggacgttgtctggcctgcggcgttgcctgaccatccattccacaagaagcaggacactggcgggcctgtggcggcattgccggaccactcattccacaagacgaagcagggcgctgtctggccggcggcgttgcccgaccatccattccacgagaagcaggacgctgtctggccggcggcgctaccggatcacccgttccacaagaagcaggacgctgtctggccggcggcgttgcctgaccatccattccacaagaagcaggacactggcgggcctgcggcggcattgccggaccactcattccacaagacgaagcagggcgctgtctggccggcggcgttgcctgaccatccattccacaagaagcaggacactggtgggcctacggcggcattgccagaccactcattccacaagacgaagcagggcgctgtctggccggcggcgttgcccgaccacccattccacgagaagcacgacgctgtctggccagcagcgttgcccgaccacccgttccacaagaaggaggatgctgtcgggccggcggcgttgcaggtggaccacaagatgcacgacgcggtcaagcgggcaggggagccggatcccggatacgtcatgtatccggcatggagccccgtccgcccctaatcgtcgattcgttgttggagaacgacgacgctccgccggcaacggcgaatgccacatgcatacatgctcgtggctcccatgcgatattaagcactagtagaggaagtgtgtgatgtgtcaacgtgctactgctatactgtatatgcatgcctactgtatatgcatgcctattctcacgtttatgcatatgggcattagtgttccaaaaaaaacaggaatgccgactgaagagagcagagctttgttctacaagtggcaccaagggagcaagtggcggtagatgctaagcgtgccaacgaactcatctcctcctgtcctagctagttggctgcttcaattcatgtgtcttctaatctccgcgattctggtgtactgctgcggccgcggggtgacgggcgacctatgccagaaaactaaacgctctacgtttattttactagaacatgggtcaactccaggatcataagagtattcaaggcagtacaattacaactacaccattaacaagtacaaatagtaccaagcagcaattaatgagatgaatgccatttgaattggcacacttttcaaagataattatttcaacaagctagtagataaggcctgtcaaggcagtaagaacactggataacaaataagcacaaaatcttactgttgcactttgcaagtcccaaaaaacagtatagcatatctaataagattattacagtttgattgtgctgcgataccagcagcaaatccagctggaagatgtaggttttctttcttccccaattatattaattctagaacttggacaatctgggaaatgaagaatggtgtcagactttaaggatttgtatagtctgccttaccctgtcaatattttggactgagggagcaaagcattaggaaatggtaacagtgcttttcaaaaatgatatgacatgtcgtggagtcaatcaacagccaagacaatgaggcaacatatgaagtaacataaatgttaagtgaaagttcgaagcatcaatcaccaaccagatatctgctaaaaagtgttttactaaaaaacatgctgatgtacatttatctcaggatcataggttcagtttgttattcatatatcaacaatccgataaccaacacttgcaatagtacaactcaaagatttaaccctgattgattatccttgttgttggggtctgcttcgaagccgaaggtcctgtaaaaaaacacattcggaagatcatcacgaaaataacgccgaagctaccttacagagaacttcggcatagcaacatacctaagacgaagggttgcaccgacttaaagatgaaaagacagattgacccatgatagtttgtgtcatgaatgtagtcaattgtagagagtataaatgtaatttcacacaggctgcgtcctgtgcctataaatagatgaacagtacccccgtactgttcacgctgatttgtgctcactcgtgtatcacgcttgtactatctccttctgtcaagccgaaggtacaaatgtaattctatattatttctgtttattcgtaataatataataaaaaatgagttaataatg

SEQ ID NO: 21777 - DNA, 955 bp, Zea mays
  misc_feature (154)..(154): n is a, c, g, or t
  misc_feature (232)..(232): n is a, c, g, or t
  misc_feature (236)..(236): n is a, c, g, or t
  misc_feature (252)..(252): n is a, c, g, or t
  misc_feature (259)..(259): n is a, c, g, or t
  misc_feature (268)..(269): n is a, c, g, or t
ttcgccacttggatacctcttaaggaccaaagtgggtcccccggtgcggccgttaaactaggatccccgggttcaggaagaaaagctcctagttcccccccccccccccgaaaaaacagctagaatcggtcggtacgtctttgggcgggctctnggctcttccatcgttggcaggcccagcgcgcccgattccgcccacgtcgcgggtagctcagaccaagcacgtctgcancgcntagctcacttttacgnccgcgancctgctccnngccgttgccgactccaagctccactcgcctgaggtcccctcgtccgaggtgctcgactggacttcctccccccgaggtcccctcctatccatcgccgctcctccccgacatgtccaagaaggtcggtaagctaccgccgccgccggcggcgcatgaggaggcgagagaggagctgtttgcttcatgctctttcgccgacctcggcctccactctaccctctgcgcccaccttcaagataagatgagtttccaagcacccactcgaattcaagctcaggcaattccagttgccatttctggacagcacatgctagtgaaggctgctactggcactgggaaaactcttgcgtaccttgctccgattgttcacgttctccagatgagggagcctcgtgtggatagaactcatggaacttttgcgttggtacttgtgccaacgcgagagctatgcttacaggtttacgggattgcacaacagctggttcatcgttttcactggattgtccctgggtatgtcatgggtggggagaacagagcaaaagagaaagcaagactgcggaaaggaatatcaattctcattgctactcctgggcgccttcttgaccatttacagcgtactgcttcatttagctattccaatctgcagtggatcgtttttgatgaggctgacagcattctcgaacttg

SEQ ID NO: 21778 - DNA, 1369 bp, Zea mays
ccggccgcggcggcgttgccggaccacccattccacaagaagcaggacgctgcctggccggcggcgttgcctgaccacccattccacaagaagcaggacgctgcctggccggcggcgttgccggaccacccattccacaagaagcaggacgctgtctggccggcggcgttgcccgaccatccattccacgagaagcaggacgtcgtctggccggcggcattgactgaccacccattccacaagaagcaggacactggcgggcctgcggcggcattgtcggaccacccattccacaagaagcaggacactgtctggccggcggcgttgcccgaccatccattccacgagaagcaggacgctgtctggccggcggcgttgcctgaccacccattccacaagaagcaggatactggcgggccggcggcattgccagaccacccattccacaagaagcaggacgctggcgggcctgcggcggaattgccggaccaaaagcagggcgctgtctggccggcggcgttgcccgatcatccattccacgagaagcaggacgctgtctggccggcggcgctaccggatcacccgttccacaagaagcaggaccctgtctggccggcggcgttgcctgaccatccattccacaagaagcaggacattggtgggcctccggcggcattgccgggccactcattccacaagatgaagcagggcgctgtctggccggcggcgttgcccgaccatccattccacgagaaacaggacgctgtctggccggcggcgctaccggatcacctattccacaagaagcaggacgctgtctggccggcggcgttgcctgaccatccattccacaagaagcaggacactggcgggcctacggcagcattgccggaccactcattccacaagacggaagcagggcgctgtctggccggcggcgttgcccgaccacccattccacgagaagcacgacgctgtctggccagcggcgttgcccgaccacccgttccacaagaagcaggatgctgtcgcgccggcggcgttgcaggaccacaagatgcacgacgcggtcaagccggcaggggagccggatcccggatacgtcatgtatccggcatggagccccgtccgcccctaatcgtcgatttgttgttggagaacgacgacgctccgccggcaacggcgaatgccacatgcattacatgctcgcggctcccatgcgatattaagcactagtaggagtgaaggtgtgtgatgtgtcagacgtgctactgctactgtatatgcatgcctattctcacgtttatgcatatgggcttttgccaatgtgaccacttgatcgatgaaaaaaaaaaaaaaaaaagcggcc

SEQ ID NO: 21779 - DNA, 1745 bp, Zea mays
cggcggcgttgccggaccacccattccacaagaagcaggacgctgcctggccggcggcgttgcctgaccacccattccacaagaagcaggaccctggcgggcctgcggtggcattgccagaccacccattccacaagaagctgggcgctgtctggccggcggcgttgcccgaccatccattccacgagaagcaggacgatgtctggccggcggcgctaccggatcacccattccacaagaagcaggacgctgtctggccggcggcgttgcctgaccatccattccacaagaagcaggacactagtgagcctgcggcggcattgccggaccactcattccacaagacgaagcagggcgctgtctggccggcggcgttgcccgaccacccattccacaagaagcaggacgctgtctggccggcggcgttgcctgactacccattccacaagaagcaggacactggcgggcctgcggcggaattgccggaccacccattccacaagaagcagggcgctgtctggccggcggcgttgcccgatcacccattccacaagaagcaggacgctgtctggccggcggcgttgcctgaccatccattccacaagacgcaggacactagtgagcctgcggcggcattgccggaccactcattccacaagacgaagcagggcgctgtctggccggcggcgttgcccgaccacccattccacaagaagcaggacgctgtctggccggcggcgttgcctgaccacccattccacaagaagcaggacactggcgggcctgcggcggaattgccggaccacccattccacaagaagcagggcgctgtctggccggcggcgttgcccgatcatccattccacgagaagcaggacgctgtctggccggcggcgctaccggatcacccattccacaagaagcaggacgttgtctggccggcggtgttgcctgaccatccattccacaagaagcaggacactggcggtcctgcggcggcattgccggaccattcattccacaagacgaagcagggcgctgcctggccggcggcgttgcccgaccacccattccacgagaagcacgacgctatctggccagcggcgttgcccgaccacccattccacgagaagcacgacgctatctggccagcggcattgcccgaccacccgttccacaagaagcaggatgctgtctggccagcggcattgcccgaccacccgtttcacacgaagcaggatgctgtcgcgccggcggcgttgcaggaccacaagatccacgacgcggtcaagccggcaggggagccggatcccggatacgtcatgtatccggcatggagccccgtccgcccctaatcgtcgattcgttgttggagaacgacgacgttccgccggcaacggcgaatgccacatgcattacatgctcgtggctcccatgcgatattaagcactactagtagaggaagtgtgtgatgtgtcagacgtgctgctgctactgtatatgcatgcctattctcacgtttatgcatatgggcattagtgtcaattgatcgatgatggacaaatgttccaacagacacaggaatgccgactgcagagagaagagctttgttctacaagtggcaccaagggagcaagtggcggtagatgctatgctaagcgtgccaacgaactcatctcctcctagctagttggctgcttcatgtgtcttctaattacttctagttaaaggttacacgggaacgc

SEQ ID NO: 21780 - DNA, 1680 bp, Zea mays
acctcttattgcttgctttttttttcgtttttttggaaaagtaaaaaagctgaatctttaatctaactttaaacttcaggaatatattccgataaacacaaaccggagtacattacatgctcctctacccctacagaccttgatctccaccctttttttggaaagatctccaccctaattaactcaataaaaaacaatgactaggctatttgtgcgtccatcaccgttcgtttgcttaaaatttgcacttcccaggtgtcctagctgctactatgtacacaactgctgagaaggaaaatggacaaggatagacacacacaacaatgaaactatgggaaaatttcaatgctcaaaacatgatgccaatatgccgtactgctcactggatagggaaataaccatcggcaacatgatctccgaagtcctaactcaagatatgttcggtcaccaataccagaaaatgattgggcctcaagactcaagcatctggaactgatagaaagtattgtgacataaaggccctgaatctcattttgtactccctaggtaaaattacagttggggatagattctttggaacaacaagagatgtcttcacccaagattccagctgtttgtcccaggtatattgtctcaaataatctataattccaaatacaagctctttcttctctttgtcaactccaacaagcaaggagtaatccatgacattcatgttctgtaagcacaatgaaatacaaaatataagactgtaaggcaaaattatagaagtatataaactcacatgagaattatttgctggcaatgggcacacatacacttaggaaagatgtgtcgttccaaatagcgcgttccatgaggtttttagtttttccttgaatgtagattggcatggtacgcatgtcttcaataaaattttgatccaacagtaccttttcagaattttctgaatcaggaatatatcgtgagaaaagagcacccttcagatcatatctgcgtagtatattatgtccaaacagaagattttccataaccatgaagttaacccttgtctccttgccattcctagtttccttaaccttaaatagtatcataaagaaatacatcataatatgccaggagcagtttgtgccacgtagtttcatggaagattcgacgtacctgatatattcctagaattttcgcaagacaagtagggttgcttgaaacctgagatgcaccaaaatgcttaaagtactcaagaccaacctttaagaacgagtcaaattcagtcgtcttgatttgttttatgataaatctgtcatccattgatttcgcaaagaaacccttactctttccaccctgtgcattccagtttttgcagcggcttatcgacgaaatatatgcaagttctgatggccagcacatcttccgaagatcatggaattgttttgcatatatacaaatgacagtatatttgcttctcagagctatcttttcattgttcagatcgatttcgtggtgcagatcttttaaagctgacagaaatgaatcataaaaccctgatgttaattcctcagggggtcctatccttgaaaatttatggttgttttcgaaagactcatttgaagacgacatggatggcagcatagaagcatttttatccaagatactagatgcagcttcataatagaacccttg

SEQ ID NO: 21781 - DNA, 3464 bp, Zea mays
  misc_feature (3417)..(3417): n is a, c, g, or t
gggtcttccacgagaagactgaacactgatcatcttcatatattgaccatcaggcaaccatgttattcactactatcagtctatcctggtctactgctcttatccaggcaacgattttttttttttttttgcatcatgaaaatacacatcaatatatcgaccgaaatgaacagacaataactgtctgtatctcctgttcacaaacaacacacacaactgaaacttaaataactaccgaattataaacacttctgactgataggagccgatgccgaaaacccattcttctagcatcctacttgatagctacgtatatatgccagaactggatggatggatggatggatggccattgtcttcatatgaaagaaaacaacttgaagtatacaaccaggtagagtgaaagagagaacaccgcacaaatatgctgccagaacagaagggcggatgcttccttgacgccatagcctctgagactggcgatcgctccaagcaggatagcactcggggtggagtactgcagggagagcacaaagcggtacatatggttttcctccacgagcagatgcaacctgtctgccagggtcacaacaccgatgccaatgcatgggagaaccaagagcctggccacaatgataccgatgatagtcctcatgcccaaggcgttgtcttttgggccttccgcgagcatgcctccgagaatcaacatcaccgacggaaccacagcagcggctaggatctccaaactgtcggtgaagaacgagagcggcgcatcagccccgaaaacaaaatctttcaggacaggaaccatgccgatggtaatggcaagcaaagaggcgatcgtcgggggctgaaggacgtgctggatcggagtcttctcggcgacaaccctaatcctcctgaccactcttggctctgccagacatcggagcgacttaggactgcttggtccagctgcagaagttccttcttcggtgaaatcgatgtcagggaacgtgttctgtgaggaacctgaaatgctcatgaaaactctcgcgatgaacggtgtcttcgaatgctcagtttccttgtcgaccatccctggccactccgcctcatgaagcagggacctactgtagttgctgaccagctcgggttcctgctgtatctcattcccttccccgacgatctcgtagaactgcatcggtggctccatcatgtggtagaccagagtgtacacaagaatgaccgcaacccactgcgcgaacgagacataggcgatgcccatggtgtcgcacccagggccgaaggggtggtcgttggtgtggcagactgacccgatgatcgcgatcgggaggttccccgtgttaccgaacccggtcatgatcaccgtaaaccggaacaggtgcggcggcgggcggcagatcagggccacgatgtacccaagggcgcacccgatggcagtgctgatgagcacgttgacggggatgaaccaccagtgcaggacgttgtctatggtgaccgacttgccgaggtggacgaagatgaggcaggggaggaagagcgcgaagacgagcttgctcaggagcttgaaggtggccctgggcacgacctggacccgcgggttggcgaggagcaggccgatcaccgccaggcacagcagcttcatcagcggcaccacggctgacacccagtcgccgtggacggtcacctgcgggtccattgaccagaccattgccgctgctaaagcttctcgcctttctctgacctgggtcctcgaaacagtctcttctaataaactctgaaaaatactcccacttctttttgtttgtatgtacaactaaattgttctcttgcacaaagacagtgctcaatcagatgcaaaaggatggttttttctgcacaccaaattaatggagaagattcagcaacggaggaaaaaactacgaaacggtattatacaggatcaataggtggaacaattctagcttggaaccggtgcggatcttgcaaatactcggtgcttggtacctgactcgtgttctaaacttcctacatctctcgaatttcaggtcttggcaaagattcaggcaaccaatcagcaagaaaaccagaaaccgcgacggaaccaaaacttgcaagattcacgcaatactcacatggaccttcgatctgggaatggagaaaggatggggaggaggcgctgtgctgtccctctccgcgagtcgatgcgccgaggcaggaaggcaggagccacaacgatgaagagagaaggaaaaaggggagagtggcggcgtgaaaggattccagatttgagagacttggcatccggcgtggcattgtgataaacttgtcgagatccccgcccggccgtagggcccaggcagaggtgtgtctgatgtgatctgaggattttttttttccttcattttttcctctcgagtctcgaaggcacgtgaattctggactgtcatgggacaacagcatcccatgtgccctgatcaggatggatcggtgatcctgcttttattttatttttcaaaagataaaggccaatataaaactgttttaaaaatctgtgtttactttattataaaactaataaaaagcagttttatctgctttcacttgccgtgaagatagataaatttaataaatttactcatctatcactagttacgaaagatattagcctttttttcctctttctatccctctacgatatcctagtccggtgataggtagcgacggtacactacatgatgtatcacataatgcttttgggaggacggcgagactgatgttagcttgatggttcgtacgaggcacgacgggacacagtagattatacaggttcaggcgctcgagcgcgtaatatcctacgtcatgagtttgcggatgtgtattgctcggtgattggggattacagagagttttgtatgtagaagacgaatatgctattgaggtgtgtcttattttggtaggggctcctcctcggtattattgccgaccgaagaggagttacaacgcaaaacccgttacatgatctccgtccacccgcctctgctagagtcgtgtcgagttcctgatgatcagcgagtccttaggagatttgcacgtcctctgcatgtgtgaaacgcgtcccaggagtcttcacgcctacacaattgtcgtcctcgctcgctccgaattacacaaaactgaagtccctggggccacacgcccggcccgttaggggccttttcaggtggcccacagagcataaccaagccctggtgaccgggggatatctatcccccaaaagccccattggttgaagccaatttttgacgataattgtctcaagactccaagaattattcctggttatgatgatgtattctgccgaattagttggtcacttttcttggatataatttctttccaatgccttgatcnattggatgtgcacataataggtgtagccctcgagctttgagctgaag

SEQ ID NO: 21782 - DNA, 2159 bp, Zea mays
atgtagttgattgttgtatttttttttgtcgatcgtccttttttttttggggtcttccacgagaagactgaacactgatcatcttcatatattgaccatcaggcaaccatgttattcactactatcagtctatcctggtctactaattttatccaggtaatgatttgcatacaacaatagcatcatgaaaatacacatcaatatatcgaccgaaatgaacagacaataactgtctgtatctcctgttcacaaacaacacacacaactgaaacttaaataactaccgaattataaacacttctgactgataggagccgatgccgaaaacccattcttctagcatcctacttgatagctacgtatatatgccagaactggatggatggatggatggatggccattgtcttcatatgaaagaaaacaacttgaagtatacaaccaggtagagtgaaagagagaacaccgcacaaatatgctgccagaacagaagggcggatgcttccttgacgccatagcctctgagactggcgatcgctccaagcaggatagcactcggggtggagtactgcagggagagcacaaagcggtacatatggttttcctccacgagcagatgcaacctgtctgccagggtcacaacaccgatgccaatgcatgggagaaccaagagcctggccacaatgataccgatgatagtcctcatgcccaaggcgttgtcttttgggccttccgcgagcatgcctccgagaatcaacatcaccgacggaaccacagcagcggctaggatctccaaactgtcggtgaagaacgagagcggcgcatcagccccgaaaacaaaatctttcaggacaggaaccatgccgatggtaatggcaagcaaagaggcgatcgtcgggggctgaaggacgtgctggatcggagtcttctcggcgacaaccctaatcctcctgaccactcttggctctgccagacatcggagcgacttaggactgcttggtccagctgcagaagttccttcttcggtgaaatcgatgtcagggaacgtgttctgtgaggaacctgaaatgctcatgaaaactctcgcgatgaacggtgtcttcgaatgctcagtttccttgtcgaccatccctggccactccgcctcatgaagcagggacctactgtagttgctgaccagctcgggttcctgctgtatctcattcccttccccgacgatctcgtagaactgcatcggtggctccatcatgtggtagaccagagtgtacacaagaatgaccgcaacccactgcgcgaacgagacataggcgatgcccatggtgtcgcacccagggccgaaggggtggtcgttggtgtggcagactgacccgatgatcgcgatcgggaggttccccgtgttaccgaacccggtcatgatcaccgtaaaccggaacaggtgcggcggcgggcggcagatcagggccacgatgtacccaagggcgcacccgatggcagtgctgatgagcacgttgacggggatgaaccaccagtgcaggacgttgtctatggtgaccgacttgccgaggtggacgaagatgaggcaggggaggaagagcgcgaagacgagcttgctcaggagcttgaaggtggccctgggcacgacctggacccgcgggttggcgaggagcaggccgatcaccgccaggcacagcagcttcatcagcggcaccacggctgacacccagtcgccgtggacggtcacctgcgggtccattgaccagaccattgccgctgctaaagcttctcgcctttctctgacctgggtcctcgaaacagtctcttctaataaactctgaaaaatactcccacttctttttgtttgtatgtacaactaaattgttctcttgcacaaagacagtgctcaatcagatgcaaaaggatggttttttatggaccttcgatctgggaatggagaaaggatggggaggaggcgctgtgctgtccctctccgcgagtcgatgcgccgaggcaggaaggcaggagccacaacgacgaagagagaaggaaaaaggggagagtggcggcgtgaaaggattccagatttgagagacttccccgccggcgccgctgccggcttcgcgggtcccgatcgagacggagccgtagggcccaggcagaggtg

SEQ ID NO: 21783 - DNA, 1572 bp, Zea mays
cattccgcccgcccgcccgcaccacacctacatgtttctttaccctaacggcctaacctttctgctctagcgaaggcacagccgccgctgtttcttcatcttccttgcagcgccggcgctccatcttactctccctcccttactagcgcttgacacgcaggtgacggcggcagcgacggcgctcagactcgggcttttagtgacggcatcagcggtttcccctcccgcctcttgccagtcccatcgcgccctcgcctcgggtcctctgcacaccgtccagtgaccttgcgtgatggactggataaagttttgcagcgattttaccgcaagtgatgggaaacagcatgcattgcttgataatcttaatcaggaattgtcccagaagtctgtactattgggtgatggttttaaactgtcagctgctgataatgatgtgtttgcaactgttcatccttttgtgatccgtgttagtgacagcgagttgcagaaatatccacatgtactgcggtggatggactacattcagaacactgttggtgctggtacaactttgcaaaagataaatgtgaccaagtctgactttgatccaccttctcatccaaggaaagctgataaaaaagatgctgaatcaagttcaaagaaagccatttccgtacagaagactgctgacaagtcaaatggaagtgctgactcaaagaaatccacaagagagcctcctgaaaataaggagaatcctactgctgcggggaacagcaaaacctctggggagaaaaagaaagtgcaagagaagtcagcaggaaaaacaacagagaaagctccagagaaaattgcagacaaggaatcagagtgcgatatcagtatcctgaatatacaggttggccttatccgtaaagcatggaagcatccatctgctgacagccttttagttgaggagatagatttgggagatggtaatgtgcgtcaagttgttagtggtcttgcaaagtattgcagcccagatgatcttactaatcggcatgttgtcttgatcacgaatgtgaagcctggaaagctgcgagatgtaatgtctgctggattggtcctttgtgcttcaactgaagatcatgctgctgtggagcctttgattcctccagaaggagccaagattggagaacgcatttcatttgctgggtttgatgggaagcctgaagatgttctaaatccaaagaaaaagcagctggacaagattaccccgcatcttcgtaccgacgagaatggaattgcaatgttcaaaggtgttccctttactacatcagctggcccatgtagatcttcgattcgcaacggaaatgttaagtgagcagctcattagacatggttgcatagattgacatcaaacttatgcagggtgtctgtgtaccattttgtcatacatcatgttttgcccatatttagcgttgcaaaatttgaacagagttacactatctgtaagcaattttctactaatggttggcccagagtttgcttttgagtatgcaaaaaaaaaaaaaaaacgcccccttgagtccacacaggtgtggtcctgtgttgagc

SEQ ID NO: 21784 - DNA, 2084 bp, Zea mays
acaccacacctacatgtttctttaccctaacggcctaagctttctgctctagcgaaggcacagccgccgctgtttcttcatcttcctcgcagcgccggcgctccatcttactctccctcccttactagcgcttgacacgcaggtgacggcggcagcgacggcgctcaggctcgggctcttagtgacggcatcagcggtttcccctcccgcctcttgccagtcccatcgcgccctcgcctcgggtcctctgcacaccgtccagtgaccttgcgtgatggactggataaagttttgcagcgattttactgcaagtgatgggaaacatcatgcattgcttgctaatcttaatcaggaattgtcccagaagtctgtactattgggtgatggttttaaactgtcagctgctgataatgatgtgtttgcaactgttcatccttttgtgatccgtgttagtgacagcgagttgcagaaatatccacatgtactgcggtggatggactacattcagaacactgttggtgctggtacaactttgcaaaagataaatgtggccaagtctgactttgatccaccttctcatccaaggaaagctgataaaaaagatgctgaatcaagttcaaagaaagccatttccgtacagaagactgctgacaagtcaaatggaagtgctgactcttagaaatccacaagagaggagaatcctactgctgcggggaacagcaaaacctctggggagaaaaagaaagtgcaagagaagtcagcaggaaaaacaacagagaaagctccagagaaaattgcagacaaggaatcagagtgcgatatcagtatcctgaatatacaggttggccttatccgtaaagcatggaagcatccatctgctgacagccttttagttgaggagatagatttgggagatggtaatgtgcgtcaagttgttagtggtcttgcaaagtattgcagcccagatgatcttactaatcggcatgttgtcttgatcacgaatgtgaagcctggaaagctgcgagatgtaatgtctgctggattggtcctttgtgcttcaactgaagatcatgctgctgtggagcctttgattcctccagaaggagccaagattggagaacgcacttcatttgctgggtcagtatataatcaatttaaaggcccatttgcgcagttagcatttatattctgtctagctgtcctgatttagtgatttatactcatgaatatgtcagccaagctgtaagaaacctaatttctcataagaacaaagtgtatagaacttacaagtgtaatatgaatgaactcatgcatgagttttcttctgccatattaggaatcgaatattgcaagtcagcttgatctacattttgtttgggctcatggtatcttgtagaataattctgttcatttctgaaataaagggtttatcgctcttttgaattttatttcagttctctcgagttatagtttgtattgccctgcattttaacaacgatcttgtttaccagttatgttctggttgttttttattacattcctcgcgtccggtaggtttgatgggaagcctgaagatgttctaaatccaaagaaaaagcagctggacaagattaccccggtacacttcagtggcctgtttgatatgatgtaacatcattgtcatggaatgttcttggctaacataacatactcaattatcagatcctgaattgaaacaccatgtttgtttttatttgatgaatgatgtcgcttattgctatactgtgcaaagtttaccactatggcgctaaccgcgttgtttatgcatccagcatcttcgtaccgacgagaatggaattgcaatgttcaaaggtgttccctttactacatcagctggcccatgtagatcttcgattcacaacggaaatgttaagtgagcagctcattagacatggttgcatagattgacatcaaacttatgcaggctgtctgtgtaccattttgtcatacatcatgttttgcccatatttagcgttgcaaaatttgaacagagttacactatctgtaagcaattttctactaatggttggcccagagtttgcttt

SEQ ID NO: 21785 - DNA, 1234 bp, Zea mays
ctagatcgcgagcggcctccctttttttttaaacaaacatggttatatacatgatctgctgcacagaattgaagactaaaaaagtcacatcaacgattccaccaatatatacatacacgcgaggaagaatgacacccactgaagcagtctctcactcacagtcaatggatacacacacctgagcggcaggctgcatctgatctcgccgcggcagctacctcacaaacaaaactagataaaaataaaaactcgagctcggaatgtactgccgccgcccgcccgccgacgcaaatggtggtggtggctggtgggtgtctccaggcgactaggcctccgctttgctgttgatcgccagcgtgaagtagatcagtatcgttgtccccacgctcgacagcgttgcgaacaagaggagaatcttccgagggttgatggacgtgaaccggctaatgaatcttttgctcctcccttccccagaatcaacaagaacaggtgtgcaatgtggagcgaccagcgccttgttctgacccaggggctgctgctccagttgagacggcacaactttgatgacaagttttttcgccaaatcctcttgctcctgctcgccgccgccgccgcccctcctctccatccggttcgaacccttacgcgacaaggccctgatcatcttcggactcccagagcagcatttatcaggcggttgaggaaggctctcgatatccaataccgcattattggcagttctgtccatgctcgtgatcggggggccctgcccaccggttccctcgagctcgaggcggatatcaacttattgagcttcctccacttcccaacagacagcaagcacagcacaaccttgttatctatctatctatcttcggaaagcggtgtcggagtaggtcgatccagatccgtccggttggatctccgccgcgccgtggcgggttcggaggcggcggcgagaggagggagaggtggggcggcggcggaacggtgatgagagacggacggagcgcggaggagggggagagcctacacgagatggggaggcaatgagtgctccttgtacccgtcggcgtgtgctgccgatgccgcagctttaacgacggactggtgtggtggatggaggaggcgcgggcaggagcaacgcaacggacgggaggtggtgggaggacgactcgagtcactcgagtggagtggtgcgcggcaggcaggcaggggaggaagggagcaggac

SEQ ID NO: 21786 - DNA, 998 bp, Zea mays
gaacttctctgccgatctgtcttcaacagatctcctgttatatacatgatctttttttttttttttttgactaaaaaagtcacatcaacgattccaccaatatacatacacgcgaggaagaatgacacccactgaagcagtctctcactcagtcaatggatacagacacctgagcggcaggctgcatctaatctcgccgcggcagctacctcacaaacaaaaatagagaaaaataaaaactcaagctcggaatgtactgccgccgcccgctcgccgacgcaaatggtggtggtgggtgtctccaggcgactaggcctccgctttgctgttgatcgccagcgtgaagtagatcagtatcgttgtccccacgctcgacagcgttgcgaacaagaggagaatcttccgagggttgatggacgtgaaccggctaatgaatcttttgctcctcccttccccagaatcaacaagaacaggtgtgcaatgtggagcgaccagcgccttgttctgacccaggggctgctgctccagttgagacggcacaactttgatgacaagttttttcgccaaatcctcttgctcctgctcgccgccgccgccgcccctcctctccatccggttcgaacccttacgcgacaaggccctgatcatcttcggactcccagagcagcatttatcaggcggttgaggaaggctctcgatatccaataccgcattattggcagttctgtccatgctcgtgatcggggggcccggtgtcggagtaggtcgatccagatccgtccggttggatctccgccgcgccgtggcgggttcggaggcggcggcgagaggagggagaggtggggcggcggcggaacggtgatgagagacggacggagcgcggaggagggggagagcctacacgagatggggaggcaatgagtgctccttgtacccgtcggcgtgtgctgccgatgccgcagctttaacgacggactggtgtggtggatggaggaggc

SEQ ID NO: 21787 - DNA, 3070 bp, Zea mays
aaataaatacatcaatgcctctccaatagctagtttatgaaactagctattactcgtagcattcgataccaaccacactgtatatgtctagtgtgagatacatagtttgtagatctctctaagtaccctttctgtaatgaggatagtgcctccttcctcttctcgtgtgaacttcaagtgcaatgaccaaagttatttctacgattgttacatcacctaaaatatttttgaaagtatttttacgttcttgatcattttagccgccaccagacatacttatattataaaataaaataccaccttactctaggcaccaaacaaagagagagttgaagggtgttttttttcctaccatggcccggcccagaattcggcccactaactctcactccgggtcgcgcctgagcaggcaggtctgacctcggcgcgctgggtcctccggggccgcccggatccagagagggtagaacaaacctgaatttcatccccaccgtcgcctcgctcgacctccacctctctttcctcccggcagcaatggaggcggcacccaggtgaggcgagcaagcagccagccctggctccccgatggcgtgcctggcgccgcagttcaagtgggcgccgtcggccgccgcccacatgccttcctcgtcctcgtcctcgtcctactccaggtgctccgcgctccgcgtccactgcgccgtcacctccgccgctgtcgtcgaggaccgcaccaacggcagcgcggcgcagctgaggctcgcttacgcggctccggcgattcagagaaactttgaggcaactctggcatcagaagcacttctaaatgaagaggcggtagtagcagcggcagccgcagaggcagttgctcttgccagagcagctgccgaagctgcccaagaagttgttcagatagtacaaagaaacaaccatcagccggtaattagaccaaaaaagtgtgtggacaactacttggcaaatgaaatccttcgcacagagatgcgatcgagcagtcctgacatgtatgctaataatcctttgatggagtatctggactcttatggtatcatggatgctgaagatgaattagatgcttatgcgcagtatactgagaacatagctgtgaaatctgctcgtcaatctgagagaaaagctaggagaactagagcagcaataaaagctagcacaaccctccatgcttcacaaaaggttgcattatcctcaaagaagaagcggtccaagggttcctcgtctagtatgaatcctttaggttcgttgtggaagatgaccggtaggagacttcttacagccaaggaagaggttgaattctcagaaggtattcaggatcttttgaagcttgaggcgatccaagctgagcttatagagtacaatggcggtcagccaaccttctcgcagtgggcaacagcagctggagttgatgagaaaactttgcgcaagcgcttgaattatggtatttattgcaagaacagaatggtaacatctaatgtgagacttgtaatctctatcgccagagagtttgaaggccctggaatggacttttatgatcttattcaggaaggaatgcagggccttataaggggagctgaaaaatttgattcatcaaaaggttttaggttctctacgtattctcactggtggatcaaacaagcaatgcgtaaatctgtctcagagcaatcccaaatatttcgcttgcctgctcacatggttgaagcaagctaccgtgtaaaggagtgtacaaaacgacttcgccgtaagcttagaagacgacccaccaatgaagaaattgcagtggacactggtattccaattaaacgagttgaggcagcagtaaacctcccaaaatatagtgtgtcccttgatagcaaaattggttccaccgacatgacatatcaggaggtcacagctgatcccagtgctgagacagctgaagagatgctcaacagaatgtccatgaagaaggacgtacacatggcactagatactctcaccactcgcgagaagcaagttgttgttctgaggtttgggctcgaggatggtcggataagaaccctgcaggagatcggtaacatcatgggtgtgagcagggagagaatccggcagatcgagtctggcgcgttccggaaactaaggagcaagaagaaggtgaaggctttgaaggattatctggtgccagtaggcaattggtgaaccgtttgtttgcagaatttgttttccttttggttcctctttttttttttgaggattctgtacttgtaccattttacgtgggtcctcatgtaaaacacgctatcagaatacttgcatcacaagaggaaagagtagtttagttccgtgggaaatgaagtaaaattcacaatttcttaaaaaaaagaaaaaaattagaaatgaaatatgtttggacaaaactgtgtaatgcatgaaaactttagaggcgcttcgccatcttaagatgggatctaccctaagcctaaaagaactcatctagttttgtaccacctactaaaacaattctaaaaaaatatataatttatttttcttggctaagttatgtgtttagctactaaccaacaaaagaacaaacttagttcatacataaagaaataaaaaaaagataaatttttgttagggagtaaattgaactagctcaaataggtggaaatgtaaaataaacttaaaaaaatactccatccgttctaatttacaatttgtttgactttttatgctaagttggaccgactcgtcttatttaaaaaatttcataattattgtttagcatataatatactttaagtatgactttgtttttttgttttttattaaaaaaatgaataaaatgagctgatccaacttgatataaaaaatcaaacaaattataatttaggatgaaggaagtactaaaggggtacatggatatcattcataggtaaggcaagagaagtaatttagacgttttagaaatgaaggctgccggtcgttgggctccgtattggggcccaacacgagcgtctaggctagggcaacaagcttgagctccagggcctgtttactgcag

SEQ ID NO: 21788 - DNA, 1818 bp, Zea mays
ttttttttttttttttgagataagctgtaattttcctctaagaaagaaagaactgtcacaatatagttttacatacacacacacaccccaacagacgactgttcttagaatcatggctccttatttacaagcacatagagaagaaaaaaaagtgcctactcagccaaactgctatgcacagtgtacctgaaagaagacttgtagggcaaccactgaacacacttgtcgatcctcctcctaagatactgcctgatctcttttcgctgcagctcaggcatgctctcgcacactatgtcaacaaggtcaggtagctccagggaagcatccttcgcatagaagtggagaaccttgggcaggaagatggtctgcctccggaccatgacatttgcttggatgaactcggccctggcttgctccagctgatggtacagtttcttggctgtgtacagcctcacaggtgggtctgaaaacgcgccggtcgagagcgcaaagtgcgcaattggctctgcgtactgaagcgcatatggatgtatggagctcccagattttttcgtcggcgtaaatagtgtccgaacccacagtgaagggcggtgggactggcatcctagaatcgagttctggatagtttgggagttcactgaatgcccacccacattgtatgcagccttcagaatcaagtcagtgcttttcatccgtttttcctgtaatccataggccatgaaagcatgcataaccaaggcattgtggatgttgacccagaaacagagctgctcttcatgtgccatctttctaggatcaatcttctccagccgtttgatcagcgatctgatagtgtccaggattttgcaggcatactcaaacttctcctcgtctacatgtatccctgggaaaaccatcaccccactgtaccgcccactgctcccgccggacgaagcgtacgcgtccggggtcgcagtcgcgtcggcgttgtagtagcaccgagggctccagccacggacggggtgctgcttcttgagggagaaggagctcgacgcggacgagaccgagagagaaggcgtgaacggcggcgtctcggacctcgcctcctcctcctcctgcgacagcggcctgctcgcgagcttgcagtagacggcggagacgcaccgcagtatgtcctccgagagcttgcacgagatcttaggcacgtactcagcgatcgaggcgctcaggaagttggccaggctggaccgccctgaggagcacctggagagctctacgcgtttagaatcggagagcgttggtaggctgtaggacgcagactccttgatgctcctcaggcgaagggcgccttcgtcgtcagcagcagtagcccttctgctgctgcgctcatggcgcggttcctgagcagacgcgcgaggggagacgccgaggtactggtcgaacgcggctctgtacagggacagcaggtgcagctccttgcggacgacttgctcctccaggacggctatctcccaggccaggtccgcggcagactgcgctcgaagcaagatcagtagccatcgaatgaaaggcatgatccatacattacaagtttacaactagtcaactattctctttctctctgtctgtcttgctaaatcatgttcaaaatttggaattcggatacagttccctgacaacagcacgtacgtactggcagtacgtcattaagaaggaaaagaagaagagaagcataatcatcactcatggcttttactcacttctccctagatatgacaaagcatcattgtgctggcacaagagatggataacagccaggaatgtgattggtaataaagc

SEQ ID NO: 21789 - DNA, 2154 bp, Zea mays
  misc_feature (1420)..(1420): n is a, c, g, or t
taatactatgacatatcggcaaatttacttagttgatagattaattatgaagagagaaaatgagatgaagctggttgtcacagttattaacacaatgtatcataaaaagtcgctgttgagaccgactttaaaaaagcgttttgcagacatacacccaggcctatgtcaaccaaattgttccatcatagtactactagcaattcgacggaagccttgtgcattttgcagactgggagacgagttctatggtttcatctgatattcagattgttcagtactacttctactacgaattcggttgctctccagtcgcccccaccgaaaagcaatgaaacctgtgaggcagtagacatcatgcggggcacatacaggcatgcctgtcacattctcacttcagcttccccaacggctgtgcacagtgatgcagttacaggtcttccattgctagcagcaccgattgctagccaccggttgtgcaggataatcagcagccatgatggttggaccagcttgtggaagaacgggcaacacgtgctgcatcgcgccagccagatatgcctcctgctcaaccaaagaagctcccatactcttaaagccaaaatacagtggctcaggggctcctgtcatgtgagctgcggactggtttggaggaatatgcccaaccaaaggaccgaacaacacgtctgggccttgagaacgcttgagtcgtgattgatgctttttaccaaccagatggatgtcaaatacagctcttgtatcacaaatcgcgttgcaaatggtgcagactagcggttgctcccttactcgctcaggccgcctttgctgtggggcttgagacactctcagcttctttcgaccacggccagctcctgtcggtttcctctttgagccattgttgttgccgttgacacccatccttgcttccaccagttgtgcatttgatggacctgttgcatttggtggggcttcaccgccatctttcatctcatttgaaggctgacaagcttgaacagcgacatgcagttctacctgtgcttcaacaccgtgaccaactgttgatgtatgatgtgttttgttttgcttggaagaactgcctggcacctcagtaatttgcaccccataaactgaagctccgacattttctggagccaagtctttgtgctccccactaaggctggttgaaccaagaggtgggaccatatgtactgacctagaggggccttctacttcagctaactgagaagatgatggagcacccatgtcagctatagcaggagtcgtaccttgcaggcgagccatatcttgcattctctgaacagaccgtttatgcctctttccatttttgtgctgctcaaggatttccttgctattacaccccacgtggcatatatcacaccaagcagctggaacaacagtaccnccgtgttgaactgctggttgtagcttgcaccatgtgtgctggtgcacagaccgtttcaggctgagcctgtaatgcaaaagatccaccggatgcttgaatggctaactgccaatcactgctcttgtttctacgacctcggccactgcctctacctcgcccaaggcctctaccacgtggtgatgtaattcctgcattccatataagaggatgatacatagagcttccacctctgcctccaccatgtgaaggcccatgacctctgtttacaccgttgagtgtacctataccacccccaaccgccgcgggatgctgcgccgtctggtactgcgggtcgtagtacggcaggtgtcccacgtcgcccccggaccacccgatcgagccggtcggctgcgacagcgcggggacggccaaaggctccgcccctggcccgcccactatgacgttgtcggatgatcccgctgcggacgaccacgacgaggaggcggccacgggagcagcatgctccgttcccggtgggggcggctggtagtagtaggaggcggcagcggcgctgtggcgggcgtaggcgtatgggtcgtagtctgatctctgcggccagggggcgccatggggaggcaagccctggtcggagcccatcgccgacggctcgccggcggcgacggcggggggcggccgtgcgggagtcgggggcattcgtgggtcgatgggatgggatggggatgccccctcgggac

SEQ ID NO: 21790 - DNA, 988 bp, Zea mays
aggtggtggcggtgagttgactggagtaggtggtaaaaagtatttcacagaagccggtggtgagctaactggacccggtggaggaggtgatttacaggtggtggtagtgagctgactggagcaggtggtggaggggattgcgccagaggaggtggtgagcttactggagccggtggtggtgattttataggtggtggtggtgagctgactggagcaggcggtggaggggattgcatcggaggaggaggtgagcttattagagctgatggaggaggtgagtttgcttgtggtgggggtggcgaccttatcggtggtggaggaggtgatgatttcgttagcggtggaggtgacctcaccggcgctggtggcggcggcgaacttaacagtggtgaaggaggtggtgatttcactgacgatggaggtgacctcaccggcaccggtggtggcggtgatttaatcatcggtggaggtgatggtggtgaaggagatttcaccgttggaggcggttcactcacatatgctggagatggaggtgattttactagtggtggtgagctaaccgaaaccggtggaggagggaatttggtaggtgggggaggcgagctaataggtgctggtgggggtggagatttcattgatggcggtggtgaactaatcggtgatggtggtggcggtggtggtgacctcaccggtactggtggtggcggcgaacttactggtggtggaggaggtggtgatttcactggcgctggaggtgaccttgctggcaacggcggtggagatttcacagatggaggtggtaaactcatagatactggaggtggaggcgattttagtagtggtggtggtgagctaaccggaaccggtggaggaggagatttgataagtgggggaggcgagctaataggtgctggtgctggtgcgggcccgggtgcgggtggcgatttcactgatggaggcggcgacggctgtgggctcactggctgtg

SEQ ID NO: 21791 - DNA, 1001 bp, Zea mays
tcgagtcagctacgtaggccccccccgctagaccgcctactctccccatccctcgccgcctcgcttcaccccacctatggtcgccgctgctcgcatcgccctgcggcccccacctctctctccctttctcctcgcaacgccgcccccgtttgtccaccaagtcaccacgcgcctgggagatggatcaaggggcgcgcagcagtccggtcaagacacgctcaacgaaagcttcaagatagcacgggagatggaagccccaccatcggctaggaatcgttgcatcacgtcatccgattcctctcccttccgttcctttgctttcgtggtggatgagaagaaagcggcgaagggcgcatcggaaaagagagcctggaggaggaggcacaccatccttcctcttgcacacggagtcctcaagctttctcctcaccttgctggaattccgggtgccatacatcatctctgtcggcaggcatgttgcccttctgcctcgctcgcagttcttccaagggctgcccgtctgtgtggtctggtttggtttggtgatgctaataccccttttgttagttcgtcacctcccaacctgctacacgaagggataaaatttcattcccaagctgctaaatggggcataagtggtttcatctcagaataaaaaacgagtgctgctggagtattatgatgcctttctaggcacatggtcttattctacgggctacctggctatgggatttgactaaaacacacatttaccttgcttgtggtgagctctttggtgggaaacgtttgatgaagccatgtttccatgtttagagaatcacatcacagtcggacctggaactttggaagagaatacctaagggctagcaggatcaacaattgattacatggtttctgtaattttttgtactgaactgaatttaagcatttatgttatattataaagttcaatttagaaggtaaaaacaaaattgttttgtgctaaaaaaaaaaaaaaaaaa

SEQ ID NO: 21792 - DNA, 1345 bp, Zea mays
agcgtgtccaagagtcttcgatgttagaaagaaagaggagctccttccggcacctgaaacctagaaccctcttcccccgcgatggccgcagggagcggcggcggctcgcggcgcgcgcgtccgaacgtgctagtgacggggacgccggggacggggaagacgaccacgtgctcgctccttgccgacgccgcaggcctccgccacgtcaacatcggcgacctcgtccgcgagaagagcctccacgacggctgggacgccgacctcgagtgccatgtcatcaacgaggacctggtgtgcgacgagcttgaggacatgatggaagaaggtggtatactagtagattaccacggatgtgatttctttccagaacgttggtttgacctcgtagttgtgctccagactgacaactcaattctgcatgatcgcctgacgggcagaggttacatgggttccaagctcgccaacaacatagagtgcgaaatcttccaagtgctcctcgaggaggcgagggagagctacagagaggacatcgtgatgccattgcgaagtgacaacgtggaggatattagtaagaacgtaggtgcattgacagactgggtaaacaattggagacctagttagacctgtcaaaagaaatgttgccttatgtgttgtatttggatatgtattgggtggaccagctgccatgtttgtaatgtacggggtgttttggttaaagaaacgaagtcgttcatcctctcttattcttttcttttaatggagtgaattacttaaatcattaccacaacattacttaagataatggttgctacatgcacaaggaatgcgatgatgctataaaaattcatgaggcagtgtggtctgcgcaaattttgttttttaattttttttatgatcggtcgggaaaccgatcgaaattcgttgaatttcggatttttcaaccagaatgcattttcaaattaaaaaacaaatatatattttttggtcgaaaatgtattctcgtcgaaattcattgtttttactaaaaaactatgattaagtttggaaaaattaaaatttctgatagggtttgtttgtaatgtgtataactcacgatgcacaataaaaataatagtttcacacacatttgttcaccaaaatcatatataacatctctatatctatcgactactctaagaatcaaacgtaggcatccacagttggtccatgcccccgtctcgcgcaattccgctaacgtcgagcgtcgccttgctccgccgagacagtcgctgcccatctccctcgagcggctagcaccactccccaagacaacttcctcccccgtcctagacagcaggggtaccga

SEQ ID NO: 21793 - DNA, 1943 bp, Zea mays
cgagcggccgcccgggcaggtacttttttttttttttttttgcaaaggtgatttttttccttttatcatgcatatagaacatgagaccacactaacaaaaaaactagagaaagaaacaaacatctacaagctttacttgtcagcattctgaattactgttctaaaaaaattagtttcccgaaacgaacgatacttagcttacagagacctaaatccagaacaaatatttgcaatggattgtacaacagacagttatattatgttgtgtatacatgttcatgcagtgtttacatggcatcagcttggtcaccaacgggcatgtcatcaacatagtttgcttgatgctggttaccagcatacaagttccttcgcccacgattgagcccatcactttcaccatctgatgcctcagcaagccttgctatggcgtcaatcaatgactgttcttgctccttcagtgctttctttgccttttctacttcctgtggatcaggattgctaacgctaaaaactttctccacctcttttattaggctctcagtatgaaggatatcaatgtcatcggaacttctcttgccaacaccattttgtggaggtggaaaatctttcctagacatgttcttcggtaatcctcttcctcttccagaacctggcatgggcccaccgcgacctgttggcttcctgaccccactacttggggcacctcggctgcgcagatacaccacagggtctatcccagagtcatcctctttccatcttatgtcttcaggtcccatctctttaagatcaacccactcccaggtttcatttgccgtattaatgtcataaaccagcacataaaggcccgtttcagcattataatcagatatgactgcttcataaaaactattatcttcaggccaccggctcatcactttacgaccaaccaatggatcgacattctgagcttgagcttcaggagcagaaccacctggaaaattcctattcatgtgtggtcctcttccactaggacctgctgaagatggcataggcttggctgcagagccacctggtaccttctgacctggtttcgtctttttgcctttagggactgggggtactgctttcctagcagttgaagacgatggctgtgttggtgtagccagctgttgtgaatgcattgcaggaggtgcaggtaaagcaggaacagattgagatgtcttttgcctcttacggccagaggtggtaggacttggaacagggtcatgaatcggttgtgggttattggacatgcttgcttgaagccctcctgttgatctccattcccttatgctacatataatattatcgttgttgactttatttaacagctccctgtgtgctttgtcagatactcttagttccttcctaagttcagtcatgagaccttccttctcccatgtaatggcatcagactgggctttgaatgcacgaaggactgaacaatatgcttcttgctcaagttgttgaatttgtgcttccatgtcagttggtgctctagcatatgaaccggcaggaacaatagttctcccattaccactaacacgtccgctgcctctgatactcctatgtggaagttgtggaagatcatcatcagttccgctgctgtcagagggcccgtagtccatgaccgaccctcggcggcaactccgccaaccaccaccaacaccaccggcagtgcaacacgctcgggcacagacgcgaacctgcggcagatgcgagggcttggcggtggacggaatccggcgagatttggagaggacgggggagggagctgtgctgctactgctctgctgctattggtatggtatcgggcgctccgatttcggtctagagtgaaaaatagagagcgggcccgaggtgctcaacgtcggacttgaagcggctgcatgcggcaaacgttgctggaccacttaagacacact

SEQ ID NO: 21794 - DNA, 1915 bp, Zea mays
gacgaatgattgctgcattaaaatggtgaaatacatgttttataaatgtgatctttttccctttatcatgcatattgaagccgagacctttttttctttttgctggagacagaaacacgcatctacaagctttacatggtcagcgttctgaattacaattgtaaaaaaaaacaagtatcccaaagcaaaagagcctacagagacctaaatccagaataaatattagcgatggattgtacaacaggcagttattttatgttgtgcatgcgttcatgcagtgtttacatggcaccagctctgtcaccgacgggcatggcaccaacgtagcttgcttgatgctggttagcagcatacaagttccttcgcccacgattgtgcccatcactttcaccatctgatgcctcagcaagccttgctatggcgtcaatcaacgactgttcttgctccttcagtgctttctttgccttttctacttcctgtggatcaggattgctaacgctaaaaactttccccacctcttttattaggctctcggtatgaaggatatcaatgtcatcggaacttctcttgccaacaccattttgtggaggtggaaaatctttcttaggcatgtttttctgtaatcctcttcctcttacagaacctggcatgggcccaccgcgacctgctggcttcctaacgccactagttgggccaccccggctgcgcagatatgtaacagggtctatcccagagtcatcctcttgccatcttatgtcttcaggtcccatctctttaagatcaacccactcccaggtttcatctgccgtatcgatgtcataaaccagtgcatgaaggcccgtttcagcatcatattcgtatatgactgcttcatagaaactattgtcttcaggccaccgactcatcactttacgaccaatcaatggatcgacattctgagcttgagcttcaggagcagaaccacccctattcatgtgcggtcctcttccactaggacctgctgaagatggtataggcttggctgcagagccacctggtaccttctgacctggtttcatctttttgcctttatggcctgggggtactgctttcctagcagttgaagatgatggctgtgttggtgtagccagctgttgtgaatgcatcgcaggaggcggtgcaggtaaagcaggaacagattgagatgtcttttgcctcttacggccagaggtggtaggactgggaacagagtcatgaatcagttgtgggttattagacaagcttgcctgaagccctcctgttgatctccattcccttatgctacatataatattatcgttgttgactctatttaacagttccctgtgtgctttgtcagatactcttagctccttcctaagttcagtcatgagaccttccttctcccatgtaatggcatcagactgggctttgaatgcacgaaggactgagcgatatgcttcttgctcaagttgttgaacttgtgctaccatatcagttggtgccctagcatatgaaccagcaggaacaacagctcgcccattaccactgacacgtccgctgcctctgatactcttatgtggaaattgtggaagatcatcatcagttccgctgctgtcggagggccggtagtccatagcctaccgtcgtcggcaactccaccaaccaccaccaacaccgccgtccgccggcagtacaacacgcgcgggcacagacgcgaacctgcggcggaagcgagggcgcggcggggggcggaatccggcgagattctggggaggagagctagctgtgctgctactatcgtatcaggcgctccgttttcgatagagaaagaggaaagacaaaacaacaatcgacggacttgaagcggattttacagccgtgatgtgggtgcatcccgcaaacgtcgccctcgtgc

SEQ ID NO: 21795 - DNA, 1795 bp, Zea mays
gagttaacagaagcgaatagaaggcaacacaggtacatgccacaccatgctgcaatgctttacaagatctaacagaagaaatcatttgttttttttttttctttttttaagcaaacaacattccacttccaaatctgtcatcatctcttttatgtatcagtatattcatctttaataacaggtatttagtgacatcgcatgaaagttagagattgctgagaccaaggaactctgtaaagctcggatacttgggctgccatccaagctttgcccgagttttggagttgtccatcctcttccccagcgaaccatcagtcccagtgaagccatgaaactgtgtgtcaaatttcctgcttctgttgacacggtccatgatctctagcctggacagaggctcgttgtcacaacccacaaagatgcagctccgtaatctctttttcatgatggaaattacaagagaggctgcatcttcataatgtatcagattgagtatatgatcaggacgcacatccaaggttccttttgacagccagtaaacatgaggaccccgatctgatttataaagtcctactagcctaagaacacagccgcctgcctcaaggacaacattttcagcttttagaagcacatcagtacgagtgctttgaccaatgggtacacaaggagaatcctcactgcagaatccattgtcactgcagtcatacacagcagtactcgaggtgaataggaaagagccttttccattccaatttgaagctgctactctcagatctccagcataatcctcagaacgatatggaggagcacagaagataacatatggaaattttggacccggtacggaccccttcaaggagggaatgataccaatatcagtcaattcactgtgatgatctgtggttgcagtctggccataaaccttgcaacctggatattcctgtttccacatctcagcgacgattcggccgagcacgccaggcccaactatgagcagatcgttgtgctcgatgctctcgggtgagagcgagctaaccgctgcatcacccgatactactgtgatcatgcaacgcggaaataacaattacaccagaacagaactggaattggccaatcaggtgaattacggaaaaagcgccagcgggcggcagcattgggtggacggaaggtttaccaatggaggaggaggaatcggcggcggcggacatcgaggcgtggcggcgcgggcgggagacgcggacgcttgggcttgaagtggggccgggagcaaagagggcggaggcggcggcgacaggtgcggtagcgtggagatagggaagacacgactggtggacgagatggtggggatggagatggaactgggcaataatgggacgcggtagaagtcgtgctgctgccctgcccatgccgatggcgtggcggcgtctcgtggacgttggagaaatggaaaagcccagtgttgatgacgccgttcaatatctcatattcttgcattggataatgtgtgcattatcctataatatctgtgatatgtagagctttaatgtcctctctgcgaattgtccgtgacgaggatttcaaacgagacctaggtcccaccttttagaagggatctcgtcagagaggaatggttctaaaattgcttcagaatcataccatcaaagtatcataagatgacgtagatgtgaaggaggtgaagactatagattggaaagctactgctaaggctaaacgtaagtctattctaagaaaaataaagtaaataagataaagttggtatgttggtatttgactattt

SEQ ID NO: 21796 - DNA, 1439 bp, Zea mays
  misc_feature (1373)..(1374): n is a, c, g, or t
agattgaagccatggaaacaattaacaggtattgaagtcaatgctttcatgagttaacagaagcgaatagaaggcaacacaggtacatgccacaccatgctgcaatgctttacaagatctaacagaagaaatcaaaagatagtcgaaaactgcggtataagcaaacaacattccacttccaaatctgtcatcatctcttttatgtatcagtatattcatctttaataacaggtatttagtgacatcgcatgaaagttagagattgctgagaccaaggaactctgtaaagctcggatacttgggctgccatccaagctttgcccgagttttggagttgtccatcctcttccccagcgaaccatcagtcccagtgaagccatgaaactgtgtgtcaaatttcctgcttctgttgacacggtccatgatctctagcctggacagaggctcgttgtcacaacccacaaagatgcagctccgtaatctctttttcatgatggaaattacaagagaggctgcatcttcataatgtatcagattgagtatatgatcaggacgcacatccaaggttccttttgacagccagtaaacatgaggaccccgatctgatttataaagtcctactagcctaagaacacagccgcctgcctcaaggacaacattttcagcttttagaagcacatcagtacgagtgctttgaccaatgggtacacaaggagaatcctcactgcagaatccattgtcactgcagtcatacacagcagtactcgaggtgaataggaaagagccttttccattccaatttgaagctgctactctcagatctccagcataatcctcagaacgatatggaggagcacagaagataacatatggaaattttggacccggtacggaccccttcaaggagggaatgataccaatatcagtcaattcactgtgatgatctgtggttgcagtctggccataaaccttgcaacctggatattcctgtttccacatctcagcgacgattcggccgagcacgccaggcccaactatgagcagatcgttgtgctcgatgctctcgggtgagagcgagctaaccgctgcatcacccgatactacaatggaggaggaggaatcggcggcggcggacatcgaggcgtggcggcgcgggcgggagacgcggacgcttgggcttgaagtggggccgggagcaaagagggcggaggcggcggcgacaggtgcggtagcgtggagatagggaagacacgactggtggacgagatggtggggatggagatggaactgggcaataatgggacgcggtagaagtcgtgctgctgccctgcccatgccgatggcgtggcggcgtctcgtggacgttggagaannggaaaagcccagtgttgatgacgccgttcaatatctcatattcttgcattggataatgtgtgcat

SEQ ID NO: 21797 - DNA, 1686 bp, Zea mays
gaagaaaatattttcgttgttaaaaaatctaacgttttgtacgtgcatacaatatttttctcgttgaacagccaaacaatcattatccaacagaaactgaaatcagtgctgctatctcaaaattttgagcgtcaactaaaactctgatcccacgttccatttcatatctgcatatgatctccagccaggatgaggtgagctggggatgtctgctaaagtggcacaattgagcaaggcacgagtttcacaaaacttgcgtgatgttacagttttattcaagctgagctacgctatgatctgaagacgcaaaacaagcattgtgtgacttgtgtcatgaaggcaccagaagaaactgaacggagcgcttgcaaaaggatgcttcagaatgtttacacagcctccacatttggctcagcatcctcattctcaacaggctcaccatccttctgcttcacatagccgaaatatccatcatcccaataatgctcctccgcacttctgccaaaaatgaatggtcttctacccattgttgtaaaaggcattaacccaaacgcacgtgcggttttgatctctcttgcaatcttacgctgagcttttgcacttatacgggtctggcttctcttgatgataattccagcttccgtaagaaagttggagaggaatctaacattcctaaaatcagccttcttcagtacctccgctgtagttgtttcaaactgtcgtctaggagggttctttgcggctgcaggttttctaaggtcaaggtcccgaacagaatacgttgaaccttgcctaaaccgcacatcaggcctgaactcaaagtcatcttcccagtcaccgtcgacgtcctcgtcctcctccatttggatgttgcgtgccgcattagcaatcgtatcatttaagccatcattaaaagaatcataaccatccatccatcctgaattgctcctgtcgccagatgcaggaaacccagggaaaccagagctgctactgtcacttaaccaagtgaaaccacccttggacaacccagatctgctcttgtcacttaacccagtcaaaccacccatcccagagcccatattgtatctcctaccagtgttctcagccctatcgagcttctcgtagagtgatcctttgtctgtgtccttgcccccaaacaaccgttcttcgaattcgtccatagtctcaccatccccggactggaatgaacgacggaagacgccggcagcggccagcagcggatggggagggaaggcatgacagagagaggcatggcaggggagacagcgcctcagtgcggagctcaccatcgcgctcgcttggtggtactcctgccctgtaggctggcgccgccgcaccgggatggaggaggggccgagggggacgatgccgccgtatccccccgtcactggtagcgcgccgccgtcgcctgcacagagcttacgacgcgccacaggaagggtcgaagggaggagctcacgacgcgtcgctggaagtgccgatgcgcgtgcagtgcgtgcgctgtacgcggctcggcgactgaaaatgggaagcgggagggcgggaggacggcgggtgggactagggttgcgactgtgggaggcggcgggacgggaggtcgaggacggtcggacggaggctgggagcggaccacctttttttttctgcccaatcccccgcccggcg

SEQ ID NO: 21798 - DNA, 1494 bp, Zea mays
ctcggtgaacagccaaacaatcattatccaatagaaactcaccccagggtttcttttttttttttttcttcctcaaaaaattttgagcgtccactaaaactctgatccaacgttccatttcatatctgcatatgatatgatctccagccaggatgaggtgagctggggatgtctgctaaagtggcacaattgagcaaggcacgagttttcacaaaacaggcgtgatgttacagttttattcaagctgagctacgctatgatctgaagacgcaaaacgagcattgtgtgacttgtcatgaaggcaccagaagaaaccgaacggagcgcttgcaaaaaaaggatgctccagaatgtttacacagcctccacatttggctcagcgtcctcattctcaacaggctcaccatccttctgcttcacaaagccaaaatatccatcatccgaataatgctcctccgcacttctgccaaagaagaatggtcttctacccattgttgtaaaaggcattaacccaaacgcacgcgcagttttgatctctcttgcaatcttacgctgagcttttgcacttatacgggtctggcttctcttgatgataattccagcttccgtaagaaagttggagaggaatctaacattcctaaaatcagccttcttcagtacctccgctgtagttgtttcaaactgtcgtctaggagggttctttgcggctgcaggttttctaaggtcaaggtcccgaacagaatacgttgaacctcgcctaaaccgaacatcaggcctgaactcaaagtcatcttcccagtcaccgtcgacgtcctcgtcctcctccatttggatgttgcgtgccgcattagcaattgtatcatttaagccatcattaaaagaatcataaccatccatccatcctgaactgctcctgtcgctagatgcaggaaacccagggaaaccagagctgctactgtcacttaacctagtgaaaccacccttggacaacccaaaattgtatctcctaccagtgttctcagccctatcgagcttctcgtagagtgatcctttgtctgtgtccttgcccccaaacaaccgttcttcgaattcgtccatagtctcaccatccccggactggaatgaacgacggaagacgccggcagcggccagcagcggatggggagggaaggcatgacagagagaggcatggcaggggagacagcgcctcagtgcggagctcaccatcgcgctcgcttgtctcctgattcctagcggcggcggcgcttgtctcctggcggtgacggtggctgtcccctccacgagctctccaggcgccggcgatgtcccctaccggcgagcccctcccctccgcggcgacctcctccctccggcggcaactctcctctctctctctctctctcggatgcagggtgagggtggcagctgaggcggtgaggcctgagggtgctgcagggtgagttcatgaggtggcggctgcagggtgcgtttagc

SEQ ID NO: 21799 - DNA, 745 bp, Zea mays
ggtaccgcggccctctctcgagttttttttttttttttttttttttttttgtgcggcccctaaaactctgatcccacgttccatttcatatcagccaggatgaggggagctggggatgtctgctaaaggggcacaattgagcaaggcacgagttttcacaaaacaggcgtgacgttacggttttattcaagctgagctacgctatgatctgaagacgcaaaacgagcattgggtgacttgggtcatgaaggcaccagaagaaaccgaacggagcgcttgcaaaaggatgctccagaatgtttatacagcctccacatttggctcagcgtcctcattctcaacaggctcaccatccttctgcttcacaaagccaaaatatccatcatccgaataatgctcctccgcacttctgccaaagaagaatggtcttctacccattgttgtaaaaggcattaacccaaacgcacgagcagttttgatctctcttgcaatcttacgctgagcttttgcacttatacgggtctggcttctcttgatgataattccagctttccgtaagaaagttggagaggaatctaacattcctaaaatcagccttcttcagtacctccgctgtagttgtttcaaactgtcgtctaggagggttctttgcggctgcaggttttctaaggtcaaggtcccgaacagaatacgttgaacctcgcctaaaccgaacatcaggcctgaactcaaagtcatcttccca

SEQ ID NO: 21800 - DNA, 5218 bp, Zea mays
  misc_feature (3282)..(3282): n is a, c, g, or t
tctatttcacatattactgctttattgaaagttaaattttgttgagcagggagatatttaattattgtacgatctgcaggtggtgtcatgacattgggtgagaacatgctgctaacatgcctcttttgagaatcaatatttcaggtgatacttgtcttacatagagacaccgtattctttttctcccatgttcagtcacttattatcatttatctctttattaaggtcttgaagcatttatttagacctcgcaaaacgactcttctacttgttatccgtgttaaaacaaaaggtctgtacagttccaaagacagtccagttactttctctatttttgcagtttgatatttttattttgtttgacttttcttgtgctctgatatttttttttttgtatttgcagcctccactagagaacctagcacaagctctcaaggaggatatttagaatgtgccaatgctttattatcgactttcctccttgtcatgtcaaaattgtcatcaaccactgtctttttctattagatatggcaatctgttcagaaaccagaagcttacaaggaagcagcattatgtgatttcttcgatgtcggtgcatcagatttctgaaagtaaggcttccatgcaccaactgactaatattttctgcaatataaaggtggaggctactgctctattgagttatgaagcgaaggaagaactatttgaggagcaggtagactagactacaagtgctcaattttatctcttcagtgcatcccattctctattgtattcaattgcatttataatgaaatttttcatcttcagtggaacttttgagttcatatatatgtatgccttatttctctttaatgttacagaagaccttttactatactatgtcagtttttcttgcaggttggacgactaaggccttgttcgtttacgtcggattggtgggtcggaacaattccgagccggattgcttctctaatttatataaactttgattaaccggaacgattccgggtgcaatccgaggtaaacgaacaaggcctaaggtagatgttttatcgttcaattgcaccaggtggtcttgcagccggtagaagaggtgtggtacctggctacctgcttcaggcttctgtcccaatacactgcaggcttgcaaagtaagacgtgaaaataaggccctcaaccttcctactcatgaggctattgtggcattatttgccatcaatgctgcaaaactaaatagtaaatttatgtggacatgctgtcactatatttcagatgttatttctcttgtatgtcgtctatgtcatggttgcttttgttcgatgtgaagaaattgcaaatgaaaagctcaaacacttcttctctgataaggtgaaaatgttcttatgtcatgccagcctaaattatactctctccgttcatttttatttgtcacgttttaattcaaaaatgaactagcggacgataaatatttcaggacagagataataagatgttatgataaatatttcaggacagagataataagatgttatgactttctagatacattgcttttgctccgtgtgtgtgtataatgtatattaagtacatagcaaaaaattgtgtatctagaaaagacaaaatatcttataatttgaaatgaaggaagtatttgtttaattggctgcatgagaattattctactctacagggttgcttggagctagatgcagctgtaaaatctggtctaccaccagccttcggaatgaggctcagtgctattcttgactctatctgagagtgggtggtctagctaattatcatcatatcataggttttatcatagaaatttaagattaacacagtggatgtcacgaatctgtgttcaaaaccattagctacttgcttcggtccgttatcttgagccttgaactgtgattggccaattgtttggtagtcatgaattctgaccataaaatgtaatatatagttggttagagctataagggttgtagttgtcatagacattgttatctgacacttttaagatttgcacagtatatggttacttcataaattagctatgaaacttaattatgcagaggctggctagaccaatgctactcatatattctacacatagcttaatattctagtgcattcaaaactgtgggtgtccttgttgaaaagcaaatatgcaatgcaaacctattactaggtgaaaacatgtaaaccaatttgaagaaaacattttagttattaaaaaatctaacattttgtacgtgcatactatatttttctcgttaagcagccaaacaatcattatccaacagaaactgaaatcagtgctgctacctcaaaaaaaattgagcgtccactaaaactctgatccaacgttccatttcatatctgcatatgatatgatctccagccaggatgaggtgagctggggatgtctgctaaagtggcacaattgagcaaggcacgagttttcacaaaacaggcgtgatgttacagttttattcaagctgagctacgctatgatctgaagacgcaaaacgagcattgtgtgacttgtgcatgaaggcaccagaagaaaccgaacggagcgcttgcaaaaaaaggatgctccagaatgtttacacagcctccacatttggctcagcgtcctcattctcaacaggctcaccatccttctgcttcacaaagccaaaatatccatcatccgaataatgctcctccgcacttctgccaaagaagaatggtcttctacccattgttgtaaaaggcattaacccaaacgcacgcgcagttttgatctctcttgcaatcttacgctgagcttttgcacttatacgggtctgtcaagaaaacgaagttaaaatccatggcaaacaaatgtattgactatgatgcagaattacaaatgcaaaggcgaggaggctgtttggttcgacgcctaacttgccacagtttgtctaaccttttgtgtctaaagttagttcttcattttggctaactaaccttaggcaagttgtggcacaattagtcgagaaccaaacagacccgagatctcgtacatggccaccaagcgaccgcagcggtgaggaattcctgtggaagtgacaccacatgattgtgagttcctgacttcctaagctcctccagccctccaggggtgatgacatgttatactgctccagaagatgatgcaatagctgcactcgcgctaggaggcaatggcacagggacggtagccaagcgtggcttcccatggcgtggttgctgccacacaaggcngacatggcgatgcctatgcatttggcggcagcagcctctctgcccacttagaccttgttcggttgcacagggataggggattgagagagattaaatctctttctatttaatttttaccaggaagggatttaatgccccacaatccctctcaaaccaaacatgcccttagatggtctgctccaagagaagggatgtaagagcgaaggcccccagaatggttcgtattggctgctggtcagcacttacgttgcctgagcttcccctgttgctattctcctcatatgattatttgtttaatttctctccatatattgatatctttttcccaccaagaaaaatggtaagcttctcagaggtaatctccgcccccctgacattgacggtctaacttatcgcaatagttttttattacagtctgtgctctttaggtctagcagcattaaagaaatttgacatttgtggaatgactaaggccgactccagcagattaaccaaagtttactcatatgcactgtagattgcacggttcggagagtagagtttgaatatatgtatgcagatcaatgggtaagcaagctgctggagatagtctaacaagattgtgtctaccaagcatagtacaccttcaaaggctgttctccctattgggagaaaccacacctcttttaagatcttgtcaagctggtgattggtgaagataacatccgattagaacttgtgagatacatacaggtaggttcacattttgatattcctccatctgttcttgaatatttgtcgtccactagttcatttgtgaactaaaacgcgacaaataaaaaaacggagggagtctttagtgagtcctccctcaagtttctacttctgcactaaagcgtttatacaaggatgaggataacaacgtaattgcaagaatgcatgataacttcttgctagcccgctactgcttgtagtattttcatatgcctaattgtttatttatgtaaaatatcaatacatatctttttttctagaaaatggcacatctgtatccgctggatattgacacatgtacccatacccatgctacatagctttccagcatggactaatgcattcaaggcagctgctcccagtattgcaaaataaacaactatcaaacacaacaggatctgataatttcactaaaagaaaggagtatcttgccccaaaaaagctcatcgtcatatataatgagtacttgagtacaagtggttacctggcttctcttgatgataattccagcttccgtaagaaagttggagaggaatctaacattctgcagggaacagttccaaatctgttaaaaatgaaactagaagctacttgttgtagccaaacatgaattcatcaaccagaccaaagatataatctttggagaaacattatatgtctctttattgcaaagaggcacctaacagtaatatttattgacataggtttccacactgaactgattatctttgcaaatagatccaaacacgaacagtcaatgtcagaggtgcccaaggtagcaggaccccggctactaagctcatagcctggttcggtaatggcgaggggcttaacccctgaacgcccaattgtgaaggaggtgagattgagagagaaagagggagataaggaaattggttgttatcttctgcccccttgtgaggattggtacatggtatatacaggcacttggactggtaagcaaaaaaaactccttaaatcccttaaagtttgccttccctgcatgctgatccttgaatgtcgctgctggtgccatctgggcacgatcaccgcgcgtctacagctcgctgagcacatctgcagccctggtcttgtgcctcctgcaggactagggatggcaacggacacattttacccgtgattatatatatatatatatatatatatatatatatatatatat

SEQ ID NO: 21801 - DNA, 3348 bp, Zea mays
gtccaacaagatgggcctaactagggcgagccactggtgtacccaacaccatgtcataccctaccatgatagcatgaaaaagtcagcagagaagtgttcaccagcgatggagaaagacatccctcgagacacaccagtgcatggggacactcgccattggtcaccgtgacagatgtggagccgcagtagaccatggggagattagtgcgacagacggcctcctcgtcaatgaagttgtgcgacgatcccaagtcgatgtgggcgcagagcccaatgtggtccatttggaggtgcacttgcatggtgtcgctggtgcggacacccatgatcacatggagcgatatatgtgacaacgactacatagtgtgggggtcgtggaagacaacatcgtcatcgtttgcatagttattaaaacatcgtttaaacaacgtttaaacgccaaaacactcattagaggctaagacgctaaaaatgttacagggctaggcctaaaccgacgttttgcatccgtaaaatgtcgtgttttgttgtttaatggtcataagccataaaacgccacgtttgaagtgttttagtcttgcacatacacaccagagagaaaatttagcttctttgggcccagtccagttcgctccacacgtttgccctatcatactcgctcaagacccgacgacaccatgtgctcacatttgtagtcctgccactgaaggtcatgccttcccgactattcgtcggctccaagaggagacaggggaagcgaggtggcaggcgcagccccacactggtctttgtcttgcgactatgtggctagttgtccatccactgtggcgccatcgtcgttctgctctagtactcccctgctctcatccactcgttcgccaccgcaaatagaggaatttgcgctcgtgccccggcccctgccccctgctcccatctagcattctgcctattgtagctacgcgcacaggtgctccacccatgaaattgtgatatgttgatattttcttatgtttaaaagtcaaaactccacccatgagtgtttcaatgttttgttgttttaataaccttgatcgtcggcctccgccaagtccaacaagaacaaacactgacacaagcagttgtgactgcgctcgaacttttcgttgcaattgaaacataggtcgagccggcaatgaccttccatttcaaatgtcgacagatgtcatatggggcacccccctaccatgacgatggtggctgcagcagccacatcaggtaatggggctagcagggcgaggtgttgggcaagtgattatcaagcatcgtctaaaaggcaagttttataggacagccataagacctactatgttatatgatccaaattgcttgggactgaaaggctttggtgtcgttgttgcatagtgattagcatgtactttattgcaatggactgtcttgaatttgctaaattcgaacataagtagtaaaatcagaagaaaatgtcagaccaaacatgtttaaagttagcacttagcagtgattactagtcatgctctagacatacatatgaagatattttagggaaattcatatattgacagtaaatttgtaatggattttgggcggtgccatcaaggctatgacctctaattgaaaaaaaaatcgaagtacgattttgagatcaacatagacttgtggcacaaaagaggtcagcatagactccttgtgttcctgaactttttgttacctagcagccctagaatttacaaagccatagaccacagcaaaatacaaacttcaatataaaatagcaaccatagtaattttccttgtgttcaggcagacatactcaccctaaaatcagccttcttcagtacctccgctgtagttgtttcaaactgtcgtctaggagggttctttgcggctgcaggttttctaaggtcaaggtcctacacttgtcagattgaatgaaataaggcattataatagcaaccacacatgggcagatcagcaaataaactaataaatgaagaaagaaatttgtaaagtacacatggtatattggtattataaagagtatttccgcgtatttgaaatgaaattctcattttgttaacaaatatctgatagtaaaacacacgatttttactgtgattttagcatagcagacatttctagcccacacacttatacactaattcatgaatgcttgcacaagataagtagataacaaaaacatataggttgcaaaagattttagacaactcggataattttgtctatttattgacaaaccaaactactgcttacccgaacagaatacgttgaacctcgcctaaaccgaacatcaggcctgaactcaaagtcatcttcccagtcaccgtcgacgtcctcgtcctcctccatttggatgttgcgtgccgcattagcaattgtatcatttaagccatcattaaaagaatcataaccatccatccatcctgaactgctcctgtcgctagatgcaggaaacccagggaaaccagagctgctactgtcacttaacctagtgaaaccacccttggacaacccaaaattgtatctcctaccagtgttctcagccctatcgagcttctcgtagagtgatcctttgtctgtgtccttgcccccaaacaaccgttcttcgaattcgtccatagtctcaccatcccctgcacagaaacagtcaaaccagaaaggcatatcaaaatcggcttgattgagactattcaagagtcaattcttcactcttagagcattattacaccagaagtataaggaaatgatggtctttagctcgagaaagctagacaaaattcacatcagatctagatgtccagggtcattcaattcaacttactgttataaccaactttagggaaaggtacgcaagtataacaactatgggcatcacacagcacgagtacctcccatgtgtggtatcttttgtttcaagagataccactcatgggaggccaggaaggaacaggaacagaagagggttggatgctcaccggactggaatgaacgacggaagacgccggcagcggccagcagcggatggggagggaaggcatgacagagagaggcatggcaggggagacagcgcctcagtgcggagctcaccatcgcgctcgcttgtctcctgattcctagcggcggcggcgcttgtctcctggcggtgacggtggctgtcccctccacgagctctccaggcgccggcgatgtcccctaccggcgagcccctcccctccgcggcgacctcctccctccggcggcaactctcctctctctctctcggatgcagggtgagggtggcagctgaggcggtgaggcctgagggtgctgcag

SEQ ID NO: 21802 - DNA, 1776 bp, Zea mays
tctctttaatattaaatatatacagaaaaattatcccatgttgtttggctgatgctggctgcaaactaatttaagtgcataggcatggatggtctggaatgcgcaccgccgatgggcatgcataacaacaaccgtgcatggctaccattaggaacctagtaaaataggcatgcatgccgccaggccatgggacaggctacacacctctatttggggggtttcttccccctcggtcactttgatattgggggagtttcacctcccctgccttctcttgtcgacgtctccttctccctccttcctccagcacgagcggcagctgtcggagcacgacagttgcagcgtccttcaggggaggaagaaaggggacgacggcacgagtttaaaccaacaatctctcgtcatatatatcataatagagagtaggacgacaaaagccatgggcagtaatggcagagatcataggcgcggagtcccacgcccgccacctttaccactttacagggattgggaggaggaagaggtcgtcaaggctggtcgacgtcggcagtcgccgttggcgcagtcgtcaacgtcacccgcggccgcagccggcgtcgccaacaagaagaggctgtcgaagcagctgtccatgaaggagaccaccagggaggtcaagtgggagaagcggaagcggcagatacaacggcagaggagcagcatgcgcctgagcgaagccgacgacagggcaggtggcagcactgctgtctgtcctgttgacggcgaggcgagctcgagcgcggagcgggtggccactggtataaccgacggggacctggatgagctgaggggatccatggatctcggcttcaggttcgacgagcagaagggcggccaggacctctgcgacaccctccccgccctcgacttctatttcgccgtcaaccggcaggtgtcggagcccaggatgtcgtttcccacgagcacgagctcagggccgtctctgtcggccaccaagtcctcgcccaacctctgcggcacgcccagcccaggtagccctggtgcgcactctagtaacgccttggagtcatggaagatttgcaacccaggtgatttgagttgcagaatttttttccatgatcttgttaacgttctgcagtttcttatgttgggaagaacggtgtgttttggcatagagtttttgtctttcttctcatctcttttgtcggttcttgatgtaataggagataaccctctgcttgtgaagacaaggctcaggctctgggctcaagtagtggcttgttcagtgaagcactcgagctgatcctcgtcagtgttttattcacgctcttcttccatacataatacccgtacaagtggttgcgatggcgatgaattagtcgtgtccgagtgaaactagatcaattgaccttgttgctcgatctaatgtcgtcccaggtcacattgttgtggacagatttaattagcgtcgggttggcaaattaaaaaatgtatatgcaaagtactgttaaaggttggcatggtgtaaaaggtgtgagctatctccctaaatcattatgtcacagatttgcaccagtctttccgtatctgcgaaaaaaaacttgtctcgttttatctcttctccacttcctcgtgtgagaggctcccgcacatgatttatcccattttattactccatattttttgcatgtacggtttcatgaaaaaaaaactctggttagcggcctatctatatatgtaatacgtatgtgattggagtgatattaatcatgtgcg

SEQ ID NO: 21803 - DNA, 1355 bp, Zea mays
aaacctagtaaaataggcatgcatgccgccaggccatgggacaggctacacacctctatttggggggtttcttccccctcggtcactttgatattgggggagtttcacctcccctgccttctcttgtcgacgtctccttctccctccttcctccagcacgagcggcagctgtcggagcacgacagttgcagcgtccttcaggggaggaagaaaggggacgacggcacgagtttaaaccaacaatctctcgtcatatatatcataatagagagtaggacgacaaaagccatgggcagtaatggcagagatcataggcgcggagtcccacgcccgccacctttaccactttacagggattgggaggaggaagaggtcgtcaaggctggtcgacgtcggcagtcgccgttggcgcagtcgtcaacgtcacccgcggccgcagccggcgtcgccaacaagaagaggctgtcgaagcagctgtccatgaaggagaccaccagggaggtcaagtgggagaagcggaagcggcagatacaacggcagaggagcagcatgcgcctgagcgaagccgacgacagggcaggtggcagcattgctgtctgtcctgttgacggcgaggcgagctcgagcgcggagcgggtggccactggtataaccgacggggacctggatgagctgaggggatccatggatctcggcttcaggttcgacgagcagaagggcggccaggacctctgcgacaccctccccgccctcgacttctatttcgccgtcaaccggcaggtgtcggagcccaggatgtcgtttcccacgagcacgagctcagggccgtctctgtcggccaccaagtcctcgcccaacctctgcggcacgcccagcccaggtagccctggtgcgcactctagtaacgccttggagtcatggaagatttgcaacccaggagataaccctctgcttgtgaagacaaggctcaggcactgggctcaagtagtggcttgttcagtgaagcactcgagctgatcctcgtcagtgttttattcacgctcttcttccatacataatacccgtacaagtggttgcgatggcgatgaattagtcgtgtccgagtgaaactagatcaattgaccttgttgctcgatctaatgtcgtcccaggtcacattgttgtggacagatttaattagcgtcgggttggcaaattaaaaaatgtatatgcaaagtactgttaaaggttggcatggtgtaaaaggtgtgagctatctccctaaatcattatgtcacagatttgaaacagtctttccgtatctgcgaaaaaaaacttgtctcgttttatctcttctccgaaaaaaaaaaaaaaaa

SEQ ID NO: 21804 - DNA, 1195 bp, Zea mays
ccggccgggaactgtaaaacggggacacaggccagatggtgcttctgcgcgtttgccgtcacttcggccacctgcgcttcgcctccttcctctcaatggcggcgccccagcaatccgctcccctgtccgggtcggcgcccaagaggctcagggcgatggccacagacgccgctgcagtgccgaatcccccagcctctagtggctgccccgcgatgaaggcggagttcgccaagcacgccgagtacctcaacaccctgaatgacaagagagaaaggcttgtgaaagctagtcgggatattacaatgaacagcaaaaaggtcatctttcaggtccacagaatcacgaaagttaacagggacgaagttctctcgaaggcagaaaatgatcttgctgcagttgttaatcaatacattgcaaaactagtaaaagaattacaaggaactgacttctggaaactcagaagagcctacacctttggtgtacaagaatatgtcgaagctgcaacactctgtagattttgcaagactggcactctattaagccttgctgaaatcaatgattctttactagcactaagtggtcaatctgttgagcccttacagttaaatgtgcttgactatcttttaggggttgctgatttgtccggagagcttatgaggctcgcaataggccgtatatctgatggggaagttgaatatgcaaaaactatctgtgcttttgtgcgggatatttacagggagctgacccttgtggtgcctttaatggatgacaatagtgagatgaagaagaaaatggaggtcatgctgcaaagtgtagtaaaaattgagaatgcttgcttcagtgttcatgtgagaggttcagagtacattcctctgctagaatcatcagcagatccaggctattcttattttggtgccccggactttgatcaatgaatgttttgaagcaagaactaactgagtgttaaaggagcttagatcaatttaaggagagcggttgtgtcaaggctactcttaggtccacagttgggtgtttgattttatcgccagtttatgttgcacatcttgaagtctgtaaatctaagccccaacgtggtaatccgggagaatcatgttgcaatacaacctttttatggtgcagacttgtaatactcaaattgtaagggagaattaaaggaaaaaaaaaaaaaaaaaaa

SEQ ID NO: 21805 - DNA, 2226 bp, Zea mays
cgattgggtaccgggccccccctcgagttttttttttttttttttttgagaaaagtgatttatcgtagtcatgttttccaaaatgctcattctcagtctgattcacgttagaaaggaagaccgtcatatcggaagggcaaggttccacccactcccatccggccatccccatctacaatggtctaaacccagatcttactcctaccaaacatgccctcaacaacctacttgacactaccaaagtatcaacggcgtagcgtcagctatacacatcggcaatgatcatttatttaaacaacatcttgagatgctcaatgcgagcgccacgaatctcctcgtcggtgagcgccccagaaaccatcctctgcttgcgcatctggacctgctgcatccgctcctcgacagtacccttgacgatgaagcgtcggactcggacctctcttttctgcccaatgcggtgaattctcatgatagcctgctcttccacagccggattccaccatggatccatcataaaaacattggaggcagcagttagatttagccctacacctccagccttgagcgacatcattagcaccagcttgtcctggctctcactgaactccttcagaactttctctttgtgcttctggctcagcttgccatcaaacctcaagaacttgatacccttctgggtgaagcggatctccagaagatcgaagaaggaagtaaactggctgaacacgatgctcttctcctgcttcctctgaaggctctccagcatcgttacgagcgttttcactttgcacgagtccttccagttgttcttggcatccacctggaaacgactctgagcaggcagtatgatcaggtcagacttgctgatgtgacgtctacagagtgggcatggccctccgtctggagtcctccagctagaaacaaggcattcgccacacatccggtgtgcgcaagccgcgtgcactggatcgtccgaagctgactcgagacagatagggcactccatcgtggcaccctggcgaatttcctcgacgaccccttctacataagccagtgaaggcactacgttctgtcttccagacgaactctgctgcaccccttcaaggaattgctgtgcaagctggttgaggtcagcatactttttagggtcagctcggctgataaccagaaaagggtgatcgcagcattgtcttagccggagaagtagctcgagaatattagcgtaattgttcagaacactgccttgtgctacaaatttgtcaaattgaacctttgatctcctgaaaagtgcttcatagaaatcacgttcatgttcagattgttcgcattctacaacttcaatacgagctggaggtagaaccagtatgggatttccaatcttgtcttttgtttccttggtcctccttagcattagtggcctaagaatagctctaacaagtttcaaccctctatcatcaccattctcataaggtttctgaataagcctctgccaccattttgcattgcaccatggctcaacatgtaggaagcagagaagactgtagaggtcctccaaattattttgcaatggtgtgcctgtaaggcaccatctgcattccgactttaatctataagctgcttgggcacttttagttttaggagatttgattgtgtgagcttcatcaagcacaatcctataccaatccatcctgtgaaaaatgctgttgcattctgttttgcatgcagctgagaggacaccataggttgttaaaacgacatcatgttgagccatcagcatgaggctactagttttatcaccagcataatgcacaaacacagaaagagctccttgtgccgaatgtgcctccaactcatccttccattggcccaataatgacatagggcaaacaacaagggtacctcctctaacagaggatattgaagtgtatcctctggtcgcacgatctcctagataccttgtgtctccttttatacagttagagaactcccccctaggattggaaagtatcagagcaatggtcatcacagttttgccaagacccattgcgtctgctagtatccctcctcttacagtctcagtcatacttggaaattgtgttgttgcttgaccagtaaaaagattaacatagactggaggagctctcctgtctgcaatattgtaggcactccaacacggattaagagtttttgcccacgcgtccgcccacgcgtccgcccacgcgtccg

SEQ ID NO: 21806 - DNA, 2442 bp, Zea mays
  misc_feature (40)..(40): n is a, c, g, or t
  misc_feature (59)..(59): n is a, c, g, or t
  misc_feature (124)..(124): n is a, c, g, or t
tgttgttttggggtgtgggaaggagacgggggcgaaaaanaggtaaagggccgcaaagnccgcggtgatgcgcgtgagagcccccatgggagggggggaaaccgcctcagggggggaagtttanagcgaaccaataaaaggggaattggggcccggggccccccggcgaaggttgtttaaaataatcccccaaaaaagaaaagggggaacgcgggccccccgccgttttttttttttttttttttgcaaaaataaaattttgtttcctggagtcggtctgtgcaatgatctttacagaagggccaaacggcataccatgtgaatgacacaaggcttgtataggaaaaacgtatggctttacaggaggagaaaatatacacgtcgtatgactcgtatattacatgtccgagtctgatggtgcgcatcaatcaggtgttcttctctagaacagacagtgctggtgcgagatagttgttagccttgtctggcagatgagccacaagttcataaagctcgttcccttggtcactgacgtactcgtagcatacatcgaaacttttgtttctcgcagtggaatcatgcagtgccttgacacagatatcagccacatcagcacagctgataccctgggagattctgttcccttgatcgaagatcagcgcgcgctggccaccaggttcttcctgcagaggacccgggcgcacgattgtatatccaaggcctgacctccgcagtgcatcttctccagccttcttggctttgagaacttgttctcttctgttagattcaattccagaacctgaacatgacaccaatatgaagtctgtttcttgaccagtaggtaaagccttgatgtattccagttttagctcaaagtttcgaggatcactagaattttgagatgcctcaccaggtctctgcctttttggttcaaacctaatggttagtgtatgcacaagaaaagggtctaggggagggtcttgtgggtttactggccgaaaagatgaaaacggcactcttaccctacaaaaacctacttttgtagtcatccgagcaaaatacttcttgctctgggtcgtgtccgccaatggaccagtttcaagaataacaacgtatgatcttccatttcctcccactgaaaagagtaaaccatcgtacctgtctagggtagaacctagaggaagagaaagcctttttgatatctcaacatatccacctcttgtgaatacaaatcctgagaaaacagcctgctgatcttctgaaaaatccagtgatgcatcgataccttcatcaaatctagaaacaaaagtatttgggaagtaagaaccctgccgcacctcccaacccttcaaggactttgcagacttgaattttgctatcaggagtttgctcttgctgcttttaccagccctgagctgggccaattcgttgtagtaatcctggaaagccttgctagcattccttactccttggttatcaaccctatttaggtctcctgtaatagttgagcgtgcagttgcacaatagattatcttgctgcagcctgatacagctgctttgacagttgcaggatcaccaacatcaccaacaacaatatccaccgaccttgggagcatatctatcacttcagggtcgtttcttcttactaaagccttgacattgtatccgcggagcatgagcttgcgcacgacgatgcggccgatgcggctggtggcaccgacgacgaggacggtggtgtcctgcgcccctggcacagtgaactcgcacataggtcctccacggataagcacggcctgctcctcctccgccagcgcggtggacgaggcgctcgaaatctggcccagccgcgagaacttgcgccacacctcgtcgaacacctgccgcgaccgccgacccagacccacggggttgacgatcacgtcgtcgaggccggcctcgagggtcccaatgctgtcctcggcgccggccgcctccttcttccttttcgcctcgtcctctgccgccgccaccggcttgtcgtccgtcccatcctcctccttggcggcggtggcggacttcttcgccttccgagaccggcgtttccggcgtggcttggcggcctcctgcgtggccgtggcgaagtcctggtcgacgagctcggcagcggccggcgcggtgggcttggtggcgaagcagcacgcgggggcgtggtggtaccgcctggcgccgccgatggaggaggaggcgagcgggagcgcgcgggaaggggacgcgtggctgtggaacgcggcgatggtgctgacggccgccctgcctggggccgacgcccgcgccgccacgatggccgccatgctctccccgccgccgctgacggacggtggtgggtagctgattttgtggcggggaccggcgcggtcgctgcaaatacttcccccggtgaatctcgctgccgcagctgataaa

SEQ ID NO: 21807 - DNA, 2992 bp, Zea mays
gtttaagaaataaagacctcgatttcgaatctgttgcggggggtgggcaaaaaaggctcaaaaataggagcagcccttaaaactccctagaaaccctattctagtgaccattgctaaaactatccctagcagtttacctacatccatctttatattcaaacttcactttacaaacggtacaatatacaatgtacaacagtacagtgttttgggtaaccatatacgatctaactctgaacacagtccccgttggcttaacctcattagattcgtgatttgcaatttcgtacactgaaactgagaaaactcaggaggacgcaactagcagaaaaacacatatttcagcaattcgaaaaagtattacagcacaaatactgctgatgtatagtaactaaatatacaagattgggctttcctattgcgtccactacagttggtacaacgccggcacctatagagccttgtccagaaggggaaaaaacagcatcaatatcacctctccccgcatcaatagtcaacatataccccacaaattctgatgaagcatctgtatctcaacatggttgcaactcgcaagcaactagccgaatagtcaataagacaaacataagccacaataacctccaggctgcgtctgcagtggtcaaaatattacatagtgcacatgtgaagcttaatattccattaatgctgcatcagtctctgacaagggtgcaagtagatcctcatctgcatcatggaacaacgaagattccatcaatagaggagagaatacttgatccagagcatcatcagtgataaaggactgatgtgccagaccaccagccgggtcaaggaaactcatggcactgatcgaatcatgtccattgagttcacttaacagaattggacttttgttgattggggtatctgcattgtagcttgtgctctttgggaacttcatctgaggtgacaaacctaatctttggttacatcgatttgccaccgaatccatttccttcttcgcagcactaattgacagcggaataaagaagtgttccgaaccatcatcactatttttatcttgtggtctctctgtattcttcaatggcttagataaagcagcttcacgaacagaacgtctaatgtcatgagcagaatagtcatcattttcgtgcattgaaccattcatttgatccttagttgaggggatggtaagcgttttctgttctgatgtgatgtcctggctacgttgacgagccaatgcactccgtttttgtgtctgtattccttttccagaagaacttggagtcagactaaataatggtggtagctttagagcaggactgcccccaggcttatccaagtgtgtagaagagagcttagaattgatctccgaaacttcactgctgctttcttctgatgttccaaaccctgcaatttgtactggcagtggcagcctcgagttcaattggtccattgagttaatagatacactattcacttcttctgagagttcgtctatagactgctgcattgctggaatagcctccttgagttgattaattagaccctgtatactgactaaatgctggcgatgttcagctaatgttgcagttaacgaatcagaatgagtactggcctctccgctggatgcactcctcagtaattcaggcccctctccatcattcgctttggccaaatgaagagattgtttatgaatacgttgtaaagcatgggtccagcggcgaagaatttcagctacatcaacagtttgctgagtacgtccattcctatcatctgaccttgtaagggcttcttccttttcttggaatagctgagaaaattcttcctgcttctccaaaattatagaagtttcaccagctttagatgatagtaactcagaatgtggaacacttgaactcatatccattgctgctagtaactgtgatcctgatatccggtatctgtgctcccgatgtgctataagatcttcaattggtccagaagctaaaacctcgtgctggcctttgcgagccaatattgattcccaaagacgagttgccttagaaaccaaatgagagttctgcccagatgagcctgagagccgttcgtcccagagttcgccttccagttttgctttgtttctcatatcttgtagtttctctaactcttgttgcaaataagcctcttcagcacatagacttcggaactcagctgtcatctcatgggccaaatttgaccatgtcatttgcctctgaacagctatgtttgcatttttaagaaatttacgcctctccagagctattcttgccttggttactgggagtaaagaagcagcatgaagataagaaacatctgttagtgctgcaggtagtggatttgatacaacatcagctgcaaatgttctcttgtggacttctctcagggcatgtacagatagttgccacaaaagctcaacaaatctcggtccgcagcatgtggcaagtgacgagaccctagaattgctccgaggcagtgccccatgctgttccagctcgctgatgatcccttgcacgatcttcctgaactccctggactgagcggagtcgaagattggccagaccttgtcaaaatccttcgcggactgcgcggggccgcggagcgaggagagaaggaagtagaggagttgctcgccaaggcgggggttggagtgacgaaataggcccacgcggccggcgggggaagagggagagccgaggaccgcgggatcgaggccgaggagtaggcagttagtgtacatggcgccctccagctccgcctcgcgctccttctcccgatccgccgccatggctgcacttgctctccacggggtgggggtgcgggtaggtagagcagctaggtttacagggagaagggcgccttcgagggccgggcctcctgctctcgcggaggtgggaagggggagaaaaaacaagcaaccgaggaggcgaacggtcagggcccggttcagggggattgaagctaattccat

SEQ ID NO: 21808 - DNA, 1588 bp, Zea mays
attacacttcaccgccagatgcattcctctccgtctttactggaataagatatccttttcttttttatctttttgaaatgcagatgctttcaactatcacattctgtggaatgaaacatctttccttgagcttcatacaattcacatataactatataagggaacaaatatttaggaagcattcagtttatgtacaaagttatgcagtttgtctgtggccaaagttataatttttacagcagatgtgagggcaaagaaacaaagccctgggactatctggtaaattgtaacgccgtgatctactgataaattgtccccgaaacaatggtaggggtctgaatcatttggcatcctcatttgcttcttctttgcgcaaagttccattagtattctgtaaattaggggatggctcccttgtattgccttggttgttcaacagttgagagaaaccctgccaaaatcctacaggccgagactgagtgctttcctgatgctcttcagaccgcctttcaaacaaaccagctgatcctggatttaactcagaaaaccttactgctccaagaagtctctcagggagctccgactcggtttgactctcaatgagaaaggccaaatctacagttagcgttgtgatatagccaaatgccaaatgaacgatcgcatttgcaactatagaagacccgatatccacatcaacttcgatgaagtttgatccttgaacatacttgcatgagagggctctccccagtatacagatggcctgttcacccacagccgtccggacaatccagggccccttgacaatattcgctattaacttaagcctggagtttcggaaggcatcatctcctttcaagaactggtccataagcgagccttcaggtatagcctccagcgacacgaagtagaatattgcactgaagttgtccttgggcagttgcaagttgaatgcccagacaaaaggctggttaccacgtgaaacctcctcatcgatagcttttctaactcgatggttactgtctttcaggatctcacagatttttgctggtcctttgatccaatcaaagccgagaggcttcagaagatactctccacctggtatttttaccttgtttgtaagatattctgggcctctgaccataaatgaatcaccgggaggagtagcccagccattaggacagttttcaggtgctagacagggaactgttcctcctgacttgatattctctatccattgttgctcagcctcaccgtttgaagaagccatcttggggatcctgagtcctgactgacgagtgacggcgacgcagcgccggcgaagtggtaggacgggacgggacccgacaagatccccgagcctagcgccggcgatggctcggtctgggaacctcgcagagggaggcgggaggatctgaagaggccttggcttcttctggatcgcgtcggattctgtatggcgtcctggctggggaaggagagaaggtttctactacttgcccgtcccagctcccacgtctcgttgccgttccagggaaggaagggaagctttttttttccggttcggcttttctaggtaatggtctcgtgc

SEQ ID NO: 21809 - DNA, 6027 bp, Zea mays
gaattccctagttcagagaaagaaagaagttgagaatgagaagcaagtgaggcgcgtttgctgggaagtggttcttgtgaggtttaggagttcacccttcttttcttccccttctagaaatggagatggtcctacggtcgcagagccctctctgccttcggagtgggccggtgctcatttttcgaccaaccgtcgcgggcggaggagggggcactcagtctttgttgaggactaccagatttgcgagaagaagggtcattcgatgcgttgtagcaagtccaggttgtcctaataggaaatctaggacagcgtctcccaacgtaaaagtagctgcttatagcaactatgcgccaagactcctcgttgagtcaagctccaagaagagcgaacaccatgatagcagcagacaccgtgaagaaactattgatacatacaatgggctgtcaggttctgatgcagcagaattgacaagtaatagagatgtagaaattgaagtggatttgcagcacatttctgaggaggaattgccaggaaaagtatcgattaatgcatcattaggagaaatggaaacagtggatgaagctgaggtcgaggaggataagtttgaggtagatacctcaggaattgtattgcgcaatgttgcagttcgggaagtggatccaaaggatgaacataatgctaaagatgtatttgtggtagattcgtcaggaactgcaccagataatgctgcagtggaggaagtggtagatgaagctgaggttgaagaggatatggttgatgtggatatcttgggacttgacttgaataatgcaacgatcgaggaaattgatttgatggaagaggctttactggagaacttcgacgtggattcaccaggcaatgcttctagtggtcgaacctatgggggtgtggatgagttgggtgagctgccttcaacatccgtggattgcatcgccattaacggaaaacgtagaagtttgaagcctaagcccttgccaattgtcaggttccaggaacaagaacagatagttttaagcattgttgacgaagaagggttgattgctagttcatgtgaagaaggccaaccggtggtagattacgataagcaagaggaaaactctaccgctttcgatgaacagaagcaattaactgatgatttccctgaagaaggcatatctatagttcacttccctgagccaaacaatgatattgttggatcctcaaaattcttggagcaaaaacaagaattggatggttcttataaacaagatcgatcaaccactggattgcatgaacaagatcagtctgttgttagttcacacggacaagataaatcaattgttggtgtgcctcagcaaatccagtacaatgatcaatctattgctggttctcatagacaagatcaatcaattgccggtgcacctgagcaaatccaatccgttgctggctatataaaaccaaatcaatctattgttggttcttgtaaacaacatgaattgattattcctgagcctaagaaaatcgaatccatcatcagttacaatgaaatagatcaatctattgttggttctcacaaacaagacaaatctgttgttagtgtgcctgagcaaatccaatccattgttagtcacagcaaaccaaatcaatctactgttgattcttatagacaagctgaatcaattattggtgtgcctgagaaagtccaatccatcaccagttacgataaactagaccagtccattgttggttctcttaaacaagatgagcctattattagcgtgcctgagaaaatccaatccattgtccattacactaaaccaaatcagtctattgttggcttgcccaaacaacaacaatcaattgttcatatcgttgaaccaaaacagtccatagatggtttccctaaacaagatctatcaatcgttggtatctccaatgagtttcaaacaaagcaactggctactgttgggactcatgatggattgcttatgaagggtgtggaagctaaggagacatctcaaaagactgaaggggatacacttcaggcaacgttcaatgtcgacaacttgtcacagaaacaggaaggcttaactaaagaagcagacgagataacaattattgagaaaatcaatgatgaagaccttgtgatgattgaagaacagaaaagcatagccatgaatgaagaacagacgattgttaccgaagaagacattccaatggctaaggttgagataggaattgacaaggccaaatttttacatctgctttctgaagaagagagttcatgggatgaaaatgaagtgggaataattgaggctgatgaacagtatgaagtcgatgagacatctatgtccactgaacaagatatccaggaatcacctaatgatgatttggatccacaagcactatggagtatgcttcaagagcttgctgaaaaaaattattcgctgggaaacaagttgtttacttatccagatgtattgaaagctgattcaacaattgatctctatttcaatcgtgatctatcagctgtggccaatgagcctgatgtacttatcaaaggagcattcaatgggtggaagtggagatttttcactgaaaaattgcacaagagcgagctggcaggggactggtggtgctgcaaactatacattcctaagcaggcatacagaatggactttgtgttttttaacggacacacggtatatgaaaataataacaataatgatttcgtgatacaaatagaaagcaccatggatgaaaatttatttgaggatttcttggctgaagaaaagcaacgagaacttgagaaccttgcaaatgaggaagctgaaaggaggagacaaactgatgagcagcggcgaatggaggaagaaagggccgcagataaagctgacagggtacaagccaaggttgaggtagagacgaagaagaataaattgtgcaatgtattgggtttagccagagctcctgttgataatttatggtacattgagcccatcacgactggacaagaggctactgtcagattgtattataacataaactcaagacctctagttcacagtactgagatatggatgcatggtggctataacaattggattgatggactctcttttgctgaaaggcttgttcatcatcatgacaaagattgtgattggtggtttgcagatgttgtcgtgcctgaaagaacatatgtattggactgggtttttgctgacggcccaccagggagtgcaaggaattatgacaacaatggaggacatgattttcatgctacccttccaaataacatgactgaggaagagtattggatggaagaagaacaaaggatctatacaaggcttcaacaagagaggagggaaagggaggaggctattaaaaggaaggctgagagaaatgcaaaaatgaaagctgagatgaaggaaaagactatgagaatgttcctggtttctcagaaacacattgtttacaccgaaccacttgaaatacatgctggaactactattgatgtgctttataatccttctaatacagttctaactggaaagccagaggtttggtttcgatgttcctttaatcgttggatgtatccaggtggggtgttgccacctcagaagatggtacaagcagaaaatggttcacacctaaaagcaacagtttacgttccacgagatgcctatatgatggacttcgttttctcggagtcagaagaaggtggaatttatgataacagaaatgggttagactatcatattcctgtttttgggtcaattgcaaaggaaccacctatgcacattgtccacattgctgttgagatggcaccaatcgcaaaggttggaggtcttggtgatgttgtcactagtctttcacgtgctgtgcaagatttaggacacaatgtggaggttattcttccaaagtacggttgcttgaatctaagcaatgtcaagaatctacaaatccatcagagtttttcttggggtggttctgaaataaatgtgtggcgtggactagtcgaaggcctttgtgtttacttcctggaacctcaaaatgggatgtttggagtcggatatgtatatggcagggacgatgaccgccgatttggcttcttctgtcgttctgctctagagtttctcctccaaagtggatcttctccgaacataatacattgccatgattggtcaagtgctcctgttgcctggctacacaaggaaaactacgcgaagtctagcttggcaaacgcacgggtggtattcaccatccacaatcttgaatttggagcgcatcatattggcaaagcaatgagatattgtgataaagccacaactgtctctaatacatattcaaaggaagtgtcaggtcatggtgccatcgttcctcatcttgggaaattctatggcattctcaatggaattgatccggatatatgggatccgtacaatgacaactttatcccggtccactacacttgtgagaatgtggttgaaggcaagagggctgctaagagggcactgcagcagaagtttgggttacagcaaatcgatgtccccgtcgtaggaatcgtcactcgcctgacagcccaaaaggggatccacctgatcaagcatgcgattcaccgtacactcgaacggaacggacaggtggttttgcttggttcagcgccggactctcgaatccaagctgattttgtcaacctggcgaataagctccacggcgtaaaccatgggcaagtgaggctttccttgacctacgacgagcctctctcgcatctgatatacgctggctctgacttcattctggtcccatctatatttgagccttgcggcctaactcagctcgtcgccatgcggtatgggaccatcccgattgtccgcaagactggagggctcttcgacactgtcttcgatgtggacaatgacaaggaacgagcccgagatcgaggccttgagcccaacgggtttagctttgacggagctgatagcaacggtgttgactacgcgctgaacagggcgatctcagcttggttcgatgcccggagctggttccactccctttgcaagagagtcatggagcaggactggtcgtggaaccgacctgccctcgactacatcgagctctaccgttcagcgtccaaattgtaataatccaaccaacggccaatgtagtgtgttgtctgcaggtctcagatgcagccattcagcttttgcaggttcctgggcattgctgtacagcctccttgtctttagttagctccattccccgaggagcacagtgcaattttttatcctcagttattatgcatagattgtctcagtagaatgctttcttcgggcatgtatgtttgtttcctctgttgttgaattctggtgttaagtcgcgtataggaatctacaggaaatgaaaaagtccatttcctgcgtcaaccttttagggctaccatgcacatgagacctttcaagtgcaaagaatattaggactagactactagtatgtgaactctatttttccaagagatttcaatttttccaatgaaaaataaactaatttttcttggaaaaatggaaatcccttggaaaaatggggttcccaaactagcccgtagagtatagatcatagaattggtctagtggttcctcgagagagaaaaaaacatagacttttcttgtcatatgcttatttaagtttattttgtacaaactttgagaaccttcaaaaacaccccaatggctggttaagtgaccagggaaataaagaggatctatagggaggaatcccccgcctctctctcacagatgttgcctagcaccggccagcctcatccgtccagtggaattaaggttggttgcgacgacagcccatcaatggaaaccaacctcgtgccccgtgccgggatctaccttccttcctcaccaccacgccgatctcaccttccataggagcttcctatgcactgttacctattataggtacatgacattgtacatctttgtatgaacttacatcaatgccaaaaatccggaattc

SEQ ID NO: 21810 - DNA, 1957 bp, Zea mays
caaaaaaagtggctgcaaatgtgcaattaatacaaactagtactctgaacattaagcacaaaacacagatggttcatatgccaaaagtggccctccaagcaattttttttactggacgaagtcaaaacctcaggctaatttcaaccctggtctaagctcccataatcccatcctctgaactggagagatcttggaagatcagcagccaaatacttcagtctatagtccaagaatttatattgaacctttgaagattattatagcctttagctaaatcctaaaaaggttaaaaccatcagcagtttcatgcataagcttgttccagcaagttcatcaccaatctctgacttgtcctgtttcgtccctcaagacgcatgcgtcattaggatttcacatgctctgggattatttagctccattgagatgtcagcacttgtatgtgagaagtgtagataacagcaataaattacataatcaaagcatgccaatacacgtccagcttcatatcattagataaaattgtttcttaatttaagtatgtgtctgaaataaaatatcaacacaagatgaagaggttttgtatttgccttaattgatttcatacagtcatttctcgtcttgttattttgtactccctccgtcccaaaatattagtcgttttagcattttactagattcatacaatacttaatgtatgtgttttatattatatatagattcattgtcattcatttaaatatagacataaattcaatggctaaaacgactaatattttgggacggagggagtatataatatcatttcttgattcaaacaatagcatgccaacatatctacttcagttatttcataaaggcatacaattttactccgctaaaagttccaccacttattagcaactttttatatcagcaaccttttggattctctgggcgtggcattacttaactgtgctttcacattcaatagttctggcaaagggaggcagcaagcttgagacaacaactgcacaacttgcaagaaaatcatcggtacgtcaacaaaaccgattttttcttgcaaggtatgcagttgctgcctctagcttgccgccgccacttgcagcaactgagacgccggcgcggagtttgagctcgaaaccctaaaagctataggaacgggatagacaagcggtgtcaaaccccgaaactacgcagaacgaagcgagggggtgtgacaagggagaagctaacggggaagcaacggcatgtctgcggcaatcccgatctgagggaatggatcggccatgcatggcatgagctgtggaggcaggaagggggcggctcccgctgccaccgtatgacgggacagtaaagcatgccagatcggtgaaatccaggagcagggagaggcgcgggggagatgtaccgggcggcgagcggctgcgagcggcggcgcgagaggatctataacctggatttggactcgacaagggcggaagggcgcgggggtggctgttgtatagagagagtgggatggttggggccttgggggggaagaggagggcggaggagcggtgcggaggagcggtgcgcagcccggccacgtcgccccggcgctatttccaaagggggcgctgccgctgtgctgcgcgcaccccgacaggtgtaccttcgcctccgccgatcgggggcaggcggacagccgaggcgaagcgacatggctgccttttgcggggtgtcgccggaaccgagcatgtgagccggcgtgcgcgactgtgcggcctgctctcttgtccacttgaccacttgcctgtaccggggtcagtggtgaactggtgaaactgataccgtcggatgggagatgaagtgatttgttgttaattggatcgcaattcgcgacggtagtggaggaagtacgtggtgttctactcagctatgatatgatttgccgggctcgtaaagattttcgagggta

SEQ ID NO: 21811 - DNA, 1039 bp, Zea mays
  misc_feature (22)..(22): n is a, c, g, or t
  misc_feature (48)..(48): n is a, c, g, or t
  misc_feature (75)..(75): n is a, c, g, or t
  misc_feature (84)..(84): n is a, c, g, or t
  misc_feature (151)..(151): n is a, c, g, or t
ttttttttttttttttttgacnccaccactatgactatccaaatccanaataaggtattttacattcttttgacnccaattaanaataaaaggtgaccggcaacctctccgaaaaatgaactgcagccgacaaggattccgtccgttctcnaatatttgtagctcaagtcagttatactaaaacgcgataaataaatagaaaacagagggagtatttcagttacataagacatcgaaaacgaatttctttgaccctactatccagcactagattcaacgtctgaatggccgtcgctgaaattatattgctcgtaaacttggaacaggatctctctgcagggtacaactgccccaatcttgatgcaggcaaggaatgcacctgacagctttctatggaggctgtacacttcatccggtggtggggtcagcctgtgcttcaacatggtggccccaagattggaaacactatgcgtgatattattcgctcgaaaatcgtgaccgcctggctttgagaacggcacaccaacaatgaaggctgcttggacatgagcatccagcatgacttctggttcctccccagtaaggaatcctagtctgcgggacatctctaagacaccggtccgatctctatttgcacaggcaactaccattcgtagataatcatctacaaagtgttttgcaaaatcacgggctgctccaaaatctatcagattgaatttccttgtagcatcatcatacagaaaattactccaatttggatccgtctgcatgaatctgaagacaaacaactcctttattgtaagctcaagcagtttacaaccaacataattgcgggtttcctgacttaactgagccaccttatcgataggaatgcctggaacaaactccgaggtcagcactttcctgctagacaattgatcaatgacctttgggacattataaccatcactatcacatagcaattctttgtaacgcttctggttacttgcttctagcacataatcacactcccttgccagctcctgctcggacgcgtggg

SEQ ID NO: 21812 - DNA, 2174 bp, Zea mays
  misc_feature (30)..(30): n is a, c, g, or t
cgacagagacatgagcattctctcgtatgntaataatattggggccgtcgtgccctgcctgtctaagttgaacctatggttcaatcacagcagactaactgactgcaagcgaaacaagctctgtttaggaaactcaagagatagaaattcatctagatcgtaatctatccaatgatattatcacgtcacatagatagacctataccaaatacatgtcatgaatatcagctcagacacttcccaaacatacgaataggttttgataaataggtactcagggaaaatacagtgtgaaccatagctagaatgccttgagttctcttaacacaaaaatcctaatccaaagtgcaaataaagtgtagccatctcaacaatcaaacatgacatcatagaaaccaaatatgagattgctcaagcttcaacagcaacccttccagccacctggtccagatcacgccttccctgggaggtgatgcgccgtccacccttgggatcgacatcaatgatgcccatctcctgcagctgctggaggatgttgcgtgaaatggcaccactgctcttgcagaagtgaggtgggcgtgagccattcctctggcggccaccataaatcttctggaagccaccaacaccaatgccttgtctcaagtagatcttccttgctacagatgcagccctgatgtagtaccagtcagggtcataaggagggagctccttgaacctcgcagtcttcacaatgtcaacccactcaggaagctccatcttgccggaacgtctgaggatacttaaggaattacacatagcaacatataggaatatgaaagtcattggaacaaccactgaaaattagtgattatcgatacccgacaaataatacaataaagagaacattcgcccaccatcaaaaccagactaattgatggcgtaaacagcacagataggtttattgaagcaaaaaaactttaaactacgattgtgaactaatagcctaaaaataaaagcttcataataacagcacgtgagacaaatgtaataagcagcacactattcagcttcagagaaatagaattatcaatgttcaacctccagaatcaaaaggattttgatcctgaaacagtctccattctgaatggacccaaggttcactccacgcccaatgtactccagacctaagggctaaccataaactctcttgatagatatcaaccgaaaataaattaaaatcacacctcgtatagggccttgcatagatgtgtgctcagagcgttttcagcacgctcagtaaaaaaattgcctaaaccccatgtatgaacaataaaaacaactttacaaacaggttttctgcacagatgatctagataaataaaataaattaaatcatatctgttgtaacagcagaaaataaaccgcctaagaccaagaggacagaagaacagcattgtttatgcctaagcctagcaaagtaacaaagtcgaagaagttagtcatgtgagcaaatcacgctcctacctaccaatcagatacccagaaggcacaagaaataaaggtgaattcggttactgcaccactgcctcacagaactcaaatatatgctgaggatcatcccatgccatcatacagttcgcaataccacgaaaaaaatggcttattcacattctgtagcgtcgaatcagatgggaaggcgacgagtcgagcaccgttaccttgccggagcgtttgagatgggcggagtaggccttgacaaactcgtgggggttcacatccttcaccgtcctcgcagtagaagccgccatcctgccgccgccgccagggacgagagaaaggcaggtagagttcgatgcggctgctctgggctagggtttggaggagtggcgacagagcggagcgtaatatttatatagaacgtgcttcgacgtttcggcgttggattgggatccgacggttgcgatggggtgagcggatggtttagggttgagggtggtatggacaggcaggtgtaagcgggccaagttcaaattgggccaagagggtggctcccatcttcagtatggcctgaatatttggtaaagggcagcccgagctcctaggccactctgcaaatacagttccctttcctatcatatactttactagttggatgcccgtgcgttgctacggagatcatataaatctttagg

SEQ ID NO: 21813 - DNA, 1041 bp, Zea mays
ttttatttttttattttttattttttttttatattttttgttttttgtttttttttttcaaatgaatgcaccatattattgaacagagacatgagcattctctcgtattgtaataataatgttgctgacgagcccagccagtctaagttgaacctatggttcaatcacagcagactaactgactgcaagcgaaacaagcacagtttaggaaactcaagagatagaaattcatctagatcgtaatctatccaatgatattatcacgtcacatagatagacctataccaaatacatgtcatgaatatcagctcagacacttcccaaacatacgaataggttttgataaataggtactcagggaaaatacagtgtgaaccatagctagaatgccttgagttctcttaacacaaaaatcctaatccaaagtgcaaataaagtgtagccatctcaacaatcaaacatgacatcatagaaaccaaatatgagattgctcaagcttcaacagcaacccttccagccacctggtccagatcacgccttccctgggaggtgatgcgccgtccacccttgggatcgacatcaatgatgcccatctcctgcagctgctggaggatgttgcgtgaaatggcaccactgctcttgcagaagtgaggtgggcgtgagccattcctctggcggccaccataaatcttctggaagccaccaacaccaatgccttgtctcaagtagatcttccttgctacagatgcagccctgatgtagtaccagtcagggtcataaggagggagctccttgaacctcgcagtcttcacaatgtcaacccactcaggaagctccatcttgccggagcgtttgagatgggcggagtaggccttgacaaactcgtgggggttcacatccttcaccgtcctcgcagtagaagccgccatcctgccgccgccgccagggacgagagaaaggcaggtagagttcgatgcggctgctctgggctagggtttgcggcccgcccggcggggccccaatgatgcgcccataggagtg

SEQ ID NO: 21814 - DNA, 621 bp, Zea mays
tccttaagcagtggtaacttcgctgtgttctttttttttttttttttttttttttttttgaataggttttgataaataggtactcagggaaaatacagggtgaaccatagctagaatgccttgagttctcttaacacaaaaatcctaatccaaagtgcaaataaagggtagccatctcaacaatcaaacatgacatcatagaaaccaaatatgagattgctcaagcttcaacagcaacccttccagccacctggtccagatcacgccttccctgggaggggatgcgccgtccacccttgggatcgacatcaatgatgcccatctcctgcagctgctggaggatgttgcgtgaaatggcaccactgctcttgcaaaagtgaggggggcgtgagccattcctctggcggccaccataaatcttctggaagccaccaacaccaatgccttggctcaagtagatcttccttgctacagatgcagccctgatgtagtaccagtcagggtcataaggagggagctccttgaacctcgcagtcttcacaatgtcaacccactcaggaagctccatcttgccggagcgtttgagatgggcggagtaggccttgacaaactcgtgggggt

SEQ ID NO: 21815 - DNA, 886 bp, Zea mays
taaaggggaacaaaagcctggaggctcggagggccgcttttttttttttttttttcgggtcgtaatctatcccaattgatattttcacgtcacatagatagacctatcccaaaagacatttcatgaatttcggctcagacacttcccaaacatacgaataggttttgatactgcaataggtactcagggaaaatacagtgtgaaccatagctagaatgccttaagttctcttaacacaaaaaatccttaatccaaagtgcaaataaagtgtagccatctcaacaatcaaacatgacatcatagaaaccaaatatgagactgctcaagcttcaacagcaacccttccagcaacctggtccagatcacgccttccctgggaggtgatgcgccgtccacccttgggatcgacatcaatgatgcccatctcctgcagctgctggaggatgttgcgtgaaatggcaccactgctcttgcagaagtgaggtgggcgggagccattcctctggcggccaccataaatcttctggaagccaccaacaccaatgccttgtctcaagtagatcttccttgctacagatgcagccctgatgtagtaccagtcagggtcataaggagggagctccttgaacctcgcagtcttcacaatatcaacccactcaggaagctccatcttgccggagcgtttgagatgggcggagtaggccttgacaaactcgtgggggttcacatccttcaccgtcctcgcagtagaagccgccatcctgccgccgccgccagggacgagagaaaggcaggtaagttcgatgcggctgctctgggctagggtttgtcccgccccgcccggggccacccagcgaggcatttcccggccgacccgagggtaccc

SEQ ID NO: 21816 - DNA, 1008 bp, Zea mays
ttttttttttttttttcgcaccaaaacatcacttccgttttcaatatcagatcgaggtcagaagttggattcgttcataatatacataaaggtacatgtcaacttatacatatttgaaaataggaaaagacacttaaacatttatcctagctacatagatacgcgagcatatataactgcaacaatccagatattgctcctgaaagatattatccctctcgagcatttcctcgtctaagtcattaagtatatagtacatgggcttccagacgtctactatgaaaaatatatatatatcaaatgaaggaatctcctccctgataaatagagcacaaagcccagctgacaactgttgaaggttaccctaatttgcgacaattacttcgtcaaagttccaatctctaacaaggtccctggacacagcacggctgcgttgaagtcgaggagtgccctccgtgccaacttgaccactcacaatgggtggaaagggggtcactttcgatgtcccagcactagtagaagttccagctggtgttactcttcgagctaagcaggccacagcagctccacatcggctttcctcctctgaacttgacaccgagtagcttctaagagagtgtgaggagctgctcatgccatggcatacaagacaagcaagactcatggttgttgtgttgctgctactgcgacgagctgggggtgacttgggcggatatggacggcgagctcgcctacagatcctcgccggggagaacgcgatgtggcgacgatttggttgacgaggaccaccgccgtgtgcttcgcgcggggctaccgcagaggaaggaacggcgctggcgggaaaagagggtagggggtggaagtggaacgccgtcgggccgagaagagggctggagatgtggtaggagagaggaagagggagagggagagatagagggagaggaagagatcggggaagcccgaggaggaaaggaaaggagacccggccgaccttctatcccggccgaa

SEQ ID NO: 21817 - DNA, 1045 bp, Zea mays
cgaatacaccaaaatattaccgccctttttttttttgttcgagatctgaagttggattcattcataatatacataaaggtacatgacaacttatacacgtctgaaaattaggaaaacacactcaaaacatttatcctagctacacaggtacgtgaccacatataactgcaacagtccaaatattgctcctgaaaggtaccatccctctcgagcatttcctcatcaagtgatcaagtattgacatggacttccagacgtctactatgaaaattttacatcgaatgaaggaatctcctccctgataagtagagcacagagtccagctgacgactgttgagggctactctaatttgcgacgattacttcgtcgaagttccagtctctaacaaggtccctggacacagcacggctgcgttgaagtcgaggagcgccctctgtaccaacttgatcactcaccacgggtggaaagggggtcactttcgatgtcccaacgctagtagaggttccagctggtgttactcttcgagctaagcaggcaacaacagctccacaccggctttcctcctctgagcttgacaccgagtagcttctaagagagtgcgaggggctgctcatgccatggcatacaagacaagcaagactcatggttgttgtctggctgctactgtgacgatctggagggtggcttgcacggatcttcgctgcgagctcctcgccggcaggctacagaccctcgccgaggagaacgcgatgctgtggacgatttggtcgacgtggaccactgccgtgtgcgtcgcgcggggcttgcagtggctacagcggagaaagggatggcgcgggcgggaaaagaagagggtaggagatggtggaacaccgtcaaggtcgggccgagaagagggcgaagggctggagatgtgggagacgagagagagagaagagatcgggaagacagagagtgaaggaaaggagaagaagaatggaagacggcagcgcggccagcgacttgtggtcttttctttttttttttttttcccggccgagcctc

SEQ ID NO: 21818 - DNA, 1291 bp, Zea mays
gctcggtcctcggaggaaaacgtactgcccggctcttatcaatccccaggttagtggagatgcaatgtaaactgcctgataagacagcaggtgtccactcctttcgtgtttgatgatcaaatctggagaagattcccatggcacatcttcattcatgttttcagaaccgttcaggaagtccagctcaaaggctttgtttctgccttcatttgtgccaagtaaccatacagggttaaaacagagaatacggacccaatatgttaaacctgacatagtgtagacctagaaagatcaattgcaatgcaccaaaacatcacttccgttttcaatatcagatcgaggtcagaagttggattcgttcataataataatatacataaaggtacatgtcaacttatacatatttgaaaataggaaaagacacttaaacatttatcctagctacatagatacgcgagcatatataactgcaacaatccagatatcgctcctgaaagatattatccctctcgagcatttcctcgtctaagtcattaagtatatagtaatggacttccagacgtctactatgaaaagaaatatatatcaaatgaaggaatctcctccctgataaatagagcacaaagcccagctgacaactgttgaaggttaccctaatttgcgacaattacttcgtcaaagttccaatctctaacaaggtccctggacacagcacggctgcgttgaagtcgaggagtgccctccgtgccaacttgaccactcacaatgggtggaaagggggtcactttcgatgtcccagcactagtagaagttccagctggtgttactcttcgagctaagcaggccacagcagctccacatcggctttcctcctctgaacttgacaccgagtagcttctaagagagtgtgaggagctgctcatgccatggcatacaagacaagcaagactcatggttgttgtgttgctgctactgcgacgagctgggggtggcttgggcggatatggacggcgagctcgcctacagatcctcgccggggagaacgcgatgtggcgacgatttggttgacgaggaccaccgccgtgtgcttcacgcagggctaccgcagaggaaggaacggcgctggcgggaaaagagggtagggggtggaacgccgtcgggccgagaagagggctggagatgtggtaggagagaggaagagggagagggagagggagagatagagggggaggaagagatcggggaaacccgaggagggaaggaaaggaaaggagaagaggagggaaaagag

SEQ ID NO: 21819 - DNA, 1900 bp, Zea mays
tttttttttttttttttttgagtttaaacagacagcttattagcaattccatgatcgatgattacatatgcatgcatgtgaaagcaaagccctcagcaggtctcaatcaattacgtagactcacgtctcgcccgtaggataggatgatctaatcgtagtcgtacgttttttttttttttttggtaacagaaagcgggaatcttaattgagactctgatcacccagaaaagatgggtcgccgaatacctacagcttgttcagcaaaagtaaacgtatcgttctccagtttcttcacagcaacacctatgaacatagccacaactttcttgcttctaaagcctgtgatgtcgacctcacaggtctacaccagcacaagctcacagtgttgaatcaaggtacgagtagaaccgtcgccgactgaactggaggaggcagcagttgaagaagcgatcatgcacaccgacaaagagagcttcagtgtcaggactgaacgatatgcctgcgatctcaccaaagaagtccagctcctgcttcctgctgtacccactctcaacatcgaagatgtggatgaagtccgcgggttcagtcatcgccatgaacttcccgtctggcgtgtagcgaatcgacctgacggctccgatgttgccacccaatacaacaactgatctggagagattgcggacgtcccagaccctgcacgtcttgtcttggttccccgtggcgaatgttcggccgtctggattccatgccgacgcaaaggagtaatccaaatggccatggagtttgtgaaccgtctttcctgaattagcgtcaatcagaagtccatcaggactgtcccccacaatagcagcaagtttaccatctgggctcaacgatgtatgattcacaggccaagcaaaatggaagtggttgcatattcgaaatttttccatgtcaaagtctctaagtccacaatcattgtttgacgcaaggaagtgcagagaaccactaggcttctcaaatatctccagagaattagtaataccgtcgtcatcatttgttgtcttgcaacagtagcttactccttgacgatccagaaacttgcatattatctccccatgaaacccaccagtaacaagcaagttatgcttcaccgccaaagtactgactggagtccgataaaacccctcgtagtaattccgatggtgcttctcgcacggtgtcacgtgtccttgaagattaatgacttcttgcttcttacaagtcattgctgaccaatgaagcacagaaaagtttgacataagatacacatcgtgccttgttgttgcccacactaaattcctcaactggaaatgacggatggtcggtttcaccgacctcgtgctgtgctgaaactcgtagtagagttggcctttctctgcaggcatgcattccttctcagaaagccttccggaattaggcacgttctcaaagttggcgtacccctgcagccgtgactgcctgtacttgtcccttgtagtcggcatcacgttccaggggatcccttgcatatccttccccttcctcacgtccatagccgtgatgtgctcagtcgctttactcgtaggttggtccagctcatcgtcgtcggagccatccattcgaacggcgtggcggtctccttcttccggatgagctccggtgaggtcgccgtcgcgctgcgacatggcccgtaagaacgcccgccgcccgcaggcaaaaggcgagtttgaaccagaccagatttttgctcgagggtctccgggaaattttgctgcaagttcgttcgttgcgccttgacggtttctcggtgtccagcgaaggagcagccgtggattgtgtggtttgagatctggttccgagtttttttctggaaccggagctaaaactcggcctttccagt

SEQ ID NO: 21820 - DNA, 2486 bp, Zea mays
atcaaacgattgcactgaaagtcaaaatgagtcgccgatacacaaatgaactttgttatttcaaaagaaatgaaattagaacaagatgcaacttctattacgaggagaatcttgcggtaaaggaagcacgcgcttctaaagtgtcaagctgaagaagcgaatcagctgttatttttgtgtgttaataaattttattttttttttttttaaattaaaaatcgaatcgaatccctgattaatttagctcccaggagaacaagccctttctccttccctgattaatttgtgagtaggaaattgaagaaaaccaaaacgaatcagaaactgttcactgtctgtgtgatgtcctggaaaatcctcagcctcttgccgatcttttccttcaccgctgggctcgtgccgcagctcgccggcagcttgacttcagtagctgttggttcgtcgtcgagcactggagccaggacggccgcgacgagggcctcatcgaacgcgctgtggtcgggtagctctggccacctgtcctcagctgacagcgacttcctcctgccgctgttctcgtcgatgctctgctccttgaacaccactgctcctgccttgtccatgcaattgccggaccgtgttctcttcaggttgcccaggggatcatggacaggagctggcttctgctgctgttgccgctgaggcagcgtgttatgtgacttggctgcgagcgacgacacccgcaaagagtagaagggctgcgcgtccacattaagcatgttctcctggagcaccgccagcttcttgctcacaccggcgttttcatcggcgaagtggccgcgcggcgccgtggctggagccggaacaggaggtggcagcaagtgatcggtgcacggctgcggctgccagatgcttgaggacgatcccagcagcagcgcatcgaagagccagttcgtgtcgagctggtcagcgcgcgggcggccgatgagcttggtctcgaggtcccgcagcatctcctgcgctcgctcgtaggccttgaggtgagagtcggcgccgcgcagaccatcaaccgccgcggggcgtacctgcttgagcacatccttggcctcgagcacgcgggcctgcttcataaggcagatgcccagattgcacatcttgttgttgtccggcccgatgagcagcgcccgacggtacgctccctccgcttccgtgtagttctccttctgcatcagcgcccaccccaggttaccctgcacaacagcagtggcaagattgagcacttggagttgaaggtatgaattcgaagctggaggccatgtatgactgagaaatgcgtgcacttacaaggagcctggtggcttcttgctccagggtgacctggaacttgcggccctgagagcgagccgttttggtccgcttgccgttgaaggcgtggccctggttgatcagctgcagcttgtgcttgagcagcgagatttggtcgtccagccgcccgcatctctgcgcatttaaatttaataccgtctcagagccagaggcatgaatcgagcgcacgtgcagagaaattaaggtagacgaagtacgagcacgaaccttgtagagatcgaggaggatgttgtcgagggactcctgcgcctggtcggagcatcggctgcgcagcgacttgatggcctcgatggcctcctcggcgcggttctgctgcttcatcacgatggccatgtccttgagcgcgctgtcaacgcggtctccggcgttgatcgcactccagaacagcgcgatcgccttctccggatccttgtccaccagctgcagcggcgcaaaggaactccaaatcagattgagtcgaacccatccgcggggagaaacgcacgcacgcactacactacacccacctggacgcgcttggctcgcacgtagggcgtgtcgccgaccggcaccttgtgcgcgacgtggaagtgagtccgcagcatggtcgccggcggcggcttgatgggcgagcagggcgccgacttggtcgggcggaggagccccatggcggcggcggcgttccagggctcctgctgcatcatcttcctcctgacttccctgccctgtatgaaacgagacgattgcggtgccgctgcgcaacagggagacgacgggaaagcggagcggtggcagtggcagtacgctggctggtagcagggttttggtcttggatatatgaatctgtttggggctccgaccgttggagagagctagccgtttgggcaaagtagccgttgggagttcctgggcctctcctgcccggcccggccggcacataatgggctggctaagcttttatcgactcttggcgctaggccgcattccttgccgagcgccgccgcggctggagctgggttcagtcggcgcggccccgttctgcggcgaactttttcttaatggtaggggcggtgaacgttgtggacttgcatctgtctcctctctcctgtgagcgagcgcatccgtggcggtggccggcgtgg

SEQ ID NO: 21821 - DNA, 1880 bp, Zea mays
gggtaccggcgccttctctcgagtttttttttttttttttttttttttccacaaatgaactttgttatttcaaaagaaatgaaattagaacaagatgcagtccacttctattacgaggagaatcttgcggtaaaggaagcgcgcgcttctaaagtgtcaagctgaagaagcgaatcagctgttatttttgtgtgttaataaattaaattaaaatcagcatcaaattaaaaatcgaatcgaatccctgattaatttagctcccaggagaacaagccctttctccttccctgattaatttgtgagtaggaaattgaagaaaaccaaaacgaatcagaaactgttcactgtctgtgtgatgtcctggaaaatcctcagcctcttgccgatcttttccttcaccgctggactcgtgccgcagctcgccggcagcttgacttcagtagctgttggttcgtcgtcgagcactggagccaggacggccgcgacgagggcctcatcgaacgcgctgtggtcgggtagctctggccacctgtcctcagctgacagcgacttcctcctgccgctgttctcgtcgatgctctgctccttgaacaccactgctcctgccttgtccatgcaattgccggaccgtgttctcttcaggttgcccaggggatcatggacaggagctggcttctgctgctgttgccgctgaggcagcgtgttatgtgacttggctgcgagcgacgacacccgcaaagagtagaagggctgcgcgtccacattaagcatgttctcctggagcaccgccagcttcttgctcacaccggcgttttcatcggcgaagtggccgcgcggcgccgtggctggagccggaacaggaggtggcagcaagtgatcggtgcacggctgcggctgccagatgcttgaggacgatcccagcagcagcgcatcgaagagccagttcgtgtcgagctggtcagcgcgcgggcggccgatgagcttggtctcgaggtcccgcagcatctcctgcgctcgctcgtaggccttgaggtgagagtcggcgccgcgcagaccatcaaccgccgcggggcgtacctgcttgagcacatccttggcctcgagcacgcgggcctgcttcataaggcagatgcccagattgcacatcttgttgttgtccggcccgatgagcagcgcccgacggtacgctccctccgcttccgtgtagttctccttctgcatcagcgcccaccccaggttaccaaggagcctggtggcttcttgctccagggtgacctggaacttgcggccctgagagcgagccgttttggtccgcttgccgttgaaggcgtggccctggttgatcagctgcagcttgtgcttgagcagcgagatttggtcgtccagccgcccgcatctcttgtagagatcgaggaggatgttgtcgagggactcctgcgcctggtcggagcatcggctgcgcagcgacttgatggcctcgatggcctcctcggcgcggttctgctgcttcatcacgatggccatgtccttgagcgcgctgtcaacgcggtctccggcgttgatcgcactccagaacagcgcgatcgccttctccggatccttgtccaccagctggacgcgcttggctcgcacgtagggcgtgtcgccgaccggcaccttgtgcgcgacgtggaagtgagtccgcagcatggtcgccggcggcggcttgatgggcgagcagggagccgacttggtcgggcggaggagccccatggcggcggcggcgttccagggctcctgctgcatcatcttcctcctgacttccctgccctgtatgaaacgagacgattgcggtggcagtacgctggctgattaggatgttctaggtaatggtctcgtgc

SEQ ID NO: 21822 - DNA, 1969 bp, Zea mays
gttattcaaaagaaacgaaattagaacgagatgcagcagcccacttctatagttctattacaaggagagcctcgtggaaaaagaatcagctgttattttggtgttaataaattgaatcaaaatcagcattaaatttaaactgaatagaatccctgtttaatttagttgccagacaggagctctcaggagaacaagctctttctccttctctgtgtatcgccacctcgagcctgcctgttgtgagtaggaacgtgaagaaaaccgaaaccgaatcagaaattgttcactgtctttgtgatgtcctggaagatcctcagcctcttgctgatcttctccttcgctgctgggctcgtgtcgcagctcgccggcagcttgccgtggccgttagttccagcagctgttggtttgtcgtcgaacaccgggcccaggatatccgcgacgagggcctcgtcgaacgcgctgtggtcgggcagctctggccatctgtcctcagctgagagcgacttcctcctgccgctgttctcgtcgatgctttgcgccttgtccaccactgctcctgccttgtccatgcaattgctggaccgtgtcctcttcaggttgcccaagggatcatggacaggagctggcttcttcttctgctgctgctgctgaggcagcgtgctatgtggcttctgctgaggcagcgtgttatgaggcttcgctgcaagcggcggcacccgcagagagtagaagggctgcgcgtccacattaagcatgttcgcctggagcgccgccagcttcttgctgagtccggcgttttcatcggcgaagtggtcgcgcggcgccggggccagggctgggattgatgccggagccggaggtggcagcaaatggtcgatgcacggctgcggctgccagatgctcgaggacgatcccagcagcagcgcatcgtagagccagttcgtgtcgagctggtcagcgcgcgggcggccgacgagcttggtctcgaggtcccgcagcatctcttgcgctcgctcgtaggccttgaggtgagagtcggcaccgcgcagaccatcgacccccgcggggcgtacctgcttgagcacatccttggcctcgagcacgcggccctgcttcatgaggcagatgcccagattgcacatcttgttgttgtccggcccgatgagcagcgcacgacggtacgccccctccgcctctgtgtagttctccttctgcatcagcgcccatcccagattgccaaggagcctggtggcttcttgttcgagagtgacctggaacttgcggccctgagagcgagccgttttggtccgcttgccattgaaggcgtggccctggtggatccgcagcaacttgtgcttgagcagcgagatttggtcgtccagccgcccgcatctcttgtagagatcgaggaggatgttgtcgagggactcctgcgcctggtcggagcatcggcttcgcagcgacttgatggcctcgatggcctcctcggcgcggttctgctgcttcatcacgatggccatgtccttgagcgcgctgtcaacgcggtcgccggcgttgatcgcactccagaacagagcgatcgccttctctggatccttgtccaccagctggacgcgcttggctctcacgtagggcgtgtcgccgacgggcaccttgtgcgcgacgtggaaggagtcggagtgggtccgcagcatggccgccgccgccgctggcttgatgggcgagcagggcgccgacttggtcggccggaggagccccgcggcggcggcgttccactgctcctgctgcatctgctgcatcatcttcgcctcaacctcctcctccttactatgaaacgaggcgattgctgtgcagcagagcaacagggagttgacgggaaagcggagccgtggcagtacgctggtagcaggaggcattggattccgcagcagatatagaatcttttcccggccggctcgaggtcccaatg

SEQ ID NO: 21823 - DNA, 3402 bp, Zea mays
  misc_feature (3176)..(3176): n is a, c, g, or t
ttaaatatcatatataaatgaactttttgttattcaaaagaaacgaaattagaacgagatgcagcagcccacttctatagttctattacaaggagagcctcgtggaaaaagaatcagctgttattttggtgttaataaattgaatcaaaatcagcattaaatttaaactgaatagaatccctgtttaatttagttgccagacaggagctctcaggagaacaagctctttctccttctctgtgtatcgccacctcgagcctgcctgttgtgagtaggaacgtgaagaaaaccgaaaccgaatcagaaattgttcactgtctttgtgatgtcctggaagatcctcagcctcttgctgatcttctccttcgctgctgggctcgtgtcgcagctcgccggcagcttgccgtggccgttagttccagcagctgttggtttgtcgtcgaacaccgggcccaggatatccgcgacgagggcctcgtcgaacgcgctgtggtcgggcagctctggccatctgtcctcagctgagagcgacttcctcctgccgctgttctcgtcgatgctttgcgccttgtccaccactgctcctgccttgtccatgcaattgctggaccgtgtcctcttcaggttgcccaagggatcatggacaggagctggcttcttcttctgctgctgctgctgaggcagcgtgctatgtggcttctgctgaggcagcgtgttatgaggcttcgctgcaagcggcggcacccgcagagagtagaagggctgcgcgtccacattaagcatgttcgcctggagcgccgccagcttcttgctgagtccggcgttttcatcggcgaagtggtcgcgcggcgccggggccagggctgggattgatgccggagccggaggtggcagcaagtggtcgatgcacggctgcggctgccagatgctcgaggacgatcccagcagcagcgcatcgtagagccagttcgtgtcgagctggtcagcgcgcgggcggccgacgagcttggtctcgaggtcccgcagcatctcttgcgctcgctcgtaggccttgaggtgagagtcggcaccgcgcagaccatcgacccccgcggggcgtacctgcttgagcacatccttggcctcgagcacgcggccctgcttcatgaggcagatgcccagattgcacatcttgttgttgtccggcccgatgagcagcgcacgacggtacgccccctccgcctctgtgtagttctccttctgcatcagcgcccatcccagattgccctgcacaacaagattgatcaccagcgaacaaagattgagcacttgagttgttgaatgtatgaatttaaaagctggaggcctggagtggccaagtatttgagttggatttaagctttgttcagcaagaaattatgagaaatgcgtgcacttacaaggagcctggtggcttcttgttcgagggtgacctggaacttgcggccctgagagcgagccgttttggtccgcttgccattgaaggcgtggccctggtggatccgctgcaacttgtgcttgagcagcgagatttggtcgtccagccgcccgcatctctgcgcatcaagacagcagcaagagcgcatttaaatttaataccgtctcagaggcatgaatgttaacacacatacgtgcacaaaaggtagacgaaggacgagcacgaaccttgtagagatcgaggaggatgttgtcgagggactcctgcgcctggtcggagcatcggcttcgcagcgacttgatggcctcgatggcctcctcggcgcggttctgctgcttcatcacgatggccatgtccttgagcgcgctgtcaacgcggtcgccggcgttgatcgcactccagaacagagcgatcgccttctctggatccttgtccaccagctgcaccgccgcagaggaaatccaaaccagatcgaatcgaacccatccccgggaagaaataaggaaacgcatgaacgcatacacttacctggacgcgcttggctctcacgtagggcgtgtcgccgacgggcaccttgtgcgcgacgtggaaggagtcggagtgggtccgcagcatggccgccgccgccgctggcttgatgggcgagcagggcgccgacttggtcggccggaggagccccgcggcggcggcgttccactgctcctgctgcatctgctgcatcatcttcgcctcaacctcctcctccttactatgaaacgaggcgattgctgtgcagcagagcaacagggagttgacgggaaagcggccccgtggcagtacgctggtagcaggaggcattggattccgcagcagatatatgaatctgtttgagggtccgaccgttggagagctagccgtttgggagagctagccgttgggagttcctgggcctcttcttccattctattctgacctcacctgttccagcccactacctctttgtgaaccggcccgacacataatgggccatgctttatcgactcgtgtcatcgtgtgcctgtctttgttgttgaatgagttccgtggagtttgttgtcgcattgctttcgtctcggcgcttgcgggcgccgccgcggctggagctgggttcggtcggcgcggacgcgcggtgcccgttttgcgggttacggcgaacttttcttaatgccgatggaggttgcggacgtgtgccaccaggtactgttacatctggcctggtggtgcgcgcgtctgtggtggtggccggcttgatgtttgacgaaatgccgaagcgcttttgaacaaaaggctgcagcgacacgcgatgtaagtggtcgaagtgcaaatctcggcgatgcttacatctctcattactttagaggcaatagacaagtttttatgctgcatttctatatgttgttaacttgtcgtgttggatgaactgcagttctctttcgaagtccacgctagttacaccattttactctcctaattgatcctatatgctagtgttctaatttttgcccagtatacaatggttcccacataatgctctgctgtagcaatttatagatgggattgtcacagttatgtgcacacgtttatgatacagtggtagtttgggaggtatatgtgtgaaccaaatttctgagcaagtttcttgtattgtggttgtctagcagttgtatgtcaatgtgactcatctaatgtactccctccatantcaaaattaaggtcgtttaggacaccatttgtgataccaagagtgattaattgcatgtaattttcccgtgcatgcctctattaaaaaggcgttgggtccagttcagtcacaactcacaactgcatgcctatccacttggttgtctttgctgtgctgaaggctccagtagtgggttcaaagccccacaaaaccattttttttgcctcgggtttggtttaagcgtgcc

SEQ ID NO: 21824 - DNA, 2738 bp, Zea mays
cctactaaaggaactgctgtgctcgaacagtgtactcacaaagcgacaattcgtagccacatagtactctcccagcagcagcaccttcttcccaggaaaaaagagaataacttcaaaaaaaaaaaaaaagaggcaagaggaggatatgttgttcctcgaggaggttctagaaggcagagatgaaactactcgtttgtccatctgatcacggcggaagcgaaagtagcattgcagtctaactttccttagatgcctgaaacaaggagaggacgttctgcagaaccataaaagaattgacagtttattaatatgtgtaagagaaaattatagacaagtaaagtttcaaaagaacaaagatggacaaagatttacatggacattgttcattggacctagcaaagaaccacagtgagagtcacaggttcagcaagtatggcattgttacgttgatccaatgaatctagcatgacctgtaaaattgttgtgaccagaatgcaacagattcccacaaaaaattctttcaccaccaacggaagggctacctaaggaaccttttgtgtgtgtttcaactttcaagatgactgggccctttttttttttttttttataataaaaggaccatataggccaatatttctatcttctaacagaagcaaaatgcttacagtgcctaagaaaataacctaatgttgcaagcactcaattgatgacacaataacaatctaatgtagtatgccgctttattacgaaaatgataagcatacagattactgaacaacctaatacactcacattccgtgctatgtacactccatctgtagacatttctctcaacacaacacctaaatagaagaggatgaattctttcagagaggccgcagcaagtgcatatttccatacctggttcatttcagtgtacaaactccaaccatcaaatcgatgttgcttcagactagtcacgtaggataaccgagtccacaatctccatcagcggctcaaggcactcaggagaaaacttgcgggcgaacatgtaagggtgtgtcgtgttcgacttcctcagctccctgatcaagcttgcggatacctctccaggctcatacatgtgtgggtggcctgcaactgaatccgtccaatttacccttgtaagggtatacttagtacaaccctcaggatcctgcatatccagcagtgtggggaagtaatgctcctccgggtagcatgaatccctgcgctcgatcagacagggcaacttgaacttcttccaaagtcgcatatccctcacgaccatgatggcgtgccttctcgtgagcacaaagaactgcgacccagcccggaactggtcatatggaacctctgggagcatgacatcgtcacctcgggcatagtacctgtcatgcagcagcttggtgtcgttgtccatgttgtccattatctctatgaagctgcggtggtggctatgagggccagcattgtcggagaggagtgcgttgtagagggtggggaacgggtggagcgggatgcaggactgcgacaggagcgcgaagaactggttgttggggtcgtcaaggagcgcggtggcgaggaggcggcgcgcggcggagatgagtgtaggggaggcgcgctgcgtggccttggcggggacgaagcggccgcggaaggatggcgtgggcggcagctcgaggacggagtaggggtcggcgtggacgtagaggttgaagaggtgggtgtggccgcggaagaacttctcccagagcggggagaagacgaggtccgagttggtgaggaagaggaaagcgaccttgggcgccgggcggcggcggaagaagtaggaggccgcggaggtgggcgtgggagtggccgacgaggaggagaggatggctcggcggaagagcgcgaggtcgtcggactcgtcggcgtccgggatggccgggagcgtcttgggcgggagcaggcgcggggcaaggaggaagacgaccgggatggagatgagcaggagcagggagagcaggaacggcgacgcgtacggcgacgtcatctccggccagcggctgccgcgcctgctgcggcctcttggatcacccggattcgcagaatgcacgccggccgcggccaatgcagcggcggatcttgggtgcgtggtttgttggtggtgatggtgggagggggcagggatcaggggaaacgcaggggggattgagagcgattgattgatggggaccagtctgcctcaaattagggacaagcaaaaggcccggcggactggatctgctgattcggggagcagcaagggcgattggtgcacgacgaaagaaacaatcgggggatttcccgcagctcagataaccgaaggaaccgcgcaagcgattgctccgtgatggtgggggcaatggcgcggcgccgctaggctgagaaccgacgacaccccatgcggggcaggatctggcccgagatcctgcgaacggcaggccaggagagcccggtccaagagcggggacgcgacagccaggaaccacgcagccggagcaggaaaccaggcgcggaaccgggaatggcggatccgggacagggcgcgaccgacctcgctcgggggaggcaggcgggaggaacccgtggaccctggaggcgggcggggtggggattgggagactctgtggagatctctggcgcccgcggcggcggccggagggacggaggtgggggaggagagagagagtgtgaggcggcgcaccccgcccgcc

SEQ ID NO: 21825 - DNA, 810 bp, Zea mays
tctaggccgcctctcgtgtttttttttttttttttttaaaacagagttggagatggtatatatgcagcagaacctacaaatcatcacagcatgtattcacaagagtgcctccatgtatacataggatgatcacattaactattgccctactaaaaaaactgctgtgctcgaacagtgtactcacaaagcgacaattcgtagccacatagtattctcccagcagcagcaccttcttcccaggaaaaaagagaataacttcaaaaaagaaaagaggcaagaggaggatatgttgttcctcgaggaggttctagagggcagagatgaaactactcgtttgtccatctgatcgcggcggaagcgaaagtagcattgcagtctaactttccttagatgcctgaaacaaggagacgacgttctggttcatttcagtgtacaaactccaaccatcaaatcgatgttgcttcagactagtcacgtaggataaccgagtccacaatctccatcagcggctcaaggcactcaggagaaaacttgcgggcgaacatgtaagggtgtgtcgtgttcgacttcctcagctccctgatcaagcttgcggatacctctccaggctcatacatgtgtgggtggcctgcaactgaatccgtccaatttacccttgtaagggtatacttagtacaaccctcaggatcctgcatatccaccggtgcggcggcctcgcgctcccccgggtagcatgaatccctgcgctcgatcagacagggcaacttgaacttcttccaaagtcgcatatccctcacgaccatgatggcg

SEQ ID NO: 21826 - DNA, 1086 bp, Zea mays
tcttgatcaccacccacatcatgttgtcccgattgccggtgacggagagccttcttcgccggccgctccgataaccgtgcggcttcagcttctctgtgctggcttcatctgaggaaacggccgacggaaagctggtggcgttggtgcttttgcagcgtctccccccccacatccccaagatccaccccgttgtctacgctttccaagaattctcatttctgtggaggcagcagtacacacggcacagcccacagtaggtcctaggcaaggcctactcgaggggtaagggtgattatcatattgattatgtgccagacacaagaattaccgaggccgtcgaaacaaatgactggaagtctctacaacgagctcttgataataaactctatatcctgctgtatggcaatgcttatggggctcctgatggaaagcctgtatggcattttccggaaaaagtatacgaaaatgaagaaactatgcgactgtgtgcagaggctgcattaaaatctgttcttgggggacttgaccatacatactttgttggcaatgctccaatggctcatatggcagttgaacaaacagattcaagtgtttcatcattcaagcgtttctttttcaagtcacaagtggttggcacaacgaaataccatgttggaaaatgcaaggacttcgcgtgggtgaccaaggatgagctgctggagtattttcctgagaacaaggatttcttcaacaagatgatcatccacattagataagatagctctgtaaccaggccatgggctatctgaacaattagcattttgtttcttgactggcgtacaagtgcagtgcactgttttgtcgtcacgagcagcattgccaaggaaccaccagggcggcgggcaattgacacatgcccattttgcctctcttttcttgggctggttatgttgtgtttggcagtgacatttctgtagcatgttgtcctctcttacctgctgtatgttcacatgacgtattatcagtttgttgtccaccatggggaagaataataattagcagggcgacatttgattccttgctttgttgccaaaaaaaaaaaaaaaa

SEQ ID NO: 21827 - DNA, 956 bp, Zea mays
ctggccgggcccacgagtgctacagtttgggcagagggttcttccttcgccatcttcagttccctccccacaccgttgcggcgcggcaccacctgaacccgaccaccgcccacaccatgttgtcccgattgccggcgacggtgagccttcttcgccggtcgctccgagaaccgcgcggcttcagctcctctgtgctggcttcatctaaggaaacggccgacggaaagctggtggcgtcggtgcttttcgagcgcctccccgtcgtcatccccaagatccaccccgttgtctacgctttccaagaattctcatttcggtggaggcagcagtacagacggcaataccccgaggaggtcctcggcaaggccgacgcgaggggtaagggtgattatcatattgattatgtgcctgctccaagaattaccgaggccgacaaaacaaatgaccggaagtctttacaacgagctcttgataataaactttatctcctgctgtatggcaatgcttatggggctcctgatggaaagcctgtatggcattttccggaaaaagtatacgaaaatgaagaaactatgcgactgtgtgcagaggctgcattaaaatctgttcttgggggacttgaccatacatactttgttggcaatgctccaatggctcatatggcagttgaacaaacagattcaagtgtttcatcattcaagcgtttctttttcaagtcacaagtggttggcacaacgaaataccatgttggaaaatgcaaggacttcgcgtgggtgaccaaggatgagctgctggagtattttcctgagaacaaggatttcttcaacaagatgatcatccacattagataagatagctctgtaaccaggccatgggctatctgaacaattagcattttgtttcttgactggcgtacctcggccgcgccctcgcttgtcgtcacgagcagcattgcc

SEQ ID NO: 21828 - DNA, 4241 bp, Zea mays
tttttttttttttttttttttttttttttttttttttttttttttttttttttttttttttttttttttttttttttttttttttttttttttttttttttttttttttttttttttttttttttttttttttttttttttttttatttgtcgctccctaaaaaaaacagagggagtattatccgcacaataggccactgggataactagtttattacttcacgtcaatgatggtgctcatgaaccataaaatatgaatgaaggaattttacagagagaattctcgcctacgaacagagcagcctgaatcagtttcatttcaggctgcttctaacaaataatcagttaaacatgatggtaccatgactaaaatcgacactatgttattgcctaatgcttgcctgagtcctatatcacaatcactatttgtagcattaacaatgagatcctagccctgcactcaagctgtaggaaaattgcaatgctaaatcgctcagcaagcctacacaactgttgaaatctctggagttctgcaaccgagcattgaacagttagtgtattcctgcaaaatcaatagacacggcctcggcaattggtagttccacaatggcatgggcagccatcgcctgctacaagcttttgtcggtaatcataggcgagttcttctcctacggcaatatcttgattagcaaacaatccaatgtgagcaagctggcaatctttgctctctaccaaaaccaaccgggtactgagattcggggaacaactgtgactaatataacgggaaacatttccagaccttgtggcatcaataaagtattcaatagcccctacagtccgaactctttccctatcaatctgggaagcaatgctaaacaagtaactgcacccaccctttgatgacacactttctgcatttttcatagccttgtcagccttcacaacttcaccaatatactcgcagacaaaggtaccctgtagaataggttcagcagccctaatagcccaacccttattctcacttctaaagagttccaacttaacaagcagccctttctgcaatactttattctggcaggacgagtcacaaatacatgatgaattgcactcatatattggatacccttcctgtaaaataattttactatcttcatcatatgcaaatctgccatgcattggtgttccattgatatccaccaggctattgtagacaccatcaaagagactcacgtgaccacagttctcaggagaacattcaggatgagaacatgcacacccaggcatagagttctctgaatcaataagagatgaatccatcacacggtttgtgatatagtgaaatccttcccaaggcaaagaactgccatgtggcaaaagttcttcaggcttcatacctaaagaatcttttgcatccacatcaatgacacagacaattggaactttctccctgccaaagcttatgtcttcacagagaacaacactctcatttttaggcttccatccgaagtgctttgaatcaagaacataatggtattcttccattccccacatttcatcatcattacgggaatcaacaggagcttcaagaaaatcaactgccgtgagttgcataggaagcagagcatttgaattatatctagacttgcaccctttagggcatatgaatccctcttgatgccaatcaatttggatgccattgtcactgcaaagctttgcagctttcacaaatatgttctcaggtaaaggtccgtatttaacttccaacgcagcaagaagacttgtcttacagcatacagagcgggcaaccgataaaacatcaaagttgcttggatggggtcttgtcttttgaatcttggaaaataaagtttgtgcaacatctgagcattggaaatcctgtaacttaccaaggctggatgtttcagattcaactatttgagatgttaagccagagatctgaaacttcaaatttttatcgattccagagctactgctcttctttaatgtacttgttggtcgcaaacttttcttgaaagcggaatagtagtgtcggccgcggttaagctggtacttcccacggcccagtggaatgtggccaacagcacctgagaccatatgagcgactttatggtggcggccaagatctggcagaagatcaaatttgagcccacataatctgcagacaaacttctgtgagccattttcatcctcaacgttgtggctatcataaaggggcagaccactcatcccttctgtttgttgagcagattgaccacttggtcgctgagggacatcaagaagcctgaactgttgggcatggtcggaaacaatgtgagggtatagcagatcagtgttcaaaaaattgctgttacatgacatacatcgaatgagaattgaatactggaggtattgagccccatgtacatcctgtacatgtctttcaaggacttttttgttggtaaatgattccatgcatgcagcacaagagtaacctctaaacagccaccgggcttcctttttgtggacagttgtccaatgtaatccaagagcttgatcatcagagaactggtgaccacagattttgcacttaggaccagatgaaagattagttttctcttcctgcaacgctacagatccttctttgttttcagaatatatttgcttagatctatctgtaccaaatccccagatatttgctagtttctctctctcagtagatatcaactttaacaaaaattctccaaaatctggatttttcgacacttcagccagtatctggggcatatgttcactagcaagaccggtgcgttgatgagaaaggttgtttctcaagaaccaataaagaaattcgcaagcctggtgtaaacatatcttatcttttcttgatgagcagcccttcaacagattgacaaagacatctttagaaacgagtcgactctttccattcctggcacgtttaaggaactttggaaggtgcttctcacaataaagagtatgtcgtttggcataatcctggcattcaacaatactgtcatgagagcgaattccaatacaaagagaagtatcatcagtatttgtcatggacgttgacgcagcacacatatcagttttctccattgcacaacctttttcaccagagttctctatagccacagtgggcatcagtttcacttgtacaacagcctggacatttttgtctgtttctaagtctatgctatacaatgcttgcgacttagaaattccttccacccacttattcggaggttcttcgcccatatggagtacctcagatggatccaacaaatttcctgggtgcattacatccaagtttgtctgtaggcggtgctttttacaaaaagtagaaccatgctgagctcgatgcttgcattttctacccatgttagtcataccactacacaatggagcttcaatggtaagtgtcttatcctcccttgaagaatgatcaagaaaatgcatactttgatgcacacaacagtaaatatcaccatcatttgcccacctaccacactgcctcccctttgcttcaatgtacgcagaacactgccgagagctcttgaatgaatctaaatcaagtctagcattctgtaaagctgcattggaactaccagatattgtattctcattggtgccagaacttccagggaacatgacagcatttttttgacttgttgctcctaatgcccctatattttcatgcatgacagagttactaggaagcttattttggtttgggtcctcagttggagtcctgtagtcagcttcacccatgtgtaaaatttggatctctcctcttcgaacctcaagttttggacgctttctactaccttgttgatctaaagctggatcgtcgtaacaattagttttctcgaagttgccaacattaccagcaggatgtaatgaaaagtactgtttcagcaattcttgtttccacgtcttccactcagggactaattcaggctgcactgatgcatcccgcaattccttaagcttgttcccaagaatggactgtcgaagttcctcacaaagcatttcaatagtctcggcatcatgtgcgttcatacacttttgattccacgtctcaatagaattttgtacccattcacagcttatgcagtcaggaagaatcatattttgaaatttgaggagcatcttcccaagatcagtgtaatctctacagcaagatgcttccagggcaaattctttccatgttgtagccttccgtg

SEQ ID NO: 21829 - DNA, 3184 bp, Zea mays
  misc_feature (2960)..(2960): n is a, c, g, or t
gggtacggcccaacggcgcgctttcggcccgcgattccttcctaacaacggagggagggagaagtgggaaaaatcgcctcgcttgttggcctccgtcagcccgcgcttccttcctccgtcctccggctcggcggtccgccgcccgcacgagaccattacctagaacatcctaatcgaaaacgcctcgcggccctacactctcgttgggtcggcacccgtgcctcccattctctcctcttctctcgctcgagcgccgcggcctctgctcgctcggtcgaggctgaaggacgggacaaagcgcagattgaccaccgggcgtcggaaccgccgccgctgccgccgaaggggttataagatcagatggggacttcggtgcaggtgacgcctctcagcggggcgtacggggagggccccctgtgctacctactcgccgtcgatggtttccgcttcctcctcgactgcggatggaccgacctctgcgatacctcgcaacttcaacccctcgcaaaggttgcaccaactgtagatgctgttcttttgtcacatcctgacatgatgcatctaggagctttgccttacgctatgaaacaccttgggctgtctgcaccagtttatgcaacagaacccgtgtttaggcttggccttttgaccatgtatgaccatttcctgtctcgatggcaagtttcagactttgacttgtttactctagatgatgttgatgctgcattccaaaatgttgtgagactgaagtactcacaaaattaccttctgaatgataaaggtgaaggagttgttattgctccacatgtggctgggcatcttttgggggggacagtgtggaagattacaaaagatggggaggatgttgtgtatgctgttgacttcaaccatcggaaagagaggcatttgaatggcaccgttcttggatctttcgtgcggccagctgttctgataactgatgcttacaatgctttgaacaaccaaggctatagaaaaaagcaggatcaagatttcattgactcattaattaaagttctggcaactggtggaagtgtgctacttcctgttgacacggctggtagagtgttggaacttcttttgttattggatatgtactgggatgaaaggcgattgcagtaccctatctacttcctgacaaatgtgtcgacaagtaccgttgattatgtcaagagttttcttgaatggatgggtgatcaaattgcaaaatcttttgaaagcagtagagccaatgccttcttgttaaaaaaggtcacgctgataattaacaaagaagagcttgagaaattgggagatgctccaaaggtggttctggcatccatggcaagtttggaggttggcttttctcatgacatatttgtggagatggcaaatgaagcaagaaatctagtgctctttactgagaagggacagtttgggacactggctcgaatgctccaagtggacccaccccctaaagctttaaaggtcactatgagcaagaggattcctttggtgggtaatgaactaaaggcttatgaagaagagcaagaacggataaaaaaagaaaaatcgctaaaggctagccttgtcaaagaagaggagctaaaggcttctcatggatcaaacacaaaggcttctgagccaatggtcattgatgcaagctcatctcgaaaatctgtgaatgcttcacattttggtgggaacaatgatattctcatagatggatttgtccctcctttaaccagtgttgctccaatgtttcccttctttgaaaacactgctgaatgggacgactttggtgaggtcatcaaccctgatgattatatgatgaaacaagaagaaatggataatactctgatgcttggccctggagatggattagatggtaggatcgatgatggctcagcacgcctgcttcttgattcaacgccctcaaaagtcatttccaacgagatgactgttcaagtgaaatgctcattggtttatatggactttgaaggtcgctctgatgggcgttctgtaaaatcaattattgctcacgtggctccactgaaacttatcctggtgcatggatcagctgaagcaactgaacatttgaaaatgcactgcgcaaagaatttagacttgcatgtttatgctccacagattgaggaaactattgatgtaacatcagacttatgtgcttataaggtacaactttcggagaagttaatgagtaacatcatttctaagaagttgggtgagcatgaaattgcttgggtggatgcagaagttggaaaagaagacgagaagcttattttgcttcccccatcgtcaacaccaccaccccataagcctgttcttgtgggtgatctaaagttgtctgattttaaacaatttttggaaaacaaaggctggcaggttgaatttgccggaggtgctttacggtgtggcgaatacatcatggtgcgcaaagttggtgattctatcctaaagggcagcacagggtctcagcagatcgtcatcgagggccccctctgcgaggactattacaagatcagggagcttctgtactcgcagttctacttgctgtgaggcaacgtacggcaaagcttaggctttatttacattggttataaattattagattagatgttgactgtaagactatcctggtgttttctgtttttacattgtttgtttcccctttcacaagcttaggcttgtgttgtccgaaatttggcgtgggatgaccgtgacaaagttttggcatcagtttccggatgaccgtggttagtatgctgaagcttgtttcgtccttcatcattatgggcatgtgttctatattgatcgtattgactctttttgaattggttgagcatattttaaatcttcttccccttgataccttctttcatcaacatcaaagctgactaccaagtggtccaagaacgatgacaatgcatccatccaaagaagancaaaaacaacgacgacaaagcgtccacctattttccacctaggggtgcaatcaatcagatcggagatgggtaatgcttgtatcatattttctctttagatttagattagatatattttctttttagatttagatcagatacgaatattattggtctatgaccgtaagatttgaatggaatcaatattcttaaatacctatctctaaaaaaaaaaaaaaaaaaag

SEQ ID NO: 21830 - DNA, 3211 bp, Zea mays
aagaggagatgcccggtcccacagcggagcttgctccctcctcccttcctctcgagagggactccctcggcgtcaccatcgaccccgcggaagcgggggcgtgcgcgtatccactcctcaaccaagtggagcatcccctcacgctagaccggagctggggggcgacgacgagccagccgccgccggtttgaccagacctgtggtgatggactgataaggtatgcctgtaggagggagagagctttcggtttagaaaataagagggtgccgcgggctggactgagagagcggaaggaaggaaggagccggcgatgggcgggtggaactggctcttctgcggccgatccaaagccggaggcggcgagctccggcctcccgagcccttccagctgccggcgcccttgcccgagtggccgcaaggaggggattttgctaagggcacaatatgcataggagaggttgatgttacaagtattaccaaattccggagtatatggacctgctcagatgctacattttatgagccagaaggaattcctgatggtttccactgccttgggcactacgcccaacagaatgaccgccccttacagggatttcttctggtggcaagggaagtggctagccaccaagttattgataccaagcccgcccttgagaaaccatcagattactcccttgtttggaccagtgctgacgcaaatgaagatgacaatagcgaatgtggttgcatctggctgccatgtccacccaatgggtataaagcccttggctatgtggttactaaaggaccaaagaagccctcactggaagcagttcggtgtgtgcgagatgacctaacggacacgcgcgaaaatttccattcaattgcaaatatggacaacgcatgccagatttggaagacaaggccttgccaccgaggagtgggagggcgtggtataccggtcggtacattctcctgcgaaaccgattcaacagatagcgatgaatcaagcactccctgcctgaaaaatgtcgactcaaatctgggtgccatgcctaatctggagcagatcaatgctctgatcaagcactacggcccaaccgttttcttccacccgcaagagacgtacttaccgtcatcagtttcttggttctttgagaacggagctacattgcacgagaaagacgcaaaaatgggagatgcaatactccctggtggcttgaatctgcctgttggtgggacaaacgatggcgagtactggattgatctccctgatgatgacaggaaggagctcgtcagagctggcaatctgaagagcgctgagctatacgctcatgtgaagccagctcatggagggaccttcactgacattgcaatgtgggtgttctgcccgttcaacgggcctgccaccatcaaggttgggtttgcgagtttcgctctgcagaaggtcggtaggcacattggagactgggagcacttcaccctccgagtgagcaacttctcaggtcagctgtcgtctatctacttctcgcagcacagcgggggcgagtgggttgaagcttgcgatctggagttcatctctgggaacaaggcgatcatctactcgtccaggaacgggcacgcgagctacccccacccaggctgctacctgatgggttccgagacgctcggtgtcggagttagaaacgatgtggcgcgaagtgatctgtcagtggattcgagcacgcggtatgagatcatctcggcagggcatctcggggaggacgctgttgcggaaccgtgctggctgcagtacatgagggagtggggaccgaccatcacgtacagctcacgttcagagatagacacggcgctgagcttcctgccgttctttctccggttcacagcagaggcaatattcaacagccttccggcggaactgtacgaggaggaaggtcctacggggcccaaggagaagaacaactgggaaggcgacgagagatgctaggctttgtcgccatcattgtttacccctgtcaccttaatctgtaccctagagctgtattgtacttgatgaaaaagattgatactgtatgtgataagaatatacagtttcgtacatatggtgggctggtggctgagccctgagggttcagtgcacttgtcaggttaggcatctcgctgcttatttagcccgatgcggtggtgcaagtgcatgactacttgccctgtgcatctgccaaccagattgcgcttgtattgtgcctgtcatacttccttttctagtggagtattttggtaagagacagatatatagttcaaaatcaaaaatctcgtgagttccgcgcccgcaaagccttccttcgaatccacgaaacaacactggtatgagactgtgttaaaaaaaagcactcgttttcaagcaattataagaacaacagtagtttcatcaaataaattcagaaaatagcactctatctatattttccattcttttatttctcacctctcaagcaaattatccaaattgtccttatcatttcatagcttattttttatctattctgttacaagtataagagctctattttcatattgttaagtatagtgttaaacatataaataaacacatgttctataatggaagaagtttagatttaaccattgaacttcaaactatactttaggatggacaaaactatactttaggatggagtagcttttaaagaacacacaaatttttaataagataagcgattagagttttttttttgggagggggggacaactacgtcaaataaaaaatggagaaagtacaatcgaaggcttctcgatgaaccaagtatgtctaattttagtagttcgatacagaggtggtcccagaacaaaatacaaaatgagggcacacttccaaaaacaagtaccaaaatatcagagcaggagcatctaagttatgcttagcagggaccctcatggtgaaaatctaggttctactacttacaacaaagaaatgagtggggcctgatcccccactcatatacacgtaggtctgcccctggttcgataccaaagatacctgagtttgaagttcaataattaaataattaaatttaggcttcttccttatacaaaattgtatatttaacactataaaaataaagctcatatattttacagagataaaaaaagagggctatataaaataaataggggtaatttgctcccatttgtatatggtgcgcacaaagg

SEQ ID NO: 21831 - DNA, 722 bp, Zea mays
gctgctgcagcggatgggcgtcgggcggttgctggcgatcccatctctggcggccgccgcactggtggagacgtggaggctgcgcagcgtgaaggccgggcataacctgagcatcgggtggcagctcccgcagttcgtgatcctggcctgctccgacgtgttctgcggcatcgcgcagctggagttcttctacgcggaggcgcctgcgtccatgcgcagcctgtgctcggcattccagttcctggccatgtcgctggcgtactacgtgaacacgctggtggtcgcattggtggcgtccgtgaccacggcctggggcggcaagggctggctccccgctgacctcaacgacggccacctggactactacttctggctgtggacggggatcagtgtggtgaactacgtcgtgtacacggcatttgcaaggcgttatacggtcaagaaggttgtcggtcagtaaggatccagactatctgtatgatcaattactgtatcttattgtattttgcagtgtacactactccggaaccgagacttttggtgttcatttgaatgcatggtcctctgtacaagcctactagcgtactgtcttgtcttacgatttgtataacaatttcctggaaaaaggaagaggatttgtatgcatgtgtagattgggatgttgtgttagtgattggatgtttaatgggcaggtgcccggtgcacaatctcccaatccatga

SEQ ID NO: 21832 - DNA, 2285 bp, Zea mays
  misc_feature (1)..(5): n is a, c, g, or t
  misc_feature (24)..(25): n is a, c, g, or t
  misc_feature (28)..(31): n is a, c, g, or t
  misc_feature (33)..(34): n is a, c, g, or t
  misc_feature (38)..(40): n is a, c, g, or t
  misc_feature (58)..(58): n is a, c, g, or t
  misc_feature (71)..(71): n is a, c, g, or t
  misc_feature (74)..(74): n is a, c, g, or t
  misc_feature (83)..(83): n is a, c, g, or t
nnnnnttttttttttttttccccnnttnnnntnntctnnntttttttttttttttttnttttttttttttnttnttttttttntttttttttttgtggaccagaggaaacagatgctgtaaaagtaggagtcgtttgtacaatagtgtatgaaagctcgacagtacgactgtaactgtaacagatgttgatggacacgaggagataaaaagtcacgcagcctaagcttcagaaaccaagttctactcagttgctggaacaaaaaagaattaacaagaacatacaaaattagaatctaagcttgttaactgttttctatcccttcatcctcatggaatctgactaagccggtagtgaggctattctcacactggatctcatctgtatcatttacggcggttacttaggaagaagcctcgctgatcgtcttggtagtgtagaaggcttgaccttagcggaagcacttcgtaagctaagttgtatatttctgggaggttcactataggctgctggtgtcatactctctaactcctcaacctcctcagcatcattctgtccctttttgtccgtagaatcatgactttgtgctagctctgcaccgaactttgaagtcagagaattaatagcattgtccgaagtggcggaagatgttggatgtgtgttgtcaaaatttccagcaataaaatgaccagaagaactagcaggcgactgggcatctgtaacaggcagttctgctactgtcttacaggctagttgataagaaatggacaaactgtcatcacgacctatattttcttccactgctactgccttcacaggttcattttccattagggtttcatctccagtttgttttcctgaagattttggacaggagtcttcattggagccacttctaacctcatccccagaactcattgtgcatttattgccaattggttgcactgaaccacatacaactggtgcagtgattctttcagactgcaaaaagacatcagcaggttctggaggaagcacctcgttatccgaagcacctggcatatcagatgtcacattgttctgaacatcagctgttaaacatgaagaacataccactggagcaccctcctgatacccagaaagttcaactggggtaccagccactgtagacgtggatgacactgagttcacagtagtcgtatcaactggatagagcactgaacgggagctctcaccaacatctgaagcaagtgatgaatcagtggaaggaacaatgttctcagctcccttgttctgaatgtcaacaatgatatttccagatggtgacgcagtgctatgatcatccttagttgacaaactgctaatgaagctagagaaattcccatgttcagacggaggggtaatgtgcatttctgccatgaagttcttggcccatgttgctgaactggagttcagatcaacaagaagatcaatgccctcatctgacattacagaaaattgaacagcagcagcatttgctgatatcttatcagacagccgacaacccttttctgtgttatcattcatacggccgaacttagtggaagcctgaccattaccattagaaggatatttttgaataatagggggacagatttgatcaattacgttagcaggtgaacaatcatgtttgccaacaaattctagatttgttgtattagttgcaattcccacgtcactttgggactgtaaattatgagcagttctcaggtcagaagatagatggccatgatattctggtcttccatggttcatagaaactggaggtatactcgtaccagtgtcaatcccctgctttttagatgtttcatcaacaggtgtctgatctcctttttgatgtttcgcatgcacaagtggtttaccatcatccctgccattgtatgggcctcttttgttgttagcatgattgcatgtggatgcttctttcatatttgctaattggacaggaggaggagcaggagatggagatgcctcaagcagcgaggcgagcgaacttgctaactgagagtgggtcttcttagcaggaaggttataccttttgcacaaacattgcagctcagggtagctgagactgaggagatgttttttgctctcttcataccccatcggattggggtggaggcggacgtggacgacgtgcggcgagtggcgccgaggtcctaggcagggtttggaattcgtcggtggattgggacttggagaatagagacggccagagtcaagacgggtgtgggtatcgggagttctgcgccccccccggcctcgagg

SEQ ID NO: 21833 - DNA, 1750 bp, Zea mays
cccgcccgggcttcccttcgcgcctaggggcggaaggccgccgtgcccgttcttcccagctgcagcaaccggccagtgcgcgcggttgcgttgcatttgcatggctgcgcgctgcgctctgggagcttgcactagcgggtcggcggcctaggcgcggggcatctttcgagtgcgtgcgtgtctgttcaagctctgatcgtctctccggcccattcgccggaggaaactgaccgccgccttctcgctctcgctctctaccctattcccggggctgagaggggaggagagaaggccacgtccacaccataaagcaggacgtacagacacgtgtacgagggggatcacggtcgggtgaggtgactaagctggcggacggaacgacgacgatggcgaggagcggcggcgggatggaaggcagcggcgggctgaagaaggggccgtggacgcaggcggaggacaagctgctgagggaccacgtgcggcggcacggcgagggcaactggaacgccgtgcgccgggagacgaggctgcagcgctgcggcaagagctgccgtctccggtgggccaaccacctccgccccaacctccgcaagtgccccttctcccccgaggaggagcgtcagatccttctcctccacggcctcatcggcaacaagtgggcgcgcatctccaagcacctctcagggaggacggacaacgagatcaagaactactggaacacgcgcttcaagcgccggcagcgcgcgggcctgccgcccttacccgccggacgtcgagcggcagatcaagctgctgcgcgcgcagaacgtcaacccgttcgcagacgcagacgccgacgccgccacgccaacgttgctctccagcataccgtcactgtcgcaggcgcccgcgcactcgcactcgccactgatcaaccagaactacccgcttctgaaccagatgcaggtgttccaccacctcggcggcagtcagcagccgtcgttccaccaggacggcagcgcggcggctttcggcgacatcgtctcctctcgcctgccgccactgccaaccgccagaacgcaggcggagctacattcgaaccaattcgacacctccatcagcggcgggctggtggatcagtcgatgctgatcggcgacgaacacctgctgcggcctaacccgagtatggtcaaggtctcctccatgcccgcgctctcctaccgtgagccggatgggtccaggatgctgccagcccatggcgccgggagcgacggcgacgtctcctcgctggggcactgccctccgggacaggacctccaccgtggtgcgacatgggacttcaccttcgcggccgtgaagccggcgaagaggaggacggcgagcgaggtggggttctccgacatgttcgccgtcgcaccgccgggggattggttcggcggcgggtcgacggcgccatcgccggggccgtcatcggccgtcaccgacgaagagtttaacctggagatgcagcagttcatgtcaatgctaccactgtctgacgagcacggctggaacgcataatgcggccgggtaaaatggaaatcgaaaactgtgtagagcgtgtgtctccttgcttctgcgacgagaatggtgtgcgcattgtttttgtaatgtgcccactcttggatctttatctgttctagacgtcgattgagtttcaaacattgataatgctagggcaccatcggcgtgggataaacaccaaatagtccaagaattcactgcataaaaa

SEQ ID NO: 21834 - DNA, 4474 bp, Zea mays
  misc_feature (553)..(553): n is a, c, g, or t
  misc_feature (3076)..(3076): n is a, c, g, or t
acgcgagcaccacaaaggtggggggatgacgacgccagggtaggtgagggagtggtggttgctgcgcacgtgggcgccaacggaggtggtgggaagagggaggggtgacatatcgtggggtggggtgggcagacgatgtatgatcctacgcccagagaggcgggagcgaggtattcaaattctgcggccaagacaagtagcggctcggacagcggacgggtggggcacacagacaaacggtcctgatctgatgaatatagatggactctgcagatttgttgaagggagaacaatatggtgacaggctactccttgccgccttaggggccgttcgtttccactggaataaacccggtttcgttccaactcatcaaaatttatataaattagagaagtaatccggctaggaattatttcgggtctccaatccgtgaaaaccgaacaaggccttaatatagtagtaataagtatagactccaccctgagtacagtgatccgattcatctagaagaagatggatgtgcctaaagagaatgagcgagagtgtcgtacnctacatacggggacacgactctgggcagtggtgaagaagctcctgcgatctcgccgatgccaccaagcaagctaagcatgcaacggccctaaatttggaagttggaagatcgtatcttttcgcacacaaatgccatgcacgccagtcgcatcatttgacggagcgaaaataggtgcggcgacgagcgcttcgcggggcgatctaggagctgcaccgcccacctcatctctctctctctctccctccaccctgcgctctgccgccattaccacgcctatcccccttccccgcccgggcccccgccttcccttcgcgcctaggggcggaaggccgccgtgcccgttcttcccagctgcagcaaccggccagtgcgcgcggttgcgttgcatttgcatggctgcgcgctgcgctctgggagcttgcactagcgggtcggcggcctaggcgcggggcatctttcgagtgcgtgcgtgtctgttcaagctctgatcgtctctccggcccattcgccggaggaaactgaccgccgccttctcgctctcgctctctaccctattcccggggctgagaggggaggagagaaggccacgtccacaccataaagcaggacgtacagacacgtgtacgagggggatcacggtcgggtgaggtgactaagctggcggacggaacgacgacgatggcgaggagcggcggcgggatggaaggcagcggcgggctgaagaaggggccgtggacgcaggcggaggacaagctgctgagggaccacgtgcggcggcacggcgagggcaactggaacgccgtgcgccgggagacgaggctgcagcgctgcggcaagagctgccgtctccggtgggccaaccacctccgccccaacctccgcaagtgccccttctcccccgaggaggagcgtcagatccttctcctccacggcctcatcggcaacaagtgggcgcgcatctccaagcacctctccggcaggacggcacacgagatctcgtctattccgatcgagcacgcacgccatgaagaactcatgcatcgtctttcattggcttggatcacatgcatgcagctctcaggaaggacggacaacgagatcaagaactactggaacacgcgcttcaagcgccggcagcgcgcgggcctgccgcacgagcggcacgagcggacgtcgagcggcagatcaagctgctgcgcgcgcagaacgtcaacccgttcgcggacgcagacgccgacgccgcccacgccaacgccagcgccggccttccggcgccgccgctcctctacgacgtcggaaacccgttcgcgttgctctccagcataccgtcactgtcgcagacggcctcgcactcgcactcgccactgatcaaccagaactacccgcttctgaaccagatgcaggtgttccaccacctcggcggcagtcagcagccgtcgttccaccaggacggcagcgcggcggctttcggtgacatcgtctcctctcgcctgccgccactgccaaccgccagaacgcaggcggagctacattcgaaccaattcgacacctccatcagcggcgggctggtggatcagtcgatgctgatcggcgacgaacacctgctgcggcctaacccgagtatggtcaaggtctcctccatgcccgcgctctcctaccgtgagccggatgggtccaggatgctgccagcccatggcgccgggagcgacggcgacgtctcctcgctggggcaatgccctccgggacaggacctccaccgtggtgcgacatgggacttcaccttcggtcagttctttctcagatttttgctccccgagaagaaactgacgctgatcgtctgaaatttcgaatgtagaataggacgaacacgaacgtgcgtacacgcggcacaaacacgatgatcatcgtctcaccatgtggttgcatgcatcgggaaaccaatgcgttttcagcggccgtgaagccggcgaagaggaggacggcgagcgaggtggggttctccgacatgttcgccgtcgcaccgccgggggattggttcggcggcgggtcgacggcgccatcgccggggccgtcatcggccgtcaccgacgaagagtttaacctggagatgcagcagttcatgtcaatgctaccactgtctgacgagcacggctggaacgcataatgcggccgggtaaaatggaaatcgaaaactgtgtagagcgtgtgtctccttgcttctgcgacgagaatggtgtgcgcattgtttttgtaatgtgcccactcttggatctttatctgttctagacgtcgattgagtttcaaacattgataatgctagggcaccatcggcgtgggataaacacaaaataatccaagaattcactgcaacaactgctgtgcaccttcgtaaagccaaacatgttcagttttaattaaatatatatatcaaaaccagtataggctataagtatctcgatccgtatcttagtttcacgtaagatagtacgatcttactaagttaaaatggtaccaatcatatntaatatcttaaattagtatcgtgatcttactttgccttcacgatcctacatatactcttttcgctccaaaatataatttattttagattaaatatatattctttaattaatttataaatatagtttatatgtatgtttacatttattattatttattcaaatgtgaacgaaaataaaaggacagattataaagaactagttttgggatggagtacaattttatagtatcccaaatttctaatactacaatcctaaccatacaataattaatgcaaatggctttttaagttataatttaaaactaagaaatgttgaaataatgccaaaaattacatttaaatatagaaacatggtcccgtgagtctttagcttctccaaaacaatctctatggaacttcggttggtggcggatcgaactcgtgcggtgaaatatgccagcaaagtgctaacgaagggctctctgcctactcggtccggtggcacattagattggttcggtgagtcacggatcagctgacttaactaaattttgtgcttttcttctttaaattgtttcagctatgcttgagggtgttcttatgacttagacaaacatatatagagaatagccaactagtctaagccaaggaacttaccattttaattcttctaacgtttacttttattctaattctagctcaaacttagctccaaaagtgtcgaaactcaaacctgagcttttccagcttctttggttgcttcaaataggctcctatgggtgtctagaacttatccaagctgctgaactacaaacagttcatcttctccaaagtataccccttttggatggttttgaggtgtttctgacttggaattcgaattgtcgatcttatgaacatgtaatcaaaacccttgggaaactatttagctcaaatggttgtgatgttatcaagcaccaaaacaaatctacaaatgagttaaatgtacacccaaaatcctattttggggtttataatagtttttgccaaaaaggtttgagttaaaatatcttttaatatattccttttctttataaagtacatttctccaaagttatatgtacaccggtcagccctgcccttgcccctgagccgctgatcgccctggcccgcctgttagtcgcgcccatgggatctgttctcggccctagatctgagattggatggctgaggacacccgataccccttcgactggtctttttgttaaagaaacacccagcttctcagtaataaacccgccgtcctagtttctttcgcttgagtccctggtttcttgtagagagacccatggactttattttaatcacaaaaatgggtataaattagggtttttgaattctaaaactttcaaaattcataactttgtcatatgaactccaa

SEQ ID NO: 21835 - DNA, 1599 bp, Zea mays
tttttttttttttttttttaaaaaaaaaaactagagctttataagagcagacaatacctgtcacggaactataaccgtgtcgtagctagcaatagcatagccgattcgtgttgtgcccgtggctgtaccagccggtacatttggtccatcaatacctaccactaccgtagggaatgccgatgcgtggaccggcccaaagtctcagaacaggtgaacaagaccagcttcaaggattttcttggcctaggcatacaattaattactcacacatatgtaccagcacaaacacatccaaacaaatccctacagtaatattgatacagaaactttgcacgctaggagctgccgagagatctaactgacgacacggactgcgctgacacggaggctgtggggctgttcacctccctgtccccattggcgactcgtgccctcccgccgccgatcctactaatactctcctgggcaacgtcgatgaaccagtcgtcgcttggaaggatcctatcagggtccatccccgtggcagaaaacgctctcatcgctctatcaatgatgtccaatatgacttgatgcacatgccgagataagaaacgaccttgcccgaaaaggatcacaaattgcatatcgaggtagaactgctgaagtccaaccggacccagagcccttggtccttcttcaacctcttcccaaaagctctggtcgtctgagagccaaagcatgactgcctccgtaagtctcatcataagcagcgtggcaaacctttccctaccaacaaacatgtctgccgcaacgcttgccatcttattcaacttcgcatacaattcctggaaaatcgcagatggaacccattcgggatcttcaacagtattatccatatcgatgtacatctctgcgctcagacgggtgtcaccttctgctgtgtctatgccgccttgaggcatgctgtctgcagaaactatctctaagtttctctaccatgcggttcagcttccttttccatgcccgctgctctgccgcacgattttggttttcaggacctcttctacgcaagctatctttgctgaccgggttcatagagtacagcttcatcgctgctctcggtagcaactcttcagctagtaaagatgcattagctaacaaagctaactgctggtcctctgtctctgccattctaacaatcttattccccaaaccttccaagttaacttcatcatccactgaccctggtagagcacttatcagcaagtttacatacgagttgaatattttcagaagcccatccatcgcggaaccacctagctgtaagctaaccagtggtccaacatcctcaaagaaatcctgaaccattgaattgaaacggtgagcactgcttgagagcttcggctggagtgccagattaccagatgatctagccagtggacgtataccagttggaggataggtgagtatccagtcatcagctgcagctaaagcagcagtactctcttcaattctcctcaaattggaatctaatgcttgctcaacagagggtctgagttgcttcatcagaactgacgaaagtgatagaccacgagcttccagcaagtctgaataaccaat

SEQ ID NO: 21836 - DNA, 6606 bp, Zea mays
  misc_feature (866)..(866): n is a, c, g, or t
ataaagaaaataatcaattatagattagtttattgtgatatgagagtcgtctataatttattcattgttttatctaaaatatgatgttatatgtggataaaaacgagccaaatcgtaaatctatgaaataatattcgttcatatgatatgcagagatattctttcgtagatttacgctggatgggggcgcggggagacggttcatggcggcatagggcggtagccagacgtaccagggcgtgcggtggggcgatcacgacgacgtggccacgacacatgactgctaggaccatggctaacggggtgttcatgactcgtgagggccaatggtgcaggacatggccgagggtgcttgcgttgtgcttggtcattcatcggaaagaagagtcgagttagaagaaacaagaaaaaaagaataaacccctttatttctctgtaatgtgtagcatggtggatatttttttctaactagtttatagctcgagctaacgctacaatctcggggagggtagggaatgacggcggcgacgataatgcgaggataagggttgatggcgacggcgacgcaagtgagggggagaggcagcagagacacgaggggggggggggagaaggatgagggatgatccaaataatattgcccattgaatttgagggagtaaagggttatacaacgatctgaacagttggttttgatttgttggtttgataagtatagagcaatttgtttggtggatttagtggaggttatgatgcggagcgatttggttggttgggttttataaagtttaaactgtgaatgaattatatatagtggcatcgactatcaatcttagattttgtggagtgccagctgctccaccaantgtaaaaatgtttagctaaaaagctagatctgaatttgtttttatttgaatttagagctctgtaccaaaacagacgtaccctatgtgacgtgacctgcatgcccaaccgcctaaatagtaaagaacgactcgttgtcttcgccagtagagctataaaaaccaaatcacaaatctaggaaagaatatcactgcgcatccggccgccccttgtggtcacgcatgcgcagaaacgttcgcatttcaaaacgaaggggacattttgtttctgggaccatatgcacgcgtaaaacaaatctcacagtgtccttacaaatttctagccacgtcgttcctgcttgtttgctgcctagctatagctagtcccaggagcgccccccctagctaggtcccccatcgttacacaagtactatattatatgaaggaatgattcatgccagcaagaaagaaccaagcctgaaagcatcagcaaagcagcaggttaaaaatcttcaaatccgtccaaaacatcccccttgggttccatcaggctttggattttaccttttcagcaaaaaaaaaaacataataataattattatttattgtgatatcgcttatcctatgatatggctttagattttagggtttagagtttagagctatgatccatccaacacaagcatgttttcagttgttcttagaactctttcttttcctcgttgctttctcgatctctcacaatttttgtggtctccatcttatcttctgagtctatatatattacagctcgtgcacaaattttaaattttgtacgtggttctcattcaatgtgattctcattctagaccctaaaccctaaaccacgtatatacatagctagaagagcgctgcgttgttacggctggtctagattaacaataataatctggttgtttcaccatgcatgtcatgcatgtgacattcagttcccaggtccgtacaaaaccgagctagggcgtggtctctcagtcagcagcacatgggtagcaactagcaaggacacactctctgtggtccttggagaccgatgggctgggagctagattacttaggatcccaaaagctctttctgttttttttaataagctcccaaaagctgatgagcagcacaaggcagtagtggcttgcatgtgtctgtgccgcgtagattattagtaccggtggtttttgtgggttagccagagcgcttgtgcttgtcagaggacaaatcatgcaagtcggtgggtttggttaatcaagtgagcggtagagcttggctaattattatgcgaggatcgggcaagcaaatagcaaatgggatgtggtgcatgcatcagacgatgtgcacgctgcagcgtccgcctgccggcccatagtatcccaatcacacccgcccaccagtcatggtcaggcgtccccacgctaactaggctctctctcacaccctcccatgacggctgggatcttctacgaaagaatggccgtacaccgggcccaagttacattttagggcatgtttggatcgcggtatctaaaacaaaaagtaaataaagtttggtctttttagaggctaaagatctaaacaggaagagctaaaagtaactaaaataataaaaaaagttttcatttagtcacttttagctcttaaagaagagctaaactttagtcggtttacttaagctctgggatccaaaaaggtaatcagatgtatatataccagggctggaatcgaaaccagaacatatcaattaccgatcgagggtcgtttttcaaaggtttactgtgttttttttactaaaacaaaaaacggtagcggtaaccataaaaaccatgtccataaagatataaaactatgaaacggataaagtaggcagtattcactatatatatatatatatatatatatatacatatatatgtctttatacatgtcgttgattttgattttggaaccgcatgcggttcaaataaactaatttcctcctcaatcccctccaatcctcccgggtcaccaaatcagccctaattgttccctcacactccacctcatcttctcacaaaaccctcgcctcgcctcgcctcttccaagccccatcagggtctcctcctctcttaaaccctcatctctgcttcctccatcgctcctcatctgcggaaatgcccggtggatgttgcgcctacaacgccaaggcataggcgtgcaataaacacacagccagagccaggtcaccctctcaggtggtcgcaacagaggaggatagatcccggtgcacaacgacatcttctacatcatcgaatcgaacggagaaggtgaagatgcccatcatgggcctcgtattgcagagcacgggtgctacattggacggccgtggcggcgtcggcctccatcgggcaggggcaaatgtgtggctttaacagtcattagagacgacaaaagctatttacgagatagctccactaagatgttttcgcgtcgtcgtcgtcgtcgcttagctccactaagatagtaagatctttctgtcattgtcgtggtcgctgtctggaattagattggatgaatttggtgcaccttgcaccaaatagtacattttcaaggccaaattctgttcgacggtccatatctcaaaccatccgcacgcactagcgcaggacagtcttgatcttgttggttaaatttgaactagtttagctagcacgaaccctcgtaattgcaatgttttttagaaaaaaaaaagaaacaaaaagtgagtgaaggagggagggagagtacgtagtagcgcactactatccaggccccatgtcagtgtaggtacaaatgggatcacaagcaaagcagtgcaagcaggtgaatccgtaattttgggaaatgccaatgcaccagactgaatcacacagctctttgatgctggcatggtggatgtgaaagaatattcacatttttttacctgtacctgtagctgcaggtagcagtggtggcccttagggtgaggcagagaggagggtcctaggccctcgaatttatagggcccaattttaataatatgatccaattacatatcaacaaaataatgaatatataaacatgtaagaagaaaattttaagatgatattataatatatatccttttatttacttattatttaatataaatatttttagatatattttgagtgttcaattaataacatttatatattaaaagtaatttgaaggaactttatttaaaatcttgtcccgggcctttatttaaaatttgaaggaactttatttacctgtacctgtagctgttttaagatgatataacatttatatattcaaatttgaaggaactttatttaaaataatgaatacataaacatgtaagaagtaatttgaatatgttaggaccaccactggcaggtagcaggatgtactggtactgctgcggctgcactgttggaaaaggcgggggagcaccaaaagttgaagctgcaatccacctcagattttgggccactcacaaaaaggaccatcacatgcacatgcccacatgcacatgacaagcacttgtctgatgtctccccctcctctcggtcacggtcagtgctctctcgctgcacattgactctagaatcttcacatcattcacccgtggtaaaaagttcagactccaatgcaaactgcgagtgggagaattgccaacgtaaactgaacttgtcagagcagtaatatcatacatacactacacatatagccggactgctgaagttgtacagcatatttggtatcttagaaaaagcgtgacacagtcaactacaaactaaatattcctctaatctatagaaagtttagaagacaaaacaccgtaaaattaatagaaactagtaaggattaaatccaaacaaacaaactaataatagttctttttttatacaagtccgaagcgcagtagtcagtaccagccagaatattctacacaaagatactcctccatatgcacccataaactgacgagtccaggcttacttttataccagtccagaaaggtgaaaaaagggttacaattacaaaagaaaaagagagagagtccgccgccgtaccccgcaaaattgtcttcttctttttgttcaaacaaagtcgccattagcttggttgcccaggggcatttctggcaaagacagggtccttcgctctggcaggggcaggacgccaggaccccgcgcaaagacagggtcctacggttcttttttttttacatgacatttgagtgacaactacatgacggagcaggcgttggggttctcgtcgctgaagatctgcggcgccatgggctgctgctggtgcaggtggtggtgcggcggcgcgtagaacggcggcgggtaggccggctggtaggcgtacgggtaccccggaggcggcgggtaggccggcggctggtagtaccctccagcgaacgggaaccgcgggtagtgcatgtacaggctggcggccgggtccttgtccttgtcgccggcctcgtccttcttgtcgccgtctccgtcgccgccgtccttcttctcctcattcttctcgccgccgtccttcttctcttcctcctccttgccgtccttcttctcctcgcttccggctccgcctgcatccttcttctcctcctccttggccgccttgtcgccgccgccgccctccggcgccggggccggctcggacttgacgacggccgcgtgcttgcccgtgcgcttgtacacgtactccgccagcttggactcctcgaacacgcccttcaccgtcacctccgacgccttgaggtccgcctcgtccgactgcacgcctgcatgcacagccatacccatacatacatacgtacatttgtggttcagagcagggactactagttaattcttggtcaagcaggtgggtggaggagttatgttggagagcagagcacccacctttcatcttgaggatcctcttcttgatcccctcggcgcacgcctcgcagtgcatgtgcaccttcagcaccacagcgatcaccggcggcttcaacaagaaaaaagagaaaaaaaaacgaaaaatcctcacatcagcctctgttccatggagcatggaaccgatgcagtttcggggggccaaatgcagaccaccaggctgtgattttcgatctcacctccttcttctcctccggcttcggcggctcgggctctgccttcttctcatcgtccttcttcttctccgcctcatcttccttcttctcctccacctccggcgggggcggcatcggcgacagcagctcgaccttgcggccggtcttcttctgcacgcgctccaccaccttcatggggtcggcggccgccttcttccccttcaccagcaccttgtgcgccttggagtcggcgatcacatcctccactcctgcagtggtggtgacagcacagcacagcacagtttccatttcagttcagatgcgtgccattctcttgggcgctctgagaagctgccatgaatcacactaattcttccaagaatataacctttgaagcaagtgtccctaatctggattgattttttttttaaaaagagtgagagtgagagtgagagagagacagaatattctgaaatctcaatcacatcgtgcaatcacgcgtgtttaatactacaacaacaaagaagaaaaccgatggacacgtagagatagtagtaggacagcagaggggtaggggcagcagaggacaggacagcatcagcattaccgtcgaagcgcctga

SEQ ID NO: 21837 - DNA, 1088 bp, Zea mays
gtacatgctggcggcggcggcagcggcagcgtctttatctccctccttttcctccaccttctcgccgccaccgccgccctccttctcctcctcctgcttctcgccgtccttcttctcttcctccttgcccccttccttcttcttctcctcgccaccgccatcgcctcctccttccttctccttctcctcctcctgccccttctcctcctccttggcccccgtgttgtcgccggcgccgctctccggcggtggcgccgggaccggctcggacttgacgacggccgcgtgcttgccggtgcgcttgtacacgtactccgccagcttggactcctcgaacacgcccttcactgccacctccgacgccttgaggtctggctctgcagattgcacgcctttcatcttgaggatcctcttcctgatcccctgggcgcaggcctcgcagtgcatgtgcaccttcagcaccacggcgatcaccggcggctccttcttctcctccggctttggcggctcgggctcctcctctgccttcttctcctccggcggcgttggcggcgggatcggcgacagcaactccaccttgcggccggtcttcttctgcacgcgctccaccaccctcatggggtcggcggccgccttcttccccttcaccaccaccttgtgcgacttggagtcggcgaccacgtcctccactccgtcgaagcgcttgaggatcttcttgaccttgcgggcgcatccctcgcagtgcatgtagacccgcatctcgacctcctcgggcggcggcggcggcgggggagggggcgcgtcgtccttcttctcctccccgtccttgggcttgtcctccgccgccgcagcgtccttgggcttgtcctccgccgccgccgtggcgtccatgggcttgtcttccttcttcttctcctcctctgccgcctccttgggcttctccacctccgcctcgcccatgcggcctgcgctgtgtgccctgctctagtcccctcgcactcacactgtactgctgctgctgtggggaaaaagctcttccactcctcggtgaccgagcggtgcgggtgagtgcctgtggtggtagtggt

SEQ ID NO: 21838 - DNA, 1554 bp, Zea mays
ttttttttttttttttttctacacaaagatactcctccatttttttttttttttttgacgagtccaggcttacttttataccagtccagaaaggtaaaaaaaagggttacaattacaaaagaaaaaagagagagagagaaatcgaaccccgcaaaaaagtctgctactttttgttcaaacaaagtcgccattagcttggttgcccaggggcatttctggcaaagacagggtccttcgctctggcaggggcaggacgccaggaccccgcgcaaagacagggtcctacggttcttttttttttacatgacatttgagtgacaactacatgacggagcaggcgttggggttctcgtcgctgaagatctgcggcgccatgggctgctgctggtgcaggtggtggtgcggcggcgcgtagaacggcggcgggtaggccggctggtaggcgtacgggtaccccggaggcggcgggtaggccggcggctggtagtaccctccagcgaacgggaaccgcgggtagtgcatgtacaggctggcggccgggtccttgtccttgtcgccggcctcgtccttcttgtcgccgtctccgtcgccgccgtccttcttctcctcattcttctcgccgccgtccttcttctcttcctcctccttgccgtccttcttctcctcgcttccggctccgcctgcatccttcttctcctcctccttggccgccttgtcgccgccgccgccctccggcgccggggccggctcggacttgacgacggccgcgtgcttgcccgtgcgcttgtacacgtactccgccagcttggactcctcgaacacgcccttcaccgtcacctccgacgccttgaggtccggttctacggactgcacgcctttcatcttgaggatcctcttcttgatcccctcggcgcacgcctcgcagtgcatgtgcaccttcagcaccacagcgatcaccggcggctccttcttctcctccggcttcggcggctcgggctctgccttcttctcatcgtccttcttcttctccgcctcatcttccttcttctcctccacctccggcgggggcggcatcggcgacagcagctcgaccttgcggccggtcttcttctgcacgcgctccaccaccttcatggggtcggcggccgccttcttccccttcaccagcaccttgtgcgccttggagtcggcgatcacatcctccactccgtcgaagcgcctgaggatcttcttgaccttgcgggcgcacccttcgcagtgcatgtagacccgcatctcgacctcctccggcggcgggggcggcggaggcggcggcgcgtcctccttcttcttctcgtcctcctccttgtccttgggcttctcgccgccgccgcctacttccttgggcttgtcgtccttcttcttctcctctgccgcggcggcctccttgggcttctccacctcctccttcttggccgcctcctcgcccatggcttccctccctccccggatcccctgctgttgtgctctgccccgcacgtctgcactgcacccacgcgcgcctcttcctctcgc

SEQ ID NO: 21839 - DNA, 1277 bp, Zea mays
ctgaaaccactttctcagtgtgccacaaataattttacaaaataggaacatgtaagaacaaaattttttttttttttttaagggtcgtaatggaccacaaaagatcaaactataaaattatgacatctctgttcaggcacatgaatgtcacgcaaccttttcttttaatttaaattacagaaacttatttcacacctgacaatagtaatatgcccatatattactaagagttatccaagaaacaacttttgtaaaaaaaaaaatacagtaaaaggtagctgatgcagttgttccactgcagaaccgaagaaactagacatgtagaattaagcgtgatcaattgcagggaaggacattgtgtccttgctgatgccaaatttggtgtagttcattttgatcttcttcagggtcactactacatcactcattgacatcctttggttaggtgaatcagtcgtgcagagcaaaccgagctcaaatattaggggcaaaacctcgttcaggttggctgaagaagaaatggcatcctgcagcagctggctgtccacgacagtgtcaagctgagatggaaatgcttgttgaacccactgcctaatgctcagttctccctcaaacatcgtatctgtgggcctcttcccagtgaagacttcaaaaagcatgattccaaagctgaacacatcactcttgcgcgatgcctttccaagagatccatactctggtgccatgtatccaagtgttccaggcatggtggaaacgaccatggagttgtcatcacccagtagcaactttgcgatgccaaagtctgctacgtgtgctgtcatatcatcatcgaacagcacattgcttggcttcaagtcacagtgcagaaccacctcgtgatgctcatggtgcagatattccattgccatagacacgtctagcatggtgtccatccttgtatggaattggaaccccatgtgacttctgtcttcagagtgcaagagcatctccaagcttccattggacatgtactcaagcaccagggctcgaaaatcaaggctgaagtcctggggggccgagaagatcacaatgtccgaaatttctggatcccagaaaatgtatgagacgtagcgcgcttcgacatggcgatggcagcggcggcgcgagaagaggggcggcaagagcgcatccttgggaggccggcggcaagagcgcatccttgggaggtcggtggctggaggaagggatgtggacgagcaagtgtgtccgtgtcacactaagaaagaaccatttttctt

SEQ ID NO: 21840 - DNA, 5668 bp, Zea mays
cgatgggaacgtgaaccaggtagaagcatccagagatgggaagcggttgaacggtagaagttgtcgatgaataatcatgcaggagacaaaattctgcaaacgtggatagcctagtatgcgtcgtttccatgcggctttaaagataaggaaatatccttaagtacttcagaagaactaagtatgcgttcttagtgtttagaggtgaggaagagctcgttataactagttgcactgatgctagcttccatacagacaaggatgattccagatcacaatctggttttgttttttgtctcaatgatggggcaatgagccagaagagtttcaaataagatacagtagcagattcaatgatggaagttgagtacattacgacttcaaaagctacaaaagaggttgtttgaatcataaaatctgttgctgagttgggtgttattcctagcgtgtctagtccagtggatctctattgtgataatagtggagccattgcagaggcaaaggagtctagatcataccaaaagtcaaaacatgtactacgacactatcacttcatttgcaagatcatagaatgaggtgatgtgaagattttcaaggtgcacacagattcaaatgttgttgatccattggtgaaacatgtttcacaagtaaaacatgggggcacataagatctatgggtataagatgcttacatcagtgatccttgaaatgagattgcttttctagttcttgcctctttatttttctcatttttattgctctatatttttgcctttgatctactcttgttaaagccaatgtcactaatgtcaacatagcttctttaagttttttcatatgctcataggtgacttttgatccatacactgtaggccacagtctaaggtgtcatgaggagccagtggtggactcagcacctaggcaccgtacgccacaatctgggttgcctcgtctagcaagtctgggttgcctcgtcagctagaagtgtacttcaagtccaaatatacatgtattttatatgaaattagctatggttactagcacatgataatcttgtctaggctatctttaattcttgggtccgccggtgtgaggagcctttgctgcaaccttaggacctagatcagaaagcgagacttggtgactgagagtatcatttgtagagctctaatgtggagtagggtttggcttagcacaaatcgaaccacgagattaaaaaaatctcatgttaagtttgcatcctcataacctactcatttacgtccgcatttcatacttgtaacttgtgtgcctttaccttttatggagcagtatattgataggtttggttttagaattaaaaaaaattgtaggtggatacaaacatcattataatcatagttgcacgttggataaaaatgtttagtttacatttgttcacccttaaaatagggctaatagtttacctgcctaattcacccttagtcctagactatctcgagtagcttacccatctcgatccccatattcgaactccactctgtgaacaataccgtctacagtgcaaaacaatgcaaaacagtattttaagtaaccatatgagtaaactgctggacacagtcttagaccgtcataagagaactgagtccttttactacgaccaccaaaaaacgaagggaaaatcagcagtgggacattgaaaatagtacttcctccgtttcaatttataattagtttgatttttttatcttaagtttgaccgactcatcttattcaaaacatcataattattattaatttttactataatatcgtttatcatataatatactttaaatatgcctttgaatgtttcatttttcgcaaaaaatttgaataaaatgagccaatcaaacttgtaaaaaagtcaaacaaattataaattaagacggaagagtactatttatcaagaatacattgaaaaacattgattattatcagtgacacatcgcaacgattaaaatttccatctcaggaaatgccttgtagacagtcttgttggaaatgaaaattttaatacatgtggtgtgctcctcataataaccaacgtttcacattgtattcctgataaatagtgttgtttctaatgtcccacagctgaaaccactttctcagtgtgccacaaataattttacaaaataggaacatgtaagaacaaaacaatcccttaacgtttaagggtcgtaatggaccacaaaagatcaaactataaaattatgacatctctgttcaggcacatgaatgtcacgcaaccttttcttttaatttaaattacagaaacttatttcacacctgacaatagtaatatgcccatatattactaagagttatccaagaaacaacttttgtaaaaaaaaaaatacagtaaaaggtagctgatgcagttgttccactgcagaaccgaagaaactagacatgtagaattaagcgtgatcaattgcagggaaggacattgtgttcttgctgatgccaaatttggtgtagttcattttgatcttcttcagggtcactactacatcactcattgacatcctttggttaggtgaatcagtcgtgcagagcaaaccgagctcaaatattaggggcaaaacctcgttcaggttggctgaagaagaaatggcatcctgcagcagctggctgtccacgacagtgtcaagctgagatggaaatgcttgttgaacccactgcctaatgctcagttctccctcaaacatcgtatctgtgggcctcttcccagtgaagacttcaaaaagcatgattccaaagctgaacacatcactcttgcgcgatgcctttccaagagatccatactctgcacagaagttccataggacagacagattcgatttgctaaaacaattgagcaatcaatatgctaaaacggactatagattgtgcaatattacaaagtgttactgcgtacatacctggtgccatgtatccaagtgttccaggcatggtggaaacgaccatggagttgtcatcacccagtagcaactttgcgatgccaaagtctgctacgtgtgctgtcatatcatcatcgaacagcacattgcttggcttcaagtcacagtgcagaaccacctcgtgatgctcatggtgcagatattccattgccatagacacgtctagcatggtgtccatccttgtatggaattggaaccccatgtgacttctgtcttcagagtgcaagagcatctccaagcttccattggacatgtactcaagcaccagggctcgaaaatcaaggctggagcaggtgttcagtatccttatcaggttccggtggcgagccatgcgaagcacacgacactcggcgtcaaagcttccaatggctttttcgtgatgcatgtctagcacttttattgcgaccaccaaaccgttgtctagttgacccttgaatactttgccaaagctcccagtccccagcaggttgttatcgctaaatctttgtgtggcgcgaacaagctcatggtaggagactaagttatgggccacgacatcgcatggatcagaaatgtcactatgtttccttgtggtaagtaggtagtacacacaaagaacaaaagaagaaaatgctatggtgacgacagggattaaaattgtaattaagtgtctattggtatgtgaatgagacttgtcgggacatggcaagaaacctagacggggagcaccacacagcgcaggattcccaagtaaagattgcgaggtgatgcgggagaaaacacctccctctgggtacctttccttctagtcgattgaaagacagattcaagtctgtcaagtaggtgaaattggcaaggaactgaggaattgtaccagagagagagttggaggagaggttcaatgatgccaagctttctagctcctgaaacaaacctgggattgagccctccaatgagttgaatgatagatctaggtaagtgagcatcttaagtgttccaaatgactctgggatgcttccaaacaaataattggaagataagtcaccaaaatccacttgttttagcccactaacgtcgaccggtagtgaaccagtgagggaattatgagaaagatccagatagataagtttgggaagctggaacaagctagatggtactgttgaatttaactgattatcggacaagtagatgtattctatcgacgtaaggttgccgatgctgtcaggtatggggccatagaatttgtttccattggtgtagaattgttgtaggctcttgagcttgccaatttgtgttgggagacgacctgacatttggttgctggcgacatcaaacaggatgagattttgtaaacgtgtgatggattctggtatggctcctgtgagtaggttgtcgtgaaaatagatactaacaaggctgcttaagtttgacaatgacgacggaagctcaccggatagcttgtttgcatttgctctaaattcaattagatatgttgacaggttccccacctggtctgggagtggcccggtgaaggaattattatatatgtcaaggagctcgagttgcctgcagttggaaagggaggacagaaagtcgagacctccgttgaaattgttccatgagaatctaaactgggtcagacctgggatgtttccaattgttctaggtacagaaccagacaatagatttgattccacactcagcaaagacaatgcagacaaatttcctagagaagctggaactggacctgttagccggttgtttcctagacgtagattctttaggtcttgcaacaggcctatttctggtggaatgtgcccagtcaggtcgcagaaagagacgtctatatcagtaatacgggtgaggttgccaagaatagctgggataggtccagtaaggtgaggaagtccgcctaagtaaagaactgggggggggggggggggactagtgaccagtggaattcggccttgaatgttgttcccactgatagaaaaccaccaaagcattggcaggttgaaactttgattgtaagggacttctccagtaagattgttaagttccagtgagaatacctgcaccctagacatgttgaacatggtggcgggtattgtgccaaggagctcattatcattgatgactaagtagtcaagtctgggcagggatcccaaagtgtgcggtattggacctgacaggtggttacttccaaagtggatatgaatcagagaaggcgtggtattgaacagataaggcggtatatggccactcagctcattgttggccagcgaaatgttttcaaggttgcgcagattctgtagcatctgtggtggaatctgcccgagagcatgttggagctcaagtaaagagacttgaggcttgtaaggtttcctatagagtcaggaatggaattagctaggcgattctcagcaagaaagagatatttaagccgtcgcagagtgccaatttcggcggggatggagctggtaaggcttgcgttcataaggtccagcccagagaggaaagagaggttaccgatgtgtggggtgagctccccttggagagatgtgtccgatagaactagagcagtgacgcgctgtcgacgacggctgcacaaaacaccaacctagtggcagaatgatacgttggttttccagctgctggcgaggacgccaagaggatcagagagctgggcttgaaagccagcagcaaaa

SEQ ID NO: 21841 - DNA, 995 bp, Zea mays
tacgacaaacatggtctgaatgtcatgtcgccgatccgatcaacctataaggcgatattttttttttttttttcttaccacaacgtaaccctcagcctttcgccagctactgaagtcgaatcaattatgtaacggagtaaaatgcaagctaaacagagccacagaggcagtctgcagtcggccatccagatcgcgagctgtcgacagttgcagaagtagagcaatcacgcagctgttgggtgctgagtaccagcaggctgtgccgccgcctgggcagtgccgaagccgcgaagcccgggaagggtccacttcgagtactgccgctccatctcgctaatcttgtgtttcattatctgtacttccagcgctagttgctcctcccttttctttatcccctcaatttccagacgacgggcctcctcttttctggcttctgacctagcacttctttgcacctcatagataatcgcagcaccagcgaccgagaaaacaaatagttcaccgagaagatctgcggcagcttgaatagctttctcctcattcaggggccgaatgtgaatgtcagtcgcacgtccgtaaagtcgcctctgcatatttgtcgtgaaacgatggtttgcctgcgcgatgccgatgatgagaccgcggaacttggggtggatgccggcgttgtacttgaggcgggccgcgatgggcttgctcagcgtccggaacgcgagcgagccgagcttcaccagcgggagcaccatcgccctcctcaccgacccctccgatgctgccgccgctctagcctccttgtacggagctcacggaggaggaggcgcggggttctctctccactcatatgacggcgtgttccgtgggcgtaggtgcgcggcggcggagatttttgctctccacgcttactttttcttggagaggaaggaggcggagggaagggcgtagaaagagtgagttggtgcctctcggatccgggatgatgcgtacaggagtcattg

SEQ ID NO: 21842 - DNA, 2518 bp, Zea mays
gtttggttagagggactaaagattagtctctagtttttagtcacatttagtcccttttttgacaaacactaggactaaaatatggaataaaatgatttagtctttagtctttcacatatgtgctaaaagggactaaaccatattaattccacatttacctctcgtttagttcgattgtactaataacaggagaatgttaaatgccattttagtattcttatgagtcatttagtatattcttactatttttagcccctagaaccaaacatgttagagaagtcccctaactaaactttaattcctagactaaagaaaccaaacatggcctaatcctatggaaccaaataccaaatagacggcccttaatttattctaaaaagcaacgaagaagctgtaaaataagttaagctacgacaaatctgtgaaataagttaagctacgactaaaaggggagactgttgcagaagctactgtttggtacttctatttaaatctatctcctgcttaaatctatgaagaagctgtgaaataagttaagctacgacaaacatggtctgaatgtcatgtcgccgatccgatcaacctataaggcgataacaacttcgattcagttgtaccacaacgtaaccctcagcctttcgccagctactgaagtcgaatcaattatgtaacggagtaaaatgcaagctaaacagaggcagtctgcagtcggccatccagatcgcgagctgtcgacagttgcagaagtagagcaatcacgcagctgttgggtgctgagtaccagcaggctgtgccgccgcctgggcagtgccgaagccgcgaagcccgggaagggtccacttcgagtactgccgctccatctcgctaatcttgtgtttcattacctgtacttccagcgctagttgctcctcccttttctttatcccctgtcatttgaacatgaataattaactaagatcgaatttgtgttctgccttgcatgtgttcaagagatatcctggcagcgtaatgttttcattaaaaaagtgaacaaatgattccaagagaatagttggaggcagttgtctcacctcaatttccagacgacgggcctcctcttttctggcttctgacctagcacttctttgcacctcatagataatcgcagcaccagcgacctgagaaattatatgtgagtccacgtcagtacttgtcatttctagggcctgaggagtcgttgcagaagtaagaaaatatgttctagaacgatcgggttttgtttctcgtcatacatgaaaacaaaaaggcgtcaacccttttcagttcatattacttcgaaaaagaccaatgcaagccaagaacacttgccgagaaaacaaatagttcaccgagaagatctgcggcagcttgaatagctttctcctcattcaggggccgaatgtgaatgtcagtcgcacgtccgtaaagtcgcctctgcatatttgtcgtgaaacgatggtttgcctgtaaatgtatgccacaaaacgtgtcagttacaactgtcccataatgtatggtgcagagcaatgtgattccattcttgctagttcagaagtcagaaccagaatctattcagtttacagtaagagagcagtacagtaagatgccaagaaaatagccatgacagcaataggataacagagcaatgctgttaacctgctgcattttcagttgttgtgcaatgcaaaactcattgtgaaatttttcctcaggctatgaccagtagtagatcatgcatatagctgtacaaaactgtgttacactgcagaatgcatcgtttacatagtgtagtttgaaataggagaagcaatgattaagactgctagagatagccttcgaagagctgaacaacatttctatatccaagacgttatttcctccagacaatgtgcccacatcatcaacattgaagaagtattttacaaggactattgcagactttttttcctgaccacacccatgactcatgggagcctccagaactgggttcgtccttcattgcggacttacttttgttttagaaaaaatcacttcaatgccattcaaacttatatcaattccttcaatgccatcagaatttatagcttcccttgaatcccttcaatgtcatcaaatttaaattttaatcatttaaataccatcgccgttagtttgaagttaacgtcgttagttccatttaaagcaaatccctccaatgccatcaaaatctatactgatcccttcaatgtcactaaaattaattcggtctatttaggtttaaaaaattccagaataaaaataatatggaccagatttttaaaaattccacgatttttaaaaacttcagtccatacattttgaaacctcaaaattactccgatatattagttcgatctatttgaaagaaatatatgaaaaactgaatagatcgaatcggtataaatgaataaccgcatagttttctgggttctaaaaaatatggactgaaattttaaaaaatttatttaaatattaataggac

SEQ ID NO: 21843 - DNA, 1287 bp, Zea mays
  misc_feature (1136)..(1136): n is a, c, g, or t
  misc_feature (1153)..(1153): n is a, c, g, or t
  misc_feature (1261)..(1261): n is a, c, g, or t
ggccggccgggccgccgccacagaacaactttctccttcttccgcgctgtcgccgtcctcctctcaccccaatctgctcggactctgatcgcagcggacgcgcatccagccagctcggattcaacctctctcccggggaaaggatggagttcgggaggaagcccttgagccttgtggagctctgcgtgcggaaggccatcgacaacctccgctacatgggcagcgtcgacggcgtcgagatggatctgctcaagcgcatcctgccgcactgcacgatggagcagctcacccgcgtagagaacagcaccgagatggatcttagcttggtaactgatccgctgtggaggcgattctaccagcgagaattcggtcaggagcatacgagcaaagtcatcgcaaggctgaaggagcttgggcaaaaaacgccgtacacatggagggagctcttcgcggcgaaaaaagagaaacagaaggaagttgaggataagatgcttgacaaattcacaaagaagtttcaggcagagagagctgagaaacaaagcaagcaaatcaaactctgtacaaaggtgcctccaagcagcaaaaggagtttctttggaggaagtggacctagcagtgtatccagttccagctacaagagccctatactgaagaaggctaggatagaggttaacagtcgagcaaggttgcagtctgctatgcaaaagaatacttttgcgaggtcatctcagccaataaggacgacctctgttagtggacagccagtgagaacaactaccattcatagacccaattcaaccgtcaccatcaccaaaccgatgggaaaaagcaggcaaattcagaacagcaggcccaaattctaggaaacggtttgctgcgatatcgcaatttcaactccagagctcatatgtcctctgaagaaagcgcctcctttgtacaaaaggagtagcacaccgtactcattttttttttggcaaaggagagacgtgccaattgtaacgtaaaaggcgttaccattgtttgtaacaaacgatttcttgtattaaagggaaaaaagggtttgtttcaaaaaaaaaaaaaaaaaaaaaaaaaaaaaaaaaaaaaaaaaaaaaaaaacccccccccgaccgagccgncgaacttcacccctgcncttctctcccttctccgtccaggccctggtgcccgagcgttctcgtgcggcaagtgggcgccgccgccggactacgccaggtgcccagttcctcgtcgggtccttcgncgacgacgagcacccaccaaaaattc

SEQ ID NO: 21844 - DNA, 2248 bp, Zea mays
gagatgggtatgggataagttttgcacctatgatgggtatggagatgaatcaaacatgacgggatgggtctaggatgctataacccggtggggaattccccattgacatctctattagtgcctcgtggtgggtaaagatcatccttctgatagcagcttctgttggaacataatataagtgaattgtccacctcctcctatcagtttaagttttaggttaaactgactggtgcatgcaacttaatagcttcattttcataccaacttataaacatttccatttcaacaataaacacataaacattttttactagtaataactctatctgtttcaagttataaaacattttagctttttaaaatcaattgcttttagtatctatatattttttataatttataatagaaggagtactattgatattttcgtaaaagtccatccatttgcatatgagaaacgcatgattcaaatgaaaaccttatagtctatacataatagatcaatccaaacaggtccactccctgtggacggcgtgaagattactattttgggtcaagcggcctgatttgcgagattaatccggcccgcaaaaatcccggttcatgggccatccaatctgcttctggtcggaccggcccaaggtccgcccgaccctcatctgacggcatgccagccaactatatcgacgaacagaacaactttctccttcttccgcgctgtcgccggcccccgcgcaccccgggctgctcggactctgatcgcagcggacgcgcatccagccagctcggattctacctctctcccgggtaagacgccgggcctcgcttcggcggatgtgggttaccctattttttcccccttcctctactcgacgaattccgttccataggatatataggatctcttaatctttcccagccgccgcgagccgaggagtcagatcgaaacctttctttttcggcggaataagtcattcgtcttcggccgattgaattactaaggtaggtgggtgctccttgtttcgccagggaaaggatggagttcgggaggaagcccttgagccttgtggagctctgcgtgcggaaggccatcgacaacctccgctacatgggcagcgtcgacggcgtcgagatggatctgctcaagcgcatcctgccgcactgcacgatggagcagctcacccgcgtagagaacagcaccgagatggatcttagcttggtaactgatccgctgtggaggcgattctaccagcgagaattcggtcaggagcatacgagcaaagtcatcgcaaggctgaaggagcttgggcaaaaaacgccgtacacatggagggagctcttcgcggcgaaaaaagagaaacagaaggaagttgaggataagatgcttgacaaattcacaaagaagtttcaggcagagagagctgagaaacaaagcaagcaaatcaaactctgtacaaaggtgcctccaagcagcaaaaggagtttctttggaggaagtggacctagcagtgtatccagttccagctacaagagccctatactgaagaaggctaggatagaggttaacagtcgagcaagattgcagtctgctatgcaaaagaatacttttgcgaggtcatctcagccaataaggacgacctctgttagtggacagccagtgagaacaactaccattcataggcccaattcaaccgtcaccatcaccaaaccgatgggaaaaagcaggcaaattcagaacagcaggcccaaattctaggaaacggtttgctgcgatatcgcaatttcaactccagagctcatatgtcctctgaagaaagcgcctcctttgtacaaaaggagtagcaccccgtactcatttttttttttggcaaaggagagacgtgccaattgtaacgtaaaaggcgttaccaatgtttgtaacaaacgatttcttgtattaaagaaaaaagggtttgtttcttggtttctctctttattatcatgcaaatggttactgaattatagaaaataccaggcaaatggttaatgaattatagaggataccaaaagctgggagagagaggcataaacttcgcctctattttcacatcaaagacaatctccggaattaaagcaaacggcattttttcatcaccaacgtagcattttagtcctaagcaagttggattttagtcctaagcaagttgggttaggctagaattaaaacccaacaagatatcaccaaaagaagaaagagagagaaaagaga

SEQ ID NO: 21845 - DNA, 2322 bp, Zea mays
aggcgtgacaaactatggtaagttaggcagcaaaccaaacagcccctaaagccagttgttcggactgttacaactgtaatccataaaaatagaacactgtaaaagtagtaaaagccggtatggattaaagccaaacaaataggcctgtgattacaatgatgcaatgcacaccacacgaatgatccatctcggaacctaaggaaaataaaaaggcaattcgagatttctttttccccaatctcgaattatctctcgatcaggagccagtacagcttcagcagcagcaccacccaccactccgagttcagtgtagacacaatcatccagtgtagtatatggcatgaaagatgaaatggttgtttcctctaatgccgtcccatctgttgcagtacggccccgacgagatgcagggagccggtcacgcagatgaggcctggagccgtgcctctgctctccaggagctgggaggcagcaacgatcaggttcgaggagaacggcgccacgtcttggcacccgatcaccatgggctttcttccggaattcgacgatggactgcagtccaagagatcaccaatgtgctctggggtttcagcaccactgacgccaccgatgtccacgtactcgatgccacgatcgcgtgccgcggctatccatacttctttcagggacgaggctggcattgcgcgggaggttcctccggcgacgctcgcctctgtcagcagcacaacgtcaggcgtttgacctgagagaagctgctcggcaaacgcaagatgctccttgtcactagccattccgacaacaagcgctagaggcccttctggtctgacagtttttatcacgcctgataaagcctttgcagattcctcagtatgagctccatcaattagtacagtggatgcgctatcgaacccaagtgccgaggcttcctctgctgtgagaaactggctcctaccaggaagttgggtctcctctaagccggcttggatagaagcgtcagagatatcccatccttgactacagagacagagagctgcgcaagcagctgtgacagcattctgacgttgatgatctcccagcagctggaggtttatgtcatgcatttcaatcgacaagggtacatcccttgaaatcttaatgctgatgtaacagcgttgatacggcttaccattatcccaatctatgcattttgtaaagctcttgatgccatgaccacaagcagatatcacgggagattgtgtcaagaatgccctgtcacgaataatttgctcaatatcttctgaaaatggtccaccaatcacaaccggtcgtccttgtttgatgattccagactttgctattgctatgctttgcagggagccacccaatgcaaccagatgttccctccctactgttgttatgacagatgctgctaattcagtacttcgaataacatttgttgcatccctagctccaccaagacctgcttcaatgatggcaatgtcaacattctgttgggagaatagaagaaatgagagagcagtaaaaacctcaaaatgtgtcagggatccattttccgattctattgcttcatcaatggctttcttagcctcgtcaaaaagatcactcaacagtcgtactggaacagggcctccatcatttccaacagaaatccgttcacgtattgttagaagatgtggactagaataacagcctacattgtagccttgggccctcatgatattggacaggaatgcagcagtagaacctttccccttggtgccggcgatatgcacagccgggaagtgggtgtgggggtcgccgagccggcggaggagccggcgcatgcgtccgaggtcgaacccgtcgtcggagtcggtgccggcgccgcgcggcacgcccgagcgctcgtagttgcgcagccgctccatgtagtcgaagaaacccgcgagcggaccctccgcctcgccaccggccatgatggtcaggccgcggcgggccatgatgctcctcctcagcagcagaccatgtgggaggcggagggcggtagggaagcggtggccgagcatccgtcgcggccgtgcggcggcggcgggaggcgacgtagagcgcgcgatcgcggatgtgacgcgcagatgctccttgccacgggatacagataaatgttgggttaaggcttgagcggtggttgggtcggctggtgcggactgtggggacgacgccggagtcgggcagcggaggacgagcgcgaggagacgacagacgacgaggagggagcagaggaggagcataccaatggcaacgggtaaaatgctttcgcgcttaatcactcctgcgcccggccgg

SEQ ID NO: 21846 - DNA, 963 bp, Zea mays
  misc_feature (844)..(844): n is a, c, g, or t
ctttgggctctcaccataatgtgcgccttcagaagaaagagtggctagacaagcatctgaaaacccaagatccttcagtgactcttcaaatctaatcggcagtcaagaaaagcacagtgcagttccgaccaaaactatgtgtctcagggtttcagcttcgatgcatctcctatatacagctcctgcttagcataaacgtaccagaataaataggtcctcaaacctgtaggcattcttacaagtgcatcatttcctaatactagtgcctccaattggatccatggcacctgaagatgcaacatctgctgatacaatcagttgagatgttctaccgaggcaatgccaatcttgctttccgaactaaatcaaaccaaagaggatacatcgcatcgctgtggccatcaaaccgccgcttacccgacctgagcactgaacgcgacacgctgaggcatctatctccagggtccccaaccttcccgacatctccatcttccacatccacatcgatcacggggtgttgtgcgtccgggggctcgtagccaaaggaagcgaggtgcgactggagggcgtcggcgtggcgcgcgtagactttgagcgcctcgccgcagtggccgaggagctcctcgaaggagacggtgtcgagggcgatggactcgatgtgctgcaagtcggcggccgacgcctccaccctgtgctccagcttctgcaggaacgaggtcctcgccatctcgaggtggacggggcgttgggagacggcgtcggcgagctcgcgggacgaggactcagcgtggtttagcaccgacgagaggaactcgcatgcggctctgatggactgatccatccncccctctcactgtctctttggcccggcggcgatgaggggcggggctcgccggagacggcgaaggggatttgtggacttttgttcgaaactttcggtttttttttcccggccgggccctc

SEQ ID NO: 21847 - DNA, 1318 bp, Zea mays
atgcatctcccaggtgaattgcagggagatgagcggtgcctcaaacacactttatttcatggttggaatgaagatcacatgaccagaactgctcagaaaaaaaaaacaatattttgagctgagatcgagtgctacatcaacatgatacaatattctagccagactcgacatacgaaaagaaaaaggaaaacttaagcatgacacgctgtagcagtagcagtatcaggctacacgttgttcttgcacagggtgtaaaaggtagagccatcaactgtctccatagttagctgattgagtcgcaacagcatcagcaaacaggctcttcctttgcgccccaatcctatctctgcaacacggtcctggttcaaagcaacactcccctgcaacttgtcaccacccaagtatgaatttagtttggatattccctcctgcaactcctcccatgatgctagactcttcatataaggagggagttgctcataatcctcctttgatgcccttatcactccttcaaaagaattaccttgaccatttctttcatttaggggagtcataatttcagcttcattcatgatcttttcgccatcatcagtactttcagcattcttgtaaagcttctttgggctctcaccataatgtgcgccttcagaagaaagagtggctagacaagcatctgaaaacccaagatccttcagtgactcttcaaatatcgcatcgctgtggctatcaaaccgccgcttacccgacctgagcactgaacgcgacacgctgaggcatctatctccagggtccccaaccttcccgacatctccatcttccacatccacatcgatctcggggtgttgtgcgtccgggggctcgtagccaaaggaagcgaggtgcgactggagggcgtcggcgtggcgcgcgtagactttgagcgcctcgccgcagtggccgaggagctcctcgaaggagacggtgtcgagggcgatggactcgatgtgctgcaagtcggcggccgacgcctccaccctgtgctccagcttctgcaggaacgaggtcctcgccatctcgaggtggacggggcgttgggagacggcgtcggcgagctcgcgggacgaggactcagcgtggtttagcaccgacgagaggaactcgcatgcggttctgatggactgatccatcccccctctcactgtctctttggcgcggcggcgatgaggggcggggctcgccggagacggcgaaggggatttgtggacttttgttcgaaactttcgggaggggcccgcgggcctcccgatgcccggttatcggaatcccggccggcctcgag

SEQ ID NO: 21848 - DNA, 1797 bp, Zea mays
gcacgagaccattacctagaacatcctaatcgaaaaacaatggcatcctcctcttccctggcctccgccaaagccctagcacgctcccacgcgtccctcctcgcgccccaaacccagagaacaggtacccggtgtctcgctttctttctcgcaggattctctcgcccggtccgtgtctcgcggctccgtgccgggcaattcaagctgctccccttcgacgatccgtcttcctccgtcactctgctgatggcttctgcacttcagcgcctgtatgtatctactgaatatgagcttggactttgattctcgtgccgtgatgcagtgctcgcgccagcgccgtcgcgctcgcgccgcacctccgtcaggatgcgcgcctctgctgctgcgccggcggagccgaagaagaccgtctgggtgtggaccgagagccggcaggtgatgacggcggccgtggagagggggtggagcactttcctcttcggatccaaagacctcggcaaggactggtcatgtcagagctcacaacagtgcttcccttcattccacactaatcgaatctttgctgttccagcatctagatagatgtcgagatagcctggctggatccctggttcaaactgttgcaatttacaaatcccaaaagcaaactcagactctgctgacttcacgactcattggtgttctcatctgatttttcagcaaccgctcgcataaatcctctcttcattgacggtccagagattttcgatgaggagaaccagaaggttgctgtaatttcacacgtatcttcgcccggtgaacttgaccttgtacaaccggacgacgccgaagccaacagcattgtcatagactttcgaggtggctggcaggttataccggcagaaaatatagttgctgcattccaaggatgtaaaggaaatgtattggctgtatcaacgaacacaactgaggcgcaagtttttcttgaggccttggagcaagggcttgatggagttgtacttaaagtagatgacatggatgatatcattaagctcaaggaacgaggcaaagagtcaattaccattgacaaaggctactgtaacaaaggtcgaggttgttggtatgggtgatcgcgtttgtgtggatctttgcagtatcatgcgacctggcgaaggccttctggttggatcctatgcgagaggaatgtttcttgtgcattctgaatgcttggagactaattacattgcaagcaggcctttcagagtcaatgcagggcctgtacatgcatatgtcaccgttcctggtggcaagacaagctacctctcagagttggggtcaggaaaggaagtcatcgtgatcaatcagagtgggctatggcgtactgcaattgtcggtcgtgtgaagatcgaatcaaggcctctgatccttgtagaagcgaaggataactctggagacgagacgtatagcatttttctacaaaacgcagaaacagttgcacttattacccctaacacaggatcaagtggaaggaccgctattcctgtgacttcgctgaaagtcggtgatgaagttctggtgaggaaacagggcgccgcccgtcacactgggatagagattcaggagtttattgttgagagatgaaaatggaaacgctgaatgcaccacttttacgtcgttttgaacaaaaaaaatgatgtatgattttgaacaaaaaaatgatgtatgattgcaacattcatctgttctgctattggtcaagattgtgagattcagagcgccccaaaaaaaaaaaaaaagggcggccgccaccgcggtgga

SEQ ID NO: 21849 - DNA, 1438 bp, Zea mays
ccgggtaaaaaaaaaaaaaaaaaaaggctcttccgatgattcagccatacaatggcatcctcctcttccttggcctccgccaaagccctagcacgctcccacgcgtccctcctcgcgccccaaacccagagaacagtggtcgcgccagcgccgtcgcgctcgcgccgcgcctccgtcaggatgcgcgcctctgctgccgcgccggcggagccgaagaagaccgtctgggtgtggaccgagagccggcaggtgatgacggcggccgtggagagggggtggagcactttcctcttcggatccaaagacctcggcaaggactggtcatcaaccgctcgcataaatgctctcttcattgacggtccagggattttcgatgaggagaaccagaaggttgctgtaatttcacaagtctcttcgcccggtgaacttgaccttgtacaaccggacaacgccgaagccgagaacattgtcatagactttcgaggtggctggcaggttatacgggcagaaaatatagttgctgcattccaaggatgtaaaggaaatgtattggctgtatcaacgaacacaactgaggcgcaagtttttcttgaggccttggagcaagggcttgatggagttgtacttaaagtagatgacatggatgatatcattaagctcaaggattattttgatcgaaggaacgaggcaaagagtcaattaccattgacaaaggctactgtaacaaaggtcgaggttgttggtatgggtgatcgcgtttgtgtggatctttgcagtatcatgcgacctggcgaaggccttctggttggatcgtatgccagaggaatgtttcttgttcattctgaatgcttggagactaattacattgcaagcaggcctttcagagtcaatgcggggcctgtacatgcatatgtcaccgttcctggtggcaagacaagctacctctcagagttggggtcaggaaaggaagtcatcgtgatcaatcagagtgggctatggcgtactgcaattgtcggtcgtgtgaagatcgaatcaaggcctctgatccttgtagaagcgaaggataactctggagacgagacgtatagcatttttctacaaaacgcagaaacagttgcacttattacccctaacacaggatcaagtggaaggaccgccattcccgtgacttcgctgaaagtcggtgatgaagttctggtgaggaaacagggcgccgcccgtcacactgggatagagattcaggagtttattgttgagagatgaaaatggaaacgctgaatgcaccagtttcacgtcgttttgaacaaaaaaatgatgtatgattgcaacattcatctgttctgttggttaagattgtgagattccattgcagcataaaaaaaaaaaaaaccattgcaacgtacaataatagatcaagacattgatgccaaaaaagaaa

SEQ ID NO: 21850 - DNA, 879 bp, Zea mays
  misc_feature (862)..(862): n is a, c, g, or t
acaatggcatcctcctcttccttggcctccgccaaagccctagcacgctcccacgcgtccctcctcgcgccccaaacccagagaacaggtacccggtgtctcgctttctttctcgcaggattctctcgcccggtccctcagtccggtccgtgtctcgcggctccgtgcgaccgtgccgggcaattcaagctgctccccttcgacgatccgtcttccgccgtcactctgccgatggcttctgcacttcagcgcctgtatgtatctactgaatatgagcttggactttgattctcgtgccgtgatgcagtggtcgcgccagcgccgtcgcgctcgcgccgcgcctccgtcaggatgcgcgcctctgctgccgcgccggcggagccgaagaagaccgtctgggtgtggaccgagagccggcaggtgatgacggcggccgtggagagggggtggagcactttcctcttcggatccaaagacctcggcaaggactggtcatcaaccgctcgcataaatgctctcttcattgacggtccagggattttcgatgaggagaaccagaaggttgctgtaatttcacaagtctcttcgcccggtgaacttgaccttgtacaaccggacaacgccgaagccgagaacattgtcatagactttcgaggtggctggcaggttatacgggcagaaaatatagttgctgcattccaaggatgtaaaggaaatgtattggctgtatcaacgaacacaactgaggcgcaagtttttcttgaggccttggagcaagggcttgatggagttgtacttaaagtagatgacatggatgatatcattaagctcaaggattattttgatcgaaggaacgaggcanagagtcaattaccattg

SEQ ID NO: 21851 - DNA, 4743 bp, Zea mays
agaagcgaagtatggcatctcataggcagaagctatctatatatcaaatgtcaggtgactagagcgaaacacagcaagctggctccgtccgaacaatcaaatctcaaaccatttttaagtctagacgtcctgaatgggagcggagatgaactacccatgtatctgctggacaaacaaggcagacactatcgaagcttcgactcatttgacctgctgctccggaagtttgagagtgagaagaacgacctgcatgctggaagtaccgtgacagatgggttagcaacgtcctaattcgatcacatcacattacattgtttggcgagaactaacctcttgttgatgtggcagcacctgatctctcccgtagcttatccgagttcaaagagttgaagctgccggtagttgattgagctgaaaatgaatatgctaagatttatgcatgaccatgaaaaccttttctccaagaaatgcatgaccttcaaacattaacactactgagctaatttgatcaagcatagaaagatgaaatgcttcaacaaaaaagttctgcctagtagtgggtaggtaaagctgtaaaatttgtgcgtgatgccatgaggttaacgtaattggaaatgtgcttgtctatacaaactctcatatcatcactacctggtgtcagcacaaggtcagaccatataatcatttttaaatcatggatgtaattatcaaaaagccttgacagacaccaactatatcggtactgagattgctcctataaaagttaagacttggatgcagaaccatcttcaaaaccatggttcggaaaggtacctgataagatgctattagtctttgaaccatcaaaagttctcctgcttgaatttgtaccatcactagtgcctcttggttcttctagttcatcttctccttctgaaactaccgaggggcttgcccagccgttagcattgttgtctcccttgttttttcgagcaaactttagaagcctcttgaatccttttggagaatccttatgaaaaactattgcgggtgggttttcagcatttccccactcaataatttctggttcattgctatctgcttgcagcatttgtgacaacgaatgacgcactcttgggcttgatgacggcaatggtgcaattcctggagaagttacatcctcaacaactacattttcactcgaaacagtgacttctagttcttgacgctctacttctacccacgcagatgatgagatgcccatgtcatcgtcaggaggttgtatggcctcatctaactcatccgtagagggttcaacttggatactggagcccatttctgttgcagttaaactcgaggccggtttctctgttttttcaatattcaagtcattatcgagcgaaatttctaaattttcatcaacatcatgtgctggttgagcaagatcagcctccagtaccttagtagttggctcggttgtcacaggagattgctccttatcttcagcttggttaacacttccggtatcttttgagaagtcattaggttggggtaccttattcttcaccataccagacctaatgctctgactaattccagtggttttcttcaaggttttggactcaagaggtacaacactgcttttatttgaaaccttttgcaagctttgcttcgtttttacacctgatttttcttctgaaggtgaaactttagttattctgcttgtctttgttgctgttttggtcttcttctcttcttgtccctttatagctggcttggtagcagtaatggtttccttcttgttcttcactgattgaatggccctttccgcttttgaagctggctgagacggcgagggcgttgttggagtccttcggctagtttgtgtggacgttgaagccatcccaggagaccttttagttttttgtgttgtagttgctttagtcaaagaaccacctgaccatgaactacgtgtagtaggcacagatgcaggtgcaggtgatggtttcggtgagcttttcctgactggtggtgtctttgatgctacttctttcggtaggactggaggtgatgaatttcgccgcgccctttgtggaactggtgaaatacgtctctctgttgaagagccagatttcgaggtcattgctggtttattcttcccagctgtttccttcaagggcttggtgcttggttcctttgctggtcgccttgtgcctttctcagttctgacttttgtgtctcgcttctctgtatgctggccatgagatacagctttttgctgattggtggaactgagacctgtagcggtggcattagcacccgcaaatttcccaggcatgacttccatcattttcaataacatctgattaagctcggcttccttctggcgattccactcagcggaggccattgcccgatcactgctttcctccagaccaggctttgcttgttctgcacaaacattactacaaacagcactctccgtttctgacactctaatctcatgagaattagcatggaaagttaaatcttcagcctcaggtgtaacaaaaaaatttggtatgttacctagttcagccttcatttcagcttcaaccttctcagtttcagaagctatgttgtttgatttactttcagatgtggaatctgagacttttccttctgagttttcattcaaagaatcacccattcctgcactccaccttctcaagacagacttagtggcaaacaagccagctttcttattttgtgaatctggattctgatccttctgcttgctctcaaaaaggttaattgcatcctgaacactcatccttctaacgttagtgtcagatttctttggtggctgatcagtttcaccattgaaggtactactttcatcatctttatccataggaatcctctgactaggagggaagtaactgaggctcttgatagcaattgctgttgaacgacgtgatcctgatctcccaatttgaaccctccgcattggagaagcagatcttctaggtgaagcagatcttacaagaggacggctcctttcaacaatggcctcaccttcatcactggattcagaggaatcatcactttctgttgagctctcacgctcaatttgtgcaagctttgctggagatacattattggcaatgggcatctgaagattagtctgaggactgatgcaaggtttatgtgcattctcatccttgtcaactttctcagttgtagaattctgctgtagtgggagctcagagggcttacaatccgatatcaacaacgtacaccgcatcaaccaactagcaaacaagaaagaccccctgttaattccttgtctcaactaaacaacataatgaatacacaattctaaagattggacgcatcatataaatgtaagagcaaacaattccaagtgaccaagttggtaagtttatgaatgactagaaggcacacttgtagccaactagcattatttgtactctctgatcgtacaaaatgagataaaatgcagagcaccatgctttttaacataccaaaactctgatgttccaaatcgctgaacaaaagcagataaatcagatatttctcttgccgataaattggatccaactgctcggttcaatacgaccaagatctcttccttcagtgcagttaatctcaaatccagtgctcgaagcaattcattcctagcatatttaaccatcgcaaatgtcaaccaaatgaggtagcaaagtaaagtagcagagaaaaggaaaggaattttactttgtcgtatccgatgaatttggcccatcatttccctaaaagtggtgtttaaaaattaagtaggtgaatcatgaaagagtaaaaccatgtaatattaaatccttgcagcactagaaattacctgctgtgctatggcaccagtaccaaataaacctcctgaagaaacagaacgtcatattaaactaatgtctaccattataaggtcgaaagagtttcaggaatgttaatatcacatggaatatgaacagactttcatgtttggatattaacaggaataactaccacataagcactagcagttgtgtctacatatttcatggtttttatgtgcatttgcatatatacacaaatttgtgaagtatggaagttcaagcggagccttgatacaatgtttggtgaaaagaaaatgagaacatacgtgatgcacatgagagcttggtgcacatggtgcatatactaaatcatcagcatccattcttaaatctaacatttctagttgctcagtatattttgcaaagaacaccattctgaagtggtggagtggagtggtggaaggtgttatttgtaaaatataacaggcaactagagacgttagatctaagatgtatgatgatgatttaatatatgcatcatatgcaccagatatgttctcaaagaaaatgtagttaaacttcaacagtgctacctttagagcataatgagttttgccagtaaaaaatacatgagaaaagcacgagttagacccatggaaacgtagatgagtacattgaaattacaggttatcaactaaagtccaagcatctgttggaaggaagggttattctcagaagatacagctgacaactatttcttcaataataataagcaagtaaatcaagggtacaatatttgtgggactgattgtctataatagattatcaaccagaaagcgatgtgattcaccgaaaggtcaactaagagcatgattacattacagatgaaagttggatcccacaacctacatta

SEQ ID NO: 21852 - DNA, 2758 bp, Zea mays
  misc_feature (21)..(97): n is a, c, g, or t
atgtgccatgccagttaagtnnnnnnnnnnnnnnnnnnnnnnnnnnnnnnnnnnnnnnnnnnnnnnnnnnnnnnnnnnnnnnnnnnnnnnnnnnnnnccgggctcgagttttttttttttttttttcaagcaaatatcaaccaatatatagttgttcattccaaataactcaactaataaagaagaataagtggcaccctagtcagtgggcatctattagactgtacacagaccacactctgaatctattgctaaccctgttcactttacagaccgcacaccaacacttctgactttaaacttgtactgtggcagctcatcttcctcatcgtcctcgtcttcacttgaatcctcttcaattttgtcccattttgagtagtcaaggcctgaatgactcttcggttttgggatggcttcccaaccctggggttttgaaggcgaagtggacggaaccacagcctttagaggttcagttgcaggttttctatggagaattggtccagctgaaggtttgttctcgaggaccagtttggttgctggttggtcaggcttagcgatagaagaagtgtcggtcttctgaactcgtggaggaagttcttcctcttcctcttcacgacaaagggactcctcttcacactcaggaattggggccagtgacttcaaaacagtacggcagcgggccggataaaaaggtcagcaaagtacacaaggcacaattaggcaaggatgtcagtgaggtgaaccgaagtaaattagcaaagagagcgaaaactgaaaacatactagctgtgtcttcaatcgtgcctgcaggttccgatacacttcagacgacgggtttatctcaacgagcctgttgacatcaaacagagctgactgataatccttcagagtgacgagagtctgggcacgtaacatcagagctccagcatgctccgtatccaactcgaggacagatgtacactcttgtgctgcctgcatcagatctcacaaatggagaatttaatattagaaacaataaatgatgtctgtagttaccggatgattccagaggaacgcatactgctattgtcagggccagggccaatacaaacaataactataccctcttactagctttcgtagtagataatcaattataagccatttgccgtcccttaaatttcaggggcccaaatcaagggaatcatttgagtagggccattcataaatttcaggtaatttttttccaggtaccgtgcctagcctgttttctagtacttttgctatttttgtaaggcaacggcaagcaaaacataagcagctgcatcttctcaagttgactccatcaatctaatgcatcttctcatgctgactccaatgaatctaatggaatcagtacaacacaaaatttactgccaactgaggtaagtgcgcaaagatcaccataacaaacaaaagctagacagaagattagtggatcctggacataacagtaccagtccatgcgcacaaatacccagtacaaattgagcatgcatattgttgtatgacgagcagaaaacacaatctacgagaccgaaatcgcaggagcccctgaaccctgaacccggaacaggacagctgtatttcgaccaaaactgacacttggaagcgccgaaggaacgccccttccccgaagtcaccaccgaggcgaggtggggaccaaaagcgacgacgcaatctgtgcaggaaagcaacccaaacccacccagagcagagggagccgggagtgggaccttgtggaagtcgtggagctttaggtagcaggcggcgcggttgctgtggagcgcgatgcgctgcgcggggccccgcgccgcagccagcgcggcggagtagagctccagcgcctcccggtggcggccgccgcggtagagcccgtgcgccctctccaccgcctccgcgccggcgccctcggcagcccccgccatcgtccgcgcgaagaacccggcggcggctctggggccgagtgaatcggagatgggatttggaatccggggagataatcacgagggggtggaggtggggggcgaggagtatgacgagacgagatgatgacggaggggggatttgaattgagggggtccggtccgggtacatggatgcctcgtgcacggttgcgggttgttgggttttgctgcccgagaccgcgcgaggaacacggctccagcctccaggctcacctgggctgggcctgcgcgggggttatatgtgcaattgacggatttgccccctcgtcgaaccttccgactcggcgttcatacaagcgaaatttgtgtagagatgttgaacctgcgtgtttgactctattttttcttcaccgacaagaaaaggttactttgatccacaaaaggagtgatttgtttatatataattaaagagtgtgcacttccatagtcccatgaatgagttgtgttttcagaaaagaaaaaaagtggctggagatgctgctctttactggtagttgggattgtgcacaattaggtagagatgaaaaatggacgaatgaacccccccctcccctcaccaagaaaccatatttcgtttttacttggtctgtttccgtattcacaggaaaacgataacggttcaatgtttttgttcgtatttccaaaatctcgtgaaaacacgggtttacccgttttagtcacacaagcgggatagagaacacataaaacaatagacaaaaatgtaccgccttagctccaccctctatgatctgcttgcttagtgattatctatt

SEQ ID NO: 21853 - DNA, 1072 bp, Zea mays
tttttttttttttttttaagggagactcttggagatcctcttatctctgattcaagcaaatatcaaccaatatatagttgttcattccaaataactcaactaataaagaagaataagtggcaccctagtcagtgggcatctattagactgtacacagaccacactctgaatctattgctaaccctgttcactttacagaccgcacaccaacacttctgactttaaacttgtactgtggaagctcatcttcctcatcgtcctcgtcttcacttgaatcctcttcaattttgtcccattttgagtagtcaaggcctgaatgactcttcggttttgggatggcttcccaaccctggggttttgaaggcgaagtggacggaaccacagcctttagaggttcagttgcaggttttctatggagaattggtccagctgaaggtttgttctcgaggaccagtttggttgctggttggtcaggcttagcgatagaagaagtgtcggtcttctgaactcgtggaggaagttcttcctcttcctcttcacgacaaagggactcctcttcacactcaggaattggggccagtgatagctgtgtcttcaatcgtgcctgcaggttccgatacacttcagacgacgggtttatctcaatgagcctgttgacatcaaacagagctgactgataatccttcagagtgacgagagtctgggcacgtaacatcagagctccagcatgctccgtatccaactcgaggacagatgtacactcttgtgctgccttgtggaagtcgtggagctttaggtagcaggcggcgcggttgctgtggagcgcgatgcgctgcgcggggctacgcgccgcagccagcgcggcggagtagagctccagcgcctcccggtggcggccgccgcggtagagcccgtgcgccctctccaccgcctccgcgccggcgccctcggcagcccccgccatcgtccgcgcgaagaacccggcggcggctcgggggccgagtgaatcggagatgggatttggaatccggggagataatctcttcgattaggatgttctaggtaatggtct

SEQ ID NO: 21854 - DNA, 1008 bp, Zea mays
gggtacctcgaggccggccgcggcctatccgagtccacccaactaatcacgcccaatcagaacagactcggtcgcttcaccactccactcgccgcaggccgccgggcgccgccgaggggatcggagcaagatgttcttccacatcgtgctggagcggaacatgcagctgcacccacgacacttcgggccgcacctccgcgacaagctcgtttccaagctcatcaaggacgtcgagggcacctgcagcgggcggcacgggttcgttgtggcgatcacgggtgtggaggacatcggcaaggggctcatccgggaaggcacgggatacgtcaccttccccgtcaagtaccagtgcgttgtctttagacccttcaagggcgagatcctcgaagctgtcgtcaccatggtgaacaagatgggcttctttgcggaggctgggccggtgcagatcttcgtgtccaaccatttgattccagacgatatggagttccaatcaggagatgtgccgaactacacaacttctgatggatcggtgaaaattcaaaaagagagtgaggtgcggctgaagattattggtactcgtgtcgatgctacagaaattttttgcattggcacaataaaggatgattttctgggtgttatcagcgatcctggtgcggcagtgtaaatggtctaagaagcgagattgtactccattgttctgacttctgagtactatcgcagacgtgtgtaatcgctggtccgttaaaactgcaatggctgtactgactgcggaacttgttgagaatgatgtgactaggaccttgtttagggcctgtttggttctttagtatggccctgattggcacaactgctgcttattgaaaaaacagcttatctgataagctggtgaaaaatagcttctgcttgttgactgcttttagtgtattttgagaagcagctgaactgataagctgctgcagaagctaactgtttggtaaaacttttgcttaaaaaaaaaaaaaagcggcc

SEQ ID NO: 21855 - DNA, 597 bp, Zea mays
  misc_feature (4)..(4): n is a, c, g, or t
  misc_feature (566)..(566): n is a, c, g, or t
  misc_feature (568)..(569): n is a, c, g, or t
  misc_feature (572)..(572): n is a, c, g, or t
  misc_feature (575)..(576): n is a, c, g, or t
  misc_feature (579)..(580): n is a, c, g, or t
  misc_feature (583)..(583): n is a, c, g, or t
  misc_feature (586)..(586): n is a, c, g, or t
  misc_feature (589)..(589): n is a, c, g, or t
cttnttcctgaactgaaaacgctttacggcttgggctgttgttcaatttagttgttgtgtttgcaagtcctggtgacaagttaatttgattatcatggcaccttatagtcccttctgcaccaatattcttcttcactgttccagttaaaggtgagatcacttttgattcctgcatgtcaggaccataatctgtatctcggtctttattggcatcactatcacctatgttctccgccctatcaagaaactgtgcataagatttgtgatgggataaataaaaccttcttgttaagctgctttcaatgactgacaacacaaacaataagataaatttatgtttctcataccaaaaacttgaaataagttctgctctctttggatcatgtgtgaaagaattgatgctaccaaggccgggtatgaattctgttcttgggaaaatgggtgattctgtcacttcgtccccatcttcagtatgaacaatcatagtaccaaaatcacctatatggaaaataatgggggggggggggggactagtgagctctctccctccctgtagcccgggggangnnganganntgnncgnccnccnccgcgggg

SEQ ID NO: 21856 - DNA, 2258 bp, Zea mays
acggggtcaagacagcagaaatcacgcctcccatgatttcgaatagccaacataaataacttttcgtttatttctgcttaactatttctctttatttggagaacaaatgcattgacaacgatacaaaaccaggctacaatatgcgttagtgccacaaaatctgattagcaaaatttgatgccgtctctacatagtgaaactccaagaggctattaacagggacagaaatttccacttccgtagagattcctgtgtcaacccagcttccagtgaccaaagcgtccacaggctaaaacgcagaagccattaggcctgctccacggtaggcacatgtcatgcgttccttcgatcctcagttctccaccacgagcaggatcagtgccacgttcacccttggctccatgcaggcttcggaactccaaaggttgcagccttcactcttgcagatctacaacctcagtattgtgcgaagtgtgtcacaaagattttgtatcgtttgctgctcttgcgtcgcttgtgaatcttgtagcggcatgtcctcatagcacgttttatgataagctagagcttgggccaggttcatcaatgtggggcttgtcgtcagcctgtgatgcacacccggaggaagagggacttcgttttgccctttccgtcctttctttgcctgcccatcaccactgaacagctccctaactgcctccaaagcatcatttgtacttgacccagccaggccatttcctgattcattttctgatactagagctagtggtgaaatgtcaattgccttaagaaatggtattggtacagtgttgccggcagcataaattgaccagagcttatcctgaactgaaaacgctttacggcttgggctgttgttcaatttagttgttgtgtttgcaagtcctggtgacaagttaatttgattatcatggcaccttatagtcccttctgcaccaatattcttcttcactgttccagttaaaggtgagatcacttttgattcctgcatgtcaggaccataatctgtatctcggtctttattggcatcactatcacctatgttctccgcccaaaaacttgaaataagttctgctctctttggatcatgtgtgaaagaattgatgctaccaaggccgggtatgaattctgttcttgggaaaatgggtgattctgtcacttcgtccccatcttcagtatgaacaatcatagtaccaaaatcacctgcctgacaatcattatatgtgccatgtttcatgtgttgctgagaacttgtagggacagtttccccatagtcctcatttattcgaaaaggcacatcttgcgttgtattgtcagggtcagacagctcattttgcacagctagtgtggctctaatcttcttcgctaccttgatctttgccaacattttcgaagctccactattgcacttctcaataaatttgtgcttcagcatctcaattgcagcaggccgaagtctggggtctttagtaagacactttgcaataaaatcatggaagaggagagaccatttctctttatcctccagcataggtgctggttcactagatatcatgaagataactctcattggatgcacagtggatcttggtggcatgccctctgccatctcgattgcagatacacctaatgcccaaacgtctacctttccatcataacgactttcttgaatgacctctggtgccatccaatgtggagtaccaatgaacgtgttgcgctttgacatggttcttgtcagctgggcagctacaccaaaatcacccaacttcacctcgccttgctcagttagaaggatgttgccccccttaatatctctgtgaactttaaaaatggagtgcaggtaagcaaggccctttagtgcttctctacaaatgtaagctatttgggattcatcaagaggctcctctgtgatgcctatcaagtcagcaacacttccaccaccacagtattccataattatccataggtactcctctccttggtagcttccaaagtagcggacaacatttggatggctgcattgctgcagcatctcaatttctccccgtatgtcttcatagccttcttccccccctgtgaatgagatgatcccgccagccgcaagctcctgcggtcgtgagttcccttgctttgtacactgcaccatatgaacctttcccaagctcatggagcagctcgtacttggtggaaggatcctccctggtaacactgtctggcaccgagctgaccgatggcttccg

SEQ ID NO: 21857 - DNA, 1394 bp, Zea mays
aagttctcgtgttctgtctctatccatttgtttactcccgatccccatcagccatggcgataaagtgagggttccaggcggccgccgcttcagggagggctcgcggcggagacaggctcggcgctcgcgcggtcggcaggagctcgcagcgggcaagggctggctctcgggcaggaggtgctcgcagcacggtgctggcaggggtggctcgtggcgcaggcaaggagaagctcacgacaggggcggctaagacttcggtgcgggcacagttgcaggttgcagcagccactcgttgaagatgtttccctctgacgtcgagttactatgaacaattttgatcacttatgtgcttctaccggtagagtgaagaccagaatgacaacataccgttggatagcagagaagtcaatcccatttttgaagaaggatccaaatatgggcgcaaaaaagttacaagaggagctagaggataaatataatgtgaagctaggatactcaacagtgtgggctggtagacagaaggcggtggaacaaatatttggaacatgggaagaaagttttgcagatttgtataggttcaaggcagagattgacgcaaaaatgcctggaagtgttgtcgatttagaggtgcaggaggaagaggatggtgtgtattttcgcagattcttttgttgtttcaaaccaagcattgatggttttctgaacggttgcagaccgtttttgagcgtagactccacagcgctcaatggcagatggaatgggcagttttctgaaaaggaagagtcacgccaaacaagggcgaccattaggatcagcaagtacttgcacgcccaaaaggcaaaaagttgtgcaaaacgagtcaactaatattagtccggggcctgttacaagaagccaatcggcgttatcaacgattggtgaaggctcaagccaggaaatggccacacccaaaaggcaacaagttgtgacaaatcaatcaactaatattagtcctgtccctgtcacaaggaggcaattggcattatcaatgctcgatgaaagcacaagtcaggaattggccacaccttcgagggcaaccaaatccccttccaagcctacatcaaggattgcaaggaagatcactccaagaaaattcaaaaagtgaatgtttttgtgtctacaaaactatgatattggatgcttttgtaatcttaattaattagaacggaggcatttggatgatattttggcatatgtatggattgttgacattaaacttgttattgtgcttgctgttatgcttctgtatgggattattgacatttggatgacatttgggcttaatatttaaatcaaacttgctattatgcttgaaaaacaaaattatttaatttatttaaaaaaaaaaaaaaata

SEQ ID NO: 21858 - DNA, 1486 bp, Zea mays
  misc_feature (1375)..(1375): n is a, c, g, or t
  misc_feature (1406)..(1406): n is a, c, g, or t
  misc_feature (1435)..(1435): n is a, c, g, or t
  misc_feature (1440)..(1440): n is a, c, g, or t
  misc_feature (1464)..(1464): n is a, c, g, or t
gggcgagatctcctctctacaggcagccagagttctaaacttgaagctgggcagcaaaagattgcagcaaattcgtgagatataagattcgccacaccgacacctagatgtcacacgccagcccgcaggtggtatataataatagtgaaaaaaagagaagctgctgctgggatggctgcatttatgcaggcacaccgctgccggcagccacgactggttgggtagtagtaaaaccaggtaggtgaattcggcacgagctggctcgtgcagcggcggcaggcggcagtgagagcgatgagcgcggcggcggcggcggcgagctcggtcaccaagttcatcaagtgcgtcacggtcggcgatggggccgtcgggaagacctgcatgctcatctgctacacctgcaacaagttccccacggattacatccccaccgtatttgacaacttcagcgccaatgtctccgtgggtgggagcatcgtcaacttgggcctctgggacacggcaggccaggaggattacagcaggttgaggcctctcagctacaggggtgctgatgtgttcatcctctccttctccctggtcagcagggcgagctatgagaacgtcctcaagaagtggatgccagagcttcgccgattttcacctactgttcctgtagttcttgttggaaccaaactagatctccgtgaagacagatcttaccttgctgaccattctgctgcttccatcatctctgctgaacagggagaagagctcaggaagcagataggtgctgtggcgtacatagaatgcagctcaaagacacagaggaacgtaaaggctgtgttcgacactgcaattaaagtagtgctgcaaccaccgaggagaagagaagttaccacgaagaaaatgaagacaagttcgaaccagtctctgagaagatacctctgtggaagcggatgtttcacatcgtaaagcacagactcttctgcgactgttgtactggacttgctagatggttgcagctctatgaatgagtagtcccctccgcagccactgggaacttctggttctctgctaccttccgatagagtgctctttgcgttcaccagctgtgcaaaatgaagtgaggttctagtttctaaattccctacgaggtgtaccttctttagtatgaatggtgggctatttagcagttcagcaaagtgtgaagtgacccttctatgcatgttttgtttccaaaaactgatgttgctaaatggctaatgaatggttatggtcgcaccggaagaaaaaaaaaaaaaaaaaactattaaaaaaaaaaaaaaaaaaaaaaaaaaaaaaaaaaaaaaaaaaaaaaaaaaaaaaaaaaaaaaaaaaaaaaaaaaaaaaaaanaaaaaaaaaaaaaaaaaaaaaaaaaaaaaanggggggggccccttaaaaggaaacaaagntaaanacccgggggaggaaaagaaaaagncttttaaagggccccccaaatt

SEQ ID NO: 21859 - DNA, 1244 bp, Zea mays
cattgggtacctcgaggccggccgggatatataagattcgccacaccgacacctagatgtcacacgccagcccgcaggtggtatataataggggtcctcgaggccggccgcggcttctgggatggctgcatttatgcaggcacactgctgccggcagccacgactggttggaaggaggagggaggggtagtagtaaaaccaggtaggtgtggctggctcgtgcagcggcggcaggcggcagtgagagcgatgagcgcggcggcggcgagctcggtcaccaagttcatcaagtgcgtcacggtcggcgatggggccgtcgggaagacctgcatgctcatctgctacacctgcaacaagttccccacggattatatccccaccgtatttgacaacttcagcgccaatgtctccgtgggtgggagcatcgtcaacttgggcctctgggacacggcaggccaggaggattacagcaggttgaggcctctcagctacaggggtgctgatgtgttcatcctctccttctccctggtcagcagggcgagctatgagaacgtcctcaagaagtggatgccagagcttcgccgattttcacctactgttcctgtagttcttgttggaaccaaactagatctccgtgaagacagatcttaccttgctgaccattctgctgcttccatcatctctactgaacagggagaagagctcaggaagcagataggcgctgtggcgtacatagaatgcagctcaaagacacagaggaacgtaaaggctgtgttcgacactgcaattaaagtagtgctgcaaccaccgaggagaagagaagttaccaggaagaaaatgaaggcaaggtcgaatcagtctctgagaagatacctctgtgggaagcggatgtttcacatcgtaaagcacaggctcttctgcgactggtgtactggactggctagatggttgcagctctatgaatgagtagtcccttccgcagccactgggaacttctggttctctgctaccttccgatagagtgctcttctgcgttcaccagctgtgcaaaatgaagtgaggtcctagtttctaaattccctacgaggtgtaccttctttagtatgaatggtaggctatttagcagttcagcaaagtgtgaagtgacccttctatgcatgttttgtttccaaaaactgatgtagctaaatctctaatgaatggttatggtcgcaccggaagaaaagaagttattgtagactatt

SEQ ID NO: 21860 - DNA, 1473 bp, Zea mays
ccggccgggccggggaaacaattgggtccctcgaggccggaaagaaacgttcctgaaaaaaaaaaaacaaaaacacgaagaactccaccgtttcatcctctttccccaatccgttcaacgacggcttcaggaacccttcctccggcggccgccacaacgagcctcgggcaccgcaaagcaaatcctatcctatcagtcgaatcgtgcgtctcgtcgagcctcgatcctatccccgccacgccgatccctcgtcggtcgtccgaatctggtggactatctccatcgccgggcgttcatttttggcccggtgagccgggggtggggggtgggtatttggtgccgtgagttgctgctcccgcccgtcgatgcttggttagcagaagagacggcggcggtaccatgttgcagtgcctggatggagtgaagcagctccttggcgtgctcctcaagtgctgccacatcgacctcaagcagcccaacggcctagaggatccggaggtgctcgctagggagaccgtgtttagcgtgagcgaggtcgaggcattgtatgagctgttcaagaagatcagcagtgctgtgattgatgatgggctgatcaacaaggaggagtttcagttggcgctgttcaagactaataagaaggaaagtttgtttgctgatcgggtatttgacttatttgatacaaaacacaatgggattcttggatttgaagaatttgctcgggcgctctcagtatttcatcccaacgctcccttggatgagaagattgagttttcattccaactttatgacctcaagcaacaaggcttcattgaaagacaggaggtaaagcaaatggttgttgctacacttgcggagtcaggaatgaatcttttagatgaggtcatagagagcatcattgataagacttttgaggaggcagacacaaagcatgatgggaaaattgacaaagaagaatggcgcaatttagtagtgaggcatccctctttattgaagaacatgacactacaatatctcaaggacatcaccactacatttccgagctttgtcttccattctcaggtcgatgatacctgaatttctgaaaactaatgaatgtcagaaggtggactgcttgctttgccaagcaaactttcagtgcctgtttgatggttcaaaaatctcatcgtcctgaaggcatcaaatcatcgtttgttgttaataatctttttccttgttttttatttggaattcttgctggattctgtgtgaatcctcttctattttccctctccattgttcctttattctatttcggttttgatggccagtacttgagtcagttaatgtgtacaaagttgcgtctgatgctgcctgtcattgaattgtatggcatgtgaggaagatttaaattgtatattcaacttttgtggtcatgatagttgcacatatttttaccatcctttccaaaaaaaaaaaaataatcgcggccgc

SEQ ID NO: 21861 - DNA, 2618 bp, Zea mays
aaacctatactaagggaacactaagatggcacacaaccccttttacatagagaaacaaagtatatatgattaagctagaactggattatctagaaacacatgtatcatcactatatcgaggagaaactgtgccaagtcaagaagaagaaactctaccacagcctggtctatactagtatcaaggtacgaagagtttttattttgacacagattcgagaaactttcacgtttcgattaaatcattaatcctcattattttttatgcagggactaatgctaagcaaagtctggagaatgcatcaagaaaaagaactctccgctctttaagacgaaacttccaaacttcataagagtttggaggaaaaagatgtatagacgctctcgaaggagaaggtagaaaaaactgaaaaggaaaacgacgaagcaaggaagatacataatgctgatgtttcaaagttaaagaaataaaatgagtttatcaaagagctttaggccaaccttgaagctgagaaaagggtaatgccgataagtatatgaaaaatcagaagttatcgggaattttaaatcagcttcgagagaactccttttctgttgtttcgcggtgctgtgatacccttaggaagattttttcctcaactggtgctatctcaagagcaaccacatacaccagtggggacaccgaaggagagctcaactggatggagaaataacgagaagttgattcgataattaccactcgcagtgactactgcgtaatgattgggtctcggggaatggcttcagtatttgaaaaagccagctgcgatcacgacaaaattgttgaagaagctaactttgatatgagtgttgataatataaagcgtcattcgaagagtgtggcaaatgccgcgaagatattcttctttgagttgtggaacaagggaggctgagagctagctgcttcggaggccgaagagtatactaggaaggttcgtctttaaacttgtattcatgaagttttgtttatggggttttccaattagtcaccatatgcccttttgtttccttttctgcagagcaagaaactgaagaaaacaaagtaaagccagaaggccgaagcctagttaagttgttggtgtggaactgtggatagattctgattgtaaaaataaattgtatgtagttgaaatgctactattttgtaattcaatgcctggctcatcatcatttatcccacttatatttctatgctttgtttatgtgtttgccattcattcttggaatccttaccaagttgaaacatgcctcacgaagaagctcttggacgtcctccaccttggagtcgtggcgtggcggaactggacgccttgaagcctttgatgggccgttaggtgggcctcagcgcatacagggacatgggctgcattttatacgggctgaaactgttgcgtgtagggtactagtaagcgacagactgggaggaagaagcccaggtgaaaccggcatggcgacggtcgcagcccgccgcctcctccagccgcgatgggtggccggtgggcggtgccggctgctgggcaccgcagcggaggcttctccgggcggagagggcgcgcgaggagggggaggtggatccggcgacgcgatctttgtgaagaagccggcggccgccgcggccgtgatgacgagggacgagacgtcggtggcgatgccgacgtcgttcatgaccgggtctgtggtcggtaagcgcttctaccgcgacgccaccgtacggcgcgccgacgatggcaatgggtggaccgtgatgctggactaccgcacgctcaagtcgccggccaagcgggtcctcaagctgccctcgcgcgccctcgccatggccatcgccgccgagtgggagtaccaggaatcagatggaattcgacctttcacaatgcctcttatgaagcttgcttgcactgcattggagagagttcctttgacacgcagcaacgggccccgcgtttcgtggtggcttatgcatgcatatttgcaagcaatttcgaatggcctggatgaaaaaactgttggattagcacctaactcatcctaatctagcttagtagttagttcatccgggagcagtagtgaatttttttgacagaaaggtttcccccactttatttccacgaaacaaagtgtatcaaccaaacattattacaaggtttaaaccatactccagcgcgtccgccaaaaccacagaacaacaagtaacaggttatcaagcactacggtggtccgaaattcctagaactcctcccaacattttctgggggtaccatcttcacttggatcaaccagatttgaattcctccaccagggaatgcgctccagttcccaagccactttctctaaagcaccagtgtataaatccagctcctcccaactttttgacttgaagagaggtttccagtttctcagcatctgagacgccctgcacagcacctgcttcacacacatccagtttttcccctgaaaacacaaagcattacgggttttccataaggaccacaaaacagcagcacaaattgtattttgcaccttgtatctcttattgctaatccaccatcttgctacagattccagatcctcccccacattccaag

SEQ ID NO: 21862 - DNA, 1412 bp, Zea mays
aagcccaggtgaaaccggcatggcgacggtcgcagcccgccgcctcctccagccgcgatgggtggccggtgggcggtgccggctgctgggcaccgcagcggaggcttctccgggcggagagggcgcgcgaggagggggaggtggatccggcgacgcgatctttgtgaagaagccggcggccgccgcggccgtgatgacgagggacgagacgtcggtggcgatgccgacgtcgttcatgaccgggtctgtggtcggtaagcgcttctaccgcgacgccaccgtacggcgcgccgacgatggcaatgggtggaccgtgatgctggactaccgcacgctcaagtcgccggccaagcgggtcctcaagctgccctcgcgcgccctcgccatggccatcgccgccgagtgggagtaccaggaatcagatggaattcgacctttcacaatgcctcttatgaagcttgcttgcactgcattggagagagttcctttgacacgcagaaaagtgattgacaatttgatgaagaaatttcatcaagatttggtattttgccgctcacctgctgatagtgaactgaccattggagttcatcaaaagcagaaggagaaaatcgatccgattctggagtgggtagacactgaatttgggttcaaacccgttgtctacacaagcttctttggggggaagcaagacgagggccttgctaaagctgtagaaactgttctgaagaaagcaactgactgtgagttggcatccattgatgctatggctgcagcagcccattccttggtgatccctcttgcaatatttagagaaaggttgggtattgaggaggccattgagttgatcaggcttgaagaagaccaccaggttgatcgatggggcttggtggaaggaggtcatgacgttgatatcgcggatcttaaagtgcagatgtcctcggctgttgtatttcttggactttcacggggactgtgaatgtttcttacctatatggctagttgtttatttccaagcttgtatgaatctgagaccaagagttgtagagaataattgccgcggaaggtcgatagcaaaccaagtatctgtactgtattcagcaatcagcagttctgatgttcgattttggattgagtccagaaaatgctgttgaggtttgaactagggagcccagcattcctctggctttgtactgttgtgagagtaagaacatatctaggaactagtattgcagtggcagtcactgagtcgatatatctacttctgcacctttcagctccagcagcacaagttgcatgatcgtattgaccggtcatttttagccatgctcaatttgctgtaacaaatagtgctgctaggtaccagtccatattggtcaaaaaaaaaaaaaaaaaaaacaaaaaaaaaaaaaaaa

SEQ ID NO: 21863 - DNA, 1684 bp, Zea mays
  misc_feature (1673)..(1673): n is a, c, g, or t
gaggtaatttggagtgctatgatttagtagcggacaaaacaatagcaccttacagatatgcattgttttttttttttttttttagccgacccctgcaaattctgcatgcagtgctttatattgtaatgtcccacatgacctaagctgtaatgtatgtatttcaaacacatgatgcaactcaaagagtaacaaacagtgtaatcagttgcttttctgactatggacaatcagtttgaacatagtacctggcaatgacacacacacaaaaaatcagatattgtatgtactagccaagcatgcatgtgctttatactactcccatagaatccggtgcagggttctttccagagtatcacttgcatggaacttccatagcagcgccaaaacattgtcataccatggctcgcaattattatgagacgaaagcaaggcacgacattgatgtacatagccgacaaaaacaactcacaggtcacatcctcctcgttgcttcgatgttgttttattggtgtgaagtgcctgcttctttcctctgccactgctgcctagctggctggccctggccgtgaggctgtcgtcttgatgcattagctctgtttctccttcgatggcctggattcttcggcttgttgctgctggcgttgcttgcctggccacgttgctcagtttctgaggtcgaagtagccgtgccttggctgggatcagcattctcttcttcagctgtgtctggcgtgctgggaggaacggaaacgtacattcctggttgtatggcaaggtctttctttggttcaatcaggccgtttagttcttgctgcagattaacaagtgactcgattctttttctcctgttttgctcagcctcggaatggagcaattccttttcatcttcaccaaggtcaactgttagtgatgccagcctggaagtattgtcacccaacaaatcacgaacatgctcaatatccttctcatcgaacactttgcggcaaacaggacaaaatcctcttggctgattcacattataatgcttgtctccagtattgggctcctttgggtttgtgtcaccatgttggagccattcccaccatctcataatgcagtcactgtggaagcaatggtagcatgacatcaacttcataaatggcaactccgagccaaccttatcctctcccattaaaggatatagacacaatggacaatcccctgctggatgattcatgttcgagaggatctctccagcttcctcacataacgtcacaagcattggacagtttgaaagttcgtttgccttgttctggatgctggtgataagatatatctgtcggttctcatcaaggcccttactttccacagcataaatatgtggtggttccttcggatactgtgaagatgctttaatgccaagaaagagctccacgaactgctgcgaggtgtcgtcggcggtgcggggccgcacgtggacgaagaggtgcggtgggaggtcgcggagcacgcggacgtcgtctccgtacaccgccgccaccgcctccagttccagccgcagctcctcctccgcctccaattgcgccgccgccatcgccatcagtcaccgacgatcgaccagcctctgtctctgaacgatgactcgatgatagttcttttttttttcttttttgagagagagcaagaaggaaatnttcccggccgg

SEQ ID NO: 21864 - DNA, 1396 bp, Zea mays
gagtagttagcatagtggtgtaagtgctatatttaaatttggtggtcaaggttcgaatctcgttaatccttatttttttgttgtttttttattttttttcatggcacaccctaaacatagcagctgggtccgccactgacccctcaaaaaactgtttttcttttttttctgcgacacattagaggccagcggcacagattcgaagccttacattaccattcctccatcgatggtgaggacctgtccagtgatgtagcttgcagcagggctgagggctaagaattccaccaggcccgctacatcctctggccgaccatagcgccctaaaggaatagttgacagaattttcttctctaactcttcaccaagttcagcagtcatatctgaagcaataaatccaggagcgataacgtttgcattaatatttctgctggcatactccctagcaactgtttttgtgaacccaataaccccagccttggcagcagcataattagcttgtccagcattaccagtaagaccaacaaccgatgctatattgataattcttccctttttcttcttcatcattacttttgttgcagcctgcgtgcaaaggaaaacgcctgtaagattcaaatcaatcacatcttgccactgtgatttcttcattctcatcaacaatgtgtcccgtgtgattcctgcattatttactagtacatcaatcgttccccatgtatcaacagccacttttatcatagattcaacatcagcctctttggaaacatctcctccaaaggtaatggcctggcctccagatgcttcaatctccttggagacttcttcagcctcctttgaagatcgagcataattcaccaagaccttgcagcctgcttttccaagagccaatgcagtggcttttccaatccccctggaagcaccagtaacaacaaccacaggaccttccaactttgtatcaccttttacaatggcttgatcaacagccgtgacatgagttcgtacaccgaggagggcgacggcgcgagagctgcggtcagggccggggcggagcgcgggtgcgaagctgacgaggccgcggcgcgccagcgatgtggagaggcccgccggggaggcgagcgcggcggcggcggctgtggcagcggccatgaaggatcggagggcggcgatgggcgatggggaggagtcggggagggggagggggagcccgcgaggaagccgtttatagaggatggcgttgggggtttggcacgtttggtgtggctgcctgcagtctgcttgctttggcagctccgatggcgacggatggcttctggcggaacgccacgacggtggatggcagatcagggaaacgggtgagaacggttgcctaccccggccggcctcgaggtacccaatg

SEQ ID NO: 21865 - DNA, 1096 bp, Zea mays
ttgctgcctgcagttcgatctatcggtccccctggaattcagtggcgtacgacgtgacaacctacaatgacataaagtacaactcagcaaacattatgaataaatgataatagcaacctcaagaattcaggtgaaaatggtaaaagcaacaacctagagtaaatacaccctaagcattccttttaccttggcaccatggaccaaaatagaaatgcatctcttgagagccaagaaaacatttggcaaagcaaagtttataatttttctaaatcagtgagccaaagcatgaaaaacaatttagggggagtaacataggccctcagttcactaaaaaatgtagccagatcataaagctactcccagtgtggtgtagatgttgagatccaatacaaactaagattttgctactttagctcaaggagccatgcaaatcaagatgagagcagaactcattgcattatctggtatgagccatcgttcaagagttccaatgaaaatatcaccacttggcatagcaattcaaagcagtagaatagcaataacctaactacctaaggatggtacattaggcacagcagacacaagggaagcaagaaaagtatttcaatcttccccgacaactttaaataaaggtaaccagccaacataaactacaactattgtgtcccctctgtatctcggttcttctttttcttctcctttttcttctcacttctctcagcatgtgtgccatcatctccattctgagcactctctggatcagcatcacttccttccttgctcttcttcttcttcttcttttcactccccttctcatcagatgcatcaacctcctccttgacctccacagctttagctgatcttgattcccccttgcctttctttttcttcttctcactcttctccccttccactgcttcagcagcttcctcaaccttgatcttctttgcaggaatagaagcatcggcatcattgttctcatcatccttccgcctcttctttttattctccttgacttcttcagtcacagctgtgtcctgctccaccttcaccttctctggcctcaggagcagctgcaagctggcaagtgacatca

SEQ ID NO: 21866 - DNA, 1964 bp, Zea mays
gcaggcaaaaaatacaacttcttgacaaatcacgaccggtatgcaagggctgtgttttctctctctctctctcacacacacacacatgtaatgctttgcccattattccgtttgcagatgatacagtacaaagcaggttcctcaaccatggtagtaaaaaaaaacacacactacactagcacatctgcttcaaagctaccggtgtctgaaacgtgacagattctgcccacaccctgtttcacttggacaacattgagttgtgctgctactctcgaatggaaccggtcttgtgctatttgcgcgtggccatgcataatgctgctactctcgagttctcctagcttggctgcggcagggacgcctgaactggcgcgagcggagacgtcggcgaggcgactttagtgggggaaaagcacggaggaggcagtctcctcgacggcgacggagtcgacgacaaccctctgggcgaaaggtccaccatctccagcgcctgcatccggagctccatcgggtagtccttgacgcacccgatcctcgggccagccccggtgctccatttgagggacagcctgtgcccgagctggtacgacttggacaactcgcccttggacttcatcctctcgaggatcgccctctggggcacttgggtggctctggggctctgcagcccgcctgacaaggtcctctggtagctcggcctgcctcgtccttcgtcttccggagggctgtctccttcgtcgccctctgtgctgtttagagcggggacgggaaccgccgcctgtggaaggtctgcctcttccatggtagctgaagtggaactccgtgtgtcgttaagtaccggcactggcactgggtcctcgttgtagtcttctttggtagatgagcgtacctcgacttctttgaggtccactccgttctcttcgaggaagttcatgaagttgtggaggttctctgcgctaggtttgtagtggccgctgtacgcccagatggacttgatcactccactttctgcagtgaatctcccagcagctatagttgcacctcctgccagaaagctggagtgctggaacacgcctctctgtttcttgccagcataaagcttttttgctgtactcataacaaatatccatttagtccccttaggacgccttgtatcaagtggttccccagactgtttgtggataacctttccctcgctaatgatgtattcgtagtgctcacgctcttgcggaccaagatacctaatgcattgctgcttcagcaaagctcttggacattcaggaaggtccagatcctttccctcgccgatatcaagccagtagaagaatggctggcctgcttggcttttgcaccattcatcgtagtagaagtgcaggttgtgcccatacctatgccgcgggtcgatggcttcgatccagtgctggaaagccagcttgagggccttgccgtctctggataaaccctggcccaccttggatgcgttgaggctgacgcggttccagcgcgaggcggcggtctccggcttgggctcgtcgaagaaggagacggtgctgtgctccaggcgcgcgtagtccagcgcctgccaccagagctcctcgacgacgacggcggagtcggcgagcttccggcgggtccggtagctgcggtacaccttctgcaccttggtggccgcgccattctcgccggggccctccaccggcgagggaggcgccagcttatccggccccgccgcctccacctccattgctctgagattggggagcgagggtccgacgcgctaaacttggacccagccggcggtttcgtccgcggaggcggaggcagaggccagagggagagggcgagaatggttctgctccgggcaggcgggcactcgttcagtgtgtcaaggacgaggagggcaggtgcgagtttaatccgtggattaacacgcgagcccccggccggggaataactaaaggctg

SEQ ID NO: 21867 - DNA, 920 bp, Zea mays
  misc_feature (11)..(11): n is a, c, g, or t
  misc_feature (13)..(14): n is a, c, g, or t
  misc_feature (26)..(26): n is a, c, g, or t
  misc_feature (35)..(35): n is a, c, g, or t
  misc_feature (38)..(38): n is a, c, g, or t
  misc_feature (42)..(42): n is a, c, g, or t
  misc_feature (53)..(53): n is a, c, g, or t
  misc_feature (60)..(60): n is a, c, g, or t
  misc_feature (73)..(73): n is a, c, g, or t
  misc_feature (87)..(87): n is a, c, g, or t
  misc_feature (114)..(114): n is a, c, g, or t
  misc_feature (147)..(147): n is a, c, g, or t
  misc_feature (225)..(225): n is a, c, g, or t
aggtaaaattntnnccagcagcctantagtttgcnccncctncccaaaaaagnctggagntgctggaaatacncctcttctgttttntgtccagcataaatctttttttgctgnctccataaccaaatatcccatttagtccccttnggacccccttgtatcaagcggttctccagactgtttatggataacttttccctccgtaatggtgtattcatagtgctnccgctcttgcggaccaagatacctaatgcactgcttcttcagtaaagctcttggacattcaggaaggtctaggtcctttccctctccaacatcaagccaatagaagaatggctggcctgcttggctttggcaccactcggcgtagtagaagcgcaggttgtgcccatacctatgccgcgggtcgatggcttcgatccagtgctggaaagccagcttgagggccttgccgtctctggataaaccctggcccaacttggatgcgttgaggctgacgcggttccagcgcgaggcggcggtctccggcttgggctcgtcgaagaaggagacggtgctgtgctccaggcgcgcgtagtccagcgcctgccaccagagctcctcgacgacgacggcggagtcggcgagcttgcggcgggtccggtagctgcggtacaccttctgcaccttggtggccgcgccattctcgccggggccttccaccggcgagggaggcgccagcttatccggccccgccgcctccacctccattgctctgagattggggagcgagggtccgacgcgctaaacttggacccagccggcggttcgtccgcggaggcggaggcagggcagggatcgcattcgcagcaggaggagaggaaccggaccgcggatacgacgacgacgagtcgttggcgccacctaccgcttcttggctc

SEQ ID NO: 21868 - DNA, 1196 bp, Zea mays
cccgggccatcgtcagctgccggtttttccatacgcgcaagcgcaacacggcaacagtgccgaccgccgacgaccaaccaaaccatgcgaagaggaaagagccgtcgctttcgctacgctcggcagtggaggacacatcttcctcgccgcttctggctttgatccggtcgcatccaacgcacgacctgttgaaccagggcgcgccctcccagggttcctttcttctccgtctccgcgtaggcgtagcgaagaagctaacctagaatcaaagagatcgcacgcaagagggagcaccggagcagcgagccagcgacagcagcagagagatcgccggggccgctcgcctgtctggagagaggaaggaaacaagagatggacgagatcatgaacaaggtgggcgcttactggctggggcagagggccaacaaggagatctcctcggcaggcgacgacctcgattcgctctcgaccagcgtcggggatggagcgaaatggctggtgaacaagctgaagggcaagatgcagaagccgctggcggacctgctcaaggagcacaacctccccgtgggcctgttcccgcgcgaggcgaccaactacgagttcgtgccagagacgcggcgcctgacggtgtacatcccgtccccctgcgaggtcggctaccgcgacggctccgagctgcggttcgacgccacggtgtcgggcacgctgggcgagggccgcctcacggaggtggaagggatcaagaccaaggtgctcgtctgggccagggtcaccgccgtcaaggccgacgccgccaaggtccacttcaccgctgggatcaagaggtcgcgcagccgggacgcctacgaggtcgtcaggggcggcatcaccgtcgacgagttctagcttagttttgctttcgcggctcacatggatggacgggcttcctcttgctcgctgcacgctgagatggacagattgttgctttcagttgcaggaataaattctacacccattagctatgtgggagatctgcgtgcactgtacatcgtgtgttttgtgctttgttgtgagaatgtaacacctgaaggattcagaaggtgtgctcgttgcttatgatatatgttgttcacttgtttttaatatcttcgggtattagaaaacaagacaatataatagattaaggtccaccttcgtccttaaaaaaaaaaaaaaaa

SEQ ID NO: 21869 - DNA, 3742 bp, Zea mays
  misc_feature (3585)..(3585): n is a, c, g, or t
ctgaacgaggagttcgtcatggaggaggataaggaggaggtccccgcggatcggtgcgttgacagggtcctcgagggcaaggaggccaccgacgtccgcctggccgccatggccgtcgtcgccggatcctgtggcgggctggagaagctctccgtccgtggaagccacccggcccgtggcgtcacagaccaaggactctcggcggttgcacgcggcccccccaacctcagctcgctcgcgctctgggacgtgcctcttatcaccgacgctggacttgtggagatcgccgccgggtgccccttgctggagcgtctggatatttctcgatgccccctcatcacagacaagggcctcgccgcttttgcgcaggggtgccccgacttggtgtctctgaccatcgaggcatgctctagtgttggcgatgagggcttgagggcaattggccgcagctgcatgaaactgcaagctgtgaacatcaagaactgtcctcttgttggtgaccaaggcatctccagcctggtgtgctctgccactgcttcgcttgctaagatccggctccagggactgaacataactgatgcttcacttgctgtgattggatactacgggaaggccatcactgacctttcacttactcgtcttgctactgttggtgagaggggtttctgggtgatggctaatgctgctggcctgcagaatctcaggtgcatgagtgttacctcttgccctggagtcactgatcttgcgctcgcttctattgccaagttctgcccaagcttgaagaagctttacctgaggaagtgcggacatgtgtcggatgctggccttaaggccttcacagaatcagcaaaggtgtttgagaacttacagcttgaggaatgcaaccgtgttactcttgttggtattcttgctttcctcaactgcagccagaagttcagggctctctctttggtgaaatgcatggggatcaaggatatctgctctgtgccacaacttcctttttgccgttcacttcgtttccttacaatcaaggactgcccaggtttcaccaatgcaagcttggccgtggtagggatgatttgccctcagttggagcaggttgacttgagtggtcttggtgaggtcactgataatgggcttcttccattgatccagtcttctgaatctggtctgatcaaggttgacttgagtggttgcaagaacatcacagatgtggctgtctcctctctggtgaagcgacatggaaaatctctgaagaaagtcagccttgagggttgcagcaagataacagatgctagcctcttcaccatgtctgagagctgcaccgagcttgccgagcttgatctttcaaactgcatggttagtgactatggtgttgccatgctggcatctgcaaggcacctcaagcttcgtgttctctcactgtctggttgctctaaggttactcagaagagtgtgccgttcttgggcaaccttggccagtctctagagggcctcaatcttcagttctgcaacatgattggcaaccacaacatcgcatccctggagaaaaagctctggtggtgcgacatccttgcataggcagcagacaagatgagccattgctggaaggggctcatgtctactgggagccacttccagatgcagatatacgaccttagcagtagcacaaccagacggtcttcaggtttttggctcgcatgccggtcattatggtgggcttccacattgttcaaggaccagttgttttagggggcgctttctagcggagtgctcgtttttcacagatcacctctcagggggtttatctgttttttgagcctcggctgccatcactggcatcctgcccctagatccagacactggtccttgcccttacagtcataagttctttttaggttgccatagtgtccaggtcctctttcgttttactgttgcaggcgttggtgatccattgacagctctggactatcacagttctaactcaactgccagatgctgctggtgctggagcgtctgtggacttgtgcggtgtgtttggttgtcatgtttagagtcttgatgtgttgtgtgtgtgtgctgttctccatggtgtgtactggtcatgtagggttgcatcttttttacggtctctttgggatgcctggtgttcatggtgatcgtggccattgcgaggcgcttactagaagccttgccttgacagccttgtatggttgtttttttttgccagatccctgtttttacaggcagattgttgagtgctgtaagcttggcgaccctctatgaataaatgaaatatgtgtttatgttgaaaaaaaaaaaaaaaaaaaagatttataacattgttgtgcatgcaagtagatcctcaaaatacacattgtctcgctgatgcattattatggacttatggtttagtttcagtgtaaaagccaaggcttatcttcaagtattgggcggcagctggctcatgcgccgtttgactcctttctaaaagagaattttgattgggcatttcctagttggtcgagttttgtactggctatacatatcatgtagtattatacagttttgtttgtcatgactatgatgcttgagttatggctttcattccattcatcctgcatgccgtgtcggcgaatcgagcgccgctaaagtctaaaccattgcccctctcccttgatcctgccgtattgcgttgcgttgaggcatttgcttagagcatgtgcctctcccctctcgtgaggtcgttgacgtatattgttgtgtcacgcttcaggagtgggctattagcgtctggatctgactagtttagcccatgcagagaaatggcttcatgcatgtatccggtgctggcagcaacatggagcgcagacaacactagaggaggcgcttgcgacttgcgaggcactgctacattgattttggaggagagtgacgagtttggtaaccgtgaaggacgcatcgatgcagatgtaaatggtatcaatattatccatctgtatttaaatttgatccgtctaaggtcatattcgtttgcacaagaatacaccaagaattattccagctaatcaaaacttatataaattagagaaacaatttggataggaattgttctagggctccattccccggtaaccgaacggcccctaaaaaaggctcagatccgttccgtatccgagtctagttactcagtattcaattcatatccgatctttatccgtatccgtaattttaaagttgaatatttaagatgtcaatatccatttaaattttaattgatataacttgataatattcgtatgtgatccgaatccgagagaaaaaatataaaaaaatatgaattgagtaatatccgtctgtattccattagattacacccatatcaacaacacatgggtgtggttagaggtgaaaacaggacacgtaccccggtcggttaccggatacaggtaacaaaataacccaaatgttcaatacaggtacatatatttacatatatttttgttgtcagaacatatatgggtactacccgattaatatacatccagatcagtggcggacgcaggaccaaaatttatggggganaggtaaaaaaaccatattacaaaatcaagcaagacgataaaaactataattgcataaaatttatgttctatatctatcaatataacatacaagtttaaagaagagaagtaaacatacaactaagttcttccagaccgaatcaagtcatgcgtacatg

SEQ ID NO: 21870 - DNA, 1850 bp, Zea mays
  misc_feature (886)..(886): n is a, c, g, or t
aacaaatctgcagcatgtgcccgctttcggtatccaataatataaacacgggcacctggcacaatcatggatgcaacaagtatgacacaaatcatatcatacatttctagaagacctttccagaatcacatgcgccacataaaccatgttctcgacacaccaatacacctaatcaagaggccaatgcccccagcatttggggctgttcggttacatctggatcgaaagggattaaattcctgtctagtcaaaattgaatagagaggatttaattctcctcaatccccttcgatgcgtagcgaacttgcggctttcttttgttcttctccaaaagtagaacgaattactgcatcaaccaaatactcatgggtgcaaagcagagagctaaggaatacaagaaacagcacatatcaatttacagtcaagaacactgatacatgcgtttatattgtcacagcatacaacagttaattttaattaggtggtggatgggtggtggggacaaggcattttctatcccccacgcctattgccctcagtcagaaacacactagctatcaatgttaatctcatcatcctcagtggcttcatcatcgaaggcagagctgttaccattggcagattccatcttcttggcgctggattttgtggacttcccgagggacttgttctttgttgatccctttttgcctttctcggactgctgcaactcaagccccttcactgacagccgccgcttccgctttgagtttggcccttcttctgggtcttcagcagtagagttgtcaactttccattgggcttgatgctggagggaatggcttgtccattctgtacagcatccatgagggatggggaaccagaatggttgctatcctccaacttntgaacttccaaggcatttctctggctgctcatcaggagaatctgggtaaggaattgctggtaagtaggagatctcatccacagaatcctccacatcactgaacactgtattcttctcagatgtctcgatatcaacatcagcatcctcatctatcactactttctcagcctgttcttcacgtggattcaagtcaaactcatcctctcgttcggcgtactcttcattttcttctaactctacgaaatcaggagcaaaagcgctccaattctctacatgctccttggcccaaatgtatacgaagcctgtcacagatactgtagcaattgtaggctcaacatgatgccaggcaagatcaatgagagcttcttttggaccttcaagcatctttacaaggcgccctgcttggttccatatctgcaacctgtgctctcctttgtttgcagaagcaccaactatccactcaccattaccactgaaacatggtgccttccactgtatctttgtgatggcatccaaaagttcacaggaaagaataaggcagcttgtaccatttgcttttaattgatcgtagtgacttccatatccattactgttgctgcttatgtttctgatctcctctctaaaacctttaacaggaagaatgtttcggtaaaattctatggacccgatcattagaatttgtcagaagatattgaccatccccgcttaaaaacataatccttaacaacccttccaccagggatgggaactattggcttgaacctggaatgcttttttgactccatgattaaaattcccccccttggaattggcccccatataaccagggccccaatggttaatcaaatggttccaccttgtggcccttaaaagggtggggtaacccccccccaaatttatttttggcggggtataaggtccaggggggggttacccttttcccaaaacacagaaaaacggggaa

SEQ ID NO: 21871 - DNA, 1986 bp, Zea mays
aatcgcacgaggattgaggctccccccggtgttgccaatgagggcctgagggcgattggccgcagctgcgtgaagctgcaagctgtgaacatcaagaactgccctcttgttggtgaccaaggcatttccagcctggtgtgctctgctaccgctgctcttacaaagatccggctccagggattgaacataactgatgcttcgcttgctgtgattggatactatgggaaagccatcactgaccttacacttactcgtctcgctgctgttggtgagaggggtttctgggtgatggctaatgctgctggcctgcagaatctcaggtgcatgagtgttacctcttgccctggagtcaccgatcttgcgcttgcttctattgccaagttctgcccgaacttgaagcagctgtacctcaggaagtgcggatatgtgtcagatgctggcctcaaggcgttcacagaatcagcaaaggtgtttgagaacttgcatctcgaggaatgcaaccgggtttctcttgtcggtattcttgctttcctcctcaactgcagagagaagttcagggctctatcgttggtgaaatgcatggggatcaaggatatctgctctgcgcctgcacaacttcctctttgccgatcacttcgtttccttacaatcaaggattgcccaggtttcaccgatgcaagcttggctgcggtggggatgatttgccctcagttggagcaggttgacctgagtggtcttggtgaggtcactgacaacgggcttcttccattgatccagtcttctgaagctggtctggtcaaggttgacttgagtggttgcaagaacattacagatgtggctgtctcctccctggtgaagggacatggaaaatctctgaagaaaatcaaccttgagggttgcagcaagataacagatgctatcctcttcaccatgtctgagagctgcaccgagcttgcggagcttaatctttcaaactgcatggttagtgactacggtgttgccatcctggcatctgcaaggcacctcaagctccgtgttctctcactgtcaggctgctctaaggttactcagaagagcgtgctgttcttgggcaaccttggccagtctatagagggcctcaatcttcagttctgtgacatgattggcaaccacaacattgcatcgctggagaagaagctctggtggtgtgacatccttgcataggcagacaagatggtccattgctggaagggctcatgtctagtctactgggagccacctccagatgcagatatacgaccgtagcagtagcacaaccaggtgatcttcaggtttttggctcgcatgcgatgcgagtgatgatggtgggcttccgcattgttcaaggaccagttgttttagggggtgctttctagccaagtgctcgtttttcacagatcacctctggggaggtttatctgttttttgagccttggctgccatcactggcatcctgcccctcgatccagacactggtccttgccttatagtcatataaggttttttaggttgccatagtgtccaagtcccttttcgttttactgcttcctggttatgaagttgcaggcatccgtgatccattggcagctctggactatcacaattctaactcaagaaccagatgctggtgtcatcttttccagggctgctgatgctggagcgtctgtggacttgtgcagtgtgtttggttgtcgagttttgagtttgtttttagtcttgatgtgttgtgtgctgttcatgttctccatggtgtgtaagggtcatgtagggttgcatcttttttacagtctctctgggatgcttggtgttcatggggatcttggccaatgctaggcgcatactagaagccttgccctgacaaccttttatgggttttttttgccagatccctatttttccaaccagattgttgagtgctgtaagcttggcgaccctctttgaatcaatgaaatatgtggttatgtctcc

SEQ ID NO: 21872 - DNA, 2429 bp, Zea mays
aactcatttcccccctcccgttccaactttattgtgtttaacacgaattgggtaccgggccccccctcgagtttttttttttttttttttacgagaaacagcacatatcaatttacagtcaagaacactgatacatgcgtttatattgtcacagcatacaacagttaattttaattaggtggtggatgggtggtggggaaaaggcattttctatcccccacgcctattgccctcagtcagaaacacactagctatcaatgttaatctcatcatcctcagtggcttcatcatcgaaggcagagctgttaccattggcagattccatcttcttggcgctggattttgtggacttcccgagggacttgttctttgttgatccctttttgcctttctcggactgctgcaactcaagccccttcactgacagccgccgcttccgctttgagtttggcccttcttctgggtcttcagcagtagagttgtcaacttccattgggcttgatgctggaggaatggcttgtccattctgtacagcatccattgaggatggggaaccagaatggttgctatcctccaactttgaacttccaaggcatttctctggctgctcatcaggagaatctgggtaaggaattgctggtaagtaggagatctcatccacagaatcctccacatcactgaacactgtattcttctcagatgtctcgatatcaacatcagcatcctcatctatcactactttctcagcctgttcttcacgtggattcaagtcaaactcatcctctcgttcggcgtactcttcattttcttctaactctacgaaatcaggagcaaaagcgctccaattctctacatgctccttggcccaaatgtatacgaagcctgtcacagatactgtagcaattgtaggctcaacaggatgccaggcaagatcaatgagagcttcttttggaccttcaagcatctttacaaggcgccctgcttggttccatatctgcaacctgtgctctcctttgtttgcagaagcaccaactatccactcaccattaccactgaaacatggtgccttccactgtatctttgtgatggcatccaaaagttcacaggaaagaataaggcagcttgtaccatttgcttttaatttatcgtagtgacttccatattcattactgttgctgcttatgtttctgatctcctctctagaacctttaacaggtagaatgtttcggtagactctaatgacccgatcattagaatttgtcagcagatattgaccatcccggcttaaaacaatatccttaacaacacttccaccagggatgggaactattgcatgtacctggatgctttttgaatctatgattaaaatttctcccttggagttgcccacatatatcagggccccatgcttatcaaatgttgcagctgttggcgtgaaaggtggggtaccatccgcaaatttattgcgggggttaggtgcaggggggttaccattctcagatacagaaacagggagaactgtagtacttccagtattcaaatcaacaagaagaggtgcagaagatagagggcatgccaaacaaatagatggagttggagaaccaggttgaaggctggcacgtaatggagtctgctgaagagtaatacgtgcaattttttccccagttggcacatcccaaagtgtcaatgacttgtcagtagcagaggcaagcaaacggtggccatacctggaccaggacacacttgttataggtgcggtgctatctttatcacgaaattcttttgcaagcccccttgtttcaaagtcccatataatacagctaccatttgagcatccagcagcaagaagtgttcctttgcggttaaacgcgatacatttcatagtaccgtgatgcaagtactcttcgattgtctcaggaaattccccctgatatggatcgactacagggacgttcatcgcgccactgacgcctcggcgcgaagctaccctcgcagatgggagtcgacagtggcggaggaagattctttttttggtatggctccttctgctacctcagtctcgtcggcaggcctcctccgacctgagcgccgcgccgttcaagatcagcagcaggaaccggaagctgttcttcctcagcccagtgcggcacgcccactgcgggggcggacaccggacaccggaggctgaggccggatgcggaggtggccaggtgggcggagagcagaggccgccgccggcgggcggaggccggaagccggtggctggtgggcgggctggcggaggctggaatcggactgcgttcagggggccgcgacggtgccggaggcggaggacggaggtcgggacgggcggacgcaggtggccgcggcggtgaggggctcgggcccccccggggtggagttcccggccggcctcgaggtacccaatg

SEQ ID NO: 21873 - DNA, 5035 bp, Zea mays
agtcgatttgaatctactcaagtgtttctttttgacagtaaatgcatattcagatatagattggcagggttgtctagatgttataagatctacaggaggcctttgctgtatttttttattacagtctcatctcttggagtacaagaataatctactatgtcgagatcaagtactaaagtagagtgctagacttcgacgaatgctataacagggatcatgtgggatcaaatcctattgaaggagttagcgattggaagtctaaagacaacacatatgtcgtgtgataatgagagcaaaatcttccaaatcatgtgttctatgcgacaactaaacttataaaggttgattatcatttttttacgagtgaaagggttataaagaagctttagattgattttatataaagtggagatcatattgcagaaagcttcaccaggctcttttggtgcgtcagctagaaattttaagtacaatatcaaattaggaagttataattaaggacggctattaagaactggttttctcgtatgataagttatagatcaattatgtaagaacatgtatcaacttcgaagtccatcccgtaagagattgaaacttatataaaaattaaaaaaacattgaccctttaaaaatatacaatgcttctcgccgtttctaattttttgagccaaactactagttacatatttggctcgctacatctaggagactgggcgcgcatgcactaccaccttcacacacagtagcataaagcttccccacttccaggcgaattgacagcccagccgttccctaccagggaagcattctgcaagtcgcgccattggtagcagataagcctgattccactcgacgccgagcttgcccttccctgacggcgagggcgagctgttattcttcccagctggacgacttctgatcagcctgatgcatgaatacaaacagtagctctcccgtccagactcaccagctgctccacgccttcagcggcaccagcacgcccaacccactcgctgcgactggaaagcaacctccaacccgggcaatcaaagccacaatgtcaggttgtcacttgcaggagatcggagaaaagatttctggaagtcgactccaaactgcatcacgtccacatggttctgtaacactacagggtaccaccagcaaaccatcaatgatacagaccgaaggggaccggaagaaccagactgaaattttggaacacagcaagttcagaaacttcgtatcgcagcttaagccatgaactcatcttcatgacaacagattattgccaggacttttgaaaccaacaacagattatgacaaaaaccttcacggcatcgtttcgtgtttcaaccgtgcgaagagtatgacactttattccttttctacactcgccatttgtacattccatacgacaacatggcgtgaacatggacaaggaacctctatggcgacaacaggatactgggcctactacaacaggctaagggcggtaacctaggcttctgttctgtcacgagctatgcgcttccacctgcaagcagctgctgctgctgcccgagctgcccacgtggcaggagaggtcgcgcacctgcagcttcatgttgcgtgagctgatcgagtccaggacgtccatgcactcctggaggtcggcatcgttcgccaggatcacccactcgtcctcatcgtccttgtatttgagctggaatgctccagccgtcagcttgaacctctttgctatctcttccagcaagtggtaccagccccttgctggcacaaacttgaaccggacggtgtcgccattgtaggtagctttcacggtcagtgcagggctgcttcggtctttgagggcacgtcctgggttccccttgaaagtaggctcgcttgaggcgctgccgctcgaagaatcggtcatgccagaggtggaagggagtgtctgctccttggtgtcatgaccatcgaccatagtgacatctgcttgttgcacaaatggtgagttccttactgttgtttggccttcaatgccatccatgcttgggtggagggaggtcagagaatcgatgttgcctgtttctccagtatgcagagaattaacagcaccaatgggattgggatatgaaggaccatgtgtgccttcagagtttgaatgctgtgtgatatttgcaataccagaaacatagtttcttctgcctttgttgttgtttgccaacgtccgaacttcatcgcctccccttttaggtataccagaaacatgaaattggctagtttctctttgccacccatcaggcgaagagaaatcttgttctgattttgggctacatgtttcctccactgctctcccaagagatgaagtaggcaatgtatcgcaagcagagaatggcatcttttccggaagagaggttgcaggaacaagagacccagtagcaggatcgtactgcaaggatctatccacaccgtgaactgatttaatgaccttctctatcttcttcaatgaacgattgaccttgtttatctttcgagatggccatcgggaaattccatgttgtctgcatattcgtttcaatgtcgttggacaaacaccaaggctcattgcagcatccctcaggctcccagagaagtatttgcgaagaacatccagactaaagttcttttcagatgcactgcgctttttatctgcaactcgcattgagcttctctgtgccttgtcaggttctctgtctccttgtttgtcacccaaagatagatcctggagtgcagattctgtgattggctggtcatcatgtgaggaactttcagagttaccagttggtaaacaagttccactagtcttctcatacattgctgcagtagcactaacattttcaatctctgcctcagagactgttcgcaagcttttgcatattctttgcattgtgctggaaaggttgtttaataacatctgctgctctccacagcccttgcagttgactgggagaaagaattctagtatgtagtcatcgtaactggtgtacgtactcctcagccggatggctacagcagcgtgcagaccaaacttacgagcatggtgtgcaagcgggtagtcttcgatactgtactctcttatatcaggtgagaagaatggcagattggatttaagggctcggcctgcaataccctgccccttctcaagatgacgatcagcacatgcatgaagaaacccctgcatctttgcatcgttaacatagcaagctgattcatggatacgaagtgctgcttttcctggttgcggatctatcccgatattctttccaacacaaaaaccattagcgatgccatttgatgtagggacccatgtaagggccaaaggaagcatgtgtgcatgacaaatagctcttagaacatccaatatctcagtaaaagcagatttctgattttcagagtaaaccttctgattgctgcgatctgttgttgtctgcaagttcacagcctgcaaggcatcgcaaacaatgtccatctctgcatcaaaattaggtttctccttgtttgtgacaagttcaagaactgcacaacaagagcccttgctgggatcgtaaactggcatagcaagtgacccttgtatttcatgaagaagagcatgctccattctcaaatactctggcttactgtaatagataacacttgaggtccactctggcaccccagatatgaagaccctccctggaagccctaggtgcagaccaggctcctccttaactgaaaacaggaaatttctagaaacttctctgtaacctgcaagatcctggtcaagtaaatagggctgctcagatgtactcaacacgacacgaccattgtgctcaacaggcatccagacttgggcaagaacaccatcactcaatgacttcctgaacaaagatagcgccatgagcatcctgtctgcaagagcgttgccaacagacctcggaatgatgctactcccttgctgtgagccattacttggaagaacaagcccatctgactcttttagccctctgtcgactccagttggactcgatgctgctgctgagttgaacctttgagcaagtgacgatgtcccgtccacaggcccaggaaaggtgtcaaacgacatgtcttctctcacagctgaagcacgcggagatgagcccaaggatgaccacatggcaaccatctgttgcgcagcggagggatcattcagcagggagaatatgtgatcagcaactgatgggctgcagagctccgagtatccatcaaagctcgtcatggcagcaacaccaaagggatcatcaaaagattgcatggggctgccgatgttactgttgcagccggcacggttgggaggcgtaggcacatccatggctttgctccactcgtcgaggcaaggatccttatccacacctagtacgccgaaatggatttggagcactgtattgagctacagacaggatataaaggagagcactgtcttctagctgaacagaatctttgtgcaaacacaagaagcaatttgatatcccggcccggccggcgtatctggctatctgcacaggagacaacttttcttatgcagaaatgtcctgttcataacgcaggtagtagacaaaaactccaagacccgtcgatcagcaatgaactccggaacccaaaaggtcaagcctttagaggaaagttcggcaaaggtaattgcttaaagcggcttcacagttcctcaaaattcaactttggcactagaaagactgtacggcaggcaagttcggcgccaacggcgatgaacctgcaagctagaagcctctttcgacaggctgaaattaagcaccaattggatcaaaagaaagccaaattcacaccagcacacacctcccggcccctagaacacagaaactccgagcacagccttgaagactgaaactccggcaccaggcggaaagaacggcgctgggaccaccgctcgccttggccgagccactagaccggctggcagcctccagactctcccaattctcgcctacaaaattattgcaacagcggacgcgtgaaa

SEQ ID NO: 21874 - DNA, 1710 bp, Zea mays
ggttcaaagaagcagcaatccatcccatctcatctcatctcatctcataatggcgaaacaagggttcactgaatgagcaatacagcaaaaatatacagctagtacacatggaatgaaaccaacagctacatgcctacgacaacaacacagtcacacacacacgtatagccgctccctttcatcctttctgtcgcacgcctagtgcacctgcgcagtcctactactactcctcgatgaccccggcagcggggagcctgttgctggtgctggcaacggggaggccgaacccgacaggcgtctgggagaaggctgtgccttcctgggcgacctggggactactgagccagaggacgacgacgacgacgccgtgttcacctgcggcggcgccgccacgttgtacctgggatcctgcagctgctctagcttctccacgacctcggacatggcaggccgcatcttcccttcgttgcggatgcactgcagggcgattccggccacggcgtgggcgcccttcttagggtactgcccgcccaacttggagtccatgatgcggtacagacggcgcttgtcgctcaagtagggtctcgcccactccaccaggttctgctcggttaatggtttcgacttgtctagcgcccgccgtcccgtcagcagctccagtagcaccacgccgaagctgtagacatctgccttcactgagagccgacctggagcagtttttaacaagacgatgcatgaggaaaaacaatcttgccaaaatgaatagtgtggccgagcagattatcaatatactggctttatgcccaagcttaagatttgatctggtacatgtggagatctctctactctctaatgcgtactcctacgtgcctgcacgaattagagggggtattccctgctgtgttccacttccttcaaaaggattgaataaaaggtatctgagctccccacggagatcacgaatggaatataattgttgaatctacccttttgaactgttcaattgcatgaaaatttagaccctatttagcacaacttattttcagcttcttcgcagatttaaacagaagttaatacctgtggtatcccttgcagtagcttatcagttcagctgcttctcaaaacgaactaaaaacagtcaataagcagaagctgtttttcaccagcttctcagatatgcagtttttccaacaagcagcaattgtgccaaacaactccttaagcatattatacatcttatttatgtaggctaaattacacgcaaagcgaaaatagcaggaaaggggaagaaaacatgaacatctctcataagaggtaaaccacacggcacacgtgtaataagacctttttatcaacacaaggaacaatcttaccaaagtagaatattaatgtcttgccactggactggactggactacactaaaaggacaatcaataatattcttatgcactgtaatacatcctagaagcatattttgtagctcagcagtttcttggcatcactttttaggacagtcacaaccttaaaaatccagtaagagcttgtttggtttgaggtggattgagggaattggaaggaattatatcccctcctatataaatttgtatgggagaggatttaatcctctccaatccccctcaatccactcctaaccgaacaagctttaagtgtctactcggttaggattggggaggattaaattccctttc

SEQ ID NO: 21875 - DNA, 1613 bp, Zea mays
cgaccccggcagcggggagcctgttgctggtgctggcaacgggagcccgaacacgacaggcgctggggagaaggctgtgccttcctgggcgacctggggactaccgagccagagaacgacgacgccggtgttcacctgcggcggcgccgccacgttgtacctgggatcctgcagctgctctagcttctccacgacctcggacatggcaggccgcatcttcccttcgttgcggatgcactgcagggcgattccggccacggcgtgggcgcccttcttagggtactgcccgcccaacttggagtccatgatgcggtacagacggcgcttgtcgctcaagtagggtctcgcccactccaccaggttctgctcggttaatggtttcgacttgtctagcgcccgccgtcccgtcagcagctccagtagcaccacgccgaagctgtagacatccgccttcactgagagccgacctgttgcaacatattctggagctgcataacctcgtgtgcccatgacctgtgtagaaacatgggtcctgtccccagttggacctgcttttgccaagccaaagtctgaaagctttgcattgaactccgagtcaaggagaatgtttgatgtccttgaaatcacgatatatgacttggttctcagcatcatgcagaaatgataaacccttagcagcccccaattgcaactttgagtcttgttccccaggataaaggatccgcacctcgtctgaatagatgattttccaaacttcctttaggcatgtactcatacaccagaagtcggtgatcaccatctgtgcaataaccaatgagtttgacaagattctggtggtgaagttggccaaggtagtcaacctctgtcagccactccttgtggccctgaaaaccttctggttttagcttcttgatggcaacaaccataccgcttcctggctttgaaggggcaagagtttgctcatcaatccagcctttgaacacatagccaaatcctccttccccaagaagactgtctgatctgaagttcctcgacgcagttctgagatcaccaaacgagaatgccttcaaatttggtgatgacaagatttccccttctgtcctaggagtaggaagctctcgactatctttgtatgaggctacagtccatgtcgaccgagtcgaaccagtcttgaccgtcgaagggttggacgatgaaattgatttgctccctgctttcgattgataggaggtgttgtccaccggcaccgctttgtccatgcagttccccatctccaccctccgctgacgccggccaatctaccggcgacacatcgaccgatccggtcgccgcgatgcctcttgggtgggagctgctaggaacagcaaggtcggagtcaacgccaggaagctccgccaccaacacaacagcgcactcctccaaaatccaatctttggaggatctgagggccgagcccgactgccacgccaacccgcgccggcggaagcacgtaagaacgaacgtgtgcgtgtccccgcctgagtcaagtcaacccaggccggcggctgagcagtgtcgtgtcgtgccgatggggttcgcccctcgcaccgatttgtcgcgggcgcggccagccc

SEQ ID NO: 21876 - DNA, 1526 bp, Zea mays
tgatagaaatctaaaaatctagaacgaaagaatattttaaatggaactagatgctgctaattttcagaaatgtactcatctggtatagtatagttgtaatatttttttttttttttttatttttagcaaacaacccttaatttcatttattttgaacaatcgaagttaatggccaacaatgaaaccaaccactcgatccatcagcgcaatggcctgggtgctgccgtggccggaaacgaagaacccgtgtccctcgttttgtgattcgaagctctccacctttcccggccaacagctggccctcaccgcctcgcagtatgcccggcccctcggtgccctcgggtcctccgacgccgtgcacacgagcagccgctcgcccaccagcttcgccaagctcggcgcgccagcgacgaccgggttgattctcggatcgtccagcccgtctctcgcaccggggaagatggccttccacctcctcttattaacttgccagaatctgtcatcctcttcttccatcctctgttcaccggcaaacgaagggtggagcaggatcacgccttctactcgtggtggttccgcggcgcgcaagcctctgacgcccgcggcgatggccatgttgtgggcgatgttcgacccggcgctgtaaccggccacgaagacgcggccgaggtcaccgtgggcggacagccacgggtccgcgccggaaacagcccagttgagcgcggtccaggagtccttgtaggctgcagggagcgggttttcgggcgcgaggcggtagccgacggagacagcgacgacgcgggcgctagcgaccagcgagttcatgtagcggtggaaaccaggatcagccggtgagccgatgacgaagccgccgccgtggaagatgacgaggatgggaagcttcgccgtggcgctgccgttgccgttgccgttgccgtccgactggggagatgacggggccgtagggatggctggcaggtagagccgcgtcgcgatgccggtggcggcgtcgacgaccacgtcttttgaggtgacgccggtgtcggcgtcgaagcccgcgggcacggtttccatgccggcgaaacgctcgacgcgaccgtcgctgtatatccggaagaaatcgcagtcgaaaacgatctccgcgctgcccggatccattgcccggccccggcgtccagcaagcactcgatagtcgatggagctggagcgtagcaaaatgtgcggtagaggtagagacgtggagtgtagcagactagcaggctagaagaacaggggctatcctatcctattctgtcctcttcctctgcagactgcagctggtatcggtggagtatctgatgaaattttttgctaccgtccaatcgcccgattgctttcacttcacccctgtggttatatctatatatatctcttctatagtatattaaagttgctttcatttcacggctatggttatatctctatctcttatctatctttgcgcgttacctttttataaataatttctcacatattttcaaattaac

SEQ ID NO: 21877 - DNA, 2253 bp, Zea mays
ggccgcttttttttttttttttttcggaatgtaaattgcacagatgcatttttttataaaaataattcaaatttctggttccaggataaaatattccacagagacatcacatgccctatatatatttcttttgcaggtaatccatagttgttgcgattagcaaaatgtatgtctcacctcgggaccagccgcacgatctcacgtatttctaattaagcattgcatttaggcactcctcttgtacaggtaaaacctcgaagagggtcatttttggcatgttttaccgtgctgttattcagctaacatgctaattactcctgttcctgagagcagaaataaactgtatcgagggcacttatatgcttcacttgtgccacacagcatatctgtcaccagagactgccagcctccactctggatcacttgggcaccacgagccgtccccgatcttcatgcacaacttatcgtcgatgattgctgagtacagatctgacccaacctccagaattttgattgatgaacggctatgtatatcttggcattttctgatttgcatcagtttagcaatttcgtcatggagaggcacaccctggtcatagaagtgatcatagaacaccgtggggatgccagggtgggtgagtatataagcatatccctccataatatgatctgacggaaaaggccaatgaccctgagtggacccagtgtcatgattttcaataaatgtaactgatcttgaaggccaccatcccatcacaccaggtggttttccttctgaatctcgcaaacgccacaactctcctttgacagcttcctgaagaatgccctttgtcgtgaaatcaaatgcggcacaaagtcctccagtgttatctatccaattaataatcctctgcctatggatatcttgattatagttcagtcggtagtcaggggggctatattcacagctatcccagtattccccaactgcaaaaagaggttttgattcctcaatgtattcttttacaaacttggctgcataacctttcgtgaaatcaaagcgaaaatcttgaaaaccaactgattttcgaagccagatcaaccattcgataatatctttgcgtacaaatggttgtgtatgatctatattgggaaccccatcaaagttatccccagtgctcttgtttcccttcccgccagaacaagatgtaacagcatgttcatcccatgatactgggatgccatcataacgattatacatgccattggatccttgagtagttccaattcgatggttgataacaacatctgccatagcccttacattatgttcgctcattttatgaagcaacaattttagctcatggagggaaccataacatgagtcaaggcagtacagattctgtggtagatagccttctcgagataatgactgtgttggaggaggaagccacactgacgtaaacccagattccgcaagatcggttactttttcctccaaaatactccaccagttgtgcttattggattcccagttaaaagcctgaaataggatttcccttccattcttgatgattccatcgtcgcgtgctgtctgttcgtcggatttatcacccgaaatcatctggcccatccaaactcagaccgaaattcaagcagaacgcacaacacgcagcgaaagccttcaacgcgcactgcaggagccttcagccagcgcgcagctacctatgtagccgcggcggttggcatggagctggcagcgggcgggcacgcggagcgaggcgccgtgcggtgttaccggggtccagtgggcgcgggagcccgcggcatgcgcagcgaccgtggcgcccaagtggggagcggggaccaaagttgtcggcaccccgcgaccctacgccgatcggatggagttgacggcggaaactcctctacctcgccgcgtgcaacggggggatgggctggaaacaccggtcaaccggccacaatttcggcagcggcttcgaatttgctcccgctggcattgatccgacgggatgaggaaggatgggaagaaggagaagttagctttgccttgtccctttgggaattgggattccgttgctcttctgcgcttttccgatcgagacttggagtggaatcgccggcgaaggatttggggattcgatttgagttttctcggcgacgtccccccggcgcggcaaaaagggatgataaaaagatactggttttggacctgatgggtcggaagatgggcccagttctgtatgggctgca

SEQ ID NO: 21878 - DNA, 1900 bp, Zea mays
gcggttggagatagtcttaatgtcggctagtaggtcacacaaacaccaaacagttcgagaatgccaatcaaatgtgaaacaggctgaggtccaatccaacacacatgcaacgcgcatcgatctaaaggtttgtatttacacatgcataaacgtacgttagaaccgtggtagacatttactttattaagatacgtctattatgtttttttccacgtatcccttaaatattccttagatacgggctgcctgatggcccttttatttccttcacttccgcaacccaggtttcggtatcattttctcccttctctacaatataaaacattgcatcgtataattgtccagtctatttaaatttgaagccaatttaccattcccccggcccatgacatgagctaggacacatatggccgcttcttggcttttctttgtttgcttgttgcatcaaaggtcgtttttaattcatattactatattagtatatccagatttggagtagacgacgagacagacattcataaactcaaacataatgcagttctgtaacataaacttctgcactgattaataagcttaagctcacgtacgcacccatagttcatcgacatattgcactgcgtgcacgaggcacgtatcattgtgtgcatgccttcgtttattgcatagatgtcgtagctatatagcagtagaacatgcgccttgacgcgcatgtaataaacgtagcggcgcacgcagcacggcatgcatgcagttggagtgtgagtgagcacatcagcagttggccggcatggcaaggccgcacttgcccggcagcgccatggcgcggttgatgtcgatcctgtagaacctcacccacacgccggcggcgttcttgtaccggcagagacatgccaggtcggcccccgccagcgcggcgcagcactcagacgacggctggtctgtcgggttgcggatggctgccgcgggctggcacgcgcggatgccggcgctcgacaggttgcagacgccgtgcgccatctcggcggacgccgccaggacaaccaggacggtcaccagcacggccgttgcccctgcctttgccatggctatagctgtggtttttgctcaagtcgtagatttgggaacggtggaccttggccgtgtataggcttctagcaggttcggctgcttcggtgttgagttgccccggccggcctcgaggtccccaatttatttatagcgggaaaattgcactttttcttgtaatcagctgctgcatgactgttttgaacaattaataaagtcatccactcttgttttccaaagccaaaagtgtgtcaaaatgtagattagactgttattaagtttctaatgttaaaagggtgttgagaaaatcactatacaaagaagctctaaagtgacacttgtaaacctattttaactggcgtttcttagaatcgtcggtgctaggggcaagtaaaaatcattatttttacatgcgggttactgaggaccgctagtggaaatcgatttccactggcggttgacataataaaaccgctagtaaaaattattttcagaaacattaaacgggttttaaaaacaaaaaaaaatattttcactcgcgtttcttagaaccgtcggtgctacgggacagtagaaatcattatttttacaggtgagtaaataaggaccgctagtggaaatcgatttccactggcggttgacgtaataaaaccgctagtaaaaattattttcagaaacattaaacgtgttggagacttgttctcaaatactatgaattaagaacaagacaacataaaatgttaaatgttattacccttcgtccaacgaagcattattcccttgaggattaatgagccgtggacgaaggttaaaaacaagatgactacggggtacc

SEQ ID NO: 21879 - DNA, 812 bp, Zea mays
ggatcccatcccatccaatgtatatggaaataaccgaacaagccctttactatatttccagatttggagtagccgacgagacagacatgcatgtactcaaacataatataatgctgttctgtaacataaacttctgcactgattaataagcttaagctcacgtacgcacccatagttcatcgacatatattgcactgcatgcacaagagacacgtatcattgtctgcatcagtgcatatgccttcgtttattgcatagatgtcgtagctatatagcagtagaacatacgccttgacgcgcatgtaatgtaaacttagctgcgcacgcagcacggcatgcatgcagttgcagtgtgacatcagcagttggccggcatggcaaggccgcacttgcccggcagccccatggcgcggttgatgtcgatccggtagaacctcacccacacgccggcggcgttcttgtaccggcagagacatgccaggtcggcccccgccagcgcggcgcagcactcagacgacggctggtctgtcgggttgcggatggctgccgcgggctggcacgcgcggatgccggcgctcgacaggttgcagacgccgtgcgccatctcggcggacgccgccaggaccaccacgacggtcaccagcacggccgttgcccctgcctttgccatggctatagctgtggtttttgctcaagtcgtagatttgggaacggtggaccttggccgtgtataggcttctagcaggtttgctgcttcggtgttgagttgcgagcccggccgccctcgaggaacccaatcgcccataggagtg

SEQ ID NO: 21880 - DNA, 1212 bp, Zea mays
attattcattttttttcttcttttggtactttccggacagtggagtagagggcgatagatagggcagcatggcggcaaccttctgcgctgggcccgccgcatccgcggcagtaaaccctagctccgccggctgccgaccccagaacctaactcgggctgccgtgctgtctgcttgctggcggcccagcaggccgactcccgctttcgtctccctccggcgcccaaatgccgagctgcggccgctgcgcgtggccgccggctccggcgttgacccgaaggttgtcaacggggaagattttcctcccatgaaggacctaattcagctatacaggacagcttttctagaaagaaatgaggaggttcttggcgtagttgagaaggcaatcactgctgtgcaaaaagagaagagtacgatagcttcccaatttgaaagtactacaaccgaaataacttctgggaaggaaaagtttattcgcttaaatgccgacctggagaatttccggaaacagactgaaaaggaccgtgcaaagttaacatcaaatatacgggtggaagttgttcagagtctgttacctctagttgatagttttgagaaaataaatctagagaacaccccagagactgagaaggagcaaaagatcagcgcaagctatcaaggcatatacaagcagttagttgaaacactaagatatttgggtgtgggagttgtggaaacagttggcaagccatttgatccttcggtccatgaggccatctcacgagaagcatccatgcaattcaaggcagggattgtcatgcatgaagtccgcagagggttccatttgaaggagaggctgctaaggcctgctactgtgaaggtctctactggctctggcaaacaaagtgcaagctcataggcgggggacaaagatgctgctttgtgaatctgatcaaacgaccaacaggaactgatagacacacatttttctgttcataacatgccgaatgtgtttgatctcaaatgagacgggatcagctatgtatggtgttgacagggagcaccagcttgaagttttgctgttacttgtaatctgctagaattttgtccaccagaagagtgagaatgaaacattggacattcataccggatttatattgagttccttgctcacttcattggacatccataccggatttatattgacttccttgcccaaaaaaaaaaaaaaaaaa

SEQ ID NO: 21881 - DNA, 2253 bp, Zea mays
  misc_feature (2109)..(2109): n is a, c, g, or t
tatgctctgaatgtggcctggactacaagaacatgtagttaatctacactatgttggggtttacccagcggtggagtgcctgatatggctcacgccataccttcccttcacccgcacgccgcaccgcactcttgtttcttcgacgcctgccaccaccattctagctctcctctccagctccatccgcagcctgtgctcaccaccattatagctctcctctccagctccatccgcagcctgtgctcgcggctcgccagctctgacactgagctccaccttctccaatctcctgctcctgtatggcgtgcgccactgcggttgttggcccttctcggtgtggtcgcccctttgcgctcatgcggcacagcggcaactctctccgctcctccctctccaactccaacatgcagcatctcagcgtgacaacgtccatcttcctcccccggccataccttgtttctggggtgtgctctgccactgggtttaccaaatacagaagatggactaaaattagactgctttgctattactatgaatcacatgggtgtctggccgtcggagataaggtggccgtcggatgtttgttagtttactgtagtgtggaggacattggaaacgccctgttcttttctctgagctaaatcggatagtttgaggaatattgtgtgaaaataggagcaacaagttttatggcgcagttgtaaagttgcattttgaactgctattgcacctcgtcagcaatgaggtgaataagtaataaaacatttatataaatgatagcaatgaaatgggaagagaaacaaaccatttgaaaatgcccaggttctctgttggatcttcatgtcatgcttttcattttgacgaaatgtgtttcatcaagtttcaccagaatgactatgtcgctgcaggttgtcaacgactcaacggggaagattttcgtcccatgaatgacctaattcaactatacatgacagcttttctggaaggaaacaatgaggttcttggtgtagttgagaaggcaatcgctgctgtggaaaaagtgaacagtagagtagcttatcaacttgaaagtattacaactgaaataacttctgggaaggaaaaatttattcgcttaaatgccgatctggagaatttccggaaacaggctgaaaaggacggtgccaagtttacatcaaatatacgggtggaagttgtccagagcctgttacctctggttgatagttttgagaaaacgaatttagagaacaccccagggactgagaaggagcaaatggtcagcacaagctatcaaggcatatacaagcagttagttgaaacgctaagatatttgggtgtaggagttgtggaaacagttggcaatccgtttgatcctttggtaagtaatatttacccttccgtcacctgtttgattctcattgactgggtctctctccctaaaacatgtatgcaaacaacatattggatccttttgaacacgcaaaaagaattatgttcgagtattaacaagcgcataataatacctaggtttttatggcctgtttcatactcatgggatcaagcttagctttcacacagtttcctggatctattttgcagtacatctcttttgatctaaataatattgggtatttggcagaaaaacaaatgggcatccactttcagtgtttacagctagaaagtatgatctgcatgagagtcgaacagtgttacttttatgttcatcatatatgcaccactgtgggggctcattcttaatgttttcttatgcaggtccatgaggccatctcacgagaagcatccatgcaattcaaggcagggattgtcatgcatgaagtccgcagagggttccatttgaaggagaggatgctaaggcctgctactgtgaaaggtctcaactggctctggcaaacaaagtgcaagctcatagaggagggcaaagatgccgctctgtggatctgatcaaacgactatcaggaactgatagacaaataaaggacctctccttctgagcagcatttttctgttcataacatggcggatgtgttcggtctcaaatgagacaggtcacctatatatgttgttgccagcgaattgctgttacttgtnaattgtatctgctagaattttgcccaccaaaagagagggtgtaacattgcacatacataccggctttatattgacttactttctcgaactaagaacttcttcggttattctaattacatatggattaaagtgtattggaatgga

SEQ ID NO: 21882 - DNA, 1060 bp, Zea mays
gtaccctcacactctgctttatatactgccgaaggtaatcccgttcgcagttcacctacgcggaaaatcactagtgattcgctgaacaaaaaaaaattacaagaaggaatcgagagcaaatgctatcttcaaccacactccgaccgccggcgccggcacacctcaccatctgctcctcgcccgcagcgtggcggcgtgcgccggcggtgcgcgcggtgcggaactacgactccatcccgaagcgggagcccttcagctccagccgcagcatcctccacgagttcctcaggcaggacaagcccctcatccagcgcaccaaggaccagatcacagattattgcacggccatcgaaggcgatgagtgctgcagctgttgggacgcttactttgaactgaataaacttgagcaagagctgcccaaagacgaaatcgcaaggatggtgaaggactcggagggtgacgtgaggtacctgatagagagcatccaccatcgctcggatctgcggaagaaggtggcagagaagtctcgcaattcagtaccgtcaagctcccagggtagtagagccgcaaagccaaggccgttccccgtgcctgatgggataccgaaaacgcaagaagagctcgctgaagaagaagaggcgttgatgccggagtctccatacacgaggctgctgagaaggatgggaaggtaccctgattggtacaccccacgccctgatcatgagaccgactgaatcgagttgcccaccatcctagtgtcccttgtgggagtttttggagcatggtaatctgaggctccttttatggcctgtggtatgtggtaagattagatttgtatctatgcagaattgcagattagggtgttcttactcttttccaattgtactaatgaaaaccggtgtgtgctttatgctgtaaatatgtggtaaatagctgaacgttttattcgaggttctgtgtactgttgcatctccgtataccttattatattatacggagtatataacttattttcgtataccacttctactgcctcgcaaaaaaaaaaaaaggggcggcc

SEQ ID NO: 21883 - DNA, 1051 bp, Zea mays
  misc_feature (1045)..(1050): n is a, c, g, or t
ccggccggaccctcaccctctgctttagggtccgccttgggtacctcggggcggggccgcagttcacctacgcggaaaatcactagtgattcactgaacaaaaaaaaattacaagaaggaatcgagagcaaatgctatcttcaaccacactccgaccgccggcgccggcgccggcgccggcacacctcaccatctgctcctcgcccgcagcgtggcggcgtgcgccggcggtgcgcgcggtgcggaactacgactccatcccgaagcgggagcccttcagctccagccgcagcatcctccacgagttcctcaggcaggacaagcccctcatccagcgcaccaaggaccagatcacagattattgcacggccatcgaaggcgatgagtgctgcagctgttgggacgcttactttgaactgaataaacttgagcaagagctgcccaaagacgaaatcgcaaggatggtgaaggactcggagggtgacgtgaggtacctgatagagagcatccaccatcgctcggatctgcggaagaaggtggcagagaagtctcgcaattcagtaccgtcaagctcccagggtagtagagccgcaaagccaaggccgttccccgtgcctgatgggataccgaaaacgcaagaagagctcgctgaagaagaagaggcgttgatgccggagtctccatacacgaggctgctgagaaggatgggaaggtaccctgattggtacaccccacgccctgatcatgagaccgactgaatcgagttgcccaccatcctagtgtccctttttgggagtttttggagcatggtaatctgaggctccttttatgacctgtggtacgtggtaagattagctttgtatctatgcagaattgcagattagggtgttcttactcttttccaattgtactatggaaaaccggtgtgtgctttatgctgtaaatatgtggtaaatagctgaacgttttattcgaggtcctgtgtactgttgcatctccgtataccttattatattatacggagtatataacttattttcgtgannnnnng

SEQ ID NO: 21884 - DNA, 961 bp, Zea mays
tctgggggtacacctcgggttcggccgtccggggttcacctacgcggaaaatcactagtgattcgctgaacaaaaaaaatacaagaaggaatcgagagcaaatgctatcttcaaccacactccgaccaccggcgtcgccggcgccggcacacctcaccatctgctcctcgcccgcagcgtggcggcgtgcgccgacggcggcggcggtgcgcgcggtgcggaactacgactccatcccgaagcgggagcccttcagctccagccgcagcatcctccacgagttcctcaggcaggacaagcccctcatccagcgcaccaaggaccagatcacagattattgcacggccatcgaaggcgatgagtgctgcagctgttgggacgcttactttgaactgaataaacttgagcaagagctgcccaaagacgaaatcgcaaggatggtgaaggactcggagggtgacgtgaggtacctgatagagagcatccaccatcgctcggatctgcggaagaaggtggcagagaagtctcgcaattcagtaccgtcaagctcccagggcagtagagccgcaaagccaaggccgttccccgtgcctgatgggataccgaaaacgcaagaagagctcgctgaagaagaagaggcgttgatgccggagtctccgtacacgaggctgctgagaaggatgggaaggtaccctgattggtacaccccacgccctgatcatgagaccgactgaatcgagttgcccaccatcctagtagtgtcccttgtgggagtttttggagcatatggtaatctgaggctccttttatggcctgtgttatgtggtaagattagctttgtatctatgcagtatgcagattagggtgttcctactcttttcccattgtgcgtaatgcaaaccggtgtgtgctttatcctgtaaatatgtgatcaatagctgaacgttttattcccggttcc

SEQ ID NO: 21885 - DNA, 5348 bp, Zea mays
  misc_feature (515)..(515): n is a, c, g, or t
tgacgaactatatatccgtatactatccattatatatccgtataaccgattgacttccctaagtgcaagctcagccaggcactcctggtaaacgaaccaaacgcatgtgtttggttgatggaccaacgcatccaggtgtgtggcgtgcaaaccagaggtcgggctaggctcgtcggatgcgcccgtcagccatgtacgacagcatgcagcagcacgcagtccaagaacattttgtatttagtttttttttatcatatctcttaattcaaatatccaatacctgaaccgatttcagatatatgttcttaccatttttcgaacaaaactagacaacatttattatataaacactaaagatttattcatttattttatttattctttgttttaatgcatacaaccaaatattagatgtatctagcctaaatgcactaatacaaccaaacaaaagatgccttactaggttcgtgtgcctaaatgtatctaggctccttgtggctaggctaggttattcntcacgcactgaccggaccagcctactacatgcaacaaccaatcacatcgtgtgagaaccaaccacctatggagagaaatctccatatgccttaccttacccggttcatgtattcctacaagcagttcaaagataccagtcagcccataattgtctgccagtagaaatgggttgaaaatgctaggggtgtccagagaaatggtttttgtaggaatgaacaaacctgtgtccattcgaaggcgctaacctagcggtgactgctgcttgggctcggtggtatggcctgcattaccttttttttctacactagaaaaagggaacaacagaactgaagcaacgttcaacatcattcagaattcacttcatgtttctgaaaagtttctgaacaataaaatggcctacgaaccaaagaaatttttgtccataaattactatggttttcatttatacttaagtatagaatattatataaaacattaatacatatgtgttctgttggcttgttgaatgtgaatataagattataggtttagagccaacaactatggtttgaatctctatttatatataattttagcattgttataattcaaatgtgggggcacaacgacggtgaaaatcgtgaaatcaggaaaactggtgctttaatatagtacagataaacaaacttttaatacggtaactggaataaaacctgcaaagaacactactaaatttccataaaatcttaacaattttatagtgtgttcaaactaagaggccttcctttgtataatcatggtactaactcagaagtcagaacaatgcaattatggaaaagtgtggcttctaatttccatttccatgtcctgcaacacaacatggtttaagaatcttgtcaaaaacatcttgtgcaaatttaagtcaagaattgaagtacttcagtgtctccgcatttcgattgagtaatacggctgggttacttgtaatagtagctcatcttacttgacagctaacaaatatttgtatgtttcaatttaagttatacaaaaataacccccacaatcaatgagtcaatttgaaatagatctattgatgtgcaatgccataccatggtaaattaatgtgcatttaaagttttacatggtacgttagcattggtgcatactgcatagtcttgtttggcaaccctatagattatataacctatgttgatgattattgtatataatctgataatctaccacaatacagcttgttgagattatataatctgccatcataatccacctctataatcggtcctattccgttacccacccagattatataatcaaggtgggttgggagggactgaggtgaaaaagtaacccccatggattgggatggattggggtgcagccaaacaaaccctaaaggtttatttgaatgcactcgtatacatctcaatccatgtgtattagagtggattgatgtgaaacttaagaggctaaataaaaaactgtgtttggccctctaaagtatgacatatgaactaacatatttcaatagacctatcaaagagcaattgcatcaagtgttatgacagtatggcacagcacgaccagcaacagatcaaagactaaacagcaccacaggtcaaaatagaatgaaaattcataaactttaaggaacaaaaaaaacacatatattgggtaactcaagtgtaccaaatgagtctctcagatgctacagaaggaaatcttgaatgactggagcttgaggtatagcatcaggctgagtactagacttttctctatgcttatgttttccttgacgatgtccacttctaccagagcttctgtgctttcttggttctttgccatcactttcaggaggatttgttcctttcactttatcattgttttgttccttgcttgttctagaacatgaagcgggatggcttcctaaattctctatctgctgagagctagattcattactgcttgttttgtttagcattccttccaagtttatatctgaagtcctttgtgaagacaatgccttagcatcactaccgaagagcacatcacgcagaacaccagacaaggggtcttctttcggaacatttgcactaggcatcatagaactgaggaaatcctcagcatccaacttaactacttttggtctggacttcatggctgtcaactttttcccaggaaatacaaggtcagcagccttcaacttgtcgtcattaacagaattattgctagaagatggtagagaatcgttagcttgagggtaatcatttggctcatcctcagttttccctgtttggagataaaagagcccatgcctcttgcgatgctcagaaagagaagacaaaccaattgacactgcaggctcatctctggtatctacagaatgacgactgcgaggatagaaaaagattgaagttgagggagtagtatcatcttcactcaccatgccagcaagttcaacaagattttcattcaggataaggccatctggaggggacactttcatctgtgcattcacataaacagggcctaattcttgacagaatactgcccgcatagtcttaacaagctcttttaacctgctagacttgtcaccatcagcaaccttccttttgttcaacccttgaatctctcttactaaatggacaaaaccaatcaggttgtgtgctctctcctggacttctacttcattgcagttaatgagtggaccaactgtagtttgaatcaggttaatcatgtaaagtatagattcatgcgaaaaagggtccttttgcactgtgctggccccaatatcttgctcatcaccagacccaagtgcagcattgctttccaaattgacagtttcatcagcagctaacctgtcaaacatgacatccattgccaagtctgaatcacccaatctcccaatatatgcactgaaacaccatgtaatcactttaaatactgcatggatgtagacagctctcactgaaattggcaggaggctggtccttggttgcaagagcgcttcaacaagctcaacaggatccttcgttaagtctacatactcaccagaaatccatgcagccgctgaaagaacagggaagaggaagtgatttccaagcaatgcaggatcaatcaggagagttcgagctgaacggacaagctctggccgtgcatcctgcactctgagtcctacatcaacaagctgccgaccaatctcatccccttgggccccgtgcagggtccgtgccatatgtgcaaggagcgaaacataccaatcaaaatccaccaccatctcatacacattatgcccacatgctgctagaacagccccaagaatgtcatttgcgaactctgggtctgacttagcaacatgactgatcagcaaagcagcaatgtccatgatgttgttttcattaaccatccccataatgagacgccatgcctcttggcgaatgttcgtgtcggcatcacccagggacttcgcaatagcctcccgacaatcattcaccgtggatgcatatgctgggccaagcataccaagagccagaagccctaggtaccgaaggttggaatcatcagcagcagcaatgaactccatggctttcccaatggcaaggcgtactgcggcatcatgtgctggcagtgcagtgagcaccgtgcggatgcactcaaaggtcagtgacatggccgcggatcgggtgaggagctggcagaccgggtcgacaattctggctgccaggcgggactcgagaggagccagtcgtgcaaacagcttgagcaccttgatgagagcccagttggatcgggaagtggtgagcaggttatagaggtcgggcgccagtggcaggaaaggagttgcgtcagcagggggcgccgatagatcacagaaggctgccacagccgccgtggacgcccgaggatcgggagaggcgagacacgctgccagcggcttgaagaggaccggcacggccgcggatggcgatgcagctatgacgcgcgcggcggcggcgatggcgcgggggcagccccgggcgaggtgtggcacgaggtcttgcgcgaggtggaccgggaggtcgggcgcggcagccgcggcgggcgaggcgaggagctggagcgcgagcgcggagacgtgatggtggacgccagcggagggggagaggtccttgtggagctggtgtgtggcgagcgggagcagcgagagcgagaccgggtggagcgagagagacgcggcgaggtaggcgaggcgcttgtgggggaggtgcggcgaggccagaagctcgatggcgaggaaggcgagcgggtgggaggcgatgggggcgaagtgaagggaggagagatacgtgagcttctgcagcccggcgggcttggtggcggcgtcgggagcgcggatctcgcggtggatctcggagagagcgcgggcaacggcggcggcctcgccggtggacgacgggtcggcgcggaggaacttgacgaggtcatttagggagcgctggaagagggtgtccaccagtgacggcgccacggcgggcgccggcggtgtggaggccatcagcggtggctgaagagaaaggggcgttgtatcagaggtttttttgtcattatggtacttgtttttaataagcttctcttttatagtactcttaatataatcttctacataatggtattaccatttagaatagcattttaacctctttttaattttgttctttcttattccttatctactaaagtgattgtattgagatgtacacacgggccgctcagctggacccgagtccaaacaggcacgattaaaaaccgggtcgggcctgtctggcccgcgtgattgtgtttctgttcggactcag

SEQ ID NO: 21886 - DNA, 3138 bp, Zea mays
  misc_feature (2333)..(2333): n is a, c, g, or t
  misc_feature (2666)..(2670): n is a, c, g, or t
  misc_feature (2979)..(3001): n is a, c, g, or t
atttaaggtaggcttatatgataattttagaaagtggtggaatgtcatattctaaaaaaatagcttattccatcagtaagattccaattcctcgaaatgaaaggaaacaaacggggcctaagtgattttcatttttccaaaagaaattagtttatttttccatgggaaaatagaaatcccttgagaaattggtgttcccaaactagccttaagggattcttattttcccaaggaaaaatgaactaatttctctagggaaaataaaaattccttgtgataacatggtttccaaattagccctaactgataatgcactagatgaccagtatgtttaatcttgtcttgaacaccgaagaggcaaaatttagcaaacagctaaaatatataaaaaaagtttatgcatttgttgttagtcctcggaatttattttaaactctcgttataatccagggcttatctatatagtatatatttgtatgatcaaaagcaattccattcctcgtagatgaacgccagcaagcaaaatgagtaaaaattacaaaaacaacagattaatatgctctcgttgagagtcgaactctagatgaccagtatgtttaatcttgtcttgaacaccgaagaggcaaaatttagcaaacagctaaaatatataaaaaaaagtttatgcatttgttgttagtcctcggaatttattttaaactctcattataatccagggcttatctatatagtatatatttgtatgatcaaaagcaattccattcctcgtagatgaacgccagcaagcaaaatgagtaaaaattacaaaaacaacagattaatatgctctcgttgagagtcgaactcaagacctcccgcttactaaatgggtgctctaaccaactgagctacaagagcttttgatattaaaacttagtcgttttttaatatatgttgtttattgtgacaccactctcttctcctcccatctgaaaatcaaaattttgaaatgtacagttgaatttaataaaaagttgggaaatatccattaaattttagaatgtaattttgaattaaaagggacatgttttcacacagtatggaggttttgaaccaaacttaggttgggtttacatggcatgagatggaggctcgggaaaggttgccaaatattaattcaatttagacatgtttttccttccatgcaaaaagatagtttaaacatgaaattcgttcaagataaaattggactacaatgtgacttgttcaaatgatatggatatagaactatactaatgtaagtgtaaagacagtagtaatttaaggcaaatacaacaagatcagtgttcttaaggcgtcgcctagggacgcctaggcgtccaggcgcccgggcaaaactggccgccttgctcgccatacccgcctaggcgccgcctaggcgctaaggcggttggctggtgcacttgctcgcctagccgctttaaggccaatcaacaagatttctaatttattattcggtatttgtttatatttaggataaatatgtaaacatagtagttgaagtcatgcaactttaaggaacaaaaaatccacatatattgggtaactgaaatataccaaatcggcctctcagatgctatagaaggaaatcttgaatgactggagtttgaggtacaatatcaggctgagcactagacttttctctatgtttattttttccctgacgatgtccacttctaccagagcttctgtgctttcttggttctttgccatcactttcaggacgatctgtgactttctctttgtcatggttttgttgcttacttgttctagaatgtgaagcgggatggcttcctaaattctctatctgctgagagctagattcgttactgtttgctttgtttagcattacttccaggttcatatccgaagccttttgtgaagacaatgccttagcatcactacccaagagcacatcacgtagagcaccagacaaggggtcttcttttgggacaattgcactaggcatcatagaactgaggaaatcctcggtatccaacttaactacttttggtctggtcttcgtggctgtcgactttttcccagcaaatacacgttcagcagtcttccacttgtcatcattagcagaattattgctagaagatggtagagaatcgttagcttgagggtaatcatttggctcgtcctcagctttccctgtttggagataaaagagcccatgcctcttgcgatgctcagaaagagaagacaaaccaattgacactgcaggctcatctctggtatctacagaatgacgactgcgaggatagaaaaagattgaagttgagggagtnagtatcatcttcactcaccatgccagcaagttcaacaagattttcattcaggataaggccatctggaggggacactttcatctgtgcattcacataaacagggcctaattcttgacagaatactgcccgcatagtcttaacaagctcttttaacctgctagacttgtcaccatcagcaaccttccttttgttcaacccttgaatctctcttactaaatggacaaaaccaatcaggttgtgtgctctctcctggacttctacttcattgcagttaatgagtggaccaactgtagtttgaatcaggttaatcatgtaaagtatagattcatgcgnnnnngggtccttttgcactgtgctggccccaatatcttgctcatcaccagacccaagtgcagcattgctttccaaattgacagtttcatcagcagctaacctgtcaaacatgacatccattgccaagtctgaatcacccaatctcccaatatatgcactgaaacaccatgtaatcactttaaatactgcatggatgtagacagctctcactgaaattggcaggagactggtccttggttgcaagagcgcttcaacaagctcaacaggatccttcgttaagtctacatactcaccagaaatccatgcagccgcnnnnnnnnnnnnnnnnnnnnnnngatttccaagcaatgcaggatcaatcaggagagttcgagctgaacggacaagctctggccgtgcatcctgcactctgagtcctacatcaacaagctgcgaccaatctcatccccttgggcctcgtggagaattcgtg

SEQ ID NO: 21887 - DNA, 1631 bp, Zea mays
gaagacagacggctagtgtatagctagggatgtaaatacgaatctgaagttcaagactgtttcaaaccacactaatgcccagtttgcatggatgaaatcctgcccaattcacgtggatggataaagaattaagtccaaaatcctggcgcatcgccaagatttggtccatctaaccaggcgctaaaactaatttacatcacaacaaacttcctctggcaaaggtaggaggacttccccttcgtcacatacatgaagtgcaacagatgaataactcatggttactattactacaatcatcttgtgcacatttcactagatgccttgcatagggcaatcagcaatgctgacagttgtatgagtagatgtccaacactgaggtatctgacgaggacactgttagaattgccccattacaattcctggccatcaaaatctggtctcactgacaggataatcaagaccctgtagagctggaattcttctcagatcctcttctgaatatgcagggatgaaccaatattttctgtcatttccaaaaacctgagcaaaattcctcttccggccaagatcatatatccaatgtggagttgtcttcttctcatatgcctcaattgtcgtcgtattagccgaaacaagtgaaatatgcataatcataaaccaaaaacgctcaaggaaaaggccagattcaacacaaaggtgagaaatgtggttgcaagtgctgcaggacttcctgggatctcgatatcactgaagaaggctatgaagtgaggcaataaagagagtgtgacaagagttgtctcgaggaaggtgtaaaacaggaacagaagaaagtatttgtagttcagtgccccaacacaattaaccacccacacacaatgatgatccatcttaagaacacatcttccacaaacagagcaatggtggcaccgaggtggcttcaactggttgcatttcctacagtacctagcccttggatttgccgtattgccaagagccacagattgctgtgaattcatctggctactgaactctgagctagtgagaggagcagtttctcccctctccgcatcaaaatcaagattccaatttggtggaacagaaccagggtcagtgagcaccacagaaaaataactccataaaagcatagcaagcagaaagtggaagaggagcaggacagcgagcgcggcgagagtggtgccgccgccggtgaggagggcggggccgtagttgcagaggacgacagcgtagtaggtaacgccgacgatggcgaggacgagtaggatcatgatggaacccagcccacggagagccgtgcagaaccggaacacgttccacgccatcgcgacccccgccgatctgtacatggtcccccccgctacctccgcctccgtcacggctgcctcgggcaaccagggaggaggaccgagcaatacaccggcgtccccccgctggatgatccagaaacaaggcgtcggaggaggattgggaatttgagattaaggaagacgaagacgggggcagccgccagccgggcaggtagagctggaggtggacctcgccgcgtccttgttccttgcttctagatttgcttcggtgacgcgttctcccggccggcctcgagggtcccaatg

SEQ ID NO: 21888 - DNA, 1669 bp, Zea mays
ggccgcttttttttttttttttttccattgcaaactagtacttcaatacttttatagggcaatggaaagaacacattgtacaatttcgaaagaattacacagcgcttatccatttactattgatagtgtataacagaggcacaattatcagaaatgatatttatatcacataataataactaaactaaagtacagcactatttgaagcacactaccagtttggatggaatgaaaccaatccacgttgtcgataaaactaatttacatcccaacaaacttcctctggcccagctaggagaaatttcacttcgtcacatacatgacgtgcaacagatgaattactcatggttactaaaatcttgtgaacatttcatttgatgccttgcatagcgcaatcagcaatgctgtcagttgtatcagtagatgtccaacactgaggtatctgacgaggacactggcaaaaattgctgtgttacagttcctgaccatcaaaatctggtctcacaggataatccagaccctgtagagctggagttcttctcaaatcctcttctgagtatgcagggatgaaccaatattttctgtcatttccaaaaacctgagcaaaattcctcttccggccaagatcatatatccaatgtggagttgtcttcttctcatatgcctcaattgttgttgtattagcagaaacaagtgaaatatgcataatcataaaaccaagaacgctcaaagaaaaggccagattcaacacaaaggtgagaaatgtggttgcaagtgctgcaggacttcctgggatctcggcatcactgaagaaggcaatgaagtgaggcaatagagagagagtgacaagagttgtctcgaggaaggtgtaaaacaggaagagaagaaagtatttgtagttcagcgccccaacacaattaacaacccacacacaatgatgatccatcttaagaacacatcttccacaaacagagcaatggtggcaccgaggtggcttcaactggttgcacttcctacagtacctaacccttggatttgtcatattgccaagagccacagattgctgtgagttcatctggctacagagctctgagctagcaagaggagcagtttctcccatctccacatcaaaatcaagattccaatttggtggaacagaaccagggtccgtgaacacgacagaaaaataactccataaaagcatagcaagcaggaagtggaaggagagcaggacggcgagcgcggcgagagtggtgccgccgccggtgaacagggcggggccgtagttgcagaggacgacagcgtagtaggtgacgccgacgatcgcgaggacgagcaggatcatgatggaacctagcccacgcagagccgtgcagaaccggaacacgttccacgccatcgcgacccccgccgatctgtacatggtcgccccgccaccgccgcctcgggcaaccagggaggaggacgagcaacaaaccggcgtccctcgctggataatccaggaaaacgaggtgttggaggaggattcggaattcgagattaaggaagacgaagacacgggcgaccgagcaggtcagagctggaggtgcacggtgcacctcgccgcttgttctttgcttcagatttactagacgtgggtccccccgttgccccggccggcctcgaggta

SEQ ID NO: 21889 - DNA, 2720 bp, Zea mays
ggccgcttttttttttttttttttcgaattaattacgcagcgcttatccatttactattgatagtgtataacagcggcacaaatatctcaaatggtaaatgtattgcatggcatgatataactaaactgaagtacaagactgtttcaaaccacactaatgcccagtttgcatggatgaaatcctgcccaattcacgtggatggataaagaattaagtccaaaatcctggcgcatcgccaagatttggtccatctaaccaggcgctaaaactaatttacatcacaacaaacttcctctggcaaaggtaggaggacttccccttcgtcacatacatgaagtgcaacagatgaataactcatggttactattactacaatcatcttgtgcacatttcactagatgccttgcatagggcaatcagcaatgctgacagttgtatgagtagatgtccaacactgaggtatctgacgaggacactgttagaattgccccattacaattcctggccatcaaaatctggtctcactgacaggataatcaagaccctgtagagctggaattcttctcagatcctcttctgaatatgcagggatgaaccaatattttctgtcatttccaaaaacctgagcaaaattcctcttccggccaagatcatatatccaatgtggagttgtcttcttctcatatgcctcaattgtcgtcgtattagccgaaacaagtgaaatatgcataatcataaaaccaaaaacgctcaaggaaaaggccagattcaacacaaaggtgagaaatgtggttgcaagtgctgcaggacttcctgggatctcgatatcactgaagaaggctatgaagtgaggcaataaagagagtgtgacaagagttgtctcgaggaaggtgtaaaacaggaacagaagaaagtatttgtagttcagtgccccaacacaattaaccacccacacacaatgatgatccatcttaagaacacatcttccacaaacagagcaatggtggcaccgaggtggcttcaactggttgcatttcctacagtacctagcccttggatttgccgtattgccaagagccacagattgctgtgaattcatctggctactgaactctgagctagtgagaggagcagtttctcccctctccgcatcaaaatcaagattccaatttggtggaacagaaccagggtcagtgagcaccacagaaaaataactccataaaagcatagcaagctgcaaaacagagagtaaattatcctattagcacactaaacaaaactgagagagaacggtgtaacataattttactagtgtttacagttaactatgttggtaggcaaagcaccagaagttcagccaaccttatggttctataatcagtagcgctcaaatgtattggattagatcatctaggaaagtttatttttcttattaaacttctttcagcatagttggctccattttaacatttgacgtatcctctattaaacaaacctaccatgttgtcagaaaaaaatattagtaaaacaataattgtagccgaatcaagacagtcgcatccagtgatgttcaaaatccatacgatataacaaaattgctcccaagaactaagatcggcacccaatgatacccgatcccgctgatgttagcatcttcaccaccaaaagagcagatatttctccggaaggacgacccatccgaatctccccaccccactccctagctacgtgaggctacgcaccagaaagtggaagaggagcaggacagcgagcgcggcgagagtggtgccgccgccggtgaggagggcggggccgtagttgcagaggacgacagcgtagtaggtaacgccgacgatggcgaggacgagtaggatcatgatggaacccagcccacggagagccgtgcagaaccggaacacgttccacgccatcgcgacccccgccgatctgtacatggtcccccccgctacctccgcctccgtcacggctgcctcgggcaaccagggaggaggaccgagcaatacaccggcgtccccccgctggatgatccagaaacaaggcgtcggaggaggattgggaatttgagattaaggaagacgaagacgggggcagccgccagccgggcaggtagagctggaggtggacctcgccgcgtccttgttccttgcttctagatttgcttcggtgacgcgttctacggccgccctcgcgcgtccccctattttcaaagcgaattaataactgaatccttacgaagttcgctgaaaattgctaaaaattatgtcaaatcccaagtctatttctgtgtacaacgatgaagcatacgtaacaaaaacccagtgacgcggttaatataaggtagtgtttggttactagggactaatttttagtctctccattttattccactttagtctataaattgcaaaatatagaaactatgactttattttagtttccatatttgacaatttagtgactaaagtggaataaattggagggactaaaaattagtctctaaaaccaaacaccccataagtagaatctacggtcgctaaactttagaatgataaatcgaatttttcgtttttagtgcatgtgttgtaaatgaaagccgaaatggtgttttccattgcatcaaagcacttagccttcattttactgccaagaatataatgaatttatgcctttgttacgcgtgaaaagaagatgatgttta

SEQ ID NO: 21890 - DNA, 1502 bp, Zea mays
aaacccacaaacgtatattcttaaatacctccccggcgcgatggccgcggccgcggcagaaacacagatgggcgacggggctccgccgccaggggctctatactccttcggaacgccgtggccggagctcaatcaaggcctcacctacaccgacacgttccgttgcgctgatgcggacgccgctaccaccttgattgagttctactctactaaccacaagagctcggcgccattgccagggtggatcaagaggattcgtaatgggcagataaccgttgatggtgaagttgtcactgatccagatatgactctggtggatgggtctaagttggtatatcatcgttttccttggcaggagccatttgcgccgtatttgctggaagtgctctacgaggatgatgacatggttgcccttaataagccttctggcttgcaagttctgcctaaaggactgtttcagcagcgaactgttttagcacagcttcaattgaaagactggaagatggcctcatcttgccggttcaagagaaaagatgtgcagtcacatccagtacctgttcatcgtttagggaggggaacatcaggcctcctgctttgtgccaagacaaaagttgccaaagttcgacttgcatcttattttgctgaaggtgctataaatgctgcaaagaaaagggataaatcagagttcagtgaagagcgaaaaatttcaaaattttatcgagccttagtgactggcatacttgatgatgatgaggttgttgttacgcaacctatagggttagttcattatcctggagttgcagagggactttatgcagcatgttcctcaggaaagccagcaatgagcaaagtatgtgttcttgagagacttgcacaccaaaatcacacactggtccaggttgaaattcattcaggacgacctcaccaaataaggatacaccttgcatacattgggcacccacttgtagatgaccctctctatggtattggtgggcaccccaattttgttgagccagaatctactggcacagatagttcttttgcatctgatgggggttatgagagacctttgcaacctgttcctggagactgtgggtatcacctgcatgcacattggctggttctttgccacccaacaaccaataagatggtaaaaattaccgctcctcttccacaaattctacagacacgggaggaacgccgcgctgcagctgagcaaaccgctggttgatcatgtagaaccttgaaaatgtatatttcttgaagttagcaagcagcaggttctcacagacgttagacactcagacatctgctcctctgtcaactgtacaacggcgagctctggttctcacagacgttaggctaccgagatggagagataacatcaggttaaataaaaataaatagagtactagctaatgggctctgtgactgtccctgaatcttgttcagtctattcgaagcgcaattcgctggaaaaaccgctttttcgctcacacaaa

SEQ ID NO: 21891 - DNA, 1642 bp, Zea mays
cagaaacacagatgggcgacggggctccgccgccaggggctctatactccttcggaacgccgtggccggagctcaatcaaggcctcacctacaccgacacgttccgttgcgctgatgcggacgccgctaccaccttgattgagttctactctactaaccacaagagctcggcgccattgccagggtggatcaagaggattcgtaatgggcagataaccgttgatggtgaagttgtcactgatccagatatgactctggagccatttgcgccgtatttgctggaagtgctctacgaggatgatgacatggttgcccttaataagccttctggcttgcaagttctgcctaaaggactgtttcagcagcgaactgttttagcacagcttcaattgaaagactggaagatggcctcatcttgccggttcaagagaaaagatgtgcagtcacatccagtacctgttcatcgtttagggaggggaacatcaggcctcctgctttgtgccaagacaaaagttgccaaagttcgacttgcatcttattttgctgaaggtgctataaatgctgcaaagaaaagggataaatcggagttcagtgaagagcgaaaaatttcaaaattttatcgagccttagtgactggcatacttgatgatgatgaggttgttgttacgcaacctatagggttagttcattatcctggagttgcagagggactttatgcagcatgttcctcaggaaagccagcaatgagcaaagtatgtgttcttgagagacttgcacaccaaaatcacacactggtccaggttgaaattcattcaggacgacctcaccaaataaggatacaccttgcatacattgggcaccctcttgtagatgaccctctctatggtattggtgggcaccccaattttgttgagccagaatctactggcacagatagttcttttgcatctgatgggggttatgagagacctttgcaacctgttcctggagactgtgggtatcacctgcatgcacattggctggttctttgccacccaacaaccaataagatggtaaaaattaccgctcctcttccacaaattctacagacacgggaggaacgccgcgctgcagctgagcaaaccggtggttgaacatgtagaatcttgaaaatgtatatttcttgaagttagcaagcagcaggttctcacagacgttagagttagacactcagacctctgctcctctgtcaactgtacaacggcgagctatggttccgcttgatgcagcgccgtctcatgtgacgtttaggccaggctaccgagatggagaaataacattaggtatttaaaaataaatagagtactagctaatgagctctgtgactgtccctgaatcttgttcagtctattcgaagcgcaattcgctgaaaaaaatgtttttttcgctcacaaatatgatttggtttgaaatggagggaggtgataattgtagaagaagatttccaatgaattcatttgcgtgcaatggactgaccctactttcgcgttacacataaccaaacattcctccccccaaaacctcccgaacaaagaggattgggaattaaggagggcgcggcggtggcgagcagcttctgctcagcgaggcagaggtaccgagc

SEQ ID NO: 21892 - DNA, 1497 bp, Zea mays
  misc_feature (17)..(18): n is a, c, g, or t
  misc_feature (1373)..(1373): n is a, c, g, or t
  misc_feature (1376)..(1376): n is a, c, g, or t
  misc_feature (1380)..(1380): n is a, c, g, or t
  misc_feature (1395)..(1395): n is a, c, g, or t
  misc_feature (1437)..(1437): n is a, c, g, or t
atattcttaaatacctnncccggcgcgatggcgcggcgcggagaaacacagatgggcgacggggctccgccgccaggggctctatactccttcggaacgccgtggccggagctcaatcaaggcctcacctacaccgacacgttccgttgcgctgatgcggacgccgctaccaccttgattgagttctactctactaaccacaagagctcggcgccattgccagggtggatcaagaggattcgtaatgggcagataaccgttgatggtgaagttgtcactgatccagatatgactctggtggatgggtctaagttggtatatcatcgttttccttggcaggagccatttgcgccgtatttgctggaagtgctctacgaggatgatgacatggttgcccttaataagccttctggcttgcaagttctgcctaaaggactgtttcagcagcgaactgttttaggcacagcttcaattgaaagactggaagatggcctcatcttgccggttcaagagaaaagatgtgcagtcacatccagtacctgttcatcgtttagggaggggaacatcaggcctcctgctttgtgccaagacaaaagttgccaaagttcgacttgcatcttattttgctgaaggtgctataaatgctgcaaagaaaagggataaatcagagttcagtgaagagcgaaaaatttcaaaattttatcgagccttagtgactggcatacttgatgatgatgaggttgttgttacgcaacctatagggttagttcattatcctggagttgcagagggactttatgcagcatgttcctcaggaaagccagcaatgagcaaagtatgtgttcttgagagacttgcacaccaaaatcacacactggtccaggttgaaattcattcaggacgacctcaccaaataaggatacaccttgcatacattgggcacccacttgtagatgaccctctctatggtattggtgggcaccccaattttgttgagccagaatctactggcacagatagttcttttgcatctgatgggggttatgagagacctttgcaacctgttcctggagactgtgggtatcacctgcatgcacattgtctggttctttgccacccaacaaccaataaggacgaaagacttctgacgcccctgagcttgagtttccgttggagcggatttcaggcttgatttttttttaaaaaattcccatattcgagtttcccctctatgtattgtagggaggaaaaagtaggattttactcttgttgtgaactgcttttactgctgatctgacagaaggcaggaacccctagaatttagaccagaaaaatgaactcccaaaaaaaaaaaaaaaatgttttaatggcantantganctactgcccattccntgtgtgactatgtgcttaccatgccgctatgcagatggtaanattccgctcctctccacaaatctacagacacggaaggaacgccgcgctgcagggggatcc

SEQ ID NO: 21893 - DNA, 956 bp, Zea mays
ggttataataacagcgaccttttcaatattcctgtcatttgcattgcagctacggaactgtcaagaaatattttggacagcaagcaggattgggctgatggagcagatccgggccccccctcgagtttttttttgtgtttgtgagatagaaagactaatgagataggctaaagctgctcatcggtattttttttcctgtttcaagctactcttgtcattacaaatttgttgaggcttataagttggattaaataatgcactttcaccaagttgctatcagtatacgctgctacaagctaactctgcgagaagatgcatcaaatcagccaaaaataaaaaagaaagaatatcaacgttcttgcatgctcgttgaacagctagctatatgagagctttgatgccagcttgttgcatctcacgcagccgccagactgggtaataggattcttcttctggcacctcgtcgctgtccatgagttgcatagcccacgaatagaagacggtttggatggtatcctgtcctccttctgtgacttgtccttctcgatctcgaacacagtatatctgctgtgtttggaagcgtaagataattatgggtgaagatccaaacatctttgtttccaatacatcagcttctgaaatgtgcaggattttgtgatcaaaaaatattccctgtgatgcataagcttctctctctcctttgcagcgctcaatcacttccttggtgcagtagttttttagagtctccgcatcaccctttgaatatgcagttaaaactggcttgatcatttcttggacatcagcaacaaaatcagaaagagaaaaggacgggtctcgttgccgaatttccctgaatgtcaccgcagctgaggtttcttcaagcaaagattcattccagcctcgaggttcctgcaccactggtcaacaacgtgtcagtcacaaaaaatatatatatt

SEQ ID NO: 21894 - DNA, 1700 bp, Zea mays
gattaaataaggcactttcaccaagttgctatcagtatacgctgatactaagctaactctgcgagaagatgcatcaaatcagccaaaaataaaaaagaaagaatatcaacgttcttgcatgctcgttgaacagctagctatatgagagctttgatgccagctggttgcatctcacgcagccttttttatggggtaataggattcttcttctggcacctcgtcgctggccatgagttgcatagcccacgaatagaagacggtttggatggtatcctgtcctccttctgtgacttgtccttctcgatctcgaacacagtatatctgctgtgtttggaagcgtaagataattatgggtgaagatccaaacatctttgtttccaatacatcagcttctgaaatgtgcaggattttgtgatcaaaaaatattccctgtgatgcataagcttctctctctcctttgcagcgctcaatcacttccttggtgcagtagttttttagagtctccgcatcaccctttgaatatgcagttaaaactggcttgatcatttcttggacatcagcaacaaaatcagaaagagaaaaggacgggtctcgttgccgaatttccctgaatgtcaccgcagctgaggtttcttcaagcaaagattcattcaagtcttgaattttctgaaccactggattgtcacttgtctcccatctttccctgacatcttcagctacctcttgtcccttggttacaacaggcttggtgtattcatccactcttctgtagaccgggtgacctcggatcttattcttaaattcttcccatttttcacccaatactgtcttttttgttggcgtaagaactaaatcggttcttgtactcttttctactttagcagaagcatgcctagcttggtgttttttctttctgctagagttagagcttaattcatccttgacgatttcatatccctgccccgctaaagttgagacttttgtgcggatcaacggtgcaaacgcaccggatactactggtgaagcagatgagattgttgacttcaatttagtaaacaatgtatggctgtctgtggcatcttcagtcgtgccatctgaatgtgaggatgcctcagttttctcatgttttgaaccttcaggcaaaccatccctgcaacttgtactctcttcttttccaactccaaaactttcctttacctcttctttagcagcaaacattttttctttgatatttgcagtaacctttttagatgtctcctcagcttcactccaaacatcatcaacacgcttgtatattgtctcagtcgttttcttagttcttactttgagatcttccttcaccacatcaagtttctcgctgaactccttcatggatttctggaattcaggattgctcttggcctcaccctttagttgcttagaaaactcattgaaaacgcttaggttcctgttattcagatgtctatatccattagttgtttgcacatttgcctttgtagccaatcgcagcgcggcttcggatgagggccgccggagagcccggagcagtgctgtggtcgccatccctggcgggtgttcgtcgccggcgaaggcctcggtatctaacgtagggcggcggcggcggtagcccacccagtcgtcgcagagagagaaagagggagacagcacacgcggacgcaggtgaagatgaacggagccgt

SEQ ID NO: 21895 - DNA, 1770 bp, Zea mays
gttttagcctggcgcttaaatagcggcaccttaccggtctgcttgtgcttcataagcatgacagcgcccgtgccccgttccttccattggttagcgtctttgtcgaaccggcccagcttctcctttcatgtcgagcagtacgtcctctgtctcttcctcgccggtggtttcggcttcctccttttttttttttttaacgaaacggaaacaatttcatgccacattttattgccaccacaataccaaccatgtctattttgcaaggcaaatccgtggcaagtcactcagacgctgggtactgcacctagtagaactttttccattgctttccctgggtccgaagaaaaagtatacctatcacttgataccatttcaagacgaaatgactgggcaaagatatatactgtacaaaaggcgaaatgacaaaactcgcaccatgccaggcttcatcagcgcaacgctgcaaagaatttaactagaaataacatatatctacgggtgccaacaaacttggagcagaataaggtgtgcttgctgcacatttggttggttccataaccaatctgggtggccatcgtgtagggtggcatcaaaaaccattgccactcgttgcggggttgaaaggaagttgctcgccagaatggtttgacctccttgaccttgactgcttcggggttgaatatgatgagcttccatcattgaatccgtggagggatgaagaaagcccatgggcccttggtagaccaatcgcatcagaatcgagggagtatccaccacccctctctactgcctctgcgtcaagtggtatctcatccaaagttttgtaagcttgttgaaggaccttaagattttcacgtatctgcttcctctttatggttagctcatcaggttctttgagcaagtcttccaaaagatcatctctataaagttttgttatgaggtaattatgcagtgccctttttgtgtgattaaccaggaaatgcataattgcttttggtatgaagtcctccacatttttcctgacaatattgtaatatgacttcaatagcaactttgtaattgctatttcaagtgcctcctgctcagactggtgttctgaaggcttcaggacgactggtggctctcttaactgtatagtggagaatgaatgatccagattaggggcaggcatagcataagatttgtttgctgtgttatctcttgcaggagcatgtgttcgatcctcattggaagtaaatatttgattccagaaagatgtgcttccactaccagaagatcctggtctctctgcctcagcagcaggccgtaccccctggatgtggtcagtaactactccatttacaccacttctacccaatatcgggcgtgatttttgagttttctcagaaacctgtgaatccactccatcctttcttactaccactgcagacattttggcagacctaacttgctgctgtgcttcctcaacagccttgctgcaaccaataaaacttgggtgcgatgtgtttatgtaatcttcctccatctcaataatgtgtgatatcatactttctgctggcttaagtccatcccgcaaaaacttcccaatgacttcatccatgcttctgcggagtataggaaactgctgcaactccgttgcaaggcagcgatggctcatctttacaagttcatcatatatgaactgtgcacactgaagacttggatcaagcaatctgctgatctgcctacgtacaaggacttcaaatgaaacaacaggtacaaacagagcac

SEQ ID NO: 21896 - DNA, 1388 bp, Zea mays
cggcatattgaattatgggatattgattcaaatcaaacagaatgcttatagcagtactacaacaacaaaaaaggcagagaaagaaaaaatattcagcggttgttaatgctgatttacaaatgcataattattaacaaagtgctatcaaatcaaaacaaaacattaagaaaacgagaacaattttatgccacattttgtttttgccgccgccataccagccatgtctattttgcaaggcaaatccgtaagtcactcagacgctgggtactgctacacacctagtagattttttttcccattgctttccctgggtccgaacaaaactatacccatcacttgatatcatatcatgacgaaatgactgggcaaagatatatactgtacaaaaggcgaaacaacaaaactcgcaccatgttaggcttcatcggcgcagcgctacaaagaatttaactagaaataacatatatctattggtgccaacaaacttgaataaggtgtgcttgctgcacatttggctggttccataaccaatctgatctggttggccgtcttgtaacgtaggagggtggcatcaaaaaccattgccactcatattggggttgaaaggaagctgctcgccagaatggtttgacctccttgaccttgactgcttcggggttgaatatggtgagcttccatcgttgaatccgtggagggatgaagaaagcccatgggcccttggcagaccaatcgcatcagaatccagggagtatccacccctctctactgcctctgcgtcaagtggtatctcgtccaaagttttgtaagcttgttgaaggaccttgagattttcacgtatctgcttcctctttatggttatctcatcaggttctctgagtcccgtcttccctgagatcatctctataaagttttgttataaggtaattatgcagcgccctttttgtatgattagccgaaaggccaatcggatatgaatcacataccaagaaatgcataactgcttttggtattaagtcctccacatttttcctgacaatattgtaatatgacttcaatagcaactttgtgatcgctatttcaagcgcctcctgctcagactggtgttctgaaggcttcaggacgactggtggctgatcaacaagggtgtgcgtcaaacactcactgcatcagaagatcctggtctctctgcctcagcagcaggccgtaccccctggatgtggtcagtaactactccatttacaccacttctacccaagatcgcgcgtgatttttgagttttctcagaagcctgtgcatccactccgtcctttcttaccaccgctgctgacattttggcagacctaacttgctgctgtgcttgctcaacagccttgctgcggacgcgtggg

SEQ ID NO: 21897 - DNA, 944 bp, Zea mays
aaacgaaacggaaactatttcatgccacattttattgccaccacaataccaaccatgtttattttgcaaggcaaatccggggcaagtcactcaaacgctgggggctgcccctagtataactttttcctttgctttccctgggcccgaaaaaaaagtatccctatcacttgataccttttcaagacgaaatgactgggcaaagatttatactgtacaaaaggcgaaatgacaaaactcgcaccatgccaggctttatcagcgcaacgctgcaaagaatttaactagaaataacatatttttacgggggccaacaaacttggagcaaagtaaggggggcttgctgcaatggttggttccataaccaatctggggggccatcgggtaggggggcatcaaaaaccattgccactcgttgcggggttgaaaggaagttgctcgccagaatggtttggcctccttgaccttgactgcttcggggttgaatatgatgagcttccatcattgaatccgtggagggatgaagaaagcccatgagcccttggtagaccaatcgcatcagaatccagggagtatccaccacccctctctactgcctctgcgtcaagtggtatctcgtccaaagtctgcatggtgcagaagaaacgtgaggtgaaaagctagtgttggaaccaagtggtgccaagacttctgaacggaagaattaaagaactgtgaaaacgtactttgtaagcttgttgaaggaccttgagattttcacgtatctgcttcctctttatggttatctcatcaggttctttgagcaagtcttccaaaagatcatctctgaattgggcaatatatttaagagtttggagcaaagttgtaaagccatagtgcataaattatcttttgcttaacatgtaataggttgtgttctaaataagagcaaataagtattctcacct

SEQ ID NO: 21898 - DNA, 3212 bp, Zea mays
aaaaggggatttactttggtatttttcaaggtttttacaagtcaatttttttgtcaaacaccgggcagtaaaatggtgttttagttaaatataaaaagcttttttttttttggaatgctagcgtttttttatttttgttttttttattttttttttttttttttttttttttttttttttttttttttttttttttttttttttttatcaaatcaaatgaaaacattaagaaaacgagaacaatgttatgccacattttgtttttgccgccgccataccagccatgtctattttgcaaggcaaatccgtaacagtgactcagacgctgggtactgctacacgcctagtagatttttttttccattgctttccctgggtccgaacaaaactatacccatcacttgatatcatatcatgacgaaatgactggatatatactgtacaaaaggcgaaacaacaaaactcgcaccatgttaggcttcatcggcgcagcgctacaaagaatttaactagaaataacatatatctattggtgccaacaaacttgaataaggtgtgcttgctgcacatttggctggttccataaccaatctggttggccgtcttgtaacgtaggagggtggcatcaaaaaccattgccactcatattggggttgaaaggaagctgctcgccagaatggtttgacctccttgaccttgactgcttcggggttgaatatggtgagcttccatcgttgaatccgtggagggatgaagaaagcccatgggcccttggcagaccaatcgcatcagaatccagggagtatccacccctctctactgcctctgcgtcaagtggtatctcgtccaaagttttgtaagcttgttgaaggaccttgagattttcacgtatctgcttcctctttatggttatctcatcaggttctttgagcaagtcttccaaaagatcatctctataaagttttgttataaggtaattatgcagcgccctttttgtatgattaaccaagaaatgcataactgcttttggtatgaagtcctccacatttttcctgacaatattgtaatatgacttcaatagcaactttgtgatcgctatttcaagcgcctcctgctcagactggtgttctgaaggcttcaggacgactggtggctctcttaactgtatcgtggagaatgaatgttccagattgggtgcaggcacagcataagatttgtttgttgtgttatctcttgcaggaggatgtgttcggtcctcattggaagtaaatatttgattccagaaagatgtgcttccactaccagaagatcctggtctctctgcctcagcagtaggccgtaccccctggatgtggtcagtaactactccatttacaccacttctacccaagatcgcgcgtgatttttgagttttctcagaagcctgtgcatccactccgtcctttcttaccaccgctgctgacattttggcagacctaacttgctgctgtgcttgctcaacagccttgctgccaccaataaaatttgggtgtgacgtgtttatgtaatcttcctccatctcaataatgtgtgctatcatattttctgctggcttaagtccatcccgcaaaaacttcccaatgacttcatccatgcttctgcggagtataggaaactgctgcaactccattgcaaggcagcgatggctcatctttacaagttcatcatatatgaattgtgcacactgaagacttggatcaagcaatctgctgatctgcctacgtacaaggacttcaaatggaacttcaggtacaaacagagcacttctaggaccagttgcattttgaatagccatgcggatatcttcatctgtaacatcctcacaaggatcaacctcctctaaacttttgacaaagatagactggaaaatgtaatggatccttgctccaccagagagttcaattgtcgatatatcttcattttttccttccaccattgaggagaaagcttcacagtatttagctagtatgttcaaaagcttagcaccttggccagcctttgaatcaacaggatcaccatacacagcaagctccttagcaacagcagtcaactgactgcttatgcgtgacttaagccccggcaaaactgtttttatatgttggaccaggatctggtttagcttctttgctaattgtggtatcccacagtactgagcaataccatgatatgctggctgagtacggaagaatttttcttcacgagccagagcatccttgatactgaggtcagagttgatatcctgctggctgcggttgacgacaccaacatagccaagctttaaggggatcacatttcccagcagaaagttccgggcatcagtgcccctgtccattatgtccaactttgtgataacaccaattgttcgagaaccatcaggatcagcaacccgagccatttgaagagcatcagagtttgctaaatctgcatttgctggcgaaacagctaagatgatgcatgtcttgtgcctgatgtatgacattatcatagtccttattctggcttcaatatcagttggctggtcaccaactggcaccttagtgattccaggcaaatcgactaaagtaatgttaaggacattcggagaaaagatcttcaaccgtatctgcctatccgatacacctttgttaccacctgcctcacgatctgtttcagcctggatctcgcgtcggatttcgcggaagtcgtagaagcgacgccccgagaggtgcaggaactcgccccactcatcggcctctgcgtcggcggggcggcgcggctggtgcacgagctggagcacgagggggcggcgcgtgcagatgtcggagccccgcgggaggaagtcgcggccgacgagcgcctcgaggacgctggcacttgccgctgctctggctcccgaccacggccacctgcggcaggtcgatcgtggagctgctccccagctgcgcgaagatgtcctgcagcttgttgacgattgggatcaccgaggacccgaccgccgccgcggcagcggccgcggccgccgatggggcggacggcgcggaggagaggtggtcttcggccatggtccggggggcgggggcgtgcaggctccgccgctaggctggcctggggatttggacgaggagagcaacgagacccgggaagggaatccctagatcttttcgattaggatgttctaggtaatggtctcgtgc

SEQ ID NO: 21899 - DNA, 1622 bp, Zea mays
  misc_feature (30)..(30): n is a, c, g, or t
attgggaccctcgaggccggccgggtatanggtacaattgcaaagatctcaagtaatgtgatttcttatgagcttttttaatgacaaaaagaatcttgcactaaattcatttgtgtttacatctttttggaaatgctcatgttttcatgttctaatgtgctcaatattttgatacaggatgggttctgcaagagctgtcaatcgccgatatattagtgattgtgtccctgcaaggatacgcatgcaagcttcggctggatttgttagcgcaagtgcacttggcatggcctgtgggccagcgctagctggtttacttcagtggaaattcaaggtctacctcgtggccggccggcaatcgactctaccgggttgggtgatggcagttgcatggctattgtatttgatttggctatggttctcattcaaagaaccgaaccgtgctaccgaggtgaatgaagccccacaaaatcctgcttctggacaaactgttgatattggacgactagagaatggaattgcacagcctctgctcaaggattccgtggataaacaaaatgaagatgaagacgaagttgatgatattgaagaaactgcagatgattctcgcaaacctgcaacatcaattggctcagcataccgattgcttaccccgtcagtgaaggtccagttgttgatatacttcatgctcaaatacgcaatggagattttgctttcggagtcgagtgttatcaccaatcactatttcagttggaatacaagcgcagtggcaatatttctagcaatcctagggttgacagtccttcctgtaaacgctgttgttggaacatacatcagcaatatgtttgaggacaggcaactcctcatggtgtctcaaattacgttgctagtaggcattatcttcagcttcaaagtcacgagcacatactatgtcgtccagtatgttgtctcagcactggtcacatttgtttctgccgaagttcttgaaggcgtcaacctttccctcctatcgagcgtgatgtcgtcccgcctctcccgtggcacgtacaacggtggtctcctctcgacggaggctgggaccctggccagggtggtcgccgactgcaccatcaccgcggcggggtacctgggcgtggggaagctcctcaacgtcaccctgctaccgtcgctggtgatatgtgttgcgtccatcgcctgcaccttcctgacgtacaactcgcttttctgatggagcttcgcgacgtatttgtgtcgtcatgattcgttccaaatcaaggcagctgggagaccgccgttgccattgcccgaaggggctgttgtgttattatattatatatgtgcgtcgatttgattgctgtaaattgacaaaatgatggcagccactggccttgccctgcaaaattttgatcgcttatgtccgtgacgttgtcaatgctatgttgtgttgacgtgttggtccaaactgtaattatgctactctcgactgatctgatctccgctgcgatgcggttttgagagtggagtcgtacgagagtggatcggcgtttttgtccattgggcttgattggatttatgtgataaatagtttgtcggccaaaaaaaaaaaaaaaaaggcccctagggcc

SEQ ID NO: 21900 - DNA, 6116 bp, Zea mays
ggccggccgggccgggtctcccctccccttcccctgccactctccgcctctggcctagcgcccccgcccgctcgatccgcctagtaggtaacggcgaggctcaccgctcactcgcccgtgaatccgtgatttctcccaccttcctttcaccgccgctctcccaccttcctttcagcgccgcccgccgtccttttcgatcagtatttaaaaatcaagatggttaacttcgggaagaaattgatggcagatcaaattccagaatggaaaggatattatatcaattacaagttgatgaagaagaaagttaaacagtatggccagcagctccagcagggggaaaaagatcgtcgtcgggttctgaaggatttctcgaagatgcttgatgatcagatagagaagatcgtcctgtttctgttggaacaacaaggactattggcaagcaggattgagaagttaggaaagcaaagggcaatactacaagagcagccagatatatctggcattgctgagttacgagaagcttatagggaagttggtatcaatctcatcaaacttctcaagttcgttgaccttaatgcaactggcattcggaaaatcttgaagaagtttgataagcgttttggctatagatttactgattactatgtgacaagtagatcgaatcacccttactctcagctgcaacaggtctttaagcatgtgggtgtaggagctgttgtaggagctttgtcacgtaaccttgctgaactccaagaacgtcaaggaagctacttatctatttatgatcagccatcttctgctcttaaggacccatcattgatatgataaattcttcagttgataagttgacaaggtcaactaattttcttcgctttttggggcaacatgccttgattgtggatgaggagtctcctagcactgcaggagaggaagaaatagaagatcagaaataccatttcatgtcccttatgctgaacctggtgaacacattcctttacatggtcaacacgtacatcattgtgccaactgcagatgactattcagtaagccttggggcagcttctactgtttgtggtgtggtcattggttcaatggctgttgcacaaatattttcctctgtttacttcagtgcatggtccaacaagtcatatttcaaaccgcttgttttcagtagcattgttttgttcttggggaatgtatgctatgcaatggcatatgatatgaagtccctaacagtccttattatcggccgtttactctgtgggtaagtatcctggcacataatcacagttgaaaatttcaactatacagtttgaatagtgggcttttgattatctggctatatcctttcttgcattagggcattggtttaatggttaattgtaaattgtagtggaagatcgaatagaaggaaaatggtttcttctctcgtcagtagccagtgtccttcattttcaggattgacttcttaagtagcaagtgtactctttcatactattgctgaaattaggatacaattgcaaagatctcaagtaatgtgatttcttatgacctttttttattgacaaaaagaatcttgcactaaatatttcattcgactttcaaccctgattttttgtttacatcatttcagaaatgttctatgttttcatgttctaatgtgttcaatattttgatacaggatgggttctgcaagagctgtcaaccgtcggtacattagtgattgtgtccctgcaagaatacgcatgcaagcttcggcaggattcgttagcgcaagtgcacttggcatggcctgtgggccagcgctagctggtttacttcaatggaaattcaagatctacatggttactttcaatcaatcgactctacctggttgggtgatggcagttgcgtggctattgtatttgatttggctatgggtctcattcaaagaaccgaaccgtgctactgaggtgaatgaagccccacaaaatcctgcttctggtaagtccaaaatctgatgtgttcctttccttactcttacgttgttcacttttaagtagagttatctgatccactaattttcaggtgtgtgtgatgatatgatccattttcttgtgatttattaattgtatgcttatcatgattacaggacaaacggttgatattggacaagtagagaatggacttgctcagcctctgctcatggattccgtagataaacaaaatgaagatgaagatgaagaagttgatgaaagtgaagaagctgcagatgattcacgcaagcctgcaacatcaattggctcagcatacagactgcttactccatcagtaaaggtattagggtattgttatgccaaatggttgcttctcttgattagctactttactaatcttgctcttgtttatttgaatcccagtaaattactgaaggattggaaataagctagataattcttgcactacagacagcctatatagcttttgatttgtaccggttccgtacacaagttttccttgcactagataatggcaaggggctggtgactctaattgttttaaaaaaaaaatcaaagccactagaaattgaggttacatgctatatatttgactaatttgaggatcaaagaaaaatcttttgtcttccccgtacccatgtgaggcttttccaattccgaccacctcattcaagccaagcatgatgctatgctgttgtaatctcttactttcggtcgtcttgacttatttgtactttgctcatacaggtccagttgttgatatacttcatgctgaaatacgcaatggagattttgctttcagagtctagtgttatcactaatcactatttcagttggaacacaagcgcagtggcaatttttctagcaatccttgggttgacggtgcttcctgttaatgctgttgttggaacatacatcagcaatatgtttgaggacaggtttgtggatttttcatgcctcagtacaagcattggtcaagcattaatcactatttccctttttgttttattgggaattattagcattggtcaatggttgatggacaattcgctcagtactgttatatagacgcctagaactctgccctttttttattttggagtgaaaacctacaggctactccttttttttttttttggagtgaaaactctgccttttacaaatttgttcgtgtttttgccaggcaactcctcatggtctctcaaattacgttgctagtaggcattatcttcagcttcaaggttacgagtacatactctgttgtccagtatgttgtctcagcacttgtcacatttgtttctgcagaagttcttgaaggtaaatgaaaaatccatttctttcttaagtatgtttctccttggcattgtatcaaagtctctcgtcttattggcaaaatgcaggtgtgaacctttccctcctatcaagcgtgatgtcatctcgcctctcccgtggcacatacaacggtggcctcctctcgacggaggccgggaccctggcgagggtggtcgctgactgcaccatcactgcggcggggtacctgggcgtggggaagcttctcaacgtcaccctgctaccatccctggtgatatgtgttgcgtccattgcctgcaccttcctgacgtataactcgcttttctgatggagcttcacaatgtatttgtgtcatcatgattcgttccatattagcgcaaatcaaggcagctgggagaccgccattgccattgcccgaaggggctattgtattactattattatatgttcgtcgatttaattgctgtaaattgattgataaaatgatggtagctactgaacctggtcttgccgtgcaaaattttgaccgactctatccttgtcatgaatacatgctgtccatattatggcactctcggctggtgagtgactccgcatgagttttggctaatagaaccttattgccatatgataagcacccctactgccacataatagaccaatggcgatcatcaacagttgcgtgttgcgtttaaaatctcaaataacatgtatcactactaaactaggtaagtgcctatgcgttgaaacggggacatataataccacaataacttatgaacaaatatgtattatactgttatgagaaaatgtttcgtaatctattttgtgatcttagccatcataaatttattattttaatctagcttatttaattactacattcaaccatcagtgccatacaaacatctatatatgataggtatatgcttgtacattactacataatcaatataaaatacattgataaaaaaggcttattattctatacttttattagcatcaccatgatccttgagttcatattctgagcttgatcaaagtaatcctcaaacacattacgagaggagagtttcccaaacattagctcatatgttggcaccgccatcctgcatgtccaaaactggcacaatgaagagccaaggctaacataaatgcaaccctaagtgcagtgtagtgatgtctcatccttccagtggactaaaaattaactttataaccttattaaaattatgcagggaaagatatctgcgagagatgcacatattccaagaataagcaaacaaccagaattgatggatcgggtacctcacaatatcaccacaaatctgacatcaatatatttcatggatactgctggtgtagcgcgagggaaggcaggcagaggtgggaagtacacagtgttgatgacgtattgatccgcgcacatacaaatagaagtgtggatcagtgtgcaaaaagtgtatgcctgcaggcttgcgcatgtacatagtgcacagttacctcattggtaggtacccatcatagttgaatgttcgtaatgaacatgaatcagcacacgtgcaactcgagtactctatctaccatggataacaatggagaaaccagaaacaatcatagtagcaccaagagggtgactgtaattctagtgtggaataaagatcattttgggtatgttacatgtcattaaggacataaaaataatcatatgaacaaaagaaacataaacaagaactcatagttgcatttgtacatctgaaaggaaaatattggttgaatatgacttcctcagtggtcatatgcagccaccctcaaacgatgtttcttatctgagcttgttctccagggcactgatgttcattaatacggtttctatatatcacatagactgtgtttaaatgagattatatatgacaagtttgccatttgatcctaatgtaactatgagtagagattatagagaacgaacttacatgttgtcccaacaaaactttccattcaagcatatagtcaggcaaggaaagtcttatcatataagtatgaagttgacatatttcaactatgtttcaaacctttataattatgaagttgacatattttagttgcttgtccaggctctttataaaatagattcgccactgctacatccgatgcaccttcccatgccaccacaccacgaatctcctcctcgagcaccagctgcttggtgcacgcccactaccccgcacacaggtgtgcatgagccattgacacactctccatgtagtcgaacatcgacgcgtagaaccgctccaggaacgtgggcgtgttgtggttcaccttcgactctgccaccaccgtgatctttggcatcagcgcccgcaccgcacgcaggaagctccccagctccggccacattcctagagcgcccacactctgcatgagctttatcataagcaccagcttgcttcgaattaggagtggatgtgatatccctgacattggtgtccacaaggcccctgccataccccatgaagctatgcaattctagttaaaacatgttaagacttctaaaactaccccatgaagctatgcaattctagttaaaacatgttaagacttctactaaaacaaatacgtgtatgacattatgcctaaatgaagtagctgatgtattaaaaaatgagttgcccatgatccaagcatcaaccatcctcctgactgcaattcagtagttgcaatgaaaactatccttccggtaagacatgaaacaaaaatgtgttgcgcaggatcgactatagcagcaatgtccatagctggttttaagga

SEQ ID NO: 21901 - DNA, 1822 bp, Zea mays
  misc_feature (1604)..(1608): n is a, c, g, or t
ccggccggaacgagccagcccaaagcgggcccgagaagtcccaaaagtcaagagccagcccaaagttagcgtcgtcgtgtagtcgtctttctcaagagtcaagagcatcatcatttcacctagtacccagtaaatggaggcgctcgtggtgcggcagctgggcgatcccaccctgccccctggcggtgaagcctccccgttcgccgcggtctctggggatcacccagtgccggagatctcatcgccgacggctgtccgagtgcgagtcgcggcgaccagcctcaacttcgccacgttcctccaggtgcagggcaagtaccaggagcggcccccgcttccgttcgtgcctggatccgactactctggcgtggtcgacgcagtcggtcccggcgtgcgtgggctccggcccggcgaccgcgtctgctcctttaccggcctcggttccttcgctgacttcatcgtcgccgaggagaagcagctatttttggtgcctgatggatgcgacctggtcacagctggggctttaccagttgcatttggtacatcacatttggcccttgttcaccgagcccaattgaaggctggccaggtgctacttgttcttggtgctgctggtggtgtcggggcatctgctgtgcaaataggaaaagtttgtggtgctgttgttattgcagttgctaggggggctgagaaatcggattatctcaaatccataggtgccgatcatgtaattgactcaagcaaggataatgttatagaaagtgccaagtctttcttaaaggctagaggcttgaaaggtgttgatgttttatatgacccagtcggggggaaattaactcaagatagcctgaaacttctcaattggggagcacaaattcttgtcatcggatttgccagtggtgatgttccagttattcgagcgaatattgctcttgttaagaactggacagttcatggtttgtactggggaagctacttaactcaccggccacaagtactcattgattcgctcaatgaactcttgtcatggctttcaaagggtctgataacagttcaaatttcacactgctacagacttgttgaggtccatcttgctttctctgccctgagagataggaaggcggttggcaaagtgatgattgtaatgggctcctcagctgtaccaaggctctgatatcattcagaaacgtttctctacgagatcataccaaggctctgttatcattcagaaacatttctctacgagatcatgaggcttatactgtgtatctcttttatcatctgagactgaagtagtttccttgtcaataatgtggtgtatgatctacaaaaataatcagagaaataagcagtttatatcgacacagtgccaagcagcatatacaactgatgagaaacagctctaccatgccaatgctgtgagtagtggcatgtacaataaatacaacctgattaaccagcatctagatcgcaaggattggattatggtggcagtgggaagacctcgccgttcttcctatgatttacgcaatggagattttgctttcagagtctagtgttatcactaatcactatttcagttggaacacaagcgcagtggcaannnnnctagcaatccttgggttgacggtgcttcctgttaatgctgttgttggaacatacatcagcaatatgtttgaggacaggcaactgctcatggtctctcaaattacgttgctagtaggcattatcttcagcttcaaggttacgagtacatactctgttgtccagtatgttgtctcagcacttgtcacatttgtttctgcagaagttcttgaaggtg

SEQ ID NO: 21902 - DNA, 2344 bp, Zea mays
aggccgtcactcactcgacccaatccaaccggccaatacgcggtgcgaacgctcaccgcgagcgaccccgcgccgcctctcgccgggggcggctcacggctaccggctgctgccacccgcgcccgtctctcttccatagtttcacctcgttcgcctggctataaatacccgcatcccgttgctctcgcggcccctccatccctcccgacggcatccccttcccctgccactcgcctccgctccgcgcagattagtattttaaactcaagatggttaacttcgggaagaaattgatggctgatcaaattccagaatggaaaggatattatatcaattacaagttgatgaagaagaaagttaaacagtatggccagcagctccagcagggcgagaaagatcgtcgccgggttctgaaggatttctcgaagatgcttgatgatcagatagagaagattgtgctgtttctgttggaacagcaaggaatgttggcaagcaggattgaggagttaggaaagcaaagggcaatactacaagaccagccagatatatctggtattgctgagttacgagaagcttatagggaagttggtattgacctcatcaaactccttaaattcgttgatcttaatgcaactggcattcggaaaattttgaagaagtttgacaagcgtttcggctatagatttactgattactatgtgacaagtagatcaaatcacccgtactctcagctgcaacaggtctttaagcatgtgggtgtaggagctgttgtaggagctttgtcacgtaaccttgctgaacttcaagaacgtcaaggaagctacttatctatttatgatcagccatcttctgctcttaaggaccccatcattgatatgataaactcctcagttgataagttgacaaggtcaactaattttcttcgctttttggggcaacatgccttgattgtggatgaggagtctcctagtactgcaggagaggaagaaatagaagatcagaaataccatttcatgtcccttatgctgaacctggtgaacacattcctttacatggtcaacacatacatcattgtgccaactgcagatgactattcagatgggttctgcaagagctgtcaatcgccggtacattagtgattgtgtccctgcaagaatacgcatgcaagctcccccgcttccgaggattcgttagcgcgagtgcgcttggcatggcctgtgggccagcgctagctggtttacttcaatggaaattcaagatctacatggttactttcaatcaatcgactctacctggttgggtgatggcagttgcgtggctattgtatttgatttggctatgggtctcattcaaagaaccgaaccgtgctactgaggtgaatgaagccccacaaaatcctgcttctggacaaacggttgatattggacaagtagagaacggacttgcacagcctctgctcatggattccgtagataaacaaaatgaagatgaagatgaagaagttgatgaaagtgaagaagctgcagatgattcacgcaagcctgcaacatcaattggctcagcatacagactgcttactccatcagtaaaggtccagttgttgatatacttcatgctgaaatacgcaatggagattttgctttcagagtctagtgttatcactaatcactatttcagttggaacacaagcgcagtggcaatttttctagcaatccttgggttgacggtgcttcctgttaatgctgttgttggaacatacatcagcaatatgtttgaggacaggcaactgctcatggtctctcaaattacgttgctagtaggcattatcttcagcttcaaggttacgagtacatactctgttgtccagtatgttgtctcagcacttgtcacatttgtttctgcagaagttcttgaaggtgtgaacctttccctcctatcaagcgtgatgtcatctcgcctctcccgtggcacatacaacggtggcctcctctcgacggaggccgggaccctggcgagggtggtcgctgactgcaccatcactgcggcggggtacctgggcgtggggaagcttctcaacgtcaccctgctaccatccctggtgatatgtgttgcgtccattgcctgcaccttcctgacatataactcgcttttctgatggagcttcacaatgtatttgtgtcatcatgattcgttccatattagcgcaaatcaaggcagctgggagaccgccattgccattgcccgaaggggctattgtattactattattatatgttcgtcgatttgattgctataaattgattgataaaatgattgtagcgactgaacctggtactggccgtgc

SEQ ID NO: 21903 - DNA, 1751 bp, Zea mays
agaggatttctattgtagaaatgcagttaggcccattaggttttgcctctttttttttcagactcggattggtctgccgtccttgtgctccgccggcaatggcgtccaccgccgtcaagctcatcgacatcgcagtcaacttcacagatggcatgttcaagggcatctaccacggcaagcagtgccacgccgccgacatcccggccgtacttgcgcgcgcgtgggctgcaggcgtcgaccgcatcattgtcaccggaggctccctgaaagagtccagagaggcattgcagatcgccgagaccgacgggagactgttctgcactgtgggagtgcacccaacaagatgcggggaattcgaggagagtggagatcccgagggtcattttcaggcactgctggctctagcgaaggagggtttagataaaggcaaggtcgttgctgttggtgaatgtggtttggattatgacagacttcagttctgtccggcagatatgcaaaagaagtacttcgagaaacaatttgagttggctgaagcagtaaaactgcccatgtttcttcacatgcgtgctgctggtgaagacttctgtgaaatcatgacacggaatttgcacagattccctggtggggttacacattccttcactgactcagcagaagatcgggacatgctactttcttttgagaagatgtttataggtgttaatggttgctctctgaaaactaacgaaaatcttgaggttctacgaggcattcctgtcgagaggttgatgatagaaacagattctccatattgtgacataagaaatactcatgctggaagccagtatgtaaaatctgtctggccatctaagaagaaagaaaagtatgagccagattcaacagtaaaaggtcgcaatgagccttgtttagttaggcaagttcttgaggtagtggctggaagcaaaggaatttctgacatagaaggcctgagtagaactctgtaccacaacacatgcaggctcttctttcctcaagatcttgacgcgtctgctaatgcgcagcttgagagtggtactgccgtccaggattgctgatgtcagagtgatttttttattataaatgtttccttttgactggtactgccgtccaggtttcgtacaacttccaatatgcctatgaaatatttttggtcttatatttcccatgtttcatgagcctgatgacatgtcaggcatgttctgactatgtacagccctactgaggctatgtcctaaaatcatttagggctaatttgacaatcatatttttttcaagggaaataaattagtccaaaaaaaaaaaaaaatagttcattttctctttggaaaaaatgggaatcccctgagaaaattaagttgtcaaactagctctaaaactgttctttttactgagtatacacaaaacataggtacaacttgaattgatcacatctttcaaacgtcaattgattcctcggtggctgcagttgcggcggcgaagggcgggggtaggacagggcgcccacgcggtggcggaggccgtggtggcgctgcaggttctggaactggaaggctgagaagcggggcgggggtgtaatggcggctgcggtggccatggccggagcgcagagatttatagaatatgacgaatattgaataaattattcactatccaggcgtaatgcccatttttttaaagataactatgcagtggatagctatttagcatattacaatggaacaagatcctgcacg

SEQ ID NO: 21904 - DNA, 1797 bp, Zea mays
  misc_feature (784)..(784): n is a, c, g, or t
agaggatttctattgtagaaatgcagttaggcccattaggttttgcccttttttttcagactcggattggtccgccctccttgtgctccgccggcaatggcgtccaccgccgtcaagctcatcgacatcgcagtcaacttcacagatggcatgttcaagggcatctaccacggcaagcagtgccacgtcgccgacatcccggccgtactcgcgcgcgcgtgggctgcaggcgtcgaccgcatcattgtcaccggaggctccctgaaagagtccagagaggcattgcagatcgccgagaccgacgggagactgttctgcactgtgggagtgcacccaacgagatgcggggagttcgaggagagtggagaccccgagggtcattttcaggcactgctggctctagcgaaggagggtttagataaaggcaaggtcgttgccgttggtgaatgtggtttggattatgacagacttcagttctgtccggcagatatgcaaaagaagtactttgagaaacaatttgagttggctgaagcggtaaaactgcccatgtttcttcacatgcgtgctgctggtgaagacttctgtgaaatcatgacacggaatttgcacagattccctggtggggttacacattccttcactgactcagcagaagatcgggacatgctactttcttttgagaagatgtttataggtggttaatggttgttctctgaaaactaacgaaaatcttgaggttctacgaggcattcctgtcgagaggttgatgatagaaacagattcntcatattgtgacataagaaatactcatgctgggagccagtatgtaaaatctgtctggccatccaagaagaaagaaaagtatgagccagattcaacagtaaaaggtcgcaatgaaccttgtttagtcagggatttttgaagcactgactgcattcccctttctcccttcctgctgtgcgaagccgtgccccaaaccctctaccatcttatttcagtccccactctctaccatcctccagggaaaaaacactagcaatcttacatgaattccaagttttgcatgtcgttgctgttggtgaatgtggtttggattatgacagacttcagttctgtccggcagatatgcaaaagaagttctttgagaaacaatttgagttggctgaagcagtaaaactgcccatgtttcttcacatgtgtgctgttggtgaagacttatgtgaaatcatgacacggaatttgcacagattccctggtggggttacacattccttcactgactccgcagaagatcgggataggctactttcttttgagaagatggtttatcggcaagttcttgaggtagtggcgggaagcaaagaaatttctgacatagaaggcctgagtagaactctgtaccacaacacatgcaggctcttctttcctcaggatcttgacgcgtctactaatgcgcagcttgagagtggtactgccgtccaggattgctgatgtcagagtgattttttttaaaaaatgtttccttttggttggcgtttggtttcgtacaacttccaatatgcctatgaaatgtttttggtcttataattttccctcgctgcccattttgccatgtttcatgagcctgatgacatgtcaggcaagtcctgactatgtacaagtaccctactgagactatgccctaaaatcatttagggctgagcatgtacaagtacagtttgatggctatgttgttcactacaatcaaacaacaactaagctctatatctatattttaaaaaaaaaaaaaaaaaaaaa

SEQ ID NO: 21905 - DNA, 1579 bp, Zea mays
ggaatgatgctattgtttctagagacgctgtgatatctggaccaaatttcttgggaaggtcaagtggatcttcaaggaggcctgttatctcgagtagccgcgatgcggtggtcaccgatagttccgagccttcacgagcgcgcacaactgatgcaagccctggggtgttccgcagagcctcaggtcctcagagaagctcacctgtccactctgcagaacagaagcgctcatcctcaggccgtcatccatctaatgcgaagaactacgattccgctctcaaaggcattgaaggccttactttagatggcgacgagagggttcagtactagagcggcaagaagaaattctacatcccctgtaaaaaagcataaccaggtggtaagcattgtgtttcctgttgagttttggatcaacaggaaacagaatgatggaaggaggatctggtcacgtgttgtgcggtttcgggtggccttctgagcaaggtaaataaacggtcctgtccgaggcgcttcaagcctagctctcgtaatgttatcgtcatgtatgtaaatgtgtcttatagtgagcctattttgttgttccaatccttacggtgttccattctgaggtgctgaacctcggggcaacaagaccgaagctggtagggacttcaattggagaactggggttcaagcatgtagaattttaaaatcggttcatttgtctggacaatgttcctgactagtaatgtgatcgcaagacaaacgatgttatttctctctctggttatcaatatgtccatctcttcacacgcctgatagaatattatttgacaaaatgatgttataaatctgtgtaattttctcaaatctcggttaaattttcagatgctttgatttttttttaaaaaaataggataacatatagtttggaatggagggaatagaagattcggcttccagccatctcgccgtctgatactgctaccctactcgcacatgtttggggttccaatcagtactcatcaatctgctaggggttttagggctagtttgccaactccattttccctatacgtctcatgtttcgtattcttgcagttaaaaaagaaaaactgggacgataggctctatatccttgtattgcaatccgtaagttcacctgaatcgcaagctacaaggtggttacaagttcagggatggcatcagcccgaaaagggtgatcatggcagggatgagaacaaacatgtgattgacccagttcccaagataaacccaatctagctagcttgtgcatagacgagttatttatacgagtaaaatcgtcgaacaaacaaaatgctcatacaagagattacaaatatcgctaaacatcatcccacacaggcctctatccatcgccatagtccccatagagtcaagtgctttgagaaaacaataagctcccaccaagactctgtactccatccattccaaattagtactcgttttagctcttagttttcatgtctatatatttaaatgattgatggtgaatttagacacatatatacaaaatacatgcatcaattattgtatgaatctattaataatctaaaacg

SEQ ID NO: 21906 - DNA, 997 bp, Zea mays
ttttttttttttttttattttttttttttttttttttttttttttttctacaagagttcgacggcatagcaccatgtcctgcaaaagagctgacgctctccaagatatacaagaaaccagggataccatgccatagcttaatgggcaacaggtgcccgcatctaataacattacaaacaaatcctattccactgttgtatactaacgtgttgctatccaaacaaacattttctacagtacaactgtcaaattgcaaagggtcaatcaatgagatatccacatctccgaacgtttgcctgcctgtgaaatctgcaaatcctactatgaatggtcagctgagaaagcaagactatgttgcttttgctgtacgttttttccacacgctaagagtatcgttgtctgattcctcgttgctcaaagtatggccatccagcttttccacatctttgggctcctttcctgccatcccttccatttccacatcttttgggtccttgactgccttttctttcacttccgcgtctttcgactctttgcctgccgcattctctttcgtttttacatcttttgagtccttccctggcttcttcgcttcgccatgtttggattctttccctgcctcccctttcacttccaggtctttggactctttccctgccttctctttcgtttttacatcttttgagtccttcccgggcttctctttcatttccacatctttggattctttcactgacttatctttcatttttacatctttggactccttccctatcttctctttcatttccgagtctttggactccttccctgccttctcttgcattttcacgtctttggagtccttccctgcctcatgtttcaattccacgtctttggagtccttcccggccggcgcggtccctacgtagctgactcgattccagatctttggattctttccctgccttctctactacaaaactggacatgagagtttcttctcatccagctcctc

SEQ ID NO: 21907 - DNA, 1247 bp, Zea mays
  misc_feature (1121)..(1121): n is a, c, g, or t
aattcaatactcttgcaagaatagaagcattttgctcatccacatttaagggaaccatgcaagatttattgtagttaactttgagcccagttgactggtaaaatgtttctaggagagattttaagcagaataattgacgctgagaggctgagaattaaaattgtatcaacatattgaaatataggaaagcctggaccatcccttgagggaagaggcagatgcaacagattaagtgaatgagccttgtttataatgcattggagtaagtcatcaacaagaacaaatacaagaggtgataaaagttcccttgccgcacaccctttatgcagtggatctctgagtacagatgtaatgtcagtatccataatatatttaacccattgaacctaaatcttagggcgctatgttctaggatgtcaaaagctttagtaaagtccagttttataataagaagctccttcttagattgttgacattaatgaatacattcaaaagaccatgcaagacagccctgaattgtccaagatttgataaaaccatattggacaccgattttcggaccaaacaatgcaagtctccggaacgttctttttagcgtgttgattatatgctttaaagccaagcgagctggaattcctgccacctttaccatcatgtctcgtagattgttctgctaaacatcgaaaacacgcacaagattgacagtacaaaacttgtgcggtaattatgccaaaactctactctgtttcctttccgtgtacaaatactaaacctccagcgtcagattctagatccaaagtaatagggcaaacgaaaaatggatgcccacaggtagttcgacaagtgtcactggtttattgcctacaacatttctacaagagtttgacggcatagcactatgtcctgcataagagctgacgctctccaagatatacaagaaaccagggataccatgccatagcttaatgggcaacaggtgcccgcatctaataacattacaaacaaatcctattccactgttgtatactaacgtgttgctatccaaacaaacattttctacagtacaactgtcaaatcgcccgccctcgcgctccgcgatatccacatctccgaacgtttgnctgcctgtgaaatctgcaaatcctactatgaatggtcagctgagaaagcaagactacgttgcttttgctgtacgttttttccacacgctaagagtatcgttgtctgattcctcgttgctcaaagta

SEQ ID NO: 21908 - DNA, 2650 bp, Zea mays
  misc_feature (532)..(532): n is a, c, g, or t
tattcgtatactcaaattaaatatttaatatgtcgatatccattcgataatatccatcccatctgaatccgtagaaaaaaaaatgaaaacaggtatgatacaatatcagcatgtatccgacccaattacacccatacccaaaagtttctaaccaacacgtttcatggttagctaaataaaaattgatttaatttaaatcactttccagtcatttttagggtggacaaaatactcatggctcgtcagctcggtcggctcgactaattttcattttatcacgagctgagctagcatctcagcttgatttgttaacgagccacctccttaactcgaacaagtatttatcagcaaaacaaaacctttatttgtattggatgaactaataagtgattaactatattaatttggtgttgaattgatgtggaaattgaatttgtaagtattattactcttttctaatatttaattggtctaaagttaattagcaattaattatattgttgtatacatatttgtatatttttttgtttangactcgcgatataaacgatccatctcaaactcacaaataagcaaagcggagccgatttttcagtttggtatcttaacgatcgagatttttcaatgtctctcgtctgaaatggactggactgaaacaaaaaacattcggggacgcgcctgcttgcttctttccccaaaccccaaaccgcaggtaggaagcaaaccgcacgccccgctccagaacggatcctcatctctcacgttgtcaccacagtctgaatccagaatccaactagtagctccataaaagcggcaatgatccagctgctgttcgtcgtgctggtggcggaggcgtccctgacggcggcgctgctcttcaagacgccgctgcggaagctcgccgtgctagtgatcgaccggctcaagcgcggccgccacgcgcccgtcgtcgtcaagacggtcgcgggcgtcatccttgccctgctcgcttcaacgctctacagcatgacacagatcgccggcagcacgagcgactccgactctggcggcgggcccacccccaccgaccaggtgctcttctcgcgtcacctcctggaggcgtgcctcatgggtaggtcctggtaacgcgcatcagcccactcgatcacgttcattacgccttgtccatgcgggctcctctatccccttttttattggtctcgattccctgtttattgcttgcttgggtaggggtgtggtgagatctgggtgtcatgaatagtctgtgacaatctaggttggtggggtgtactgctatcttgcttattcaggtggctgttcaagcggttgtgttgatgtaagctggtaacccgggcagtaactagtttttaagctttcaaatattattaaacagatcaaggtctttttggtctaaaaaagaaaagagcatccattctttgaccctgcgtaggggattaaaacttataacattcttatgcatctgtttgtgagtaaatgtaaaattgtaaggtccagctagtaattttatcctgaggaactatttcgatccaagctatacagcttccccatctcactccacagtgcaaaaaaagtgcgcacagagtttgttgatgggaggtgaagtacttgttgcatcagcattgggcacattcagaatttcttgttctggtgtattctgtatatatgttgcaatgaaatttctactgtgcatatgactccagtagaatgtggttatctatcatgtcctttttacgcatgcaccctttccctcttaaaacattgtgctaaatgtttcagcactgaattcatgttatctgccccatgttgaagtctgagctgagtactattctttcagggtactccttatttcttgctctagtgattgaccggctccaccaatacatcagagatttgcgccggtttaaaaaggacttagaggctgtacgtaagcataataaaatgttggaggaggcaaaacatggaaactcggaggaggcaaagaaataccaggaagagattgccactctgaacaaggagatgaagaaactgaagctacaagtccaagaaaagacagaagaggtccatgtttcagaggacaaggcacttgctatccaaaaacaatccgaaggcttgctgactgaatatgaccgcctgctggaggataatcagcatcttcggacacagctgctgtcaattgaccgcaggctttccaactcttcttgaacgaagagtctatttaggggatgctgaagaatttctgtggaagatcatgttaccacccaaagtgtatggcagctacctgcttcctcacttgttagtcttagcatcttcaattaactagctattgcattatattgttggcaaaactagtgcaagcattatatggtctagaactttggagtttctcttgtgtgtttcttgtaatgcctactttttatgtgtgcttatagtgattactgttttgaacagaattttatgattattgcagacgggcattcacatgttgaaaaaaaaaaaaaaaatccatgagggtcccagactattttaaaagttgttattgagtaaaaaaagatgtacctcaataaaaaaaattcaaatcagaatctttttcgttttagaacgagaacttatcaagctaagcctgaagcag

SEQ ID NO: 21909 - DNA, 1146 bp, Zea mays
gcacgagaccattacctagaacatcctaatcgaaaagaaacaaaaaacattcggggacgcgcctgcttgcttctttccccaaaccccaaaccgcaggtaggaagcaaaccgcacgccccgctccagaacggatcctcatctctcacgttgtcaccacagtctgaatccagaatccaactagtagctccataaaagcggcaatgatccagctgctgttcgtcgtgctggtggcggaggcgtccctgacggcggcgctgctcttcaagacgccgctgcggaagctcgccgtgctagtgatcgaccggctcaagcgcggccgccacgcgcccgtcgtcgtcaagacggtcgcgggcgtcatccttgccctgctcgcttcaacgctctacagcatgacacagatcgccggcagcacgagcgactccgactctggcggcgggcccacccccaccgaccaggtgctcttctcgcgtcacctcctggaggcgtgcctcatggggtactccttatttcttgctctagtgattgaccggctccaccaatacatcagagatttgcgccggtttaaaaaggacttagaggctgtacgtaagcataataaaatgttggaggaggcaaaacatggaaactcggaggaggcaaagaaataccaggaagagattgccactctgaacaaggagatgaagaaactgaagctacaagtccaagaaaagacagaagaggtccatgtttcagaggacaaggcacttgctatccaaaaacaatccgaaggcttgctgactgaatatgaccgcctgctggaggataatcagcatcttcggacacagctgctgtcaattgaccgcaggctttccaactcttcttgaacgaagagtctatttaggggatgctgaagaatttctgtggaagatcatgttaccacccaaagtgtatggcagctacctgcttcctcacttgttagtcttagcatcttcaattaactagctattgcattatattgttggcaaaactagtgcaagcattatatggtctagaactttggagtttctcttgtgtgtttcttgtaatgcctactttttatgtgtgcttatagtgattactgttttgaacagaattttatgattattgcagacgggcattcacatgttg

SEQ ID NO: 21910 - DNA, 1215 bp, Zea mays
  misc_feature (1194)..(1198): n is a, c, g, or t
aagaaaaacttttccctggaaaaagttcttaatattgacagctagatagattcactataaagaactattacataattaatttaataatatttattttgtaatattaaaattttctatatactctgatcaaactttaaaacattgtactcctcgaaaaagtgagaatcgtactctttcataaacggaagaagtaacacacatgacagcttccaggaaaataaacaaactaggtaagggtctaccttagaataattaaagttagttaattagttagctagacttaactaaaaaaatagactacctattagctctcctatttgaataaactagggctaatatttagctatttaccagttagctccggtattaaacagggccgcagtcacaaattttttttttttttttgctggaaacgattgaatatattagcggactgtacacatgtctgatatctccattgggggtaaacaaaaaaaagggtatgatgctggagacaacagctggtttaaataagctgctggtctcgaaatttttggaacatgctctgtcaatctacatgtccacttccggagaaacccgtcgacagacaggtgtgatctatttcaatgtgattccgtggtgcatacagtttgcagaacctccgcttaatttttttgctgaaggaagcgtatagagacaaccaactccatctattgtcgtccttgattacttcgcataagtttgagggaaccagctttccagcaacatatgcttgagcctcagcaccagggcgaacatgccgtagcatgggaggtgcagcagtgccaccaccaggtaccatacaggtgcaccagggaatgtcaagtctagaaatgggtaaggccaccctattgacacgaaaaagtggacgatccactgaacattaacaaaaatgcccgtccacagtaggaagtatgctatcctaaaccacgggaaatgcagtctgtttagagcggcatctccaactatgaagacaacgttgattgaatgtgtcccaatcagaataaaatccatcttatgctgattgtgggcaaggaaagggtacagaataaaccagaacaccaaatctgtaatcatcacagcacctgcatttgtctgaaacatgatctggaaacatataaccccaagtctcctgctatttccgccccccccggccggcctgcgagtgtcatgcannnnntttgaaaagcagggtca

SEQ ID NO: 21911 - DNA, 1168 bp, Zea mays
aagaaaccggaaatccagtttctataaactgaaatataaaccggtatatttggaaccacactaacttttataaaccagttctttaaaaaccagatgcttcaggcccttagaatgcctagaacgaggtaaaagaaaagaaaaacacttggtcatcagaagaccaatttgcgacatcagaggatattctcaataccaattgtcatccacaactataacagaatgggggaaatatctttacatgagaggtcttccgtagtccatacagtacccgtgtatatggactggcatgcattacatggtacaagcaatacacacaagtgttctgtcacgatgccgttggcctaggcaacctctttgcaatttcctcaaacagttggtttatattatcagctgtcttggccgacgtctcaatgaaaaacatattgttcttctctgcgtagtcctgcgcatcctgcgaggatacacttcgattatcatgtagatcagccttattaccaaccaaaaccattacaataccaggactaccatgcttctgaagttcctttacccaatactgtgctttgctaaatgattccggacttgttatatcatagacaacaattgcagcagcagctcctctgtagtaaagtggcgccaaggcagcatacctctcttgcccagcagtatcccaaatttcaaacttcactattgttgaatcctccaatgccaatgtttgtgataaaaaagatgcgccaacagttaccttggaagtaggatcaaactgaccacgaacaaaacgaagaacaatgcaacttttcccaacacctgagtctcccagcaataccaacttagcacgcaagtcctttgaactggcgtctggagagctatcgttgctgatagtgttcagccctccagtatttctagctggcacggaggaggagcaacccatagtgcacgctgtccgccggcgtcgacggggctagcgcaccgtggcacgagcgcggcaaccggcggggaggggggatcgggccttttgccctgcctccgacttcgggtaggtccgccgcagattgtcctttctcgtcgttggtctggggctggggctcgggctcgggctctgaatctcgttgtgatgcacgcgcgacgcgttgctgctgctgcagaacggggaaagcgaatccaagtcgtt

SEQ ID NO: 21912 - DNA, 2854 bp, Zea mays
  misc_feature (69)..(70): n is a, c, g, or t
cccaaaaaaaaactatttccttgcaagcacggggcagtaaactttgattctttaaaacggcccccccannttttttttatatttttttaaatatataaatctcttttttttttttttttattcgcgatcttggtcttcgcgtggggccgcccttttttttggggacaaggcaaaaacacttttgagtgtatgttatgtacaggcacggttcagagcagcaacagcattacaagcgatgaccagtccaataaacatatgaacgaattgaccgacaagatacataaagaggtaaaaccttgcatgggtgcgtgtgccacaaatacagaaactacccggccagcgacatatactatctttcccgccccgccccctatagtctaagcagattccatgaacaaagggcatctatatctatctgcacttgctgtatctatcaagctaccatactcatgaagcagaagtattaaaaaaaccacttctggtagcgacgactttgagcaccatgaaaagcactgttccctgtataaaaaaaacagcactgtgtgtgggaaaaagaactgggtctgcataactataaccatcaggaccctgccacaccatttccgttttcagtggatggggcgtttgaagtagcatcatccgttgtcaaattggatacgctatcagacagcgagttcacctcatccaactcagatggtgctgtcgttgaagcaccgtcctccgaggcaatgtcagaggctgcgtctgaagccatgctagatggttctgattgctctggcatttcagactgtgactgatgctgattctgtaggctccaatacataatgctagcggtaagtgttagaatcatcttctgattcacctcgacgatgtcctctggcaacaggaacacagagcatccaatcttccttgcaacactaatgatgtacgtagcattcagcttcttgtcctcatcagtttcccctttagtaacaactttccagttcacaacccttggctgtactgtgctaagaagctcgaggaagaacaatccatttgataagctcttgtccttgaaactttccattcgagatgttcttccggacgctttcactttgctgttggcccagtctagaatatcggcatcagaaatttcttttccttgggaccctccttgggagtggaatctcagtttgtttaacagctggaggatattgaatctcatcaattgccacagaagtgcaacaatcaatttcttatttccctgaacaatatcgtttccagccagatttactaaagaaaacttcaactgcttcccaatttttacaacttgattgcaattctccagttttctaaatggcaatttaattggaggttttgttgccagcttccaattgacagatccaggagacaccttgtcaagcacttcaagaagtacccatccattgcgaacatcttcgaagacattgttcacatatgattcaaccccaaggctgttgatccacattcgaaaggctctttcttctctagataatagaacatcatcatgtgttgctgtctgtgtgagggtaacttgtttggtgtcactggtcagaccattcctatgctggaatatttgtgcaacaaatgcaagatttagattggcagatccctcagtgatatcctttggggtcaagtatctcttacagtccaacttcgccgcttgttcaagtactagttttgccctctcattcggatccttggtgtccaatgtagtttcaggggaatgctctggagcaagagctttcagaaggtaagcatacgcttcaccatccttcacatctgaagagaaattgttaacagttttcttgtagccagcttttttcagatgatggttcatccaccgaagtagcatcttttctggcgacaaactcaaaacctcgtctatatccttgctgtcatcaaatagctccaccagctgtggtgtcttcttgaggttaagatcagctaaaagttgaatctttatgatttgtgatatcaatccaagaactaaatgaggccttccctccaccaaatcctgtgtgccaatgttgacaacagtgcatccaatggccttggcggaattgaggcagagcgtgtgattttcatttctctcccatgggttaagaactcgcgtgggatttattgccctctcatcaatggtcccaggtacagctacattgatcagtttgcagagcagaacaccatcccggatgagatcgaacagctggtttccagacgggtccatgggcaagtacttcttcaggaatgggtcttcacggaggtaagtattgatgtgcgccacatacgaagatttctctgcctgattgaggttgtgcagcagcgtagtggtgctggacttgaggaacgacgacttgccaccccggccaccgccggcaccaccctccttggcactcacccgcgcctgcagattcagatactcccggaggaaggattcgaattcaatctcctgatcgctgtcggggtacgactcggacaggaaggccgcgatctcctccacagagaccacctcattgagccccctcagcttcttcatcatcaccgggagattcttagtggtgacatggccggaatctctcttcagagacacgaacttggccttgagcgatcggagctcgacctgcgtgaactgcccctgcagcgaggggtcggacacgacgacaccgacgaatccggacatctccgccggccacgggccgatcccacccgcgcccgaagcggctttcgaatcggtcacggcaatccctcaccctctctggcgcgcggtgtctttgcgctggacggaaaaaggtgagcaatggcgccctcgcgctccgctgttcccgacccggccggc

SEQ ID NO: 21913 - DNA, 1799 bp, Zea mays
tacgccatataccaagcatgtacaccgtcgtggtttcgacgtgaatcgcacattttttttttttttttcgagaaaaatcgtcacagggatatactactctcgttctgaactcctgattcagaacgagcgttttcacccatggaaacacatacagatcaacccagcagcccaggcatagataaacgcacacacaaccacctgaagacagcgagattatccgcagccctctgcagctgagagtactaatgtagtgctcctacgaaggaaacgattgcaggcgagggagcaaaaaaaaaaaaaaaaaactaagcaagagaaataaaatgattgattgctgcaaccgggagtaagtagtgtacgaacgaaatcgaatgcctggcctgcccttgtatgccgcgacgccgatacgtgtgtaggccggttaccgccgcagcgttgcgacgccgctgttgccctcctccattctccgttgatggaaacatggagctgccaatggcggagatggcgaaggaaccgtagcttccggcctggcttgcatcgtgtgcctgagccttgcgacgagggtcgaggaagaggtgcgcagtggaaaagggagggagagttggagagaacagagatgcgagtcaagcggcgatacgatgcggctcagtagcggtagggggcagcaagctatcaagctatgcactgagtaatggaagggaactacccctttaaaagcctgcctcttagtcttaggggctagacctgtaaagtacttatgcattcgatgctaaacaactgaagactgaagtcgtcttgtcatcgtgtttccactgctgtgtgtgtcctaaaatagctaacacttaagccatctttgggacatgggagtttataaatataaaaactgacgtaatgacgcatggaaatagtgaatagctgtcatcaccacatgcgaaagaagcgtggacgtaatatggggatcacatgggatttaaaataccgtcagcgaaagcagccaaaccaaattgaaacctcatgataacaaatctcatgcaaagaacgcatccacaagcagtacaaactgtttctaaaggacaatgcaaaacctttttaagcatatgttatgtacaggcacggttcagagcagcaacagcattacaagctttgactagtccaataaacatatgaacgaattgaccgataagatacagaggaggtagtaaattttgcatgggtgtatgccagaaatacagaaaatacccagccagcgacacatactattatcctcccccactatagtataagcggatccaatgaacaaaaggcatctatatctatctgtgactgttgtatctatcaagctaccatgctcaggaagcagaagtattaaaaatatcgcttctggtagcgacaactttgggcatcatgaaagcactatttcctgtaacagcactgtatggggaaaaaaagaacagggtttgcataatcataaccatcaggaccctgccacaccatttccgttttcagcagatggggcgtttgaagtagcatcatccgttgtcaaattcgatatgctatcagacagcgagttcacctcttctgactcggacggtgctgtcgttgaagcaccatcctccgaggcaacttcagaggctgcgtcagaagtcatgctagatggttctgattgttctgtcaattcagactgtgactggggctgtttctgtaggctccaatacataatgctagcagtaagtgttaggatctggtgccgaattcacctcaatgccctgtcctccggcaacagaacacagagcatccaa

SEQ ID NO: 21914 - DNA, 1620 bp, Zea mays
tttcgccgcccttccgcggtcgcgtgggcaaaaatcaagctgcttgcaactacatccaactttttgaacatatacatcttgtgcactaaaatctgtaattattgagatggctcggtcacaaaaaaaaatagcagcatggggaagttggcaggtcaggtaaacaaaacgaccgatcaaaactctgcgaaagggtggatttcagattgcaacgctcgattttctcccctacacaaaatgatgcaacccggagtagcgtttctggcttattctgttgctcttctgcgtcgtctctaggtagcaccagcatgcgagatatctttgccgaaaagcccagagattgctttccctggatcctcctgcttgatgagggattccccgacgagaaccgctttgaccccagcgttttgaacgaacgaaatatcatcaggagtgaacagcgcagattctcctacaacaattacatccttttgagctataacctgtcctcgttcaccttccagaagcctttttgtgtttgtaatatcaacttcaaatgtctcgagattacggttattgatgccgatgagctgtacaccatcaatccctaaaacacggtccatttctctttcgtcatgaacctcaactaaagcagccatcccaagtattttgcaaattttcaacatgtatttgatatcgcggtcaggtaatacagcagctattagaagaacagcatctgcacccttggaccgtgcatagtaaagttgccaagcatcaataatgaactctttgcacagaagagggcactggactccagcattgcgtatagcctccaagttgtaaaaacttccctgaaagtacttttcatctgtaagaacactaaggcatgctgctccgtttttctcatatgcctgagcgatctgaaccggatcaaaattctccctgataacaccccggcttggtgaagccttcttgacctccgcaatcagagcaggcaagccagttcgatcgtaggacgccttgagcgccccaacgaagtccctagcggggggagcagcctcaagcggacccttcagcatgtacaggggcctcctctccttcatctgcgaaacctcgacgtccttgttccagatgattttctcgaggatgttccgcggcgtgttcccctcgttctcgaggcggaactggaacgggcccacgtagtgcaccgcgggccccgtcacgggccgccgccggatccttatcccgtcgacgccggcgaccacgggggagtacgcggcagcggcggccacggggctcccgttgccctcttgctccgtggtgccccccgcgttggcctccgcggcgtgcgagctcgtcgcgacctcatccaccgagtccgtctccgcgctggtgcagcggataggcgcgcggctcgggcggccaacggcggcgtccatggaggccgccgtgagggggcggcatgcaactgtggctgtggtggtgacggtgacggcgagggttccggggcggcggagttgggagtaccttgcgcccggacggcgaggcgcggatccaatggctagtgcttccatctgaagcgcccgcagagcagaggtgggctggctaattggattggggtggacgttagccgttgggagttgt

SEQ ID NO: 21915 - DNA, 733 bp, Zea mays
aagctgctgatcccgtccaagtgaacccccgcccggccccccacgcccccgggcaggtgctccgctacgaggacaacttcgacgccttcagcaacgtgtccgtcatcatccagcccacgtccaagaagaccatcgccgactacggctctcccgaggagttcctctcccaggtcgactacctgctcggcaggcaggcctacggcggcaagaccgactccgagggcgggttcgagaccggcgccgtggccaccgccaacgtcctggagagctccacccccgtgatcgacggcaagcagtactacgccgtgtccgtgctcaccaggacggcggacggcgacgagggcggcaagcaccagctcatcgcggccaccgtctccgacggcaagctctacatctgcaaggcgcaggccggcgacaagaggtggttcaagggcgccaggaagggagtcgagaaggccgccgcctccttcagcgtcgcatgatgcagtaatattgtttcttcgatgggatgggatgcacgcactacgtagagagcttggctaggccaggcctggctgagcacgcttgtgtgttccttcgactgtacatgagaacaaagactaagaccttgttcgtttctatcggattacacctggaattgttccagctaaggccttattcggcacaatagtatttaatacacactcggatccaatacacaaccgccgtaacgtgaatccatcccatatcattt

SEQ ID NO: 21916 - DNA, 1144 bp, Zea mays
  misc_feature (918)..(918): n is a, c, g, or t
  misc_feature (921)..(921): n is a, c, g, or t
cattgggtacctccaggccggccgggaccgccgccccgcctcccatcgttacgttagtcgtccgcccgcgctagtgccatccacactcttctcttctccccggccggaccggagtcaggcagccgaagcaagaaaagcaagcggctttggaagttgggatccatggcgtccacctcgtgcttcctccaccagtccaccgcccgcgtggccgcgccgtcgccgcgcctcgccgccccgccgcgcagcgcgcaactgttcgtctgcaaggcccagaagcagcaggccgccgcggcggagagcgacgtgtcgcgccgcgccgcgctcgcgctcctcgccggcgtcgcggccgtcggcgccaaggcgagccccgccgccgccgcctacggggaagcagccaacgtgttcggcaagaccaagaagaacacggacttcatctcctacgtcggcgacggcttcaagctgctgatcccgtccaagtggaaccccagcaaggagcgggagttccccgggcaggtgctccgctacgaggacaacttcgacgccaacagcaacgtgtccgtcatcatccagcccacctccaagaaggccatcaccgagtacggctcccccgaggagttcctctcgcaggtcgactacctgctcggcaagcaggcctacggcggcaagaccgactccgagggcgggttcgagaccgacgccgtggccaccgccaacgtgctggagagctccacccccgtggtggacggcaagcagtactacagcatcaccgtgctgaccaggacggcggtccggcgacgtgggcggctagcaccaactcatcaccgtcaccggctccgacggcaagctctacatctgcaaggcgcaagccggcgacaagcggcggttcaagggcgccaggaagggcgtcgagaatgccgncgnctccttcagcgtcgagcgatcgacggaaactatagttgctttgatgcttttcttcagggatgcacatgcacgcaccgtgtgtacgtatagagctaggcatggcctggctcgccatgcttgttgtgtgtttctttgattgtacatgagaggacccgtttctgctgccatccaagttgtttgagatatacatatattacaagaattgaaagaaatttaaaaaaga

SEQ ID NO: 21917 - DNA, 2559 bp, Zea mays
cattgggtacctcgaggccggccgggaccgccgccccgcctcccatcgggccgttagtcgcattcgccccctcgggccgggccggcactcttctcttctccccggccggaccggagtcaggcagccgaagcaagaaaagcaagcggctttggaagttgggatccatggcgtccacctcgtgcttcctccaccagtccaccgcccgcgtggccgcgccgtcgccgcgcctcgccgccccgccgcgcagcgcgcaactgttcgtctgcaaggcccagaagcagcaggccgccgcggcggagagcgacgtgtcgcgccgcgccgcgctcgcgctcctcgccggcgtcgcggccgtcggcgccaaggcgagccccgccgccgccgcctacggggaagcagccaacgtgttcggcaagaccaagaagaacacggacttcatctcctacgtcggcgacggcttcaagctgctgatcccgtccaagtggaaccccagcaaggagcgggagttccccgggcaggtgctccgctacgaggacaacttcgacgccaacagcaacgtgtccgtcatcatccagcccacctccaagaaggccatcaccgagtacggctcccccgaggagttcctctcgcaggtcgactacctgctcggcaagcaggcctacggcggcaagaccgactccgagggcgggttcgagaccgacgccgtggccaccgccaacgtgctggagagctccacccccgtggtggacggcaagcagtactacagcatcaccgtgctgaccaggacggcggacggcgacgagggcggcaagcaccagctcatcaccgccaccgtctccgacggcaagctctacatctgcaaggcgcaggccggcgacaagcggtggttcaagggcgccaggaagggcgtcgagaaggccgccgcctccttcagcgtcgcgtgaccgacgtaaactattgtttctttgatgcttttcatcagggatgcacatgcacgcaccgtgtgtacgtagagagctaggcatggcctggctcgccatgcttgttgtgtgtttctttgattgtacatgagaggacccgtttctgctgccatccaagttgtttgagaaatcttggtactaatattgcttcgtctttttttaaaaaaaaactcttcctgccaaaaaaaaaaagaccacaagcggcccttttgcatgaactactttgtttgcatatcggttagccagtaccacctgaataatgatcaaactttacatataccttgcttgctaggatcaagtgacggttgaaaaggattttgaaaaaaaaacctttataaaagtatttgtgaaagtgctaacttgaacctaagatggtcgttgtccgagaggcaaaatttatgcctagcatattttcgaagttttggaaaaacaaaaatagctttgaaatggctgagtttggtggtaacaaaccatagagaaaaagcagtggagaaagaccatctgggccggaatttccgaggtccatagagaattttgagtaacccttctgttgtgcgcgcggcctccatcccaaaaaattccctgtctgtggcccaaatttctcaacaggcccattaaccttgctaacatctatgctccacaaagtatgcagcacgtatcatgtatggactatataccaagcaaaacaagggacatcccaacgaacagaaaatctgttcatgattggacgtgcagaagatctgttctatgcctaaagctctggttctccagttttaggctctggatcttgtggaggttcgctacggactgcagaaggtctgacatcgtgctctggtagtctggttcatctcaatggccctgaccacgagcaccctgagctcactcaactcaacttgcccagttcatccatgttgaacaggcagtcgtcaagctcgtcgacgtcacattgtaccagcagctgtagatcctctagggacgttagacaccactgcctagatcatgcttctgttgacaaggtcattgaattgaagtacccgtccggccgtccccaacctcaaacaaccaagttcctggcttctcatgaacgagatcttcagctatccacgttcactgcttggacgcctgcccgcgtatataatcttctggagatgtgcttggatcatgcttgcaagaatgatctactgccaacagactatagttgaaccagccagaatcgaaacctaaccagtcatgcatgcaaaaaaaaaaaaaaaaaaaagtagcccgagtgaacagagtacccaacagtcgacagaagaagaagaatgcaatattgtactaaaaaagcagcagcagcagcagcgaaaggagagaaagcagagttcaatagctaccaagattagtgttcaatagcaggagaagattcacactgttatcctaaacgttaaaggatcagtcgccctctatttagacggtcgcctaggcggtctaaaaggtttacactatagcagtaaacatatgtataaaattattattttcgcgtgcccttctaggtgtaattttagggcatgaacatacgctattcattttaatataaacaata

SEQ ID NO: 21918 - DNA, 2489 bp, Zea mays
ctctatacgctccccctgcaacaaatccttctcaataagatccggacacttaagataaaacataaggaaaagcccacatggtcctagcctagagcaccttcagcatcgcaactccaaaccgtcacctttatttcgttctccgggaaaaaaaagaagaagagatatcaacaaatcattctcatgaactaacactctctcatcttgttcccaaagatcatgggacaacgaaatctccagtctacctatcttcctttttgaacaagtctttataaaatataaaggggctaaagcaacgtcaatcgtacctttctgatcttccacgtactagatcatcaggacctcctaaagcatccaccctttttttttctcagtacttcagacattcaaacagtctgagaacgctaaggtaagatgcatggaacatcttaattaggtgtggagtggcattggacatgtcacggatggaacagtccaccgacttggcgagcttatttttactgcaaaattaggtgtagagtggtatgtgaacaatgtgaacccttgagttctattatactccctttgtcccaaattaaaatttattttagttaattaattaattaatatatttatataatatttgatgtatatgttttatatgtgtctagatttatgttcatccatttgaatatagatataaaaatcaaaagcaaaaataaatattagtttaggacggatggagtagtttgttgccggtcggcaaaattaaaaagaatcagtatattcttgagccgctttgaatatagacctgactgtttgtgtataacaatccgactatttgtgagtcaaaattcataaaatgtgtggtatttcttcagtcagaactggctcgattcaggatccaccagcaggcaggtagacgatcgcagagacgcagacgccatgtcatgacagttgctgccaaacggaaagggcagggaaccagcatcgcgatccgacgtggcccaatggcgcgtcgcggagccttatcccgcggcgtcgcccctgatccaaactccatctgccggggcgccacgcaccacaggcacaggtacggtatgcgaccccacggccgcctcccctcgttaacacgtcgcggcctcgctaacgcgcccgcgctagcgcgagtggtggcacccacgcacactcttctcccccacgagtccggaccccggaggagccaagccatggcgtccacctcctgctgcctcctccaccagtcaaccgcccgcctcggcgcgtcgccgcgcctggccgccgccccgccgcgcagcgcccagctgctcgtctgcaaggcccggaagcaggaagccgccgcggaccagagcgacgtctcgcgccgcgccgcgctcgcgctcctcgccggcgtcacggccgccgccggcgccaaggtgggtcctgccgccgcggcatacggagaagcaggtaacttacggagcatgcaaccggcgcacgtcctcgatcaattcgcttgccttagttaaccatctgcccgccgcctgatcgagtgcctgtgcctcgctgagccgcgtgcgtcgtccatgtcggtcggcagccaacgtgttcggcaagcccaaggcgagcacggagtacatcgcgtacagcggcgacggcttcaagctgctgatcccgtccaagtggaaccccagcaaggagcgggagttccccgggcaggtgctccgctacgaggacaacttcgacgccaacagcaatgtgtccgtcatcatccagcccacgtccaagaagaccatcgccgactacggctctcccgaggagttcctctcccaggtcgactacctgctcggcaggcaggcctacggcggcaagaccgactccgaggtccgtaatataaccctgtggactgtggtgacgacggccatgcatgtgtgcatctctgtagctgcagtgctgcttgccttacatgaatcgacgtgcgtgcagggcgggttcgagaccggcgccgtggccaccgccaacgtcctggagagctccacccccgtgatcgacggcaagcagtactacgccgtgtccgtgctcaccaggacggcggacggcgacgagggcggcaagcaccagctcatcgcggccaccgtctccgacggcaagctctacatctgcaaggcgcaggccggcgacaagaggtggttcaagggcgccaggaagggagtcgagaaggccgcctcctccttcagcgtcgcatgatgatgtaattttatttcttcgatgggatgggatgcacgcactacgtagagagcttggctaggccaggcctggctgagcacgcttgtgtgttccttcgactgtacatgagaacaaagactaaggagagctgagctccattcccgtacaaggatcgatttcttcagtcacgcaaattgtttaggaaatcttagtgctaatagtagcgcttcgatgttcccagccatgagaacaaagactataagcatcttccgggacttgaatcagagttc

SEQ ID NO: 21919 - DNA, 1126 bp, Zea mays
  misc_feature (16)..(16): n is a, c, g, or t
gccggccgggcttcanaaaaaagagggcctccggccggccaaaacacgtcgcggcctcgctagcgcgcccgcgctagcgcgagtggtggcacccacgcatactcttctcccccccagtccggaccccggaggagccaagccatggcgtccacctcctgctgcctcctccaccagtcaaccgcccgcctcggcgcgtcgccgcgcctggccgccgccccgccgcgcagcgcccagctgctcgtctgcaaggcccggaagcaggaagccgccgcggaccagagcgacgtctcgcgccgcgccgcgctcgcgctcctcgccggcgtcacggccgccgccggcgccaaggtgggtcccgccgccgcggcatacggagaagcagccaacgtgttcggcaagcccaaggcgagcacggagtacatcgcgtacagcggcgacggcttcaagctgctgatcccgtccaagtggaaccccagcaaggagcgggagttccccgggcaggtgctccgctacgaggacaacttcgacgccaacagcaacgtgtccgtcatcatccagcccacgtccaagaagaccatcgccgactacggctctcccgaggagttcctctcccaggtcgactacctgctcggcaggcaggcctacggcggcaagaccgactccgagggcgggttcgagaccggcgccgtggccaccgccaacgtcctggagagctccacccccgtgatcgacggcaagcagtactacgccgtgtccgtgctcaccaggacggcggacggcgacgagggcggcaagcaccagctcatcgcggccaccgtctccgacggcaagctctacatctgcaaggcgcaggccggcgacaagaggtggttcaagggcgccaggaagggagtcgagaaggccgcctcctccttcagcgtcgcatgatgatgtaattttatttcttcgatgggatgggatgcacgcactacgtagagagcttggctaggccaggcctggctgagcacgcttgtgtgttccttcgactgtacatgagaacaaagactaaggagagctccattcccgtacaaaaaaaaaaaaaaaaaaaccggccgcccacgcgaaaaaaaaaaaaaaaaagggcggccgc

SEQ ID NO: 21920 - DNA, 1389 bp, Zea mays
ctgaagattgagaagatatagatgacggattcttttagagagtaacataaaagacatagaatatattttttaaatgatgaaatttaggggcctaagagcttttgcaaattggcgaactatgtatttgttgttgagcataaacacgcagtcattgcaataatgtcacagaaaaggatgtttttttttttttttgattacccctctacaataatctgaagcaaactagtgcattattatcacagcttatccttctgcttgtttattcattcaacatgttttacatcaatttatgctgtccagtcactattcaacatcccgagaactcaaacagcatagtatgcttatacttctcaccgggccgaacaaccacagagggaaactcaggctggttgatggcattcgggaacccctgggtttccaagcacactccagcatgcttcgcgtagacagcgcccgccttgccaccgatgccatccacgtagttggcagtgtacagctgcatgccgggtgcgtcagtccacaggtccagggtccgcaagctcgacggatctttcagcctggccgcacgcttcaggccgtccttctcgtcgccacagtccagcacgtagttatgatcataccctccaggaacaccgtcgatgcgctcgccaatcctgcgctccgtcgtgaagtcaaaaggggtgccatcgacgggcattatctcgccggtgggaattgtgttctcgtcgaccggagtgatgtgcttgccccagatctgcagcgagtggtttaagatgtcgccgcaggcgtgacctgcgaggttccagtaggtgtgctgcgccaggcttataggagttgctttgttctctggtgtagcttccatgtcaagccttagagtagtagcttcaggaagagagtatgttgctcgaatggttacatcgcctggatagccttcttccccgtccttgctgtgatactgaaaagttattgaagggcattcgccatctttgtgctccacgacatcccacacgaccttatcaaatcccttcaacccaccatgaaggctgttaggtccattgttgacaggtaatgaatactcaagtccgtttagtgtaaacttcccatccttgatcctattcgcgacacggccaactatgcagccaaaataaggtgacatgcctttcacgtacggatccaagccatcgaatccgagcaccacatcagcgacactcccctgggcgtcggggacgaggagggaggtgatggtggcgccccagttggagatcctcgcggtgatcttgccgttggagagctctaggatcttgggctcggccgccattgatgacagttagcgagagattcgcctccgagctcgatttactagcgggggccctttactagcgtgggatc

SEQ ID NO: 21921 - DNA, 1153 bp, Zea mays
ttttttttttttttttccttttttttttttttttttttttttttttttttttttttattatcacagcttatccttctgcttgtttattcattcaacatgttttacatcaatttatgctgtccagtcactattcattcaacttcccgagaactcaaacagcatagtatgcttatacttctcaccgggccgaacaaccacagagggaaactcaggctggttgatggcattcgggaacccctgggtttccaagcacactccagcatgcttcgcgtagacagcgcccgccttgccaccgatgccatccacgtagttggcagtgtacagctgcatgccgggtgcgtcagtccacaggtccagggtccgcaagctcgacggatctttcagcctggccgcacgcttcaggccgtccttctcgtcgccacagtccagcacgtagttatgatcataccctccaggaacaccgtcgatgcgctcgccaatcctgcgctccgtcgtgaagtcgaaaggggtgccatcgacgggcattacctcgccggtgggaattgtgttctcatcgaccggagtgatgtgcttgccccagatctgcagcgagtggtttaagatgtcgccgcaggcgtgacctgcgaggttccagtaggtgtgctgcgccaggcttataggagttgctttgttctctggtgtagcttccatgtcaagccttagagtagtagcttcaggaagagagtatgttgctcgaatggttacatcgcctggatagccttcttccccgtccttgctgtgatactgaaaagttattgaagggcattcgccatctttgtgctccacgacatcccacacgaccttatcaaatcccttcaacccaccatgaaggctgttaggtccattgttgacaggtaatgaatactcaagtccgtttagtgtaaacttcccatccttgatcctattcgcgacacggccaactatgcagccaaaataaggtgacatgcctttcctgggcgtcggggacgaggagggaggtgatggtggcgccccagttggagatcctcgcggtgatcttgccgttggagagctctaggatcttgggctcggccgccattgatgacagttagcgagagatcccccccccccggtttactagcgggggtcctttact

SEQ ID NO: 21922 - DNA, 2735 bp, Zea mays
cttccttcttcttcttggcaatctccctcagcaggtcctccttcttcgcctgcagcgccgcgtcgcgcatgacgtcagcgtaggtccgcaccgaggggtccggggtggcctccccagcggcgaacgggtcatggcgctccggcgagatgatctggttgaggcggcggcggcggtagtcgtcctcgcggtcgatgatgcgctgggacctcttgggcagcccgtcgtcgtcgtcggccgaccgcgggatgtcggcggcggcgatggcgtggcccgtgtaggccgcgaggcggcgcggcgcagggttggcggcctccgcgtcgtcctccgcggcgtcgtcctcggaggccgggatggaggtgtcgtagcccgcgaagcggttggggtcggcgcccccgccgccgtagaggtcggtgtcgaaggtgacggaggacacggccatgggcgcgccagccgccagcgcctcctccatcctgcgccgctcctcttgcgtgcgcgcgagatctgcgtcgatcgagtccatggcggcggcggcgcgggaagggagcgggtagggtttgctttggtggacggagagtgaagataagatacgatgcgcgcccttcacatgcgttgggttgaaaaatctggcacggtggctggatctcgtccgttgattgatcgtttacgcgatccggatcgttcatttgtggtgctagccttggacttattcccaagtcccaacaaagccctcgcctgtctaataaaaaaacaaaaaaagcaacaaaaaaaaagcaaagccctcgccccaatccaatcgatccccaatccgttcacgcactccccaatctcgccgtcgccggcctcctctccggcctccgccgctgcctctctccacaataataatccactcctcgtcgcctcgcgtccgtctccttgaccaacgtgctccccccttcttctacctgtaattcccatcctgcttgtgcggcaagggcctctcccgcacgatggggaagcacgagttcctgacgccgaaggcgatcgcaaaccggatcaaggcgaaggggctgcagaagctgcggtggtactgtcagatgtgtcagaagcagtgccgcgacgagaacgggttcaagtgccactgcatgtcggagtcgcaccagaggcagatgcaggtgttcggcatggcccccgaccgcgtcgtcgagggcttctccgaggagttcctcgagtccttcctctccctcatccgccgcgcgcaccgccactcccgcgtcgccgccaccgtcgtctacaacgagtacatcgccgaccggcaccacgtccacatgaactccacgcggtgggccacgctcaccgagttcgtcaagttcctggggcgcgaggggtactgtaaggtcgaggacacgcccaaggggtggttcatgacctacatcgaccgtgactcggagcaggccgtcaaggaacgcctcaagcgcaagaggatcaagtcagacatggctgacgacgagcgccaggagcgcatgattgcccgccagattgagcgtgcgcacaagtccttagctaaacccaatggtggtggtgctgccgagggcgagcctgagtctggcagtgaaggagagtattcaggttcggatgatgatgagcaggagccggaggatgactcgaaagaggcagataaggcaacaggtaagattgcgattgcgcttcagaaggctgtgccggggcccaaggttaatccttttgacgataagccgaagatgaaatttggttttgatgaggaggatggctcaggcacccgagaccaggagaagaatgagttgaccaagaagatgggaaaggatgtgaaggcagcagaggcaaagaggtcagcattggacgagctgatgaaggaggaggagaaggccaaggagaggagcaataggaaggactactggctgtgccctgggattgtggtcaaagtgatgagcaagtcattggcagagaaggggtactacaagcagaaaggggtggtgaagaaagttattgataaatatgttggggagattgagatgttggagagcaagcatgttctcagggtcgaccaagatgagcttgagaccgtgatccctcagattggtggacttgtgcggattgtcaatggggcttatcgggggtcaaatgccaggttgctttcagtggacactgagaaattctgtgcaaaagtgcaggttgagaaaggcctctatgatgggaaggttctcagggctgtcgaatacgaggacatttgcaagatatcctcatgatatacaacgtgattcattccattttcctggatcatcactgaagcaaacaagctatacgatctagtgtactagctctgtcgattagattcttaatagtttctgtgcttgttattgtttgtgctggaatatcttctgttgaagcagtgtttgatatcttgatgtttctagttcgcggtaactgctgaaaggctatctgtgagaaaatgctctcatttatgtttgcttgttactagaccagaataaccgtattgatgagtttcagcattatttgccaatcaaaaaaaaaaaaaaaacatcgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccctttaaaaggaccaaagtttactaccccgggcttgcaaggttaaagtttttttttgggggccccaaaatt

SEQ ID NO: 21923 - DNA, 2489 bp, Zea mays
ctgcagcgccgcgtcgcgcatgacgtcggcgtaggtccgcacagagggatccggggtggcctccccggcagcgaacgggtcatggcgctccggcgagatgatctggttgaggcggcggcggcggtagtcgtcctcgcggtcgatgatgcgctgggacctcttgggcagcccgtcgtcgtcgtcggctgaccgcgggaggtcggcggcggcgatggcgtggcccgtgtaggccgcgaggcggcgcggtgcggggttggccaactccgtgtcgtcctccgcggcgtcatcctcggaggccgggatggaggtgtcgtaacccgcgaagcggttggggtcggcgcccccgccaccgtagaggtcggtgtcgaaggtgacggaggacacggccatgggcgcgccggccgccagcgcctcctccatcttgcgccgctcctcctgcgtgcgcgctagatccgcgtcgatcgagtccatggcgggggcgcgggcgggggcgagtagggtttgggttggtttggtttggtggacgaaatggaagatgcgaattgcgatgcgagattggagaagggaaggggactagctagcgggactgcggggagacgggagacgcccttcacccctgaccagtgacaacgtgtattgggttgaaatgtcggcacaatggctagatcttgtccgttgattgtcgtagacgcgatctgggccgttcatttgtggtaccgacttctccaaacaaaggcctcgcccccaaacggccaacccaatcgatcgtccccaatccgttcaggcagtccccgacatcgccatcgccgccgccgctctccatcataaacaatctactcctcgtcgcctcgcgtccgtatacttgaccgcccccttctcctacttgtaattcccctcctgcttgtgtggcaggggcctctcccgcgcgatggggaagcacgagttcctgacgccgaaggcgatcgcgaaccggatcaaggcgaaggggctgcagaagctgcggtggtactgccagatgtgtcagaagcagtgccgcgacgagaacgggttcaagtgccactgcatgtcggagtcgcaccagcggcagatgcaggtgttcggcatggcgcccgaccgcgtcgtcgagggcttctccgaggaattcctcgagtccttcctctccctcatccgccgcgcgcaccgccactcccgcgtcgccgccaccgttgtctacaacgagtacatcgccgaccggcaccacgtccacatgaactctacgcggtgggccacgctcaccgagttcgtcaagctcctggggcgcgaagggtactgcaaggttgaggacacgcccaaggggtggttcatgacctacatcgaccgtgactcggagcaggccgtcaaggaccgcctcaagcgcaagaggatcaagtcagacatggctgaggacgagcgccaggagcgcatgatcgcccgccagattgagcgtgcgcacaagtccttagccaaacctaacgatggtgatgctgccgagggcgagcccgagtctggtggtgaagaagagtattcaggttcggatgatgatggggaggagctggaggatgtctcgaaagaggcaaacaaggcaacagggaagattgcgattgcgcttcagacggctgtgcgagggcctaaggttaatccttttgaagataagccggaggtgaaatttcgtttcgacgaggagggcgacttgggtaccggagaggagaaggatgagctggccaagaagaagggaaaggatgtgaaggcagcagatgcaaggaggtcagcattggacgagctgatgaaggaggaggagatggccaaggagaggagcaataggaaggactactggctgtgccctgggatcgtggtcaaggtgatgagcaagtcattggcagagaaggggtactacaagcagaaaggggtggtaaggaaagttatggataaatatgttggggagatagagatgttggagagcaagcatgttctcagggttgaccaagatgagctcgagaccgtgatccctcagatcggtgggctggtgcggatattgaatggtgcttatcggggatcaaatgccaggttgctctcagtggacactgagaaattctgtgcaaaagtgcaggttgagaaaggtctctatgatgggaaggttcttagggctgtcgaatacgaggacatttgcaagatatcctcatgatatacagtgtgatccattccattttcctggatcatcaccgaagcaaacaagcactatgcaacccagtgtactagctctgccagttacatatctgatagtgtttgtgcttgttactgcttgtgatggaatatcttctgttgaagcagtgttcaatatgttgttgtttctagttcattgtagctgctgaaaggctatgtgtggggaaacggtgtcatgtatatttgcttgttactagaccctgataattttgcaatatttggttaacttctataaaaaaaaaaagaaaaaa

SEQ ID NO: 21924 - DNA, 1479 bp, Zea mays
  misc_feature (33)..(33): n is a, c, g, or t
aaggttcctctgatgggggtctgttagagggantgggggtgccgccggaccgaaatgattacagtgaggctaagatcaaggtagttggagttggaggcgggggttcgaatgcagtcaatcggatgattgagagctccatgaacggcgttgagttttggatcgtgaacactgatgtgcaggccataagaatgtctcctgtgctcccccacaatagactgcagattggacaggagttgactcgaggcctgggcgctgggggaaaccctgatattgggatgaatgcagcaaaggagagcagcgagtccattcaggaagctctttttggtgctgacatggtttttgtgacggctggaatgggtggaggaactggaactggaggtgctcctgtgattgctggaatagccaagtccatgggtatacttaccgttggcatagtcacaacgcctttctcgttcgaggggagaagacgggcagttcaagctcaggaaggaatagcagcattgagaaatagtgtggacaccctaatcgtcatcccaaatgataagttgctgtctgctgtttctccaaatacacctgtaactgaagcatttaatctggctgatgatattcttcgacaaggcattcgtggcatatctgatataattacggttcctgggttggttaatgttgattttgctgacgtacgtgctatcatgcaaaatgcagggtcatccttgatgggtatagggactgctacaggaaagtcaagagcaagggatgctgctcttaacgccatccagtcgccgctgcttgatattggaattgaaagagccacaggcattgtgtggaatatcactgggggaactgacctaactttgtttgaggtgaatgctgcggccgaaattatctacgaccttgtcgatccaaatgctaatctgatatttggtgccgtcatagacccgtcactgagtgggcaggtgagcataaccttgatagctactggcttcaaacggcaggatgaaccagaaggccgcgtgtcgaagggtgggcaacaaagtgagaatggccgacgcccgtcccccgcagagggcagcagcacggtggagatcccagagttcctgcgacgtagaggaccttctcgcttcccacgagtttgactgtcctgtcctgcacctgcacctgcacctgtatgatatggtccacccacccttaggtcagaattagatgctcttgtgtggcactgagtcttctctaggcatcgatcgtctctagcgcggtttgttctttctagttttccttttttcttttcttttccccgccaccgattcttatggttatggtcatcaataatgtgtagctgttgtgagctctctagcgctatatgtaatgtagtccgtggagaatgtgttttccctgttacactggttctgaatagaatggtagctgaagaaaaaaaaaaaaaaaaaaaaaaaaaaagtactctgcgttgttaccactgct

SEQ ID NO: 21925 - DNA, 2137 bp, Zea mays
  misc_feature (2114)..(2136): n is a, c, g, or t
gggtacctcgcgcccgcccggccgggccctacgcccaccccacccgacccgggcacacaacaccaattcaccaaacttctcaagactgtcactgtccactccaccacctcacttgcgatgcgaacaagagcaaagccctgaaatccttctccccctgcacgcacctgcagacctgctctctcgcgcgcatctcccgtgcccctcactgtttagtggcgacgactgggcgacagtcgccgccgccgcccgctaggggccgtgcccctggtctccatcttcgggcgcttcgcccaccagatatgagcagctggcaattcgattttgaggccattatttgataacccgggacaagtgcactgttacctgaccattttagcttgttcagatggctacacagttgccatgcttcacacagctcagtccaccgtcttgtagttggataaaagatgtcgggaactgcaaggctacgcctgatagggtagccagaagtgcccgagctttgggccactgtcacttccggtgctgtgcaggcccccgtagtgcaaactctttcaagaagaaagactctttcgagaagaaagactctttcctcgaacttcatccggaggtatctctgctccgtggcgagaagagtgccgaggttgtgccaatgaaaggttcctctgatgggggtctgttagagggactgggggtgccgccggaccgaaatgattacagtgaggctaagatcaaggtagttggagttggaggcgggggttcgaatgcagtcaatcggatgattgagagctccatgaacggcgttgagttttggatcgtgaacactgatgtgcaggccataagaatgtctcctgtgctcccccacaatagactgcagattggacaggagttgactcgaggcctgggcgctgggggaaaccctgatattgggatgaatgcagcaaaggagagcagcgagtccattcaggaagctctttttggtgctgacatggtttttgtgacggctggaatgggtggaggaactggaactggaggtgctcctgtgattgctggaatagccaagtccatgggtatacttaccgttggcatagtcacaacgcctttctcgttcgaggggagaagacgggcagttcaagctcaggagggaatagcagcattgagaaatagtgtggacaccctaatcgtcatcccaaatgataagttgctgtctgctgtttctccaaatacacctgtaactgaagcatttaatctggctgatgatattcttcgtcaaggcattcgtggcatatctgatataattacggttcctgggttggttaatgttgattttgctgacgtacgtgctatcatgcaaaatgcagggtcatccttgatgggtatagggactgctacaggaaagtcaagagcaagggatgctgctcttaacgccatccagtcgccgctgcttgatattggaattgaaagagccacaggcattgtgtggaatatcactgggggaactgacctgactttgtttgaggtgaatgctgcggccgaaattatctacgaccttgtcgatccaaacgctaatctgatatttggcgccgtcatagacccgtcactgagtgggcaggtgagcataaccttgatagctactggcttcaaacggcaggatgaaccagaaggccgcgtgtcgaagggtgggcaacaaggtgagaatggccgacgcccatccccagcagagggcagcagcacggtggagatcccagagttcctgcgacgaagaggaccttctcgcttcccacgagtttgactgtcctgtcctgcacctgtatgatatgctccacccacccttaggtcagaattagatgatcttgtatggcacctagtcttctctaggcatcgatcgtctctagcggtttgttctttctagttttctttttttccccgccaccaattcttatggttatggtcatcaataatgtgtagctgctgtgagctctctagcgctatatgtaatgtagtccgtggagaatgtgttttccctgttacactggatctgattagaatggtagctgaagaagtgatggttgcctgcattagtatggtagctgacccggcccatgtttgttttcctnnnnnnnnnnnnnnnnnnnnnnng

SEQ ID NO: 21926 - DNA, 1838 bp, Zea mays
taaacatacgtgttgtggatgatgaaactgctgagtcactaggcgtgtttcgacggtttgaaaaacctacctcgaaagcccttagcttggcccttggtctttgcctctttttttgatagtggtctttgcctctttggacgtgaagcccaaccagccatgcgcccatgcccgaatgctaggaggtcttctgccggccattctaattttcctttgtcggaaaactaagaacgtattttctctctatttaaatatctcaaaaataaactcaaagtgacgcaatgtttaatattggctccttctgatgtggcataatcctttgatttgataaattggtaacaacactgtaggcttgctctgtaggacgtagcatttctacttgtaaaacctggtagcaaattagaaagccgaaccactgaatctctaggctattggaatgttcagtatgttctttatggtgaacaaatccttcgtcctttcgtttttttctggaataactgattataggagctatattcttgatcctagaaaagggaaaactgtaattacatcatgtgagcggtgacctgtgagggcaaatatacataccactcctaaagcacaatgacattctgtctgtctgacaataaaaatatatgctcaagtgctcaacaaaaagaactcatccattactacggtgcaccaatcagctgtggtagtgtatacatggtttgcacacacgagtattcactattcagtagacacacacgactcatcttggaggtgcaaatcggggtgagatcaagagcaccgtcgtcacctgatctcccgggctatgaccggccgacgaggagagggcgtgcggggacgagcagtcggtacgcggagtggccccggacaaggccgcacctcgccacggccgcggcccggccagcgtcctcgatctgctccagcacccgcacgaaggcgtcggcgtcgcacggcagcgcgagcgggccggccgccgcgtacccgaacgcctcctcggcctcctctagcagcgcccggaacagcgggtggttcacgcactccgtccgcaccacgaagcgctgccgccccgcgccgacgcacaccgtgaagcacccctccggcgccggcctgctcctccgcgcgccgctgcggcaccggcccagcgtcttcgtgatgagccccggcttcctccctctctccgccatggccgtgcccgtgagctccttctccaccatgggcacgaccgcacgagtcaaacacaggacttgggcgcttggcaagactatttagagctgaaggcgtgaaatcaagctttgtgtggggcagtgggatgaatatatagtcgctctgtagctaaaatggttgacgcgttttgacttgtggatatagattattttttaaagtgaataatataatggatatgttattattaaatatctttaatggtaaaataacccataacaaaataaacaacatttatatagaaagttgaataagaaaaatagtcaaataaaatgttaaaagttaaaatatcaactatagtatttgtgtgtatatgtacacgtagagacaagaggcaagacgtttagtgaacctagagaaacggtcttgatcaagaggcagcttttttatataagattagctgctacgggctcatgagagagaggctgatctatagttttatactacacaataattgcatatatagaattgggtgcttcaacttgtagcacgcacgtacattcatatagtacggtttggcagtttcggaagggtaggagtcgtgacatcaagcacggccgactcgagggggcagcgagtccatggcaataataatgcagtagattttagcg

SEQ ID NO: 21927 - DNA, 1112 bp, Zea mays
  misc_feature (720)..(721): n is a, c, g, or t
  misc_feature (734)..(735): n is a, c, g, or t
  misc_feature (737)..(742): n is a, c, g, or t
  misc_feature (975)..(975): n is a, c, g, or t
  misc_feature (977)..(977): n is a, c, g, or t
  misc_feature (998)..(999): n is a, c, g, or t
  misc_feature (1007)..(1008): n is a, c, g, or t
  misc_feature (1029)..(1031): n is a, c, g, or t
aggccggccgggatcgaggccaggacttggcacacgacacccacaaaggtggaccgtcacaagaacacacacacacacaaaggcaacacgacggcctcaattctccacaccacacgaagaccaccacccagctcagctctcgcagcactaaaccccatccactcgctcctttatcatcgtctccctcccctccattctcagtctcaggctctcagctcagctgcgtcctcctgccacccatggcaaacgcttctctgcagtccttccttctcccgcacgaccattctttcgccggcgccggcggcagccgtgacggctccgcgtccgccgtgcacaagctctccaccaacaccagcggcagcatttccttcaggctctacaccaaaacctccccctcggtgacagcagcctcagccaccaattcgtcagctccgactccagttgccccggcatctgcaccagcggcaggggacgaagaagaagaagaaggcccctctctcgacctcctccgccgccagctcgccgcgggcgactaccggcaggcggacgagaccacgcgggcgctgatcatcgacctcgccggcgagcccgcgaggcgccgagggtacgtcttcttctccgaggtccagttcatcccggccgaggacctcgccgccatcgacgggctctggaaggagcacagcggcggcaggttcgggtacagcgtgcagcgcggttggnnagaaaaaaaaaanncnnnnnnacacttcaccccgcttcttcatccgggtcggctggatgaggaagctggacacggaggtgggagcagtacaactacagggccttccccgacgagttcatgtgggaattgacggacgacacgcccgagggacacctgccgctcaccaacgccctcaggggcacgcagctcctggcgaacatcctcacccacccggccttccaggaggaggaccagggagacggggctgctgctgnanaagagagtgcaaacaccaaanntgataacnnagggagggagagacccaggtnnnatgagagatttcaagcctgattattctttttgattcaggctggcgaaggaaaccaaaaaaaaaaggggcatgggagtttgt

SEQ ID NO: 21928 - DNA, 1025 bp, Zea mays
gggtacctcgaggccggccggggggaccgtcgctgccgccccggcggccgggctcaggctctcagctcagctgcgtcctcctgccacccatggcaaacgcttctctgcagtccttccttctcccgcacgaccattctttcgccggcgccggcggcagccgtgacggctccgcgtccgccgtgcacaagctctccaccaacaccagcggcagcatttccttcaggctctacaccaaaacctccccctcggtgacagcagcctcagccaccaattcgtcagctccgactccagttgccccggcatctgcaccagcggcaggggacgaagaagaagaagaaggcccctctctcgacctcctccgccgccagctcgccgcgggcgactaccggcaggcggacgagaccacgcgggcgctgatcatcgacctcgccggcgagcccgcgaggcgccgagggtacgtcttcttctccgaggtccagttcatcccggccgaggacctcgccgccatcgacgggctctggaaggagcacagcggcggcaggttcgggtacagcgtgcagcggcggctctgggagaagtcgcggcgcgacttcacccgcttcttcatccgggtcggctggatgaggaagctggacacggaggtggagcagtacaactacagggccttccccgacgagttcatgtgggaagttgacggacgacacgcccgagggacacctgccgctcaccaacgccctcaggggcacgcagctcctggcgaacatcctcacccacccggccttccaggaggaggaccagggagacggagctgctgctgcagaagagagtgcaaacaccaaagatgataacaaagggagggagagacccaggtccatgagagatttcaagcctgattattctttttgattcaggctggcgaaggaaaccaaaaaaaaaggggcatgggagtttgtggtgcagagatgctggcatggtgtaattgatttaaaagatcatgtatccgtagttctgtttgggttcttttt

SEQ ID NO: 21929 - DNA, 1653 bp, Zea mays
ccacgcgtccggtctcttatgcacatacaaattatgatataagggtattgtccaaaagtactgagaagggtgctgcatatggaaattatgtcgatcctgagaatatgtcggccccaacctttaaaagtctagtgtacttcatgttggccccaacactttgttaccagccaacttatcctcaaactacatgtattagaaagggttgggtgacccagcaactcataaagtgcgtggtttttacaggcttgatgggcttcataattgagcaatatataaacccaattgtgaagaattccaaacatccactgaaagggaattttttgaatgctatagaaagagtcttaaaactctcagtgccaacattatatgtatggctttgcatgttctattgcttttttcatttatggctgaacattgtagctgaactcctctgtttcggtgaccgtgaattctataaggactggtggaatgccaaaactgttgaagagtactggaggatgtggaacatgcctgttcataagtggatcatcagacacatatattttccatgtataaggaaaggcttttccaggggtgtagctattctaatctcgtttctggtttcagctgtattccatgagatatgtattgcggtgccgtgccacattttcaaattctgggcattttctgggatcatgtttcagataccgttggtattcttgacaagatatctccatgctacgttcaagcatgtaatggtgggcaacatgatattttggttcttcagtatagtcggacagccgatgtgtgtccttctatactaccatgacgtcatgaacaggcaggcccaggcaagtagatagttcggcagagacatgtacttcaacatcgaccatcagaagcagactggagcgacgcggcaggaagcagcagtagcccctcacttgccattgtttaccatcagctagcagctggtcagcctgaaaatgcttctattccaggcggccgtgctgggatgcagcgtgtacattaccagcgatgcaacgtcaacggttaccaagcgcggataagcagtgctcgtggcatgtgaactctgtacacattgaagtctatatgtccgcggtgctgtgtgcataatgtcgtggtagatgtaatatgtacaatgtatgccacgacttaagaggtcaaaatgaggctcacgtcttggagtgaaaaaaaaaaaaaaaaaaaagaacagacatcgagactcgatgaacttgttctgagccggtaacttcttgtgaccctgtcggctgtcgcgtcgtgtaccaagagcctggttggtagggattgttgtcggcttcacaagctggaaaacagctcctaccaaaatatccatccacccggccgctcaatcatcgcagaagctgcggaattcgagctgagagaagctacgacagaagctgaaaaatgtaacttttggctatgggcgggtttgcccctgggccggcgcgggggcggagggccacggggctgccggagctaaatctgatgggtagtaaactagaaaggaacaaaactgagtaatgatgctgaagaaaactgaacaatgatgtaactaggatacggatttaaaatttcctaatacatacacacgtgaatcgcctagaacgcatgcactgcaggggtaccgag

SEQ ID NO: 21930 - DNA, 2093 bp, Zea mays
tatttgtatatacctactaaaaatttgcataacaaatataaaccaaactttcctagcaactaataaacaaaaaatcctaatacacaaacctatcttggataaactgatttagaagtaaacatgaaatggagagagaacaaacaatatctaaccatcttaaacaacctcatttgaataattaggtaaaaactagatgtacttttatctctaaaacatggtgaaagcctagttccaaaatgtagttaaaattaagcaaaaatgaacaataattggtaattgaaacataattaaacccatcttttttagcaaccttcttccaaaaaaataaagatcaaaacctctcccttgtattttgtgaaatctggaccttcaaaatcgcctctaatgaaagttggctgcgagctacaactactgtcgggaaggacgaaggggtatttatactataaagttcactaccggttgacttaaggaaccgcacgtgaaaacatatttccgctagcagttctctttacacaaccactagtggaaatcgtcaatttctactgactgttggtataagggtaccgccagtggaaattagattattactggtggttcaattacttacaccaattgccggtgggacgatttccacttgcggttctttaaaccggggtcacatgtttattttcaatggcgcaccataattgaaaccagtgaaaagttgaatgcaatacaagtttagagctcgtttgtaatagtggtaaataaactcactaatttccgtgggctgtcttactgcagcccataaaaattaaccaatttttgtggagttaacagagagagcataaaattatcttggcccacataaattttgctttttcctgccagtaaagatcaggtcatcacatgtgtagacaaagaacctttttaatataatatacactccaccctgtgcatctctatcgtgaggtgtacacagcctaatatttctgagaaaatataacagattgatgcgagtacatcctaaaattagtgaagggagtttagtttgttgaagaatagaatggtgtcacagagaagtttagagttcagacaaactgtgtttatcgatgcgatcactgatacatttcttcctgatccatattgggtagagtcgtctctgacacgaatgcaatttcggttaagatcagaacgattacatacatgccgcaagcggatggatcaatggatcactcggaggcacggccgttgaacgattctgacttgaactgctcatagaacttggtgatgaactcctccgcctgcatgtcgatggcgtgtgggcaactgctgtcaccgtcatcgccaccctcagcaccctcttcctggtcgctgtccatctggtgcagatcctcagcggacgcgtagcggctggtcatgcccacctccttgatctcgaagccgaaccgtgcctgcgacggcggcgggaggatcacgtcatggtacacatcggcgtggcccagcggcggtggcggcggtggcggcgggtagtactccagctgcccgcggaggcggagcgggcgcataccgtccacgaggcgcttccacgacgttgactcgtcatcggcaggcttgcaatcgtcatcagcagccgcgatggctctcttcttggggctcgtggtgtcgtcgtctgtcttcttcatgctgtcgtcgctccggccgaaggacaggaacatcgccctgaagaggctgaacgccccgcgcttcttgcgagtggaagggctactggaggagacgggagtggtgcattccatcgtcaagcgatggccatcgtccttggtggattctccgacactgaacaacgcctcctcctcgttgcttgcggccgaggtgatcgtgggaacatccccattgatattttctttctcctctaggcttattgttacgctagggatggcagtgcaggagaccgcgtcggcgccattgttgtccagcactacggcggcaacgatcataggcgaaacagctacttcctccatgccagggaggaagagaaggcacgaggccttcggcttcgagggtaaggctctcctcccgggcggccgcggggggcccaatcgcccctaggagtg

SEQ ID NO: 21931 - DNA, 1592 bp, Zea mays
tttttttttttttttttggcgtggttaggatcagtaaactggaaaagttgatcctgtacctttattttacaggtgaagggaatcgttgctcgtaaccctcgaagaaaacgccgggctattagctactatctaacaatgtactactccctccgtttctttttattagtcgctggattttgcactatccagcgactaataaaaagaaacgaagggagtacatgcatgggcattcggaaatctgtcagggtctcagggatcagtagacggcagtctgctcctgactttgtgctcaggcttatgcgtgctctcgaaatcgatatgaacaaacgcccgctcgacttgaggcaacttctcgattctctcctgcagcgattcaccgatggcgtgcgcctctctcagccgcatatcttccgctagttcgatgtcaacctctacaaagtagagagctccaaagctgtaagctctgacagtctcaacccgcctcactcgtgtgtcgtgcttcatggcgaggtacgttagcatctgcagcatctctggaggagcacattggcccactagggtagctgcattttctaatacagttttggaccagttgacgatggtatatacagcaagtatgacagcccccgcggggtcaatccaccacaggaatttgtccccaagaacagcagccaccagaccgacgacattggttatcacatcgaagtagtggtccttcgcataagcccgaacaatactgttccctgaactcttgcagtagagccagagagccagtttcacggcggttgccgaaagcatgatggagtacaaccatatcagctgctccgatgtcatcttctcgccaggtttgttctccaccagctgttcgacggcctggaccaagacctggaaacctagagttgccatgatggcggcgaagacgatgatcccgacgggctggacgcgcagcttcccaattgggtacttgtagatgttgaccctcttcatggaaaggtgcgtgaaccagaggatacccccggccatgaaatccagcaacgagtcgagcgtggacgccgcaatcgccatggaccccgtcctgatcgtcgcatacaccttgaagaccagcagcacaatattggcgtagttggagatcttcatggcgaactcgctctgcttctgctccgcgtcctccgagtcggaggcctcgacatccgaatcgaattcgccgggcatgcagcgcgcctccacctgctcgaaggtcttcagggtcgcgagctgcttctcgtagtactgtctcacacctctggacatgcctttggcgcgggagaggtcgacgtcggcgaggtgctccgggtcgagcccggcgcgcaccttgtcgggcagccgcgacaggaagctgctgcgcagcgaccgcgccgagtcacggcgccgcagagacgggggacggccgccgccggccgccagcagcggggccctccgatcgtctccctccatagtatcgggcaattcgccgggcgtcgacttgagtccggctgtctgtttcgtcgccctctcgggtgtgtatgtgtatctctctctacggggaacagttttggttttcgcttcccggccgg

SEQ ID NO: 21932 - DNA, 685 bp, Zea mays
taggggccttttttttttttttttttcaggtttaaaaatagaatggcccttgtcattcagtactgccatgagttcatggttagtgccccagtaaaataaatgtgccatcattgccacattagagtagaaacaggacaaatagctttttgctaaggataagtgtctcataattttctgataccgtgcttacagatgatcatgcttctttacggaacacatgcaaccagttgtggtgcattctagttcagaatggcttcaagtctgtattaacttaagatcagctacaactcccgagcattcaagttcacggaaccaggcttgctgcttcttgtggagtcttttggggcgttccagaactctgctgattgaactggcagcatagttaatcgagcacgccgcagcgctcaccagcgaccgcgccatcgtcagcgcacagaacattccgcggccgccggagagggcttggtcggcggggtgcgtccattcgtcaaagatccagccgtagcggcggtcgaagacgaggcggcgcgggcggcggcggaggtgcggagccaacgaatcggtggaggactgagccgccgccatggctggcgttgacgctgtcacgctatcacgcactgtatataccaatgttttaaatttagttcgaccgtggattttttttgtttttcccggaccggccggc

SEQ ID NO: 21933 - DNA, 658 bp, Zea mays
ttttttttttttttttaaaataaatgtgccatcattgccacattagagtagaaacaggacaaatagctttttgctaaggataagtgtcccataattttctgataccgtgcttacagatgatcatgcttctttacggaacacatgcaaccagttgtggtgcattctagttcagaatggcttcaagtctgtattaacttaagatcagctacaactcccgagcattcaagttcacggaaccaggcttgctgcttcttgtggagtcttttggggcgttccagaactctgctgattgaactgacagcatagttaatcgagcacgccgcagcgctcaccagcgaccgcgccatcgtcagcgcacagaacattccgcggccgccggagagggcttggtcggcggggtgcgtccattcgtcaaagctgcgggagagaggaggggcgagggagcgtcagagcacggaatcaggacgtcggcggataccgcaggggggaggtggggctgcgggtgctcgtgtgtctcttacatccagccgtagcggcggtcgaatacgaggcggcgcggacggcggcggaggtgcggagccaacgaatcggtggaggactgagccgccgccatggctggcgttgacgctgtcacgctatccgcactgtatataccaat

SEQ ID NO: 21934 - DNA, 1628 bp, Zea mays
ttttttttttttttttttgcatataacctaatttgtgttttttttttttttttttcagtggacatagaacgatgtatcttttacaggttcgctcacatgtttatcctcgttcccatattgttctcacaattctcacaaaaataggctcaaaagaaaaaaatgatcaaaatccgcaacactgcatcctcaagctacaccttcaatcctaaaagaagcatctctactaaaaaaacggacactgatggaatcatcacaagtttgaaaccgaatcgtgtgagcatagtacttattcggtttctttcgcctatcagacgcttctcttttcttctcccacggctcctctggacgagttctcgcggcggcggagagatgacgcggcagtggcctctgccttgccggacttatcgtcgccatcgcctttccacccggcgcccggtgtaaagagcgacagcagcctcgccatggtgctcctggcgctcccacccaccgtactggtgtcgcgggcgctaccctccatgacgcgcacggatgctaccgcgctcgtcacgtgcctcagcctgtgggacatgaggagctcaaggcgcacgtgctccgggagccgcagcgcgaaccgctccatcccgccgtcgctggcgctgtggcccgtcgagttggaccgcggcagcgcctgccgccccgccgcgcggcggttcctcgcgaggcgctggatcgtagtccgatcctcttcttcgcctacctcgcttgcgccggcgccgccgattagcacgatagccgcgtgaacgggcgacgagtccggcgtcagcggtggcgccgtatgaagctccagctgcgctgccggggctggtggtggcgcgtcgtcgaggacgctggcgcggcaaagcgggcaggtggcgtgcctctcgagccagaggccgatgcactccgggtggaacgcgtgcgggcacgtcgggaggatgcggagggcgtcgtcgtcgtcgaactcgaggaggcagaccgagcactcgagcgcgtcctcgcgcccgtccacgatccggtgctgtctcacctctcggaagaacactagcggcagcgcagcgatcgcggcggcatcgagccctcccttgcggctgccccctccgcggggccactccggtgccgacgccgcgtccggagcctgggggtcgtcgtcgtcgggggcccggaacaagtggaggcaggcgaaggcaagaagcacgacgaagacggggaagaatacggccatgaatatagagatgctcatcacgtcggcgaccgtttggttgtcgcgcggctccggggactgcgccgcaacgacggataccgcagagaccgctgccaacacggcggcggcgtacatggcgtcgtcccccgggtgccggggctagggtttgggcggagacggcaggtgaggtgcggtgcggcggtgggtttgattagtggtcctcggagggttttagatgccgagagccccagatgacagattgcgcgagaaataatccagcataattgatttccttccgagattacttggcgtcggctgtacgcaagaatggcatgcagttcgggtatctgccgtgccttgcgcggtgcgtccgtgccgcgttaaccaagaatagttggcaaattttgca

SEQ ID NO: 21935 - DNA, 1129 bp, Zea mays
  misc_feature (8)..(8): n is a, c, g, or t
  misc_feature (74)..(74): n is a, c, g, or t
acacaatnacccacacacacgcgttcaagtaccgttttaggggatctgcgtgattcagccctattagtactggngcgttgctgccttttggaactctgatataagacaatactagtacagccttttggagctctgatataagactatactagtacaaggcatgtgtattgcaacgacacacaattaatactagtataatatctgtggattacgacgacacgctattatatttgatatagtccatgtatcagatattaaactgataaaaacaaatattactctttatctaacctaaaacatcgaaaaaggtatgagttgaaaagtaggtcagccttttttataggttactcggatgctcgttctcattcagctaacaaggtaatattacgtaagtgttgcgctacgtgtagctttctgtcgtattagtcttgagtgatttctcaagatccatctatgttataaggactcattgttagtcttgagtgatttctcaagatccatctatgttataacgactcattgttagacaacgacccattattaagcgagaaacgggaataaaaatgatcacacgtgctttgtacgtgacacacgacgtacaaaactgctgctttaatatactagagatatactggtacaatatgcccgtgcgttatgacagcatacgaatcatatttgatgttatagtacaccaattgcacaacatcccgtggtaagccaatgttttttttttttttttcattttttttttttttttaaaattaaagtggacatatgagccacatactaaatattaaattgtagatgctacacttttttataactcggtcaatcaatcatcctcagttcagctagcgaagtgataccatgagtgctacatctatgtaacttcatgccatgttagacttagatgttttctcgcagctggtaactccttgattgttagacgacatatgggaaagaaaaaccgagctactctacacgcttcggacgtgacgcatgaaactggtaagtgcaacaattagcttcataaaacttaaatatcaatggcacccttaaacagcgagccactatttgaatcagctagtcagcatccataatgatatggggggggggcctacgtagctga

SEQ ID NO: 21936 - DNA, 3658 bp, Zea mays
  misc_feature (2670)..(2670): n is a, c, g, or t
  misc_feature (2786)..(2786): n is a, c, g, or t
atcgctgtgaaaaaagagaaacgacgatggagatgctggagtaatgtgtttggtgacaaaacagatgaactaaaaaacaaatggtccacatggaggtaggttaggttcatcagaacgtgacaatatacctatgaaaacagcattcattattctattgtttgtactcaggaataatagacaagcagagaagtccatgatttggtttcccttagtttaggaccctgtcctgttttttttttttagtgcagccgtgcaggtatcagcatatgggtttaatgtaggtacaccagaaacatttgccctgttaaattaaacaaagagggcgagggtggcaagatgagtagagctggtggacttgatctgagcagactgcaatgaatcatatcctcaagaggataaaaaaactattacctcctgtgcagggcatctgtgcatcagcgacaggaaaagagagatgaatgaacgaacctaatccatccatcagcagcgtaaccaaatcaggcacaggtttgggtattaatttaaagcagtggaagtgatgagctgggagcaggcctaacccttttccaccaactctagaagagctcccgcgatccagtcaagtgccctataaaatccagccccgcttggcttcacccacccttgggctcgcagtcgcagcaacgatggggaggtcgccgtgctgcgagaaggcgcacacgaacaagggcgcgtggaccaaggaggaggacgaccgtctggtggcgtacatcaaggcgcacggcgaagggtgctggcgctcccttcccaaggccgccggacttgtgcgctgcggcaagagctgccgcctccggtggatcaactacctgcggcccgacctcaagcgcggcaacttcacggaggaggaggacgagctcatcatcaagctccacagcctactcggcaacaagtaggcagcccgaccgacctcaagcactaaggcacccactaaggcactaactgtgttgtctgtgtatgatctgtttgttgggtcacagatggtccctgatcgctggaaggctgccgggcaggaccgacaacgagatcaagaactactggaacacgcacatccggcggaagctgctgagcagggggatcgacccggtgacacaccgccccatcaacgagcacacgtccaacataaccatatcgttcgaggactggggccaggggaaggcgctcaagtgccccgacctgaacctggacctctgcatcagcccgccgtgccaggaggaggaggaggccatgctgctgaggccggtgaagcgggaggaggccgggctctgcttcagctgcagcctggggctccccaagagcgcggactgcaagtgcagcaacttcctcgggctcaggaccgccatgctcgacttcagaagactcgagatgaaatgagagcttccatccatctctgtctgtctctctctgtaacttcacccctgataacacgcaggagtagtagtcaccaactgatttgtcgctccattaattctgtctctctctctctctctcgctatgtaaattagcatcaccaactgattgattgatcatgggcaattaataatacttgttgctgctgcaaattgacattaatcacggttgccatgtgcagctgagacagatcttacgacgtttaccaaaccactagtagagcagcagcagcaagcatccaaatggcttcctgctgtgggctgtcccccggcgatgcggtaggggcgccgccccctgctgtgggctgtgggctgtgtggcctgcggaaaaaaggcagctggttttggaaggatctcgcgcagcaacttgcctgatcgattggattagttgcggatgtagcgtctggcggcaaaagctgtgctagcgtactccttgtgcgtgtttttccctatatttctctccatatctctgtactttctattatattttaggacatcacttgaaaatagttgtttcgaaccaccgtgggacgacggtgatcgccatatatatgttgaattgaatgcacatgcacgggcgtgatggtaggtgggccaatccccattatatttaataactgtcctactagtagctagagccggcagcatcatccgatccgccgcttttaaacaaatgaatcattattatcctgatcgaacctgctaggctggggacactagtgttagattcaattcgtctaattccccaataaacaatgacttgtgcgagttcattagtgctgatagatatatacctcttcattccaacacaagcaccgcgcgctataattttcgtacgtatagtacgcatcaaacttataatttgactagatttataacaaaaaaaaaattgtattaataatatctatatatatatatatatatatcgctaaacaagtttgtcataccaattatatattgctgtgaatgaatattaatgtattgtttaaatatgtgtaggtcactagagctagcaataattgttccatagtttattttggaagtcttaaaattatttaacgatgatgaggccgacgaccaacgatcgtgtgttagggtaataaaaaaaatctacaagatggcctaaaaagttacaacaagccaaagaattaaacaacagaagctagctattggagaacaatacaaaaataaaactacaagcaacaagtcgttttccggcggctanctaccaatacgtcgatcatcccagatcgaagcaattaaacccccgcacatacgttgtcctgccttttcaattccatctcttggttggttgcttttcttttattaattattattatnagcagtactggcaactgagcgagtataaaatacgctacgcgtcatggtgtctacggtagctgatcaagtattaaatacagagaaagatataaagatatatatatatatatatatatatatatatatatatatatatatatatatatatatatatatatatatgcatagccgtcgtcagaatcgcgcgctgtcatgacgacatatatatatataacggtgcgtcatagctagctagtgtgatgcgtacgtgcactgtattttggtagttgctgaaattgaatgggagcaaataataacaatgaccaagtgcgtggacggtgacattcgatcggttttattgatgtgcactgtgcttgctgtttggtgtccgttgctggagttatctcctccgccgcccggacttctcttacatcaactgaacatgttttgtcgcatgtacaagaagcgacggccgatattagaatcgaggactccgaccggagctgccgggctcttcatagagcgaagaaggttgtcgcgagcgggcgaaggccgtgccgcgtcccgttgtcgtttgggtccatttgtaagcctctctatggcgtaggatcaatagtacgtttagtcaaactttacttaacatcgatgtaatattctagagctgtaaggtgggatattctaggactgtagcaggtaaccgtggacgtaacagggcgtatctacctactcggttacttataaataaccccgcagtgtacattgataggacacgctacagttaaatgcttactattacgttgagcaactgtgttccttctttctcgagtgattaggcgcaccaggtgtcccaacactcagctcgattgcaagtgacgagacaagcacggaggtag

SEQ ID NO: 21937 - DNA, 1307 bp, Zea mays
ttttttttttttttttttttttttttagtgcagccgtgcaggtatcagcatatgggtagtacaccagaaacatttgccctgttaaacaaagagggcgagggtggcaagatgagtagagctggtggacttgatctgagcagactgcaatgaatcatatcctcaagaggataaaaaaactattacctcctgtgcagggcatctgtgcatcagcgacaggaaaagagagatgaatgaacgaacctaatccatccatcagcagcgtaaccaaatcaggcacaggtttgggtattaatttaaagcagtggaagtgcggacgctcggggccggccgggttgcgaggcctaacccttttccaccaactctacacagagctcccgcgatccagtcaagtgccctataaaatccagccccgcttggcttcacccacccttgggctcgcagtcgcagcaacgatggggaggtcgccgtgctgcgagaaggcgcacacgaacaagggcgcgtggaccaaggaggaggacgaccgtctggtggcgtacatcaaggcgcacggcgaggggtgctggcgctcccttcccaaggccgccggacttgtgcgctgcggcaagagctgccgcctccggtggatcaactacctgcggcccgacctcaagcgcggcaacttcacggaggaggaggacgagctcatcatcaagctccacagcctactcggcaacaaatggtccctgatcgctggaaggctgccgggcaggaccgacaacgagatcaagaactactggaacacgcacatccggcggaagctgctgagcagggggatcgacccggtgacacaccgccccatcaacgagcacacgtccaacataaccatatcgttcgaggactggggccaggggaaggcgctcaagtgccccgacctgaacctggacctctgcatcagcccgccgtgccaggaggaggaggaggccatgctgctgaggccggtgaagcgggaggaggccgggctctgcttcagctgcagcctggggctccccaagagcgcggactgcaagtgcagcaacttcctcgggctcaggaccgccatgctcgacttcagaagactcgagatgaaatgagagcttccatccatctctgtctgtctctctctgtaacttcacccctgataacacgcagtagtagtagtcaccaactgatttgtcgctccattaattctgtctctctctctctctctctcgctatgtaaattagcatcaccaactgattgattgatcatgggcaattaataatacttgttgctgctgcaaattgacatt

SEQ ID NO: 21938 - DNA, 1621 bp, Zea mays
aggccgctttttttttgcttttgttggaacttagatacttaaagtgatttctcgtgtgattcaatatccaaaaaaattcggatatccaaaaattccatccaaatcattgttcaccatcttcgaatccggatccggacgaatatttttcaaaccatattacatccttacatgtagccatacactactactagttcagctcaagctaggccttgtggacgacaacaaagcaggacagaatggccctggggttgaacaccagcagttcttccaggttggagaagaatcccaccgaccccaccaccgactcatgctccttgtcgtcgtggtcggcctcctcctctgccgctgctcttcttccttgggccactacacccttcctgcaacgtcgtcagcacccctgcaagattcatatacacaacctgtagctagccagctagcttggatcgatcagaaagtcagaggctcagagccagctaatttagattttttggagagccaaagaaggctgaaaagcccaagcctaagttgggatagtctttacaccagagggagggtccagataccggaccaaaactatggcatgctatcctattccatcatcatcacaccagttgcgccatcgctccaaggggaagggggaaaaagacacgaatgactcatcagtcgttcaagttcactccgtattgttgagcaaggttagtgatgtctcccttctgcactagagcttccagcatgtcgtacttcttgcagtttccatcaagcacctcctgctgccgagtcgccagttccttctcatctttcaagattttctgtatgagggccatgttctcagattcctgcctctttgcaaggtttttcaatttctgcatcgcttcatagtccttatctccttgttttacccagcagaaatcttttcgaaggccagggcaaggagggcgatcacgaaacatctcagccttggcatggatagcttttacaggccttggcattcccccaattatgaacgggaaatcattcatcaattctacagcagccttagcctgcacgtcatcatccaattccaccaatgcagcagaagcaatatctttatatgggatcgtgtaattgacgatgaactccacatggacaacatttgcacattgtgcaagagcagctttgatggccgattcctttacttgaggagaaaggtggtcaatatatattgtcctcttaactttcttctcgaaaccagcatagtccttggaagcctgttctttggaagtctccatagaagagcaaccggcagcagcaggggcgtcgtccttctggccgtgctcctggcagcagaagctccagcagcagagaagaggcaggatgcgggcgtcgtcctcctggccgtgctcctgctggtgctcgacggctgcagcctgctgcctggtggtgctcggcggaagagcaggggatccgatcaggtaggggtaggggatgaccgatcggatcggatgggcaggggccaggggatgaggatgagtggatgaccgaccggaggagccggtttgctcggcggctgtcggctgggggatggggattagggtttgccggtttgagcgtcttcccccggccgcccgaggggcccccaatg

SEQ ID NO: 21939 - DNA, 1718 bp, Zea mays
gataaaataaagtattgcttatgttaaaacttggatacttaaagtgatttctcgtgtgattcgttatccgaaaaagtctggatatccaaaaattccatccgaaccattgttcaccatcttcgaatccggatccagacggatattttccaaaccatattacatccctacatgtagccatatactactactagttcagctcaagctaggccttgtggacgacaacaaagcaggacagaatggctctggggttgaacaccagcagctcttccaggttggagaacaatcccaccgactccaccaccgactcatgctccttgtcgtcgtggtcggcctcctcctctgccgctgctcttcttccttgggccactacacccttcctgcaacgtcgtcagcacccctgcaagattcatatacacaacctgtagctagccagctagcttggatcgatcagaaagtcagaggctcagagcccgctaatttagattttttggagagccaaagaaggctgaaaagcccaagcctaagttgggatagtctttacaccagagggagggtccagctaccggaccaaaactatggcatgctatcctattccatcatcatcacaccagttccgccatcgctccaaggggaaggggggaaaagacacgaatgactcatcagtcgttcaagttcactccgtattgttgagcaaggttagtgatgtctcccttctgcactagagtttccagcatgtcgtacttcttgcagtttccatcaagcacctcctgctgccgagtcgccagttccttctcatctttcaagattttctgtatgagggccatgttctcagattcctgcctctttgcaaggtttttcaatttctgcatcgcttcatagtccttatctccttgttttacccagcagaaaccttttcgaaggccagggcaaggagggcgatcacgaaacatctcagccttggcatggatagcttttacaggccttggcattcccccaattatgaacgggaaatcattcatcaattctacagcagccttagcctgcacatcatcatccaattccaccaatgcagcagaagcaatatctttatatgggatcgtgtaattgacgataaactccacatggacaacatttgcacattgtgcaagagcagctttgatggccgattcctttacttgaggagaaaggtggtcaatatatatcgtcctcttaacttttttctcgaaatcagcatagtccttggaagcctgttctttggaagtctccatagaagagcaacctttgatcttctgaaaaaacttatgcttgcacctgttacacagcagatagttactgatttgaactttgtagatctcctgccatcttgatgaggctttgcagatctcctatgtgtcgtgctctgcgcgaggaagagggggatccggtgctctgcgcgaggaagaggagggggttccggtggtctacgcgaggaagatgaatcgtccgcgaactgaggcggtgggcggcggcggcttagagagggagaggaagccgccgtgcgcgaggaagaggagggggctccggtggtgtgcgcgaggaagatgaggctgtcgtgcgcaaactgagcaatgggcggcgacggcttcgagagggacaagcggagacagggaaaccctttccgaccttgtgacaccggggatggaaacgctgtgcaccccaccggatgccccgcggataag

SEQ ID NO: 21940 - DNA, 998 bp, Zea mays
agtcgtcacgaccatgatttggtaactgaagcaacaggaagccggcggtgtaggcgacccatggcgccacagaggaggagagagagggcggtgggggaggcgcggccgagctcgtcggcgccgacaccggcggggccggggtgggtcgaggtgcagcgccggcgggtgggcggcggttggacaagccgccggatctctatctacgcctcccgagtctacttcctcctcctgatgctccagatcccgctcttcagggttccttgtagagcaggcacatgcacaactcctattcaagtcacatcgtctcagttggtgtcaaacgagatattcccaccagctgttgtgaaggccatgctctaccctggagctatcgtgagcagcctaactaaaagcaaggcatttccgagttggagtgacctgtttgacatgtacaacctgacagaagccaaaaatgcttctgctgtagttgatctccagcgtctagagatacttgcgggaagctacttctgtgttgctggagggcttcttggcatcataaatcctgggaggatgactttgtttggtactcttttggttatctggggtctcgtgaaggaagcactatttgggaagccagtgaacagcgatccgactgaatcaacttatgtctacccaaccattttgattgcacttatatgtgctttcatgtcaataacttacaatgtaaagaagacagcagcaagtagtcctgtttctctcgcgaagccactgaaaagttctgccaagtcaaaactgaagtagaccctgttacaactttaatccttgtaactcattccaaatatttatttatccttgtaactttcaatcctatagcattcagttttttccttgtatttacagttcacaaaggccacctctgtaatgtttaccaaaaacagctagaccttgtttccccccaataattctgatgtttaaaaaaaagatccagtgccgaaggcttctacatgagtggagtctag

SEQ ID NO: 21941 - DNA, 1012 bp, Zea mays
ttgggaccctcggggccggccgggacgacctggatttggtaaagaaagcacaaagcaggaggaagccggcggtgtaggcgacccatggctccacagacgaggagagagaggttggcgggggaggcgcggccgagctcgtcggggctaacaccggcgaagccgggggcggtcgaggtgcagcgccgacgggcgggcagcggttggacgagccgtcggatctccatctacgcctcccgagtctacttcctcctcatcatgctccagatcccgctcttcagggtcccttgtagagctggcacatgcacaactcctattcaagtaacatcatctcagttggtctcaaatgatatattcccagcagctgttgtgaaggccatgctctaccctggagctaccgtgagcagcctaactaaaagcaagacatttccgagttggaatgacctgtttgacatgtacaacctgacagaagcaaaaaatgcttctgcagtagttgatctccagcgtctagagatacttgccggaagctacttctgtgttgctggagcgctcattggcatcataaatcctgggaggatgactttgtttggtacccttttgattatctgggtctggggtatggtgaaagaagcactatttgggaagccagtgaacagtgatctgactcaatcaacttatgtctacccaaccattttgattgcacttatctgtgcattcatgtcgataacttacaatgtaaagaagacagcaagaagtagtactcctgtttctatcgctaagccactgataagttctgccaagtcaaaactgaagtagacttacaagtttaatccttgtaactcttttgagatatttatttatgtgccaaaaaaaacaggtttgaggatgacctggggatgcttttggggggtgtcgggccttcaatactgtaacattcagttttctttattgtattaacaattcgcaaggtcacaccgtctgtaatgtttaccaaaaaaaatcttggttttctccc

SEQ ID NO: 21942 - DNA, 1568 bp, Zea mays
gccggccgggccgggaccgggccgggaataattgaggttccactctgtctgttccctccttcctgctgttacaatgattgttactattagccagtctgagtaatacatgtgcatttggtattgtccttgtttactagtagctaatagctgttaagatctaaaaccagccatccgtcttctgggaagaagaggtatagtctcccgatcctagttctgcctctccagttgcatccttcgtcactcactctccctacatcctgtcacgagactggtgttcagacctgagagacctttactcccatggttcagatgtctttgcagaggagcatagccgtatatcctcgttgctccttatctgattcgttccatcgtgtgggtggttcacgaagaagatgggcctcttgtaggtcccagtcatcacgttttgcttataatgcaagaccatccccaattgttctcaagaccgaccatgcaattgatccccctgaaccaaaggatttggatgcaagttcctcagcttcaagaagtggaccttacattgggacttgccatccatcaggcgcagtcggagtgatgggtgcgtcttcctcttcctgcctcagatttttagagaaatttgtgagttggagcactggaggtggagaagaggcacctccgttcatcatctgcaatgacccgcttgtcaagaaagagctgttgccatctggaacccaatccacttctggctgcagtgccagtattgctcttgggaagttaaggcagaagaggctcttcttggagcaatctggagcatgctgtattgttatgccatgccagttcttacatgcctggcatgatgagatttcgcagggttgctcggttccgttcatccatgttggtgattgcgttgtgaaggaactcaaagctgctaacttgaaacctgttgagtatggaagtaatgtccgtgtgggagttctcttcactgacaataaattggctacaaactgttacctagacaagttggagagccagggttttgaggtgctatgtccagataaggcttccatggagcgtacagtgttaccatcagtggctgcattcgggaagggggacatggaaggtgcgagaaacctgttgcgagtgtcgctgcaggttcttcttgtgagagctgtcaattcgataatccttgcgtccgatgaccttgtaggcattttgcctgatgatgaccctcttctcaagaaatgtatagacccactggatgccctggtccgagaggccatcgcatgcgcccgagcaccacggccatgattcgccgccctagctagattactctgtttacaccttggctgctctgctgatgagcacatatgtaaataagttttacacaaggtagaaaaagacggatattggttgaacacattacgcattttcatctatgttagcccatgtaatgttcggatactagttacaaaaatactaaatatagtctaattacaacaaaaaaaaaaaaaaaaagaactaaacgacaagataagccttttaaacataattaggcaaatatttggatcatgtgttagggcttaaaattt

SEQ ID NO: 21943 - DNA, 1266 bp, Zea mays
aagaaaaaaaagatggtgtgtccccaaacaggacctttgtttaagccgcgccttggctcgtcacgactaacgaccatgatttggtaaagaaagcacaaagcaggaggaagccggcggtgtaggcgacccatggctccacagacgaggagagagaggttggcgggggaggcgcggccgagctcgtcggggctaacaccggcgaagccgggggcggtcgaggtgcagcgccgacgggcgggcagcggttggacgagccgtcggatctccatctacgcctcccgagtctacttcctcctcatcatgctccagatcccgctcttcagggtcccttgtagagctggcacatgcacaactcctattcaagtaacatcatctcagttggtctcaaatgatatattcccagcagctgttgtgaaggccatgctctaccctggagctaccgtgagcagcctaactaaaagcaagacatttccgagttggaatgacctgtttgacatgtacaacctgacagaagcaaaaaatgcttctgcagtagttgatctccagcgtctagagatacttgccggaagctacttctgtgttgctggagcgctcattggcatcataaatcctgggaggatgactttgtttggtacccttttgattatctggggtatggtgaaagaagcactatttgggaagccagtgaacagtgatctgactcaatcaactcatgtctacccaaccattttgattgcacttatctgtgcattcatgtcaataacttacaacgtaaagaagacagcaagaagtagtactcctgtttctatcgctaagccactgataagttctgccaagtcaaaactgaagtagacttacaagtttaatccttgtaactcttttgagatatttatttatgtgcaaaaaaacaggtttgaggatgacctgatgatgcttttggtgtatatctgactcttcaatactgtaacattcagttttctttattgtattaacaattcgcaaggtcacaccgtctgtaatgtttacaaaaaaaaacagataaatcttggttttctcccaaaaaaaaaaaaaaaaaggcaggtttaattcagtttcatattgtatccaataagattgtagtctattttaccacaaggatggaaagttgtaattcctgacaggttctgggtcagttgttattcttctgtgtttggattttcatttggggggtcatggtatttggagttattaaagaaattgtccaaaaaaaaaaaaaaaaaagcggcc

SEQ ID NO: 21944 - DNA, 1304 bp, Zea mays
  misc_feature (1247)..(1247): n is a, c, g, or t
  misc_feature (1250)..(1250): n is a, c, g, or t
caagaggaagccggcggtgtaggcgacccatggttccacagacgaggagagagaggttggcgggggaggagcgctcaagctcgtcggtggtaacaccggctaagccgctggcggtcataggtgcagagccgacggacgctcagtgattagtaccgaccgtctggatctccatctacgtctcccgagtctactttgtcctcatcatgctccagatccccctcgccggccgcccttgtagagctggcacatgcactactcctattcaagtaacatcatctcagttggtctcaaatgatatattcccagcagctgttgtgaaggccatgctctaccctggagctaccgtgagcagcctaactaaaagcaagacatttccgagttggaatgacctgtttgacatgtacaacctgacagaagcaaaaaatgcttctgcagtagttgatctccagcgtctagagatacttgccggaagctacttctgtgttgctggagcgctcattggcatcataaatcctgggaggatgactttgtttggtacccttttgattatctgggtctggggtatggtgaaagaagcactatttgggaagccagtgaacagtgatctgactcaatcaacttatgtctacccaaccattttgattgcacttatctgtgcattcatgtcgataacttacaatgtaaagaagacagcaagaagtagtactcctgtttctatcgctaagccactgataagttctgccaagtcaaaactgaagtagacttacaagtttaatccttgtaactcttttgagatatttatttatgtgcaaaaaaaaacaggtttgaggatgacctgaggatgcttttggtgtatatctgactttcaatactgtaacattcagttttctttattgtattaacaattcgcaaggtcacaccgtctgtaatgtttaccaaaaaaaatcttggttttctcccaatgtttctgctatctaggcaggtttaattcagtttcataatattgtatccaataagattgtagtctattttaccaatgtttcttctgtgtttggattttcatttgggggtcatggtatttagagttattaaagaaattgttcagaactgacagctgataaacatcaatcacacagattgaaatgagcaaaggacacatgcagtgatttcatcttttttccaagttgacaagggtggtccatcattgcagcaatattgctgtcctatgctcttagcatttgtgctgntgnattgtgcaacaacggcacggctgaatttgcaagtggctcttattgccctgcctc

SEQ ID NO: 21945 - DNA, 1286 bp, Zea mays
ttttttttttttttttaacaaaaccgtcattttgttttgttgtcttaaatttgtggcctctatcgactactgtaaaacaccactagctcacaataattattattagttagtatttgagtgaaagcgacacatctaaacggaaactcaccatgcagagatccacgttggggaaccgtcgtcggaaactctcggctgccgtcctcggcagcggcgcgccgccacataccacgcgctccagcgcctctaggtggcaccgctccttgaccatggccaccaccaccggtggcgacgccgtcatctcactgacggcccacctccccgccgcctcgatcacccccttcacgtcgcgccgcgccaccgcgtcggtcagcatcaccgtcgtgtgccccagcgccacccccttcagcgtgtagtagaaccccatcgagtggaacatgggcgcgcccagcagcgacctctcgcgaccgcgcctcggtttccccagcagagcatgggatcccgccgccatcgcgatgaagctccggtgcggcagcgccgcggccttcaccctcccggttgtccccgacgagtactggatcgccgccgtatccgactgccgcaccaccgccgtgtccgccgcaagtccctcctccccacggccgtcgctctgcttctgcagaaaggagcggaagtggtccgaatcgaggagcacggcggggaggccagccggcagctttgcggcggtcgacgacacggcgaaggcgacggacgcgcctgacagtgccacgaggcgcgcgacctcgtccgcggtcagcgcagggtttaccggcgacaccacggcgccgaatgagagcagcgcgaagtagagcaccggcacgtccagccgtgtcggagcgaggacgaacgcgacgtcgccgcggccgagccggaccacggagcgcagcgcccccgcgagcgcgcgtacctgggacaggaacgccgggaacgacacggcctcgccggtggcggcgtcgaggagagccgggtgcgcgggggtcggggacgacgccaggagcgagaacgcaaactccggaaacgagagcggtgagtccgtcggcggcagcggcaccggcgggcgcaggctgcggaacgtcctggtcacctcgcagaagccgctgcggccatctacacctccgggagcagcgccgtcggcattggccgcaggcgcggaagtggccatttctccttagcacccagtggtgactggactggttggtgattttgtcgtgtcccccccgcccgtaccctcggcgcggccgcatctggca

SEQ ID NO: 21946 - DNA, 3102 bp, Zea mays
gtcgacctgcagcgaacttcagtttgaagtgctgcttccaaaaaaaaagcagccgagatgttataacgtatttcattacaatattgccatctagtcagggtcaacgactactgtcctagccatagcaatccaataaatctttgattgcatgggatcggaagggattgaacgttcagatttctgggaatcaccaacggtttccggctggattgtttgtctaaattataccggctgattgtttgtctaaattatataagatttgatcggctagaaaaattccaggtccattcctagataaaccaatagggtcttaaggcttgtacgtattattcagaacggtttgtctggaactgttctagccggaatgttagttttatttgtattaacattgattagctagaataaatctaggttttaatctcctttatactcacttttgactaacaagagatttgatcctctctaatccacttctaacggaacaactccaaagattcaacattggttgctcggggatcgtgaagtaatggctgtgggattaatggaaaaggcttgcatgattcgcacatatgatagcaaatttcttgtgttttctacatatagagtcactaaagcccgtacctaagggtatgctcttgatcagttttatatgcataagagaatagtcttcaaattagttatattataaatgatgtcaagaaaccagagggctgatattaaatgagttacgctatcctcgatgttctggtgtcttggtgttagttgtgtcgtgttcggtttttggcgtttgggagcaactgcacggttagtatcgtcattgcaaaaaccaccgagccatgcagtgagctctcagccgatgacagctgggccaatgcccatgcccacgcccaccgccgtaaaccagactcctctagcctgactatacatgtagtcttggattatgtgataatagtattgcctaccagtggcagttgctagtatcaaatatacgctactgttaacctgcacacagtttacagctctgtctgtcatccgagcgaaactttctgcagatccgggacttgcatctccttgttccttgtcgagatgcccagggtcataccaacagaaacaagggtctccagtgacctttcgctgtttgccacgagatcagcgtcaaattggatggcgtccttctcgaagacgcatatcactgtactccctccaaaggagaaatacccaaactcatctcctttgcggacgtagtcaccctcttttttcaagaacgtgatgcttcctaccatggttgctccaatcgcaacaaatgctacctttccaaactctgaagttgatatcattgatacaactcttttattctcagtgaatacattgcaatacttgctattcacagcgatgggattcaccgtgtacaggcacccgggaatttccacaaatttctccacagttcctgagactggtacgtgaaacctgtggtaatcctgaggtgcgagccggaaaatgaccaacgatccgttgcttaaagcattcgagtgtgcactggtacctaggagaccctcaattgaaaatttacggcccttgatccaaagccttgtgctctcatcaacggaactgaaagccattaatcggctatcagcagcacaggtagcaatactgttttgatcaccatgtgcaattggtctagcaccaggcttcagtcctcttatgaaaaactcgttaaaagtcttaaaactttcaacagggtccttgatctcatccatattaatttgatccttaaataactcaaggaacttgggaatatcttttgcagattccagcgagttcatcttttttccttgcttctcagataggttcttcaagaggtctttaacacctgtattgataagagtgagtcctacttttgattggtataaagccctcatggacaatacaatttttccgtcaataacttcttcgactatcctctttgttcgccggtcgaaaaccagaatatgtgaagctgtagagccagagtgcaaaccaacatcatacgtggagaaatgtgcccattcactgagcttgaacatccacccataagatgcctgtttgtcagttagaaatccaccagtcataatctgattaccagttccctcatcgaagcaaagtgtcatatgtatcatatcatttatgttatcatattttccaagatcttcaccacagacagggcagttacttataagtggttcttcttcttgttgagcagccagtagggctgccagttcatctatgtcaactatgccatcactatttgtatctgcttgacggaaaagctcttcaatctttgcaactgctaatttattaccaaaagctttcatcaagtctgagaattctgataaggaaagagttccatcttcatcatagtccactatagctaagacacggcgggcaaagctttgttctgtttcaacagggtcttcaatgtgacaggagatggatatgctgcccacggtagtattgggtgacgatgggtccaacagacgaaggtcctcagagtgttcctccaagtccttagtaagcatttcaaagagattaacctcgcagtaaccaaccaaagtgttcttcgaaaatcggttcgtctcaaaaacagagatacgtgcaatatgaggtccattcgtctccactataaccttcttctccgagtcccacacaggcctgtgcgtgttgtcggacgtctcggtgcggtacgtgcggtcgccgagagagaggcacgcgaagaacttgtccttgaactgcatatccgccttggctatccggacgcgtgcgatgccggcgaactcgtcggcggcgagggccttggaggagaccgagtcgtcgccggcgccgcggcgcaggcggttgcgcaggcggcggcggaaccgcgcgaagcgcgagggcagcgcctcgccggcgccggcgcaggcagtgggccgcgacgccgagtggcccatccggacaggttggtggggactggggacgaagacggacgggacggcgcggcgcggcgcgccttttgcgggacggtggtgggcgcggcgtcagacagacaggcagacagacgccttggcaggggtcccggccggcctcgag

SEQ ID NO: 21947 - DNA, 5660 bp, Zea mays
  misc_feature (2435)..(2435): n is a, c, g, or t
tttttttttttttttttttccagaaacatccatacgttgcaggtcaatatacttgtaatcctattaacatttctatatacaccaggacaacaatgtatcagcaaaagctttccagcctacaaattgctagggctaggaagtgagcataaaatgatcccaaaaagctgctgtgttttgcgagagggaggtaggggcgagggaataatacaggatttgagcgatctcttgcattatgcgacagcactaatatctgttggagatactctgcttgtcccggtccgctgtaggagcgtttcccctcgcctgcccttcgcgattcttgttgagccgggctactctgtactcctggcaataatgctgttgctcgctcagcaacctccagcttctgctcccagaatcactactgccgttaacagaaccagactccacgaccatgtcgccctcaagaatgcgaagaacatgggacatgcgaggccttgaatgtgggtcacgtcttatacacaggtttgccgcgtgcagcatgcagtgcacctcgttttcggagtagcgcgcgcccagtcgtgggtctatgagctcatcaattgcatactcctccaagaatggccgtgcccattcagttagcaactgctgaccctttggtcggttgatgtcaacagccttccgcccagtcacaagctccactaacacaaccccaaaagagtacacatcagccttctctgttatttgcccactctgcgcatattcaggtgccagataaccaaatgtgccaataactcttgtttcaacacccatgtctccatcaggttgccatcgtgccaggccgaaatctccaaccagtggctcgaaatcatgtgtgacaaggatgttgtttggtctcatgtcgcgatggattatgcagccaaccctacattcctcgtggaggtaccgcagcccacgagcagcaccaactgcaatcttatgccgtgcagtccactccaatgtttctctattacgaccatagagatgtgagtccaaagatctattgcagatgtactcgtaaaccaataaacgccttctgtcctcaacacaaaaaccaatcagcattacaacattccgatgttgcgcacaactaagaacttccacctctgagcagaattcaacatcaccctgagaactagcaagcttgtgttgcttaacagcgatagcctgcccatcaggaaggacaccttgatgaacagaaccaaatccaccttcagctaagaaatttgcttgggagaaaccaccagttgcaagctccagttcagcataactaaaccaccgaggtggctttccgaaaacaggtgccttgtgctgacatattgaacaaagtggaggtggtccaggaggtgcattccttgccaatgagacagcatccctgacatctccgcggaagtttaagtctgacctgcttctcatagcactaatttcattcaggagatccagcttggaaatcttttccaacaaaacatctgcagttgcagtacgagttttccgtggaacttttccaagcgaccttgaggatgctgatccctgtagaatatcagacatccatggctgaaaagagaaatttgctggagggctcaatgtttcactgtccgaatcagaaatattgacatctgaatgctgaattttatcctttgttgctagtacctctttcttcagagaaccatttatttcagaagcagaaaatggagatgccccagggtctgaacttgagacagaggaagttcccgcttcagtacttctgaaaggtgtatccaggtctgggctgctatttggggttacagcaggtcctcgaattgaacttcgtgcctccttaacatcagttgcagttttaccactagaacaatctaacacaggtggaactgcacatgttgctttagactctttatcaggagatcccacaagattaagccgaaggactttaggctgagaacgcttcataacaacaatgttgcactgaagctcctccacacaacgcttctcctcgtgcttcaaatccctaaagcagcagcaacatacaatttattaagcaaaaataacaatgaaagaatgtaggctgtattcaaaaaaaactactgtttcaggagttgagagttgaccattacttgtctagcacaacccagcttgcttgtgcttgcttacactcagcagcaacaacaccagaaggagagccggaaacaagcttatacattacatttatctacagaagcacagataaattaagcacacaagtatatgataattttaataaacatgtaaacgagcattagcaccaggtcaaaccatgtcaatatcatacacatccaatttcttcaacatttgagaacacaactctgataaatcacatttctgatccaccatagacttatggccacttgcacagtctccggcaaacagtggaaaaccccagaatntttctgcctgaaatggtgaagcgtgcacatatttttcaggcaactactggaaaaccggagagaaacattgacagaattacgtgatcattgtaactaaagtggatatgattagtagtacaagcaaacgtgcacatgagcactcattgatgcccagaagcaaacaggaaagccaaaagcggaaacaataccagagctctgtgccgggatgacgacgaggagtatgatgcttccgccgggctgcacgacatgcgtgagcgcccagatgacggctgtcttggagatctccctcgtggctgcccttaccgcgaccaccaccttctctgccttcacggtcatggaggccgctcccttgccagccacgggcttccccttcctctgcagcagcagctgctgctgggaagagcccaccatcatcttcttcctctagacaaccagcgatgcctacaaatccagaagctctaagccagaaaacccaactgccaaagcaaacaactcaacaacctaagacccaagaagaaacagccaaagcaaactagaattgatgcccgcctagtacaaacaacacagcaaccgcgctctcatggcaacagggaggggagacgagtgagcaagcgagcgagtaccgtaccactggtagttgccactagagttggacgccgaacctgcttggcaggcggagttgaaccaaaaaggcgagcaacacgacaggtaaagatgattgagttagaaaaggaggcagccttttccaccagttcaagtgttggcctaggtcccgcccatcgcagcctttattggtggccgcagatgggagcgggcaccaccgctgcggtcgccggcactgtagacgggaaagatgaccccggaccctcggcttcggctggtggtcagattgcacagtgcagcctcgtcctccgcctacccacagtattccggggcacgccacaggaatcgccgtcacaaattattcgagccggacgtgccctcgcagatctcgccgcgcttcgcgcctcagaattggcctctccatgtgggaggaatcaaagccggaatcgaaatttcttctctcccgacaaggaaatccccagcccccccacccaaaaaaaaatgcaacgctggatttgactcgcatttcgttccataaacaaacgaatgatataccaactgcaaaaacaggggagacaaaaccgttccgatttctgcagctcccatctgagcggcgccgaattcacaccccgccctcaaacgaaggcggaaccggaaaaccagagtcaccgaagggaaagagacgcaccaggggggcgcgacggcgacgaacgagctccgcgcctccgccgccgacggcagcgcaccctgtcctcctccttgccgagcgacgcggcgcgggcaaaccctagccctcactgagaacgcgtggaagccgggacagaggcgttggaagaagtggccattaaagcggtgaatgcgccgaagctattaaagagctccattgctccgcgcgaacctctggctccctcagctactacttcccacttcctgacttccacgaccttcaaccgcagccccgatcgccttcgaccctttcaaccgaagaattaccctcttcgcccttccgtattttcaaatattactagctatgccactccctccctgaatgggaaaacgcatttaaaaaccggctgacggggcagagagtaactgccgtcggtttgcaatctaacggccaatgaagccatagagtaaatgctgcccagggtgccctcgtgggccgagcaggctgtccttagccagggaccccctggcaggatcagagaggagtcgtggcgggggtgcggtccggcgcgcggaggcgtcaggggcgccctgtgtgtgtccagtggacagtgaaatggtccccgtggacgtggtgtaccaagtgcttgctgcttgagtttgttgcagccgctgccaacgctggatcccagggttttgatctggtctctgttgccacttgccattgattctgggttcacccagtgctgcttgccaaaagaatttaactcaatttttacatgctttaagagacacccgctagggtctgtccttttatttaacaccactgtacaacgattatatgaaaacaaacattacacatattaggtaactaggtaaatacccgtacgttgcaacggggtaaaaatagtacaactataacatatgtatggacatatgttatgcagaaaacaagcaaatcactatgataaactcataatgacttgtcaccttgttcgaagggaaaaaaggtgctccttagtcttacagctttaagaagagaaccatacatatgtcaccgcattactccaatctccaataatgaaacgggtgtaggattatgttgtctccgtctgggaaagacatgtgcaaagattaaaaacttcagttcatcactaacaaaaagcataaaagtgattaagaacactaccatcatagaactcttgatttttaggatcactgaggacctcataagcctgagctagctcctagaactgaaacaaattcatgagttcttagtttttatcacaatcagaaaatcaacagccctaaccaaccatttatacagccttacaactaaacattgccatattcatgcaaattaggcaaaatgacctatatatacatcactgttggttctgccaagcaagatcaaaagcaccatgatagactgtggaggtggcggtgcgggcgagcttggatgtatatatcagcctatgaaccaagtaacagtagcagcagagtttcaatgattataattctattcttggatcgtagaattgttcagtatctttctcattgctcgctagtgccgactgggtataatgtatatggaaatggagatatgaaacggaaatatgaaacattgctaactaatactatcttcatagctggtggaagaaaactttttccccctgagtgtaattaattggcgagagaaactaatgcagtgtcctgttttgtttcaccttcttgtagttgtagggcttggcagagaaacactgggggcaccttgaagagatcctcgtcgctgtccttctctgccggtggcacaatgatgaagaaggtccctgcttgcaagtattgggtgacgtggcatgtcatcccgcaggttccagtcgccgaacatcgggatccggtgccacttgcagtcatcttgcgcctgtcagaaaaaaagaaacgaaacagagtttactc

SEQ ID NO: 21948 - DNA, 2677 bp, Zea mays
tttttttttttttttttgtgtttttttttttttttttttacctgaatcaacgccgttttccaacttgtttttttttataggaaattacccatttctactatacaccagggcaatgtatcagcaaaagctttcggcctacaaattgctacgaagtgaagacaaaagagcaagccaaaaaaaattgagaccgggaggtagggcgaaggaataatacaggactaaacaatctcagctgcactgcattatgagacggcactaatatctgttggagatactctgcttgtctcggtcccaagaggccctcaaggcactgtaggagcgtttcccctcgcctgccctttgcgactcttgttgagccgggctactgtactcctggcaatgttgctgttcgttcagcatcctccagcttctgctcccagaatcactactgccagtaacagaaccaccagattccacgaccatgtcaccctcaagaatgcgaagaacatgggacatgcgaggccttgaatgtgggtcgcgtcttatgcacaagtttgccgcgtgcagcatgcagtacacctcattttcagagtagcgctctccgagtcgtgggtctatgagctcgtcaattgcatactcctccaagaatgggcgtgcccattcagttagtaactgctgaccctttggtcggttaatgtcaacagccttccgcccagtgacaagttccactaacacaaccccgaaagagtatacatcagccttctctgttatttgcccactctgtgcatattcaggagccagatagccgaatgtgccgataactcttgtttcaacgcccatgtctccatcaggttgccatcgcgccaggccgaaatctccaaccagtggttcgaaatcatgtgtgacaaggatgttgtttggtctcatgtcacgatggattatgcagccaaccctacattcctcgtgaaggtaccgcagcccacgagcagcaccaactgcaatcttttgtcgtgcagtccactccaatgtttctcgattatgaccatagagatgtgaatccaaagatctattgcagatgtactcgtaaaccaataaacgccttctgtcctcaacgcaaaaacctatcagcattacaacatttcgatgttgtgcacaactaagaacttccacctctgagcagaactcaacatcaccctgggaactagcaagcttgtgttgcttaacagcaatagcctggccatcaggaaggacacctcgatgaacagacccaaatccaccttcagctaagaagtttgcttgtgagaaaccaccagttgcaagttccagttcagcataactaaaccagcgaggaggctttccaaaaacaggtgccttgtgctgacatattgaacaaagcggaggtggtccaggaggtgcattccttgccaacaaaacaacatccctgacatctcctcggaagtttaagtctgacctgcttctcatagcattaatttcattcaggagatccagcttggaaaacttttccaacaaaacatctgcagtgcgagtttttcgtggaacttttccaagtgatcttgacgatgctgatccctgtagaatatcagacatccatggctgaagtgagaaatttgctggagggctcaatgtttcactgtctgaatcagaaatattagcatctgaatgctgaattttatcctttgtttgttgcacctctttcttcagagaaccatttgtttcagaagcagaaaacggagatgtcccagggtctgaactcgagacagaggaagttcccgcttcagtacttccgaaaggtgtctccaggtctgggctgctatttggggttacaacaggtcctcgaattgaactccgtgcctccttaacatcagttgcaattttactggtagaaccatctagcacaggtggaactacacatgttgctttagactctttatcaggagatcccacaagattaagtcgaaggactttaggctgagatcgcttcataacaacaatgttgcactgaagctcctccacacaacgcttctcctcatgcttcaaatccttgtctagcacaacccagcttgcctgtgcttgcttgcactcagcagctacaacaccagaaggagagccggaaacaagcttatacctcacatttatcttgtctatgtcatacacatcaattttcttcaacatttgagaacacaactctgataaatcacatttctgatccaacatagacttatggccacttgcacagtctccagcgaacagcggaaagccccagaactttctgccagagctgtgtgccgggatgacgacaagaagtatgatgcttccgcctggctgcacgacatgcgtgagcgcccagatgatggccgtcttggagatctccctcgtggctgccctcaccgcgaccaccaccttctctgccgccacagtggcggcggcggcggcggcgcccttgtcagccacggacttccccttcctctgcagcagctggtggcgggaagagcccaccatcatcttcttcttcaagacaactagtaatgcctacaaatccagaagctctaagccagaagcccaattgcggaagcaaataactcaacaaccaaagacccaagacccatgaccatgaagcagcaagcgaaagcaagtataaagcaagtggaagtgatgctcgcctagtacaaacaacagt

SEQ ID NO: 21949 - DNA, 3792 bp, Zea mays
ccacaaacactttcctttgagcattacatatctttttgaactaatttagttgtccattactattttatttaatattttgtatgccgtcgcaacgcacgggcacctacctaatgactttagaatatgtttagtccctagaaccaaacatgtagggactaaagtttagtcctaggactaaaatttagtcctaggactaattgaaaccaaacatggcatcagtagtacaaaaaatcgttggtactatgatcagcggcctcatccaatagaggagacttggtcagtcctacttctacggttctaccttcttgcattgcgttgcgtcgtcttatcagttatcacagccacagcagtagcacatccccaccacgggcgaggagccggggacgtacgggtggaccacggtccggccagttgtggctttgcgagcacagtgtcaacagacagccctggtatggtaaaccctgctcctccgtgaaccgggaaaacgatgattgcccttgcttgcctgcctgcctgcgccaccgtgaacggaccaccatgccgcagcacagtggcatcttgctcgcagtcgcagccttgccagtcgccagccacagtagctggccggagaactccacgagttgctagttgctacaagccggcgtacgtacggtggcccccgggccattgtacgcacgcacaggaacgcatgcaatgatgagcgctgctctggcagccgctgacatgcatcaggacgtgtccacgcgacgcggacgccgggctggacgtgtcgcgcgagggcttgcggcggggcgagcgctctagcagaaacagccggccggagcagcagccgtcgccgtcgccgtcccgtcgtccatcgggctctcggaccgggcccaacgcaagcgccagcatcttctcgccgtttgcagcagcaggtgcacagacagaggccctctgcctgggcctgcctgccgcctgtcagccagacgcgcttcaggcctgctgtttttattacagcgcggaacttgggtagagcgccatgcctgaaaggattgcagtgcaccgtttcagggggcacagcacactatggaattggatggtagtaataaaccacatgtggcattattgcatgattatattataccagctacgtttgcctgtagcgcaacgaatgcaaacaccacgactgccaagaacagcgtggagatgccaccaggatgtctgtactacttttccagaaacatccatacgttgcaggtcaatatacttgtaatcctattaacatttctatatacaccaggacaaccatgtatcagcaaaagcttttccagcctacaaattgctagggctaggaagtgagcataaaatgatcccaaaaagaaataaagaaatgcgacagggaggtaggggcgagggaataatacaggatttgagcgatctcttgcattatgcgacagcactaatatctgttggagatactctgcttgtcccggtccgctgtaggagcgtttcccctcgcctgcccttcgcgattcttgttgagccgggctactctgtactcctggcaataatgctgttgctcgctcagcaacctccagcttctgctcccagaatcactactgccgttaacagaaccagactccacgaccatgtcgccctcaagaatgcgaagaacatgggacatgcgaggccttgaatgtgggtcgcgtcttatacacaggtttgccgcgtgcagcatgcagtggacctcattttcggagtagcgcgcgcccagtcgtgggtctatgagctcatcaattgcatactcctccaagaatggccgtgcccattcagttagcaactgctgaccctttggtcggttgatgtcaacagccttccgcccagtcacaagctccactaacacaaccccaaaagagtacacatcagccttctctgttatttgcccactctgcgcatattcaggtgccagataaccaaatgtgccaataactcttgtttcaacacccatgtctccatcaggttgccatcgtgccaggccgaaatctccaaccagtggctcgaaatcatgtgtgacaaggatgttgtttggtctcatgtcgcgatggattatgcagccaaccctacattcctcgtggaggtaccgcagcccacgagcagcaccaactgcaatcttatgccgtgcagtccactccaatgtttctctattacgaccatagagatgtgagtccaaagatctattgcagatgtactcgtaaaccaataaacgccttctgtcctcaacacaaaaaccaatcagcattacaacatttcgatgttgtgcacaactaagaacttccacctctgagcagaattcaacatcaccctgagaactagcaagcttgtgttgcttaacagcgatagcctgcccatcaggaaggacaccttgatgaacagaaccaaatccaccttcagctaagaaatttgcttgggagaaaccaccagttgcaagctccagttcagcataactaaaccaccgaggtggctttccgaaaacaggtgccttgtgctgacatattgaacaaagtggaggtggtccaggaggtgcattccttgccaatgagacagcatccctgacatctccgcggaagtttaagtctgacctgcttctcatagcactaatttcattcaggagatccagcttggaaatcttttccaacaaaacatctgcagttgcaggtacgagttttccgtggaacttttccaagcgatcttgaggatgctgatccctgtagaatatcagacatccatggctgaaaagagaaatttgctggagggctcaatgtttcactgtccgaatcagaaatattgacatctgaatgctgaattttatcctttgttgctagtacctctttcttcagagaaccatttatttcagaagcagaaaatggagatgccccagggtctgaacttgagacagaggaagttcccgcttcagtacttctgaaaggtgtatccaggtctgggctgctatttggggttacagcaggtcctcgaattgaacttcgtgcctccttaacatcagttgcagttttaccactagaacaatctaacacaggtggaactgcacatgttgctttagactctttatcagcacatcccacaagattaagtcgaaggactttaggctgagaacgcttcataacaacaatgttgcactgaagctcctccacacaacgcttctcctcgtgcttcaaatccttgtctagcacaacccagcttgcttgtgcttgcttacactcagcagcaacaacaccagaaggagagccggaaacaagcttatacattacatttatctacagaagcacagataaattaagcacacaagtatatgataattttaataaacatgtaaacgagcattagcaccaggtcaaaccatgtcaatatcatacacatccaatttcttcaacatttgagaacacaactctgataaatcacatttctgatccaccatagacttatggccacttgcacagtctccggcaaacagtggaaaaccccagaattttctgccagagctctgtgccgggatgacgacgaggagtatgatgcttccgccgggctgcacgacatgcgtgagcgcccagatgacggctgtcttggagatctccctcgtggctgcccttaccgcgaccaccaccttctctgccttcacggtcatggaggccgctcccttgccagccacgggcttccccttcctctgcagcagcagctgctgctgggaagagcccaccatcatcttcttcctctagacaaccagcgatgccaggg

SEQ ID NO: 21950 - DNA, 2681 bp, Zea mays
agctgtcgttagctaaactcaaaagtttaattgcctatgatgaaaatattcatagaatagtattttatcccacccgtatgtgccgataactcttgtttcaacgcccatgtctccatcgggttgccatcgcgccaggccgaaatctccaacctgtcgggcaatcattatggaacttacaaccataatatgaaattaatacttcaacaggaaccacaaaaaaaatattgaatggctagcagagatcagcagatagataagcatcgctccaaagaaaatctgctttagataaggccatcctatcatgcaaactgtaatagcaaagaatatgatagattgacctccataagaaagactccaaacatcgccataaatgtttaatggcaacaaatagtctaccaccagtgcctgatgattgcatccaatacagaaaccttaacctatatggaaaggttcctaatgccaaagacacgtgcaaatggtaaactttactacaccacaatcagcaaagtacgactataccagtggttcgaaatcatgtgtgacaaggatgttgtctggtctcatgtcacgatggattatgcagccaaccctacattcctcgtgaaggtaccgcagcccacgagcagcaccaactgcaatcttttgtcgtgcagtccactccaatgtttctcgattatgacctgaatgatatttcaaaaaatagcttaacaggacagatatatgtcaacatcactaggctcgcaggacccttggtacaaaaaaagtgaaacagagagagaagaatcaggaatacaaagttgttaagtgcatcaagaacttgaagacagcatgtgccatgaccaaactaatggtttatgtacataaatcctaccgagaaaacggtcttaccatagagatgtgaatccaaagatctattgcagatgtactcgtaaaccaataaacgccttctgtcctcaacgcaaaaacctatcagcattacaacatttcgatgttgtgcacaactaagaacttccacctctgagcagaactcaacatcaccctgggaactagcaagcttgtgttgcttaacagcaatagcctggccatcaggaaggacacctcgatgaacagacccaaatccaccttcagctaagaagtttgcttgtgagaaaccaccagttgcaagttccagttcagcataactaaaccagcgaggaggctttccaaaaacaggtgccttgtgctgacatattgaacaaagcggaggtggtccaggaggtgcattccttgccaacaaaacaacatccctgacatctcctcggaagtttaagtctgacctgcttctcatagcattaatttcattcaggagatccagcttggaaaacttttccaacaaaacatctgcagttgcagtgcggttttttcgtggaacttttccaagtgatcttgacgatgctggtccctgtagaatatcagacatccatggctgaagtgagaaatttgctggagggctcaatgtttcactgtctgaatcagaaatattagcatctgaatgctgaattttatcctttgtttgttgcacctctttcttcagagaaccatttgtttcagaagcagaaaacggagatgtcccagggtctgaactcgagacagaggaagttcccgcttcagtacttccgaaaggtgtctccaggtctgggctgctatttggggttacaacaggtcctcgaattgaactccgtgcctccttaacatcagttgcaattttactggtagaaccatctagcacaggtggaactgcacatgttgctttagactctttatcaggagatcccacaagattaagtcgaaggactttaggctgagatcgcttcataacaacaatgttgcactgaagctcctccacacaacgcttctcctcatgcttcaaatccttgtctagcacaacccaccttgcctgtgcttttaagcaaaaataacaatgaaagaacgtaggatgtattcaagaaactactgatttagcagttgaccatacttgtctagcacaacccagcttgcctgtgcttgcttgcactcagcagctacaacaccagaaggagagccggaaacaagcttatacctcacatttatctgcagaaacagcaataaattaagcacacaagtatacgacaattttattgaagatgtaaacgggcattagccccagctccaaaccttgtctatgtcatacacatcaattttcttcaacatctgagaacacaactctgataaatcacatttctgatccaacatagacttatggccacttgcacagtctccagcgaacagcggaaagccccagaactttctgcctgaaatagagaggcgtgcagatactttcaggcaactactgcaaaaccagagaaacattaacaacactaggcgataaaaaccatggatttggagcacatgagcactcgttgatatcctgatgtaccaaacaggaaagctaaaaccagaaacaataccagagctgtgtgccgggatgacgacaagaagtatgatgcttccgcctggctgcaccacatgcgtgagcgcccagatgatggccgtcttggagatctccctcgtggctgccctcaccgcgaccaccaccttctctgccgccacagtggtggcggcggcggcgcccttgtcagccacggacttccccttcctctgca

SEQ ID NO: 21951 - DNA, 1000 bp, Zea mays
gagattggaacagtagcagtaagttcgaaagcaaatattacatttatttgcaaatatcatccacgaggattacgccggcctcaaggtctaaccaaaacaaggccacgagataatccacgacaaatggtaaagggtgaagaaaaaaaaaaattaccttttgaacttgacagacctactataggatcccactcacaccatcagtaagtacatcaggtatcgataccataatgaacaaaataaacaccgctagggaaaggaaaagaatttccaacacagcgaacttttttttttcttaagagggttaatgcttctgtcgatgaaacgatgctgccggggtgcgattctctacctgggttggccttggaacaacccccaaccgagggagcttcactctttaacctaaaggaacctcaaataataatgtgtacgatttacccccccaaaattaaagaaaaccaatctctgaatatcaccgccttcagctatccatctttgttgagtacctcaatcgcgtcgtgagtctatgttgctagactaccaatctgctggtcaagctgcatctgttcaagcaacgctcctataaccgcggcttggtcgtgtccatccagctgggtgctcaggccagaaccgtcgccattgttcatgccggaaggcattagtggtgagggtccaacggaactaattgattcagccgtagtaacttgcttctccggtggagattccttgaccagtgtatgcacccaagagagatcagggtcgtcaccaccagacctcagctcgaaggacgatgagcgccggagcttacccaattcttcaccatttatgccccaatctggtgtccccgaaggagatccccacttagaccatgatgagcttagaggggagccaagagccgaagctcgcgccgcactaggcccaaggtcacgagagcccggccggccccgtggctcccgctgcttctcccgctggacaagagcagcggctaggtgggagctcattg

SEQ ID NO: 21952 - DNA, 4056 bp, Zea mays
tctgaagaggcgatcgtcccaaccgaactccaccaaccgtctgtgctgacacctcagcatatcacgagatacacaggcgaggatatagtccagatgaatacgaatggcgagactggttcttctgcttcaagttcgaaaacaatattacattattgcaaatatcatccaggaggattacgcaggcctcaaggtctaacaaaaaaaaacaaggccacaagataatccacgacgaatggtaaagggtgaaaccaaaaaaaaattaacttttggaactcgacagaactactataggatcccaagcaacctcttacaccaccagtagtacatcaggtatcgatatcatattgaaataaacactaggggaggaaggaaagaattccgacacggcgaacacgccttcttttttcttaacaggggttaattaacaaaacagagaacttcaatcgatgagaccgatgctgccggggtgcagttctacctgggttggccttggaacaaccccagacgaggaacttcattcttttaacctactgggacctcaataatgcgtatgatttacctccaaaattaaagaaaaaccaatctctgagccaccaccttcagctatccatctttgttgaataccataattgacagggggaaaagaacttggaattcagtagataagaatatagtaccctcacaccttccaggctcgttgcacgcctatgttgctagactaccaatctgctgatcaagctgcatctgttcaagcagtgcccctaaaaccgcggcttggtcacgcccatccagctgggtgttcaggccagaaccttcgccgccgttgttcatgctgggaggcattagtggtgagggtccaacggaattaattgattcggacgtagtaacttgcttctctggcggagattccttgaccagtgtatgcacccaggagagatcagggtcatcgccgccagacctgagctcgaacgacgatgagcggcggagcttacccaattcttcaccatctacgccccaatctggtacccctgaaggagatccccacttagaccatgatgtgcttagaggggagccgagagctgaagctcgtgccgcactgggcccaaggtcacgagaactgaggcttctcatcgtctgctgttgcttctcacgctgggcaagagcagcagctaggtgggagttcatcggggagcctgattcgacacatcgtggagacatccggccaggggagggcatcccaagcgatgcatgcagcagagatgggtgtgaaggtaactgcttgttgtccacagcctttggagagtaaactcctgtgttgattggagaaagcagtgcttgctgctgctgctggaactgattcaggatagcagccttgtgagaaggtgaaaacatagcaccctgatcaccattactatacctcggggatgataccagttcggcagagaagagatcatccaggtttgatggattcagggacttggtccgtgcagagtggttccctgtggatgaaccgagacgggaatagcatagatcattcataagttgggaatcgaagtccggcatcagggagtagtcatcagcaggcatatcccttgcactgagtgacgttcggagcctgcttgactgaaggctgctgccaggaaggtgtaatgttggaacatttggctgctgccagcccaatgaagggggcatcccattgcccgaaggggacattggaggggtaaatggggacatcaccgctgaaaccgatgatggggaaccgggcattaagcccattgctgcagccatctccatagcagctgttgctgaagcccttggggatggcaccgctgatccagtggagacatacaatgggcggagttcatcagttgtgtgggcaaagaaacagacgcggcggttacagcttgtgccatccttgcataggcgtgtccggtattgtgctggatggagccagcactcaaacactccatgagcatattcacacatgtctccgcgacggcacacacccttcctgaaatctgggcatggcacacaactgtagtggtacttgcgggggtctcggcgccgagcattctctcctgggtggacaaaggggcactcagtccagtcatgagagtatgcccgtgagcaagggcggaccttgaacgagtacatgcggaactcatcagaagcatagatgctgttcttgatgtccggaagggatggatccactgggtattccttcttctctgatgtcgcaaccctaggcaagtcagcaaactttgtcatcatcaacacagaagcagacggagaccgtgcatcctctgcagtgggggatgaaacgggtgatgagatcgagttggtggaccttgtcaccacccgaagcatgccgtgctcagacttcgggaatccaagaagatcttgaagggcgaatttagcatcaaacatcttcggtggcacagagatcacatcagccggccgtcgcccggcgccccccgcccggtcggtgtctgcccccgctcctagcagcagctttacggcctcaaccgccgaccgtgacccaccagaggcggcgcagtggagggcagtggtgccatccgtgcccgaacggcggttgacgtcgacagacgagagggacaccagcaggcggagcgcagcaaggctcccgtaggtggcggcgaccatcagcggagtgcggtgctccaggaccttccggcggccgtaccagaggccggcctcgtccgcggcggcaggcggcgcgcgctccagcgcgcgtcgcagcccctccgcgttgtcgtcagcggcgagctccagcaggcccgcgaaggcgtcttccgtgtcgactgtgagatgcctcgccatctcggtgacagcggccgccgtcatcgcattcttcatgggcgtgccggtcgccaccgcgccaacgtcgacgcctgccgtagaggacgcagagatcggcgtgccgtccatcaccggggctcgtcggatcggaagaactgaagcgacgatgataaacagaggaaaccagtcaagaaactagtcaagcaagtcatcactagtgcgagatatggactagaagtgacacgaaatcggaaggaatataaagatagatgctacgaaaatgaaaggaaggaagcccacaccaccaaatcgcgcaagaaaaaaaacacctcgaatcaaccccacaaaaatccaatctttggctagatcaggactcctccaccgagctcacgctctcagccggcagagaaggttagtgaatactactccccggctgctccgtacagtagatcggagtaagaaagtggaaagtctacggaagcccacctgttgagagtcacagcagcgcgtgatgcggcgaaccatctcagcagcgaaccgccccaaagatctccaggaaccccatgcggagcaagcgtcaaaaagaggaagcgcgaaagatcgagagaaaagctgcgaccttgcgccgagtcgtccgggaggaggcaaagatagggctgatctatctatctagttccgatttctggggagaggggaggggagacgaagctgctggggttgagggaggaccggaggagagagaaagagagaggtgcggtaaaaatggggaaagtggggagagaaactgaactctatagccggggaagtgggacggagggagatgtgggcgggcctgtggggtggctttcggtttctattgggctaggggtataggtgtaaccgggctaaaaggccaccacgaggcaatgatatttttgacctgatccaaacacgacacggcacgtcatggcacaaaggcgcaaagtttagcggaccagatccgatcagtcacaacacgatatatgggtcgagctataggccgagcatcgagtctaatggacggcacgacacgacccacttagggcactacccatttaatctgtagtcgtatataaacagttctatacttctataacagttttgtaataatgtaatgagatatttgaagttctataacacttttatggttgttgtcttatctgtaatgacaggctaaagttttatagacggtagttctcaatgttcacaacaatttta

SEQ ID NO: 21953 - DNA, 1395 bp, Zea mays
cattgggtacctcgaggccggccgggggcggcccactcgctctcgctctacctccccgtcgtcacgcgctcgcctgtgcccctagcgtttcgccacctcctgctcccgcaccgcctccggctccgcctcgcctccgccgtctccccatcccgggcgcggcccctcggcctcggcgcccgcccgccccgcccccacgccgcacccctcggctacggagttggtgcagggagaaggccgagtggtggactggaccacagagccatgtcaagttccacaaattcaacagtggccacggagttgtcggtgtctgagaatagcagggaaattgagccgctaccttttgtgaatgacaaacatggaggcgtcatcattgagatgaagactccaatggatcctggagtgttttcagcttacttgaaagcagcgctggcaaaatggagggagcagggaataagaggtgtctggatcaaattacccatcaccctttccaaccttattccaacagttgtagaggaaggtttctggtaccatcatgcagaggaaacttacttgatgcttgcgtactggcttccaaatacaacacatacactaccagtaaacgcaacccaccgtgttggtgttggagcttttataatgaatgacaaaagagaggtcttggttgtacaagaaaagagtggtgtacttcgaggcctaggtgtgtggaaatttccaactggcgtagttgaaccgggggaagatattaacgttggagccataagagaagtaaaagaagagaccgggattgatgcagaatttgttgaagtgctggccttcaggcagagccacaaagctttttttgataaatcagatctatttttcgtgtgcctgctacgaccgctgtcatatgacattacgaagcaagactcggaaatagaagcatgccagtggatgccagtagaggaatttgcagcacaaccatttgtccagaaacatgagcttgtgaagtacatcctcgaagtaggcctggctaaagttgacaagaaatatgcagggttttcgccaatctccataaaatcggcgtttacagacaaattgtccttattttacatgaaccggagggacctggacaaagcctcaggatagagtaatatgtaattaaacacagggaattcaagatagttgaaatttcagttctggtatgtaaaagcaggccaagtcattcatacttgattattttgttcacaaattggaagtttcgggcatccgacacttgtgatttttcgaccatatgtcgtctgctacacatctgtgtttcaaaggagtgttgcaatccaaaagtagagataaaactgttgtgcttatggatttgtatttgtaggtctacagacaataaaacactgttttcctttattatat

SEQ ID NO: 21954 - DNA, 1304 bp, Zea mays
cccacgcgtccgcacgagctcgcgtgtgcccctcgcgctccgccgccaccaccttctactaccataccgctgcgtcgccgcccggaccacgcccgccaccaaggcctctcctccgcctcgtccccatcacgggcgcggcccctcgacctcggtggccggccggctcgacaccgcaccgtgaccctcggctacggaggaagaagacggagtggtggactgggccatagaaccatgtcaagttccataaattcaacagtggccacagaattgttggtggctgagaagagcaggggtattgagccactaccttttattaatgacaaacatggaggtgtcatcattgagatgacgactccgatggatcctggagcgttttcagcttccttgaaagcagctctggtgaaatggagggagcagggaataagaggtgtctggatcaaactgcccatcaccctttccaaccttattccaccagttgtagaggaaggtttctggtaccatcatgcagaggaaacttacttgatgcttgcgtactggcttccaaatacaacacatacgctaccagtaaacgcaacccaccgtgttagtgttggagcttttataatgaatgacaaaagagaggtcttggctgtacaagaaaagagtggtgtacttcgaggactaggtgtgtggaaatttccaactggcgtagtagaaccgggggaagatattaacgttggagccgtccgagaagtaaaagaagagacagggattgatgcagaattcgttgaagtgctggccttcaggcagagccacaaatccttttttgataaatcagatctatttttcgtgtgcctgctacgacccctttcatacgacattacgaagcaagactcggaaatagaggcatgccagtggatgccagtagaggaatttgcagcacaaccatttgtccagaaacatgagcttgtgaagtacatcctcgaagtcggcctggctaaagttgacaaggaatacgcaggcttttcgccaatctccataaaatcggcatttacagacaaattgtccttattttacatgaaccggagggatctggatagggcctcagggtagagtatatatgtaatgacatgggcaattcaggatagttaaattttcactttggtgtgtgaaagcgggctaaatcttgttagacctaatcttgattgtctagtaatttttagagtcaacttcgtgctgataggttctaacctctataatctagccgatttcgtatgtataacctgtctaggcactttctgagtagatcaaagctcacagtttgt

SEQ ID NO: 21955 - DNA, 1591 bp, Zea mays
tccaccgcggtggcggccgcccttttttttttttttttccttttaatcagatcaatgatgatggtgaatcagccagttagtcgctttcacgtacgcacgttgttttcagaagaaacagggcacacacgtcgcccgctcgttcttctgtgttgttccttctgaaacaatgcgtctgaaagagacacatactagttaattaagatgtcataaatgcttctgagttttaagtgtttgacaggctacgcatatgctggttggacgatgattgttgccccggatttcagcaagtcctacagatttgaatcgagccaatccatccaggcaccgcgtgcagtgcaaatgcagtgagtcagtgtatgcaccttcctccctggaacgtccagccgatcttccccatctggcgctcccacagcgggcgcgccatgtagcgcttccagtccacgatcaccctcttgaggtcgaacagcttgttctccagcccgacgcagcaggtcatgtgcacggtggcgatgcggttgaggtccctgcccagctggcagaagccgctgacggtggcggcgtcgatgaaccggatccggacccccagcccgtccgcgagctcccgcttgatctcgttgaacacgaactggtcgtggttctccgggaaccgccgccgcgccgcgtgccagtaggccatggcgcgggcgttccggggcgtcgccttgaagtagatgaagcccgtgtgggggaagttgcccaggtcgtccgggttgccgaagtagaagtcgctcgacgtcgtgatgtccgccgccatcgtgatgtgcaccagcgggttccggaaccacgccacgttccacgtccgtgaagagcaggttgtagccgagctcgaggacgcgctgctgcagcttcagcttgctccacacgaggtccaggtagtccttggtcatgtagctcttggcgccggagaggtcgaggcccgccttctccggcctgagcaggtggcagtgcgggtgcacggcctggcaccgccggaacgcgccgtcgtccatggccaccaccacgacgtgcttcgccaggtgcgacacgttctcgcccacgcggaagctctccaggaacgagtccagcagcgaccccggcgccgcccacgcctcgttcaccgacgtcatgatcaccgtccggtcctccatcgccgctcggcgcagcatccgcgcaaaccccgcatcgtcatcggagccggacgcgcccgcctcgttcgctggaggagctcctactcctccggcgtgttgctctagagcgtcgacgaccaccgtgccgtttgctcgtggagtactagtactgcagcgcacgctgcctgagccagagcgaggaccggcctccagcgcgggccacgcggggctcgcagtcgccgtcaggaagaagaggagcagcacggtggccgaagccgccccgagcaggaagacgaccagcggagacagagacgggctgctgttcttggaggtcgccatgccagccccagccgcgagcgaaagtaatgcccccccggctactcgctctagctagctagtccagagtcccagctggcataccccggccggcctcgaggtacccaatg

SEQ ID NO: 21956 - DNA, 2471 bp, Zea mays
atcggatcggatcagccgagattcacatgctgccatcaccagggtaatgagccagcttagcttacgttgtttagtttaacagtccagactattatttatcagcaggccttgtttcattccttttaattagatcaatgatgatggtgaatcagccagttagtcgctttcacgtacgcacgttgttttcagaagaaacaagggcacacacgtctctcgcacgtactacagtgtagtacgaacagaaacaatgtgtctgaaagagacacatactagttaattaagatgtcataaatgcttctgagttttaagtgtttgacaggctacgcatatgctggggggccgcggggccggcccccggatttcagcaagtcctacagatttgaatcgagccaatccatccaggcaccgcgtgcagtgcaaatgcagtgagtcagtgtatgcaccttcctccctggaacgtccagccgatcttccccatctggcgctcccacagcgggcgcgccatgtagcgcttccagtccacgatcaccctcttgaggtcgaacagcttgttctccagcccgacgcagcaggtcatgtgcacggtggcgatgcggttgaggtccctgcccagctggcagaagccgctgacggtggcggcgtcgatgaaccggatccggacccccagcccgtccgcgagctcccgcttgatctcgttgaacacgaactggtcgtggttctccgggaaccgccgccgcgccgcgtgccagtaggccatggcgcgggcgttccggggcgtcgccttgaagtagatgaagcccgtgttggggaagttgcccaggtcgtccgggttgccgaagtagaagtcgctcgacgtcgtgatgtccgccgccatcgtgatgtgcaccagcgggttccggaaccacgccacgtccacgtcctgcgcgcgccacgccacgccagtcgtcaaacggaacgccgcctcgtaactcgtgaataaaccagtgaaaactcaacgggagcagcgactagcgagcgaggcacgtgccgtgaagagcaggttgtagccgagctcgaggacgcgctgctgcagcttcagcttgctccacacgaggtccaggtagtccttggtcatgtagctcttggcgccggagaggtcgaggcccgccttctccggcctgagcaggtggcagtgcgggtgcacggcctggcaccgccggaacgcgccgtcgtccatggccaccaccacgacgtgcttcgcgaagtgcgacacgttctcgcccacctggaagctctccaggaacgagtccagcagcgaccccggcgccgcccacgcctcgttcaccgacgtcatgatcaccgtccggtcctccatcgccgctcggcgcagcatccgcgcaaaccccgcatcgtcatcatcggagccggacgcgcccgcctgaaagagaacaaaaaaacacggcatcagctcatcgccggtggccaagaacaaggaagcagctagcgcattacctcgttcgctggaggagctcctactccgccggcgtgttgctctagagcgtcgacgaccaccgtgccgtttgctcgtggagtactagtactgcagcgcacgctgcctgagccagagcgaggaccggcctccagcgcgttccacgcggggctcgccgtcgccgtcaggaagaagaggagcagcacggtggccgaagccgccccgaggaggaagacgaccagcggagacagagacgggctgctgttcttggaggtcgccatgccagccagccgcgagcgaaagtaatgctgctagtgctactcgtactagctagctagtccagagtcccagctagctggcatatttccgaaattgacctctcttggagattgctagtcggacgctagacgtgccagtttgtgctgcccaactcgactctcgcgtttcattcaattcaactcttttattcagtgattctacctgtctgcgctgccgccgaagcttctgcaacggagactattcaggcttcaaagtgcagggttgtcagagatttatctatgcaaaggatccatacggaagaacagagaattagagatctgtcagcatcaagagagatgcttgacgattttaacgtgcaaccactcgaattgaagcgcggtacacgtgccaatgtgccataggtcaggcaagatgcccactccgaacaagaaacctcagtcgtctactcgtcttccgtccgttgtcagctttctgaaacaaattaaactgacgacgacaaggcttgagcttgacaatggcaagtgtttcccaacccgcgccgcccattcttcttcgcttcccgtttaaaccgatacaggtttctgaaagaacctgtcggctctgctctgaaactgcaatgttttgccgcatttacaacaacggggttatcaagcagcacggcagtttgcagtttcgggaaagacgatggacaacatgctcacccatttatctgaccccttcagaa

SEQ ID NO: 21957 - DNA, 1982 bp, Zea mays
  misc_feature (11)..(11): n is a, c, g, or t
  misc_feature (31)..(31): n is a, c, g, or t
  misc_feature (34)..(35): n is a, c, g, or t
ccgcccctttntttttttttttttttttttnttnntttttttttttttttttttttttttcgtcaaaacgtcccacactgctctggcctcacttcgaacagccaaacacttgctgacactacagtgcgagttccaaaaactcaaatctccttctaaattggaaagcacattgaggtaactatatttttccttaatccccttcaattccaaaaaaggatttaagttccctaaggattagtttaggaacttaaatactcaggagttggaggggattgaaagagaaatattttatttttccctcagttcactcgaatttcggatgaaatttgagtttctaaactaggcttaaatgtgatgaaatcccctaaaaaatgtcacattgcgattagtccaggtttcaggtttcatagctgggccacctgagtcaaagagcagaattcatcgttcatctctgaggcgaaatcctcacccacctccatcctgctgcacagcgttgggacggaatagcgccgtgctactgctgcagctgactcctgatcgcccggctccgtctccgtatccactctgttcgaattgccaacagaggagccgttctccttcccaaacagctgctcggcaatatcacggcaaggcttcagatcgtcctcgctccgtgctcctgtcagcttacccagcagctcgttcagttccgtggctctccccatcttctgcgctgtgctgaacttcatcggggtcggggttagacgatcgtccagacttgggccagacggttcgtcaccctcactggcgctttggctcccgcgcaggtccttcagcttctggtccaagatagtggcaaccctctccctgaagctattggcagcttcgttatccgacttcaacctcgcctttgccgccgaaaccaacaggtccatcctttcttcctctgaagaagaagttgcttcagcctcaggatcaacatcagcatcttcttccatgggacagaatgcttcctccagtaacccgacgttctgcgtatacctctcgtacgcttcgttttcagcgtcggtatctccttgcatatgttcctttagcttcataaacctccacttgtttatacccgcaacatcctttttggtaactgatttctttgtttggagaaacttcagaaagtgctggggaagcttttgcaaggcagccagccttgacgctgaactggttgcaggtaaattgttagattgctgttctgttgttgcaggagcagttgcaggtgacggcttatctggcaatgtgtttgtctgcttcagaacatggatgtggcaaggattctgagccttgtagcagcagctcttgcaacactggaatgggcaccgggagcgggcgatgttaccacacaagatgcacttgggcttgttaaggccccggaggtttggcttgggcatgtcgaaggcagcggcaggaataggaggcggcttctgtggcgtcccattgctgttggccactgccggcgcaggagcaggactagcagcagagggaggcgagtcaccagccaccaccttggcgactgcagcagcggcgggcttcatgtcctgcatggttctcctcaacccggcaaaacaggagccagttggcaagggtttcagctgccggtctgttgggctccgcttgaggcgcgtccctcgctggggccggcttaccctggcgctgggaggcgaggttacgctggacgcagcccgcagggcatcgggcggtccgagagatgcagatcgggagtcggccggacctgggcagctctacggctgcgcgcctacggcctacctaccagcggtgcgtcgtcttcgcgcggaggtacctagcggcggcacgtcgtcgtaccagtaccactccgggaagagggagaacgggcgaacaagcgtgaggcgggggtcgacgctgacggcttcagggctgggcggctgcctattgccttgtcccggccgggcggacgcggggcggacgcgggg

SEQ ID NO: 21958 - DNA, 1854 bp, Zea mays
  misc_feature (1836)..(1836): n is a, c, g, or t
ggacctggggatcgcaaacagccgccctttttttttttttttggccgcttttttttttttttttttgaacgtgtcatctttaaaattgcgaacctaagaacaaaacaaatcctgagctttacacatgtaacagaaagtaccattcctgatgatgccattgccatgctacaaatttaccatccatcgcctcgtaaaaaaaaggagcagggcatcggctatctactacttatatggatcgtcaacgttggcagcgattagaatgtcccttctaaatcttcaccgtttgttccgagtcggcgttacacatacaggctcgcttcgctcagagcattctggtgctagctgtcgtccatgggttcttcttcctcctcaggatgtatataccgcttcatgtattcttcctcgatcatctccttcagcaaggttagcctttggatgatcaccgggtcgctcatctttctcgcatccataaaatccgtctcctccttgttgagatggtatgagtcgagaagcattttgatccatttgtggagttcgctgggagtcgtgtatagagcatcttcatccttagcttcacgcccatctccgggagagaaagcagttgcaagagcaccaaatctctcttcaggctcttcaatattcagcaaatacttcagcagcttcatctccggaggtgagatgctcttgaggctttcttttgtagttgtataaatatgatacattatgtccttgaccttatcattcatagttgtagattcttttgcagcagcccaagctctgttaatgagaagaattagagatgaatcaagttctttagccttggctaagcttttgatcttgtcacaagcaccatctagtgaagaggaattcagtatatcatcaaacttcaactgagcagattcaatatccaactgttccagtgtgcaatcatatgcatgaattgcagacaggcatttagccccaagcctgactattccatctcgctcatcaaggccattataagcattcacaaggaaattaagatggcggaagaagtccccagtgaaatccttccgtcgtcttgcaacaatggcattaatatcagcaggattctctctgagctcagtgaagagttccatgtacttctctatttcatcatctatctttttaacttttctagcaagtacaaccaacttttgtttcaatgagggatcagcctcaatatgtatgcgcacttgacaacgcttgtagaagtgccctctatacctttgccactcctctctaaacaccaataattttctccagtcctttgtttctggtttcatatacatgaagaactcaatgaatttgtcgcagatttcagtcattgtgtaccccattgcaacttcagcctcagtttggtctttcacattagcaatggttggactagctacacaacgtggcagtggtggagctgcggcgaggcggccgcgctgggtcgaatggggaatgtgtacggaggcggaggagggagagagggactgcgagggggcggcggccgttgacgcgggcgagggtcggggagcacggcagaagacgcccaggttcgtcgccatcggtggcagcgcggtgagaggaaccggctgaacgagcgggtggcggactgcgggctggcctcgccaagctcgagcagcaatccagcaacagctggaccagcgggctggccgacgcctcgcttggcgcttgcctcgccgcgcgcgatgtggacgccgggaccgctgcctcgccgagtcccagtcaccgcgtgggacaccggcagcgcagctcgcgctcgccgtggtggggaacagccggccgaacggaatggccctgccggtnagcggcggagtggataag

SEQ ID NO: 21959 - DNA, 4685 bp, Zea mays
  misc_feature (1840)..(1840): n is a, c, g, or t
tagtggagatggcgggaagcgtccgagaggagccggaagtggagcaccacttgcatgtggagaaaacccgcgactctctacggagttactcgaccgaggtgcttggctctcacgtgggcttccctttgcgtaggggcactaacgaggattaatcgggaccttgcgtggttccggatacctcggtaaaaatactggcgtcatccacgagagtttacatctctacctcgctctttagctttcgcatttatattaagcatttaagtttcaatcttgtctttatacttatattgttgtagattgaaacttagcctttgcggtagagatagcaaacacttagacaaaacctagtttgcatattctagtttgattaattgcataggttttgctctaggaatttatttgtggcctagtttattgaaagtttttgaagtcctaattcacccccctcttaggcatcgcttgtttctttcaccagaactgtctggatggtttaaaataagtattccaatgacatagtctatattgatggagagatgacattgcttgtgttgaggatgagagcactggctatatatactattacccaataagactctgcttgagatatgtttattattaatcttaacttgtttagttgtattttttccttgataataacttcgcccttgatttttgtatttatagcaaaggagatgcctctgagaagtgggaaattgaaaaaatggttaaaaaagaaattcgtttccggaacgaaatctcaaccatgttattagcaatataagggatgacgtgccagcttctggtgcttttgagaatatagtggaatagctggaaaaggggaaactagaagagatttgttgtttgattttagtttaacatgctccactttactatgagaattctattcggttatctgcatcatttgaactgcaattatggttttctgcaattaacagtgccagatgtgaagatcagaagtgagacactgaaaagattcatgttgttaaaattgaagatctgaatgatgcatctgttgtggtttctatagtgattacaaatgctggtgttgctcactgtattacaagggaagctcccttgcttaatatgcatttataggatgttgtggctgaaacaaagggctcagagtttcaatagggcagtgggtaggattcctttctactctgctagggagggtagtgagtgctacagctacattcttaggaatgatggtaaagatattgagccttcagctttattttaaatgctctttgttacttgtcatcgttacacaacctatattagggctcgtttggtagagctccgagagccgattctctagtagaatgattccgagtgattctctagcagaagtgaatctatttgacgaaaactgtttgacaaataagctgtgaagtgatttctgagaggttatagagtggagagcaggttgggagcagtgggaaggagttttttggctcccactttatagtataaacatagagactagattcactctactcccaccgtgcagcagtttagatttttacagtttagctctgtaagagtgattctcgctgaagcggagctatggaagctctgccaaacacccctttaatcttagcttctaaggctggctccagcaatagtctctaaagcctcctctaccctaaatatagaggaccaaacagacctctatgctctccagcaacgtactctaaatggtcctctaaatttagagaacgttgctggattctttatatatagagtttctctaaacggacatctatccatttgaatactttaaataaccggtttaacaaaactaaaatatgcacaatanatttaagagtatgacaaatacgtatgtaaaaaaataaaaatgtctctaatataggtatttgcgtatagaggacatgatttagagtatgttgttgaagagaaaggatatatagaggataaaatcttttaaagaagactgtaaagaacggatatagaggatgaatatagaggacgttgctggagacagtctaatgactttttacctgcgctgttgtgtttgtttagatcttacttttactatctaattattattattattattattattattattattatagttgcatacaactatattgactcgacgtttgcttctggcttcaaccacggtccaggccccaccccaggcgcaagcggcaagccaacgctcctgccagcaccatgccaccatcaacacacactgtttttcagccaacccctctctccgttggcgctttacggacagcgcaggccgtgtgcgcgttttaactggcacaacaggaacggcggagcgcatgcccactgtcgtggtcacgaggtttcgtccgtacacgcagcatagcagaagcgggcactccttttccgtcgtgtggggagaggtgaagcaggcattttcgaatgggcgcctgatgttctagttccgataaaaatccctacgaaccaagtaaccaactactggggaccgtcgaccatggtggccacaagccaatcacctctattctctctgcaacagatcctgcaaaaaaaaagacgcatgcagtgatgctaaagttgcggccaacccacgcaattgacgtggcaccaccgattccttccggcacgcgctcgccatcctgaccgtccaacttgaactgcctcatcgcagccgttggattccgctaactggacaataaatacattggattcctctccctctcgtacacgccaaccagcaccttttgcctaccccggcaccaccccgcctttgccttggtgttgaaaagtcgccgcgttcctcttgcctgatgaaatcaatcctcttctcgtctagatctgagcctccgcgtggcttccagatcagatgcttggtccgatcaacgacggtgagtcttgctctgttagttgattgttcgaaatgcatggttttgtttttgtgatgatgtgcaggttccgatcagtttcgtttgattgatgagttgacgcatcggttcgaagcgagacgaggctgcatggtttttgtgcctggaggtttctgatcagcgtgtttaaggaaactggatgctacaatttgttatctgcagaccttcagagctgcgacgttccggcttccgggggatctggatcttggctgactggacaattgcgaggcgttgacgggcttctaaagcgtggctggattgctggatctcctttctgccccgcgactcgatgatatctctttgtattggtaattattggatgaaatttcgataattattagatcggagagatgttggtcgcggcggtccgtgcctaactgaaggcaaggtaaggtccgagacaaaagaggggaaaaggatacatgaaaaagaagtgagatgtgacatcttgaaggcctttgccatgttgggtgcgctcgcatggcaggcatcgtaataaagatgttggttttgtgtgctgggtgggagatcgcacagggaattgtttttttcatccctgggttctcccgcccattgtgtccctgtgccctgcttcgtgttgtttggcttctcgtcctacgcttcatcaccggtgctgctgcaaattgaacggcgtttctcgtctcacggcgtgctgcaaattgaacggggctacatcgcaacgcaacacacaaggtacaaaccggatctaaacattttcaatttacagcgaagttagcaagttactgaaatcaccatcaatcgttcaaaactcagcgcgccacaaacttctacgcctatactacgccatgcatatgcagttcatccacccaacgcttatcccgtaaggctataaagcacatgcgaaaggcgttcattcactctgtaaggcgttcttgttcttcacccaacgcttctcgcacgggggtcttctattgaccattgaagaaaaacatttgactggagatagcatctggaatatatgaatctagtataacgaactaggtctgaaaatctgggcaattccagattcgattctcatgtgagatgataaaaacgtcataattatcctgcgtactaaaaaatattcgctagttgagtcgttccggcatatacaaaattattagctacagttgttcctgcatgcgtgtaatgtccttcggtgaacttgtctgtcattatcatttaaaaacgtatctagatgcattacggaagatttttagtttcctttgttatatttgagaagttatatattgtatatacagagagatgcagctgtgtattatttgctgtagcttcgattgcgagacgcatggttgcagtcattttattgtagttagtttatatgatacgtcgttgtcaccgcatgaagattaactgctgtgccatatgaagacctcctgcctcatcacggtgtttgtatataagatcaactgcagtgcctacacggtggacggagtatttgtatgatgtgaaggtcactattcagcatcgtcagtatgaaatggctatggccttcaaagctttctttcttggtcaccggacagggaagaaatattctgctcaagctcacaattagatacaagacataactcagataagagcttgttcaacttgcactatagttcatttgagtatttacctattattgatctcttgagttgaagctaggtttcaagtatctcctaagaatccctggttttcacatatacgaattcttcgacagcaacg

SEQ ID NO: 21960 - DNA, 929 bp, Zea mays
tactaaaaaatattcgctagttgagtagttcccgcatattcaaaattattagctagttgagttgttcctgcatacgtctaatgtcctacggctgtttatgtgaacttgtctgtcattatcatttaaaaacgtgtccggaggcattatgcaagatttttacttctcttggttatgtttgtgaagttatacattgtatatacagagagattcagctgtgtattatttgttgtagcttcgaatgcgagacgtatggttgcagtcatttttattgtagttagtttatatgattaggcgttcattcagctgtgtattatcatttaaaaacttggatccgggcgatcaccgacctgcagcattgcgcgcatgtgtttggttcctgcctaagttgccacactttacctaacttttctactttacctaacttttctacctaatgttagttcttcaatttgaacgactaagtttaggcaaaatgtttggttcttctagaactaatcgttagcctctaaaattagatatataggttttaaacactcactattgttagctatttaacaattagttcattaacttgattaatctagctactagcaatttgttagctggctaattattagctcttggttccaaatataggccttaatttgagctttctcctttaggtgagtttattcttaatgcctacttaatttcccctcttctcaaaatcaaaagatatttttactttccagatgttttcccctccttttcaaactaaagatgttttgactttccagattttggtatgcttgtagttaaatctacactttagataaagaaatgtttgtgtataagtaaaaatcccttatttggtcgtcatggtaaatggctgcggtggacatgtgcagtctgtggcgactgatgttcagtgatcttgctgtttttttgta

SEQ ID NO: 21961 - DNA, 1564 bp, Zea mays
aaccccgcctttgccttggtgaagaaaagtcgccgcgttcctcttgcctgatgaaatccttttctcgtctagatctgagcctccgcgtggcttccggatcagatgcttggtccgatcgaacaacggtgagtcttgctctgttacttgattgttcgaaacgcatggttttgttttgtgatgatgtgcaggttccgatctgtttcgtttgattgatgagttgacgacgcatcagctcgaagcgagacgaggctgcatggtttttgtgcctggaggtttctgatccgcgtggttaaggaaactgggtgctacaatttgttgctacaagtgcccgatccgtcgaattgatgtctgccgaccttcagagctgcgacgttccgggaatctggggggatctggatcttggcggactggacaattgggaggcgtctaaagcatggctggacaattgtgagatgtgacatcttgaaattgggtgcctttgccatgttgggtgcgctcgcatggcaggcatcataataaagatgttggttttgtgtgctgggtgggagatcgcacggggaattgttttttcatccctgggttctcccgccctttgtgtccccgtgccctgcttcgtgttgtttggcttctcgttctatgcttcatcaccggtgctgctgcaaattgaacggatcttctcgtctcgcggtgtgctgcaaattgaacggggctacatcgcaacgcaacacaacacgcaaggtacaaatcggatctaaacattttcaatttacagcaaagttagcaagttactgaaatcaccatcaatcgttcaaaacttcgcgcaccacaaacttatacgcctatgctaggtcatccatatgcacttcattcacccaacgcttatcccgtaaggctataaagcacatgcgaaaggcgttcagtcactctgtaaggcgttcttcacccaacgcttctcgcacgggggtcttctattgaccattgaagataaacttttgaatatatgaatcagctgtgtatatttgctgtagcttcaaatgcgagacctatggttgcagtcattttattgtagttagtttatatgatacatcgtcgtcaccgcatgaagatctactgctgagccatatgaagacctgctgcctcatcacggtgtttgtatataagatcaactgcagtgcctacacggtggacggagtattatttatatgatgggaaggtcaactgttcggcatcgtcggtatgaaatggctatggccttcaaagctttctttgttggtcatctggaaagaaatttcctgctcaagctcacaattagatactagacataactcagataagagcttgttcaacttgcactatacgaaatgttaggagataattgaaacctagcttcacctcaagagagatcaataataggtatgtactcaaatgaacaaatgtttgtggataagtaaaaatgccttatttggcggacatgagcagtcgatggcgactgatgttcagtgatcttgctgtttcattgttggtatatattcctgtcggattgttatcaaaaaaaaaaaaaaaa

SEQ ID NO: 21962 - DNA, 2235 bp, Zea mays
  misc_feature (5)..(5): n is a, c, g, or t
  misc_feature (7)..(11): n is a, c, g, or t
  misc_feature (20)..(25): n is a, c, g, or t
  misc_feature (27)..(28): n is a, c, g, or t
  misc_feature (31)..(31): n is a, c, g, or t
  misc_feature (58)..(58): n is a, c, g, or t
  misc_feature (64)..(65): n is a, c, g, or t
  misc_feature (69)..(69): n is a, c, g, or t
  misc_feature (73)..(73): n is a, c, g, or t
  misc_feature (75)..(75): n is a, c, g, or t
aaaantnnnnntcccccccnnnnnngnnccnctctattaactaatgggatcccccccngctgcnngganatananagagctcaccacgagcccccccccccgttcaaacttcgcgcgccacaaacttctacgcctatactacgccatgcatatgcagttcattcacccaacgcttatcccgtaaggctataaagcacatgcgaaagacgttcattcactctgtaaggcgttcttgttcttcacccaacgcttctcgcacgggggtcttctattgaccattgaagaaaaacattgactggagatagcatctggaatatatgaatcgagtataaatgaaattagtcacgtatgttggtattcaatatttgttcagacgaactaggtctgaaaatctgggcaattccagattctcatgtgagatgataaaaacgtcataattatttgctaagtttaatgacctacgtcagtttctgcgtactaaaaactattcgctagttgagtcgttccggcatattcaaaattattagctacagttgttcctgcatgcgccagattctcatgtgagatgataaaaacgtcataattatttgctaagtttaatgacctacgtcagtttctgcgtactaaaaactattcgctagttgagtcgttccggcatattcaaaattattagctacagttgttcctgcatgcgtctaatgtccttcggtgaacttgtctgtcattatcatttaaaaacgtatctagatgcattatggaagatttttagtttcctttgttatatttgagaagttatatattgtatataccgagagatgcacctgtgtattatttgttgtagcttcgaatgcgagacgtatggttgcagtcattttattgtagttagtttaactgctgtgccatatgaagattaactgctctgccatattaactgcatgaagattaactgcatgtgccatatgaagacctcctgcctcatcacggtgtttgtatataagatcaactgcagtgcctacacggtggactgagtatttgtatgatgcgaaggtcactgttcagcatcgtcagtatgaaatggctatggccttcaaagctttctttcttggtcaccggacagggaagaaattttctgctcaagctcacaattagatactagacataactcagataagagcttgttcaacttgcactatagttcatttgagtacttacctattattgatctctcttgagttgaagctaggtttcaagtatctcctaaggtttataggtgaaaaccagggatttttttttgcactacaatctgtgacgttttaatacttgattactagttgttcatgcattgctattgtattcgcatatcccctaggtttaagagcaaggtttaagagcctttctaacaaggtgactcaatgatgtctcaaatttaaaatactacatttaaagtgttcaggtcgccaaaaacaaattgtgcttctacatttaagctttaatcatgtattttaggaagtaaattatattattagaaaaaatgtttagaatgatgtagaaaacatggatagagccttagtccgagagtagtatatttggatcttaatgtgcccgaaatttataaaatagggcactgttggagctgtttttactgatttgctctatattttaagatagggtactgatttaaagcacggttgtagttgttttaaatacaacatttcaaatttccacttatacacaatgttagcttatttttaccgtccgcgtggaagctgcattgacgttgaggctggcggcagtgcgggcggcagcgtgggcgagaagaggccgctgccgcccgcgcgcggacgaggcggacgagaggccagcaccgggcgatggcgctcgcgcccggcgagagcgagcagtatcgcctcgctctcgcccgcgctggagcgtccgtccgggtgagaggcgggcgagagggaggcgaggcactggcggggcgagagcgcgggtgagagcgacgtggcgtgatctgattggtccacgtgtcgcgatctgattggtccacgtgtgctagccgttgcaactagccgtttttgaccgtttggagtccaaaaatttcgaaaaaaattgcaaaaaatcacaaattttatccctaattcctctatatattatgttgtgtgttttctgagcgttgaaataaatccgcgtgaattaaaaaaaaaaaaaaaaaaaactcgagggggggcccggtac

SEQ ID NO: 21963 - DNA, 3028 bp, Zea mays
gggcgggggcatggccgtggccgcgtgggcgagggaagggcacagtaccgctgcttcggatcggcgacgatcttgggtgggattcgcgcgagcgcagaggttgctcgcggacgctgacgggggcaggggcacgtattgcggcctcgcgggagcaggcgggggcatggtgatgctcggtggacgccctcgttgcgctcttaagaagtagtatagatttgttttaatttgtgtatgctgtgatgtgtatgtaaacagttgattttaagtgtatgtgatgaattagtatattattatatgtcatatggtgtatgttaattatttacaattattttagaatttatgtttagaaagaagaatgacaggatttggtagaccacgtgttagtgatgaaaacactggatgcgtgatttcacaattaaatcttgtttataatgaatttagagtttagtcgagatgtatgtactcataggttcatatacttaatttagaccgactaaataaataatagaagctttattaacattgagataatataagtagtacccgtggactgcatttctatgtgtaaccaaataatgcatataataatgtttacttttggatatctgcataaatttaggatttgcctaaataggattaactagaaataccatccctatttcgaatgtttactttgcgtaactcctcccacttgctgaggccctaccataagtgaactcacctattgctaaatttttgtccctaaaaccggatgtaacaatattggtgctacagtcttaggaataatggtaaagatgttgagccttcaattttattttaaaatgctatttgttacttgtcatcgttacacaatctatattaatcttagcttctaatgtcttttcgcctaaatatgctgcgctgctgcaaaaacaatgacgcatgaagtgacgctaattgctcgcaagttgcggccaacccacgcaattgacgtggcaccaccgatcaccttccggcacacgctcgccatcctgaccgtccgactcgaactgcctcatcgcagccgttggatttccgctaagtggacaataacatggggaacctcgggcccgcccgggacccggcctttgccttggtgaagaaagtcgctgcgttcctcttgcctgatgaaatcctcttcccgtctagatctgagcctccgcgtggcttccggatcagatggttggtccgatcgaacaacggtgagtcttgctctgttacttgattgttcgaaacgcatggttttgttttgtgatgatgtgcaggttccgatctgtttcgtttgattgatgagttgacgacgcatcggctcgaagcgagacgaggctgcatggtttttgtgcctggaggtttctgatccgcgtggttaaggaaactgggtgctacaatttgttgctacaagtgcccgatccgtcgaattgatatctgtcgaccttcagagctgcgacgttacgggggaatctggatcttggcggactggacaattgggaggcgtcgacgggcttctaaagcgtggctggacaattgtgagatgtgacatcttgaaagcctttgccatgtcgggtgcgctcgcatggcaggcatcataataaagatgttggttttgtgtgctgggtgggagatcgcacggggaattgttttttcatccctgggttctcccgccctttgtgtccccgtgccctgcttcgtgttgtttggcttctcgttctacgcttcatcaccggtgctgctgcaaattgaacggatcttctcgtctcgcggcgtgctgcaaattgaacggggctacatcgcaacgcaacacaacacgcaaggtacaaatcggatctaaacattttcaatttacagcaaagttagcaagttactgaaatcaccatcaatcgttcaaaacttcgcgcaccacaaacttatacgcctatgctacgtcatccatatgcacttcattcacccaacgcttatcccgtaaggctataaagcacatgcgaaaggcgttcagtcactctactctgtaaggcgttcttcacccaacgcttctcgcacgggggtcttctattgaccattgaagataaacttttgaatatatgaatcagctgtgtattatttgctgtagcttcaaatgcgagacctatggttgcagtcattttcattgtagttagtttatatgatacatcgtcgtcaccgcatgaagatctactgctgagccatatgaagacctgctgcctcatcatggtgtttgtatatgaagatcaactgccagtgcctacacgctggacggagtatttatatgatgtgaaggtcaactgttcggcatcgtcggtatgaaatggctatggccttcaaagcttccttggtcactggacagggaagaaattttctgctcaagctaaaaattagatacaagcttgttcaacttgcactatagttcatttgagtacttacctgttattgatctctattgagttgaagctaggtttcaagtatctcctaaggtttcgtataggtgaaaactagtgtttctctctttttttttttgcactacaatctgtgacgtttcatgcccttagtttgagctttctccttagtgagtttattcttaatttttcttcttttccaaatcaaaagatgttttgactttccatattttgctatgcatttagttaaatctacactgtagataaacaaatgtttgtggataagtaaaaatgccttatttggtcgtcatggtaaatggctgcggtggacacatgagcagtctctggcagctgatgtgtcagtgatcttgctgtttcattgttggtatatattactgtcggattgttactattgaggagccattttttgcaaaaaaattttggaggcttcactacatccattatcaataactggattttgctctacgaaggtacatgtccattatcaataactcgatttttttaattgttcttcgatagtctttgcattgtgaataccaataattgctgccatttataactaatactttaaccaaggcgcg

SEQ ID NO: 21964 - DNA, 1621 bp, Zea mays
tggccgcccgtgccgccggcccgggcgggacgctccaaccctagcatcttctgcctgcctcggcacccgggcctttgccttgtgaacaaaagtcgtcgcgttcctcttggctgatgaaatcctcttctcgtctagatctgagcctccgcctgtctttcggatcagatgcttggtccgatcgaacaacggtgagtcttgctctgttatttgattgttctaaacgcatggttttgtttttgtgatgatgtgcaggttccgatctgtttcgtttgattgatgagttgacgcatcggctcgaaacgaggctgcatggtttttgtgcctggaggtttctgattagcgtgtttaaggaaactgggtgccacaatttgttgctagaagtgctcgatccgtcgaattgatatctgccgagctgcgacgttccgggggatctggatcttagcggactggacatttgggaggcgtcgacgggcttctaaagcgtggcgggagacaatggaggggaaaaggatacatgaaaaagaagtgagatgtgacatcttgaaggcctttgccatgttgggtgcgctcgcatggcaggcatcgtaataaagatgttggtttttgtgtgctggggtgggagatcgcacagggaattgttttttcatccctgggttctcccgcccattgtgtccctgtgccctgcttcgtgttgtttggcttctcgacctacgcttcatcaccggcgctgcagcaaattgaacggggctacatcgcaacgcaacacacaaggtacaaaccggatctaaacattttcaatttacagcaaagttagcaagttactgaaatcaccatcaatcgttcaaaacttcgcgcgccacaaacttctacgcctatactacgccatgcatatgcagttcattcacccaacgcttatcccgtaaggctataaagcacatgcgaaagacgttcattcactctgtaaggcgttcttgttcttcacccaacgcttctcgcacgggggtcttctattgaccattgaagaaaaacattgactggagatagcatctggaatatatgaatcgagtataaatgaaattagtcacgtatgttggtattcaatatttgttcagacgaactaggtctgaaaatctgggcaattccagattctcatgtgagatgataaaaacgtcataattatttgctaagtttaatgacctacgtcagtttctgcgtactaaaaactattcgctagttgagtcgttccggcatattcaaaattattagctacagttgttcctgcatgcgtctaatgtccttcggtgaacttgtctgtcattatcatttaaaaacgtatctagatgcattatggaagatttttagtttcctttgttatatttgagaagttatatattgtatataccgagagatgcacctgtgtattatttgttgtagcttcgaatgcgagacgtatggttgcagtcattttattgtagttagtttaactgctgtgccatatgaagattaactgctgtgccatattaactgcatgaagattaactgcatgtgccatatgaagacctcctgcctcatcacggtgtttgtatataagaatcactgcagtgcctacacggtggactga

SEQ ID NO: 21965 - DNA, 1900 bp, Zea mays
acgccaaccagcatcttttgcctgccccggctccccccccccccccccccccgcctttgccttggtgttgaaaagtcgccgcgttcctcttgcctgatgaaatcaatcctcttctcgtctagatctgagcctccgcgtggcttccagatcagatgcttggtccgatcaacgacgaccttcagagctgcgacgttccggcttccgggggatctggatcttggctgactggacaattgcgaggcgttgacgggcttctaaagcgtggctggattgctggatctcctttctgccccgcgactcgatgatatctctttgtattggtaattattggatgaaatttcgataattattagatcggagagatgttggtcgcggcggtccgtgcctaactgaaggcaaggtaaggtccgagacaaaagaggggaaaaggatacatgaaaaagaagtgagatgtgacatcttgaaggcctttgccatgttgggtgcgctcgcatggcaggcatcgtaataaagatgttggttttgtgtgctgggtgggagatcgcacagggaattgtttttttcatccctgggttctcccgcccattgtgtccccgtgccctgcttcgtgttgtttggcttctcgtcctacgcttcatcaccggtgctgctgcaaattgaacggcgtttctcgtctcacggcgtgctgcaaattgaacggggctacatcgcaacgcaacacacaaggtacaaaccggatctaaacattttcaatttacagcgaagttagcaagttactgaaatcaccatcaatcgttcaaaacttcgcgcgccacaaacttctacgcctatactacgccatgcatatgcagttcattcacccaacgcttatcccgtaaggctataaagcacatgcgaaaggcgttcattcactctgtaaggcgttcttgttcttcacccaacgcttctcgcacgggggtcttctattgaccattgaagaaaaacatttgactggagatagcatctggaatatatgaatctagtataacgaactaggtctgaaaatctgggcaattccagattcgattctcatgtgagatgataaaaacgtcataattatcctgcgtactaaaaaatattcgctagttgagtcgttccggcatatacaaaattattagctacagttgttcctgcatgcgtgtaatgtccttcggtgaacttgtctgtcattatcatttaaaaacgtatctagatgcattacggaagatttttagtttcctttgttatatttgagaagttatatattgtatatacagagagatgcagctgtgtattatttgctgtagcttcgattgcgagacgcatggttgcagtcattttattgtagttagtttatatgatacgtcgttgtcaccgcatgaagattaactgctgtgccatatgaagacctcctgcctcatcacggtgtttgtatataagatcaactgcagtgcctacacggtggacggagtatttgtatgatgtgaaggtcactattcagcatcgtcagtatgaaatggctatggccttcaaagctttctttcttggtcaccggacagggaagaaatattctgctcaagctcacaattagatacaagacataactcagataagagcttgttcaacttgcactatagttcatttgagtatttacctattattgatctcttgagttgaagctaggtttcaagtatctcctaaggattcgtatatgtgaaaaccagggattctcttttttttttgcactacaatctgtgacgttttaatatttgatgactagttgttcatgcattgctattgtatttgcatatcccctaggtttaagagcatttctaacaaggtgactcaatgatgtctccaatttaaaatactacattttaag

SEQ ID NO: 21966 - DNA, 2063 bp, Zea mays
ggggccccccggggccggccggccggcgccaaccagcatcttttgcctaccccggcaccacccccccccccccccgcctttgccttagtgtagaaaagtcgccgcgttcctattgcctgatgaaatcaatcctcttctcgtctagatctgagcctccgcgtggcttccagatcagatgcttggtccgatcaacgacggtgagtcttgctctgttagttgattgttcgaaatgcatggttttgtttttgtgatgatgtgcaggttccgatcagtttcgtttgattgatgagttgacgcatcggttcgaagcgagacgaggctgcatggtttttgtgcctggaggtttctgatcagcgtgtttaaggaaactggatgctacaatttgttatctgcagaccttcagagctgcgacgttccggcttccgggggatctggatcttggctgactggacaattgcgaggcgttgacgggcttctaaagcgtggatggattgttggatctcctttctgccccgcgactcgatgatatctctttgtattggtaattattggatgaaatttcgataattattagatcggagagatgttggtcgcggcggtccgtgcctaactgaaggcaaggtaaggtccgagacaaaagaggggaaaaggatacatgaaaaagaagtgagatgtgacatcttgaaggcctttgccatgttgggtgcgctcgcatggcaggcatcgtaataaagatgttggttttgtgtgctgggtgggagatcgcacaagggaattgtttttttcatccctgggttctcccgcccattgtgtccctgtgccctgcttcgtgttgtttggcttctcgtcctacgcttcatcaccggtgctgctgcaaattgaacggcgtttctcgtctcacggcgtgctgcaaattgaacggggctacatcgcaacgcaacacacaaggtacaaaccggatctaaacattttcaatttacagcgaagttagcaagttactgaaatcaccatcaatcgttcaaaactcagcgcgccacaaacttctacgcctatactacgccatgcatatgcagttcatccactcaacgcatatcccgtaaggctataaagcacatgcgaaaggcgttcattcactctgtaaggcgttcttcacccaacgcttctcgcacgggggtgttctattggtagtcattatttgttcaggtgaactaggtctgaaaatctgggcaattccagattctcatgtgagatgataaaaatgtcataatcatttgctaagtttaatgacctacgtcagttcttacgtactaaaaaatattcgctagttgagtcgttccggcatattcctgatgtcctacggtgaacttgtatgtcattatcatttcaacgtatctagatgcattatggaagatttttagttttctttgttatatttgagaagttatatattgtatatacagagagatgcagctgtgtattatttgctgcagcttcgcgatgttgcagtcattttattgtagttagtttatatgatacgtcgttgtcaccgcatgaaaatctactgctgtgccatatgaagacctgcctcatcacggtgtttgtacataagatcaactactgtgcctacacagtggacggagtatttatatgatgaaatggctatggtcttcaaataagagcttttgttcagcagattctcaagctcacaattagatactagacataactcagataagagcttttgttcaacttgcactatagttcatttgagtacttacctattattggtctctcttgagttgaagctaggtttcaagtatctcctaaggtttcgtataggtgaaaatcagggattctctttttttttttgcactacaatctgtgacgttttaatatttgatgactagttgttcatgcattgctattgtatttgcatgaaattggatacagagggctttctccttagtgattttattcttaaatccttcttaattttcctgttttccaaatcaaaagatgtgttgactttccagatgtttttccctccttaaaattaaaagatg

SEQ ID NO: 21967 - DNA, 812 bp, Zea mays
gaaagacccggcaagcccgcaaaaccctcgtctgccaacagctgtctcgcaagtcgcaacggctgagtgcgcgcacccatcagtcccgtgttcccgccacacccctcccattcccctctcaatcctgtccccaaatctctctcttctctctagcggcgaggcgaggcggtgaagacgagcgagcggcgaggatgttgtgggtagacaagtaccggccgaaaaccctagacaaggtcaccgtccacgaccaggttgcgcagaacctcagaaagttcgtgtcggagcaggattgcccgcacctgctgttctatgggccgtcggggtccgggaagaaaaccctaatcctcgcgctcatcaagcagatgtttggcgccggcgcggagaaggttaagctggagaataagacatggaaaattgatactggaacaaggacacttgagatagaattggcgatgttgtcaagtgctcaccatgtagagatgaaccccagtgatgctggctttcaggacaggtatgttgtccaggagatcattaaagagatggccaagaacaggccaattgatgccaaaggaaggagagcatttaaagtccttgtgttaaatgaagttgacaagctctcaagagaagcccagcattccctccgtaggactatggagaagtatagctcatcatgcagactgatcctatgctgtaacagctcctcaaaagtgacagaggctgtaagatcccgttgcttaatgtgcgagtaaacgcacccagtgaagatcagattgtccaagttctagaattcattgggaagaaagaaaacctga

SEQ ID NO: 21968 - DNA, 1058 bp, Zea mays
  misc_feature (1029)..(1029): n is a, c, g, or t
atggaccacacctgtcagaaaagatagccggaagccggaaaaaccctcgtttcccgtctcggagcggcggagtgcgcacctatcagtcccaagttcccgccacacacctctccattcccctcccgaagtcccgatcctgtcctcaaatcccattgctctatcttctctagcggcgagtcgaggcggggaagacgagctagcggcgaggatgttgtgggtagataagtaccggccgaaaaccctagacaaggtcaccgtgcacgaccaggttgctcagaacctcaggaagtttgtgtcggagcaggattgcccgcacctgttgttctatgggccgtcggggtccgggaagaaaaccctaatcctagcgctcatcaagcagatgttcggcgccggcgcggagaaggttaagctggagaacaagacatggaaaatcgatactggaacaaggacatttgagatagaattggcgatgttgtcaagtgctcaccatgtggagatgacccccagtgatgctggctttcaggacaggtatgttgttcaggaggtcatcaaagagatggcgaagaacaggccaattgatgccaaaggaaggagagcatttaaagtccttgtgttaaatgaagttgacaagctctcaagagaagcccagcattccctccgtaggactatggagaagtatagctcatcatgcagactgatcctatgctgtaacagctcctcaaaagtgacagaggctgtaagatcccgttgcttaaatgtgcgagtaaacgcacccagtgaagatcagattgtccaagttctagaattcattgggaagaaagaaaacctgattcttccagctggatttgctgctcgtatcgctgcacaatcaaaccgtaatctgagacgtgcgatactggtttttgagacttgcaaagttcaacaatacccatttacatcaaatcaggtggcgcctcctcttgattgggagcaatacgtgtctgaaatagccacggatatactgacagaaacaaagccctaaaggctatntgatgtccccagaaatctatgattactcg

SEQ ID NO: 21969 - DNA, 1352 bp, Zea mays
cattgggtacctcgaaggattattccgacctttttcatccctcatcccacgcccaaactccatctccatcacctcgcacttatcggtgaaaccgcgcgatgactacggcggcgcccgcgctgcccatgttcctccggctgtgcccggcctcgcccttcctcctcccccccagcctacacgtccccagctcaaggcgccccactccgtcgcgcctgagctcttttcgccctgcaaggccactcttccccatctcagctgtggagaaaaccaacgaggctgctgcggctggggagggtgagctcgaggggatgccgcccgagttctacgacgaggagtggcaggcccgtcagcgggagaggactaaggagtggcatgcatatcggcagaaagaggaggccgaggaggaaagaataacaaatgagtaccgagagataggcatgcgcctgaaagcttatccgcaagaagaagttcgcaaagctaggattttagtttcaagtttcataagagctggtggagatgttgaggaggaaattgagaaggctgctgaaagaggagagcttactgaacttgtccttatggtcatctggaatcgacttgatattgctcggcgtgatgatgagcgggatgccatcagaagccttgatctcttgtatagaagggtagagacagagattctgaagagtgaagcaactcctgccatgagattgctcaatgatcttcttaatcttcatgatggaggcgacaatgagaagtggttaaagaaatgtagaaagcgcatgcttgaagtctttccaagagaggacccattcactgtggtccttcctgctgggttcaacatggagaatcgtgaagggcgaattgagctaccgcctcaggatgatgatcttcttctgagagtggactttgtcagggaagttgatgagctgctgaaagaggttcgtgctgtggaagacaagaacaagcaacaaattgggtttgacccagaatcagttgcatatatgctgaagcagcaggagaagatgcagaccatgcgtcaggtggaatctctcctggacttggcgtcctcgttgaaatggtgaggattgagtactatcgaacaactgaacaactatgctgtttgcttagaagctagacgtcattgacttgacatttatactcaacagttagagggggtatctgttttcagctagttagaccaataaccgttctgggtagagccatgcagtttacttggacatccatgtacatttgtatgtgtagagatattttatatcaatgtatgtctacactgctaatgaaaaaaaaaaaaaaaaaaaattctcttcaccaaaaaaaaaaaaaaaaaagcggcc

SEQ ID NO: 21970 - DNA, 2075 bp, Zea mays
aaagcgccggattccggtagtggatgagatagagtcttgcttgcatgtatactttttctaatatggagaggctcacttttgtacgtggccgataatacaataccaattacaaggtaatacatatatcctacacctggatggtgggtacatattaatagaatacgtacgatatatgtaacatctcatgatgtgcctagatacttctccaaacgaaagttaaacagatcgttgaggcaaccaagcttgtcacagctggctatacactctgtcgttccatggaaccatcattcagaaaataactatggcacactccgatccctttatttttgtaatgtagatttcttcgcagtaccaaaccacaatataaagtcggtgctgatcgatggaggagatgccttagggatagatctccaggacacctcgagctccaaatttcttcagcagcttgtagtcactgaaacctgctttctggatgaggtcacgccagtcattcacgtcccgctgccggcctcctttcatcagcatcatgcagacgtccattaggagttgagtttgaaacatgactggtcctgaggctgggtcgagaataatatctgcgatgacaaccttccctccctcttcccgtgaaggtattgccttcctgcagttggcaaggatcttcacgcagtcctcatcactccagtggtgcagcaccatctgcatgccatgcatgggaagtctcaggaatattaaaatatattatatatatggagctcaggaaaattgtagaggtcgtcaagctcatcatatcatagataataagatactcttaagtatatatgaggtggtgttatctacacaaaaaatgttatttccaaattatgcatgaactcatatatattatatttttgcagtgaagaaacactatttaccttaagtaacaccatttgagcacgtgggatggatttgaacatgtcacctccaacatagttaacaacaccatcagccggtatcttgcgaatctcctgcggaaggtccagtactgtgatcttgatcagtgggaaggccttggcgagggccttccctgttgtgccatccccatggtaacagcagtcagtcactgacttcaccccctggaatacgtcctggtactcccgcacggcaatgctggttgcaaagttgtcatggaccaacaaacctagtattgacatcttgtggaacccgggagccttgcgctccatactctcctcgaacagcgatgctgcgtgcttgtgatcgaaaggaggtgtcttggcttccttcttgaaccagtcagctaggtctattgccaggtcaatgtagtgtgctgacgtcacagtgagtaggaaaggtgcatggtccatgtgattgttatcggcagcgatgccgtccaccaggaggtatgacagtggtgtgagggagtagacagcctctggggactcaaccacggcgaagacgcccgaggacgacagcagccgcatgaggcggccaaggaaaggtagcttagcctgggggagggacagtgaggcgatcaggtcgggaagcgaggcagcaccgcctaggctgtagatggcagtgggtatgccgagctcagtagcgcacttgagagccatggatttgaggtagcacaggctgtttcgccatagatcggcctgtgcctgcagcagctcggcgtctgtgggaactacaatggatggggccagagctgccattgtacgttgctcgatcgatcctgtttgtgttgttaattttgtgtggtctgcttagatgcctggatcgtccattcttggcttggcttaatacatatatatagtgtgttccttacccactgcttgttgagaagatgttcataattctggacttagctagctgtcctcccaagcatggaccacgaggagagagacggttctacgtggacgcatgtcgattcagaagtcgtaaggaaagtgatagtgctaaggctatgcatctacgcgcgtgtttcacgtggtcatagaaaaccaataaggccaagaaacgtactgcatttaatgacaaaattgaaaacccagctgcttgcactggacggcatggagtat

SEQ ID NO: 21971 - DNA, 1516 bp, Zea mays
  misc_feature (849)..(849): n is a, c, g, or t
gcatgtataaggggctttttttttgtggttctcttttgtacgtggccgataatacaataccaattacaaggtaatacatatatcctacacctggatggtgggtacatatatattaatagaatacgtacgatatatgtaacatctcatgatgtgcctagatacttctccaaacgaaagttaaacagatcgttgagcaaccaagcttgtcacagctggctttacactctgtcgttccatggaaccatcattcagaaaataactatggcgcactccgatccctttatttttgtaatgtagatttcgtcgcagtaccaaaccacaatataaagtcggtgctgatcgatggaggagatgccttagggataaatctccaggacgcctcgagctccaaatttcttcagcagcttgtagtcactgaaccctgctttctggatgaggtcacgccagtcattcacgtcccgttgccggcctcctttcatcagcatcatgcagacgtccattaggagttgagtttgaaacatgactggtcctgaggctgggtcgagaataatatctgcgatgacaaccttccctccctcttcccgtgaaggtattgccttcctgcagttggcaaggatcttcacgcagtcctcatcactccagtggtgcagcaccatcttaagtaacaccatttgagcacgtgggatggatttgaacatgtcacctccaacatagttaacaacaccatcagccggtatcttgcgaatctcctgcggaaggtccagtactgtgatcttgatcagtgggaaggccttggcgagggaattccctgttgtgccatccccatggtaacagcagtcatcctacttngtcactgacttcaccccctggaatacgtcctggtactcccgcacggcaatgctggttgcaaagttgtcatggaccaacaaacctagtattgacatcttgtggaacccgggagccttgcgctccatactctcctcgaacagcgatgctgcgtgcttgtgatcgaaaggaggtgtcttggcttccttcttgaaccagtcagctaggtctattgccaggtcaatgtagtgtgctgacgtcacagtgagtaggaaaggtgcatggtccatgtgattgttatcggcagcgatgccgtccaccaggaggtatgacagtggtgtgagggagtagacagcctctggggactcaaccacggcgaagacgcccgaggacgacagcagccgcatgaggcggccaaggaaaggtagcttagcctgggggagggacagtgaggcgatcaggtcgggaagcgaggcagcaccgcctaggctgtagatggcagtgggtatgccgagctcagtagcgcacttgagagccatggatttgaggtagcacaggctgtttcgccatagatcggcctgtgcctgcagcagctcggcgtctgtgggaactacaatggatggggccagagctgccattgtacgttgctcgatcgatcctgtttgtgttgttaattttgtgtggtctgctt

SEQ ID NO: 21972 - DNA, 3305 bp, Zea mays
aaactgacataaactacagctccatactggatctagaacctagagccatctcaaatacctccatagtaacaccttcatagtcattgtttacataatgaagtttaaaatattggtggttctcgggtgggatatgtaagctgcctctgaacccgataacatagctttgataatgaagtgtgttatatctgattacctgacatctctagtctaaacaactcattagcaaatagtacaagtgtacaaccctagtctaacaacccactatcctagtatagaaacggctgctacctctttagcaagtacagcccatccctcgtttctagcttttcatctgctactagaccagaaagaaaactttgcagctgctgcagcgacttgtcatacgatggctcggcaatacaaaacatctttagagtgttatgtatcctgtccagcgacatactcccaaaatttgttagcattccgacgatgtatttctcgtagactgtcatttctttcttaagctgttcctccactgaagccacagagctttcaccttcctcctcagtcatctgatactctgccatgcgttcattcacaatactgtccttgttgacatcagacatgctatcgacaacagtgaaggtgcgatcatcggcatctggtcctgctgattcagtcaggacccccttgcttgtccagaaacttattcttctgttaagagaatccataggtatgccaatttctgtagcaagtgcctttgaagtccaactagatttctcttgaaaccgcattatgattgcagcatgcacaggagctacagtaaattgcacgcttcttccgtcaaattgcagttctaacttgactgttccaagatttttcttccataatagctttcgtggagtttttatctggtgaaatcgttttgcgtaatccgatagcaactgatcaactgaagcaggaacaacaaggtcttctatctgaattggtggccaaaaattagatgatattatagtggcatccaaaacatcatgagacacttctgcctcctcttgcccaggaacagtttgagatgacttcagcaaagatgttttaatgttcgaattggttctcttcgagtcaatcaagtcattaagcataatctcacacttctgcatgctgctctcaccaaaatgaatcttcaggagttccaatgtgcgaatgtctgaatcaatttcaaagtcagatttgttgagcagcttttctgccagcattacacggtattcattgactagttggtcctttgagccaattatactaaccattagtccaagtatatcgaccttccttctgttcctgttgcctttcaatgggtctgcttctacaggatcgggttcccagctttcagaattgagccatgcttgtttctcatcaatgtttgcatgatcgtcgtaatcagcattttcctggttttcagcatctctgttcaactcttccagaagattgtcacctgcattgcctgttccacttccacttcctcctgacccatcagttagcattgtcactatgcatttgatagtgtcttttctacctctcagataatccctaattggttcaccaactgcttccaagaacaccccggtggggtcaattgtccgcaatgcctttatagtggacacatattggtgcaatatatcatttgttgatgcaccagcagtaagtaggcgatatcgaagcgatgagataaatgagtcaacaagcttagagtgttggcccgtgtactctaaacacagctttaggtcttcaatagcgggagagctctcagggtaatctacaattatttcaaaaagtttgccaattcgtaggtcctgcaaggtttcataagcaaaatattcaaggcgcatgtgccatctcacaagggcttcagaaggaacaccaatccctgggaaggaagaagggcgtgaagctaatggtgatttgagaccagaagatccactgccatggtccacagagtcaccgagatatgttaaaagagcatgcagaaactgaagaggaacagcctgacaagttccgaattttatgtcagaggacatgggtggagtaaatctacaaccgaaggtccaaatttcgtacttcgctaaatggtgagatgagatggtacctgaatccacttcttcacacaccaaaggactgacactctataatcatcaccagctagttcataaaccttagactgcagagtgagaatgagagataatactaggtcaattataagaaattcaatagtatctatgccaaaataagtgatgcaaacctttaaaagccagattattgcagaggaataagcatcttcagtcatcgatgtaaaaccaatacatctaagatcacgaacaactttgccaatgttctttaccaaggagctattttctgaaacttcagaaccatcaatgtccattccagaatgccagtcagatgtattactcctttgaaaaggttcatgatccacaagttgatcactctcataagatccagccataatactattaagttcttccagcttcttcttgaaatagatattcaatatgtctgagaagtgtgagaagaattaatactattccattttacaaagtgcaacggttttattttttcatccaagagagaatgaaatacatattgtgctcaatattttgaagctatttggagaagcttcaggtttgaaaactaatattcagaagagtagtgtttatctcatacgaagtggtgatgaggatttgataaccctacaagtcagcttccatttgagctctcatctttcccctgtaaataccttggcctgcctctgtccttaaaaaattgtccagaattcaggtgcaacccattattgacagagtggctgatcaattgtctggttggaaagcggatctaatgacaaaggctgggagaagagtgcaggtccaatatgtgatggcaggcatgctcatttatttagccatggcagttgacatacccccaggatcactcaaggctattgacaaaatcagaaaaggctttccctggcgtagaaggaaagatgttagaggaggacattgtttaatggcttggggcagagtatgtagacctcttgaaattggcggtcttggtatttctagtctcaaagaattgggatgggccttgagaatgagatggctatggctgggcaaaacagaaccggataaaccttggtcctcgctgcctatgcagttctctaaaaagatgaaggccttcttttccactaccatgctcactgaaattgggaatggatcttcaaccttattttggcaagatcgttgggttcaggaaagaaaatg

SEQ ID NO: 21973 - DNA, 1477 bp, Zea mays
gggggttgtttttttttttttttttttttctccatactggatctagaacctagagccatcccaaataccttcatagtaacaccttcatagtcattgtttacataatgaagtttaaaataaacgaggatgtgagataggatatgtaagctgcctctgaacccgataacatagctttgataatgaagtgtgttatatctgattacctgacatctctagtctaaacaactcattagcaaatagtacaagtgtacaaccctagtctaacaacccactatcctagtatagaaacggctgctacctctttagcaagtacagcccatccctcgtttctagcttttcatctgctactagaccagaaagaaaactttgcagctgctgcagcgacttgtcatacgatggctcggcaatacaaaacatctttagagtgttatgtatcctgtccagcgacatactcccaaaatttgttagcattccgacgatgtatttctcgtagactgtcatttctttcttaagctgttcctccactgaagccacagagctttcaccttcctcctcagtcatctgatactctgccatgcgttcattcacaatactgtccttgttgacatcagacatgctatcgacaacagtgaaggtgcgatcatcggcatctggtcctgctgattcagtcaggaccccctatatcatcacatcacagaagctatcagcaacagccaatatacaataataatgattatgctccaacagtcatgttagcatgttctgcatgatgacaagcatatttcacataaaaaaaataaagcaacaattatccgctgatacatgtgtgccagaccttgcttgtccagaaacttattcttctgttaagagaatccataggtatgccaatttctgtagcaagtgcctttgaagtccaactagaaagttcgatagatttagtcaaaagagtacaaatgatacatgcaataatacagttctttgaatacctagatttctcttgaaaccgcattatgattgcagcatgcacaggagctacagtaaattgcacgcttcttccgtcaaattgcagttctaacttaactgttccaagatttttcttccataatagctttcgtggagtttttatctggtgaaatcgttttgcgtaatccgatagcaactgatcaactgaagcaggaacaacaaggtcttctatctgaattggtggccaaaaattagatgatattatagtggcatccaaaacatcatgagacacttctgcctcctcttgcccaggaacagtttgagatgacttcagcaaagatgttttaatgttcgaattggttctcttcgagtcaatcaagtcattaagcataatctcacacttctgcatgctgctctcaccaaatcggaccttcaggttgattcagacattcgcacattggaactcctgaagattcattttggtgagagcagcaagcataatctcacacttctg

SEQ ID NO: 21974 - DNA, 1137 bp, Zea mays
tacttaagataccaggtgaaggagcacgaggaatgacatgctccaaaagctatcttgctagacactggcgtactgaatgaaccatatgattgtccgcctgcaattgttctaattcagatcataagacttggacggatggctatcttgtgtgagcatggagaaaaacaacaatggctggtaggaggctacgtgatgtcgtcaaagctgtacttacaagtgacaacaggggcgaattcactcccattcatgttgttcttgcggagctaacaaatacatattcgcagtatattacaacttttgaagaatatgagatccaaagatacgagggagcatcgacgttgtatggcccccacacgttgagcgcctacattcaggagttccagaaacttgctacagccatggtggcaaacaaagaggtcccgacaaattttcagcccccagacatgttggacaagcaaataggactcctcccaggcgttgtgttcgactccacacctcctggggtggagttcggagatgtcagctcagacgtccccgcaagctcaactttcaggaagggcagtgtcgtgaacgctacattctactcggcgtgcccgaggaatgaccttctcacggacggcacgttcgcgctcgttgagaagctggacggcagcaacagctgggttcctgcctacgacgacgacgactggtcactacgcttcaagtggtccagaccttcgaagctgagcccgagaagctttgcgacgctggaatggaccgttcctgaagacgccccgtcgggcgtttataggttgaggcattttggtgcctccaaaccactgattgggtccatcaaacattttacggggacctctcgggcgttcgcagtgcgttaggtagcacaccgttgcgttgcgttgcgttcgacggcacacctgtcagagaatcgacaccgggtcatatacttactttgcatacctgccacagtatatggacatgttttccctatagtttttacatgctcctgatattaatataacgctgtccatctctcattctgtctggtcatgtcaaatactcaaatcgccatatagctacagactcgatgtgtgtgaaatgattagtaaacgggaaaaaaaaaaaaaaaaaaggccccta

SEQ ID NO: 21975 - DNA, 2776 bp, Zea mays
agcagcaactgaatcatccgaggaaggagggtggagggaggagggattttgccgatcacggcctgcagtcaatttgtcagtttattgagacatccaacttgcatgagttgatcaacaagcccatccctggttccttatggaggcatcatcttccttgcgcttccaagtttctcgttttagttcgttcaagatatggctatgcctttttctggtactcgttcttcagaactgcagcccagcactttcagattcaccatatttggtcggtatggggagctatgacataacagggccagcagcagacgttaacatgatgggatatgcaaatgctgagcagatcgcctctggaattcactttaggctaaaggctcgtgcctttatcgttgctgagcctaacggcaagcgtgtcgtgtttgtaaatcttgatgcttgcatggcatcacagcttgttactataaaggtgcttgaaaggcttaaagcaaggtatggagatctttataatgagaataatgtggctatcagtggaatccatacgcatgctggtcctggtggttatctgcagtatgtagtttatattgttacatcacttgggtttgttcgccaatcatttgatgtgattgtcaatggaattgagcaatgcattgttgaagctcacaacaatctccaccctgggaaaatctatgtgaacaaaggtgacatccttgatgccggtgtgaatcgcagcccaagtgcatacctaaataaccccgctgaagagagaggcaagtataagtacaatgttgataaagaaatgaccctcatcaagtttgtacatgacgagtctggtccgattgggagtttcaattggtttgcaactcatggaacatctatgagtcgtacaaattctttgataagtggtgataacaaaggagcagccgcgcgtttcatggaagattgggcagaacaaaatggcattccaaaacaggcagctcatgtaaatcacgatggtttggaatctttacacatgacctctcgacttccgagaagagtctccccaataattcctgaaccaaatgagataactgatgacttagtacaattggcgtcatcctacgaagcctcaggtggacggcgattatcaagttcaagtatcaccaagcgtatcagaagtacccaacagaacagacctaaatttgtttctgcattctgccagtcaaattgtggtgatgttagtccaaatgtcctgggaactttctgtatagacactggccttccttgtgacttcaatcacagcacatgcaatgggaagaatgaattatgctatggacgagggccaggatatcctgatgaatttgaaagtactcgtatcattggcaataggcaatttcaaaaggctgtagatctttttagttcagcttctgaagaaatacaaggcaaaattgactacaggcatacttacctagatttctcacaacttgaagtgaatgtccgtacaagcacaggaggtcagcaagttgtgaaaacatgcccagcagccatggggtttgcctttgccgctggaactacagatggtcctggagcttttgactttaaacaaggagatgtcaagggaaaccctttctggagattagtaagaaacttacttaagacaccagggaaggagcaagtcgaatgtcaagcaccaaaacctatcttgctagacactggtgaaatgaaggaaccatatgattgggcgcctgcaattcttccaattcagatcataagaatcggccagctggctatcttgtgtgttcctggagaattcacaacaatggctggcaggaggctacgtgatgccgtcaaagctgtacttacaagtgacaacagtggtgaatttaataacattcatgttgttcttgcggggctaacaaatacatattcgcagtatattacaacttttgaagaatatgagatccaaagatacgagggagcatcgacgttgtatggcccccacacgttgagcgcctacattcaggagttccagaaacttgctacagccatggtggcaaacaaagaggtcccgacaaattttcagcccccagacatgttggacaagcaaataggactcctcccaggcgttgtgttcgactccacacctcctggggtggagttcggagatgtcagctcagacgtccccgcaagctcaactttcaggaagggcagtgtcgtgaacgctacattctactcggcgtgcccgaggaatgaccttctcacggacggcacgttcgcgctcgttgagaagctggacggcagcaacagctgggttcctgcctacgacgacgacgactggtcactacgcttcaagtggtcgagaccgtcgaagctgagcccgagaagctttgcgacgctggaatggaccgttcctggagacgccccgtcgggcgtttataggttgaggcattttggtgcctccaaaccactgattgggtccatcaaacattttacagggacctctcgggcgttcgcagtgcgttaggttgcacaccgttgcgttgcgttcgacggcacacctgtcagagaatcgacaccgggtcatatatttactttgcatacctgccacagtatatggacatgttttccctatagtttttacatgctcctgatattaataacgctgtccatcgcccgttctgtttggtcatgacaaatacccaaatcgccatatagctacagactcgatgtgtgtgaaatttctatatattaaagcaggaaagaaatctgttctcagattcagccacgtcagcatttggctttacag

SEQ ID NO: 21976 - DNA, 1792 bp, Zea mays
ctgacattttttatttggatagaaagcaaccagcaatatctacaaacacagcccactaaacaaatatggaaatttaattgcacataaattgactcattattggcaaatgtaatgcattattgagaccagctcaatgattgaacaatataatcaattcaagcatacacaatattatcattgaagggcactgacagaaccaacaattccagccccaagagaaaaatgcaacaaactaccatcatgtagtacaagatatttttttctttgcttgggacattttattcctaaggtgatacttcagatgtcattgaacataaaaatgtacaagtaacatcacacagaggagtaagatgaacacagaaaacaagaatacaagactttgagagtagaaatacaagatgaaaatgatgaattgggccattcaatcaatagttccaaactactatacaaaattcccccaacatgatcaaataggtcgtgtttggagctaaagtgtgttggttggtggtcaacatgtactccctaggtattaggggcagcaagtatcagaaggcacagtgcccctaacaaatgtggcaaaaggcagaaatgtctactcattttcagcaaatataatgaataactgaaataatatgctcatatcaccagcccaacgcccccaatcaattcaaccatgcacatcactttatgcaagatgtaggcactcaccagatcagcactggcatccccaatgaaccaaacctaaactccaaaacaagcaacatcctagcattaaccccggacccgggaccccacagctagccaacgcgaatccacgtcacagtacccagtagttccccaccaatcgagcccaggatctgccaatgaggcacgcacacgcgactgagcatctacctactcgcgatcgggggaaatgatcgcaaatggaaatcggtgatattagcgaggtaggagaggtcaaaaggtcacgactcaccaggacgaagcagatgccgatgaaggccacgatgccgaaggcgaaggggtcggcgccgggcgggggcggctggcgcccgctcggctgctgctggaaacgcggcatcgacggcgacggcgacggcggcggcggcgagcggcgtctctgcgccgagtcggaggtgacgtcagacatcgcgaggagggtgggcgggggtcaccgggaaccgtaagcgaagtcggtcaggcttggtgccttggcaggtcacaggtggaacgggcgacgggagtggacgaaaccgcgaggaagacgaaggctggtgtgcggtgtgccactcgcccactcctggcgtggagtgttgcccgtgttgggtaattttggttcgagcgagtaaagtgtaggcctcttttggaatacggttttggattaggaagaacacaggaatagtaaaaatacatgaatacatgtgtaaagcagaaaaataaaaatataagaaaatttgttgaaattgtgttaggatgattgtaggaaactaggaaacacttacaaaacgggtcaaataacattgtgtgtcaagatccatatgagattctttatcaaggtaagctatttaattacacactaggtgagtgctcgtgcgttgcaacgggaacatataataccacaataacttatgtacagatgtgtgttatattattatgaaaaaagatttcataattcatttatggttctaggcatacataaattttattttttttaatctaactgtttcaccactacattacaaccaatcagtattatgcaaccttctaattatacatattctagataagttta

SEQ ID NO: 21977 - DNA, 1685 bp, Zea mays
agcagtggtaacaacgcagagtacttttttttttttttttttttttttttttggagtttttaagaaactaggaatctagtttctataaactgggatataatcagatatgtttgaaaccatttcagttttcataaaccagtttctaaaaaaatagatgctccaaacatgtcctaagtcagtgagcaaaactgtacatttttggcgaagaaaatttttgcatctaaatcttcaagagggtcctgatgagtcttttctggcttactgaggtactgaacggctcgtgggaatcctatctactgcgtggacggtgggatcacacacacaaaggtcttttgcttccaactcacggaacacgcttctacatctcataatggtccttcctaggagcagcatcaaggtagttcttgagcaacctttgatccatgatcatgttaggaatcttttcaccgaagaaaatctttgagttattggcgattgattcaatgaacctcagctcaagatactcaggtgtcagtttgagcctattggcctctgcttccttcaatatcctgtagtagtttgcatctgctactgctttctctcgtgcgaggtacatgtcattatcaatctgctcctgtcgcttggaactgtccttttccatcagcttctgctccatcaggatcttgctcacctgtgcgttcttctctgcttcagatagcgcaatcttcttctgtgtttctgcctccttctctgctaccttttgcttctccatggcgatcagtgcctttgtacgctcctcctccataagttcaaagtttcttctgatactaccaggtatatttggcttcgtaacacgaacactgatgatttcaattccaggagcatagcgtgtacagtctctttgaatagcttctttcattgtttcatcaatctgatcgaacatgtcaatgtaaacttgctgcaaactgtgagcactgcagaactgattaatctcatgatggattttatcatatatccatgtcttgtcatagtgcacaccatagttgagtagggtttcatgcacaaactctttgcgaaggcggttcacgacctctatcttgtcaaagctgatcataacaccaccttttgttccacaaggaatatctctgacctggtctgtttgaagtgtaacctgtattggctcgtactgggtgatcaaagggagcttcagatgaaaccctggaggagtgattgtcttcagaagagcacctcctctccagtacaccccaacatgtccttcaggaacttgatgtagaacacttgatgggactgagagtgaaaccaggacgaagcagatgccgatgaaggccacgatgccgaaggcgaaggggtcggcgccgggcgggggcggctggcgcccgctcggctgctgctggaaacgcggcatcgacggcgacggcgacggcggcggcggcgagcggcgtctctgcgccgagtcggaggtgacgtcagacatcgcgaggagggtgggcgggggtcaccgggaaccgtaagcgaagtcggtcaggcttggtgccttggcaggtcacaggtggaacgggcgacgggagtggacgaaaccgcgaggaagacgaaggctggtgtgcggtgtgccactcgcccactcctggcgtggagtgttgcccgtgttgggtaattttggttcgagcgagtaaagccaggtaccc

SEQ ID NO: 21978 - DNA, 2172 bp, Zea mays
cctctaaaagttcgagaggttatatagagcttttccatttaatatgggctatatatttgttttgatatatttattttttatgggtatttttttgtagggagactacatcaaagattagactatcttcagcaacttatacattctatttttttttatcacatatcatatgtgttttaagtatgtgttttaagtgactatatataagtaacttacgggtcatggtctttccagaccctcacatgtcgctcatccgttacactgttagtatgacctaacctactcctaccaatatgattttgtcgctcatccgttacactgttagtaggacctaacctactccaaccaatatgatttttgttgtctcaacacaaaagtattatactagtttcttagtaagcttgtgtggcaggcctataagacaggaaaggtagaggcgtacatcacatgagaaatctttaagtagaagcaccgagtgttctgcagtcgatcaggtggtgtgcaagaagcagaaaaattttttttttttttttcggggagcaaacttgcacatttatgatcgagaaaactttggcatcagcagtgctacaaattgttctgcccatcagtcaaaaattataacccagatccttttcaagagattacctgggtttggaggccagcggccttgaccatcagttttgaagactacaggatttgcactggttgcatcactgtcggtcacatgcgaatgctccaggtgccctaatgctgctactacacaaaacaagccaaagatctcatgactgctaatttcatcttcaagaggatcctgatgactcctttctggcttactagtatactggacggctacacggtaatcctatctactgcgtgggatcacacaaaaaagaaagacttctgcttccaacccacggaacccgcggctacatttcataatggtccttcctaggaacagcatcaaggtaattcttgagcaacctttgatccatgatcatgttaggaatcttttcaccaaagaaaatctttgagttgttggcaattgattcaatgaacctcagctccagatactcaggtgtcagtttgagcctatttgcctctgcttccttcaaaatcctgtagtagtttgcatctgctagtgctttctctcgtgccaggtacatttcattatcaatcttctcctgtctcttggaactgtccttctccatcagcttttgctccatcaggatcttgctcacctgcgcgttcttctctgcttcagatagcgcaatcttcttctgtgtttctgcctccttctctgctaccttttgcttctcgatggcgatcagtgcctttgtacgctcctcctccataagttcaaagtttcttctgatactaccaggtatatttggctttgtaacacgaacactgatgatttcaattccaggagcatagcgtgtacagtctctttgaatagcttctttcattgtttcatcaatctgatcaaacatgtcaatgtaaacttgctgcaaactgtgagcactgcagaactggttaatctcatgatgaattttgtcatatatccatgtcttgtcatagtgcacaccatagttgagtagggtttcatgcacaaactctttgcggaggcggtttacgacctctatcttgtcaaagctgatcataacaccaccttttgttccgcaaggaatatctctgacctggtctgtttgaagtgtaacctgtattggctcatactgtgtgattaaagggagcttcagatgaaaccctggaggggtgattgtcttcagaagagcacctcctctccagtataccccaacatgtccttcaggaacttgatgtagaacacttgatgggactgagagtgaaatcaagacgaagcagatggcgatgaaggcgaagacgccgaagacgaaggagtcggcgccgggctggggcggctggcgtccgctcggctgctgctggaagcgcggcatcgacggcgacggcgacggcgggggcggcgagcggcggctctgcgccgagtcagaggtgacgtcagacatctcgaggagggcgcgcgcggatcaccggaacccctaggcgagatcggtcacccccgcgccccttggcgggtggtgcgggcatacggggtgagcgaaaacggcgagtccccggccggcctcgagggacccaatg

SEQ ID NO: 21979 - DNA, 1991 bp, Zea mays
ttttattaaattttttttttttttttttttttttttttttggacgtcctgccgcccttttttttaactaataaattgttaacatttaataacctctattggatcgagctgtacatatgcatgcaaacgttttctctctgcagttacgtcagacggctgacacgtagggctaaccgctgccatcaatttgcaactagcttgaggattaaatttacatgtcgagtttaattcagctcacaaataatccgtttcaggaccattatttacacacagcaaaccagatcagccagtacagcttcgcctgagatagggtgaatgggggcggcagggcgcttcattcggtgcctccgccgtcatctgccgcagaagctttgcagactgggcaagcgttcttcacctgcagccatttcttgatgcagtctgcgtgatacttgtgattgcattttagcttcccgacagagtcctcgaatttgtaatcctccaggcaaattacacatcttgcgctctcattatcatcatgagtacgggcagagctgcagcagggtatctccgtcacacagcttgaaagtttttcatcagctaggcccgtgttgacattgcctattcgttctcccaaagccagcagctcctcataactcatatcatcaatgtccagcctcatgtcccagtgagggtcagaatcttctctcgattcatggataaataactgatttagcatcataaaacgctcggttgctggtcctctcaagttattttcttcaataaccagtggacgaaaagcatggtatgaatccctcagccttctactccttgcactaccactggaacctagagccacatgacctagatgtctcgaagatgcagcagcaccttcagcatgaacacttgctgctgctgctgctgctgaggtagcaggcggatagccagggacggcaggtcgatagcaagggatatcaggctcatgggtaactgtcactgagttgttaggagtcgcaaaagccggggcaggatatgtgctgatgctgttaggaggggctgctcttggggcatacccaccatgcacaaaatgtagactatcagaagaaccaggaggtgctaggacagggggggcatttatgttggtcctctgcggagcagagtagtatgtcccttccctgaaaaccatgctacagtttccatcgctgcctggggcagtcactcttggaggtatagaaaaatatgctctattttgtgcccccgcccgactttgaggaccaattacattagcatggtgtggtggcccatgagtgctgcttgttgcgcaagctacacctggattgtgtcccaaatggataggattgtgatcatggcgacctctcacattcctctgagatcctccattgctaccaaagggctgatcagtccagtagcttgaacccatatttgatgttattcgaggagggcagggttcaggagcaggaataggatttggaggcatgtagcatgggaactgaggattagatgaactgccagcataacagctcccattattgactccatccactggataaataattggatttctccgcttcagtgcaacccttctgtcatccatatgggaactcagaatgaagttatcatcagacctatgtggatagctcaaagcaggcagatgatgagtattatgtggtgcataggtgctactggagcttccagcaagaggatagccagaataggatgcaagcatggttccaggagcatcactgtgctgaatatgagattgcccggtgtgacttgagaatggaatgccatttggtcttattggtgcgcccacataacctgatggtagagctccatttgctgcatcagttctagaatgcataaataactttgggccaaaaggctgtgctcccctctggaacctgttcacatgatccatcctggaggcatgtgtgttattatgatgatgccctgccataacacatgaacagggggattgtatcccggccggcc

SEQ ID NO: 21980 - DNA, 1050 bp, Zea mays
tttttttttttttttttaaaatgcagaaaatttctcattgcaatcagctttattgtttctaccacatgaagattttagatttccatactggctagagcatttaacaagggcaagtataacttaacgacctttttcttgtagcacgatacaattaggtactatttgtttttttttctacttccgcatcaggagaactacggtatgagcagctatgctcctgttttcccctagactgtcaactttctcgtgcgttttggccttgagattgaccacagatggatctgccccaagtaggttgcacagattcaatctgattgtctccttgaacgggctaatttttggtttttgcaagatcagcgtagcatcaaggttgcccagctcgtagcctgcttcatgcatcaatttcacagcttccctcatgaacaccgaagaatcggcgcccttccaacgggggtcggaatccgggaaaatctgcccgatgtccggcagccccagcgcgccgagaatcgcgtccaccacgcagtgcagcagcacgtctccgtcagagtgagcctcgcagccgcggtcgtgggggatgtcgatgccgccgatgatgagcgggaggttgggctccaggcggtggaggtcgaagccgtggcccacgcggaacggtagcgcgggcggcttcggcgtcgcggccaccgcgggctggtgctccgcctggacggcggccgcgacggctggtgacggcctaggccggaggcgcatggagaacggctgcgcggagggagggaaggacccggcgctggctcgtggcgcagttgagatgggggaggaagccaggaagagggaggaggcgtagggcgcggtggccatggcgccgctgctggtggctggtgcttggtgggcgagatggcgcagtggccgagctttttttcgggatgctcggtgaagtggggagcgcgactgcgcgaggaggaagaggaaccgagaaatccttgcgtttttttttttgtgtgccggaattatttgcgccaagccgaagtgagcatctgcaactggagatcgcgg

SEQ ID NO: 21981 - DNA, 1031 bp, Zea mays
gtaccgggcccccccgcgcgcgctttttttttttttttgtgaaatacagaaaaattctcattgcaatcagctttattgtttctaccacatgaagattttccatactggctagatcactcaacaatcacaagtataagataacaaccttttccgtgtagcatgatacaattagctgccatttgttctttctactttcgcatcaggagaactacagtatgagcagctatgctcctgttctcccctagactgtcaactttctcgtgcgtcttggccttgagattgaccacagatggatctgccccaagtaggtcgcacaaattcgatcggattgtctccttgaatgggctaatttttggtttttgcaagatcagcgtagcatcaaggttgcccagctcgtagcctgcttcatgcatcaatttcacagcttccctcatgaacaccgaagaatcggcgcccttccaacgggggtcggagtccgggaaaatctggccgatgtctggcagccccagcgcgccgagaatcgcgtccaccacgcagtgcagcagcacgtcgccgtcagagtgagcctcgcagccgcggtcgtgggggatgttgatgccgccgatgatgagcgggaggtcgggctccaggcggtggaggtcgaagccgtggcccacgcggaacggtagcgcgggtggcttcggcgccgcggtcaacgcgggctggtgctccgcctggacggcggccgcggctgccggggacggcctcggccggagccgcagggatggctgggcggacggagggcagggcccggcgcggattcgtggcgcggtggagatgggggaggaagccaggaagagggaggaggcgtagggcgcggtggccatcgcgcgccgctgctggtgctggcttggtgggcgagatagcgcagtggccgagtattttttgggatgctcgggggagaggagaccgggagagcgcgaggacgaggaggaaccgagaaatccttgcgtttttaatgtgccggaattatttgcgccaaggcgaggagc

SEQ ID NO: 21982 - DNA, 6440 bp, Zea mays
  misc_feature (6409)..(6409): n is a, c, g, or t
ccgagcccaaacagcgggcttcgtgccgggctcgcgggcctcgtgcttattggacatctataccaacagtcataataaagaaaggctccaccatgcttccatgtcatggatccaaataaagagaaagggacacttgaaagctgtttgcttgcgcctttatatttgcttccattcaaatatatatatatatattatatgatatacgtataaataaatatatatacttgtctttcccgtccactcagtcatcggagcatcagattctgcttaaacaccaagcagtgtggagacaataaagctgcctagctagctatccttccccttcctatacatctctctctctctagctactagtgcaagagctagcgaacaatctttgcaacttgcatgctggctctttatctttatgtaactcatcgcctcataattagtatatataaatatttatatatataatcggctgcttagcacgtacacagctaatgatgtgtgttaagtcgagatcgcacttgtactccgttcgtcgtcgtcgtcgtcgttgcttcagttcaatcaattctaaggagcaggagcatgatgatgatgatctgctacgagtactttggagtcgtccttggtcgtccggccggcgggcggcccggcctcggcgagcatctgcacgacgtcggccatggtggggcggagtcccggcatgctgcaggtgcatcgcacggcgacgcgcagcgcctgcagcatctcctccttgtaggggctccacgcgagacgcttgtccagcgcgtccgcctcggctccggcgccggaggccaccttgccggagacccagtgcacgatgtccctcgtgtccccgaactccggctcgatgggcttcctccccgtggccagctccatgagcaccacgccgaagctgtacacgtcgcacttggtcgtcgccttggacgagtaggcgtactctgccatgccatccgtctaaaatttaaaaagcgaaagagagggaaaagaaatggttcatgcatgcatcatgcatgcatgtacttcccattcctacctggcgccaggtagccgtaggtgccggcgatggtggtggtggaggcgtctcggtcagcgccgccacgcccgcgcgcctggagcaccttggcgatgccgaagtcggcgaccttgggctcgaagtcggcgtcgaggaggatgttggaggacttgatgtcgcggtggacgatggggaagaggaggtcgtggtggaggtaggcgagcccctgcgccacgccgagcgccacgcggtggcgcgtcggccagtccagcagcaggtagcagccgtgcagcgcctcccataggttgccgttcggcatgtactcgtacaccagcaggttgcagtcggcgcccgagtagcagcagtagagcttcacgatgttcttgtgccggatgctgcccagcgtctccacctccgtgcggagctcgcggtcgcccagccatccgccgtcgctgtctccgctgttggtggtggtgctggtcaccgccgcccagtccacctgcttgctgctcggcccacgcagccgccgcttcgacgacacccacagcttcttcaccgccaccagctcgccgccgctgagctcgttcttgtacacggtcccggagccgccgtgccccacgatgttcttgtcgatcagcgcctccaggatctcgtgctggtcgaagctcagcttatggaagctcgtcacgtcgtacgactcgctcgacgccggagacgacgacgccagccccttgtcctgccccgcgtaccgccgcgcccgcagcacccaccgccgcgccagcgccagcgtcgccacggcgcacgccagcgcgcacacgcccaccacccacacgtccccggccagcccgcgccgcaggctcggccgcgggcacagcggcagcgccgggtccgtcaggttcagccggaacgccacgcacagccccgggttccccgccacgctctccagcaggccctccttgatgagctgcagcggcacagggcccgacaggttgttgctggagaagtccagcgagtttggaagcagcttgcacagcgactccgggatctcgccggacagcgcgttgtccgacaggttgagcacgttcagcgtcctgagccccgcgagcgtctccgggatggacccgttcagcaggttcccctgcagggacagctggttgagcctcgacagcaggcccacggactccgggatgggcccggcgatgaggttgttgctcaggtcgaccttcaccagcccccacgcgccggcgatctccggcggcagctcgccggacatccggttgttggacgcgaacagcgacgtcaggttcgcggcgcccgctaccgtggccgccacggcgccggtgaagtggttgtagctgaggtcgaggatggaggcgtgcgggaggccgaagatgcccggcggcacgtcgccctccaggtggttgttgctcacccggaaccggagcagcggcgtgcactcggcgtacgccggcgggatgggcccggtcagcaggttgctgagcaccaggatgtactggaggtggccgttggcgcaggcgtacggcggcagcggccccgtcagctggttctccgacacctcgatgacgttgaggtccgagtagcggccgaggtcggcggggatcccgccggtgagctggttgcggtacagggagaggatgcgcagctgcgtggagttgccgagcacggccgggatggggcccgtgaggcggttggtgtagagctggagcacgcgcaagccgcgcagcgcgcacagcgactccgggatgggccccgtgaggcggttctcggacaggtcgatgtcagtgagctgcgtgaggttggcgagctcggcggggacgccgccctccagctcgttgtagtagagctccaggaaccgcaggttcgtgaggcgcgccagcgactccgggatgcggccggtgaggaagttgccgctgagctccaggtcggtgagcgacgtcatgttgccgaaccacgcggggacgccgccgcgcatggaggtggtggagaggatgagcacgcggacgcgccgcagcggcaggaacagcgactcggccggccgccacacgtcgaacccggggttctcgttgaggttcaccacctccaggctggtgacgttggcgacggacgtcgggaacgcgccggtgaagaggttgttggacaggtcgagcacccgcagcgcgcgcagcggggacaggtcgcggggcacggcgccagacacgccggagaagctgaggttgagcacctccagggaggtgcagttgagcacgcccagcgggaacccgccgcggacgtcgttgcacgccatccggagctcccggagcgcggggagcgccgcgcagacgcccggcgggagccggccgacgaggcgccacgacgtgacgtcgatgcccgtgacgttgcccgacgggtcgcaggcgacgccgcggaagctgcagtagtccggcgccggcgacgtgaagtcccaccacctcgacatgcccggccccgggaactcttccttcatcttggcgaggtaggcagcctgcgtgtccagctccagtgccgccgcgcgaccgccatcatcgccggacgcgaaggagaggacgatggcgaagagaaggaagcagggcaagggtggaggtgagcaaagagtggacaccatagcaccgtacccacccaacagctgacccaaactcagaagaggaggaagaagaagaagaagaactgtattgtatgagcaagccttttctttcttgtgcctgcaaagctagctttgttgttgaaaggaacctttgttgcaagcgcgaaacggaatggggtgttatggaaaatggtgaggaggagctatcaggaagggagagagagtatatgagtggagtgggaatctgttgccgaactggtgaatggcgacgaaataaaggagagatgcatggcttttgccgttggggatatatgccctcctgcccccagctgctgctcagtgctcattcagtcatttgccaatcaaaactaaactgattggtacaggtaacttcagcacagtgcactacactagaagtaaaccatgcttttcttttcacatatacatgaaacagtcagtggtcaatgagaagagtacaaacaccatcatgcaagtatatcggtatctactattgcatccagcagcacagtattgattcaatacatggccggccgtcagtcagtatttgttgtctgctgaaacctgatatcactagtagtcagtatatgatcactcacactgtcacacaacgagtcggtcagtcgtgaagtcacagcccctgctgtgaattgtgaactgaagacgctagctagtgaaggcataaaggacagtgcagcagaactgcagatcagcttgcaagcagaagcagcagcagcagcaaacagtgcaagtgtgcaactgctaatcctgcgatcttcatggggaacaaggacaaagcctgcctctagtggacgccaatcccaaccaataattgctcacactttaggagggtcagcagcaagctgaaacctgaaagcctcttccctctcctaaaaagcagcgagtcagagcagcaaataataattaaaaaacacacacacacacacagcgagtgagtgagcgctgctcgatcagctgcagatacttcttcagtagtggcctcaatgatgccatgctttacctgccagtagcttgttcgcaatgtgtgtgtgcatacgccaatctgcatcttttttcccctgttcagccagctcggtgcttagcagtctagtacctgaaccagtactttagtttgctgtattatattctcttaattaatggagcaaaatgccacgcctgctgataattgctatgcaaacagtgagcttgggtttggctgaagaccccgtcagtcaacattattcagtcccgacctgggataactaagaactttcaaatggaattttaggcagctccccattactagcgctagctaatgcaaccgtaggctaatgcaaccgtaggcctttcttttaaaaaaaaaaagaagaaagaaagaaagaaatgccacgggagtggaatgcacgcgtgtgctccgatgttttccacttcaatttccaccagcgccgttttggatagcaccgaataaaaacctccatccttattgtactgaccaaaaaaaatgtcctcgaaagaacagcatgaacataggagaagtcacaaatttcagtttcttttttatttatgagttcctcaataaaaaaaaggaatgaatatttaagaacaatacccgctcgctccgttccaaaataaaatatattttacctctttagtcgattcatacaataattaatatatttgtttatatatgtgtgtttatatttatcgtcatccattcgattattgatatagaaatcgagagttaaaaacgactaatattttagaacgtatagaatataatttcagtggaggtggtggtgggtccccgtggaggaatccatggcggataacgagctgtggcgggagaggtggtggtgatgcatagatgctcactcaaaaggggtcgtgcacttgccattataaataaaaataaaatgcaactcacccagctggtggcatgagaaaggagaccgttgcaagtccaaccaatctttttttgcacatgcatgcagtcacgcatcatcatgtgtttttcggctctccagtattggccaacagcgttgttagccaaccgttgtaagaaagagtgcgtaataacgcacggttcgccacatatgcaaggaaatagggctgatcgggcccgataactcgattggtctgtctccgattttcccatctatctgagaattttctcacgtttacattttaggctacacacgagtccttgtagcctgataaaaaagagcagggttgattatcctcaggcagtttatattgttgtaatgcagtttttagggtttaaaatttcaaacatggcttgattcatatgcgcaaccacggacgtagggcccaatatcgctcagtattgtttgagcaataccatagcctagcacaagaaaggatcaacaataaaaaaattctaatgtccgtctgttcacttgtgtgctcccgtactccccctctaccgagctccaccgccaagcgagtcgctgacgcattgtcaccggtcacggccatcgtgtcgctggcgcagcgctggagaacggccacccaagctctgcgtcgggccgccataactttatggcctattttgcgtccgctctagccgtcggacacacgtacgcactccccctctaggctccggcccactatcgagccaccgacgctcctgtcctatcgagctccggccaaggctgctggtcgagctctaccccgcgtggtcgcgctttctcctacgtcgaggctgagcttgtcccgactcctgttgnttccggtcagccacataggtcgtgctccacc

SEQ ID NO: 21983 - DNA, 742 bp, Zea mays
atctcctttgcgcatgcacaggaaacactagggagtgcagggcacacggcactttctacaaaactcaataaaatttcggagcaatttcaacacatgacgctgtagtaccgccaccggagcaatacacctcacaaatgcatcaataccgtcatatacatacacagcactcaccatctgctaaccgttcgactgtacaaaactccagtcttccggctaggtcctatccatattgctcgttcaagatattctgctgcttcctctcctgagctagacgacgctctttattcaacttcagagctcttcctttctcttctccggatctgaacattttcttttcggtggctgacatgttttcagtacgatcaattttgatgtcaaagacctcatgcagcaaatcgttgtcctgtgaatgcttcaggaatccccgcccaagaaaccgcctcatatagttcaactgtatcgattcacgccatgatgtaactcttaaaatgccattcttgcctgaaatcctaagtgattcttcagggcactcaccactcttaataaaatctgagattcgttggaacaggtctctctgatcattaagatttttcttgtcagcacccctgccccccgcctccatagatagactatagactagaccagatagttgggccttcaatgcttgcatattcaagaaaagttgatgattagaaccaccagactctctagcgtaactgtcaacatcaagcttcgtcactag

SEQ ID NO: 21984 - DNA, 512 bp, Zea mays
  misc_feature (415)..(415): n is a, c, g, or t
aaaacgacgacagagtgctacatatgcgcgccgtgccaatttttagaaacatttgtgcgctgctgctactgctactggtctgatctgatgatcattcatcatcaacaggtaggtagtaataatcctcagctcagctgcatgtcgtgaagtcgcacatgagccttgtccgcccgccgccgcgcacagcgactgcgggtcccagttgagcgcccggaacaccagctgcagcaccgtctcgtccatgatgcccgcgttgacaccccggacccgcgccgcattgccgcctccttcttcccaggggccgtcggcgccagcgctctctcccgcattgccgccgccggcaccgccaccgttcagccgcttgatggtcagggcactctcgctcatccctgcgcgcccatcaacctcacgcttnaccgcgtgcgcgttgcgactactgactagtgactcatgatgagcagcagctcacttgcctaactagcgctcgctcggtcggtggccaataacagcgt

SEQ ID NO: 21985 - DNA, 2081 bp, Zea mays
aaaaaagctcaggacgaacgagagcgaacgcatttcgaaatctcttgcagaccaattattgcggctagaggaagagttcgccaattattgcccttaggctagacgacctctgtgttattcacaatcacctcatatctctaccctatggaactgtacaattgtgattaactgaactcaagatctcctttgcgcatgcagaggaaacactagggagtgcacagggcacacggcactttctacaaaactcaataatatttcggagcaatttcaacacatgacgctgtacatgcctctgctcctcggtatgcaaaactgtgttgtagtaccgccaccggagcaatacacctcacaaatgcatcaataccgtcatacacacacacagcactcaccatctggtaacagttcgactgtacaaaactccagtcttccgggtaggttctatccatattgctcgttcaagatattctgctgcttcctctcctgagctagacgacgctctttattcaacttcagagctcttcctttctcttctccggatctgaacattttcttttcggtggctgacatgttttcagtacgatcaattttgatgtcaaagacctcatgcagcaaatcgttgtcctgtgaatgcttcaggaatccccgcccaagaaaccgcctcatatagttcaactgtattgattcacgccatgatgtaactcttaaaatgccattcttgcctgaaatcctaagtgattcttcagggcactcaccactcttaataaaatctgagattcgttggaacaggtctctctgatcattaagatttttcttgtcagcacccctgccccccgcctccatagatagtctatagactagaccagatagtttggccttcaatgcttgcatattcaagaaaagttgatgcttagaaccaccagcctctctagtgtaactgtcaacatcagcttcgtcactagaagaaacatcaaacagtcttagctcaaaacacagagctaatgcttcaccagcagcaatccgcacagcacggtcctctgcttctagaaggctacagagaaatgtaattggctctttccaagaatcagtatttcttctagatgaaccaatagttgttaaaagaaatgcccatgcagatacggcagctgctaacaaaggaggcttcggttttctgactacgccgacatttgatcctgattttggatggatcacatcccagatggctttcagagacagctgagtttcagcaagatcagttgcaccaaccaaatgtgacaactgctaagcaatcaagtgcagagatcatctttgtgcgtcaggccaagtttggagaactctcaaaagatgtggatgtgactcatccattatttcgtgcgaactacttccagcacctagtgtaattgccagtaagccaatgcagcgacaagccagacacacctcttttacagatccccttttaattgaattgatgaactggctcaatagtgtgacatatttgttttccactaaaccaagaagcacaaaactttcaaaagcatcggtaagagagcccaatgcttcctctcttgtggatcccctcttctcatagagagcgtcgacgtacttgtcaagaacgaattcctgcgagctaatatgctctgtggcctgcgcgaactgaaggtcagacagcccactggacatggaggtcacgctatcggcatcgccaccaccgtcaagcttgtcatcggcaccaccaccacctcgaccgcccttgttcctcttactcttgcccatggagacgtctgggcggtccaggaagcgaagaggccaagaaccagccggtgatcaggcgcaggcgtagcggcgcgcggtcagcggtggatccgacagagggaggcgtcgtcggagggggcggcgaggaggaaccgggaggaagagctggagctggagttggaggtggagaaacggaggcgcgcgccgtcgttgaggtcggattggccgtggagacgccgagccatgtgagattgggcgacggtgaggggcggatgaacggagcaaggaagaggagacttttctggcttcccggcgcccccccgttccccatg

SEQ ID NO: 21986 - DNA, 1665 bp, Zea mays
ggcatgctccccaggctgttcgtgcgggaccgtcacgtgggcggcgcgtagaacgtgctgcgcctgaacgaggagggcctcctggcggggctgctggagggcctgcccagggcgcgcggaggggcctactgctgcgacggatgcggcggcatgaggttcctgccctgcttcgactgctcggggagccgcaagctggctgtcgcgcttcccgtggtggcctcctcgcggaagaaagcagggaccgtggtggtgcgatgcggggagtgcaacgagaatggactcgtgctctgcccaatctgctcctgaataaaacgacgacagaggcaatctggatcgaatttgctacatatgcgctccgtgcaatttttagaaacatttgctgcgctactgctactggtctgattgatgatcatcatcaacaggtagtaataatcaacaagtacatgatcctcagctgcatgtcgtgaagtcgcacatgagccttgtccgcccgccgccgcccgcgttggccctgcggaaccgcgcgccctccaggagcaccctctgcccggagctgaggagcgcgccgttcatgtggtccatgacgctggccgtggtcgggtacaggaagggacccccgggggcgttgtagtaggcgttgagcagcgccgccgtggcctcccggagcagcgtgcggtacatgtcgccgcgcccctccagcgcctccccgagcgtcagctccgacccgtaccgctgcgccgccaggggcccgaacgccatggccaccgtcgtgttcggggtcactaccttccagtggcagcggtgctccggcgacgaccacatgtcgtaggtgcaggcggaggagccctgcgatgctgccgtcgttggaggcggcggcggcggctgcaatgtttgtggtagtggctttcgccagacgggcggcaggaaccttgacctccggcgccagaagaagggcggcgaggaagaaggcgaagccggcgccggcgcctgcgcctgcgcctgcgcctgcgaagatggcctgccccgcctgaacctgtcgtggtcgtgccccggacagaagtccatggcctcctccggttgcgagagcagcggcggcacggtgtagagcgagaggcccagcatgcggaaggcgagggtgagctcgcgcggcacgcgccgccacctgatgacgacgcggcgccgcagtggcccgtcccctggacgacgcgcgccgtgcagcggttcatgtccggggagccctccatgcggacggagaagccgccgaaccagttggtgttgctctcccgcaccgtcagcggggtgtcgccgccgccgcactggatggccacgcgggcgccgtagagcgggtagtcgaagagtcccctggcgccgtccttgcactgatcgcagaacaccatgccggccaccaccgtgctggccatggccggcaccgccaccgcggcgaattccagcagcagcagggtcagtagtagcctgctggtgttgatgaccatcatatgacgcggctccttcaccatatatataatatatgcagcacaagcagagcagacgatcgttgttgatgctttgccagcaaaactcagatgtgtatatatatagagagagagagagctgaactagctagctcaaaggtatagtagtaagtagctcgctttgcgtgacgcg

SEQ ID NO: 21987 - DNA, 549 bp, Zea mays
ccgcctgaacctcgcgggccggccccggacagaagtccatggcctcctccggttgcgagagcagcggcggcacggtgtagagcgagaggcccagcatgcggaaggcgagggtgagctcgcgcggcacgcgccgccacctgatgacgacgcggcgccgcagtggcccgtcccctggacgacgcgcgccgtgcagcggttcatgtccggggagccctccatgcggacggagaagccgccgaaccagttggtgttgctctcccgcaccgtcagcggggtgtcgccgccgccgcactggatggccacgcgggcgccgtagagcgggtagtcgaagagtcccctggcgccgtccttgcactgatcgcagaacaccatgccggccaccaccgtgctggccatggccggcacgccaccgcggcgaattcagcagcagcagggtcagtagtagcctgctgctgctggtgttgatgaccatcatatgacgcggctccttcaccatatatatatatgcagcacaagcagagcagacgatcgttgttgatgctttttttg

SEQ ID NO: 21988 - DNA, 1245 bp, Zea mays
ttttttttttttttttcgactcgaatacggatcggatttcagccttcttagatagatcaaatgtgaatacgggcagataatatttgtaccatttacaccccttataaacacgatgacaatggcataagaagagaaacaagatccaactgtgtgtgttccagttcaaaaggagaaagaaccatggtttactcagttctctactcaattccactgtgcataaaggccctcctgctatcctggcaactgccgtttcagcagtggttcgggtttcagcatgcagtttactccatagtccatactgcagactgaagcaaacaaactactgaagagcaaccaaaacaaccagttatcccacagacacaatcttcggctgttgccatatagttatagtccacagatgttcagctgttgccatgtaacatactaactccacagatgttagactgcgaaaaggattaggaaccatgcagcattcaacaacactaatgtctagctcctacaaacaaattcacaagaatgatgcaatcagaatggatattatatatcatgcccaacgccttcctccgatacgccttgcaagttgtatgtccttttgcatgattgtgacacgcttggcatggatggcacacagattcgccatttcaaacagttctatcaagtggaattctgctgcctcttgcagcgcaaggagggcttctgcggtatagcgctctactttcccgtttgttacgaaattggttaactccctcaccacacggacgaaaggcgcaaaggggatgagcggttcagtggacttctggtacttcctgatctcccgcagcgctacagtccctggccgccagcggtggcgtggtttcgtcttcttaactgagtcacctccagacgccgctcttcccccggtcccagcagccctttcctgcattccatcaaacagcttgcaagcaagtaagagcagcccacaaaaaaggcaaaaggagggaactgatccccgcacgcacgcgctcaccggcgtcgccgaggtactcgcaccacctgagcgctcgaactggagcttcttcttgggcttctccgccgtcttcctcacggcctggtgcttggttcgagccatcgcggtgggcgcctcgcactgctctcgtggccgacggtttcgattcagaactctcgggacgggagggcgtgtcgacggtgagtctttttttaagggggcaggagatggtgaaatgaaaagaggtgcagcgttattat

SEQ ID NO: 21989 - DNA, 1160 bp, Zea mays
agatagatcaaatttgaatacgggcagataatatttgtaccatttacaccccttataaacacgatgacaatggcataagaagagaaacaagatccaactgtgtgtgttccagttcaaaaggagaaagaaccatggtttactcagttctctactcaattccactgtgcataaaggccctcctgctatcctggcaactgccgtttcagcagtggttcgggtttcagcatgcagtttactccatagtccatactgcagactgaagcaaactttctcctgaagagcaaccaaaccaaccagttatcccacagacacaatcttcggctgttgccatatagttatagtccacagatgttcagctgttgccatgtaacatactaactccacagatgttagactgcgaaaaggattaggaaccatgcagcattcaacaacactaatgtctagctcctacaaacaaattcacaagaatgatgcaatcagaatggatattatatatcatgcccaacgccttcctccgatacgccttgcaagttgtatgtccttttgcatgattgtgacacgcttggcatggatggcacacagattcgccatttcaaacagttctatcaagtggaattctgctgcctcttgcagcgcaaggagggcttctgcggtatagcgctctactttcccgtttgttacgaaattggttaactccctcaccacacggacgaaaggcgcaaaggggatgagcggttcagtggacttctggtacttcctgatctcccgcagcgctacagtccctggccgccagcggtggcgtggtttcgtcttcttaactgagtcacctccagacgccgctcttcccccggtcccagcagccctttccggcgtcgccgaggtactcgcaccacctgagcgctcgaactggagcttcttcttgggcttctccgccgtcttcctcacggcctggtgcttggttcgagccatcgcggtgggcgcctcgcactgctctcgtggccgacggtttcgattcagaactctcgggacgggagggcgtgtcgacggtgagtcttttttttaagggggcaggagatggtgaaaggaggagaggtgcagcgttattatggtgagcagtgagcactgaccccactggtgtggtgtctcccggcacggccggc

SEQ ID NO: 21990 - DNA, 2887 bp, Zea mays
cccgcccggccagcggcaaacccaaaattaggacgcgccgcttcttctgtctactaccccaccatccaaaaccccactccggcctccgccgtcatttcctctccccgccaatccgccaccatttccagttccgaccgacctcgaaaccctagcccccagaccatcccactcgcaaccgccatgccggacctcccctgcgacggcgatggcgtctgtatggtctgccgcgtcgcatccccgccggaggtcgacctcctcacctgctccacctgcaccacgccctggcactctccgtgcctctccaagccccccgccctcgccgacgccgccagctggagctgccccgactgctcccccgactccgctgccgtcgccgctccctcgggccccgccaacaccctggtcgccgccatccgcgccatcgaggctgaccacacactctccgaccaggagaaggcgcgccgccgccaggccctcctcaccggcgacgcccccgacggcgcggacgacgatgacgacgaagcgtccgacgatgcccttgagatcgtcggcaagaacttcagctgcgttttctgcatgaagctccctgaacgacccgtcacgacaccctgtggccataacttctgcttgaaatgcttccagaagtggattcaaaatcagaagaggacgtgtgggaaatgtcgggcgcagatcccggccaaaatggctgagcagccaagaatcaactccgcactagtcgaagttatcaggatggctaagatttcaaagaatcctaactctgctggctcagcagttccatatcactatctacgaaatgatgataggcctgataaggcctttacaactgacagggctaagagggctggaaaagcaaacgcatcaagtggccagatctttgtgactattgcacctgatcattttggccccattcttgcagaaaatgacccccgcaggaatatgggtgttcgagtcggggaaacatgggaagaccgacttgagtgcaggcaatggggtgctcactttcctcatgtggctggcattgctggccagtctacgcatggtgctcaatcagtagccctctcaggagggtatgaagatgatgaagaccatggagagtggtttctttacaccggaagcggtgggagggatctaagtggtaacaagcggacaaacaaggaacagtcatctgatcagaaatttgagaagctgaatgctgctttacgcattagttgcttaaagggctaccctgttagggttgtacggtatactttcttttgccatatttacacataaaacagcgaggtttgccatgtttcctgtgttgtctttccttgtctatttgcttgtttctggaattcttaaatattgatgttcttgggtgttttgacagtcgtctatatatgcttcgtgtcctccaattgctggacctttgtctcactatattgtcttaaaaggtcgcacaaagagaagcggtcctcatatgctcctgaatctggtgtgaggtacgacggggtttacaggattgagaagtgctggaggaagattggtattcagggtaagttcaaggtctgcaggtatctctttgtacgctgtgacaatgaaccagctccttggaccagtgacgatcacggtgaccgtccaagaccattgccaaagataaaggagctgcaaggtgcaactgatataacagagaggaaagggcgcccttcatgggattatgatgataaagatggctggaaatgggtggtgcctccgccagtcagcaggaagcctgttctatctggggatcctgagaccgacaagcaaatccgtagagcaacaaagcgtgttcatttgtctgttgctgaaaggctgcttaaagaatttgcttgttcgatatgccgggcggtgattaaagaaccacttacgactccatgtgcccacaacttttgcaagacttgtttgcttggggcatatgatagccagtcttctataagggaaagaagccgtggtggtcggactctaagggcacagaagattgtgaagacgtgcccttcttgcccaactgacatctgtgattttttagagaatccccagatcaaccgagaaatgatggagctgattgagactttgcaacgcaaggctgttgaagaagccaagatgacttcagatgatgctgaggaatgtggtgatggtgattcggaggaaaatgatggtgatttggtgaagggagaggatgttagtggtttgaatgagggagagcaagacagtgcagacgctgatgctaatgttgaaggttctgtgaagattgtggttgaaatcaaggaggaaggaaaagatgataaaaggtcaaagatgggcgcgactgaagtggtggatgtgttagttgatgaagatgctgtgaagcagacgaaaaagcgcaaggttgatgctgaggctggcaccaacggtggcaagaggatgaagagcagtagtaccgtggaagaggttgctgtgtgcgtcactcctgtgaaacggagcaggaagagtggtgatatggatgatgagcgcaacggcagtcctgctgtgagcagcggccgcagggtgactcgcagcagtgtggatgacactggatctgctgatagtccggcgaggaggactagaagccgtgccagagctgatgctggttgctgaaggggtagaggaagcggggaggcggcagaaccgcagaagccagccgtgtcttttttgggtggttgtacgtacatatactgggagccttgccttatattttggttgaggggtgcaagtcagatactgtttgctgtgcacacctgtttcttttggtttgggagaccgattgctgcttcctggatgctaagcgttcatccaagacccttaaaacattcaattcaaatcggacgcgggg

SEQ ID NO: 21991 - DNA, 1210 bp, Zea mays
  misc_feature (1196)..(1196): n is a, c, g, or t
gatgttgttacattcatccacgaaaatgttttcataacatgtaattccttttatacaaaggatcatagtgatggggtcaccctatagattgtgcaaatgcgaaccatcgtttggatcagagggtcatgcagtattaaactatgaaatgttaatgttggttggatagtagaacaaacacagcaattagacgggaagcaaaatgcaatactgtacatgagacgttgtaattttcaaaaagagagagagaatcacatctattcgacgaggaaaaatggaaagctatccccattatcttgcacctagttgagggcatccagtgggaaggggcaaatccaagttctcgacgaccctgaatgtccttgctaccatcttgtcaacatacagcgtgccttcaagatgatcacattcatgctggaggatgcgcgcttgccatcctgaagcccgtaccttcatggtgctcccattccggtccagacctgaaacttcaacgtccagatgccgctccacgaccgccctgtatccatcaacactgagacatccctcaaagaacagcgcggttcttttactcgtgctcttaatctttggattgataatgaccgacgagaagatcaaaggggcggcggtcttgtgcttcgatgtccttcttgggtgcatagctgatgtactcctgcgtatcctcgagaacaataatcctgagcgggacgccgatctgcggggcggcgaggccgacgcctggggccctgcgcatgacgtcgaccatccggtcgatgacgccctgcaccttctcggacagcacgtcccccggcgccacctcctgcgcgggctcgtgcaggacggggtcgccggccttcacggttcccggcgtcaccatcatcgccgtggacgcgccgccgcccttgccgcccagcagcccggatagccagcccccgccggcgtccgccctcacgcttctccaccgcctgccgccgacggaactagcggagactgaggaaccagtgagtggcgtggcgggggcgaggagtaaggtggcggcggcggagagtggacggaggagcccaaccatcttcttcacgtagcttagctaccagctacggcggcgggcaggatggagtgggtgactgggtgattgcgacgtggcaagtgggctgggctttccgatataactgggttggaggcccaacaaaatccttcatgtnccccggacgctggg

SEQ ID NO: 21992 - DNA, 2084 bp, Zea mays
  misc_feature (2054)..(2056): n is a, c, g, or t
ctcataaccacctatgacattgtcaggaacaactacaagctcataagaggcaactcctactacaacagcaatgatgatgatgatgaggaaggaactttgtggaattacgtaattcttgatgagggacatctaataaaaaataataagacacaaagggcccaaagtttgtacgaaataccttgtgcccatcgcattgtgatcagtggaacacctattcaaaataacttgaaggaaatgtggactctgttcaatttctgttgcccagatgtcttgggtgataaacagcagttcaaaataaggtatgaaacggctatccttcgaggaaatgacaaaaatgctaccgctcgagagaagcacgtaggctcaaatgtagcaaaggaactaagagagcgaatcaagccatactttttgcggcgcctgaaaagtgaagttgtctttgatactggtgcatcagaagaaaaaacattagccaagaagaatgagctaattgtctggctgaagttaacaccatgccagaggaaactatatgaagcttttctaaatagtgagctggttcatttagcattgcagccaaaggcatcaccgttggctgcaatcacaatattgaagaaaatatgtgatcatccactgctattaactaagaaaggtgctgagggtgtgttggaaggaatgggtgaaatgttgaatgatcaagacattggaatggtggaaaaaatggccatgaaccttgcagatatggctcatgatgataatgcactggaagttggtcaggatgtctcatgcaagctatcattcatcatgtccttgttgcggaaccttgttggagaggggcatcatgttttaatattttcacagactcgtaaaatgctaaaccttattcaggaagctataatattagagggctatgcgtttttgcgcattgatggcaccaccaaggtttctgaccgggaaaggattgtgaaggacttccaagagggttgtggagctccagtttttctgctaaccacacaagttggtgggcttggacttacactcaccaaggcaactcgtgtcattgtagttgatcctgcatggaaccctagtacagacaatcaaagtgttgatcgtgcttaccgaattggacagactaaaaatgtgattgtataccgcttgatgacatctgcgaccattgaagaaaagatatacaaattgcaggttttgaagggcgctctgttcaggacagctacggagcaaaaagagcaaacacgttacttcagcaagagtgagattcaagagctatttagtttgccacaacaaggatttgatgtttccctcacacataagcagttgcaagaagagcatggtcaacaagttgttctggatgagtccttgaggaagcatatacagtttctggagcaacaaggaatagccggtgtgagtcatcacagcctcctattctctaaaactgcaaccctgcccactctgagtgagaatgatgcactggacagcaaacctcggggcatgcccatgatgccccagcaatattacaagggatcctcatctgactatgtcgccaacggggcatcttttgcgctgaagccaaaggatgaaagtttcactgttcgaaactacattccaagtaacagaagcgcagagagtcctgaagagataaaggcaagaatcaaccggctttcacagaccctctccaacgctgtgctgttgtcgaagctaccagatggtggtgagaagataaggaggcagataaatgagctggacgagaagctgacttctgctgagaaggggctgaaggaggggggcactgaagtgatttccttggatgactgatccaagacatggagagtctgtgctcggcaaaagtaaagtgttttgaatagctttagtcactgggttgtgactagcatcaatcaagtctgctctttttgctgcatctctgggctgggtctatcgtttatgcaatacaatgctttttctgatgatgattatatgaataatataatccccagacaaagcagcaaccattacagtcaaaaaaaaaaaaaaaaaagccgcccgannnctctagagcgaccgcgggccctcgttgg

SEQ ID NO: 21993 - DNA, 1073 bp, Zea mays
  misc_feature (57)..(65): n is a, c, g, or t
tcatctgaactggtaccaaataccataattacattactttggttcgtagggtacacnnnnnnnnnctggtcggtgtgaaaatgtgctgcatatttacgaaggtagcagcaccacagcataagaactgcgaacacacctgcactcttcagatgtactactgattcctttacaaaatgaacacatttcccattcttctgattccttccttgttccggaacattttttttttttttttaaaggaaacctcgttcatttatttgcttctgaatccaaggcgatttcaaattctcaatcttcagcagtacatgttctgcctacctcaatggttccatctcttggtattgtagtttacagtaagattttgaacagaaatgatcgctaatgccataatgtgacataagcgcaaacaaaacacttgcacaaatcccctcgactatcaagattcatcggacctgggaggaagctgagcagaacctggcagtggtgacatcatcacagcatgcttgtacatccgccaccaattctccgatgcctcatcgaccgtccggtaggtccagatatgtggtttggccttctcccgcgcgatgaggatctcctccacctctgccttccgctttgtcttgagagcgaggcagcccataagatcgccccacttgccgaagcaggtgtcgaactccccataccggtaataattctgcatctggtggaatggtgagtaacagaaccagagcatatcaaagcattttatgcagtccagccgtggtgttggtggactgctcgatacatttggcttctctttcggatccataatccttgcggcgggacggatccgggcgctcacgggcagagaacggccacagcgccgcctcccccctcctgcggcggcgtagatccgacgtccgggcgcgtcgccggcgcagatccggcggctgggcggtgcgctgtacgggtcccacgatggtgcgattccctgtgcctttgggtgatgtgtcctttttccctccaggcttgttaacgaaactgaattgttaatgagccaactcgatcttcccggccggctcgaggtaccaatg

SEQ ID NO: 21994 - DNA, 2310 bp, Zea mays
ggccgcttttttttttttttttcgccaaggcactattttagcatatattcaaccattacaaaaacagctggagctgccgaactcagttttttttttgtcacaataagggattcaattttttaattcgaatgcaaacatgttacacttagatttggggcttgtttgagatcttgctggagacgaaaaaatcactacgcgggacaatctttgcacattgcagggatttgttttatacgacgtacagatatgggagaagttagttttgagtacaacatgaatttactttaccttgccttgcagggattaatcctagatcaaactcatcttctggtacagaggatacaaacaaggaactgctttgctagcttcttccaaacaattctgcatgctatgccaatcgttctgtctctgtctctctctctaataacaatgacaagaatctcaagtagcagttcaatcaatctgtgcatgctatggagtatgaacaagaatcaattttgatggaaagttagtcggcggtgagagtgagacattcgagcaccctggcccctgtcaggctggcaatttgcccaggtcagctacgttgttagattatagtatacgtgtgcatgcatggccaggtcaggtgccgaggtgttgctgcagcttgctcagatcagacgccgttggatctcgggctggcgccgccgtgttgtgtgtcgacgttgacgtacttgccccagaaccagtggcggctccagacgaggttcatctcctcgatgggcacccccttggtctccggcaggaagagggcgatgaaggtggtcatgatgaacatccacccggcgaagaagtagaagagcccgaacttgagcgagcacagcatgctgaggaaggcctggccgatgatgaaggtgagcagcatgttgacgcacacggcgatgctctgccccgccgaccggacctccagcgcgaacacctccgaggggacgagccagcccagcggcccccacgaccaggcgaacccggcgacgtagaggcagatgaagagcaccagcagccaggcgttggagcgggacatctcgcccacgccggcggtgccgaactggagcgcgatcagcgtgcccaccacgatctgggagacgaacatctgcgtaccgccctgcaggaacagcgcgcgccggcccaggcggtccacgcacacgatggacaccacggtggcgaacatgttgaccagccccgtgatgacggccgccatcagcgacgcgtcgtcgccgaagccgatggtcaggaacagcaccggcgcgtagaacatgatcacgttgatgcccgtcagctgctggaagaaggggatcagcgctgccaccgtcagctgcggccggtacctgcgctccaggatgttgcgccacgggtgctcgatggcgttcgcctcctcgctcgccgccaccatgtcgtcgtactcgtcctgcacgtcgtccgtgccgcggatcttcaccagcaccgccttggcgtcgtcgttgaacccgcgggcgataagggagttgggcgtgtcggggagcaccagcgcgcccagggtgatgatgagcgccggcacgcccgcgagccccagcccgatgcgccagccccacccgccctcgatgcccgccgtccagaagttgatcaggttcgccgccaggatgccgatggtggtcatcagctggaacccgatgttgagcatgccgcgcagcttcgccggcgccatctccgacaggtacagcggcaccgactggttggcgaagccgacgcccacgcccagcaggatgcggcccatgatgagcatcatcacgtcggtggcggcgccgttcagcgccgacccggccaggaaggtcaccccgccgcagaacatggaccacttgcgcccgaacacccgcgtcacggacgccgccacgaacgacgtcgccagcgccgccaggtacagcgacgacgtgaacagcgtcagcagctggctgtcgaacttgcagtactggttcgtgtccttgttcgccgccgccttggcgtacacggaagggaagaactccttgaggaacgacgccatggacgtgacaccgccggagatgccgatgtcgtacccgaagatgaggccgcccgatgacgccaccaggcaggtgaagaacacgaacggcgtcatgcggccggggtacgtcttgcccccggccgcgttcaccaccacgccgcctgccattgccgcgggcgcgggcggacagctggggcaatggcaacgcgagaaacaacacgagacgacgaggaacggcgggcgcgcggggtggcctgcaggtccctcccggccggcgg

SEQ ID NO: 21995 - DNA, 1094 bp, Zea mays
gtctagaagtactctcgagtttttttttttttttttttgccaacgaactgagaggctcactttatatataatgcatcaagtcaaagcagaaaatttcaaaagcaatgaccacaaggttgcttccttcttttaaccccaaaatcacaggcacttgccttggacttctacgaagtccaccaaaaataaaaggcattttctgacgagttttggatagaagactcgccaggcccaaaatatgatttggaggtcgtgcggcccgcccttcagggttacttcaccatagttacaccaacccagaattactcgattcatttcatggcaacaaaagtgtcgatgacggtccttcctgcaaaggccaccttcagcagtagaacatgaactgcttgacactctccatcactttcggcagctgcttcaccggaacagcgccatctttcatgcgagagctcgccactgaagacgacccctggtcggagaggtcatcgtccatgtagtggcgcgcacggaaggccgccaggtgtgcatagtacgccgggggaactatagagactgatcgagtgcatcgcgcatacgtgtagcacagtttgtaggtcaacgtttgcagtgcatcggcagtgaatttgttttcgtcaaacagaacatggtagtgtgctggccggctcgttccctgtatgccagagtggctacaaaggtagaagtcgaattcacttggatggcatatcttcgtgtcaacaacagttcctggcaaaatgtttccacttcgatccatctgtccgtgtgcatgatgatcttcagggaaaagccgtgtgtgatggcgcttttgcaccacaatgaatgtaattggaggaaggtagccctcttccaagctggcacacgcctttcgaattgcatccacgtcactcagctaggccatggctaacaaaagagaataatattgtgaagaaaaccacctttcgaattgcatccacttcataaagcaagacctggctaaactgcccctcactgacaccatctcgatagaaaattatcctgcttggtttgcggctcccgtttgccttatagaatgacacgagtagttccctgatcattgtcgt

SEQ ID NO: 21996 - DNA, 771 bp, Zea mays
  misc_feature (6)..(6): n is a, c, g, or t
  misc_feature (18)..(18): n is a, c, g, or t
  misc_feature (748)..(748): n is a, c, g, or t
cctatngttattactggnaacagaacccatacagcatgcacatatttccatcagttatcagacatatataacacaagcatataggacattcatggaagttcacacgaactaaaattgttcacagaagtccacacaaattgaaactggaacaagttcacagaactacaaggtggcgaccaatacaagttcacggaagtacaagaaactaattcatcctacattgcagcagtttccttagtgtcaacttctttttaagcatacaaacacctaaaccttcacttgggctcacttggctagatgtagcctaaacttcgttggtactgccttgcactgctaatgcctgccacccttcaactactactgcctgcatcacttgtgctgcttcaccttgtgtaacctgaacttcagtactcgacacagttgaggatggacatccacttattgaaaatagcacaagacgactacatggaaactatcatatactggttgtgatggttcttgtgatggttcctgtgaaggctcgtttgctccagcatctttttaggtcatttgccaatctccaccacactaagaggggacttcaacaaaacttcttccctccacctgaagaaatgaagcacatctgcaacttgatcagcgagatcagcaacagatggcaccggcgcatctgacgacattgcagctgctcccatctcgtgccctcctggcactgggatgggaaccaagtggacacaaaccactcgcaagnatctgaacgctggtaactctcgt

SEQ ID NO: 21997 - DNA, 1090 bp, Zea mays
  misc_feature (23)..(23): n is a, c, g, or t
  misc_feature (35)..(35): n is a, c, g, or t
  misc_feature (68)..(68): n is a, c, g, or t
gaaaagatcagttatgatctctnccctatgacctngagaagacaccaagcacctgtactttgcaactngtggccaatccattgatgcaacgaccgctgcaatagacggggatgcatcttcccctggagctgggtgggtaacatcagctccaaagataattgtaggtaaatctgttaacaaatgtattctcctatttaaagcatcttcgagaactgtattacggccaccaaccttaacattaattttaagagccaggttttggagatattgtcggccacctttaaaaacattcttaggttgacaacattgagttactaaaccaagttcagtttcacaaagacgctttatcctaccataaaagacacttgcatttgcatctggtaatacaacaattagtaaatcaagctgtctagtcacgccttgttgggcaagcatttgtgaagattgtctatgagtatttctgagtgcagcttctaagttatctgggcgggcttgcccaacatcaacacaaggtctcccatttatttgcatgcccatatcattgcacgccccaaccaagttgttgcaaaacatgcggacgtcatttggatgcaagcgagaagcaaaagtcacacaagcccaatactgaatggatactccatcgatcaatctcttgttgttcatgttccactgaccaacggaaggactacacaccttttctcgtccagagtcatggtacttaagcgtcggagctggcagcacacgtgcatcaaccaaggcaagttcatttgtcaccttaataccaaattctttggcacaatgatcattaccatagttgttcctgttaactacctctaaaatgctgccctccctttgagttggtcgctcacatgccatcttcaggatgcttgtgacttggcgctcatttagcttcctagaatagcgttgaccgtcaagtatactgcaaacctccattggtaaataagtcggcctgctatcattgccagattgaagggggggggggggggactagtgaaaactgtaattatattggtgtttaaagtattggacaactgaaacacttgccccatcttgattaaacgttaaacta

SEQ ID NO: 21998 - DNA, 4578 bp, Zea mays
gtctcctatcacaacgatagtttcctatttacttctactcggctttcatcaactagcactatattgtctacaaaaagcatacatcaaggggtatccccttgtatgcccttgtaaccttattcatcaccaagcaaaaagaggtcagggctcaaagctaatacttaatgtagtcctattctaatcgcaaagtcatatgtgtccacatcacttgttcaaacactaatcacaatattgttgtacatgttgttaataagtctaacatgctccgttggaactttatgtttttttaaaaacccatcacataacatttcttggtattttatcataagacttctttaagtcaatgaaaataatgtgtaggttcttctgcttcctatattgttgcatcacttgtcctattaggaaaatggcttccataattcatctttcagacacgaaaccaaattggttcaaagtgatctcgttatgtcccaatggggtccattcgggtttcatctctattagaatttctaagtttaatgttagctcgccaactctatcataacccacctacttcagggcttggagcctgctatgtcgagacaacttagacggagttgactagtacacatacattctgaaaaaaaaatcataacaagtattttagcatataacaatatagcaacattgcacttcttgtattgcacttggggataaatcctggtcctaatgtacaagtcttctgtaggttttagataagtgccaacagaagaaaacagtcagtgcccttcctggactacttgaatcaccaggtgagtatgacactgtcgtctggaaccaatcggatattccatctatgtcaaattataagtcattccaccttcctagaaagtcaaactaccttaactttgatcaaatatatataataaaataataattattatgataataaataaataaccttatattcttcattaatcatattttattgttgatgttttaaatctttgtgattctttatataattttagtcaaatttgagatgctttaacttctaaaaaacataagataacttataatgtaaaattgatggagtacaattctgtcagaactgcatagcactgagagctccctgaatgctaatcatcctgacattttgagtgagtgatgacggcaagaactggagcggcggccaacgacagctcttctgccttgcgcgtgttctcctccgaaggaacaagatactagtccttgacgaggcgacagcatccatcgactcaggcaccgacgccatcctgcagggggggtgggggggggggggtcatcgagaaagaattatctggctgcacagtcatcaccatagcgcacagggttccaactgtcacggacattgacatggtcatggtcctttcctacggtaagcactaagcactcctcctaaccatcctggttgagagttgagacacattcactgacaaagtagagcctttctggagtatcgccaagttgatgtaataggtttctgccatatctgcaggcaagatggtcgagtacagcgcgccatcggttctgatggaagataagaactctgcattttgtaagcttgtcgatgagtactggtccaactataactgaatttgcaaggaaatcaaataggtatgtatgtcaagcactttgtgatccagaaacaacaggtgctgttgcgctttacaacgacaagttttgtcgccatgaaatttgaacatctgaaaccctggagatggattcttattgttcctgtcaaagtactttgagatttacatttgtgctgaaagccggcgactacacaaactaattgaacaaagacacatcctggttacccgttacctccactacagggtccctcttatacccttttttttgtgatgtacatgatatataggttatctccaacaggaatggccatttgccatgttatacaactgcaagaggattctaagacaggtagcctgcctttcattctggttcaaaaggcttgcttgccagtgctacaaactgataccaacccgggtctttatcggcttcagcttcacacccatactctcaggagacagcagctcaggcgatatacagcatgggctcagtggactgcgagggctgctgcttagctgatacggcctgtagagcccgtatcccatgaggaagtactccattggcatcaccatcgcgtggggctgctcctcggtcacaagggagccacagtcctgcacctgcagttaactaactcgtctgagcatccgcctttgttccagacatgtttctatcaggagatggcatcacacatatacacccagacacattacctcaactaacgcgcagtatctgcggtccagttttgtggccatgtggatagcatcctcgtggaactgtgagctctccccgacgaagatcagcgtgcggcattgcagcttctttaacgaatctgttaagtcatgcctcctggtggagaggaaacccgtatgagcatcaaggttccagagatgaattctctcgttaaaaaaaataaaaaaaaataaacgaatagcaacatactcgtttattgagtgaagaaaccgccagatattttcgccctgcttgtcatcaagtaactgcatataaaaatcaacagtaagcaaccactagtattatacaaccaagaaaatatacaaactgaaaaaaagagagggaggctaacacttctactggctcgcactatgtcggattcaggacactgtgcatccccacgcagcttctgcagactcatatcagtgcgtcagttaatggaaacaatagactacgggtcccaagaaaacaagacgagaatattgagatcttaaccaaccttgctaaagtaccgttgaagcaagcactccttgaccaggccttgattcccgtagtaataaagcaaatttaataacacctgttgtatgatctgtcattattagtactcattagcattagagagaaaacggtaagttgtcactgatagatgtaagttactttattatacagccactcgctccacgacggggacttgcacagaggggaaaccagcatcaatcctattaccctctcccggtatttcgtctattgaagagtataaaatccttgttaactcaacataggatagtgattttgtatcaagttacaagtctgaatgaagtgtgagaacataccgcaaagagagtgagaacatacgcaccagcggtgacaccaaggcacatcacagatcctaaactgaatgaagtgtgactaaaatcagatccatggggttaccgaatgagtagctttcaagaatgaagaagccatgcattaggactacaatgccatgccacaacacagtacctgaagaaatcaagcacatctgcgacttgatcagcgagatcatcaacagatggcaccggcacatctgacgacattggagctgctcccatctgtaggactcttaacaaaagccacacagcaaagatcatgtaagtaaccaactcgaaatacagacgcagcacaccttgtcacagggattgaaccagcatcactgacctcgtgtccctggggattgatgtggtagacacagaagttgtgtagcagcaaagacgccacttccgggcagaagaaaaatgcttggaaacaggacaggtctgcccaagccaattgggaacagcgagatataaacaatgttcagtcatgccagttatcagtgaatcagaaaaaaaaaatcctcgatcgacagcacttacagttcagagctacatccgggtacgttataagcgctggcttgtcctcgtctccgtacacggcaacggttacagaaccacttctcgtcctcacaagatgatcctggggaagaagaagaaaaagtagtcaccttttagcagctatttcagcggcactgaccacacccaagccaaaaagaagaacagaaaaaaaaatgagagaacagcatggaagtggaacagacaaagtttggcagatttcggatgactcccataataacagatgaacacattgaccaaatacaggtagcagtttcaagaacaaacattagaattccggcatgttcatcgtataacacaagcacatagctataaaaatgaaatgaacattgcagaattctgtgcacctgtggttgacagagaagacaaaaagacagcaaaactttcgggttacaaaaaaatcatcaccgaaaagcgaaagcgtttgacgacatgacagacgaaaacgtattactatataaataaattgagtttcaccgaaccagtgatctctatctctctaagcagaatgaaaaggctagactctacacaacaacacataaagaaaccaaactcagttcaattgccatctaataaactaactgaaatcaaccagtacaaaaaaaaaaaacagaaccgcgcggcccaaaattgaaagccagagcggaaaaggcatctccatctggaacggaagcacgaaaagagccacatgtcgtcggaccttgccgccgaaaggagatccgctcgacgtccaccgacacggaaccggagccgcttgattccgcctttgctccttccgcgaccccccggacccgcccttcttcggctc

SEQ ID NO: 21999 - DNA, 2238 bp, Zea mays
ttttttatagtgtattcccgtttttccagattttccatttcaaaagatcagacagcgtttgcgtaaattttcgcacgtaaacagccacagaaatttctcatcatttatacaagtagaggtctaaaggacctgaaccacatgtacagctcaaattgagcaaagcccaaaaagaaaaggataggaaaacaaataaattggaaccaagaataaacataatttcgaaggtcatttatacaaacggcatcaatagtccacgagagcagcaaagtgtaacggtctaacggttccacttcactcattactcggacatgatatagttgagcatcgaagcgattttcgctgtcttataatcatcccggagctgaatgaacctcaaggcatcctttcggatgctgggggttccttcaaacagggatgctaaactttctggagcaacaatgaagacgttcgccacaattcccaacagttcgaacttctcatctatggagggggcattgaagctacgaacgaaatccccatattcagttatgtcacgtttcaaccgtaggccaccactgggactaaatgtgaacttctgccaatgattaagcagccccttatgcaagcgatttcccagctcagtcaaaaaggactgtttgttgaggccttcaagggcactgaatgcaacctcaagaacacgagagagataggctacaattcttatacaagcattagttggccgatgatctggtgcagctccatcatctggtgttcgataatctgtagccttctgttccgaagacaacaatctttcaacctcagacataacagtatcaatacattgtagcagtcctttgtgagcagcagcctcaactactgatactgctgaccccatatcttcacaagcagacggatgagcaccatcaacaggtagcaagagccgagatatggtatttgagaagtactgctgaagaatagctacgctactggtacaacgctgcacagcaatcataaaggatctaaagctgctctcaccagctgaagctgccacctcttgtgcagaagcagcagcagctgccactctcctactaacacttgtcccgatgacatatctatcccgcaaagctgcggcctcatttaaactctctctagcacggtcaagcccttcagttaagtattggctcacttgatcaagcaagcatgcaaatatggatctcacgttagctgcaacagtagtaggctgagaaaacagtagtgtgcatctggttatggcttcctcattccagcgaacaaattccgttactacagtaacagatatctgttgctgtggtgatgtggtcaaagatgctccttttgcacgtccgattgagccagtagactcagattgttgcttagcctcagctctcagttcagccatctttgactgaaatagctgcctgagtgatgcctgctcaaattctgtgtactcatctttgtgggcaacatatatggattcagtaagaccttcaatatccaaatccccacaaccaatagactgcaaatccttagccagttcttttgttttgtcatatgcaactgccagaattcttaggtattgtagaaggcctccttcgagaggaggcaaactagcaagagagggctttactataattctgtcaagaatggtcgttaccctttgttctagcactcgctggacaagaattgccatgacctcattcggagaaggaaagacagccgttattgtagctgcctctttcctcacagtatctgcaatttccttatacaatgtagagagaccatctgcaatactgtcgcaatcagcttgcaacccctcatcacccagaacaacttgaatatcagtgttcatgatttccacatcaataaacattggtcgtattgcaacatagtgttgcatagcactggttccccggttgaactgtgacaatattttagcacattctgccattgtagacaactcccgtctctgtgatgcagcatcaaaccgagccagtagtcgattctccaattcattacaatattcttggagatttgcaacagcaacctccaaaccacggcttgcattagcagagcctacagctgatgacacgccatgtctaccaacatcctcctcagcaaatgaccgcaatttctgtgcaattgaagcagcctcagcaacacgactgtcatcagaaaataaaggagaagtgtgggggtgtggggtgtggccgccgtatcgggggcggacgggacgaggaatgc

SEQ ID NO: 22000 - DNA, 1356 bp, Zea mays
gatcaaaaaggaggtcgattttttttttttttttcgaacatgggaaacaaacaactgagtctgaataactggaattcaaaattctgccgatacaatacaaaagtagcatctggcacactatataaaaaaaacatcgtagtagctagcagccgttcaatatgctaaggtatgctcgtcgtcctacagtgtccaggaaagccaaggaataactgcagggaattgggctatccacgaaccggctactgcaagggagcatcaggatccaatcttttctggattgcagctgcagcctgaaaattgcccaacctgtattggtagttcatttcttcgcgtagacgggcctgctccttcatgtcttgagccagtccagcttgcatagagcgttttaaagcttccacttcttcctcctttcggcgctcacgctccttcaacaattctagtcgtcgctgttcctcatcattaaatacagtgcgttctgtcacaatcatttttaaacccttctttttctctttctccattgctttgtgatggtaagcatctaaattataatatttttttgatggaaacgtggctgtattgtgatcctccatgaattccttgaacatttgcttctcttcccaatttgacaatgcctccaaattaacctgcttgacttctgatagccatgcagtgaactctggtcgcttgctccacatatcgagctcacggatgatgccatatttcccccacgagttggtcacagcgcccttcttccccaaattcttcttcccctccttcctcttcttctccttcttcctcctctccctctccttctccttctccttcctctttctcctctccttctccttcttcctccgccttctctcctcatcctccctctccttcctcctcttgcgccgccgcctccgcctctcctcctccgaatccaactccgactcgctctcagactccacgctggaccccgagtacgacgactcggactccgactctgacgacgagcccgagctctcactgttcctgcggcgccggcgcctgtgccggcgctctttctcctttctacgccgtttccgtcgctcgctggagtcctctccggaggactcgctctcctcctcctcctctcgccgcttggacttgccgcggtggtcccggttccggctcccctttgagcggtcgttgcattcggcgtcaagcgacttgctgccgctgcgcgccgcctcatcctcctcggcggatcgaccatcacggggcgacccagaggccggcatggcgtcgcgaacctagggtttcgcgccgcggaggcgagatggaagtgagagacagatcggctcgcgacggtgccgcaattggtggccgcct

SEQ ID NO: 22001 - DNA, 948 bp, Zea mays
tctcggtccaaccgtgcacacctcgggaccatttccttcgttcggtcgttcccctactatcctcctcgcgttcatctcgcccgtacgccgacgctgccgcctggctcgcaccgccagccggcagtgcctcagtccagatcaagcctccctcttcccagatcgggtcctagttgggctaccgcagccctacgccaggtgccgagtccctcgccgatttcttcgccggcgaagagtgcccaccagatccgcccctgatggacaacgtcgagtctgcccctgactcgccggcgcaggcgccgccgtcatccgcctcttctctccccaaggagcaatcgcaggtggagttggagctgaggctgcttcaggctcttgagttctaccctccatcaaaactcaaaggcattcaccggcattttgttctctacggcctcatggaatatttgcgaaaaagccttgaccgacagttctcttctgacgaagttctacaactcttggaccgcttctttaacctagaaatgctgaaaccagaggatgatgagaaggataacttccgtcagggcgaagaattttcgttgccagagagttttctcaacaaggaagaataatatctagtaacctcgtactttgggcgtcctctggaagagaaatcagaacgctggttcttagtgattccctctttcttgtagcattgtcatctggaacatcggctgcggggagacactgaacactgaagtaaagaaacacatttcctaagctgtggttgtgtttactgactgtacagctagctttgtagactagtgtaatcgaaaatcggttgaattgtgtggttgcctggagcgtgaacaaaaagcaaggaggggcaattacaaaagctgctgctgttttacctatcaaacttctctgatcatgactataggtgcagttctataaagcatccatgattccatg

SEQ ID NO: 22002 - DNA, 744 bp, Zea mays
aaggcaacgagatcagtcggagaacttcaactgcggcacaggtgcgtacacatcttagatgagagatagagagcatgttttatattgtaactatatagatagaactaaaatgaacataaaatattataaaaatcgaacggttctactagttaagattggcctaatatgctacgacttcccgcacatcgggagtctcaacaaacacactaccgtctgatcgtttccacccctccgtctccccttaactttccagcttcacttgcagcggatctgaagccggcttcagatcgtttccagctccgtctccctcttccaccggagctggtgccggtgccggtgcttcttgagtgccttccttctgggaaagcgtctcctccttcagtctagtcacctctaactccttggcttctagctcctcttgcaggatggccaccagttcgtttgatctctccacgtcattcgtcacgccgtccatgtgcttatacaaaacatcgaattgattccggagctcgttgttctgcgacttcagaacggcgattttcatcccgagctcatggatttttccttccgatgccatcgccccaatctcttcgttttcctcttgcagtgttctgcatttagccatcagcatttttcccagtttgctggatggagtgaaattgacagcagcaacattgtcctgtagctcctttatttttttctctttctcctccacaagattttttaagcgtgtaaattcctcag

SEQ ID NO: 22003 - DNA, 1689 bp, Zea mays
tttttttttttttttttttttttttcgggtctcactaaccaatattacatatttatttcaaaagaaatactaataatacagaaattgtctcaaagaaacaatacaattacaaaagaaaatttgtatgaactgcaactttttgtgatgctgatatctatatcatgctctattttaggcaacgcaactcaagaaatagaattgaattagctggttgactatagcaatggtcctagaacaaatttcatagactatacgcatatggaagaaccactatgggagcttatgctgaggaacaggataacatttctttcctaggcctatagaacttctctctgtatgaccgaccgactagatctacatttatcctggttggctggcactacagtctcatgtacaagtgagtccacacgggccaatcggcgttgctcagcgtgaactaccattcagcttcggagactcagatgccgcgtatccataagggctcttgctagcccagttccacaggtctccgcacatttctgtgatgccatatttcgctttccagtggagctctctctctgcttttgccggcgatgaaaagagaatctcagcatcaccaggacgccgttggcccatgatcaaagggattttctttccagaagccttctcaaatgcattgactatctccaacactgatgttccttttccggttccaaggttgtatgcttcacatcctatgttagatgagctttcaaaaagcttctttaatgcgaaaagatgtccttcagcaaggtcaaccacatgaatataatcacgaacccctgtcccatcctttgttgcgtagttatttccaaatattgttagcgatggcctcctgccaactgcaatttgctgaacgaagggcataaggttgttaggagttccacatgggtcttcaccaaggtatccactggggtgagccccaactggattaaagtacctaagcaaaatgatattccattcaggatctgaatggtagatatcacggcatatctcctctgccataagtttggttctgccatatgggttatgtggagtgagaggaaaatcttcagtgcagggtgagttcttaggtgacccataaactgcagctgatgatgagaacactaacttcttacatccatgagctgccattacttccagaagatttattgtgccaacaacattatggtcataataaagcaaaggcttttgtacactttctccaacagctttcagtccagcaaaatgaataacagcatcaaatcttgttgaagcaaaaaccttttccaatccatctttgtcacggatatcaaccttgtggaacgcgaggtttttggcgtgttccaccgcgagcgagcgcaggcggcggatcacgagctcggaggagttggcgaggctgtcgacgacgacgacccggaagcccgcggtgagcagctgcagcacggcgtggctgccgatgtatcccgccccgcccgtcacaagcaccgccctgctgctcggccccgcctccttcgccacagacatctcctccaccccccgcgaggccgcgaccctccctcctctctctctctctctctactggcccggtgcttgcggatctgcgggacgaaacgacaaccaagtgtccaaaactgcgaatggtaggggaggaggcgtggacgagagggggtcagggggaggcgaggaaat

SEQ ID NO: 22004 - DNA, 1435 bp, Zea mays
tttttttttttttttgcagtgtagtattagtgtattgcgtacataggtagctcgtcacatacacgaaaagctccagccagccagccctcccaaataaatagataaagataaaaatcagacgtttctggcatgctcccctctttcaacaagcatatgcatggtacgacctacaagtgaatgtctcgacgcccaacaattattttcttgcctttttacacaccttacgttcgaggatcacagtcagcacatccatcgatcgaccttgccaatcgatgatcaatctactgtacagttgagtgccatgccacaataatctggatccagaatggagtaggcttcccaaagatgtaaggaatgcccaccaatttgactagctttgacatagtctacagatgttcaatttagaatgtgcattcctataacaaaacaagaatcatgctgctgcagatcgcttattgtcggggtcttctatgttcagggcctgcagtaacttcggccatgattcgggtatcccaccaggcagattgaactccagcagtttcccacgtgctctgtagaactcctccactggttcagtcaaatcatggtacacacgcagccgctcttttaccacttcttcagtatcgtctgctctagcaatcagcttcgattcacactgtggaggaggcaacagtgggggcatgtacattcgaggcccgccgtcttcaccctcaatatcaatggaggccacattgaagttccctccacactggctgcacatcctcctgccaaggcatttcgcaagcagagcttcttctcggagtttgagattgatcaccaaatcaatgtctgtgactccttcaagtatctccgcttgtcctatggttcgaggaaagccatcaaggatgaaccccaattcacccttttcctctccctcttccagacgtcttgacagcagatttatgatgatctcatcagacaccagttttccatgattgacaatctcagcaagcttgttggagaaggggccaggggtggccagggcgtcgcggacgaggtcgccggtggcgatgtgcgggacgccgagcagctgcgagaggcggctggcgtaggtgcccttccccaccccggggcacccgaggaacacccactgcacgcgcctcccgtcctcctgatcccgccccatgcgcccgggcgccgccgccctcacccgcgccgccgcctccttcggcagcgccggccccgaagcagcggtcagggttcgccgggacgcggcggcgaagttgcggatcgcgcgagacatccccgccatctcgccggctcggctcgggacgagcagggccgcagagatatttcttgggtttttcttccttttgtcgtgcgttcgtgacttgcgtgttgcgtgttttgagttcgacttcgagtcttcgccacccacgagagagggagagagaga

SEQ ID NO: 22005 - DNA, 1245 bp, Zea mays
gtctcgacgcccaacaattattttcttgcctttttacacaccttacgttcgaggatcacagtcagcacatccatcgatcgaccttgccaatcgatgatcaatctactgtacagttgagtgccatgccacaataatctggatccagaatggagtaggcttcccaaagatgtaaggaatgcccaccaatttgactagctttgacatagtctacagatgttcaatttagaatgtgcattcctataacaaaacaagaatcatgctgctgcagatcgcttattgtcggggtcttctatgttcagggcctgcaataacttcggccatgattcgggtatcccaccaggcagattgaactccagcagtttcccacgtgctctgtagaactcctccactggttcagtcaaatcatggtacacacgcagccgctcttttaccacttcttcagtatcgtctgctctagcaatcagcttcgattcacactgtggaggaggcaacagtgggggcatgtacattcgaggcccgccgtcttcaccctcaatatcaatggaggccacattgaagttccctccacactggctgcacatcctcctgccaaggcatttcgcaagcagagcttcttctcggagtttgagattgatcaccaaatcaatgtctgtgactccttcaagtatctccgcttgtcctatggttcgaggaaagccatcaaggatgaaccccaattcacccttttcctctccctcttccagacgtcttgacagcagatttatgatgatctcatcagacaccagttttccatgattgacaatctcagcaagcttgttggagaaggggccaggggtggccagggcgtcgcggacgaggtcgccggtggcgatgtgcgggacgccgagcagctgcgagaggcggctggcgtaggtgcccttccccaccccggggcacccgaggaacacccactgcacgcgcctcccgtcctcctgatcccgccccatgcgcccgggcgccgccgccctcacccgcgcccccgccgccgccgcctccttcggcagcgccggccccgaagcagcggtcagggttcgccgggacgcggcggcgaagttgcggatcgcgcgagacatccccgccatctcgccggctcggctcgggacgagcagggccgcagagatatttcttgggtttttcttccttttgtcgtgcgttcgtgactgagttcttgccgggtttgagttcgacttggggccgacgcgtggg

SEQ ID NO: 22006 - DNA, 1295 bp, Zea mays
gagcacaccaatctgatttggttgctacttgttactgctggagttcctcgcccctttttcgcccgttctttttttttttttttgttcgaaattgtgcacaactatatgttctaaattccagtcaataacttcgtatggctaccaaacttggttgagatctatccctggagaagttgcttcacattacactcatgactcgtcttaggacgaatcctgcagctgcaaaacacagaaaatctggccaagacctatttatctatttacaggtaagaggaggccatgctgcgcacatctgtcggcatgaaggccagtacaaccagcaagacgagcaggcagaccggcagccacaacagcagcgacggcggcggcggcaggggaggcagcaccagcggcagtatcagcagcgagacggtgaggcaggcgagcacgaggaacgccccgatgctgaagtaggtggacgcgatgaccttcttgtcgaggaaatccgcctcctgctgacgctgctgcagatgccgcttcacggcattcctcctttgtattgccgcccctccttccatcgcgctagatcggcttgccatgtgttctttggtgtaggtggaggtggagaccagtcgcagtgagtggttgccaaagtaagcaagaagtgaaaggcggtgtgagaacgccttgtgttttctgaacgttttgtaatcagatctgagctccggtggtcgaatcgcccgtcccctgcttcagaagaactgcccctaaagccagaacatcttaaatcccgaacctcgcattgttctccggtcctcactgttcaaccacgcctgaagaaacacgttctcccctttctcttgctccagtaggaaggcaagaatccctctttaatccctccagatcaagaaagatatctcaagaacggtggcagcggtggcagcagcagacccctcaaaggctcggattcagccaccagcaacgccgccggacgggacaccaacagccggggtgcgcggaagaaaacagagagcgcagatgggaggtgcggagggagcagaggggggatccggtgatagcgaagctgatatctcccgtgacgacgccgactcgactcctggctgcagctcctgctcccggggggaaggatggagatggaaacgggaactgggggaaactggagagagattgagcatgatgacgggcaggggggaggacgagtggtcaattttatgagtgggggattcgcagcacggtttcaaatctcggaggtcggaggacggaggaagaagagggacggatacattgcatcaagt

SEQ ID NO: 22007 - DNA, 1337 bp, Zea mays
aagactgaaagcgtaattttagatcaataaaaatagaggggagcacacaattctgatttgggtgctacttgctactgctggagttactcgcacgtgctcggcccgctctccactacaagatatgttcgaaattgtgcacaactatttgttctaaattccaggcaataacttcgtatggctaccaaacttggttgagatctatccctggagaagttgcttcacattacactcatgactcgtcttaggacgaatcctgcagctgcaaaacacagaaaatctggccaagacctatttatctatttacaggtaagaggaggccatgctgcgcacatctgtcggcatgaaggccagtacaaccagcaagacgagcaggcagaccggcagccacaacagcagcgacggcggcggcggcaggggaggcagcaccagcggcagtatcagcagcgagacggtgaggcaggcgagcacgaggaacgccccgatgctgaagtaggtggacgcgatgaccttcttgtcgaggaaatccgcctcctgctgacgctgctgcagatgccgcttcacggcattcctcctttgtattgccgcccctccttccatcgcgctagatcggcttgccatgtgttctttggtgtaggtggaggtggagaccagtcgcagtgagtggttgccaaagtaagcaagaagtgaaaggcggtgtgagaacgccttgtgttttctgaacgttttgtaatcagatctgagctccggtggtcgaatcgcccgtcccctgcttcagaagaactgcccctaaagccagaacatcttaaatcccgaacctcgcattgttctccggtcctcactgttcaaccacgcctgaagaaacacgttctcccctttctcttgctccagtaggaaggcaagaatccctctttaatctctccagatcaataaagagatctcaagagcggtgacagcggcggcggcggcggcagcagacccctcaaaggctcggattcagccaccagcaacgctgccggacgggacaccaacagccggggtgcgcggaagaaaacagagagcgcagatgggaggtgcggagggagcagagggggatccggtgatagcgaagctgatatctcccgtgacgacgccgactcgactcctggctgcagctcctgctcccgggggggaggatggagatggaaacgggaactgggggaaactggagagagattaagcatgatgacgggcaggggggaggacgagtggtcaattttatgagtgggggattcgcagcacggtttcaaatctcggaggtcggaggacggaggaagaagagggccccggccggcctcgag

SEQ ID NO: 22008 - DNA, 806 bp, Zea mays
gcagtatcagcagcgagacggtgaggcaggcgagcacgaggaacgcccccgatgctgaagtaggtggacgcgatgaccttcttgtcgaggaaatccgcctcctgctgacgctgctgcagatgccgcttcacggcattcctcctttgtattgccgcccctccttccatcgcgctagatcggcttggcatgtgttctttggtgtaggcggaggtggagaccagtcgcagtgagtggttgccaaagtaagcaagaagtgaaaggcggtgtgagaacgccttgtgttttctgaacgttttgtaatcagatctgagctcgggtggtcgaatcgcccgtcccctgcttcagaagaacggcccctaaagccagaacatcttaaatcccgaacctcgcattgttctccggtcctcactgttcaaccacgcctgaagaaacacgttctcccctttctcttgctccagtaggaaggcaagaatccctctttaatccctccagatcaataaagagatctcaagagcggcggcggcgggagacccctcaaaggctcggattcagccaccagcaacgccgccggacgggacaccaacagccggggtgcgcggaagaaaacagagagcgcagatgggaggtgcggagggagcagaggggggatccggtgatagcgaagctgatatctcccgtgacgacgccgactcgactcctggctgcagctcctgctcccggggggaaggatggagatggaaacgggaactggggccgaaactggagagagattaagcatgatcccggccggccgcgaggtacccaat

SEQ ID NO: 22009 - DNA, 837 bp, Zea mays
  misc_feature (14)..(14): n is a, c, g, or t
  misc_feature (43)..(43): n is a, c, g, or t
tttttacccgaacntagtacagatcttatcagcaagctgtttncaaagtgggtttaccattcaaatttacaactggaccataatgccatgccagcaataacgagtgaaaaaacagcgggttcctttaccaagcgaggaacgccggaccaaacaaacaaattaggcaaatgtagtcaatgtcatgtagccatcgacgaatgatttaacccacctaggggcctttctttcctctttgtttgcaaaaaggggcaagaactcattgccacgtatcatcatatctcaaaaattcatcctcgattaataaggaggttgtcatataatctcaagctctcatctcaccgcacgaaactgagactggaacaacaacaaaaaaagatcttcttcagcttgcacaaacgaaaactactaccaggaagagcaagagcataggcataggcatgcgagcccaacggcgtcgcgcctacttctcggacgagttgggcccgcgcttcttgccgaagccgacgacggcggtgacgaagcggcggttgtactgcatcctcttgtacgcgcggccgcggggcttcttcttcttgtcctgcttcgccaccttgggcgtctgcccgcggaccttcccggcgcgggccagcgatccgtgcaccttacccatggctgcgaagcggcggcggcgacggaaggaagcgcggggagcctgggagatgcggtggctgtaaaaaaggcggcggcgtcggcggcggctgtaaaagccgggcccgccggccctgagggggatggcttaatacgcgtgagggttttttgcgtcccgggaaccggccggcctttcgaagcggccgccac

SEQ ID NO: 22010 - DNA, 753 bp, Zea mays
ttttttttttttttttcgaacgccaaaaggggcaagttttttttgccacgtataatcatatctcaaaaattcatccttaattaataaggaggttgacatataatctcaagctctcatcgaaactgagactggaacaacaaaaaagatcttcttctgcttgcacaaacgaaaactactaccaggaagagcaagagcataggcataggcatgcgagcccaacggcgtcgcgcctacttctcggacgagttgggcccgcgcttcttgccgaagccgacgacggcggtgacgaagcggcggttgtactgcatcctcttgtacgcgcggccgcggggcttcttcttcttgtcctgcttcgccaccttgggcgtctgcccgcggaccttcccggcgcgggccagcgatccgtgcaccttacccatggctgcgaagcggcggcggcgacggaaggaagcgcggggagcctgggagatgcggtggctgttaaaaagaacgaaccctaggtgagggggagaacttaatacgcgtgaggattttttgcgcgcgggccgattgggcttcaggaaggtctgtcgtggcccgtggggacaagattgacgggctttgtcacactggcctcatgttaccgttccaacctatctttacaacgctctcggtggatcacgagtgacaattgagattcacggattaatgaaagaaaacgatggccacggaaaccacgtttggcgaggctgcttctgaaacattttgctctgt

SEQ ID NO: 22011 - DNA, 3524 bp, Zea mays
  misc_feature (2633)..(2633): n is a, c, g, or t
gttgggatgataaatcatgtaacattattaggaaataacagaggtatgactgattttccatgggccatgaaaaacatcatttgaaccactacaatagactggccgttgtaattttttggttcatgacttcccctttctattatccttttgcttataaaaaaagtaataatacaagtatggacttaaatgctgggtccatagatagtgtcatatgtacttatgggttctgattgtagttttttggtaacaatggtatgcttatataattcagactttgggtaatattggtgagttcttagggacattatagtaaaccagtagcaagagaaggtttattcatttctttatactgatttgattatgagcattgctaggtaccacaatgtcctattcatactccagctgaataaaacacttgttgcatagcgaagctaaacaaaactcttcacaagttacaacatatcaatacacacttttatgcattcatactatatttgtgccataaattgtatggatatatgttttaacaattgtgcttaattgttctgttaatgtttgtgaactgcaggttcaaggtcatctcgggcaaaaccacttcactggacatcatgcctgaagatagcaggagatgttgcacagggtcttgcttacattcaccaagcttctcggcttgtccacgggaacatcaagtcttccaacgttctgcttggttcagactttgaggcttgccttacagacaattgcttgtcgttcctcctggaatcatcagaagtcaaagacgatgctgcttacagagcaccagaaaacatgaaatccaacagaatgctaacgcccaaatcagacatatatgcttttggtgtcctcctccttgagctccttagcggaaagccaccgcttgagcattcagtcttggtcgcaagcaatcttcaaacctatgtccagtcagcgagagaggatgaaggagtggacagtgatcacatcacaatgatcgtggacatagccacgagctgcgttcggtcctcaccagaaagtcgacccgccgcctggcaagtacttaagatgattcaagaagtgaaggaaaccgatgcaactggtgataatgacagtgatcttaccagcaactcctagttgcctgtgtgggtccatctctggtggatgaatcattcctgctgaacggatgtagactgtataatttgaagtgagggtgaaccctagataggaccgtaggagagtactgcaatagcataaggatctctatgttcggtgtggtttgagctagggatgctgtaacatattataggatttcttattgtcagcaactcagcatgttctggtctggttctactagtggcagttttagcaccagtctgttgtgtgaaagtttattagattgatagtagtgaagccacaaaagctgtgtgaagactgaagatctggttttaaattctattaccagcaagtattgtgagattttcatgaaatgattagttggggatggaacggtgaatataactgtcttttctgttctcagactaatccagttcttcaacttgtctggtgtccgaaacgcgacatgtttgttaagtggtaggagccatgaccaccaggcctctagtgccatctagcacggactcctccatccctaactaaattagttcgcagtgttatccgaatcctttcttaaagaaatcaattcctagaggcgctggaagcttgagttaacaccatgttgcaaatgggtttggacattccagcgtcaagcaagctgatggcgagctcggagagcaacgacactgatcaagatgctggatagaagtgatggggttttcaggcggatttgaatatttctgctgaagaattgtcttggagtttttggcgtgctactgaagctagtagtacgatagttggttgccttgttttagttttcctctcaacttttcttgtcatttttagtacggtgcaatcttaatctcaagtgtccttttaaatttcactctctaaattattttttagagaattatttatataaaaaagttttctatatctttttaatctccaacaacctttctatatcttatttgtactctaaacagttattcacgttttctttatttgactagcaaaaacaccggaataatgactatttagataagttgttggatagtgtgtgtttttttaaaaataattatttatatagattagaaagaatatagagtcttttggagttgcgcaggtggtctagtgctcttttcttctttctcatcctgatgtttttttttccagccgactcttgtatttccgttctgcgaatggaaatggacttctcctgattcaaaataattcatttttagagttaccttacgttatttaaaaaagaacaaatttgtagaaaagagcaccaaaaacctatatcatcaagttaatatcattaaaagcgtggcatccatgagaaaacgtgcaagaactacggatttacacaaaacacatgcttataaaaccctggcctaccaaattatcctcacagtccactgatgaaatttagggtgacacaaaatacgcaaaaaaaaccggtaaatgacaatagctgcaaatcgtttctctgaaacatgccgcggggatattttagtgtctangcagggcaggtactccatgtctccgtgtcacgtggtcggtggttttctgttgcagcgtcgtcgtcgtcgccagtgtcttcctttggttcacccattccagtccagcgtgtgtttgcgcctcgcacatgtgtgtgtgtgcacagtagcactagcgcccacgatttctggaccgctgatggatggccttggaccccaagtatgttggaccgttgggccgtcctaggccgaccgatcaagaaagactaggcccatctgtagcccatagcagcaagctgcgtttgtgaagccgctgacaagtgtcagcgagcccataaaacacagagtgcttgaccaaagggttttttctgttgagaataaggatgtaaacggtcggtaacggtcggaaaaaacctctcaccattttcacctgcatatttttttgttcggccggaatcggtaaacgggaaagtcggaaacggataacgaccggtaaatttcagtatatcgaaaacggataaatccgagcaaaatagctcggaattgatcgggaaatggtaaaatagctcggaattgatcgggaaagtcggaaagagatgttttggcgggaggtccacatatccatggttgtactaaacctgcattcaactgttttcagatgtgcatacaatttctttttctcttccaaatacaaatccatgatatcattcctaacagtcacacgagacttcaatggaaagctaggccttaacgatttaatgaaatccacaaaagtagttatgctcagccatttggaaagggtactcatgcattataatagccaagtaaaattttttcaagctatcttcctgatcatacttgtaggtttggacaagtgtgagatttgtgccatggtctttgtctgccttgagctgt

SEQ ID NO: 22012 - DNA, 5593 bp, Zea mays
tccctggggaggagccgcatgaaggtggctccatgaccagagctggagcggctctttgtgcaagagacagagcgtttgagagcccttccaaagaggcccttagtacaactaaccatcatgcattttttatgaagaaaacatgtataggtatttgttcttatatagtctgtggtggtatgtatagaggtgataattagctctagattttacactacaaaatttaaggatcgaatcggattagtgtcgaacttatattcctatttattattgaactacaattagttaatagtcctaacttatagtgaagaaacatttgaatcgtgatctataagcactcttagagggctctgaatttttaccaactccacgtaaaaaaatactaatatatgcgttcaagataatggtagggaagagtagcatttcaattccgatgggcgatgcgctaaacctcttagtaggtgtcctctgtgttagttgaacgtacaaagggatttggtccgggactgttttggatttgtgatccgtgcaacgccaagatcacttgatcatcatcggactgaactgactgttgaagtgcagacaacaaactgtccaaatagaggcagtcatttctcagttaaagttcagatggttgcagtgcaagcccctgcagacaaaatcctccaacacttcgcagagcactatagtctgtatctgcttcggaattaggtaacgttcaaaattcccgtgagccctaaaatcatgtgccgtgccccgtgcgtgctttgggaacgccgaggaaccgaatatcctcatggcccaaccggccgcgtcgcgatgtcatgctagaacgggccttgccttcgctgaagtatggcccaaaacggccggcgaaagcacctagctgcccggcccatgactgactacttactttattactggcaccgctgctccgatccgataggcgatagctgctgtttctgcttctgcaagactgcaagcaactcattaggcaggtgctcaatcacatccgcgttcgggcggcactgttccatcacatgcattttacaaaatggacatgacttctctaggccttggtccaggcctagcaggtcaggtgctacgattttgaatcacatgttttgccacacgaccaagcaactgagtgaggacgtacgggggaagcaggggaattagtaatgactcactcatggtgaatgctgaactcttaatactagccgagagtcggttgcatcgtcgctttccttccttcattccttttcagctgatgaaaagctcttgtttttatttttttattttttgcacgaacgtggttcagtcggtcaccgtccagcatgagcctccactccagagttgctgacggctatcagccttcagaccagaaaattacagcgcttgatgccaacttttttatgatggtaaccttgagtataaagcaaggttagcatttggtacgatgctagtactggtgactggttctatctagctgtgtttcggaaaactgtgcagaatgatgcgcgtcgttgggttttgaatccgtgtcattattacgaacgcaggggggacagaggcgtagggccacaaactgacgagatggggccaaaacacaggtcagtgccgcgtgacttgagtcggatcggagatgccactggccatgggtgtgggcacacaggcagtcagggaagaaagatggaagtgaagagtgcacgtatagtgttcaactgctgtctctactctctactccctgccccccatgaatttgccgcagggcacacctcctctctcactggatccgacgagccgtgcaccgcgccagtctggctgcagcagcaccacaataccacatgttgctttgcttcgccgagtcgagttcaccaggacggaagggacatcttgcacggcgaactgagcgtgtggcggtgtgggagagaatgtggcgatgtcgccgtcggtgccgtctgtatggtggacgctctgcgtttggttgcagtgacatcgacatggcgtatgcatttttggcgtggcgccaagcgcaacagctacgagatgcggtgccgaacctgtctcacgatctcactatctacgcccgtggatccgcggcccaccggtcagcgaggtgaacgtgacctcggtcgcgcccgtttcttcttcttcttcttctaccgggcgtcatgctcgtgcgtaggacaggacagcggacagctagctatagctgcttgggcgtcggcggggcggtggaagaacaattcccgtctgcccgacaaaagcagcccaaataatttaccagcggtcacgtgggccccgcagctctgaatgaatgtccgcgggtcctctgcctcccctccgactcccccgttggcagtgcacacaagagggccccgagtggcaggcacggtaaaaattcgcattgatgaggtgtgtacgtcactacgtcgtcgtcagtcttaaaaacaaagtggccccgataggagtacagcgtcctgctatgctagctagtactgtagctaccgcgcgagacccgcaggtatcgaaggggcaacggctccttttcaaacattcccccgtgcaaatccgtcgctctcggcattcggctacttgcgttgcatggctccaacgtttgcccaagtgcttgctcgtacacgaaatcagcaacatattattattatagaaatactagaagttgggtataacgtggcgtcaagcggagcaatccaggacgagggctccggtagttagccctgtgcgtgcctgtctgtacgcttggctgatctgcatttcgttttcagagctgttggtgctcgccatcccagacagcgtttcttctcccatccgtgatctgcatttgaactgccaagcagctagctgcgtgcgtgctttgccgttgctgttgctgtccccgctaatgagctcctccgtacacttggccaaactcgcgcccggcccgcctcggaacacccacgtgccccggcgaccaccctctgaccctcgtccccgtcgttccccagatctcctctcgcatctcgcatctcggcgtgccaccaccactccgctccaccgctacactgaaaccaaccaccacgccacggcacgggcaccacccaaacccatccctaaatcccgagccccaaaacccccgtacgcgctcgccgcgccgcaatggcacaccaccgccgcgccccgctcctccccatcctcctcctcctcctcctgctcgccaccaccacggaacccgcggcgcccggcgccgcatcgcactcggagccgacgctgccagtgccgccggtccaagccgccgcggtgccccccgccgcggcgctggcgtcgacgcctccgccggtctcgccctcggccgcggcgctcgcggcattcctcgccaaggccgacccggcctcccgcctgcgcctccccagccccgccgcctcgccctgctcccgcccgggggtcacatgcacggccaccgcccatatcatccgcctcgtcctcgagtcggcggggctcaacgggacgttcccgccgggcacgctctcgcgcctcgccgagctccgcgtgctcagcctcaagtccaacgcgctccacgggcccgtcccggacctctccccgctcgccaacctcaaggcgctcttcctcgcggggaaccgcttctcggggcccttcccgccctcgctcgcctccctgcgccgcctccgctccatcgacctctccgggaacaggctctccggcgcgctcccgcccggcatcgaggccgccttcccgcacctcaccctcctccgcctcgacgccaaccacttcagcggcaccctcccgccctggaaccagtcgtcgctcaaggtgctcaacgtctcctacaacaacttctcggggcccgtgcccgtcacgcccgtcatctcgcaggtcggcgccgccgcgttcgcgggcaaccccgagctctgcggcggaggtggtccgccgcgagtgccgcggctcccacctcctcttcttccacgggggcggcgcgaacggtaccgccgctccccctgtgcagagcgctgctgctagcgacagcgggccgcagcgggagaacctgagcgtgccggattcgtccgtgccaaatgcgaagagagcgagacggaggatgaccaaattggccgtcgcggtcgctgccgggtctgtcctcgccgcgcttcttgtctacgccatgattgcgatgaagaggagcaacaagcggaggcgcccgagcaccgcgtcgtacgagagccccaaccccaagaagagcgcgcccgcgtccgaggtgagcagggacaatgctgacatgggctacgtcgagtgcgtccccgacgaggagacggcggccattatggtgccggaggagaaggcacggcgcctggagcggagcgggtgcctgacattctgcgcgggcgaggcggcgagctacagcctggagcagctcatgcgcgcgtcggcagaggtgctcggccgcgggagcgtggggaccacatataaggcggtgctcgacggcccggctcgtggtcattgtcaagaggctggacgccgccaagattggcccagcggcactggaagcagaggcgttcgagcagaacatggatgctgttggccgattgcgccatccgaaccttgtaccactccgagcattcttccaggcgaaggaggagcggctgcttgtgtacgactaccagcccaatggcagcctctactctctcatccatggttcaaggtcatcccgggcaaaaccacttcactggacatcatgcctgaagatagcagaagatgttgcacagggtcttgcttacattcaccaagcttctcggcttgtccacgggaacatcaagtcttccaacgttctgcttggttcagactttgaggcttgccttacagacaattgcttgtcgttcctcctggaatcatcagaagtcaaagacgatgctgcttacagagcaccagaaaacatgaaatccaacagaatgctaacgcccaaatcagacatatatgcttttggtgtcctcctccttgagctccttagcggaaagccaccgcttgagcactcagtcttggtcgcaagcaatcttcaaacctatgtccagtcagcgagagaggatgaaggagtggacagtgatcgcatcacaatgatcgtggacatagccacgagctgcgttcggtcctcaccagaaagtcgacccgccgcctggcaagtacttaagatgattcaagaagtgaaggaagccgacgcaactggtgataatgacagtgatcttaccagcaactcctagttgcctgtgtgggtccatctctggtggatgaatcattcctactgaacggatgtagactgtataatttgaagtgagggtgaaccctagataggaccgtaggagagtactgcaatagcataaggatctctatgttcggtgtggtttgagctagggatgctgtaacatattataggatttcttattgtcagcaactcagcatgttctggtctggttctactagtggcagttttagcaccagtctgttgtgtgaaagtttattagattgatagtagtgaagccacaaaagctgtgtgaagactgaagatctggttttaaattctattaccagc

SEQ ID NO: 22013 - DNA, 1941 bp, Zea mays
aataaccctctgttgtcggaccagcagcagctaagtgcactttttaagatctatctcgtaagcattgcgaagccaagcgatccttccttcttttgtctgcaagtttgcaaaaatatctctatactttttctcagtcaatagatgagtggcaaacaaatgtatttggctgccttctggtgatccatcatccataacttgttgcaattgctttttaatctcaagtcgaactgggtcattgtcagcagaggtaatggacttgttagtggtcattgaacgcgactcaaaagcctccactagtcttctcatgtactcttccctcgaatcttttttcttcttgggtttgggagaatcatggcgcatcttacgcttcccactagcatttgtgcaggggtcaggtgtgctgttttcacccccacctaaagtggcttccaaatgatcatcagatgatgaattagcatcctcgacgccaggaaccagggttctttcatttgtgcagacaatgggtccaaacataacctttagctcgtcctcattctctaggggggctgttttgaacataatacaacctggcattgcctgcaccaacatggtagttcctagtttgagatggccaatactattgttagtctacaaaacaaaaaaaagatctacttacttcattttgcttggcccaccactcatctggcgcactgattgaaccagtatgagggtctcgaccaagacctgtagccctttcatttagagttttccactgggtgaacattctcttcaacgagtcccacctattcttcatttgatcccttgtgtacgtgcgaccagtgcgttccttaaactttcttatcaggttagcatacccttcggcgtttaggaattgttgtggcctgttccgtgcattgacctcttctacacatatttctgtgtaaatttttgttgctctactatcccacttagcaatgactttgccagacttgtccatctagtgcaaaacaagtgtagacgattgaaaatatgtattgaagtgcagttactacgacaacaaaatgaacaggtaataataacataaagtactaccttaaggagtcacattcgtttgcctcgagccgaatcggctcgagcccgagccgaagtgctggtgcacacaaaagaacagggaacacttcagaactgcgcaggaagcaaaaggctgatctttccctgttaccctaacacctgcctctaacaagttcttacttaaacttgatgacctcgaacaacttactctaacaaggtctaacttaaacttcattatcactaaacgatggcatctggtccgagtcatattcaagaccccagaagtttgcaaagtgatcagcaaagtcccaatctggactaaggtactcgtcagctgggggtggtgaggacaaggctgacggttcgtagttgctgtcacccgggttgtttacgttgttcacgatgtccaggttctcttgcaacaccagagagtcttgctcaagcatgcaagcaatgtcctccaatgctacacgaagtttggtagcctcaaaagaggtcaacccgcgtccgcgacggattgtttcccgagctacggaaaatatcttgtccgcaatctcttgcatccttccaattgccttgtcggctatggagtctgctgaatccatctgatgtggatttaggttgttagttcactaacaagggcatactaacttgcatgtattgacatcaattgcgttctaacatggacaacatttggttgaagctaccatagaggtactaacaaaaacatgtatgaacacgtactattaacaaacttgttgtgaacaaacaaactaacaagtcatgactcgagaaagaattgtgttatacaacagaacgatggtaatccctgtaaaccgtaaacacataatttggtaacccatggggactctaacaattgtgtatgcacga

SEQ ID NO: 22014 - DNA, 3318 bp, Zea mays
  misc_feature (3234)..(3234): n is a, c, g, or t
cgaattcgcggccgcgtcgacttttttttttttttttttttgaatatagattatagagtatatatatgtctaatctgttatgtcaaccaccatagctaaaccaacacaactatgcaagttttttttttttgtttgtaaaatcttatttgaaccggtggcggatgtaaacaggtagagctaagcaatcatccaagccagcacaattttttgcacaagtgcataacatatatactactacaaaagtgaacaactgtagaactctgaaagacaacttaacagtcacctcgatcttgcatacttgcaccaaggcaccaagcaaagcttcccacaagttcatcaaagctagagcctggggcctttcattcgtccttcttctcgaggctggtgttgttcagccgctcgacggccagtataagcgcctgtgtaccgagcccgccctcgccgtgcgcgatcagcgacacgtacagctgttgcgcgagggcgagccccggcagcgacagccccatggcctggcattccaacaggcagataccgaggtccttgacgaagtgccggacatagaagccagccgccatatccctctccaggatccgcttcccatacagttccagcgacttggacccggctgcgccggtggagatggcctccagccacttggccacgtccagcccggccttgtgcgcgtacaccatgccctccacgagccctaccatggtggatgcgatggcgatctggttgcccagcttcgcgcgctgccccgcgccgggcccgcccatgtacagcgcgtttcccatgagcttgaagagcggcgccaggcgagcaacgacggcggcgtcgccgccagcgaagatggagagggtggcgttgcgggcccctcggtcaccgccggagacgggggcgtcgacggccgagcagccggcggcggccgcggccgcggctatctcggcggcgagggtggggtcggaggtggtcatgtcgacgaggataccgcctggggtgaggccagagagggcgcctgtggatggatcgagggcggtggagcggacgtcggaggggaagccgaccatgaggaagatgacatcggcagccgcggcggccgcgcgcgggctgtccgcgaggctggcgccgcgggagacgaggccctgggtcttggatgccgtccggttgaatacggtgagagcgtagccggcggcgaggaggtggccggccattgactggcccatgacgcccgtccccacccaggccacgcgggtggtgtccggagagatcggacgctcggagatgttcgctgccgtggacgacgacgacgacatggctgctgcagcggcggtagcggcaagcggaaagggcgggcggcggcggcgagtgaggaaacgggatatgccggcgagcatttgggggcggagtagctgctagatatgctgcccctgtatgcaggtgaattgtcgcaaattttttcttctggcgcgtcgcagtagcagataaggcggcgtgaggtggtgagtactgagtacactcattttccttttttttttgaaccagcctttctagcttctatcggtcactctcttgaaaaggagccagtgggctttatatccatgggccgtatggtagcccatcgccaatctgcatcaaccaaactcggcagttctctcccgctcttctctgcttgctagagctacagctagctgatcggtatttctattttacttcaaaccgttttggttccttctcatggtatcttgtgttgattggattgaatcagatgccttgaagtgtcttgtgtttcgaattcgaggtttctatggacactcgaggtaatttaggtcgattcgggtttactggtgcctgactgttctgtacctaattggtctatccgatctgtggaggtaaggtgcagtcttggtttactccggatgtcctagattactcgattctccacttcattttcgtgtcaaccagttagtttgcaccttagagtctataaagaagtgggtctgttgtgatcctgggatggtagtgtggcaccgatttgttaattcagatctgttcattttgccatgactatttgtggctggtatagtctgatttggttcaaacgattttgttatttgttggcaggcctcatatccatggtagctcgtttaactaaaatatgatagctcttttagctcgcgagctgtctcgttaacaaaccgaggttaacgaaccgagctaggatgttagctcagctcgtgaaaaaaaatcaaacgagccgatccaaactaaaccgagctgactataaatcaagcgagccgagaagccatgaatttcgtccatcactacttctagcatggcttttatatcataatttccacaaataaggtaacttatacacataactcttttgttcagaataaaaaaaactatacgcaacttttgcagtaaatttgtgcatgacatgttcccagctaatttctcaacataaaaaaattgttcctagtactgtgtgtgttcggatatggccgcatggactgtgtgtgttcggtccagagaaaaattgaaaaacagaggcagaccggcagcaagaaaacagatagacaagaaaacgacggccttacttgttccagatcatccacggaaagtcgaaggcaaaagcctcgtccggttgttggttttggtgtccacatggccatgggatggcggcgagtcagcgaccacaagcccataggctgtgatcaaaacaagcgaaaccccgttgggaggtacggaagggattcggtgagtccgcagtccgcaagagcgggtcgtcggtctcgcgtctcggtcagccgatgcgggccggtccaagcacccgcgggcttcctggcacctgcacggctgcacctgacactctgactagagataacaatggaccttattctggtgaattcttcgttatgctaatttggaaccctattttcccacataatttttattttcctaaataaaattagttcattttctattgaaaaaatagaaattcattgaaaaaaatagaattcccaaactagcacttagagatacttttgagaccaaggaaattatagataattggaggggttaaattttctttattattcaataaataattatcttgtcaaaacacctttagttgtataaatatgtttattttgatatatacataatgattttttttacatctaacatgtgtataagttacaatgttttgaattaataataaagaaagtgtgntctaatctctactacaagcggggacgagaatttatctctaccgagaatgaagatgagaaaagaatgtcctttgacagtatacat

SEQ ID NO: 22015 - DNA, 1033 bp, Zea mays
gaaccaactatattcatttagacggcacaaatctccaaggggtgcttatgttctgatagggcttagggtagggtagggtagcgatgatacctacggtgaccacgttacacacgcaccagcaccggtgctgctgaggtagaacagtagtagtagtctccaagagagaattatttctctaaaacattaattagctggcttcacccacggtaactacgagtccatcttttgcgccttctccaactgtccttgcctaaaatatcgccagtgttgtgccttgtgcagaataaccaccctacttgctcctccaaatcttcagcgcaaaactgggtataatgataaggcaatacattgccattgcacccaatacccccacattaaagagcgcataaccaatcctttctctgcgagactcctccattggtggaagtcccacaaacgccagaacgcttgctgcaagaagcaggatgaaaaccaaagatgcgagcctacgcgagcacgatagggtcctgcagcaccttccacgttaacgctctaaatatcttcgtggcttggatctgaatctccctggcgtgagtgcggagtgaccgtctgaaccccaccgcaagcatggcgcgcaagacccgcagggcgaagacgaggatgagcagcgcggggaaaacgagggctccgatcgagactttgaggaacccgtagaccaacggggaagagtcgcccaaggctcggcgcgccacggtcccggcagccacgcccgcgcaggcgacccacgcgctcaagaggtacagatactggagcactctcggcacggagaggttcgggggcgctaccgccggtgcccgcggcggcggcggcggcggcggctgctgctgctgctgcgggagaatctcgatcgccacttcggcgacggccatcagagcagggaaggaaatggaaaccgcacgtcgaagctccaaccgctcgtctggggactggactctggagcgaggggaaagcagaatcccggccggcttcgaggtacccaacccccccccccccc

SEQ ID NO: 22016 - DNA, 6070 bp, Zea mays
  misc_feature (1007)..(1007): n is a, c, g, or t
  misc_feature (5350)..(5350): n is a, c, g, or t
  misc_feature (5398)..(5398): n is a, c, g, or t
tacttacgttgtcttagtcactaaaaccaaccaggggcctagatgctttcaggctcttttggtcttgagtcttgaacttgtgcttgatatttattgatcttctaagtatcttttaggtcttcttttgaggtgttgcatcctcagagccttagtccaatcctcttcgaattatgtgaactacaaaacacaaacacttggaacacattagttcacaaggttacgttgatcatcgaacatcaaaatcacttagccaaatggctcggggtctattttcctcacagactggaagtagggacgttctgatctaaccagtataaatcttgcgcccaccacgcacaccgtccggagcccagaacgcgcacaatgaatttacttgtcggagcgaggttcgaaacaccgacagtttgtatctgtatcgtcttttagcgtccacatttatattctatatcttcgttgtgtgctttagctttctagcttagttgatagactagttgataggtttaaaatctagtttttatagttttgtgcagtagagatagcaacatacttagtctaaatcgtagttgtatatagatagcttgtttattgcgtagttttgactagacaaaaaaaaatgtaaaaggcgtttgtaatatagattgtctttgacgtgattgttcctacactgagtttttagttctgagatcctttcatgagcagtcactggtctacactagatacaaccccactgccgtgtcgtgcctcattttagtcctctcctgccatggagttgttgcttcgtttagcgttgagtgaaggtttgtctttgtgtcaattcaaacgtggtccttgttccgtgggaattcgtttgcttgcttttggttgacacgtcataacatggattttttttttttttgcgatctttttagcaatggtgaatggtccgcataagttcaccgcacgccttatgagcgagtgaggatactgttttagcacgccgtagtttggaaaatcctcggttgcagaanatgacttcgaggcttatcgaaagattggagatcacccctgctgtgtttaacgaggtttatggaaatttgaatttcagtctcaagaacgctctttgagggtcactcacctaggtctaggttagtcacccatctccgtctggtagccttcatcagctaaatgaagattcgaacaacaatccacagctgagtagtactaaccaagaactcgcctagtcgcccacatggccacatgcccgcaagctggcattgatacactcctaccacaagtccacaactagctgtatacgtaataatcacaaccacagatccagtcacgacgctgaaccaactatattcatttagacggcacaaatctccaaggggtgcttatgttctgatagggcttagggtagggtagtgatgatacccacagtgaccacgttacacacgcaccagcaccggtgatgctgaggtagaacagtagtagtagtctccaagagagaattatttctctaaaacattaattagctggcttcacccacggtaactaggagtccatcttttgcaccttctccaactgtccttgcctgtcaagaaatcacggcgacttttggttagatcagtattcgacagttctgcgggtacgtcacctagctagtacatgtttagcaatacaacaagccaatatcttatgtcctttatactagttgtgtcacttaaaactaatggtaggaaattttgaggtgtcaggttgcaagcaaccacattcatttatcccttccacaacaaagaacgtatgaaattctgaatatgcttacttatacataaaagctagtcactagcggctagaggtacagtactccctccgtttcctatcttaaagtcacgaaggcttgttttaagttagttttgaaactttgaccaacaatatctataaatataattatttttaaattattgaatttatacattgtagtagatgttttaatagtaaatgtaatagttttgcttttatttagtcaatatttatgaatattttgttattaatggtctatgcttcaaagtattgacttaggacaaaccttcgtggccttaagatagggaacagagggagtaagttattatcaacatatcattgtgagaagggtgacaggggggaaaacttgtacactatggtaggatcccttgcaccacaaccaaatatattttccaaataaccactgtaaaaatgcagtagaaacaaggtaaagtaccaaaaagatgggcctgaatcactaccatgtctatgtgttcacataatcaaactgagtttttcatttgatttactcaaacataaaaggcatcagtatgatatataaaaagattaatgccattaatgtatgtgacaaagtgaaaccaaggtttatttctgctaccaaccaaacataaagctttaacacaataatgtacaataaacagaacaggatacataaaaggccatttgaaaatgcatgcagataagtggatttttttcatcaggagatctgtttatcatgtcaataagaataaaaatagtataaatacaacgctctcacacaaccccctccccgccttcccacaccacccctcagctagggacataatgcatgtgagcgtttcaaagaataaacaaccgacccaaccaaacactaagggggtgttttttgaagagccaatccattttagatgaggtggtgcatcatgagttcattccacaaatttggtgcaatgaactcattcgtaacattattaataattatgagcctatgagtaatgaaatggtgatgaatcaactcattccattctacaaatcaaacaagaaagtgaagagtgaaaaaatgatggactacttcattccttaaaccaaacacgttgtaaatgggccagccaattatctggcagtaacatccaaatgggctaaatctatagcgccagaaagacgccacaggtgtgcctcatccaaaaactgtccaagaacaaacttaatggtaaatagtcccattaaaaacatagtagttgtggtgattccagaaagtcaatgcccccatggttaacacttagcaaggatttgaaacctcttagggcttgtttggaagccaggggattttagcccatccattcccctctattcaccttgctcccaaacatgcccttattatgtccgtgggcaccacggcaaacaatcctcaacatcaaccatagttttttttttttttgtaatagatgaaaaatccaggaaccgtagtgacagattaggagttacacatggcctcagactggattcaattacacataatttccaaaaaaaagtactttcaaacatttttcagcctgtagcagattttatgctaacgttcacatgaagtctattgttcaataactacctattgaagcagctttcacagtcagaattctgatttatgctactaaaagggctgttaacatactaataagaggcaacaaagcacaactatgtacgatccttcgttatagaaaagcttatacgacacaagaccacaggatggccagagaaacagttgggtacctcagatatcgccagtgttgtgccttgtgcagcatcgccaccctacttgctcctccagatcttcagcgcaaaactgggtataatgataaggcaatacattgccattgcacccaatacccccacatcagagagcgcataaccaatcctttctctgcgagactcctccattggtagaagtcccacaaacaccagaacacttgctgcaagaagcaggatgaaaagcaaagatgcgagccacgcaagcacaatagggtcctgcagcaccttccacgttaacgctctaaatatctgacaaggatgtccgagagcatgtcagcaagagcaagcaaactcagtcagttctcctcgattgaaataatcatagggattggattggatttataattatgtttgaatataaaactggaaagatgcaaatgcaatcacgaaaatatagtgcacaaattaaattttctctagagaaactgatacagcataactgaaagcagctccggcatccacacaccatagacctgatgaggacgacttggagcaaactaaaaagcgtttaattttgagctcacacgaccgtattgataggatgtgtatgattattttctgaaattggacagattcagatcaattctcctttcgaagaaataacgcaagctatttcccccctgaaactgcgtgtgtatacagtatatgattccacatcaacacacagagaactagaacctaccaaactactagtatatatatctcgtaaaactaaaactcaatccaataccttcgtggcttggatctgaatctccctggcgtgagtgcggagtgaccgtctgaaccccacggcaagcatggcgcgcaagacccgcagggcgaagacgaggatgagcagcgcggggaaaacgagggctccgatcgagactttgaggaacccgtagaccaacggggaagagtcgcccaaggcccggcgcgccacggtcccggcagccacgcccgcgcaggcgacccacgcgctcaagaggtacagatactggagcactctcggcacggagaggttcggaggcactaccgccggttcccgcggcggcggcggcggctgctgctgctgctgctgcgggagaatctcgatcgccacttcggcgacggccatcagagcagggcaggaaatggaaaccgcacgtcgaagctccaaccgctcgtctggggactggactctggagcgaggggaaagcagaataggaaggggataagacggcccccgtcagggtcgcaccattaactgcgaaattaactcttcgtaaattgaattaactgataataatatatattattgtattacaaatatgtcactagtattttttaaaaactctaaaaactgatataaaaaatcaaatagctcagttaaagagtaaatggaaaagctgaataggaagaatggttgaataggagatgaaataaggagaataatagttgagagaagttatttaaatatgaatagtaaatacgaacgtggatttaggaaagtgaatggccctgtgacgaacacggaagggatttaacacgcgtcaggttctgattcgtgccgagtggacgaatgaatttggggcagtttgctagtgaaggaaaaaaaattattcaaagtcatgcaaactgaagcactatagtaccatatcgatacatgtcacttatcagatgtttttttctatgtattaaacaagggagcatagctggctcctcgaagcgccacgtcatttgttttcttctggccgtccgatcatattatgacggtcctccattcagctgctatgggacgtcnctctttagatttgtagccgtcgtccattcgctgtgaagcttctagatnactcgagtccatggcgacaggatccccagaagtgtcgccgtgaagcctcaaacgaacctcactgctccgacactccctaggtgctttacccttccggcggcaggatctccccccgtgaagcgagtccgtgttgccaagatccaaaaaacgtcgtcgcgaagtttgcatcccctcccctcggcgtgcacaccgccacctcatagcgtgtcatgctcgcacggcttcgcggtgcgcctgccctatgacgcagccacaccacgacctagcccgctcgccgacctagcagcactgtcgtgcctttgcgccacctgccgccgaccacgctgggccttatgcacgcgtcatgccgcaacaacgacgctcacgtcccgccctgaggtaagataaccaactaccccttcctgggtgcgccccctcctcctaggtgctaccatttacgcactgctcgcattatcattcacgaaggtggaggacgtcgcattggacacaatggggatcagccgcacatagaactgggtgcgggtcaagacgtgcctgggcggggccaagtacgtccgcgtcgtgtgcttcgccatcgtggtcatgcacagtgttggccaccccatcgtcatcgactagctctactacgatgtgccccggtagagtgatggcggcggtggcagctcctagcca

SEQ ID NO: 22017 - DNA, 1272 bp, Zea mays
agtctcaagaacgctctttgagggtcactcacctaggtctaggttagtcacccatctccgtctggtacccttcatcagctaaatgaagattcgaacaacaatccacagctgagtagtactaaccaagaactcgcctagtcgcccacatggccacatgcccgcaagctggcattgatacactcctaccacaagtccacaactagctgtatacgtaataatcacaaccacagatccagtcacgacgctgaaccaactatattcatttagacggcacaaatctccaaggggtgcttatgttctgatagggcttagggtagggtagtgatgatacccacagtgaccacgttacacacgcaccagcaccggtgatgctgaggtagaacagtagtagtagtctccaagagagaattatttctctaaaacattaattagctggcttcacccacggtaactaggagtccatcttttgcaccttctccaactgtccttgcctcagatatcgccagtgttgtgccttgtgcagcatcgccaccctacttgctcctccagatcttcagcgcaaaactgggtataatgataaggcaatacattgccattgcacccaatacccccacatcagagagcgcataaccaatcctttctctgcgagactcctccattggtagaagtcccacaaacaccagaacacttgctgcaagaagcaggatgaaaagcaaagatgcgagccacgcaagcacaatagggtcctgcagcaccttccacgttaacgctctaaatatcttcgtggcttggatctgaatctccctggcgtgagtgcggagtgaccgtctgaaccccacggcaagcatggcgcgcaagacccgcagggcgaagacgaggatgagcagcgcggggaaaacgagggctccgatcgagactttgaggaacccgtagaccaacggggaagagtcgcccaaggcccggcgcgccacggtcccggcagccacgcccgcgcaggcgacccacgcgctcaagaggtacagatactggagcactctcggcacggagaggttcggaggcactaccgccggttcccgcggcggcggcggcggctgctgctgctgctgctgcgggagaatctcgatcgccacttcggcgacggccatcagagcagggcaggaaatggaaaccgcacgtcgaagctccaaccgctcgtctggggactggactctggagcgaggggaaagcagaataggaaggggatcccggcccgcctcgcggcccccaatgcaa

SEQ ID NO: 22018 - DNA, 838 bp, Zea mays
tagggcccttttttttttttttgtttctcccactctccctttataacccataccaaattagtacgtatgtgggtggacaggttgagcctgggacagatgcagtggtgggcatcatggctcaatcaatatgacttctgcttcattatcaatacaacagattgctgatatatggtattccaagttaaatatacacaacacaaactccggtcctgtaaacagaaggaattgtccatataaaaacttgggcttataggcttgccacgggcatgatgtaaaaggtggctcgagatgtgtagcagagctttttggtgtccttaagtctgaaatcgattgtggtaaccacgactgatctgcccttcctcagtatctgcgcttcaacgtccacttcagaatcgcatcgcgctgcagcgaggtacgcgatgctaagctcgccgaggaacatctctcgatccccggcggctgcccgcgcgcacgccatcccgacggcctcggctacggccgccaccgcgccgccgtggagcgtgttgtacgtgttagtcacggcgtgcgagacggtgatggtgcaagagatccgcggggtcggggaggcggagacggcaacagaggagaggattgcgcggacgagagcggagtaggcgtcgggctggtcggccgaggccgggaggcgcgcgtcggcgcctagggcgcggaagaatgccagcgtcaccgcccgggagtccgccggcgacagcttatgccctggctctccgtccgccatctcctcctacgtctggtcgtttgcttcgctgttccgcggcaccgtgagtgagttcgggatggggttggggcggggagtaat

SEQ ID NO: 22019 - DNA, 3200 bp, Zea mays
tacatatttctgctagtcatttctaaatccatcgactcacatctattgcagatttgcaacaacaaacccgcagcaattggcactctctttacatacacaacacacctggaatcagttagcatttccaattcattgcattattggtcatctaatttaaaaacccaattcccttaccacaatgcaatcagaccgagcattttagagcttaagcatccaatcccctatccatagtgcaatcagcgaccgaacattttacagctaaagtacagtgacttgccccagatggcagaaaatggcaagggacaagcagtacctgggatcaccttggcccacgcgtcctcgaaccggaacccagaggctcgtagaacgtccctacaagacgctaagatcgcctcctgggcgcgctcctcgagcaggcgcagccctgcggtggccatgagccgcacctccgcctccctaacggcgccgccaatcttatccctcgcaaaatctaacagaggcttcagggactccccggcccgcgccgggtcggcggcgaaggacgagaggcccggggagacgcgcatcacggtggagcgcgccagatccgggcggccgtcgggccccgccgcgaagacgtgggcccgggtgcccgtgctgcctccgtctatgatgacggagaagcgcgcggaggcgggagcgggacccggcggctgggcgacgacgtggacgagcgcggagacgatgagcgcgaggagcgctgtgccgaggcagaggctgaagagcctgcggcgccggcgggggcgtggagaggggagtttggtggtggggtcaggcatggtggcgagccgtgtgcaaccgggacccccggccgccgccgccgcccgcccgccgtgactcgtggacggcgagagaggtgacgacgacgtcgagccttttattttatattttatttagatatatttttacatggtttttggccgaccggcggggggcgaacgcttttatagtagggacaggggcagagtggaaggcgccgtgcaaatcttacgtcaacggcgcggcaagacgacttttattttatttttattacacgacgaaacagtaaacgttatatatttatttatactcacaggaaaccaaactgctctacacaatggaatatacgtacggtacgctcgaagtgtgtaccagctgtagtaatggattttgacagcttctatgcagtgcagccatgcagataaagaatttaattaacacattgttggatcgagaacctaacatttggacagcaaaaatcctacttcgttctatagtttgagctccaagtccagctcctcgacgtcgccgccgccattgtcgtcgtccgagtctccgaggtccacgaatgcgacctggggcggcgccgtcgtctggccaggcttgggcttggcacgcgctcgccggtgaccctgctgccactggctcaccgatgatgagctctgcacgtcagaccgggtaaaaccgtactgtaatgaacattctcgccactgaaaattgaatcggtagattacggggataaaggttcggtaatttacttgctccgctctaaattctatttgtttagaatttttctaggtatcttttattatatatatatatatatatatattagtttaatcattttaaattatcctaaatattttataagtcaaagtatctcgataacaaatatagaaatattttttttatggtatcgaatagttatactgtaaacaataaattttattataattatttagtatcgtaaataatattattttattatataaacttagtcgaacttagtatatcttttgactcttaaaaaattaaaatagctttataatttgagaagaagaaaaacagatacctcagacgaggcagcctgtatagtgacagcgctctggatctgatcgtcctgacgagtatggttgtgatgggacgaagggtgaccgccgccgttcgtcgtaaacagcctgctggcgacgacgcacatataaccatcatgtatgatggtttagattacattacacaaatgcaactgtgtaggagtagtaaaaaaaatacttgcctgctggtcaaaggatcattggcatagtaatgctgggcgaggtaatacggagtcaaataccctctggccatttgcagttgatgagcagctccatttccgacgacctgtagataaattcttgtgctgagatcaaagccgctcgctctctctctctctctctctcttcattttctcatcaggaatcgtgaacgcggagagagtggagtggagtggagtgggttgcgtcggaatcgtcatgcgcgcgtacgtacgtgttggtggcggtgcgccggcgccgccgcatgcacgaccagagccgccgtcgtcggaggaggcagggacgacgacgacgcggcggctgcggcgtagcagcgctcggccatctcgagcgccatcctgatccgctccagctccgccacgcccagccctcgccgcggctcccgcctcgcgggcgacgtgacgtcctcggcggcggacgaggccttccgcttccgcccggcggcctctcctccgctcaccatgacccgtacgtacgccgccgcgaccttcaccagtattgtcttccacgcacatcctgatcttcgctgtataaataggtagccacgcacgccgtactacgttcattctcgatgagaggaaaaggaaactgagctgtgtatctcagcattgacggcgggggggacgatctgacgcgcatgaatttcagatactacgctacgctcccggtaaatcccttctccttgcgcgcctgatcctcgaccggatccgggattcccgatgcggtaagtgtgttggatgcggctaagatttggtccatttccagcgcgtgcgagttactgcgccgcgatcgccatgcatggaaacgaatccctgccctgccgccgcgatccatctcgcttttactcgcctccgccgcgcccagcacttccagccagctagcgttttaatctgcttgtgtttctctacaattaaacgcatacgatccccgctctcccacgagattcgccgcggcaccctgcagctagcgtgcggggttctgccgcagcctccgccccagcagcatctcctccccccagttccgcaatcccctgccttgccactatcgtggaactaggcgtcccggctcactttggtgagttccccaaaccaa

SEQ ID NO: 22020 - DNA, 1930 bp, Zea mays
ttttttttttttttttgtgagaaatatcgacctcattagatgaacaaagcaactataattattcatcaaataattcaattaacacatggcaatttgttctacacatcattcttctatacgcacaaatgcgctatcttcctgctccacccacccagctctgctacctaaaggtaaaaacacaaagaattgaactcgtacattgttgcacaacacagcatctattcatgtcgtataaatatagttcttctgcacaagatttagcgtcagctgatgcgtgttatgatgtatcggcctttctctaagtcgtatatgattttcgtcttgggcttcctccatcttgatacaaagagtactccacataaaagaaacattcccagcacagcaaacaatggtctattgctatgggttgattctgcggtggtgtgtaatggctttaaactcgtattttgcatcagtgtgatgaaagctcctagagcccattcaacctgaatgtctccaacctggtttgaatactcaatcctcttgtcatccagtggtacaccaagactgtcatgcagtagagccacaatgtatgccatcgagaagcaataccgtgaaaaatcctcatctgacctattaggatgcttttttctaagactcgacaaatgctgattgcaaaattgttctccagcaaacatgaaatcagatagtgatgaagacttcttaagtccaaagaactttgaagtaaaatagaaattttcagttcccaagaagtatccacgcagctcaggtacaaaagtagatcccaggtgacattgttgatactggcacttttctgcatttatatgagatacatgtggcactaatcctttcctttttgcagtaaaagttgtgaagaagatatgcactctgtaaagtttccagtcccattattaacatactggttctctaatgttgaccttgaagcaccttcattgcgtgaatatcctctgggagcacaaggatcagcaagtgtaccatttttgaaagagcctcttgacctcagcatttcatggaatgagtcttgagctgcattttgaccaaagtttaaaaagctgttggtatagagagtgtatgttgtttcaccaaaagtataattatatgacagtttgggtggaagtacttcatcagaaacaaaggtaagctgagctgaagcgcccccaagttcaattattccaacggttttgttaggatcccctccaagtcttccaagagcataatttgccgcaacccaagcatagacaccttcatccgagcctgggatcaccttggcccacgcgtcctcgaaccggaacccagaggctcgtagaacgtccctacaagacgctaagatcgcctcctgggcgcgctcctcgagcaggcgcagccctgcggtggccatgagccgcacctccgcctccctaacggcgccgccaatcttatccctcgcaaaatctaacagaggcttcagggactccccggcccgcgccgggtcggcggcgaaggacgagaggcccggggagacgcgcatcacggtggagcgcgccagatccgggcggccgtcgggccccgccgcgaagacgtgggcccgggtgcccgtgctgcctccgtctatgatgacggagaagcgcgcggaggcgggagcgggacccggcggctgggcgacgacgtggacgagcgcggagacgatgagcgcgaggagcgctgtgccgaggcagaggctgaagagcctgcggcgccggcgggggcgtggagaggggagtttggtggtggggtcaggcatggtggcgagccgtgtgcagccgggacccccggccgccgccgccgcccgcccgccgtgactcgtggacggcgagagaggtgacgacgacgtcgagccttttattttatattttatttagatatatttttacagcccggcccccccggccgg

SEQ ID NO: 22021 - DNA, 1909 bp, Zea mays
  misc_feature (1885)..(1885): n is a, c, g, or t
ggccgcttttttttttttttttttggataaacaaaacaggtataattattcaccaaaataattcaattaacacatggcaacttgttctacacattcttctatacgcatttgtgctatattccatgctctacccacccagctctgctacctaaaataaaacaaataattgaactggtacattgttgtacaacacaacatctattcctgtcgtataaatatagttcttctgcacaaggttcagcatcagctgatgtgtgttatgatgtaccggcctttctctaagtcgtatatgactttcgtcttgtgcttcctccatcttgatacaaaaagtactccacataaaagaaacattcccagcacagcaaacaatggtctattgctatgggttgattccacagcggtgtgtaatggctttaaacttgcattttgaatcagtgtgatgaaagctcctagagcccattcaacctgaatgtctccaacctggtttgaatactcaatcctcttatcatccagtgatacaccaagactgtcatgcagtagagccacaatatatgccatcgagaagcaataccgtgaaaaatcttcatctgacctattaggatgtttttttctaagggtggacaaatcctgattgcaaaattgttctccagcaaacatgaaatcagagagtgatgaggacttcttaagtccaaagaactttgatgtaaaatagaaattttcagttgccaagaagtatccacgcagctcaggtacgaaagtagatcccaggtgacattgttgttccccgcccggctcctttcctttttgcagtaaaagcagtgaagaagatatgcattctgtaaagtttccagtcccattatcaacatactggttctctaatgttgaccttgaagcaccactcatcctcagcatcatttcttcattgcgtgaatatcctctgggagcacaaggatcagcaagtgtagcattttcagaagagcctcttgacctcagcatttcatggaacgagtcttgagctgcattttgaccaaagtttaaaaagctgttggtatagagagtgtatgttgtttcaataaaagtataattatatgacagtttgggtggaagtacttcatcagaaacgaaggcaagctgagctgaagcgcccccaagttcaattattccaacggttctgttaggatcccctccaagtcttccaagagcataatttgctgcaacccaagcatagataccttcatccgagcctgggatcaccttggcccacgcgtcctcgaaccggaacccagaggctcgtagaacgtccctgcaggacgctaagattgcctcctgggtgcgctcctcgagcaggcgcagccctgcggtggccatgagtcgcacctccgcctccccagcggcgctgcccgcgccgtcaatcttatccctcgcaaaatctatcagcggcttcaaagactccccggcccgcgccgggtcggcggcgaaggacgagaggcccggggagacgcgcatcacggtggagagcgccagatccgggctgccgtcgtgccccgtgacgaagacgtgggcccgggtgcccgtgctgcctccgtctatgatgacggagaagcgcgcggaggcggaagcggcgcgcggaagcggggcgacgacatggacgagcgcggcgacgaggagcgcgaggagcgcggtgccgaggcagaggccgcagagcctgcggcgacggcgggggcgcggcgaagggggtttggtggtggggtcaggcatggtggtgaacggccaggacccccgcccgccgtcgacgccgctcgccgtgactcgtggacggcgagagaggtgacgacgacgtcgagctttatttttatttaaaatatactatattttacatggttcnccggccggcctcgaggtacccaat

SEQ ID NO: 22022 - DNA, 1886 bp, Zea mays
tttttttttttttttttttttttgggtgagaaatatcgacctcattagacgaacaaagcaactataattattcatcaaataattcaattaacacatggcaatttgttctacacatcattcttctatacgcacaaatgcgctatcttcctgctccacccacccagctctgctacctaaagatagaacacaaagaattgaactcgtacatcgttgcacaacacagcatctattcatgtcgtataaatatagttcttctgcacaagatttagcgtcagctgatgcgtgttatgatgtatcggcctttctctaagtcgtatatgattttcgtcttgggcttcctccatcttgatacaaagagtactccacataaaagaaacattcccagcacagcaaacaatggtctattgctatgggttgattctgcggtggtgtgtaatggctttaaactcgtattttgcatcagtgtgatgaaagctcctagagcccattcaacctgaatgtctccaacctggtttgaatactcaatcctcttgtcatccagtggtacaccaagactgtcatgcagtagagccacaatgtatgccatcgagaagcaataccgtgaaaaatcctcatctgacctattaggatgcttttttctaagactcgacaaatgctgattgcaaaattgttctccagcaaacatgaaatcagatagtgatgaagacttcttaagtccaaagaactttgaagtaaaatagaaattttcagttcccaagaagtatccacgcagctcaggtacaaaagtagatcccaggtgacattgttgatactggcacttttcctttcctttttgcagtaaaagttgtgaagaagatatgcactctgtaaagtttccagtcccattattaacatactggttctctaatgttgaccttgaagcaccttcattgcgtgaatatcctctgggagcacaaggatcagcaagtgtaccatttttgaaagagcctcttgacctcagcatttcatggaatgagtcttgagctgcattttgaccaaagtttaaaaagctgttggtatagagagtgtatgttgtttcaccaaaagtataattatatgacagtttgggtggaagtacttcatcagaaacaaaggtaagctgagctgaagcgcccccaagttcaattattccaacggttttgttaggatcccctccaagtcttccaagagcataatttgccgcaacccaagcatagacaccttcatccgagcctgggatcaccttggcccacgcgtcctcgaaccggaacccagaggctcgtagaacgtccctacaagacgctaagatcgcctcctgggcgcgctcctcgagcaggcgcagccctgcggtggccatgagccgcacctccgcctccctaacggcgccgccaatcttatccctcgcaaaatctaacagaggcttcagggactccccggcccgcgccgggtcggcggcgaaggacgagaggcccggggagacgcgcatcacggtggagcgcgccagatccgggcggccgtcgggccccgccgcgaagacgtgggcccgggtgcccgtgctgcctccgtctatgatgacggagaagcgcgcggaggcgggagcgggacccggcggctgggcgacgacgtggacgagcgcggagacgatgagcgcgaggagcgctgtgccgaggcagaggctgaagagcctgcggcgccggcgggggcgtggagaggggagtttggtggtggggtcaggcatggtggcgagccgtgtgcaaccgggacccccggccgccgccgccgcccgcccgccgtgactcgtggacggcgagagaggtgacgacgacgtcgagccttttattttatattttatttagatatatttttac

SEQ ID NO: 22023 - DNA, 1041 bp, Zea mays
  misc_feature (981)..(981): n is a, c, g, or t
  misc_feature (1008)..(1031): n is a, c, g, or t
caccaacgttcatttactgcatcaacaacgtcattaaagtttgtttaattcaaactaaacaatgtgaaacaaatcgcacagctcaaatgacaagtatggaacaaagaaggcagactcctgtaggacaatccaccaacatattgccaaaccgggttaacagaattataaacacaaaatccctgatcaatacctcttgcgtaatttacagctccaatgctatgcgacatgcaaaaaagaggaagactggagtgcgctttaagagctagtgcagatttaagttcaattcttctttttcgagtgcttcaccagccattcaatgacagaatcaatgttggtagagttcttgcaagatgtcatgaaacatgccacttctcggtcagtgattgtctttaggcccattagttctgtgaaggtttgcttggggaaagcttcaggtttgtcaattttattgccaatgactagtaacggaatcccggtcaaagatggcttgctcaagaggtcatggagttccccctttgcaatggccatgttttctcgatctgccgcgtcaacaacatacacaattgcagaaaccgcacggcagtatctctcccacatgctgcggaatcttggttggcctccaagatcccacaactttatcgtcacatttcctttcgtaacttttctcatattgaatcctacagtagggatcatatcctcactaaagcctccagtagcaatagagttcacaagtgacgttttcccagcattttggagccctatcaaggaaagctccatctcttgcttgaagaagaggctgcggagccagttaagaaaagcctcccagaaccccatggcgccgggtccttgtcggctccggggagctgcgcggtccggaggccggcggcgaagaaggcggaggggatcgtgcggggcggcgacgggttgaagggcgcagggggattcggtggaggcctcctgtcacccgcgtttactttattnggaggcggattctgaacccggccggcnnnnnnnnnnnnnnnnnnnnnnnnagggaggcga

SEQ ID NO: 22024 - DNA, 880 bp, Zea mays
gcgacatgcaaaaagaggaagactggagtgcgctttaagagctagtgcagattaagttcaattcttctttttcgagtgcttcaccagccattcaatgacagaatcaatgttggtagagttcttgcaagatgtcatgaaacatgccacttctcggtcagtgattgtctttaggcccattagttctgtgaaggtttgcttggggaaagcttcaggtttgtcaattttattgccaatgactagtaacggaatcccggtcaaagatggcttgctcaagaggtcatggagttccccctttgcaatggccatgttttctcgatctgccgcgtcaacaacatacacaattgcagaaaccgcacggcagtatctctcccacatgctgcggaatcttggttggcctccaagatcccacaactttatcgtcacatttcctttcgtaacttttctcatattgaatcctacagtagggatcatatcctcactaaagcctccagtagcaatagagttcacaagtgacgttttcccagcattttggagccctatcaaggaaagctccatctcttgcttgaagaagaggctgcggagccagttaagaaaagcctcccagaaccccatggcgccgggtccttgtcggctccggggagctgcgcggtccggaggccggcggcgaagaaggcggaggggatcgtgcggggcggcgacgggttgaagggcgcaggggggttcggtggaggcctcctgtcacccgcgtttactttatttggaggcggagggcgacgcggcgtggatggggcgggggacgagggagtgacagggaggcgagggcgccgcgaccgcgagcgagcagcggcgatcccggcccgccccgaggtacccaatcgcc

SEQ ID NO: 22025 - DNA, 1111 bp, Zea mays
accttggggcgggccgcccccacgtcaagactagttttttttttttttttctttagaacaaatcgcacagctaaaattgagtggaacacaggaggcagcctcagagcacgggcgtgcacaataccagacgctgtccaccaacatactgctaaaccaggttaacaaaattatgaacacaacatccctgattaatacctcttgcataatttacagctccaatgctatgcgacatgcaaaaatagagagattggcgtgcgctttaatagctagtacagatttaagttcaattcttctttttcgagttcttcaccagccagtcaatgacagaatcaatgttggtcgagttcttgcatgatgtcatgaagcatgccacttctcggtcagtgatcgtctttaggcccattatttctgtgaaggtttgtttagggaaagcttcaggcttgtcaattttgttgccaattactagtaatggtattccggtcaaagatggcttgctcaagagatcatggagctccccttttgcaatggccatgttttcacgatctgccgcgtcaacaacatacacaattgcagaaaccgcacggcagtatctctcccacatgctccggaatctaggttggcctccaatatcccacaattttatcgtcacattccctttggtaacctttctcatattgaatcctacagtagggatcatatcctcactaaaacctccagtagcaatggagttcacaagtgatgttttcccagcattttggagccctaccaatgaaagctccatctcttgcttgaagaagaggctgcggagccagttaagaaaaaactcccagaaccccatggcgccgggtccttctaggctcctgggagcttcgcagtccgggggccggcggcgaagaaggcggaggggatcgagcggggcggcgatgggttaagggcgcaggtggatttggtggtggcgtcctgtcacccgcatttactttatttggaggcggagggcgacgcggcgtggatggggcgggggacgagggagtgacagggaggcgagggcgccgcgaacgcgagcgagcagcggcgaccggcgatgccccggcccgccccgcgggtcccaatg

SEQ ID NO: 22026 - DNA, 1870 bp, Zea mays
ggacaatgagactgtcgagagctgctaacacataggacgtcgccggcggcgacccgccaaggtcaggccagggctgaggcctccgctttggaccagatcgcgctctcttgcggtcctatagctactgaactgaaagccaagccggtcaggtaggaatggatcctgctctgctgtgcactggtcgccatctttaaatccaaacggggttgcaatggaacaccgaccacccccaccctgatcggtgatcccagtcccatcatatgctgggagcacgccttattcatggccttccaaatggaccagcgcaacgtgctccaagtttaactccattgccataggctcagagatgtactactattcagtagcgtgtggccgagatctgatctactcgtgcccggaaactaggggttatctccgtcgcagaccaccgcactcttcccttcctatggcaatttcccctaatcatggagacatgcactagtttgatccgttctaatgccttgagttacggtttaagatccagagatctaacagcaggagcttacgacagtttcatgtgctcactgctacaatgtagtacctatatatgttggagacggagcctggaaccggcctaggcttttccaccacatggggcctcgcatgtccagcactgcaattctgaaagcaagtgccgacacctgacgggaaacatccattcaagatacaaaaccatgggatgggatacaggtttaacgacaactcggtactcgttacagaggggtttacattttgccatatgtttggtgccaagaactggcgtcatggaactcatctcaaaaaccttgtttcaaagcggcaaaaaaaaacactggtactgctggtagccacaccgtaaagcctaaccgaaactgaaggagcggaaaccataacactacaagttcactggtactataaccgctggcgacggggcggcgctcttcagccccggttgctgactgaatacgccactttgacaggcctgccctgcagtttcgactggttcatcgctatggccttctcgagcgactcgtcgtcttgaaattcgacatggcagaagccacgggaacccccggttcttttgtcgacggcaaaccttaccgatgcaatcttcgacggcccgaagaaacctcgcaagtcgttttcgtccacgttccatgagaggttgccaacatatgccgagaggcagccttcggacttcttggggtcggtttcgaactctgccttcctcttcttgtttgaggtggccgtcaccctgcacctttcaaccctcatgtatctgctgccaattttgaatccatcaagctcaagagactttattgcatcttcttctgactcgaagcagaggaaggcaaggccgcggaagttgccggagtccgggaagcgagagagctgcatcgactggatgggcccgtagaactcgaacagcttccggatgtccgcctcggtggtcgtgtagggcaagccgctcgccaccaccttcccgggctcatagccttccgccgccgcagtcgcctcttcctcctcctccttctccacctgtactgccgcctcaactacccccgccgggtgctcttgctccggctccaccgacggctcctcatcggcggcggcggcggagataggctggccccacttgtccctcttcgtcttcttccgcgtctttgccttgccggggcggagcttggtacaaggagtctggtcctcggccgccatggctaaaccctagtcctctcggcggctcgtccttgattccttgctccgcagccctctctcagcccctgctccccctagagaaatttgctattatagctcggcccattcgcggtagccggcccagctccagaatctc

SEQ ID NO: 22027 - DNA, 1574 bp, Zea mays
  misc_feature (53)..(53): n is a, c, g, or t
gggaggggcacgctgacgtgctggacccgttggacagcggatccgaggccgcngacgcgtgcggacgagtcgcctagtgggcgagcccactcggcagagagagcggggaggggtggcgggcgtgcgctccagcattatgacgtgccgagccgtcgtcgcgcgcctttgtctcttgctcagatcggcccaacgcaatgatgcccagcaggttggcatccgcctgcagccgagcacaggacaatgagactgtcgagagctgctaacacataggacgtcgccggcggcgacccgccaaggtcaggccagggctgaggcctccgctttggaccagatcgcgctctcttgcggtcctatagctactgaactgaaagccaagccggtcaggtaggaatggatcctgctctgctctgcactgctcgccatctctagatccaaacggcgtttcaatggaacaccgaccacccccaccctgatcggtgatcccagtcccatcatatgctgggagcacgccttattcatggccttccaaatggaccagcacaacgtgctccaaatttaactccattgccataggctcagagatgtactactattcagtagcgtgtggccgagatctgatctactcgtgcccggaaactaggggttatctccgtcacagaccaccgcattcttcccttcctatggcgatttcccctaatcaaggagatatgcactagggtttaggagttacggttaagatccagagatctaacagcaggatcttttgtctgtttcttgtgctcctgaccatttcaagaggagacacctgacggaaacatccattcaagatacaaaaccttttttttggctgggatacaggcttaacgacaactcggtactcgttacagaggggtttacattttgccatatgtttggtgccaagaactggcgtcatggaactgatctcaaaaaccttgtttcaaagcggcgaaaaaaaagcttaagccaaaactgagggagcgaaaccgtctcactacaagctcacactggtactgctggtagccacaccgtaaagcctaaccgaaactgaaggagcggaaaccataacactacaagttcactggtactataaccgctggcgacggggcggcgctcttcagccccggttgctgactgaatacgccactttgacaggcctgccctgcagtttcgactggttcatcgctatggccttctcgagcgactcgtcgtcttgaaattcgacatggcagaagccacgggaacccccggttcttttgtcgacggcaaaccttaccgatgcaatcttcgacggcccgaagaaacctcgcaagtcgttttcgtccacgttccatgagaggttgccaacatatgccgagaggcagccttcggacttcttggggtcggtttcgaactctgccttcctcttcttgtttgaggtggccgtcaccctgcacctttcaaccctcatgtatctgctgccaattttgaatccatcaagctcaagagactttattgcatcttcttctgactcgaagcagaggaaggcaaggccgcggaagttgccggaggccggg

SEQ ID NO: 22028 - DNA, 1632 bp, Zea mays
cattgggtacctcgaggcccgccgcggcgctgcctccctccactactacgccactctgccttccctcccccaccaccacaaggaccgcttcaccattgccgcgccgcgtccagctgagcctcctcttagccgcgtccagccaggagaaggcgggcgcgcacacctgctgcttggtgaccacgttcgatggagctgcacaagtactggggcgtggggggccggcggtgcggcagctgcgagggggccccggcggcggtgcactgccgcacgtgcgttggtggatccttcctctgcacgacgtgcgacgcccgccccgcgcacgcgcgcctgggccacgagcgcgtgtggatgtgcgaggtctgcgagctggcccccgccgccgtcacgtgcaaggccgacgccgccgtgctctgcgccgcctgcgactccgacatccacgacgccaacccgctggcccggcgccacgcgcgggtccccgtcgcccccatcggctccgaggccgccgccgcggccgtggaggccatgctgttcgggaccggcgaggcggccgcttccgaggccgacgagcagcacgcggcggccgagcacgcgcagcagcagcacgcgcacgcgctgaacctcaacgtggaggccaaggacatgaagctggactacctcttctctgaactggatccctacctcagcgtcgagatcccgcgcttccagcacgctgacagcgtcgtccccaacggcgccggcgctgccgtcgagctggacttcacgtgcggcatcggcgttaagcactcctcctacagctcctacacggccacctccctcgctcatagcggctcctcgtcggaggttggcgtggtgccagaggccttcggcggcagcggcggcgggagctttgagctcgacttcacaaggcccaagcctcaggcctacatgccatacaccgggactccccagagccacagcgtgccatccgtggacgtggaggtggtgccggagcggggagacttggctgcggtgaggccggtgccgctgatgggggagagcagggaggcgcgcctgatgcggtaccgtgagaaaaggaagaacaggcgcttcgagaagaccatccggtacgcgtcccggaaggcctacgccgagacgccgccgcgaaatcaagggccggtttgccaagcgtgctgaccacgacggggacgccgacgccgacgacgctgaggccgaggccgaggccgccgtgccgatgtcatatgtgctcgacttcggctacggcgtcgtaccgagcttttgatgtgcccgggcccaacacgcgcgcacatggccggccgcgcgcttgaaccggcatggcacgccgctgcgcgcgcgccttgtacttgtatcgatcgatgtatagggaggagtagtaatcccatgtactctctttttgagcaagctcttgcgtaaactagtgatgtataatttgtactactagtaagaaactgcagtagccgctgctaatggatcaccaatctataccgcgcacaagttgtcttaaacgcgccaccccgagcgcccgcgtggggggcccggttctcaaaaatacacatcagtttttttaaaaaaatttaaaatcgtgtatctgaagttatatgcagaaaaaaaaaa

SEQ ID NO: 22029 - DNA, 1630 bp, Zea mays
cattgggtacctcgaggcccgccggtgcgcggcctccctccactactacgccagccactctgccttccctcccccaccaccacaagaaccgcttcaccattgccgcgtccagctgagcctcctcttagccgcgtccagccaggagaaggcgggcgcgcacacctgctgcttggtgaccacgttcgatggagctgcacaagtactggggcgtggggggccggcggtgcggcagctgcgagggggccccggcggcggtgcactgccgcacgtgcgttggtggatccttcctctgcacgacgtgcgacgcccggcccgcgcacgcgcgcctgggccacgagcgcgtgtggatgtgcgaggtctgcgagctggcccccgccgccgtcacgtgcaaggccgacgccgccgtgctctgcgccgcctgcgactccgacatccacgacgccaacccgctggcccggcgccacgcgcgggtccccgtcgcccccatcggctccgaggccgccgccgcggccgtggaggccatgctgttcgggaccggcgaggcggccgcttccgaggccgacgagcagcacgcggcggccgagcagcagcagcacgcgcacgcgctcgccctcaacgtggaggccggggacctcgagcccggccgcctcttctctgaactggatccctacctcagcgtcgagatcccgcgcttccagcacgctgacagcgtcgtccccaacggcgccggcgctgccgtcgagctggacttcacgtgcggcatcggcgttaagcactcctcctacagctcctacacggccacctccctcgctcatagcggctcctcgtcggaggttggcgtggtgccagaggccttcggcggcagcggcagcggcggcgggagctttgagctcgacttcacaaggcccaagcctcaggcctacatgccatacaccgggactccccagagccacagcgtgccatccgcggacgtggaggtggtgccggagcggggagacttggctgcggtgaggccggtgccgctgatgggggagagcagggaggcgcgcctgatgcggtaccgtgagaaaaggaagaacaggcgcttcgagaagaccatccggtacgcgtcccggaaggcctacgccgagacgcggccgcgaatcaagggccggtttgccaagcgtgctgaccacgacggggacgccgacgccgacgacgctgaggccgaggccgaggccgccgtgccgatgtcatatgtgctcgacttcggctacggcgtcgtaccgagcttttgatgtgcccgggcccaacacgcgcgcacatggccggccgcgcgcttgaaccggcatggcacgccgctgcgcgcgcgccttgtacttgtatcgatcgatgtatagggaggagtagtaatcccatgtactctctttttgagcaagctcttgcgtaaactagtgatgtataatttgtactactagtaagaaactgcagtagccgctgctaatggatcaccactctataccgcgcaaaaaaaaaaaaaaacgcgcccctccgagcgcgcgcgtggtttgcactgttttcaaaaatacacatcagtttttttaaaaaaatttaaaatcgtgtatctgaagttatatgcagaaaaaaaaaa

SEQ ID NO: 22030 - DNA, 812 bp, Zea mays
aaaaaaaaaaacaaaaaaaaaaaaaaaaaaaaatgtgtttgttgtggagaataacctgtgggcaattggaatgtacacattagggctacatcggacccagagatttggaagaaggggccagcatttggaatgcctggggtgcatgttgatggtatggatggccctgaaggtcagggaggttgctaaggaggcaattgagagggcaaggagaggtgaagggccaaccctagtcgagtgtgaaacatacaggttccggggtcactcccttgcagacccagatgagctcaggaagcctgatgagaaaacacactacgccgcaagggattctatcacggccttgaagacgggcatcatagagcagaacctcgcaaccgaatccgagctgaagagcatcgagaagaagatcgatgatgtcgttgagggggctgtcgagtttgctgacgcgagcccacatccgccgcgcagccagctgttggagaacgtgtttgccgaccccaaaggctttggtatcggccccgatgggaagtacaggtgcgaggatcccaagttcacccaaggcactgcccaagtttaaggaggttaatctgcgctctgtaccactgtgcttgggttctctagttttgtcgatcccagtgtcatgttaaggatactgtatgcataaggcggtccatttctttggctcttaggcttgtgtctgatactattgtgtaatttattcgaatgctcaactgatgctcatgttttatggcaaaaaaaaaaaaaaaaaagcggccggattccccgcgcgcatgccgccgggaccttcgcctcgg

SEQ ID NO: 22031 - DNA, 2697 bp, Zea mays
  misc_feature (2574)..(2574): n is a, c, g, or t
cacgcgttctagtttggaagaagggctttgtggttctgtgttcctgcttatttgtaaaactttaattttgattctctcttttcagcccttccatgtttaggtaaaaacatctcacttttgaaaaaaaacgtgttcaagaatctattctgtacaaatgcacaacataattcctcactggaaatctggaatggaacaacaagtcaatcgtgcattctgtggcagacgaacaacctgaccccacgtatgcatcggaagttcgggacggagtgacgcactacacagacgcgacaagagcgaaggcacagaggaggtgtgcagcggtgcgcggggctgagctgggcggaccctccaaagcccgagcgtgagcgccatcgtccaccgaggccttgcctgcctgccttgtttccccaaccccctcggaccctcacatcttcctcggtctctccgccgcccaccacctccatccccctcctctctttatacgccaccgcggcggggcttcccccatccctctgtccgttcgctgcattgctcccctaaccgttcggccaggagacagcggagagggcagagatggcggccgcgtccttcaccgccgccaagttcctggcgccggtggccgcgagatccggcggagagagggcgcccccgctccccgccggcgcctcgtcctcctccttcgccaggaccctgcgccgcggcgcggtgcaccacccgcgcctgcgcaccgcgctcgccgtctcctccgacctgctcgctgggaacaaggccgcgcaggccgccgccgcgcatccggcggttacacgggaagaggcactggagctgtatgaggacatggttcttggccgtgtattcgaggacatgtgtgcacaaatgtactaccgtggcaagatgtttggtttcgtccacctttacaatggccaggaggctgtctccactggcttcatcaaacttctgaaccaagctgactgtgttgttagcacataccgtgatcatgtccatgcgctgtccaagggcgtcccggcacgttctgtcatggctgagctctttggcaaggccacaggctgctgccgtggacagggtggttccatgcacatgttctctgctccccacaacctcctgggaggctttgccttcatcggagagggcattcctgttgccactggtgcagcctttgctgctaagtaccgtcatgaggtgctcaaggagtctggccctgatgggcttgatgtcacattggcgttctttggcgatggtacctgtaataatggccagttctttgagtgtctgaacatggcacagctttggaagcttcctattgtgtttgttgtggagaataacctgtgggcaattggaatgtcacacattagggctacatcggacccagagatttggaagaaggggccagcatttggaatgcctggggtgcatgttgatggtatggatgtcctgaaggtcagggaggttgctaaggaggcaattgagagggcaaggagaggtgaagggccaaccctagtcgagtgtgaaacatacaggttccggggtcactcccttgcagacccagatgagctcaggaagcctgatgagaaaacacactacgccgcaagggattctatcacggccttgaagaagtacatcatagagcagaacctcgcaaccgaatccgagctgaagagcatcgagaagaagatcgacgatgtcgttgaggaggctgtcgagtttgctgacgcgagcccgcatccgccgcgcagccagctgttggagaacgtgtttgccgaccccaaaggctttggtatcggccccgatggtaagtacaggtgcgaggatcccaagttcacccaaggcaccgcccaagtttaaggaggttaatctgcgctctgtaccactgtacttgggttctctagttttgtcgatccagtgtcatgttaaggatactgtatgcataaggtggtccatttctttggctcttaggattgtgtctgatactgttgtgtaatttattcgaatgctcaactgatgcccaggttttatgatacgttccggagcttaacttgttcaggaacagctcagtttctactctatagaagtatgtagaatggttttgggggagtaaggccttgtttgtttaccccataaattatataatccagcttataaataagttgagaagtaaacatagattattaggtggattatgtaatctagatatctagattatgataatctataagcaggtcaataggtacttatataatccataagcttgattctataatcctagaaggaaacaaatagagcctaaatttgtttatcctctaaattatataatttagcttaaataagttaagagacaaacaaacaaaactgattattaggtggattatataatctagatatctagattatgataatctataagtagaatgatatgtttatataatctataagctagattattactcctttcggttttttttatatttgatgttggttagtacaaaaatgaagtagctagcgtcaaataaaaaaaatgaaggtagtataagaaaacaaacagggcctaacagatatagngtgcatcagttcagattgaccttgggccaagttttatagctagcccaaactgtcatttctttgtgatgctacactgcatgggatatctggtattctggtcaaaggttattttgcgaattgcga

SEQ ID NO: 22032 - DNA, 3731 bp, Zea mays
ctgagaagacgacctagcgatctacctgtagcttttctctactaaaagagaactctttctgttaggtgttgtagctgtacagactaagggtacttcatcacagaggaaggagggtagttgtccatcctgttggacatgtacgcaactacgtgtatatatgatatgatatattcttgtacagcagtacaggagagggaggcacagctcatatgaacttgcactgggatccattcaaagtgatgaattgaagaggctatgtttagttcttccagccagtcctaaacaagctcaactcattgacctgttatatttatttgcaagctgccacggcagatggttgggttgagcactccagtcactggtgactaccaaactaccaatgcaagaaccataggaaaatggcctcacgccatgtcaaattctccatcctgaattcagtggccttgttagttgcactgctgtgcgctgcactgctaagcacagcaggaacggcaaaagatcacttttcaagtacttgtagatcgtttgagccccacaggtttgcagtgtgaaggtcacaagttcatcatcactgtggcgtccatgccatgccactgtcgcctccaaaagctcacgtccgaatcatacaaaattttcagttcccccaatcatcttttccacataatttatgtcgatgtccccaacttttccgtccagaggactctggtacatgagcaaagaccaggtttgctaacctttttgcccaaccggccggccgcgggcgccggcgagccggccggtagccttcctgtcgctatgccggccggggccagatggattttcttcatgccaacctcacctgcaaaaataaaaataaaaaataaataaataaaatgtatgcattgtggtggcctggcctggagccctggtccaagctggtagaacagcagggatgctgtcaccggcacacctcattctggtcacctgttattaaaatactacctctccacaaagtaaccaatagatgttgcctgcgatgttgatcagatcagtcagttggtatttgggcatcagagttcggtgcctacttggctacttcaaccagtagccagccagctactggcgtactgcatgtacgtgcgtgcagggattctccgtgcatgtacggtatgtatccctgacaagagggaggctgtgtggccattatgtgggacaagacaaccatgcattcaatttgcaatgcaacactgtattgcttgcatggctttgttaccgtcagtcaagaactgtaatgcagaggaaccggtataaacaacgagcatgtttgttccggtcttccgggaggcaggcatgtgccttgcataatgtaatgtaatggcatggaatggaatggaattctcctctcatgtggattatgcacccccaatcattggccacccaatcaacctctctttagtctctacgtgtttttacgtgctagcatgctctgggccttttgcaatggaatctcttctctgcgggccagtagtcatggaaagcgagtaaacaatggaagaaacctgaaaccaattcaatgctgcagatgcaacagtctctggtgaagatagagagatctcattgctgctccctccccttttttcacttttgctttttaggcccagtaccctccagtaagttttgctcttctttttgtgcacctttctttcgtatcctttcaggtgcttggatggatgcagccctctttcttggcatcctcctcccctttgacctcacctcccagcatcggatgcgctgtaaaaaaaaggaaaggaaaggctaaaaagaaactcatcagttgtaatgccgttttcttgcatgatcatgaaaggcacagttctatatatatatatatattcagtgaccatgaacacccaggtcacgtgtcagttcccgagattatacagcgaaacaatgtccagatgcatctttaaatgcgttagttgcaacatcttattagttggagtgctgttgagctcccaggcacgggtacacatccgggccccagttccaacctcccgtcgcccagcctgtggacacgagtagaaccaatcaatgaaaacgatatgcatatctatcatcactcttcataaaaatttttttggcattgttcagcacgaggtcactcaggatcagacccgttcagcctgcagctcatgcatcactgacagtcctggttcatacggaacatggccacatacggcaggagctcccatttcaggctgcgtccaagaaaagccgaaaaaactgtggcactgcgcctatgtgacaaggttgtctcagggaggccttgacaagctgtcgcagcaagcttacaaatatagcaaggagccaacagcagcaggctagagaacaaggcaaaaaattggaaccatgcttcttgggtcttgtgtcgaagggggtgctgaaggtttcttctgttcagttggtgcttacttacatgctactgcaccaagcacgaaaaactcatggtaatccagagccttttacagagttcagaccaagcatctgcaacccatacatgatggcactgctttcagcaactccttgtcacaggaactttcacagtctggtcatctcaccgatagatagatagatagtccgagaaagttgtagcacgcatcttacatcttatatattggcttaaaggatggagcagttgaacagtagaaagccacaccaaatgggcgcatgaatcaaagaccatcatcggctaatgttcttactgtggtgcctcctcctctacagagatacaactgacacaactccagctcatcatgatgcggaacttcgattttcccgctaaaaggaagttacacaggacttcatgacgaataaccactcaagcacttcgacaaaggagagtcgaaggacggactgtcatttcagggtaatgtcaaatatgactccttcaagattcgagatggttgttcttgttccgttcacttcttcaacacgcattccatgcttttcagcttccttgagtactagtgcatccatgactttagttcgggatacataagccaatatgaatctgcatttaccagcttgaatacgaacaatcctctctacagtatcaaagaggcaggaaatgctagattgctggaagcaaatatcagctccaagaacaagatcaaatccaccaggatgtttttcaataataccgcttaaatgatctgagtttccccactctagtttctcggctgtcaacactgcatgtgcattctcagaacatgactgcaactctatatttttctttataatctccagaacttcatcattgtgatcagtcaagacaacctccttgcagaaacggctacacaatatgccagtaatgccaatcccagatcctagctcaactactgaacatcccttcacaatttcagggtgttgagataggtagttgttcataaggactgcccctggccacactaactgtccagtaagatcaaaatcagtggaagcggcgcggaggcagaggaggcgcaactcgtgggatccgaaggtgaaggtcgtcatctcgtagctgcggtccacgaagaaggaaggatccaggcagacaatgtcgtcctcctcttccttctcctcccgcttcctcaggcttccggagtccgccatcgttcgccgaatttctccgcgccgccgccgccgcccccgccggcaaccagacctactgcagtggaggtgccgcggtgtcactcccaactcccaagctt

SEQ ID NO: 22033 - DNA, 1125 bp, Zea mays
ttttgtagcacgcatcttacatcttatatattagcttaaaggatggagcagttgaacagtagaaagccacaccaaatgggcgcatgaatcaaagaccatcatcggttaatggtcttactgaggagcctcctcctctacagagatacaatacaactgacacaactccagctcatcatgatgcggaacttcgattttcccgctaaaaggaagttacacaggacttcatgacgaataaccactcaagcacttcgacaaaggagagtcgaaggacggactgtcatttcagggtaatgtcaaatatgactccttcaagattcgcgatggttgttctggttccggtcacttcttcaacacgcatcccatgcttttcagcttccttgagtactagggcatccatgactttagttcgggatacataagccaatatgaatctgcatttaccagctttaatacgaacaatcctctctacagtatcaaagaggcaggaaatgctagattgctggaagcaaatatcagctccaagaacaagatcaaatccaccaggatgcttttcaataatactgcttaaatgatctgagtttccccactctagtttctcggctgtcaacactgcatgtgcattctcagaacatgactgcaactctatatttttctttataatctccagaacttcatcattgtgatcagtcaagacaacctccttgcagaaacggctacacaatatgccagtaatgccaatcccagatcctagctcaactactgaacatcccttcacaatttcagggtgttgagataggtagttgttcataaggactgcccctggccacactaactgtccagtaagatcaaaatcagtggaagcggcgcggaggcagaggaggcgcaactcgtgggatccgaaggtgaaggtcgtcatctcgtagctgcggtccacgaagaaggaaggatccaggcagacaatgtcgtcctcctcttccttctcctcccgcttcctcaggcttccggagtccgccatcgttcgccgaatttctccgcgccgccgccgccgccgccgccggcaacaagactactgcagtggaggtgccgcggtgtcactcccaactcccaagctttggattgagccgc

SEQ ID NO: 22034 - DNA, 1011 bp, Zea mays
tttttttttttttttttatcgagcaatcagccatcattcgcgtgtggtgaaacaccacaatgcgttagcacctgacagacagccttgtatttgcaaatctaacaacaattactgtatgtgacttcacaaagatcaaaagccatagttgcagtgactcttcataacagttcattgatctctctatggtagtacaacatgcaaatgggaagtggaatacatcgtcttcatctgctccatgcagcctttggagcatctaatttatacctcagcaacatccatacaaaaatctcatcttgaaccatcaataaagaacaaattgggtaacatgaacaatttaacataaaatgccaagtcgccgatcacaaggctgatggatcgatctagacgacctttggaggcgcctccagcatgagcttctcgatgaggtctgcagcgtcctgcaccgtcgcgatgtcctgtgcgcttgtttcgtcgacggttatgttgaacgcctcctcgaggcccatcacaatctcaaccgtatccagtgaatcagcaccaagttcggcgaattttgattcaccagtgatagcagtcccatcgggaagagccagctgctccttcactatactacagaccttgtcgactgtctccttcttagccgaacagcaaatcttgaaccgaagagaacttggtcttgaacggatggatacagaagtcatcctgtggctctggaaggaaaccgagctccggcttgaaatcacatttgtcacctggcgccgcgcggcggccggcgagaaggaggcggcgagggagtgcgccatgctcgtcgctctcggatagggggcggcggcgagggaaagaggcgctagctgcagctagtctagtgggacaggacagaggtggccgtgaggtcgtagcaggccaggagcagcagctatcacacggtgggagcgtagtgcggcgggccccccggccggccgcgaggtacccaatagaaaagcgtccgtccgggctccggagatgtctgac

SEQ ID NO: 22035 - DNA, 1184 bp, Zea mays
ctgcaagcttggcctactgcaccccctccattattgactcgatccctcgttatgaataggcgtgtgttttgtgaccagagtctgcactgccttagtacgtcacagtgtggatagatagaaaatgaaaggaaatggcaaataaagtcgtcgttagctagtcctgtacgttcatggaagcatatgagagaatttgattttcttttcctgtgacaatcatatgctgtgaaaacagaaccggaaaaaggaacaacctcctctagtttgacaaaaatgggtcctaaaacatgatcacataatgtatgacagagtgtttactatatctacaccaccatccaaacagaccaaaaaacaaacaaccacatgtttcacaagtgcagcaataaggaccattattattttagtaacatatgttacacttaatatgatataaccacctcatcaagctgatttaatttgctgcagagatgacacgtacaatccttttgtacatgtggatagatctggttctgtagcctttatatgttcatgtttttagggcatatgcttactgaacatagatgaatagggcttttgaccgcggcgcgggacagacagccttttttttgcaaatctaacaacaattactgtatgtgacttcacaaagatcaaaagccacagttgcagtgactcttcataacagttcattgatctctctatggaagtacaacatgcaaatgggaagtggaatacatcgtcttcatctgctccatgcagcctttggagcatctaatttatacctcagcaacatccatacaaaaatcttatcttgaaccatcaataaagaacaaattgggtaacatgaacaatttaacataaaacgccaagtcgccaatcgcaagactgatggatcgatctagacaacctttggaggcgcttccagcatgagtttctcgatgaggtctgcagcgtcctgcaccgtcgcgatgtcctgtgcgcttgtttcgtcgacggttatgttgaacgcctcctcgaggcccatcacaatctcaaccgtatccagtgaatcagcaccaagttcggcgcatttttgattcgcagctaaaggtgattttgatacagagggattaccgtatccagtgaatcagcaccaagttcggcgcattttgattcgccagtgatagcagtcccatcgggaagagccaggt

SEQ ID NO: 22036 - DNA, 1867 bp, Zea mays
  misc_feature (358)..(358): n is a, c, g, or t
gaggggctaaaatctcctacttattaaaaaaatattgaataaggaggagattttagcctctctaatcccctccgggtttaaggctcccaaactagctgttagccctaacagcttctagccgaccatcccatcccggatcgacatgttctgagtcatgttctgtaaacctaagcactgtgtggatgtattgctgtattgtattgatgtattgttgtgatggtcatgatatttgaattttcagttcagttcagtaaatgttgtgttgctgtagtatataaatttgtattgctgtgttgctgtaaagctcagtgctgtaaaggaaaatatacatttgtttggcaaccggccaatcaacaangtttcctggaaaactgacgttaacgaaaaccgaaccgaaaattttgaaaaccaaaatcctcggttattatgattttctggtaccgaacgattcttcaaaactgaaaaccgaacttttcttgtaccgaaaaaactaaaccgaaaaaaccgattaccctgtcatcaatcatacacgatgaccatccatctcacattccattatcgctgtggccaatatgcaaatcgatgttcctcgaaaacaataataaaaaatacaaatgtgagattgcatatattttgaaaaagatggcagggctgagccacacgtttcaccatcaataggacaaaagcagcaccagccaccaggcagactccctcgactccgactctacgcgacacacgagcgcaggggctcaaacgcgaaaaaaaagaggccccaacgcccactccaccggccaatcacccgccggcgcgccatggcggccgccgccggggactccgtcaagcagccgctcctccaccgcgcgtacccgtcccacgccgcgtcggcctcctcgccggccctcccgtccgttcccccggggggcgggggccgccgcttcccagggggcctcgacgtgcccaacctgaagaagcgcggcggcggcacgcgcagctggatccgcgtcgaggccgccacggcctccgtgcagacgctggagatcgacaaggccaccatgatgcggcgctgcgagctccccgcgcgcgacctccgcctgctcgacccgctcttcgtgtacccgtccacggtcctgggccgcgagcgcgcaatcgtcgtcaacctcgagcagatcaggtgcgtcatcaccgccgacgaggtgctcctgctcaactccctcgacagctacgtcctccagtatgccgccgagctccagcgccgcctgctccagcgcgcggagggcgacgagctacccttcgaattccgagcgctcgagctcgccctcgaggccgcgtgctccttcctcgatgcacaggtgaccatcaaaactcctcaatttcatgtctagttttttttgttgttggactcatagtaggttcagtccccattattgggttatggcccgatgatgactatattctgacatggtttgcaatcctttaattggctggctcaatggtccactagcttgccaggtttttactaggggtcacataatgagaagttttagaatattttgtgagtatcatgttgcgcgtgatacaatcaaaacttctgaaaccactgctggttatagttcttgctggatgagtgggataccacaacttcccaattgttgctgagcatcaagtaaaatgttgcagctaactttctgatggtgatttgaacacatgttgtcaatgagagacttcgttttgcatctgttatttcttccaacttgcatcagtctcctgcttttgcaatttcagctaggatagtttgaatgagcccatcaaagttttaaagttggatgtttcttatgagaaaacttcaaatttggtgcatgttagtaac

SEQ ID NO: 22037 - DNA, 1895 bp, Zea mays
tccaggagctggagatgttactggaagcttattttgttgttatcgacagcactctgaacaagctgacatcggtaccgagccatatctccagcatatcttaaatctggctatgctatgtgtagtaataatgtgataggagtgaaaggggtctgatgatctgtttttccttctttcagcttaaagagtacatcgatgacactgaagacttcatcaacattcagctggtatgccagcatattttatgctctctattcgggatatgaatatcagagtttatgcatttctcacactgctggtctgtgtaacttatttgactttccatatgttcctaggacaatgtgcggaaccagctgatccagtttgaattgctgctaacgaccgcaacatttgttgtggccattttcggagtggttgctgggatattcgggatgaactttgagacatcagttttcgaaatagagaatgcattccagtgggtccttgtaattacttcagtgaccggcgttttcatcttctgctcctttctttggttcttcaagtacaagagattgatgcctttgtagagaatgtatatgccctcctcccataggaccgatgaatcaatttcaaccctgttaagaggcacttgatcagaagcctgaacctctgccgatgtaaattaccattcttttagaggtttacggcatgagtaccgagaatccgggtgaaaattgtaaccttcttgacatgatccctgtgctgtataagagaaaatcatattacagtttatacaaataataccgaccaattctacatccagaaaaaaaaaaaggtggctcgataggatataagatgatttcgtcaaaacatgttcctgacgcttctagctcccagtaaacagtgtcttccatctggctactctatccgtttcttatgttaaggtcacgaagatttatcttaaattaatattttaaaactttgactaataatatttataaaaataattatttttaaattagaaaatatatatattgtgatagatgttttaataataaatctaatagtttcatttttattcagtaatattaatgaatattttgctactaacggttaaagttaaaagtatttaacttagaaaatactttcgttaagtgactttaagatagagaacggaggagtagttcattcatgagaaacaccagtgcgtggatgttgacttgatgctgcacgtggcagtgccacgatgtcacgcttgcacgcgaactccatgcgtgtcctcttgccgcttaacctgctaccaccataaagctgcttcggcacggagcccgaccggacacatagcttcctagtccgtgtagtggaggtagtggaggtagccatcatcagaatccagaaaggagcaccgtgtgtgcgtgatgtggccggagaagatgtacgcgtgggcgtccatggcagaagacccgctcaagcgcgcggggtcggcatcggcgcatccgtcgagccctctacggcgctacagcccaacgacgctggcggtcggcggcctcatcgtcgttggcggcctcagctacgtcatgttcgggagcaagaagaacgggcgcgaccagcaggccagccgagcttagaaaaggcccgtggagatcgtcgattagctagcttaccgagatgttccgaaaataagataggattaggctctttggcgggtgttatgtatgtgttccatatgtgcaaaaacctcgagtgctactatcttgttatccatgtatgtataacatgccgattttcttactgaataagtagcctcccttgtgatttaattattagaaccacggaagatatgtggttcaaatgttaagctcgtttcattgtagcatctgtagccgccgctcgcggtctagaactagtcggacgcgggg

SEQ ID NO: 22038 - DNA, 1707 bp, Zea mays
acacgtttcaccatcaataggacaaaagcagcaccagccaccaggcagactccctcgactccgactctacgcgacacacgagcgcaggggctcaaacgcgaaaaaaaagaggccccaacgcccactccaccggccaatcacccgccggcgcgccatggcggccgccgccgggggactccgtcaagcagccgctcctccaccgcgcgtacccgtcccacgccgcgtcggcctcctcgccggccctcccgtccgttcccccggggggcgggggccgccgcttcccagggggcctcgacgtgcccaacctgaagaagcgcggcggcggcacgcgcagctggatccgcgtcgaggccgccacggcctccgtgcagacgctggagatcgacaaggccaccatgatgcggcgctgcgagctccccgcgcgcgacctccgcctgctcgacccgctcttcgtgtacccgtccacggtcctgggccgcgagcgcgcaatcgtcgtcaacctcgagcagatccggtgcgtcatcaccgccgacgaggtgctcctgctcaactccctcgacagctacgtcctccagtacgccgccgagctccagcgccgcctgctccagcgcgcggagggcgacgagctacccttcgaattccgagcgctcgagctcgccctcgaggccgcatgctccttcctcgatgcacaggctgcggaattggagattgaagcatatccattactggatgaactgacatccaaaatcagtactctcaatttggaacgtgcccggcgattaaaaagtagactagttgcattgaccagaagagttcaaaaagtcagagatgaaatagaacaactaatggatgatgatggtgatatggctgagatgtatctcaccgaaaaaaagatgaggatggaatcatctgtctttggtgaccagtctttgttgggctacaattcagcaggcgctgttggggcttcagtttcagctcctgtatctccagtctcatcgcctacagaatcacgaaaactggagaaatctttcagtttgtgtagaagtaggcatgacagtacgaagggctcagataacacaatgacagagcatatccaggagctggagatgttactggaagcttattttgttgttatcgacagcactctgaacaagctgacatcgcttaaagagtacatcgatgacactgaagacttcatcaacattcagctggacaatgtgcggaaccagctgatccagtttgaattgctgctaacgaccgcaacatttgttgtggccattttcggagtggttgctgggatattcgggatgaactttgagacatcagttttcgaaatagagaatgcattccagtgggtccttgtaattacttcagtgaccggcgttttcatcttctgctcctttctttggttcttcaagtacaagagattgatgcctttgtagagaatgtatatgccctcctcccataggaccgatgaatcaatttcaaccctgttaagaggcacttgatcagaagcctgaacctctgccgatgtaaattaccattcttttagaggtttacggcatgagtaccgagaatccgggtgaaaattgtaaccttcttgacatgatccctgtgctgtataagagaaaatcatattacagtttatacaaataataccgaccaattctacaaaaaaaaaaaaaaaaaaaaactcgagcccggggc

SEQ ID NO: 22039 - DNA, 1630 bp, Zea mays
cattgggtacctcgaggccggccggccgggctcgactctgactctacgcggcacgcgagcgcagaggcccgtccgcgaaaaagaccccacaccgcccactacaccggccaatcacccgccggcgcgccatggccgcagccaccgctaccggggactccgtcaaggagccgctcctccaccgcgcgtacccgtcccaggtcgcgtcggcctcctcgcccgcgctcccgtccgcgcccccggggtccgccggccgtcgcttccctggggtgctcgacgtccccaacctcaagaagcgcggcggcggcacgcgcagctggatccgcgtcgaggccgtcacggcctccgtgcagacgttggagatcgacaaggccaccatgatgcggcgctgcgaactccccgcgcgggacctgcgcttgctcgacccgctcttcgtgtacccgtccacggtcctgggccgcgagcgcgccatcgtcgtcaacctcgagcagatccggtgcgtcatcacagccggcgaggtgctcctgctcaactccctcgacagctacgtcctccagtacgccgccgagctccagcgccgcctcctccagcgcgctgagggcgacctgcttccagtcgaattccgggcgctcgagctcgccctcgaggccgcatgctccttcctcgatgcacaggcagcggaactggaaattgaagcatatccattattggatgagctgacatccaaaatcagtactctcaatttggaacgtgtccggcgattaaaaagtagactagttgcattgaccagaagagttcaaaaggtcagagatgaaatagaacaattaatggatgatgatggtgatatggctgagatgtatctcaccgaaaaaaagatgaggatggaatcatctgtctttggtgaccagtctttgttgggctacaattcagcaggtgctgctggggcatcagtttcagctcctgtatcgccagtctcatcacccacggaatcacgaaagctggagaaagctttcagtttgtgtagaagcaggcatgacagcacgaagagctccgataacacaacgacagatcatatccaagagttggagatgttactggaagcttatttcgttgttatcgacagcactctcaacaagctgacatcgcttaaagagtacattgatgacactgaagacttcatcaacattcagctggacaatgtgcggaaccagctgatccagtttgagttgctgctaacgactgcaacatttgttgtggccatttttggagtggttgctgggatatttgggatgaactttgagacatcagttttcaaaatagagaatgcattccagtgggtccttgtaattacttcagtggtgggcgttttcatcttctgctccttcctttggttcttcaagtacaagagactgatgcctttgtagagtgtatatatgccctcctcctcccccatcatatagcaccgatgaatcagttcaccgtgtagaccttctaccctgttgaggaacttgatcagatccctgaatttctgccgatgtaaattaccattcttatagaggttcagggcatgcctgccgagaattcgggtgaaaattgtaactttctcgacatgatccctaagactgtcgcagct

SEQ ID NO: 22040 - DNA, 1209 bp, Zea mays
gggtcgccctgttctcgtttaaccatgatttccattgaccactgaattcaggcccaacaatggtttcaccgaacgcaacaaaatctccatcgctgcaagttcacggggatgatgtttagaggaaaaactgctacattgcagtggtagttcttaaatcatactcatgctcttgcaattatgtgacattcctttgggcactcatgacgaggcataatctttgaaatgctaactacgtggttctccgtcgtgtatctccccctcttcaaacagatcatcatatgcaacaggagcgcgaattctgtccgccagtggtttgcgttgagctttattgtctgatacgtgtatctccacatcatccaattgctcagggtcatccaatgtttccttttggtctcgcgcttcaatttcatcatcaattaaagcactgccctgtgaacttgcatcttcgtttctgctaatctgtggtcgtttcgtacacctaaactgcttctcaagttcctttccctttgccattatttccttgtaagccttgggttcccgcgactttaagatgttccagagaattccaccaccagtgcgaaagcggcttccatcagcaatagtctgcccaccacacttctgaatagcctccacctctctaacaagatcattgacagcagtgacaccaaggcagccaacagcattccagacaaggtacgacttcttctccttcaagcgcttgcaagtgttaagaacaaatcgattaatgtccgcgatgttggtgggcgccccatcttgcctccctttgttcttcttccctttgttcctcctcttcttcctcttcttctttccatccggtccgtccttctccgcctgcctaacacctccggcggatcctccagttgcagcggagacctcagctgctcgggcttcctccgtatccgagtcggcgtcggccatctcaacgtcatcgccgtcgtaatttagggtttcctcgcctatagcggcgtcgcccagggcgcattcgcttccgcccataccgagccccaccactggatgcggtctagcctctcgttctcgcgaggaaggaaaggaaagcagcgcaagagggcgcgaaaagagagaggacagagcagcctaaaagccggctcaaattcccggccgcacaggtctttggctagggttgaaaacaatggcacggaccggatacaagacatcattcccggccgg

SEQ ID NO: 22041 - DNA, 832 bp, Zea mays
tgtaccagcattaatattaatgcagaaaatgccagacccactaaatacttctgctgaatagatctcttttccagttttaacttacacttggcttcctaaacatagcactgctaccatatttcacgcaacaaaatggtcagcgccgaaactacagcactcaaatcaaatgttttctgatcaaatacacctaaacacataatactgaatcagccagtctcatgcatgatgtgtcaaactctacaacttccttcgaaacacaggatcgacattaacattcaaattcgtgaaattctcacaccgagcaacggtttcatttattttttcaagtaccttcggcaggtctgcaatattagcttcgatcttagatttgaggatcttgactttcttctcaagctcctggtcgtcttcggtaactgatgtttccgagataactgcagcttcagggcgagcggacgggcggagcgcgtcgaggcgggagacaatagcgtcggagaggagggtggcggtgccgcggacgtgttcgaggacgcggcggtccagatcggctacctctctctccagctcctccacactctgcagctcctccgcctccgcctcgtcctcagcgtctgcggtaggggccggagccttcctcttgcgctggttgggcgcggctccagtttggcctggctcgagcgaaccgccagccatggcggattttgtgaggtagagccggtacgcccgcgcacgggccggggccgacgagggaagtgcagcgcagcgaattcagtttgggggaggagcgcagggtgcggccgtgcgatgcgactttgcattgcaatttgcccgcaga

SEQ ID NO: 22042 - DNA, 1221 bp, Zea mays
  misc_feature (1206)..(1206): n is a, c, g, or t
cccgttttttttttttttttaaggcaaaacgaataaatcaattactacagcagtccccttagtagcgaatagaatacacaagccactgaatatatggctacctccagaaagtattcgagccctatatatgatacataagaaaaattgcaatggtctccttactgcaaaaaaaaaaaatcacagctagattaagcctttacatctttcattgactttcagatttaaaggcagaacgggaggcgagggcgactctgactgcggatgtagcgcaccaggtcatcgctatagttcttgtggtaaacaatggtgtcgctcagttgcttgatggcttctctcttctcctgcactctagctgctagctcgtcttctttctcgtccaccgtcttctggagctggagcatctttgtctgtgcctcagcagcactcttcaccatttctgacaccaccatttctttctctttgaacctaatagccagctcgttgttcgcattggcaagttccttctgttcattaagatgatcatgtaccttcttcctcaggattttaagctcgtcactacatgcagatgagcggtcaatgaagagcacaaaattctgactgcagattgtttctagctcatccaatttgtcagcccatttacagaccactgactcagcatgtcctttaacctgcatgagagttccttccagcaagctgactctccctgaaaactgctgtactaattgttcaagatgacagatctctgcccgcagtgcttccactgacgcttcatatctctcttctttgcatttgctttctgcctcagtaactttaagcttctgctttgctagctggagctgaacttcaaggtcttggacatgcttttgtagcttaatattctccttatttgcagataacttttcctcttccagaagccgatgtttctccacagtttctgtgtttttctgctctagctgatcaatctgctccatctgactcctcttaagtatctcaagatgtgatgcccttgtggacacctcatcatatgcatactgaagcctctgacagctaccaacagcccctccaaggctctggtggagaaccttcagtcctgcctcctgatctgaactttttatgtgtaactctatcttcaaatcctgccaaacatgacatgttttctgtgcatgcttcaatcataattttcacacttctccaattatctttganagacaatgatgatgc

SEQ ID NO: 22043 - DNA, 1060 bp, Zea mays
gtacccttgtgttagcactgcatccttatcttcttgtattgccttcaactcatcctgcatctccgccttgtctcgttgtgattgctccgtcaaagtgtagatgttcttctgtaactcatcattagcttgctgtagagttgaaatgttctcagtttgcttttcaaccacaatctcaagattcctgacagaatcctgagacgtctgtaatttcaatagagatgtgttcttatctgcacgtagctctgaaatttcagcatgcagattgctcctggcttcttcaaactgcttgtccaaggtggaattgttttctagctggacagaaagctcctctttcagtcgtatcacctcattctcaagattttgtactgaagtttctgactgcttcagttgtgatagcaccgcattcttctcttcttgtattgccttcaaatcactttgcatctccaccttgacctgttgtgattgctcagtcaaagtgtagatgttcttttgtaactcttcattagcttgctgtagagttgaaatgttctcagtttgctttccgaccaaaatctcaagattcctgacagaagcctgagacatctgtaactccagtagagatgtgcccttctctgcacgtaggtctgaaatttcagcatgcagattgctcctggcttctgcaaactgcttgtccaaggtggaattgttttctagctggacggaaagctcctctttcagtcgtgtcacctcatcctctagattttgtactgaagtctctgactgcttcagttgtgttagcactgcatccttatcttcttgtattgccttcaactcatcctgcatctccgccttgtctcgttgtgattgctccgtcaaagtgtagatgttcttctgtaactcatcattagcttggtgcagagttgaaatgttctcagtttgcttttcaaccagaatctcaagattccttacagaatcttgagatgtctgtaactccaatagagatgtgtccttctctgcgcgtaggtctaaaatttcagcatgcagcttgctcttggattcttcaaattgcttgtccaaggtg

SEQ ID NO: 22044 - DNA, 1016 bp, Zea mays
  misc_feature (64)..(69): n is a, c, g, or t
acgagcttggtgccatccacacagaaggagctcaccctgtccacaaggctaccatcgtacccannnnnntggccctaggaatggtggcccaactccctgacaaagaccagactagtgtgtcaaggaaacagatgctagcgaaactggatgtctgcatgggaggccgcgtggcagaagagcttatatttggggatactgaggtgacatccggcgcgtcgtcagacttccagcaagcaactgcaatggcaagagcgatggttaccaagtatggcatgagcaagcatgttggccttgtctcttataactacgaggacgatggaaagagcgtgagctcagaaaccaggcttgtgattgagcaggaggtgaagaatttcctagagaacgcgtataataatgcgaagaccatccttacgaaacacaataaagagctacatgctctggccaacgcacttcttgagcacgagaccctcacaggagcccagataacgaacatattggcccaggtacgtaacaaacagcaacaagaacatactgtcgaagcaccacagagggccccagcttccccggcatcaccagctgcggcggcagcagctgcagccgccgcggcagcacagcaggcggcagccaaagctaagggagtggctggtatgggatcttagcacatggagcgccccaccggatgtatatttaaccaaacaagcaaagctgttccagcgattgacagttgatgaaggtcatcggatgtattgtatgctaaactgctgcagcaatagaacacactgattgcgtggaagttactcttccatgtgcctcgagtgcaaagcagagacaaaaaaactgtacgtgttgtagacttgtagctggtgcttgaatcagttttgtacccacatcgaaaacaattcctgttgtttacaccccgaaaaattgttagatttcgatctggctgccttgtgtaccctaacaaggcggctatggccccgctccctgaataaggccctgttccaatctcgtgagat

SEQ ID NO: 22045 - DNA, 795 bp, Zea mays
ataaaagaaaagggtaaaatcggccggccccctcgtgtcgtcttcctctccgccgcttctcctgtccaccctcgactgcttgcgcgtgacctgagccgccgccgcctacatccgctcatccccgcgcccgcctcaaccacgccgccaccgaccacgtataatcctgcctccccttcgcgcggtttcgaggctcgtttcctttgggatcgttcgtctgccccgaccgcgtgggcgcttcttcttcgggatctcgctggaccgagcggcccagggctagggattcaggcccatggcgtggcggcgcgtcctcacccagattgcaaggcatcgaccagcaaaagcaatctacaatgaactagttgcttcctcccctttgggtgttcttcgaagtgacatcacttcaggtgccaggattagacatttacaagagaggaaccagtcaagttacattggtagccttgcacgccgggtccgagacttagaatcaccaagcggaacttctctgcttaaagagatttacagaagtgacccagagcgtgtcatacaaatatttgaaagccaaccttcattacattctaatcctgcagcactttcggagtatgtaaaagctcttgtaagggttgataggctggatgaaagtgccttgcttaaaacactgcagagaggtgttgcttcctcgacaaggggcgaagaaagctttagtagcattccagcattaattggtgctggtcaagtaacaaaagatggagctcttggcactgcaaatgcacctattcacatggtcacagcagaaac

SEQ ID NO: 22046 - DNA, 1246 bp, Zea mays
tctgctcgttgagttggatggctttaagcagaatgaggggattattgtcattggtggaacgaacctttctggagtcgctagattaagccctaatcagacccgggcggtttgacccgcattttggtggttccaacccaaattggtgaaggccacccccaatttttaaattccattttgtaaaaggggtcctggaaacctttattttttggactgtccaattctattttggccttttaccgtcctactcgttattggcaaatcttgaaaggggatgagggggccttattgatcttggttagaggaccaccggatttctctggggcaaaccttgctaactgggtaaatgtggctgctcttaaggctgccttggttggtgcaaaagctgtcacaaatggatgatcttgagtatgcaaaggaccgaatcatgatgggtagtgagcggaagtcggcagttatctctgacgaatgcaggaagctgacagcataccatgagggagggcatgcccttgttgcaatccacacagaaggagctcaccctgtccacaaggctaccatcgtacctagggggatggccctaggaatggtggcccaactccccgacaaagaccagacaagtgtgtcaaggaaacagatgctagcaaaactggatgtctgcatgggaggccgtgtggcagaagagcttatctttggggatactgaggtgacatccggtgcgtcgtcagatttccagcaagcgaccgcaatggcgagagcaatggttactaagtatggcatgagcaagcaggtcggccttgtctcttataactacgaggacgatggaaagagcatgagctcagaaacgagacttgcgatcgagcaggaggtgaagaacttcttggagaatgcatacaacaatgcgaagaccattcttacaaaacacaacaaagagctccatgctctagccaacgcacttcttgagcatgagaccctcacaggagcccagataaagaacatattagcccaggttcataacaaaccgcaacatgagcatactatcgaagcaccacagaaggcctcagtcgcaccagcttcccccgcatcaccagctgcatcagctgctgcagcagcagcagcagccgccgcggcagcacagcaggcggcagccaaagctaagggggtggctggtatgggatcttagcacattagagcacccccactggtttgcattgtgtatatttcaccaaacaagcaaagctgttccagcaat

SEQ ID NO: 22047 - DNA, 917 bp, Zea mays
ttgggaccctcgaggccggcccgggcccatgtcgtcttcctctccttcacttttcctgtacgccctcgaagcttcgactgcttgcccatgacctaagccgctgccgcctacaccctcacatcccgcgccctcctctatcgcgccgccaccgaccacccccaaatcctgcttccccaccgctcgcttccgttgggatcgtccgtcctcccagaccgcgtgggcgcttcttcttcggaatctccgtgggccgagtggcgctgggctagggattcgggcccatggcgtggcggcgcgtcctcacccagattgcaaggcatcgaccaacaaaagcaatctacaatgaactagttgcttcctcccctttgggcgcttttcaaagtgacatcactgcaggtgccagaattaaaaatttgcaagagaggaaccagtcaagttacatcggtagccttgcacgccgggtgcgagacctagaatcaccaagccaaacctctcttcttaaagagatttacagaagtgacccggagcgtgtcatacaaatatttgaaagccatccttcattacattctaatcccgcagcactttcggagtatgtaaaagctcttgtaagggttgataggctggacgagagtgccttgcttaaaacactgcagagaggtgttgtttccttgacaaggggggaagaaagctttagtagcattccagctttaattggtgctggtcaactgacaaaggatggagctcttggcactgcaaatgcacctattcacatggtcacagcagagacaggtcaatttaaggatcagctttggcgtaccttccgaagcattgcactaactttccttcttatttcgggcatcggtgctctcatcgaggatagaggaatcagcaaaggtcttggtctgaatgaagaggttcaa

SEQ ID NO: 22048 - DNA, 1127 bp, Zea mays
actcctatgggcgattgggatcctcgaggccggccggggtctctccaccacccagatcaaccccgcacgcgacatcaatagtccctaccattcggcgaacgtacaaatcaaagtgcggcgtgcccgctcgcaaactttgagtacgtactgctaccccggctcgtcctcctctcttctccatcgccgttggttctctcacgccacacggtcatccgatccctgtccaccgcgttgggagcggcgcagcccatggacgacaacgagagagagaaagagaatgagaatgagaaggagaagcactacgggactgacgtcgaggatgaagaagaggacgaggaaggtaacaagcgagtcgtggtgcttggcccccaggtccccctcaaggagcagctcgagctcgacaaggatgatgagagcctgaggaggtggaaggagcaactccttgggcaggtcgacacagagcagctgggagaaactgcggaaccagaggtcaaggtgctggacctgacgatcctgtcacctggcagaccggacctgatccttccgatcccgttccaggctgacgagaagggctatgcgtttgccctcaaggacggcagcccctacagcttccgcttctccttcatcgtctccaacaacatcgtgtcaggcctcaagtacaccaacactgtctggaaaactggagtcaaagtggagacccagaagatgatgctggggacgttcagcccccagctagagccctatgtctacgagggcgaagaagagaccacccctgctggcatttttgcgagaggttcttattctgccaaactaaagtttgttgatgatgatggcaagtgcttcctggagatgagttactactttgagattagaaaggagtggccaggaactcaatgatgtgtggaccagcatggctgactcgtcggagtatgttagagctcatagctaagccaagcacaagatgtggactcatcttcaagaatgattttcattcgctacttcatcgttaatcgcattttaatttgttttgaattgtcattgtacgtcgtttatgacataaaactgtttattcatcacatatataattcatgtatcgagatatatattcagatatttttcttagtgtt

SEQ ID NO: 22049 - DNA, 1132 bp, Zea mays
ctcgaggtatccgaattcgcggccgcggcgactacaaatcgcagtgcgacgacgcggccggccgctcccaaactttgagtagtgccgctctccgtcgtcctcttcgatctccatcatcgcgccacgtacgtacggtggtcacatccctgtcgaccgcgcgcgttgggagcgcatccggccgtgtgcattagccgcccatggacgacacggagagagaaaaggagaaggagaaggagaagcacgactgcgggacggacgtcgaggacgaagaagaggacgaggaaggcaacaagcgcgtcgtcgtgcttggcccccaggtccccctcaaggaacagctcgagctcgacaaggacgatgagagcctgaggaggtggaaggagcagctccttgggcaggtcgacaccgagcagctaggagaaactgcggagccagaggtcacggtgctggacctgacgatcctgtcgccgggcaggccggacctggtccttcccatcccgttccaggcggacgacaagggctatgcgtttgctctcaaggacggcagcccctacagcttccgcttctccttcgtcgtctccaacaacatcgtgtccggcctcaagtacaccaacactgtctggaagactggcgtcaaagtggagacccagaagatgatgctgggaacgttcagcccccagctagagccctatatctacgagggcgaagaagagacgacacctgctggcatttttgctagaggctcctattccgctaaactaaagtttgttgatgacgatggcaagtgcttcttggagatgagctactactttgagattaggaaggagtggccaggaggccaatgatgtggccggaccagcagggcagagctgactcgtcggagtacgctgttgttagagctcatagcaaaaagccaagcagaaaatatgtgctatcgcttcaagaatgtttcactactttcttcgtcattatcgattgtgttttgatttgtttcgagctgtcattaattgtatgttgtttgtcgcataaggctgtttattcgcatatataattcctgtatccagatattcagacatatttgtgtagttctattgttcaatttctcaacctgatacacatagggttccctttcctt

SEQ ID NO: 22050 - DNA, 3120 bp, Zea mays
  misc_feature (1082)..(1082): n is a, c, g, or t
  misc_feature (1310)..(1310): n is a, c, g, or t
  misc_feature (3077)..(3077): n is a, c, g, or t
tgtttatttgttttggtaagctttttgcaattttggatcaaaactagtgtatttatgaattttaattatactttgatgattttatgtagaaagaaattaataatgtataaatagcctcagaaatctatgaaattatacgaaggtacaacatatggccacatatagtcataaaaaataatgggaccataaaatccacaggatgtcaacgtttcttctattttatttccacttattgcgtgagttacacgtgaaatcactctaagtatccaagtttcaacataatcaatacttcactttaccatttttacgtgggaacttgagattatcttctattaaatgcttattagtattaatttacttgcaatttcgtggtcgaacaagaatattttttgataaccaattaatgcattatccgacaagtatccgatatccgatcaaataatatccgtatccgtcacttatccgcccggataaatatccggtccctgtatccgtatccgtcccgtttctaactatccgtatccgatcccgaatccgttttaaatacattagggtaggatacaggatgagctaatattcgtccgtatccgtccgttttcacccctaatagatgcagatagaaaaagacaatgaacagaaaatagagtagaagacaatcagaagggacttactcatataatactacttatctccttcaatgttcttattgtaaagaacaactagttcttttgctttcgacaacgaagaacgtagacgatttagtggcatagatgggttagagacttaagtgtctctattcttcttctttctcttgtgcttagaggagagcgtgcatgataacgtgtaaagaactgaaatgtaaagtgaaagtagagaatgaaagaagtgtctttgtattaatctctttacatatttatacaagaaaaaggggtgcaatgaatagatgcctaattataggagacaactgttcactgcatcataccaaaggatatgtcgtttgattacataattaactaactaatctttatctaatcctattccttgaagagctatcttgtggcttttcacatcagcgacgaggngacaccttcgttcggaggcaataggtgctgcgagcctggccttaagaggtgtgctttttctcgttgccacaccgtgtttgctcacagcccgtgttcaggccggaaacccagttttgaggctctcaaacgagctcttttaattttctcctcaatctcctccaatcctcttgtgatcctcttgtcatcaaatcagtcttaggccttgttcgattacaagggatgaaatcntactatggatttaatccaattatggattgggtgaatccatacctcacacctaatcccatggtgggattaaatccatcaactaatccatgtgtctctcaaagctagttattcttttgatatatggattataatgtaaatttgtgcagtatcttcatggatttgttccatacataatgagctatggataaaattcatgtcttccatagtttaaaaaattcccaaaccctttgattatattccatgatgggtttaatcgaataaaaaaattaagtaatcttggattattttgggacatagattgtgatatgaatttaattccaattcatactaatccagagctggattggtgtaaacgaacaaagccttaatgtttatatattattatggtacagataaaaacgattggaagaaagaaaggttcatcacttttaatttgacatttctgtcaaaatgaaaggatacaatattatcaaaacaagaacctcattgataatacgctaatatcaaaaacaagaaaattcatcgatagggaaactaaacaaaataatatttgggaaacaagtcaaactgtagaacatgatatcagccatgcatgtatagaatctgccgcatctcgtacaaaagaaactagcaattaagacagacccaatcaattgtttggatatatttagttaggtcaaagttttgagtgggacccacatattttttcatgaaaaaaatagcataacttcagaaccttcatcaactcaggttcctgcaatcagcagagtccaagtcggggctaccttcatcgacatctgcagccgcaattctttcatttacatccgcagtatgttcaaggcccaattatttcaaaagacatgcatcaaccactctttaacatagcacagtgggaccctgtccaaacagcaatgcaactacagaactgctgatgctgcccaggaacaaactcttgaccagggacacgcccattgcctcaaaatgtgctatgtacaaactacaaacaaaatataaaagtagtagttccaagcagattcactcccatgcccaaggctctcaggcttcatttacaagggtcaggggtctcaacactgtcaaccgcgaggagcagccatttgctgcttcttgatcctatccccagccttcaccatgctgatatcatgaggggttataaatatccattgagacccttgtgcgacagcaaaatctactagggtgtctaagcttattttgcggctcaccgcatccatgaatacatcaaactcatccatggccctaaatggtgcttcggccattccatgaagagacaaggtgaagcaaagggttgagaaagatcgttctccacctgaaagtcctctagtgtctctaatggtatcacgagacgcatcttgaggcattgtcagctcaacagacagaacttcattcttataatctacattgatgtgcccactgatacctttctttcccaggtgctcgttgaacagccacgtaagctgacgcttcaaaagacccgcatttctctgaaacttcttccatctcaagtccagtgccttttgacatgcatttaatttgtccctaaaacctgaatacatttgttgttttctcaggatcttctgtcccttcttgtcatgcagtgctctcagatcatcaatggtttcagtatatcttctgctttcttgctgaaatttctgttttaatttcttaatacgagcacttaattgttctagggttgatccttcaacacccccaagagcttccacttcactnctcggcacaaattgttgaagccttttcaaaatcggacgcgtgg

SEQ ID NO: 22051 - DNA, 1068 bp, Zea mays
ggccgcttttttttttttttttttgcagatgaaccactctccatcagggcaagggaaacaacacggctcatgagcaacatcagccactctcgtgccgtttttttttttgtgttttcaaccctaaacaaagaccgatgaaacaatgagcacacatgtccaagaagtcaacacagcatccctccctccctagaacctaagatttacaggggcctcacactgccaagctctcctccaccggtggaaggcagtgcagtgcgcccatcatcacaaggttctctcctgcctgccactgccactagaggagaaaagaaaagggctaaggaacaagacaccccaacaacagcaagcggcagcggggagcggcgtctcgtcctcacacgatcatcactcacgcgccgaggtagtagagagcgacgagcgagcagcaggccaggatcagcagccgcccagcgccagccatcgggaggacgacgccggcggcagcgctgttgtcgttgagggccgacggacccatcgctggagggctgtacacgccggccgaaccgctgctgctgctcgtcgttgcagcagcacttggggtcgcagggtacgtgcagccattggtgctcgggtcgacgttgctgagcgcggcggtgccggagaagacgcaggcctgcgggttctggccgttgcgctggtagaagctgttggcggcgtaggagcagtgggccttgacggtgtccggggcgaagcaggcgccgctctgcaggatgggcttgcagtcggcgccgccgccgcacgcgtagtccagcgtcttctgcagcgcgctgtccgccaggtccgaccggcacacgcaccacgcgccgtctgagcggccggcgagcgccgccgtggccaccgccaccagcatgaagaggcgagctgtgtcggccatggatgctgtggatgtgaggcggcaggcgacggcggtgaacaggctcaaggtacccctacagtgcggccggcgacgagccttgtacaactctctctctctctctcgcagtctcgcttcccttgaagccttgcactcaggccccggggtacccaatg

SEQ ID NO: 22052 - DNA, 1058 bp, Zea mays
agtaagtgcttgctcaactaaattttctaacctcctctctagcaccataacagttgaagggagcaccttttgcaattcctctagaagcttaaaccttgaactagaagaatcaatgccaagttttgaaaacccaaggaacaactgctgtggagaacaagaaatcatacaagtcgacagttcatgcactctttttctattaacaccaaggggtgtgatctcacatcgtaaagtcttcatagcgcccatgacattgtcattttttagaagttcaaagaatttctgctccaatatcaaaaatgccgcagatttcaagatgttttcatcttgaaggccaattgtattcatggtaaccaccgcattatcccaatttccatcaatcacctgttctctgaaaagtttcaccatagggttatgtaaaataatccctgattcctcctccagaactgctccacttttttcatatccaagactatacagagttttgctgattatcctaacaaattcctccttcttaataacacccttggaaccaaccatagcttctttcccttgggaaggcaaaggtctagccattgtacttcccaaaggattggcagattttgaaaacaagaaacagtctggtaaacttgcagattctactgaggatgctcttgcgcgttttgagggtggttcatcatcttcaaaacctcccatgaaatgccaagatcagcccatatatttttcacttcaaggaaggtgatggcatgcaatctccacgtaaaatgatccaaacagttagcgaaagagacggaagattctccagccgggagtcccgatcccgccgattcgccgagaaaccacaagaggagcccagaatctgagccgaatcgcgcggaatctccggggaatcgccggccccggcggagaggaggcggcccagcggtcggattgggtgggggaaagcggcgagagggagcggaggtgtagggagagggaggaatggaggggggaggggtggtccggtgtttggctttggggagagagtggggaaacagactgaaccgaattctctgctagca

SEQ ID NO: 22053 - DNA, 4015 bp, Zea mays
ggttgtgggtttgatcccctttcggctgtacgggagaatggaatgggaatgggctttgcggggagaggaatgagaatgatagagaggagggaatcggaaaggctacgaaatgaacagaatagtgaatgacagaacgcggaatgacagactactattgcagtcttgataagtagtagagataccacgtacacgtacaccagctctatacaaatgccattagtacagtttgagccattagtatagtgtggtgcggttgctgatgggccgacgggccgagggtagccgcgggccagggtccaggcagctagcttcgacttcgagggcgagcgagcgacaagtgacgtatgggagagccaaaccggctgcgcgctgactcgtccaagccgtgtaggtctcttttatcctgtgctgactgctaattagtagtaattactactgagcacggcgaagatctgtcttgtaaatttctgtactagaagattatgaaaaaaaaaagtctgaagtcctcccgtaccagcaagcaaacgagacttttactggacggcgcgctgttcagcaaggtcagaagaatgcagcaacttgctgataaaaaaatcacgtgccaaatgccgttctccgctcccacttgccaacgacaaggaggatctgcacttgtctcggtggggctgaaaaaactggagccggggacggctgcgtgatgcttgccgtaaaaaaggagaagtggaaaaccctagcgtatccatgacccatcaatgcatcatccacttggcaaccgttgtccaagagtagagatggccaaacgggccgcccggcccgttttaggtccggcccgccaggcacggttaggaaaccggaccggacctgctaagtccgcgggcttgattctctgtccgagcctggtccgcagcgggcctaaacgggctggaccggcctgtttagcacgaaaaaagcgggctaaacgggacgaaaagcacgttttagttcaaaaaaagcgggcttaacgtgcttagaggtaaacgggccgttccgggctaacccaccgtaccaagtttcctgtccgagtgcgacccgcttattcgtgtcgggccggtctaggcccgcataaaaccgggtcgtgccgggcttagaccggacccaaacagcgggcttcatgccgggctcgcaggcctcgtgctttatggccatctatatccaagaggctgctcgtggtcaaggagtccagaaaccgcgctcatgctcgtctgaagctgcgtttctgaagaaaacggtggcgtcagattttggctgccacgactgctaccaagtggccgagtgcaccatcccctgggctggtggagtaagtgaaaggccggaatgggcccgtgggccggcttgcgacagcgtttctctgggcttctcgccgtcgtcgtctcctgtagcaaaccaaagaaaccacgttttgttttgctgccttgctgctggtacaggacaggacccccgttccccatgcccacctgcagatgaaccactctcaggctctcagctatcgccatcgccaccagcagatgaaccactctccatcagggcaagggaaacaacacggctcatgagcaacatcagccacaagtcaggcagtgcgaagcttagcgcatcaaccctaaacaaagaccgatgaaacaatgagcacacatgtccaagaagtcaacacagcatccctccctccctagaacctaagatttacaggggcctcacactgccaagctctcctccaccggtggaaggcagtgcagtgcgcccatcgtcacaaggttctctcctgcctgccactgccactagaggagaaaagaaaagggctaaggaacaagacaccccaacaacagcaagcggcagcggggagcggcgtctcgtcctcacacgatcatcacgcgccgaggtagtagagagcgacgagcgagcagcaggccaggatcagcagccgcccagcgccagccatcgggaggacgacgccggcggcagcgctgttgtcgttgagggccgacggacccatcgctggagggctgtacacgccggccgaaccgctgctgctgctcgtcgtcgcagcagcactgcataacacaggtggtgaacacgaagaacagtcaagctcagagttacggtcgatgatgacaagcagctgcgtagcataggtaaacactaaacacagatgcacacgaacagtcgcagcccagagttacggcgacaaagtcacattgctttgacttaataatccctatgctcgtggaaaatcaaatcaaggcacatatgcagatgatatgggatatgcgcgcgttaatgctaccccggctctctttgccacaccagtactgtactacttttcaataatcacgcttccaaattcggtgtgtctaaacattccacaagtggcgtttggttgttcattggatgccctggattgcatttttacagacaggtaccaaaggggtattcttgcggctgcagaccgttggccccagcagagagaaaggggccagaacaccagaacaaatgcaagaacccactttgaactttggagagtactacacacacgtctagcgacctggtaatattccagcaccctatgaacaaccactaccccccccccctttccagtaggtttgaaaggagtcaggaaggaatgaataatggggagaacctacgcgccaagtcacaaacgaacgcacaggcgaaaagtgacagcaaaaggggccggccggttcgtctagctgcgagacggaaccagaagggtacaggattcccctaaaaagaccccatgaatacacagttgttcatcgatgcagccaaatgtggggggaaaaaaaggagagagagaaacgtatccccccgcggccacgcgcaaaccacctttttattcctccaggatttttccaaccccaaagaacaagtgaacaacacacggccgcccaccggatggtaccgcgtcgctttgatttgaaaggctccaaatctatagcacgcactaggaccagggcaccaggcttaggggttaagcctttctaaagatgggcggcgacggcgagccgagctggagatatcttcaggttgtccagactccagagagttgctactgcaagatgcggcatttcccggaaccaatacctatcgtctttcaatcagttgagttaaaaatgttaaatgggttgggaaatatccgatggctttttttgctttcattggtaaataagccagttcagtttcgtgctcgtggcaagaaatgctagcgctagcaacaaacgacagcatgtcatgccctctatatatctctagttctctactactaattatatctgtctgtcaacaaaatcgagaaaggagtgcgagaagtggcaatgccgtgcaaggatcaccttgccgccgcagcgccagccatcgggaggacgacgccggcggcagcgctgttgtcgttgagggccgacggacccatcgctggagggctgtacacgccggccgaaccgctgctgctgctcgtcgtcgcagcagcacttggggtcgcagggtacgtgcagccattggcgctcgggtcgacgttgctgagcgcggcggtgccggagaagacgcaggcctgcgggttctggccgttgcgctggtagaagctgttggcggcgtaggagcagtgggccttgacggtgtccggggcgaagcaggcgccgctctgcaggatgggcttgcagtcggcgccgccgccgcacgcgtagtccagcgtcttctgcagcgcgctgtccgccaggtccgaccggcacacgcaccacgcgccgtctgagcggccggcgagcgccgccgtggccaccgccaccagcatgaagaggcgagctgtgtcggccatggatgctgtggatgtgaggcggcaggcgacggcggtgaacaggctcaaggtacccctacagtgcggccggcgacgagccttgtacaactctctctctctctctcgcagtctcgcttcccttgaagccttgaactcaagtgacgaggaggaggattt

SEQ ID NO: 22054 - DNA, 2734 bp, Zea mays
tctgtgtgacttgcgatcagggcattctctagcccaatgttgatcactgccacaaacaaagcatcctccctttcccttgttattgttgttgttcttctttttaaactgtgctgtttgaacaggtttattcgcattctcttgtttgttctggtttttcttcttgttgaacttgcggaagtttctcttctgcaccacattagcagtagaggtctccacacctttcccactgtcctttgttctagccctttcctcaacatcaagagtaccaatgagctcttccacattgaactcttgtctcttatgtttgagagaggtagcaaagtccttccaagaatggtggcaacttggcgattataccgccagccacaaacttgtcaggcaaaggacaaggaaaaagttcgagttccttagctagtgcctggaactcatgagcctgttccactacagatcggttctcaaccatcttgtagtcatacagctgctccatgaggtacagctcgctaccagcgtcagttactccaaactttccaacaagtgcatcccacagctctttccctgtaggaaggatgatatagcttttctggaattttgtatcaagtgcgctaattactgctcctcgaaagaggttgtcttcagccttaaacttagcctcatcctcaggaggtaagttggcaggcttgccctcagcggcatgaaaacaagacattgcagtaagccacaattccattttagctttccaaatcaagaagtttttaccatcaaaaggatcaggctttagcacaacagcaaaacctctgacagaaaaatgcctaacattaggtttttggattgttaaattataggcattttccatatcattttaattccataaattaacattatgatgatgacatataaaagatgattaatcatagaaatcatgatctcaaatatatccataacaatatggatcatgagaacataaagcatatgaatcatataaaaaatttaagtatatttcgcggaaggaagctgaaggagaagggtcgcatgcggcacgccaagagacggacagctgaaggataagagtctcgcatgcggcacgccaagagacgggcaagagttgaaactcccgcgtttaatgagtgctaaaaattaacacaaccacaccacacgcacgccacgcggcggcggcgcgcgcacgcgcatgtggcacgcccttgtacgtttcttgacttctcaaattaagtggaataattctcaccatataagtcaagccaacgacccttagacttccaatatgatactattagtgttctccaccattacacaacatagagtttattgaataaatgggccaagcccataaaagatccaacacaaatgcacatgatatatgtggtgccatgcatatgtacatacttaatctaaactctttgtttaaggatcaacgactaaggtgccatttttttttcaaatttgcagccgcgcggatgagtaagtgttgaagggttttttataaaatatcaagcgttgatccggtaaatggtacagatttaatatgtgtagatgtacactaaagatatatatacacaggatatgcccctacctgtagaaggcgatggcaagtgggcagaatacgacgatcgatgatccacactagtgtatcaggcgcgcccatgcgcgcgggagcagctatgtgaaattttttatatatttagttttagtagtgtaatatattgatatatcatgtgtacatttatagcagctgttttgtagcacatgataacataagattaagagcaaatttaaacgggtagcagtgattacataagttgtactgagttcataagtatagtggttacactcagcttacatctgactgatatgaccatgcatattacatcttgtttcggtaccgtgttctgagagttgtaggttgcacagagcttaggctaaactaataaggtttcatcagctttgctttatgtgcacaaaagcacttgcgcttcaacagtgacatggtcgtcataggtatgcaaagcagatactaagataaagtagtttcatcagcttgtttatgtacataaaagcatttgctcttcaaaagtgatgatgttcgtcgcagacacgtaaagcattttttctgcacaaaaaataaggaaagattagtttttttaaagagtctgtgagctattctattttatgcacaaaggttataaatgagagtgaagaacgatcttatacaaagaagagttgtacataatgtctcaccttcatgagaacgacgctgatttactcgccatcgctttcaggctccgtagaacctaattgttgtttttgaacattcatagttttcatcatgtctgtgttctttaatgttaaaaggattatggtatgaattgttgaaaaagaataagcaagtttggaacatacctctttggtggggatgccagatcttttgggatagggtggtttgaaacctggtcagtattctataagtaagtgaataagaactatcaaatattgtgtctaatgtataacaaaaattcatatctggtttgaagtatgtggaaatgttgttcttgaagagagtgaggtactagaggtttgcaggtcggttttgacatcagtagaggaaaaatagatctatgtgagataaactagatggctttctatcaagaagaaaatgtagatttgctttcgtaataatttgaatttagatggggtaggtgtataatcatattgatgtcaa

SEQ ID NO: 22055 - DNA, 1051 bp, Zea mays
ccccagcagataaaccgattaaacaatgaaccctcatgcccacagacagagtcaacacagcatccctcctagaacgagaaggctagaaccctaagatttacatcagagaaagtgaacggaagtcgcagcaacgagaatggcatttgtgaggcctcggggttctcgcgctccaccaccggaaggttccatctgcctgccactagaagaaaaggggcaaggaacaaacaagacacacccaaaacagcagcagccgaggggcgtctcgtcctcatgagtcacgcgccgatgcagagagcgacgagcgagcaggaggccaggatcagcagccgcacggtggtgagtccagccaccgggaggacgctggcagcagcgctgttgtcgttgagggctgtcggacccatcgtgggagggctgtacacgccgggcgaacgctgttgctcgtcgtcgcagcagcacttggggtcgcagggtacgtgcagccattgccgctcgggtcgctgttgctgagcgtggcggtgccggagaagacgcaggcctgcgggttctggctgttgcgctggtagaagctgttgacggcgtaggagcagtgggccttgacggtgtccggggcgaagcaggcgccgctctgcaggatgggcttgcagtcggcgccggcgccgcacgcgtagtccagcgccttctgcagcgcgctgtccgccagctccgggcggcacacgcaccacgcgccgtctgagcggccggcgagcgcggcggccaccgctaccagcaggaagacgtgagctgcgtccgccatcgatgatgtggcttgctttgaggccgcgacggcagtgaacaagctcaacgtactctacaatgcggccgccggcgccccttgtacaactctcgctctctctctcttcctcgcttgaaccgaagcgacgacaaggggggtttaatccagcagcttgggcagggagttgggcagcgcccagttttgtgaagcactccactccggtagaagcctccaaggctccagccgcagccaccgcccgcctcgtgccgaatcggcacg

SEQ ID NO: 22056 - DNA, 1139 bp, Zea mays
tttttttttttttttttttttagatgaaccactctccatcagggcaagggaaacaacacggctcatgagcaacagcagccacacgtcagtgccgtgcgttttttttctttttcaaccctaaacaaagaccgatgaaacaatgagcacacatgtccaagaagtcaacacagcatccctccctccctagaacctaagatttacaggggcctcacactgcccagctctcctccaccggtggaaggcagtgcagtgcgcccatcatcacaaggttctctcctgcctgccactgccactagaggagaaaagaaaagggctaaggaacaagacaccccaacaacagcaagcggcagcggggagcggcgtctcgtcctcacacgatcatcacgcgccgaggtagtagagagcgacgagcgagcagcaggccaggatcagcagccgcccagcgccagccatcgggaggacgacgccggcggcagcgctgttgtcgttgagggccgacggacccatcgctggagggctgtacacgccggccgaaccgctgctgctgctcgtcgtcgcagccgcagcacttggggtcgcagggtacgtgcagccattggcgctcgggtcgacgttgctgagcgcggcggtgccggagaagacgcaggcctgcgggttctggccgttgcgctggtagaagctgttggcggcgtaggagcagtgggccttgacggtgtccggggcgaagcaggcgccgctctgcgggatgggcttgcagtcggcgccgccgccgcacgcgtagtccagcgtcttctgcagcgcgctgtccgccaggtccgaccggcacgcgcaccacgcgccgtctgagcggccggcgagcgccgccgtggccaccgccaccagcatgaagaggcgagctgtgtcagccatggatgctgtggatgtgaggcggcaggcgacggcagtggacaggctcaaggtaccacctatagtgcggccggcggcgagccttgtacaactctctttctctctctcgcttcgcttgaagccttccccgccggcctcgaggtgcccgatgtaaatgcagcagcttggacagcgcccagttctgtgggtggcgtgtcccgccgtagcatcgggacgggagggacgcagtgcac

SEQ ID NO: 22057 - DNA, 1051 bp, Zea mays
  misc_feature (24)..(24): n is a, c, g, or t
  misc_feature (43)..(43): n is a, c, g, or t
  misc_feature (62)..(62): n is a, c, g, or t
gcagctggaggaagcacttctgcnaattctctagaagcttcanccgtgaactagaaggatcnaattccaagctttgaaaaacccaggaacaactgctgtgaagacccaagaaatcatacaagtcgacagttcatgcactctttttctattaacaccaaggggtgtgatctcacatcgtaaagtcttcatagcacccatgacattgtcattttttagaagttcaaagaatttttgctccaatatcaaaaatgccgcagatttcaagatgttttcatcttgaaggccaattgtattcatggtaaccaccgcattatcccaatttccatcaatcacctgttctctgaaaagtttcaccatagggttatgtaaaataatccctgattcctcctccagaactgctccacttttttcatatccaagactatacagagttttggtgattatcctaacaaattcctccttcttaataacacccttggaaccaaccataacttctttcccttgggaaggcaaaggtctagccattgtacttcccaaaggattggaaaatttcgaaaacgagaaacagtctggtaaacttgcagattctactgaggatgttcttgcgcgttttgagggtggctcgtcatcttcagaacctcccatgaaatgccaagatcagcccatatatttttcacttcagggaaggtgatggtatgcaatctccacacaaactgttgcaaacagttaccgaaacagatagaggattcttcagccgggagtcccgatccccgctgattcgccgagaaaccccgagaggagccccgaatccgcgccgaatctccagggaatcgcccgccccggcggtcggattgggtggggaaagcgtcgagggggagaggatgcgtagggagggagggaaggatggtggtgtttggcttgggggagaggggaaccgactgaatagaaacgggattggcacgggggtgcagagtgcagactgcagacgtccagtctggagaagccgtgcatggcctcatgatctctcccggccggcctcgagggtcccaat

SEQ ID NO: 22058 - DNA, 2707 bp, Zea mays
tgtattcttcataggaaactcattctcaaaaaatgttgcgtctcttgattccatgatagtatcaacatacatatcaggcacgtcagattttataattaagaacctataccctgtgctgtgaaaaaagtacccaaggaatatacaatcaacagttttaggcctaagtttacgctttttgttgattggcacattcactttatccaagcaacccaaagtgcgcaaatatgagagatttaatcttctcttttcccattcctcaaatggtgtgatctctttgttctttgttggaactctgttcaggacatgacatgctgtcaaaatcgcctcaccccaccatgccttggataatcccgctgtactcaacatggcattcaccaaatctgttagagtgcggtttttcctttcagcaatcccattggattgtggtgagaatggcggtgtcctctcatgaataataccatgttccacgcagaactcatcgaacacattagagaaatattctccacctcgatcagaccttaaccgttttattttcctctcaagttggttctcaacttcagctttataggccttaaaataattgaacgcttcatcttttgtttttaagagatacacataacaaaatctagtggagtcatctataaaagtgagaaagtatcttttaccacctttggtcaaaattccattcatctcgcacagatcagaatgaacaagttctagaggtgccaaactcctcgcctcagcagccttgtgaggcttgcggggttgttttgattcaacacacacatggcacttagactttttgaccaagttaaatttaggaattaaatttatatttgctaaccgcataagacagccaaagcttgcatgacaaaaacgtgaatgccataaatctgactcatcagaaaaatgaacagaattcaccagtttattacacacatcatgcagtgataagcggaacaagcctccgcagtcatatcctttaccaacaaaagtaccatgtttcgacacaacacatttattagactcaagaacaactttgtatccatctcgacatagcatagaagcgctaacgagattcttcttgatagagggcacatgctgcacgctcttcaatggcaccgtctttcccgaagtaaacttcagaatgaccgtaccaacaccaagaacatgagcacgcgacccatttcccatcaacaaggcgccagacctcccgacctgataggaagtgaacatagaggcatcagcacacacatgaatgtttgcaccactgtccatccaccactcaggtgaattacagactgaaagaacaaatggtaaagaattaccatacccagatgttcctccttcagtttcagtggttacaacattagctgatttcttgtcttgagtgaacttgcgatcagggcactctcttgcccaatgttgatcactgccacagacaaagcatcctccctttcccttgttattgttgttcttctttttaaactgtgctgtttgaacaggtttatttgcgttctctggtttgttctggtttttcttcttgttaaacttgcggaagtttctcttctgcaccacattagcagtagaggtctcaacaccttttccactgtcctttgttctagccctttcctcaacatcaagagtaccaatgagctcttccacattgaactcttgtctcttatgtttgagagaggtagcaaagtccttccaagaaggtggcaacttggcgattataccgccagccacaaacttgtcaggcaaaggacaaggaaaaagttcgagttccttagctagtgcctgaaactcatgagcctgttccactacagatcggttctcaaccatcttgtagtcatacagctgctccatgagatacagctcgctaccagcgtcagttactccaaactttccaacaagtgcatcccacagctctttccctgtgggaaggatgatatagcttttctggaattttgtatcaagtgcgctaattactgctcctcgaaagaggttgtcttcagccttaaacttagcctcatcctcaggaggtaagttggcaggcttgccctcagcggcatgaaaacaagacattgcagttagccacaattccattttagctttccatatcaagaagtttttaccatcaaaaggatcaggctttagcacagcagcaaaacctctgacagaaaaatgcctaacattaggtttttggattgttagaattataggcattttccgtattattttaattccattaaattaacattatgatgatgacatataataaataattaaccatagaaatcatgatctcaaatatatccataacaatatggatcatgagaacaccaagcatatgaagcatgtaaatcatataaataaaataagtatataagcatggttcatggtttgttgcggaacaactggaaataaacagatcacaatatacacgtgatgactgtaagattaagacagacagatataacatatcataatacgatagaacagaggtacatacgacatatataatatgcagagtataaaacagtaacgaactgaattgatcataccctcccatgcgctcggaggatcctgatccttgtcgaacttctcttgtcatctgatcgagatgaacacgccaggaaccagtgatgaagacaacgacagacgttgggcagtcgcgaatacgctccccaaaaacctaattgtc

SEQ ID NO: 22059 - DNA, 2008 bp, Zea mays
gtccggtgattccacaaaatttcaactgactgttttctgaagcattgcaaaattatgttattactatgaagtccagtgaagaaactacttttgtgatgactactcatgtcacttttgaatccgggcccgtcgcgcggccgggaaaccgtcttggaggttgtagttctgatgggtggtatgcccccccccccccctttgttgctggcaactcgtgatggtttttccagccttggtgaacattggcagtggctacagcttgggcaggggctggtggcagcgcaaaggagagtgagagggaactttaaggcaaaaacacttttctggttaatccatatggatacatccaaaagatgttatatatatgatccacccttcttaattcaattcaagctttcgccacaaagctctcttattctctaatactgataactttttggcggccccgaattggaggggtatggaggttgcagcatgctagccgtaccctctggttgctgcaacatgtagatgtaggtggtggctactgcctcttgggttcagctgggctgcttggcccatgggcattatgccaaaaacataaatgtgtaaaagtgtacttacagaagacataaatggccaaaagggggagctatttggtgccttgaaataaataaaataaaaaatatgttctttggcttctgcctactatttaaaatttacaaatgatttgcaggtgagtcattagaagatgctttgaggcaattatacctcattgatgcaattgatgaaaacggacaaataacggatgttggacgagttatggcagagcttcctcttgagccgtctctttcaaggactttgattgaagcaaatgaattgggatgcctatctcaggcgttaactgttgcatcgattttgtcagcagaaataacattgcgatcagttagcaaggacgtggtggatggaaagaggaaaaggcaggagctccctgatgggtctggctggggtgaccatatacaattgcttcagatatttgaaagctgggaccaaactggctatgacacaaaatggtgctctcatcatgatttgcaggtgcggggtatgaaattgagcaaagatgtgaggaaccaactatgtcagattattcaaaaaattgcaaaaggttcaactgatgtggatgcaaggaaaagccggaagaatgaccctgattatagaaagctgaggagagctctctgcgtaggatatggtaaccagctagctgagaggatgctgcatcacaatggctaccatactgttggctataggacccaacttgtacaggtgcatccatcttctgtactggaaggcgatgagtatggaaagtttccaatgtacgttatttatcatgagctgataagtacaactcgtccatacatgagaaatgtctgcgccgtcgagcaagcctgggttcagcctatattaaagaagctcgacaaattagacataaacagattaagtggtggttcgagtgcaccgggagattctgaacttctgggagacaataagcaagtgaactcgtcaaagaatgacgtgggtgtaaaacaatcagaggtggacagtaaaatccaggcagctcgagagcggtaccttgcacgaaaaggcaagaaatgacaatcgacacgtttaactgatcgctcagcatccttctggtcagcctgaagcttctctgaagatcataccgaggaaccattcgtgttattgtgggtggtgtatgcttcaacgtgcacaaacaagagaatttcttatgtaatcttttgtttgaggactctaaccttttcttttatttggcattactgtgatgtgaccttttccttgggccgaaatattttacaggcttttctgcatgggctagattcttttcccccatattcctatatggtgttgtctgttgaggtcttgtccctcctgcctagcatatgttgagtcccaagcaaggcaacaccgcaatatgatgcgttcttggaagtgataaaaaagggaaaaaaaaaaa

SEQ ID NO: 22060 - DNA, 1287 bp, Zea mays
ttttttttttttttttatttttttttttttttttttttttttttttttttttttttttttttttataacgtatcgcaatccccaaataacgtttccattcgttagccaggtgtcaccaattccgtttaataggttacattctacagaaaactacatgcatttgcagggaaaacatagaaatgctagctttatgaaatcaacctgccgaggaagctagaatggttcagatacagcaaagtgaaactcgtccaaaaagttgaaatcctgaacagtcatttctctctccatgaaggcacgagaatacatcgagtcatcaaacaaagatctcaggtcatataaagttttttttccctatgtttgcctaatgcaaaccttccactcggtgcagctcagctcagcggaagcgaaagggaaagaggcccgtattctgccaaagaaaatccatccatcacagtacacttcacttctttgaaagagccatgacgttgaagttcatcgagttagggttctctgcaattctagctttgatgacttttgcagcatcctgcaacaaggtttcaggtgatgaagggccatgggatgtgggttgtgattttcgtccatcaagctcataaagttcaccatcaacacaggagaaacatacaaaatgttcattaacatcaacattagcatcagtgtcaccagcagatgcagcaacagaatgtgcatcttccatctcatcatcttcctcgagaaaggcagcacgctgagctggatccatatcagccgtttgcttatagaacttctcaaaataggacccctcaactagcttgatttgagatgttgcatttcctattgcatgaataacaccaactgttccacaagcattaccaacagtctgcttcgtaaagtatactttcttgctcaattccttgcccgctgaggtcgatgtggcagcagaaacacttgattcttctttctcctcgtccagggaggtgagcgggtagaggaagaggacggcgagaacgggctggggcaccatagcgagcagctcatcgtcaaggccgtagacgtcgcagaactgcacatcctcctcgtggactcccagcccccatatgaactggttcaggacgtccgggttggcctccagcgggatccaccgcttccccatcttctcggtgcgcggcggtgggagaggagggcggaaaccgagcctgtcgagtgtcgactagcgcagggacaggcggcggggagtagggtaaaatgcgatcggggtggaaatggaaaaggcgcggacgcggggggcgt

SEQ ID NO: 22061 - DNA, 623 bp, Zea mays
  misc_feature (612)..(612): n is a, c, g, or t
  misc_feature (622)..(622): n is a, c, g, or t
gccatatcatcaaagagtgtcataaaattaagaatgaaacaatgtttctcaatacaaaatttcacttcactatttcatagactaacataccaattaaatactgcaactaaatagtcaatagaaaacaataaaatatgtaaagatgaaacaaatggtgatgtgacatactattaaatgtgtatgaaaccatcataaaactacccttctaaatagcctaagtacgcaggaaaaaggtgaaatcgtgaaccaccatttctctatccatcaagaaggcacgagaatcatcgagtcaacattttttccctatctttgtttccctgtgcaaaccttccactcggtgcagtactcagcagaactgaaaagaaaagggacccgtattctgccaaatgaaatccacccatcacagtatacttcacttctttgaaagggccatgacattgaagttcatcgagttagggttctccgcaattctagctttgatgacttctgcagcatcctgcaacaaggtttcaggtgatgaagggccatggggtgtgggttgtgattttagaccatcaagctcgtaaagttcaccatcaacacaggagaaacatacaaagtgtacattaacancaagattaanc

SEQ ID NO: 22062 - DNA, 1158 bp, Zea mays
ttttttttttttttttgaaaaaggtgacacgatttcattcctatttcatcctatgaaacttatttatcttaaatactatgacatatcatataaaatggtgatgtgacatactattaaatgtgtatgaaaccatcataaaactacccttgtaaatagcctaagtacgcaggaaaaaggtgaaatcgtgaaccaccatctctctatccatcaagaaggcacgagaatacatcgagtcaacattttttccctatctttgtttccctgtgcaaaccttccactcggtgcagtactcagcagaactgaaaagaaaagggacccgtattctgccaaatgaaatccacccatcacagtatacttcacttctttgaaagggccatgacattgaagttcatcgagttagggttctccgcaattctagctttgatgacttctgcagcatcctgcaacaaggtttcaggtgatgatgggccatggggtgtgggttgtgattttagtccatcaagctcgtaaagttcaccatcaacacaggagaaacatacaaagtgtacattaacatcaagattaatattagtgtcaccagcagatgcagcaatagaatgtgcatcctccatctcatcatcttcctcaaggaaggcagcacgctggactggatccatatcagctgtttgcttatagaactttccaaaataggaaccctcaactagcttgatttgagatgttgcatttcctattgcatgaataacaccaattgttccacaagcattgccaatagtctgctttgtaaagtataccttcttgctcaaatccttgccccctgcggtcgatgtggcagaaacacttgattcttctttattctcctcgtccagggaggtgaacgggtagaggaagaggactgcgagaacgggatggggcaccaaggcgatcagctcgtcgtccaggccgtagacgtcgcagaactgcacagccctctcggagactcccagaccccatatgaactggttcatgacatccgggttggcctccagtgggatccaccgcttccccatcttctcggcgcgcggcggtggccggtggaagaggagagcggaagcggggcctgtcgactagcgaaggaacagaggcggcggtgaaaagcgatcggaatcggggggtgaaaat

SEQ ID NO: 22063 - DNA, 3166 bp, Zea mays
atgaagaatagtttttcattaaatggacgtagctgttcttttgttcttttgatgatgatctagatgtgacagcaacacacgtgaagagcaaataatgtacaacaatcacatgcacaccagtagtacagagcagtgtgcacatcatgaatacagtactggaacaattagccaaaatactatcgaggcacttgtctcctactcatgccgacacagctcactcatgcagtgtagcgtacgtcacatagctgaagtagtccctgaccttcctcaccccctgcgccaccgcatcattggcagctggggcggggcacgtcgtctcagtggttgccgcggccgggcaagtctttggccgactctggatgaatgcagcgcactcctccgggcgcctctggttggcgagcccaggaatgcagttgctctttacgttcagcacgccatcttttatcagcgccgcgcacgccggcccgacggaggtgaagtagttgccggacagcgtgaggttggcgagtcggccggcaggcccggcgagcctgcagagcgcgtcgggtacgtggccgtagaggcggtttccggccaggttcagctgctcgacgctgatgaggcaggagaaggacgacgggatcgggccggtgagctggttcatgccggcgtcaatgaccgccgccttggcgagcatgccgagctcgggggcgagacagccggagagctggttgttcaggaggagaacctcgagaagggagtctttcaggtgcgctactgatggcgggattgggcctgttagcctgttgttggccagggcgaggaagctcagtttggagaagccaagatctgcaggaagttgcccggacaggtcgttgtagttcaacagtagagccttgccatccgcgactccaggaatgatgcctcctcccttatcagggccagttcccaaacgaaatcttaactcgatcattccagcaacacagtgaatgttggctctagctctcccagtaacttcagaatagtcctgaacttggaggtcagtattgtcgtcgacgctaagatcgtacgagtattcaaggcctgtgagtcgggggatgccgccgttgccgaagttgttggaggcggcatggaagagtgcgacgtcggggagctggtcgacgaagccttgcagcttcggtgcacgcagaccgaagccattgagaactactgccgtcactgtgagctccttagctcggctggtcggtgttgcacagtagaagccgacgtagctcttctcgccgcagatgtcgttgccggcccacgtgccggtgatgttcttgggatccgaagtgatcgtgctcttgaagctttgaatggcgtggtaagcgcggtagagccgatcgtttggaaaatcttctggtcgtaggttgttgtatgatagaggatgttggttcgccttgggggatgcttgctctgggctggacgggtgtgctacaatcgcaacaacgacgtagcaatgcagcaagaagaggcactggggaagcggcaatctaagccggttggccatggccatttcggtttggtgaattcccggccggccccggggggcccaatggatagacagtggtatggcaggaacgggtcggctcctacggctacgggtttcacacccggcggtggtgggtgcattagatacaggtgctttgctgtttcaggcaatcgtcacctcaaaactcagacaaactttttacggaacgtgacttttggtaaaaaaaactcgacgaactgtacatcgacaacgatttctttataaagtactttttatcagtggaaaaaataaaaaaaatattttaccgagtggaaagaaagacactcgctaaaacattactttgtcgagcgtctgtcaggaggcactcgacaaaaaatatagtttgtcgagtgtcaacgtctgacactcgacattgttaacggttgtcaactgtagatggcttggcaaaggtttaccgagagtcgcctttgccgagagctggacacttagcaaaggttcctttcccgagcgtctatgtatgtcgaatgttcggctctcggcaaaggaggtttttgccgagtgtgtttgttcgtcgtggcactcggcaaagcttattttgtcgagtgtctgataaattactctcggcaaagcgtctgacactcggtaaagagtatgtttccggtagtggtggatgtatagctgatttgaatctgatcagacgggcgagactagatggatcagcacgggatgcgaatattttggtccagcacaggcacgacacaacatggcatgatagtaactgtatccgggtcaatccaaggcacgtcataagatatgtttgaatttgcggacaagctcatagggcaacacacgcatgatctgtttaattctgtcatatttagcccaatgtcagctcatagggcaacacacgcacgatctgtttaattctgtcatatttagcctgatgccaagcacagataatccatcaggctgaacacggctagcctatttatagctcgaccttactcgcctcaatctagtccactatatatacacagatgactgacctgactcctatttttgagttattttcaaactttattgtaaaaatggagaaaatgagctataaaaatagagaaaataagctatttttagctccattacaaggtgaaccttaagccgcacgttagatgacatggcacgacccgttttaaaccaattgggtcgtgtttgggcttggactttagcccatgaacgagtacaacacgatctaatatctatccgcgtcatgccttgacccgactaaatcggcctagcctgtgatagactcagaccgtataggtggatgttgttttgcctccacatgtctgtgtgtttttgtcatgggcccactatggccacagtccataacataataaaccacacaataacacatttccattttactagcaacatactttattagaagcatatttagagtatgtttggaatttgcccctcactactagagcaagatactttcgtgtgatatcattaacatcggttactttagaaccgatattgaggtttaattgtcacatatccgcatgggacattagtatcatttggtgtcttccattgaaactaatggcaagtcactaatagtggttgaagatacctatcaataacggatggaga

SEQ ID NO: 22064 - DNA, 2463 bp, Zea mays
  misc_feature (1660)..(1660): n is a, c, g, or t
  misc_feature (1767)..(1767): n is a, c, g, or t
gcagctgggtcacagggcaggagatgatgaaactgatgcgaggaagaagaatacaaagcagagacccagcaacacaagctagatgtattttttttttttttttcatgaacaaaccaaatcatcagtacatgagctatatatattaatttagaccaacgcggcactgagatcgacacggcaactaaatcgatcgagcaatgggtgacgaaggctatagctgctattatattagggtaggtaggtagctacagcgaggtagacgatgcactggccggggagcgaggagaggtgagtatctgtcatctgctgcatccgctagcttataattaggcgtcgatgacgcggaaggcgtcgcggttcttgatgacgatgtcgtacatgtggacggagccgaagtgggcgaagtccttgggcagcgagatgaggtcgacggaggtgcgcttgtggtactgcagcaggccggcgccgccgccgtctccgccgccggcgtagtagcgctcccagccgagcgccgccagcttgcgctccagcgaggcgtaggacgtgaccacctccccggacggcgtgtgcagcagcgccttgcgcttgcccggcgccgccgccgcgttccccgacgtcgggttctccaccagcctcaccacgccgttccggaacacccacacccccgacatgcttggttcggaccttctttattgatggtggctgcctgctgctgccgccttggcttttcctctcgctcgctcgcccgcctgcacgccctggctctgtggggatcgatgtccggatgtgcgggaggggggggttcgagggaacggtctcgtgctaggcgcgcgcgcgcgctacgctagctagctgccgtgcgtatctctctgtgtgtgtggactgtggagtactggagtgtgacgaccataccgacgaccgagatcgaatgcgctgcgcacggagggcgggccgggggggacagttgctggggattatccgcgggcggacacgtatggatcatcggagcttgcgtcgtgatcaagcagccggcggcccgccggctcatcatccgctgggacgcgtatcgtacgtgcgtatggtggtgcccatatactgccatgcatgcacacgcacagtgcggagaagaacagtgtggcgtccatggaatccaatcctcgatatctctatccacgcatcatcatggagaataccccatccccagcacctagctagagcagagataggctgtgagctgcagccacgcgcgcctctgctattgcatatggaagcatcgattcgccgccggtggggtacgtacggtgtgggtgcttcagcgtcacgggtgtggtctccgtcgcccgacgggctccatcacatccattcacatgtcctccgtccgtccgtcgtctacaattacgtgcatgcatccatcatgatcatgctcgtcgttaattattactacctagctttacggtgaacgacaacgatactgacagctgcctcacatagtatagtatactatagttatatttattatacatacacacgtgtatagagagattgtatattaaaagccatagactctcaataattagagtaagctctagtcaatgatatctttcggtttagtcacaccagctcaatcagggatggacacaggcccataccaactaggtgnaacccaaaaaaaatttagactacactataaaacctgttgcaccaccgccatttgccctcaacataccctagtcgtctcgcctaatcacccagatccgatgtcgttgncttcaatctagctcccctcaccactaggaacgatcgatcgactgcaaaggcgtgaccacatcctctgttgtaggtgtggtgccattgtagttgtggtgccagctccgcggcaatggacgtcagcggccgtgttctgagagacgacagttccaccgatggtgagccacccaacgccaagatcgtggccagtaccagtaccgatgtcaccggtgccacgatagcgagcgcgagtcagctttcatgggcgtagatggaggccatgatgggggcttcacatcgactgtcatcaatgagggcgccttaaggaccgcccacctcgccggctacctcgtcgatgtgaaggttcaccacagcagcgagcgccttcactgcctattgtaccaagagcttgacgtgttctcctatatcatctgcctcctcaccttctaccactcgagagacaaaaggcgtgctgatgctagagttcgcgctgaccattgaaacaacatttacgctatatctcacactatttatgcttaaacttgacgattttacgatcatgaatataatggcatagagatatccatgtctctcacaatggctcgatatttttggtaaccaccacaattcgcgcatgtctgttacacaggggccatacgtgacatggagctgaccattgtaacaacatttacgctatacctagcactatttacgctc

SEQ ID NO: 22065 - DNA, 958 bp, Zea mays
ggggtaccggcccccctcctcgagtttttttttttttttttttttttttttttttttttttttttttggctttaaaagggataacttgcaaaagaaaaataaactcttacaaggtagcaataacttggaattaagtcgggagttttgaatactacataaacaccagcagccagcccttttctgacagaacatcaaaactgtaaatttaaccattttagttaattgctgtaactaagctgagaaatttagggcaaggggctgagtgatcatccgccaattaagttcggggtctcaatatctgggtgcaagttcaaggacccaagcatctgtgatgtcacttacaaagacccgatcaaggggaaatcagtgcactttattggagagaaggactggctcaaggtaccttcggaggagctggcttctgcctttgatgagcctctcatcataaggcatcctcatggccacactgtccctaggcttggttcgcactcttcccaaatctttctgttcgatttgcctccttggaatcagcatatgatataaactgcttgcttttcactcagtttatgcatactgctttctcactgataatctgatgggttctttcgcagacgatgtgtctgtgaaacagctttctgaatggagctcgtgcatcctggaagaccttgagactgcaatcgttcctgaggccttagattcgggcaacccatctgataaggaagctactagtgcagaattcgcagaaaacctggtgactgcttgaggcttgcccactttcgtggcatggttggtttggttgcatttgaaacttgtaccgtttctactgagtagtgcgtggaacttgtttgatcgcatgtgtatttgcattggcaacaccaatccagcgctatctactgaatcaaatggattcaggcatcaagtacaaagtattgttggactcgagccgaattccgagctt

SEQ ID NO: 22066 - DNA, 1060 bp, Zea mays
ccggccgggacaaaaaaaaaagggaaacctgggccggccgggaaacttacgctgtgcttttgggagagttgagctcatggagcaggacaagagagccaaggtgctgtgcctgcacggcttccgcacaagcgggagttttttgaagaaacagatcagcaaatggcacccttccatatttcagcagtttgagatggtcttccctgatggcctcttcccagctggtggaaagtcagagatagagggcatatttccaccaccatacttcgagtggttccagttcaataaggaattcactgaatacacaaatctggacgagtgcatttcatatctatgtgattacatggtgaaaaatgggccttttgatggcctgctcggattctcccagggcgcaacactttcggcccttttgataggctaccaagcacagggcaagttgctgagcaatcatccaccaattaagttcatggtctcaatatctgggagcaagttcagagacccaatcatctgtgatgtcgcttacaaagacccgatcaaggtgaaatcagtgcacttcattggagaaaaggactggctcaaggtaccttccgaggagctggcttctgcctttgatgagcctctcatcataaggcatcctcagggtcacactgtccctaggcttgacgacgtgtctgtgaaacagctttctgaatggagctcacacgtcctggaagacctcaagagtgcagatgttcctgaggccttagattcaggcaaaccatctgataaggaggctgctggtgcggaattcacagaaaacctggtgaaagcttgaggcatgctcactagtcacttcagccttgttcgattatttctatctcacatggattgacatcgaaacgaacaatcccttccatggcatggctgcatctgggacttgtaccgtttttactatgatctgagtagtgcgtggaacttgtttgatcgcgtgtgtattgcatttggcaaagcaataaatcgttatttagagctacaaactaaaaaaaaaaaaaaaaaaacaactttttttaaaaaaaaaaaaaaa

SEQ ID NO: 22067 - DNA, 1129 bp, Zea mays
ctctgcggcccgggcggccccgagccggccgggaaacttacgctgtgcttttgggagagttgagctcatggagcaggacaagagagccaaggtgctgtgcctgcacggcttccgcacaagcgggagttttttgaagaaacagatcagcaaatggcacccttccatatttcagcagtttgagatggtcttccctgatggcctcttcccagctggtggaaagtcagagatagagggcatatttccaccaccatacttcgagtggttccagttcaataaggaattcactgaatacacaaatctggacgagtgcatttcatatctatgtgattacatggtgaaaaatgggccttttgatggcctgctcggattctcccagggcgcaacactttcggcccttttgataggctaccaagcacagggcaagttgctgagcgatcatccaccaattaagttcatggtctcaatatctgggagcaagttcagagacccaatcatctgtgatgtcgcttacaaagacccgatcaaggtgaaatcagtgcacttcattggagaaaaggactggctcaaggtaccttccgaggagctggcttctgcctttgatgagcctctcatcataaggcatcctcagggtcacactgtccctaggcttgacgacgtgtctgtgaaacagctttctgaatggagctcacgcgtcctggaagacctcaagagtgcagatgttcctgaggccttagattcaggcaaaccatctgataaggaggctgctggtgcggaattcacagaaaacctggtgaaagcttgaggcatgcccacttcagccttgttcggttattcctatcttacatggattggatgggattgaaaaattttaagaaagattttgatttgctatggatttaaacccatccaatcttgtccaatccatatggattggcaccgaaacgaataaacccttccatggcatggctgcatctggaacttgtaccgtttttactatgatctgagtagtgcgtggaacttgtttgattgcgtatgtattgcatttggcaaagcaataaatcgttatttagagctacaacaaaaaaaaaaaaaaaaaagcggccaaaaaaaaaaaacggatcctcgaaag

SEQ ID NO: 22068 - DNA, 2738 bp, Zea mays
  misc_feature (2674)..(2674): n is a, c, g, or t
aagaagctcaaggacctcatgctcgacttccaggcgctgcggcagcggatgatgtccgagtacaaggacaccgtgcagcggcgctactacacgctcaccggggaggtccccgaggaggaggtgatcgagcgcatcatctccgacgggcgcggcgaggagctcctgggagcagccgtcgcggagcacggcaagggcgccgtgctcgccgcggtgcacgagatccaggaccgccacgacgcggcgcgcgaggtggagcgcagcctcctggagctccaccaggtgttcctcgacatggccgtcatggtggagatgcagggggagaagctcgacgacatcgagagccacgtcgccagcgcctcccactacgtgcagggcggcaacaaggagcttggcaaggccaaggagtaccagcggagcagccgcaagtgcctctgcatcggcatcatcatcctgctcctcctcgtactgctcgtcatcgtgcccattgccaccagcctcaggaagagttgatcgagtttgtgatgggaagaactgtgaaaaaaaatgaggggttcgaatccgatcgggtgggtcggtggtcctagtgatcaggacactctgcagttgtgtctcgtctcgtgttgcttgatttcgtattcgttaatttgagcctgaatgtttccgtatccatcaggatttgctgatgataccaccggcaattgcagttgctatctcttactgggttgtattgtatggtgtgagattcggctgaaacaaattcgtacttagcagttcgaatttaaaattctcatacatgacatggatggtgcttgattgcttgttgtttgggtttcccattgtctgccaattgccaaatcctttgtcattccttgcatgagatggatggctggatggtgcttggcaggaaattttccgttctcaagttttgtcctgtcactaggaaatcaaacattattaggtcttgttcgtttctatcggattacacccggaatcggtccggctaatcaaagtttatataaattagagaagcaatccggccgggaattgttccgacccaccaatccgacacaaacgaacaaggccagaggcggcccggaaccggaaggctgggcccgacgcgaggcgcggccgaccaaagccgtggcgccccgtcgcgcgcatggaacagacagcggatagggggcggccgggcgggggcgcgtgatggaatgaccggtggtgaccacacggggcggggactggggcgtgtgcggcacgcagatgcagatttccccggatggggcgtgtgcggctgccggggccgcatcgtgtgcacgccaaactctcccgtcctcttcccctcctcgacaccaagctagcgacgctacgcagcagcagctatcttatcccccccgctggcgcccgcccggccgggacccttccccacactgctgcgccgcgcagtcttctgcttctccccaccctcgcctcagcttccctgccgttccctccgatcaccagctgcttgtgctgctgagtgctgaggcaagaaccaccgcgtttcattgttcgagtccttgctcagtcccatacatgttcctcttctttgtgcttgctgctatagattttgaactattattgttcacgtgcagggtagcgatgaagctcttgaaccagcccatcagcccaggcggccatctcgtgccggcgcagccgagcaccacggcggccgcggggcggtcccatgcgcactgccctcggtggcaggcgcagacgctgcgccgggccagcagctacgtcggcgtcgagcacatcgacgggaccaccgcgtccgtcccagtcccagtcccagtcccagtcgcggccccgttcaagccgctcacgctcgacttcctgcggtcgctcctggaccggaactgcagcatggcccccgccgtcccggacggcgaggccagcgccccgccgccgccgcagatggtcgcgctccgggtgctggtgacctccgccgtggagctggacgcgcgccaggccgagcgcatcgcgcgcaagatgcgccgcctcaccggctttgtcgacctcaaggtcgagaccgccgtggacgcgtccctcatcgccggcttcgtcgtctgctacggcaccgacgactcgcacgtcatcgacctcagcgtcaggggccagctcgcggcgctcaagagccgcgtcgactccatcgaccagaccgcgcatgcccacggacacccacaccaccactgaccgtcgatccaacacctgaggcaccggagcaaagcacagcgcgccgtcaccgtgctacagcttacaatacaagcctatactgtacacgcacagaatgacagaaccgaacgcgcgccatggcaacaacagttttcctatgtaatgttgttgtaaatcgatagcgagaaaacttaattgctgctaccttccttcctgctgagcttgtatacgtttctattgctaaagaaacgaacgctattgattgtatatttgatcgatgtggagacagcatgcagcctctatggtgtaaagtctaatatgctattgcaaggttgaagtttgtatatggaggatcaggcttcaggcctgcagcattgtaatggactcccatgaccatgaaaaaaatggctaagagtgcgttcgtttgttcaggattaaggccaggaatggttccaggtgatcnaaagtttatacaaattagataaaaaaaaaaaaaaaagggccgccgctcgcgttctagaactagt

SEQ ID NO: 22069 - DNA, 1501 bp, Zea mays
gcacgagaccattacctagaacatcctaatcgaaaaggatgccagatttccccggatggggcgtgtgcggctgccggggccgcatcgtgtgcacgccaaattctcccgtcctcgacaccagctagcgaggctacgcagcagctgatgataccttatcccccgctggcactctggcagctagctattacccccctgctgcgccgcgcagccttctggtctacccccgttggctgcttcttctacctaccctcgccgtcgcctcaacttcccggccgccgtcccctccgatcaccagctgctgcttgtgctgctgagccaagagcagctagcgatgaacatcttgaacctgcagcccatcaacccaggcgggcacccggcgttcccggcggccaaggagagcgggcacctcacgccggcgtcggtgcgcttcgacggcgtgccggtgccggcgcagtcccacgcgcactgtccgaggtggcaggctcagacgctgcgccgggacagcagctacgtcggcgtggagcacgaagggaccaggaccaccgcgtccgtcccggtcccggtcccggtcccagccgttgccccggtgcctgccccgttcaagccgctcacgctcgacttcctgcggtcgctcatggacaggagctgcagcatgagccccgccgtcgcggagtacggcgaggacagcgccccgccgccgccgcagatggtggcgctccgcgtggtggtggcctccgccgtggagctggacgcgcgccagaccgagctcatcgcgcgcaagatgcgccgcctcaccgggttcgtcaacctcaaggtcgacaacgtcgtggacgcgtccctcctcgccggcttcgtcgtccgctacggcaccgacgactcgcacgtcatcgacctcagcgtcaagggccagctcgccgcgctccagaaccgcgtcgactccatcgaccaccagaccgcccacgtccacggacacccgcaccactgatcatccgatccaacacctctggactctggtgcacatgcaccggaaccggactacaccggagcgaagcgcgccattgccaaaccgtgctacagcttgcagtatacaagagcctatctccatgactgtgattacgagactatatacagaaccgaattgaacgccatggcaacaacagttttcctgtctaatgttgttgtaaatcgcgactgctacctatccttcctgctgagcctatatatgtttctatttctaaaaaaacgaacgttattgtataatatgatcgatgtggagacatcatcctctatggcgtaaagtgcaatatactatctcaagggccaaggccgaggtttgtatatggaggaggattcaggggttgcagcactgcaatggactctatgaccatgagaaagatggctaaatgagactgtatcactctgcaccgatcagattagagacgcaaacacatcaggattattaattcgatgtttctctaattatccaaaaaaaaaaaaaaaa

SEQ ID NO: 22070 - DNA, 1077 bp, Zea mays
ggagatggggccatccgcgacgcgctcgaccgcctgcacgccgccaacgaggtgggcaagtcgctgcgccaggtggacgccctccgcgcgcaccgcggccgcgtcaacgccgatatcgtcgccgtgctccgccgcgcccgcgacatccgcgctaggctcgagtctctggaccgcgccaacgccgcgcagcggaggctttctgctgggtgccgcgagggcacgccgctggaccgcacgcgcaccgccgtcacctcgggactccggaagaagctcaaggacctcatgctcgacttccaggcgctgcggcagcggatgatgtccgagtacaaggagaccgtggagcggcgctactacacgctcaccggggaggtccccgaggaggaggtgatcgagcgcatcatctccgacggccgcggcgaggagctcctgggcgccgctgtcgcggagcacggcaagggcgccgtgctcgccgcggtgcacgagatccaggaccgccgtgacgcggcgcgcgaggtggaacgcagcctcctggagctccaccaagtgttcctcgacatggccgtcatggtggagacgcagggggagaagctcgacgacatcgagagccacgtcgccaacgcctcccactacgtgcagggcggcaacaaggagctgggcaaggccaaggagtaccagagaagcagccgcaagtgtctctgcatcggcatcataatcctgctgctcctcgtcctgcttgtcatcgtgccaatcgccaccagcctcaggaggtgatcgagttgtgatgggaggaacaacgccggggttgtgaattgtgaaatgaaatgaggggttccaattcgatccgatgggtgggattgggggttctaatgatcaggacactctgcggttgtgtcttgtcttgttcgattcagtattcgttaatttgagcatgaatgtttccgtggaatcttactgaattgtattgtatgaggtgagattcggtaaaccaaattcgtacttgtaagttcaaattcaaaaaaaaaaaaaaaagaaaaaaaaaaaaactgtgcccgtggccattgctctctccctcgtgca

SEQ ID NO: 22071 - DNA, 2404 bp, Zea mays
aattcggcacgaggcgcttggcatgatgtgggaagcacttcaagattgtttggctgctacatcaattgaccccacctttcttaaagctaaagttagagctgccaattgccagcttgcattgggcgatcttgaagatgcattaaggagttacatgacctgtttgaacagtaacactgggacttcttctgaccctaaaatattagccgaggcttctgatggcctggaaagagtcaagagagtgatcgattgggtatccctgtgcaaggaacttattgagaaaaaaacatctcctgaagcaacaaaagccttagaattgatctccaatgcattgcacatatgtccatattcagacagcctcaaggagatgaaggcagagacattgctgatgctacgaagatacgaagaagtgattcaactatgtcaggagtctgtaaatccgactgaaagaaagccagctttattcaaagataatggagaaccaaaggattccagtctctttgacaaacacacttctctggaggtattggcggccctatctcttttgcaagtcttatttcctttcaggcaagctggatgaggctgtcgaattattaaagaaacatgagcaagtcacacctgtcaaagaaagtgacgtgaacacatatcaagaaaatttctcatcattgtcagcgattataagagaactactttcccttaaggctgctggaaatgaatcatttcaagctggtagatattcagatgctgtcaaacagtattcagcagctttggcatgtaatagtgaatcgcgcgcattttcagctgtctgtttttgcaatcgtgcagcggcgtatcaagcactcggtcaagttactgatgcaatatcagattgttcacttgccatggttcttgatacaaattatccaaaggcaatttcaagacgagccaccttatacaagatgataagggattatgaccaagctgctaatgatgtaaggaagctaatctctcttcttgaaaagaaagtcaatgtgtctggagtatcaccaaaagcttttaacaagcacaatgatctcaagcaagcacatgtgaggctttcatccatagaggatgaagcaaaaaatgacacccccctgaatttgtatttaatcttgggagtggagccatcctgctcttcagaagatattaagaaggcataccggaaagcagcattgagacatcacccagacaaggctactcaattattagtaaggaacgagaacacagaagatggattttggagggatgttgtcaaggaagtctatgcagacgcggatcatctgttcaaaacaattggggaggcatataatgttctttctgacccggccaagcgtgaggagtacaactttgaagaggatctaagaaatgccaggaggagagtatctagttctaggagcatgcataggtcacctgaacagaactacagcaacagaggctttaatccacgccagcggcagtcaagcagagcatcacgttcacgttggtacagcaattcagacgattactggtaaagaagccattacatatggagtgggcatgtggtgcgaagcaacttttgcatgtgtggagcaaaaggcctccttgcaccaagatggcacctgcctttctggggttttttaggtgccggtgctgacgcaccagccttcgcagtctcagctttcgtgtctgtttgctgtgtttcttttccagagggtgaaaatattaggattgatcaactggggatctggtatgattggttgacactaatagtgttgtgacttgattagcacagaaaatacgtgggattaggaagtggtacatcaaattatcttttgttggcctggtgatttctgaacactgactgcttgggagtggctggcatgatggtatccactcttgaggagttgaacaccgagaacaacgtcgaaagttaggagcaaggataaagatgccggttcctcgaatatctgcaggcactcttttgctggatgcatggctactgtttagcacgggcagtttgcagcagatcagctggaagaaaagagacatgctcttctgtttggcgcgtgcaattctgttctgttgcttctgtttaatccaaacgacgtagcgctggaaacagagtgggtacatattataactgtgtaactgctcaatgtcgggatctcgatttttttatttattcattgttattagattgttagctagcccaatgttgagaggatcgatgttccttcgaagaaaagaggctcgggttacggtgatattggccaagtgcaggttctgtcatgttgcttatgatgaaatatttggaacgacttaaacccgtgggctgctgcatatgtttttttttgcgtgaacgtttcattgataaacggtatatatacacatattcgaaggccttaagcac

SEQ ID NO: 22072 - DNA, 2140 bp, Zea mays
agttacatgacctgtttgaacagtaacactgggacttcttctgaccctaaaatattagccgaggcttctgatggcctggaaagagtcaagagagtgatcgattgggtatccctgtgcaaggaacttattgagaaaaaaacatctcctgaagcaacaaaagccttagaattgatctccaatgcattgcacatatgtccatattcagacagcctcaaggagatgaaggcagagacattgctgatgctacgaagatacgaagaagtgattcaactatgtcaggagtctgtaaatccgactgaaagaaagccagctttattcaaagataatggagaaccaaagaattccagtctctttgaacagacacacttctctggaaggtaccgccggcccggccgcgtttgcaggtcttatttcctttcaggcaagctggatgaggctgtcgaattattaaagaaacatgagcaagtcacacctgtcaaagaaagtgacgtgaacacatatcaagaaaatttctcatcattgtcagcgattataagagaactactttcccttaaggctgctggaaatgaatcatttcaagctggtagatattcagatgctgtcaaacagtattcagcagctttggcatgtaatagtgaatcgcgcgcattttcagctgtctgtttttgcaatcgcgcagctgcgtatcaagcactcggtcaagttactgatgcaatagctgattgttcacttgccatggttcttgatacaaattaccccaaggcaatttcaagacgagccaccttatacgagatgataagggattatggacatgctgctaatgatttaaggaagctaatctcacttcttgaaaagaaagtcaatgtgtctggaatatcaccaaaagcttttaacaagcataaagatatcaagcaagcacatgcgaggctttcacacatacatgctgaagcaaaaaacgatacccccctgaatttgtatttaatcttgggagtggagccatcctgctcttcagcagatattaagaaggcataccggaaagctgcattgagacatcacccagacaaggctgctcaattattagtaaggaacgagaatgctgaagatggattttggagggatgttatcaaggaagtctatgcagatgcggatcatctgttcaaaacaattggggaggcatataatgttctttctgacccggacaagcgtcaagagtacgactttgaagagaatctaagaaatgctcggagagtatcgagctcaaggagcatgcgtaggtcacctgaacataactacagcgacagaggctttaatccacggcagtggcagtcaagcagagcatcacgttggtacagcaaatcagacgattactggtaaagaagccactacggcgtggtcatgtggtgagaagcaacttttgcaactatgtcatgtgtggagcaaatgcctccttgcaccaaagatgggatgggatgcacctgccttcccgggttgtttaggtgccggtgctaatgcaccagccttgcagtcagcagctttcctgtttgtttgctgcgtttctttttcagaggatggaaatattaggattgatcaattggggatctgggatgattgcttgacactggtagcgtcgtgacttgactagcacagcaaatatggaggattaggaagtggtatatcaaatagtcttttgttggcctggtgatgtctgaacactgactgcttgggagtggctggcatgatgttatccgctctgaagtcaaaacactgagaacaacatcaaaggttagaaatctgggtaaagatgccagtttgtccaataggtacaggcattcttttgctgaatgcagggcccgctgtcgtaagtttacagcagatcagctgaaagaaaagagacaggttcttctgtttggcgcgtgcgcgtgcagttttgttctgttgtttccttattaccaaatgatgtagcgttggaaagagttggaacatattgtaactgcccaatgttgaaatctcgtaacatttatttattctttattactagacttgttagccaaatgttggaagcattttaaggtaatcaaggttccttcaaagcaaaaaaaaaaaaaaaaaaaaaaaaaaaaaaaaaaatctcgaagagggg

SEQ ID NO: 22073 - DNA, 1450 bp, Zea mays
  misc_feature (4)..(4): n is a, c, g, or t
  misc_feature (1441)..(1441): n is a, c, g, or t
tatngggtaacgttcgaaaaaaaagcaggctaaacttaatattaccgccgtccaaaagaggctgcaattattttgtaatgcccacggtacacacatcactctgcaaatagacaaggattttgcggcagcgccatgagctgtgtgcactggcgtctcgaatgcaccggttcttttacgtgcaaggccttgatttgtcaacacgaccaaagcaagattcaccaccgtaaatcatgctctactaaccatcttcaatacatcggatcagatataacaagtaaatataacggatgcatgtcagccgagtgccaccgagctgaaggcagaggcacagaagcaaagcaagcgcacacccaaaagtacacagactgatgtacgatggaacacgagctttacagcacggagacctctcacgatttccatcaagacctcccccatatgcagtatgctgatacgacgtctgatattgcggtgacgtggagtaccatgtaaatctcacctcatagtgtaacaacactagcccttcagaataatcacagcaaatgatcatactgatatggttgcaacaccttcaactgtcaagcctggcattttgggggttacaagatagccgaaagtgctagacatcagacagtgagatgttgcaaggacttagtaaggcttgggtctcttgcacaggtcttacttgggtcctaagctccaatgaatcctcactggtcacagctatgttcattggccaaagttcatctccgagtatcgacgaggcttattttggcgttgagttatttcatcacttgcaacctctgttatttcttgggacttcaacagagaagaagcattatttgcactaggttctctaatagaaactgatgaagatgcttgttcagattgtcgagagtaataacttccatccatggctatataaggggaaccataaggtgctcctagagctccagaggcaccagtcaatattggtagccaggtcatctcagaattattattgagaccaagttgttgttgagacacaaatcctggcagagccataccgattgaaggaacaccgcgcccaactggtcgcggacctccaaactgcataactggcagcaatgctggggtaccatggaaattttgatcaccaagtttaatgcccattgcacctgtagccccaagaacatgagccccaccacggagaaacgaagaatgctctgttccttggtcatcaggttgccccttaattgttaaccgagaatcatatttgtttgatccactaggtgaagaaatttcagtgtcatcacccagaatagttgtaggttgtgctggtgatattttactgctattgctgaattttgcaccaaacatctgggcaggcatcctgggcgcagattgtgtaggggattgaactgacccggccggaacaattggatgtgcaggctgcccaagtctntattgactg

SEQ ID NO: 22074 - DNA, 974 bp, Zea mays
ggagaggatccaaggaactcctccgggccttttaaaaaacttgttatacaacacatatatctcatttgaacgcaatacaaggttggtagtaaaaacagtcggaatgttcggcagcctcgacctctactgtttaacaatacatatatctctcgtttggacgcaatacaaggttggtctctcgcgcgaaaaaagacaagtgagcaccccttcacacggagcaaaaaatgatgagcactgtcacccaccaccaagcttttgcccgcctttttcttattcacttcaacagagaagatatcctcatctcttcctggatgacgaagaagccgcagcaattataccaccagcaacaagacccacaactccaaaggcgcctgtgatgatagccatgccaatcataccatctcttttggttttttcttcaacgagcctttgcaaagttatggcttgtctccagtcatgttggatctctaagcatctttccaaaagctgtcggcttcttgtataatccccagttctgtaacgaccaacagctaacaagtagagcttctcccttgtttcctctgggctgctagacctgtccaatgaagcttcaagcattccgatgccccggttgacatcttcaggctgtctagagtgaacaagcgcccaggagagcctcatcaggctctcggttttctgttcttcatttgcagcctcagcaacctcactctcgaaaccggcgatgatgtcgggatcgcaccagggcaggacgtcgctgccgcggaagatggagcccaccgagtcgattaatttgccgacgtgcgtgtccatcccccagctctctcttctttttctgacgcttttttggggttttccgaggggtggtttgatccgtaggagggcggtgtgtgttttatacggagttttcggcgtgccagaacctatgagaggctagtagatggatgggttggattccggcctcgaggtacccaatg

SEQ ID NO: 22075 - DNA, 2430 bp, Zea mays
  misc_feature (12)..(12): n is a, c, g, or t
gctctttcctantggatcccccgggctgcagttcccccccccccccccccgaatccgaccaaatgcctcgattgtttctgcttccgttcaccaccgcttcaaaactttgaactagcaaaatcaggagttaaaaaaaacctgaggtatggtgattataagtggaaacaaacagggccatcctgttggcattatagttgcacatgataaactattggcaattcattttcctaccttgatagtggatattagtaggagatgaaaaatccatggacattcattttatgatctgcctacactgaaaatgggaagcataaatagtataccaacctcttttggttttttcttcaacgagcctttgcaaagttatggcttgtctccagtcatgttggatctgaagaaaacatgaaatgttttgttcaacatgcaggcaatcaaattcaggggtgcattggttgacagtacatgactaaggcctgagactaaaacaaaaccgtaaggtcacatcagggaataacaacagataacacatttccctgatcaaacctctaagcatctttcccaaaagctgtcggcttcttgtataatcccccagttctgtaacgtccaacagctaacaagtagagcttctcccttgtttcctctgggctgctagacctgtccaatgaagctggcaacagataacatcatgagctatggggacaacggcaaagaaatacgcttcagtgaacaatattgacttattgaagttaattaagttaattgtgaaaggttcgatgtcaagtagcctaggatgggactggtctagattgaaaagaagagcggttttcattctttttaactatgctgtactctaggtcctctaaatttaacaggtttcaacatcagcaatgtaaccccacattcatgaaagtgttaactgggtttcttcagagaagtgggagtaggaagtcaaacaaggcacgccttatggcatgtagtcatttccttgtaccaccacacctttctcaacatgctaacgatgatggcaagttctaagttcataagcacactagttaaaagatgaggtccaagtcaatcgctaatcaaaacgtgaggtccaactcaatcacactttttcgtggaaataacaatcaaatactgagtaaatttatcgggccatattatatttatgtattttgagaggggcagaagaagagccccgacaatgtttctcaagccataatttttgttattgaaagaaaagtccaactattgatgctgctggagacaaacaggatatacatatcaccttcaagcattccgatgccccggttgacatcttcaggctgtctagagtgaacaagcgcccaggagagcctcatcaggctctcggttttctgttcttcatttgcagcctcagcaacctcactctcgaaaccctgataaaaaggaattgatcataaagaacgtgtggcaacgattacgattaggcgtgcgtgagcgtgatcaaacacggtttgaccagataacgggatgcaatcggataattggtttgttttgcttaatgaccgcagtagcgccacggtggaatgggaggtgatccattgttggttcaaccgaccggcaaggtgagctagtgaattccccgtgactacaaggaacctgcgacacaattcccagcgcagcaacgactcagcgaaccccgtgccgattcgtgggcctctcgtgcgcatcccaccagagcgacaagaaggcggaagaaggaaacggtcggattggcggcatttatcaacaggcctccctgggaggcagccggcagcggaggccgcagttatctcggcgagaagaggaggggaaggagaggcttacggcgatgatgtcgggatcgcaccagggcaggacgtcgctgccgcggaagatggagcccaccgagtcgattaatttgccgacgtgcgtgtccatcccccagctctctcttctttttctgacgcttttttggggttttccgaggggtggtttgatccgtaggagggcggtgtgtgttttatacggagttttcggcgtgccagaacctatgagaggctagtagatggatgggttggattggaccaagagggtagcgttgggtgctaagcaaagaaaggaagccgttagcgacctgacgcaccgctgctgcgacgaaacttaacgcgttccaccttgctctacctccacctcactatttttaactatgtttcaccaatccaatcatggaactccaacttaaaaaatggccttgaatgggaaaagaccgaaagagtgtaagaaaataaaacaaaacgacgttgtgtaacgagtgacatagtggttaatttcatactaactccacaaggactaaaaacatgaatttgtgtagcccctctttggctgctccatcaaattagtggagttagggtaaattccacgttttca

SEQ ID NO: 22076 - DNA, 1571 bp, Zea mays
ttttttttggcccttggggccttttttttttttcgagtcaagaacctcactagttatgcattttaccatcatgatgtacagttgtagtttttttttttttttttgaaaacatggttgaatctactagaaggtaggggtgcaaatctactagatgacttgtactggattgaacattcctgtgaattaatagcggtttctaaacaacatgtattgctttttgttgtaaacataactgtctcatctgacctggaaatagagcctatgtatcattcctacttcacaagtttgtccaggacgtttcatttacttctcatttgcagctttgtacaaagacagcttcattttatacttgaaactaagtgacatcaaaagagtgatgcatcctataaagcttatgtggaaatatggttcaagagaactcgtgccagaagctctgctcaagccaccagctatttgagttgacaaactctggtcctttttttgagggtggagcaagctttgaatcagatcaatggcttgaagctcaaggccaaatgtccgccgcgcaactggtcacctcgttggactttcggttatccagactctctaggcttgcagtgctctgtactggtgagttctgtactcgtgtacctgcggttggacccctgaacgcatcactccctagtaaatccaaccctgtgagcacattcaaagcttggcacatcttccttgagttcacgtatggtgccaggccaaggtcgcctaggccacacgatacagcacttctcgctaccatatcctctgccatctttaccttaattcttaacgcttctacatcggatttgaggattctgttgtctgtgactgcagtactgaactgttggttggcatctgaaagttgctggaacagtgttgcgttttcacctttgagtcgttcaacctgtgactcaaggtcagacaactgtgcctgtttcctcctcctagaccgccgcgcagactccctattggacaccatccttcttattcgcttcgtctcaatggatctgttacctcgctcgtatggaactccctctacctcatacagtgattcgctgtcggagtctgactcgctttcaagagcatgattggctgaggtggttagcccggggctagcggatatggacgccgcctgcgacatgactgggttcggcgtgcggacgttcccgtaccaccaactgcctccatccatggtgtccgagtcggcgaaaccgaagccgggtgagaagacgccgctccctccgggatcgcttgatccaccgcaccccggactgctacctccggcggcggcgcgggcgtcctcgccgctctcccggatgaacgcctccagctccagctccgacgcgcacttcttcattccggcctgccagtggaccaactctcgacgcagaccgcacctgtgcctcccgtcccggcgtggtggtgtcgtctcgtctcgccggccggcgtgcggacctgcttttgaagggcggggcgcggacagaaacccggtggtacgtggaaaggttggttggggtgctgggggataaaccgcctcgtcaaatggatggtgacgc

SEQ ID NO: 22077 - DNA, 2653 bp, Zea mays
ctgacaaaaaacaattttctgaaacccggagtacagaaagaccgagatggtattgaagcaaagaatacaaagcttgtagagaaaatgtcatctactgatcttgctggaagtgagcgtgatgctgatacaacagataatgacaaacaaacaaggtattttttatttagtatatttggtcttctgcttattgtgctcgtgctgtatgatattcatttgttattatgcttacaccttgtgccagaattgggggtgcaaatgctctgcccaacatgctcctcggttaactgtgcaaggagatagagccatgccaaagaagacctaaaactacaggtaacggatcagccattccagatacactcataatcggctaagggaattagcactatttaaaaaataaatacaaacataaagaacaaaagggatttgaacattatacaaaactctgcaccgaagctgggcatacagcctaaaccggtgattgctcacttggtcagctcacacctcacaggaagctcaagatcactgctatatatagtttctaagtcatccataatccagctgtctctgaggaatctcattgcaatctaatgccaggagaagcctcattccacccatttatgccctgcaaatgctcactggcaaaacttaaaggcaccactgtgctcatgcaaaattccaaccggttgcttggccatcgcttggtgccgttgtgcaactggagaacttccaaattccttgcactcagtgctatacctttaagccgctgcacccatttgttaagtacatattccaacaattctgaacatagccaaaatgacttatgatgtcctccaaggtttattcagctctcaaactcagtatttccttcgctgtcctcctgcggaagtaatgcatttgcttctgtccgaaaatgaggtccatatctctgctgtagaagtcaatgtatttgagcataaacatgccgcagtcccatccattctcctgcaaaggaaggtttttgacaccttcctgcttccataagagcacatccatctgttgaccacttttgtctttgacctcatccacaatatacttggccaagacattcaagaccttcatgtccatgccaccaagtgagtctagatactgaaactttttgtccctgatgttgatgactgctaaacaccaatggacttccttgtgtatgggaacaaatatcttgtcacaatcaattagactgtaccctaacttcctttttgttgtccatcttctaacagctttataatcatacccactggaaatcagcttcttgtagaaaaaggtgttgaagaaatgacattttaagaacctgcaaggttctcttagttccctttctttaagaagatcaagatacaaattgatagcctcatcatttagccactcctggttattcaagcactgcatgatctccctcgttatcacaatatttgaaggttcatgtactgctaacctctcatgtctgttcttgccatgaagagcctgacgaatcatttcttcatcctcatcagtaagaggaacaaaaggttcaggcacctcctccttctttggcgtaattcgcgggagggcctcggcaagccgctcaaggctaagacggccctgctcagtgagccgcacctcaaactcgagcgtcttgagcttggcatcccgcttctgtcgcgacgcctcgtacagctccttgtatggtggcacccttctcactaccacgctccccatcacctcctcctcgttctgctgcttcctctcgtcctcatcctcctcgatggcgaccacctcgaagggcgccgcctccgcctgcctcgtagcattggtaatggcggcgggagtgggcggcgccgggtgggtgacgctgttgacgagctcaacgtactgctggagtccgagaggacgaggcgggggtgattgcggggagaaccatgagtggccggcggcgtgggcccgtgcggcccctccaagctggaagacgcggaggatccgctgggggccgtggatcgagcgctggaatggcggcggtgggagtcggcgcctgtgcggaagcggggtggaagcggtggtagaagagggggatgggcccggcgtggaggaggtggatgccgccgcagcggagtggatgatttggggagagggacggataggcgggaaatcggaggtggagggatcgtgttcaggaattggggagagcttggcccgcttgaagggaggggtaagggacggcggggaggaggggtaggggaggcggtggtcggccgagaggcagtggtccgccgagagacgcttccggctgtcggtgagggcgcccatcgacggcggcggtagaaaccctagcggcggtagagagcgccccagctacagctagcgagggccagttgcgcagttggcggcctttcgaggaaggagcggactcgggggtctatttttattttattttcccccatcgactttttgagctttttggttattttttgatccatttctgcgcggcagattgtaatgtactagtaattggcgcgcgtcagcgcgcgttcataattgtatttaagttaaatcacattttaatttagctagaggtattaactatgaatttctcccatacaaatcatttatataggcacgcaccgaacgaaaaaaacgataagag

SEQ ID NO: 22078 - DNA, 1110 bp, Zea mays
caagaacactggtatatatatatttttggttccaagttaatctatacctccctatctttgatgaatctcattgcaatctaatgcttgaccatgcaaaggctcactgtcaaaactaggcgctgctgtgctcatgcaaaattcccttcaacctgttgcttgaccgttgtgcatccggaacattttcaaaatcattccactcaatgctatacctttaagccgttgcagccatttgttaagtacatattccaacaaatatctgaacctaaccaaaatgacctatgatgtcctccaaggtttattcagccctcaaactcagtatttcctttgccgtcctcctgcggaagtagtgcatttgcttctgtccaaaaatgaggtccatatctctgctgtagaagtcaatgtatttgagcatgaacatgccacagtcccatccattctcctgcaaaggaagattttcgacactttcctgcttccatgagagagcatcaatctgttggtcacttttgtctttgacctcatccacaatatacttagccaagatcctcaagaccctcgtgtccatgccaccaagtgaatccagatactgaaactttttgtcccttatgttgatgactgctaaacaccaatggacttccttgtgtatgggaacaaatatcttgtcacagtcaattagactgtaccctaacctcctttttgttgtccatcttctaacagctttataatcatacccactggaaatcagcttcttgtagaaaaaggtgttgaagaaatggcattttaagaacttgcgaggttctcttagttccctctctttaagcagatcaagatacaaattgataacctcatcatttagccattcctggttattcaagcattgcaagatctcccttgttatcacaatatttgaaggttcatgtacggagggcgtctcggtcctgctctacgcatgaagagtccatcggagccattttttcatcctcggcagtaagagcaactaaaggttcaggcgcgtccccctcgtttggcgtatgtcgcgggagggcctcagcaagccgctcgagaataagacggctccgcctgggcgagccgcacctcaaaccgagaaagggg

SEQ ID NO: 22079 - DNA, 3380 bp, Zea mays
aagctgagtacggtcggattcgggcgaccacgcgtccggacagaaccgatgctgttcatgtcagcagttccttttccttccccatgaaggcgccgcgccggcgtgggggcatcgatagccgcgccggtgatacggcgcaccgccctgctcgcccagcggattcggtgcggcagacgtacgcggacagccggacccggacgcgatgcgaagtgcgaacccccaaaatattccacttgtcttcccccctcgtcgacccacggaaccttcgactcctcgccactggagtggctggctacctccaattcagcacgtaaagaaagcaaaccgcccgcagttccgttccgcaagaccagatcgcccgcttttctcctccggtcctctcctccctcccctctcccctgagccctgatcgaatcgatccacggtgccggcggacgcctcgacccctccagttccatccaatccgccagtgaacagatggcgtcgcagtgggctgctccgccgccgggctacccggccgggcacgggcaggcgtacggcgaccagcagctggccacgccgccgcctcaggcagcgacggccgtggccgtgacggcggcgagcaacggcgtgggcaacccctacgtcgtcgtcacccccgcgtctgccgcaccgtccacctgccagagtgcgcgcctgaatctgctctcgctcatcctttgcgccccccttgaagcaagagaaatcctcagcctgcttacgtgttttgttcgcttggatgcgtcgttgcagccgtcaggaaggcgctgggccgctacggcaagctgctcgaggacggaacccgcaaggccgccgacgccaccggcaacatctggcaccaccgtgcgtgccccatgctttgatcctctctatctctctctgtctgtctctgatcagttcgccaatcgtcatgatacgcacgctatggcttccgatgtgtgacttgctgctcccccttggcggacagtccggacggcgccgaacatggcggacgcggcggtggcgcggctgacgcaggggaccaaggtgtacgcggagggcggccacgacagggtgttctaccagacgttcggcgccatgcccggggagcagctccgcaaggcctacgcctgctacctctccacctcctcggggcccgtcatcggcacgctctacctctccacggcgcgcctcgccttctgcagcgacagcccgctctgctaccagggccctgccggccagccgcacgagtgcatgtactacaaggcgagtagcagcctgcctttcagtcgcattcagaaattcagttcagttgcctgcatcttcttcagttccctgtgagtcgtagacgactgacagaacaaaaaaaaaaagggtaaccatatgcgaagtatacctgcaggtggtgcttcctctgagccaggtgacatccgtctcccccccctccagcgtgcccgaccgggcagaaaggtacattcagatcaggaccatggataaccacgagttctggttcatggggttcgtgaactacgacaaggccctcaagaatctctacgaggccctgcagcaccgcgatgtcagcggccaccagcgctgctgatgctgatcaggcttcggttaggtcctacagtcctactgctacttatttcgtccatgatgaactgtgatacctttatctcatctgatgttcttgatgaataagagaaccaccgaaaactcctggtgtgcttgcgtcgctaatctgatcggtgcagagagaatatggtgcatctcacaaaataacatttctttaatccttgatacattctcatttagccaaatttttttcatggtcatggagtccattacaatgctgcaggcctgatcctccatatacaaacttcaaccttgcaatagcatattagactttacaccatagaggctgcatgctgtctccacatcgatcaaatatacaatcaatagcgttcgtttctttagcaatagaaacgtatacaagctcagcaggaaggaaggtagcagcaattaagttttctcgctatcgatttacaacaacattacctaggaaaactgttgttgccatggcgcgcgttcggttctgttctgtcattctgtgcgtgtacagtataggcttgtattgtaagctgtagcacggtgacggcgcgctgtgctttgctccggtgcctcaggtgttggatcgacggtcagtggtggtgtgggtgtccgtgggcatgcgcggtctggtcgatggagtcgacgcggctcttgagcgccgcgagctggcccctgacgctgaggtcgatgacgtgcgagtcgtcggtgccgtagcagacgacgaagccggcgatgagggacgcgtccacggcggtctctaccttgaggtcgacaaagccggtgaggcggcgcatcttgcgcgcgatgcgctcggcctggcgcgcgtccagctccacggcggaggtcaccagcacccggagcgcgaccatctgcggcggcggcggggcgctggcctcgccgtccgggacggcgggggccatgctgcagttccggtccaggagcgaccgcaggaagtcgagcgtgagcggcttgaacggggccgcgactgggactgggactgggactgggacggacgcggtggtcccgtcgatgtgctcgacgccgacgtagctgctgtcccggcgcagcgtctgcgcctgccaccgagggcagtgcgcatgggaccgccccgcggccgccgtggtgctcggctgcgccggcacgagatggccgcctgggctgatgggctggttcaagatcttcatcgctaccctgcacgtgaacaataatagttcaaaatctatagcagcaagcacaaagaagaggaacatgtatgggactgagcaaggactcgaacaatgaaacgcggtggttcttgcctcagcactcagcagcacaagcagctggtgatcggagggaacggcagggaagctgaggcgagggtggggagaagcagaagactgcgcggcgcagcagtgtggggaagggtaatagctgccagagtgccagcgggggggataagatagctgctgctgcgtagcgtcgctagcttggtgtcgaggaggggaagaggacgggagagtttggcgtgcacacgatgcggccccggcagccgcacacgccccatccggggaaatctgcatctgcgtgccgcacacgccccagtccccgccccgtgtggtcaccaccggtcattccatcacgcgcccccgcccggccgccccctatccgctgtctgttccatgcgcgcgacggggcgccacggctttggtcggccgcgcctcgcgtcgggcccagccttccggttccgggccgcctctggccttgttcgtttgtgtcggattggtgggtcg

SEQ ID NO: 22080 - DNA, 1495 bp, Zea mays
ctctcgtaggccagaagcccacaaccatcggcccagtgctgaccagaacccgatgctgttcatgtcagcagttccttttccttccccatgaaggcgccgcgccggcgtgggggcatcgatagccgcgccggtgatacggcgcaccgccctgctcgcccagcggattcggtgcggcagacgtacgcggacagccggacccggacgcgatgcgaagtgcgaacccccaaaatattccacttgtcttcccccctcgtcgacccacggaaccttcgactcctcgccactggagtggctggctacctccaattcagcacgtaaagaaagcaaaccgcccgcagttccgttccgcaagaccagatcgcccgcttttctcctccggtcctctcctccctccccttgagccctgatcgaatcgatccacggtgccggcggacgcctcgcccccttcagttccatccaatccacgagtgaacagatggcgtcgcagtgggctgctccgccgccgggctactcggccgggcacgggcaggcgtacggcgaccagcagctggccacgccgccgcctcaggcagcgacggccgtggccgtgacggcggcgagcaacggcgtgggcaacccctacgtcgtcgtcacccccgcgtctgccgcaccgtccacctgccagaccgtcaggaaggcgctgggccgctacggcaagctgctcgaggacggaacccgcaaggccgccgacgccaccggcaacatctggcaccacctccggacggcgccgaacatggcggacgcggcggtggcgcggctgacgcaggggaccaaggtgtacgcggagggcggccacgacagggtgttctaccagacgttcggcgccatgcccggggagcagctccgcaaggcctacgcctgctacctctccacctcctcgggccccgtcatcggcacgctctacctctccacggcgcgcctcgccttctgcagcgacagcccgctctgctaccagggccctgccggccagccgcacgagtgcatgtactacaaggtggtgcttcctctgagccaggtgacatccgtgaacccttcttccagcatgcgcaaccgggcagaaaggtacattcagatcaggaccatggataaccacgagttctggttcatggggttcgtgaactacgacaaggccctcaagaatctctacgaggccctgcagcaccgcgatgtcagcggccaccagcgctgctgatgctgatcaggcttcggttaggtcctacagtcctactgctacttatttcgtccatgatgaactgtgatacctttatctcatctgatgttcttgatgaataagagaaccaccgaaaactcctggtgtgcttgcgtcgctaatctgatcggtgcagagagaatatggtgcatctcacaaaataacatttctttaatccttaataaaaaaaaaaaaaaaaaaaaaaaaggagaagagaaaagaactcgagagagggcgccgggtacc

SEQ ID NO: 22081 - DNA, 602 bp, Zea mays
cggcagcagcagtgtgctctgcgccggcgcatcgatgctgctctaggacgtttctccgccagagctcctgcgcttcatgcgggagcagcggtcgcagtgggccgacagcaatctagacgcgttcttcgcttctgcgatgaaaccggatttctgcagcttgcctattcctcctcgccttggagggtttggtggccaggtcatacttcctctagcccacacgtttgaccctgaagaattcctcgaggttataaaagtaggaaatgccggtaactaccaagacgcgctcctgcaccgtgatctgtttctgttgcagatgtacaacggggtagacgagaacatggcaggcacttgttcagagctcatctttgcccctatagacgcatcgttcagcgacgactcgccactgctgccatccggctttcgtatcatcccgatcgacgctcctcttgacacgtccagccccaagtgcacgctggaccttgcctccaccctcgaagccggaactcccagaagcaggacaagcgggagcggcggccctggaactgccgccgccgcttgtgccggctccaaggccgtgatgacgatcgtgttccagtttgcct

SEQ ID NO: 22082 - DNA, 1469 bp, Zea mays
ctcgaggccggccgggattcatcccaaaccccacgcgactgagctccactgccaccatggtgccgctccactgctcagctagcgtccacctccacttcctatcgccatctctccccctttcgtcatccttctctctcctctgccatcgcgtccgccgccccaccgccatccgcgccgaagctgaagtgcggcctccgctacctgtctccgcggcggagtcagagccccctgacgccggcgctgtggaagccgaaggtcagggacccgtggagctccgcgctccgacgctcttctcgactgatgacaatcccaccccgctccagactgccaccagtctcctcctcaccggcgccatctcggtcttcctcttccgcgccctccgccgccgcgcccgccgcgccaaggagctcagagtgcggtcgagcgggttgaagaagcccaacaatctcaccgaggaggccctggagaggctgagattgatgagcgcctcaccgatcgagaccgagaaggcaacttcgcccatccaggctctgctcggcgggattgcggcgggggtcatcgcactcatcctctacaagttcagcaccacagtcgaggctgcgctcaaccgtcagaccatctccgacagcttctcggttcgtcagattacaatcacaataagaacaattgtcactgggctgtgctacctagcaacttctgtctttggaatcaatgcggtgggattagttttgtattccctccaactcactttacaatcaatcatggacgatgactccagctcttccacagggaagattagtgaacaatctaatacactggcatcatctgatagctccacaagtagcagggaatcagacagtagtgacatgcaagtcactgacaaaagtaaaaactcagcagagaagcagagctagacatgtaatccagacagccaaaatctgagatctgagggtacatatctgatgaaatcattttaagcattccttctcattattagctgaaaaatctgatgagagcgatctcaactcgagagtttcaattatgctagtattccgtccaaaatccgtccaaaaaaaagaagagaactcaattctagatttgagctaagttaaattgtcttaagtttgattatgtttttttaaaaatatcattatttatatcattaaatatgtttgttataaaatatattctatgattagtggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaactcatacaataaaaaaacacaaaataaaatataacttaacgtaaaattaaaaacaattgtgactggaaaaaaccctgaaaataacccaacttgggcgggctccccaccatatccaaactttaacccactgcccgtcatatcgaataggcccgtttttataagaccttcccaac

SEQ ID NO: 22083 - DNA, 1041 bp, Zea mays
ttttttttttttttttatgcaaattagaaagcatctttttaagacataagatgaacagaacgatcaacgggcacggacacaactccgcccactactggcgacccgggcagaaggtgacgaggtactgcgcgccggtgccgcacgtgaaggtgctggtggggtcgtcgtacgcgtagctgtaggccgcggggcaggccgccttgaacagcctcgagtacttggtgggcccgcaggtgttcggcccaccgtgcgcccccgtgcagcagtactcgggcgacccgaacgcctcgcacgcgctccggcacgccaccgccggcgccccctcgccgcccgccgccgcggccgtccgcagctcgggcgggcacagcgcgttcacgtccccgacgcagccggcgtacccgcacgtggcgcggttgaccctggcgcccgccgccgccacgccgatgccgacgttgtacccgtccaccaggctcacgtcgtagaagtccttgccgtcggcgctgcccagggtgaactccgccagcgtgacgggcggcgccccgcccagggagcagctcgcggcgccgctgcagtcgcccgtggcgcacgagaggcggccggcgggggacgacgacgacgcgacgcagcccgtgcgcgcccacaggcggcccgaccagcccgccggcgccgggaacgagacggtggcgccgggcgacagctcgaagcccccgcccccgacggccgccgcgctgttcccggacagtgtggccggccagaccgtgtgggtgcagttgttgtgcagcgtgaacaccgtcgtgccggcggcctccgcgccgaacatcgcccgcgacagccagattaccccagcgaggagtagaaggcttgcaactcgtatggctcccatggaaacgggttggttggagctagggcttgacgagaggaaccggcaatgggccaatggcagacgtggacaatgtgcggtggaaatagctggagctggaagaggaatgtgcaggcagtaagactttttcgattaggatgttctaggtaatggtctcgtgc

SEQ ID NO: 22084 - DNA, 911 bp, Zea mays
aactaaaaattttttttttttttttttttttttgacaaccagatgccgatcctaacatctgaccatacgcatgcgatgtacgtgggcattgtttcgaaccaaaagggcaacggaatacaacatgctcatccaccaattcgcgatacagtgtccaagcgatacattccgtatttcatacaaagaatctcagctttcatcacaatttacaccgcattattatcgcctattcgccttcagaactccaaaccgcagttccggagtccaaacagaatcgtcctgctggaacgacgtccttgcatcgcgaagcgttgcagcagcagtcctagcactggcctgcaggcgacgccgccgagcgcgaggggtcgagcgctgagccagcatgacggcgaatctgccaggtgccggggggcgttgacgaggtggcatggggagggagaagctgacgggcgctcgctgcacccagatccaggagcgccaccgcaaaggcacacgccgccggtacgaacaggaagcagaagaatatagtatgacaagaaataaaacgagtgtttgacatagactacctgtaccgaacggccggaaacctcaccggcgaagatagggtataataaagcgacgcaagtacgggtaccgataccagtcgaccaccagggcatgagggcagcaccagcagcagcaacgtgctgcttcgttaaactccagcacggataagcacggcctaaagaatcttaggagaaacagcaaatagcacaggagaggagaagaaaacagtgtagcgaggctacagtgagccaccacgagcctcggatctcaggtcccaggaaggacgcaacaagcaaaaaaaaatggaggggtggatcaggatgcagagctcccttcaatccaaacccggccggcctcgaggtacccaa

SEQ ID NO: 22085 - DNA, 1386 bp, Zea mays
tccaccgcggtggcggccgcccttccttctggccttacgcatgcgatgtacgtgggcattatttcgaaccaaaagggcaacggaatacaacatgctcatccaccaattcgcgatacagtgtccaagcgatacattccgtatttcatacaaagaatctcagctttcgtcacaatttacaccgcattattatcgcctatttgcctccagagctccaaaccgcagttccggagtccaaaaacaagaacccaagtccacggcttgaatcgtcctgctggaacgacgtccttgcatcgcgaagcgttgcagcagaagtcctcgcactggcctgcaggcgacggcgccgagcgcgaggggtcgagcgctcagccagcatgacgcgaatctgccaggtgccggggggagaaaagctgacgggcgctcgctgcatccagatccaggagcgccaccgcaaaggcacaagccaccggtacgaacaggaagcagaagaatatagtataacaagaaataaaacgagcgtttgaaataaactacctgtaccgaacggccggaacctcaccggcgaagatagagagtgtaataaaacgacgcaagtacgagtaccgataccagtccaccaccagggcacgagggcagcagcagcagcagcaacctgctgcttcgttcagctccagcacggataagcacggcctaaagaatcttaggagaaacagcaaatagcacaggagaggagaggagaggagaagaaaactgtgtagcgaggctacagtgagccaccacgagcctcagatctcaggtcccaggaaggacacaacaagcaaaaaaaaatggaggggtggatcaggatgcagagctcccttcaatccaaagagcggccagcaagggggcggtgcagctcctcggtcatgcaaaccacaagcctatctcaaagacgagagagaaaccctccccatggaatacatgcatacacatgatgagataggatagtgggaaccatgaacgagcagcggaaccagcccttcggaacgacccttcattggaatgataggagctccgcttcaaacccaaaccatcgatctgcccccgttcggtccggtcaaacaccagcagggccaagaaacgcaagcgaaagcgcaaaaccgccggccacgagatctatgtgcggaacaccgtaaagtactcggacagaatagagaagcaaataaccggtgatagtatatatgtatgtatagaaataaagaacagcagatgcgggatagagtgacgacgagaagaagaggtatagagggctatgaaaaggggaatctggggagtgagggaactggcctatactattctcggcccttgctttgctgttcatgggttcccggccggcctcgaggtacccaa

SEQ ID NO: 22086 - DNA, 2182 bp, Zea mays
ctgcaggtttttactgcacgcgttactgtatcttggtagtgtatcctttatagttgtccactgtcaggctaagttttctcaatctctaactccctatacatgattttgaagagataaaaaacatatcctgtatgataaaaaacaaacaactgtacaatcatttttcgttccattatcatatactcacactataaaaaaccatgggaaaatccaaagaaaactacagatatattttataaactagaataatatatcattattctatgttattatgaggtataaaaatgagaatttagaagttaaaattttatatattaagagtatacatagtttcttctgctatacagtattgtgttgcctaccgagagactaatggaaagactaagagtgtttggtttgaaactaatgaagagactgagtgttttggtttgagaaataagctggtccattaccagatcagtccttatttttatttttattttgttttgtagaatggaattagctaatctattatcacctcagtcctcatattttgtactgataagaaataatgtcatcctatttgaatagaaccactttattttaaatagcaagagggtttctagtcactcaatcagcactaaggacgtgtcctggtacacaggaagataaaaggatgactaccggcgcgacaacatcgaacatttgagagatttttgacaaaaaatgaactaaaaacgaagctattaacgatcagattctgacaaccagatgccgatcctaacatctgaccatacgcatgcgatgtacgtgggcattgtttcgaaccaaaagggcaacggaatacaacatgctcatccaccaattcgcgatacagtgtccaagcgatacattccgtatttcatacaaagaatctcagctttcatcacaatttacaccgcattattatcgcctattcgccttcagaactccaaaccgcagttccggagtccaaacagaatcgtcctgctggaacgacgtccttgcatcgcgaagcgttgcagcagcagtcctagcactgcacattacatgtcggtcagaaagataaacgaagctccctcccatgacacggaagcaccagcgggcggcgacatgcgatgaaaccggacctggcctgcaggcgacgccgccgagcgcgaggggtcgagcgctgagccagcatgacggcgaatctgccaggtgccggggggcgttgacgaggtggcatggggagggagaagctgacgggcgctcgctgcacccagatccaggagcgccaccgcaaaggcacacgccgccggtacgaacaggaagcagaagaatatagtatgacaagaaataaaacgagtgtttgacatagactacctgtaccgaacggccggaaacctcaccggcgaagatagggtataataaagcgacgcaagtacgggtaccgataccagtcgaccaccagggcatgagggcagcaccagcagcagcaacgtgctgcttcgttaaactccagcacggataagcacggcctaaagaatcttaggagaaacagcaaatagcacaggagaggagaagaaaacagtgtagcgaggctacagtgagccaccacgagcctcggatctcaggtcccaggaaggacgcaacaagcaaaaaaaaatggaggggtggatcaggatgcagagctcccttcaatccaaagagcggccagcaagggggcggtgcagctcctcggtcatgcaaaccacaagcctatctcaaagacgagagaaaccctcccccatggaatacatacatatatacacatgatgagataggatagtgggaaccatgaacgagcagcggaaccggcccttcggtacgacccttcattggaatgataggagctccgcttcaaacccaaagcatcgatctgcccccgttcggtccggtcaaacaccagcagggccaagaaacgcaagcgaaagcgcaaaaccgccggccacgagatctatgtgcggaacaccgtaaagtactcggacagaatagagaagcaaataaccggtgatagtatatatgtatgtatagaaataaagaacagcagatgcgggatagagagacgacgagaaggagaggtatatagagctatgaaaaggggaatctggggagtgagggaacaggcctatactattcggcccttgctttgctgttcatggtt

SEQ ID NO: 22087 - DNA, 1203 bp, Zea mays
aaggccgctttttttttttttttggtgaagacatactctctttatttattcgcaatatattacaagtaaagcattacacatgaagagtgcatgcacacgtagtagtagtagtataaaattaaaacgtattttcgacaaacatatgaactgcttattaaagcattattacattaatatggcttatttataaatcacatcaatcgaagtttatatcgagagactatggacgatatatcgctcagtcgtcgtccttggagagcttcctttccgtgacctcagacttgaaaccgaagctgttaacaccacggaagatgccgtcatcaaacttgaaaaccttcctctctccggtagtcaaaacgtcctcctgagtataagagaaggggacttggcagatgccctgtgtggcgagcacgctgacagtgacgacggagtatgcaggcacaacgacctcgtaggcgttggagtacctcggccgcgaccacgcggactcgctacccagctgtaggtggagttgaactcgctctggacctcaatggttgcgggtaagaccacaggaaccccagcttcaatggtggtggtgacccccagcttcatggacttgctcgaatcccatagcttgcccttgatgacgctgtacttgagggtgatggtggtcttgctgtccgtgctggtgccgttcaccgcctctcgagtgatgagggtcttggccttcttgtcgaagatcttggcgcccttgaggtggtactcgatgttggagatcttccgggagaggacggcttcttcaatcttgaggtacgcctccttcctgatggtcgggatcacggccggcctcgaggcactccaatccttgccctcgtaggtcagccggtggcagaagtagttgttgccgaggttccgaagcgcgtacacgccatcctcgccgatcttgatgagctcgaacaaggtgtcggagttgttggtgctggtgtcgtcggtgtcggcccagatccagttagggcttcgccgccagaacttgccgagatggttggacttgaagcgcaccacccgtttgccgttcaccttgtggttgtaggtgatgaacctcacacttgggtcgccaatgtctcccgatgcaaattgtaggtagggatggccttcaaccttccgagcactaaggtacagaccgttatctcccttgaaacacacgtacttgggcaagtccag

SEQ ID NO: 22088 - DNA, 4173 bp, Zea mays
gacaagatgatttcaaaacaaaactttgtcaactacaaaaaagctctttgccgagtgtgaaaaaaaacactcggcaaagaagctctttgccgagtgtgaaaaaaaacactcgtcaaagagctttttgctgagtatcaaaaatatgacactcggcaaagaaactctttgccgagtgtccaaaataaaacactcggcaaagagcttctttgtcgagtgttttcttttaccgagggttttttatgtgacactcggcaaatactttttttgccgagtgccaaaaaaacactcggcaaaacactcggcaaaatatttggcactcttctttcaaaaaaatatttggcactcgtcaaagaaccgaattccggaagtgattccgagtgaaatttgagtttacaaaatagtcgaaaactatttatgagaaattttcactccctcccccgttgctttgaaactagcctgtagtgagagagatcccgccagactcgtttttggtaaaaaaaatcatacaaaatttgatcaagggataagtccaagtagtacaaaattgtctttttctttttttttttttgtatttgataacaagtggtgaaggactctctctgtttattctcaataaattacaagtaaagcattacacataaagtgtgcatgcacacatagtagtagtataaaaacgtgattttgacgacacacatatactgaactgcttattaaagcattattacattaatatggcttatttataaatcacacagatcgaagtttatcgagagactatggatgatatatcgctcagtcgtcgtccttggagagcttcctttccgtgacctcggacttgaaaccaaagctattgacaccacggaagatgccgtcatcaaacttgaaaaccttcctctctccagtagtcaaaacgtcctcctgagtataagagaaggggacttggcagatgccctgtgtggcgagtacgctgaccgtgacgacggagtatgcaggcacaacgacctcgtaggcgttggagtactcttctttctcgatgatggactcgccccagctgtaggtggagttgaactcgctctggacctcaatggttgcgggtaagaccacaggaaccccagcttcaattgtggtggtgacccccagtttcatggacttgctcgaatcccatagctttcccttgatgacgctatacttgagggtgatggtggtcttgctgtccgtgctggtgccgttcaccgcctctcgagtgatgagggtcttggccttcttgtcgaagatcttggcgcccttgaggtggtactcgatgttggagatctttcgggagaggacggcttcttcgatcttgatgtgcgcctccttcctgatggtcggaattgtggcgttcaggcagctctccttgccgtcgtaggtcagcctgtggcagaagtggttgttgccgaggttccggagcgcgtacacaccgtcctcgtcgatcttgatgacctcgaacagggtgtcggagttcttggtgctggtgtcgtcggtgtcggcccagatccagttggggctccgcctccagaacttgccgagatggttcgacttgaagcgcaccacccgtttgccgttcaccttgtggttgtaggtgatgaacctcacacttgggtcaccaatgtcttccgatgcaaactgcaggtagggatggccttcaaccgttcgagcactcaggtacagaccgttatctcccttgaaacacacgtacttgggcaaatccagttggtcctcatccttgactccttggtcgattgcttctacgatactgcctaaagtgtcctctacgcctggaatgtatatagcatgccatatatagattggtatatcaaataaattaatgatgatggcattgattataaataatactccatccgtcataaattaaaatttgttttaccatattcacacaataattaaatgtattctatatatgtgtctacaaccagaagtacaaaaaggaatgtcaggtgtgaatacctagtagtgtcttcttattatctgactgatgtgcaattatatttgagagacccttaatttgttaatcagccttattgcaaaaatgatattcaagtactgttaatgcagtttgcatccttctacatttacattaatttttaccatctttctgtgaatcagctctctccatgattcctggctatatatcggagcttaacatgcatgcgaacaatgcagaatacacacagcaactgcttgttgccgggtatcattttcgggcacgctaattatccttgtctatacccatacgggacagcagtacttacactagtgtcctaagtttgtctgcaagcatatctacgcatcccaaaagatgtctttatctgtatctcttttctccacatttatataccatcaatagatcaaaagtcaaaacccatattaattatctgtggcgtattttaatctggatgcctttcataactactccgctctgtcagaaaatatagttctttctgactctttttttcatccatattcgaacgaatgataataaatctagacatacatacaaactatattcgtagttaattaatgaatgcatttaaagtctaaaacgaattacattttgggaaggggagagtatgtctctaaaatataaaacaaaatagatagagcggggaagcaagagaggacatatggcccaacgtactttcaaagtagaaaagatagactatagcgtgtaaagaaggtagtggttagagaggaactggactttcactatcaaaaaaactagaatcattccacatccgtccaacaaatgaaagaagcaattaattttagtagcattaagatgttatgaacacgttcagaaccgaaattttatgcattattattttatccaaatgtagtgtcatgcgtccatttatactcgtctgtgtaattattttactgatcgttttgtatattagcaaaagaaggcgtacgtcgatgagagatggctattaattataggaacgaaacgactcaccttctacaacctgcgacgctacgccagtgacaccactgattccatcagcgaccaagttgcccgcgcctgcgattgcagaagagatcaagtgggccatggtaaattcagtttttatgccgatagatgcaatatgtatatcaagtgagctagcgccgcgtgccgagctctatgctctgcttcacctcaacaccccactcgtgctcaatttatactaggggagtggggcgctatctggctaggctaggctaactagcgccttgcccattggtcgatgtgtgtggccagaaattcgcccgatccaatgcaacctcgtggtctaattcatgcatcagataataccaccagcaattttggttggtgctatttcgatttcctgtgaggagcgcgcctggcgtgtttgattttttatgttgtttacggaggcttattactaataattatcactatttgctgccttagtttttcaatagttcgtcatttgtgggtggttggatcgatcgaataatattagctcattcaccatattctaatgttctgcttagttgcttcaattttctgtttccacgtgtacgtttaatagaaactctactagtatacattttataaacaagacgtttaaatagcctagataataattcaactattagctattcttagcaaattagctaatatatagttagctagttatttattagctatctaatatcactattatttttagtcagctaactattagctctactgaattcatttatgtatttagattaaatcatttacttcagctaaaaacccatataaatgaagtgattatttacgttggtctgctaaaggctaacttaaataatcatatttacgttatgttggttacaaaaaaccaatgtagatgtttcaaggattttcacaaacgtacgaggactctatcatagttagagtcgtgtacttcgggacactctgccgaggtttcatcgacccggtgattcgagcgagacaatgctttgagttgccatctccgttcacaggaaggaagagcgggaatcagtttgtaggtgcatcattgtcttcgcccatccaacaggtgagctccgcgttacattgcacccatgttaccatgatttcggcgatcatcataaaggattgaagatgggtggagaggagttcgg

SEQ ID NO: 22089 - DNA, 1460 bp, Zea mays
atcgcggccgcgtcgactttttggtgttgacgctttctctttgtttattcgcaataaattacaagtaaagcattacacataaagtatgcatgcacacatagtagtataaaaacgtgattttgacgacacacatatactgaactgcttattaaagcattattacattaatatggcttatttataaatcacaccgatcgaagtttatcgagagactatggacgatatatcgctcagtcgtcgtccttggagagcttcctttccgtgacctcggacttgaaaccaaagctgttgacaccacggaagatgccgtcatcaaacttgaaaaccttcctctctccggtagtcaaaacgtcctcttgagtataagagaaggggacttggcagatgccctgtgtggcgagtacactgaccgtgacgacggagtatgcaggcacaacgacctcgtaggcgttggagtactcttctttctcgatgatggactcgccccagctgtaggtggagttgaactcgctctggacctcaatggttgcgggtaagaccacaggaaccccagcttcaatggtggtggtgacccccagcttcatggacttgctcgaatcccatagcttgcccttgatgacgctgtactgaggggtgatggtggtcttgctgtccgtgctggtgccgttcaccgcctctcgagtgatgagggtcttggccttcttgtcgaagatcttggcgcccttgaggtggtactcgatgttggagatctttcgggagaggacggcttcttcgatcttgatgtgcgcctccttcctgatggtcggaattgtggcgttcaggcagctctccttgccgtcgtaggtcagcctgtggcagaagtggttgttgccgaggttccggagcgcgtacacaccgtcctcgtcgatcttgatgacctcgaacagggtgtcggagttgttggtgctggtgtcgtcggtgtcggcccagatccagttggggctccgcctccagaacttgccgagatggttcgacttgaagcgcaccacccgtttgccgttcaccttgtggttgtaggtgatgaacctcacacttgggtcgccaatgtcttccgatgcaaactgcaggtagggatggccttcaaccgttcgagcactcaggtacagaccgttatctcccttgaaacacacgtacttgggcaaatccagttggtcctcatccttgactccttggtcgattgcttctacgatactgcctaaagtgtcctctacgccttctacaacctgcgacgctacgccagtgacaccactgattccatcagcgaccaagttgcccgcgcctgcgattgcagaagagatcaagtgggccatggtaaattcagtttttatgccgatgcaatatgtatatcaagtgagctagcgatgtatgctagctctatgctctgcttcctcggtcccccccggccaggccacccgggtacc

SEQ ID NO: 22090 - DNA, 1523 bp, Zea mays
tttttcactcactcccgttgctttgaaactagcctgtagtgagagagatcccgcccgactcgcttttggtcaaaaagattacaaaatttgatcaagggagaagtccaagtctagtatattattagtttgaaattgacgcatgttttttttttttttttttttttttttttttggtggagacatactctctttatttattcgcaataaattacaagtaaagcattacacatgaagagtgcatgcacacgtagtagtagtataaaattaaaacgtattttcgacacacatatgaactgcttattaaagcattattacattaatatggcttatttataaatcacaccgctcgaagtttatatcgagagactatatggacgatatatcgctcagtcgtcatccttggagagcttcctttccgtgacctcggacttgaaaccgaagctattaacaccacggaagatgccgtcatcaaacttgaaaaccttcctctctccggtagtcaaaacgtcctcctgagtataagagaaggggacttggcagatgccctgtgtagcgagcacgctgaccgtgacgacggagtatgcaggcacaacgacctcgtaggcgttggagtactcttctttctcgatgatggactcgccccagctgtaggtggagttgaactcgctctggacctcaatggttgcgggtaagaccacaggaaccccagcttcaatggtggtggtgacccccagcttcatggacttgctggaatcccatagcttgcccttgatgacgctgtacttgagggtgatggtggtcttgctatccgtgctggtgccgttcaccgcctctcgagtgatgagggtcttagccttcttgtcgaaaatcttggcgcccttgaggtggtactcgatgttggagatcttccgggagaggacggcttcttcaatcttgaggtacgcctccttcctgatggtcggaatcatggcgttcaggcagtcctccttgccctcgtaggtcagccggtggcagaagtagttgttagcgtggtcgcggccgaggtacacgccatcctcgccgatcttgatgagctcgaacaaggtgtcggagttgttggtgctggtgtcgtcggtgtcggcccagatccagttagggcttcgccgccagaacttgccgagatggttggacttgaagcgcaccacccgtttgccgttcaccttgtggttgtaggtgatgaacctcacacttgggtcgccaatatctcccgatgcaaattgcaggtagggatggccttcaaccttccgagcactaaggtacctgcccgggcggccgctcgaaacacacgtacttgggcaagtccagttggtcctcatccttgactccttggtcgattgcttctacgatactgcctaaagtgtcctctacgccttctacaacctgcgacgctacgccagtgacaccactgattcccgccccgccccgggggcccccgcctgcgatgcagaagagatcaggtgggccatgcccggccggcctcgagg

SEQ ID NO: 22091 - DNA, 1438 bp, Zea mays
  misc_feature (18)..(18): n is a, c, g, or t
  misc_feature (21)..(21): n is a, c, g, or t
  misc_feature (51)..(51): n is a, c, g, or t
  misc_feature (53)..(53): n is a, c, g, or t
  misc_feature (55)..(55): n is a, c, g, or t
  misc_feature (58)..(58): n is a, c, g, or t
  misc_feature (88)..(88): n is a, c, g, or t
  misc_feature (136)..(136): n is a, c, g, or t
  misc_feature (142)..(142): n is a, c, g, or t
  misc_feature (162)..(162): n is a, c, g, or t
  misc_feature (166)..(166): n is a, c, g, or t
  misc_feature (257)..(257): n is a, c, g, or t
tttttttttttggagcanctntcttaattatcgcaataattcaagtaagcntncnctnaagagtgatgcacacgtagtagagtataanttaaacgtattttcgacacacatatgaactgcttattaagcattattncattanatggcttatttataatcacnccgntcgaagtttatatcgagagactatatggacgatatatcgctcagtcgtcatccttggagagcttcctttccgtgacctcggacttgaaacngaagctattaacaccacggaagatgccgtcatcaaacttgaaaaccttcctctctccggtagtcaaaacgtcctcctgagtataagagaaggggacttggcagatgccctgtgtagcgagcacgctgaccgtgacgacggagtatgcaggcacaacgacctcgtaggcgttggagtactcttctttctcgatgatggactcgccccagctgtaggtggagttgaactcgctctggacctcaatggttgcgggtaagaccacaggaaccccagcttcaatggtggtggtgaccccccgcctcctggacttgctggaatcccatagcttgcccttgatgacgctgtactggagggtgatggtggtcttgctatccgtgctggtgccgttcaccgcctctcgagtgatgagggtcttggccttcttgtcgaaaatcttggcgcccttgaggtggtactcgatgttggagatcttccgggagaggacggcttcttcaatcttgaggtacgcctccttcctgatggtcggaatcatggcgttcaggcagtcctccttgccctcgtaggtcagccggtggcagaagtagttgttgccgaggttccgaagcgcgtacacgccatcctcgccgatcttgatgagctcgaacaaggtgtcggagttgttggtgctggtgtcgtcggtgtcggcccagatccagttagggcttcgccgccagaacttgccgagatggttggacttgaagcgcaccacccgtttgccgttcaccttgtggttgtaggtgatgaacctcacacttgggtcgccaatatctcccgatgcaaattgcaggtagggatggccttcaaccttccgagcactaaggtacagaccgttatctcccttgaaacacacgtacttgggcaagtccagttggtcctcatccttgactccttggtcgattgcttctacgatactgcctaaagtgtcctctacgccttctacaacctgcgacgctacgccagtgacaccactgattccatcagcgaccaagttgcccgcgcctgcgattgcagaagagatcaggtgggccatggtaaattcagtttttatgccgatgcaatatgccggcctgtgtatatgtatatcaagtgagctagttgctagctctatgctcgcccccggccgcgcgtcgagggtacccaatg

SEQ ID NO: 22092 - DNA, 1881 bp, Zea mays
ccccttctcgagtttttttttttttttttttttttttaatcagtataccacagtcatagttccatctctttttttcttttgctcctcttttttttattcacaaaaacatcacaattataatatcattcacaactatatcatttacagatagctagctagattattcacaaaagctccagagatgatcagccacaataagttctagtttacaatgaacaatttaaaattaaacaacaatttaatagtattgtctcagcaattcattgtactccccagtttgctggcttgagctcaaatttccatcagcatctgctgtgagcgttttagcctctgaaacatgtgtctctttgcctagatcagttttctgaagaggagcatgctcaactgtctgtctgtcgtcagagggctgctgttgctcaactgtctgtgtgttgtcacagttggcatcttcctctctgcactgttttaccacattcttctcagtcttgtggaaaatgtcacactaatattgctataaatcccccaagttcctttccgggctacgaagcaatatcttcatgttcctcattttaatccccagcctgaacattgaacttcctgttaactttggttttcctgatggcaaattatatttctcgtgaacacctaaagctctcctttttcatatataaagtagactgtctaaactgtcacatcacactaaatggcattagaaagctatatcaaaaataagttcaaacagttgaaacatacaagagaagatttggtgataataggtcactgaatctcacagataatagatgtcatgtttgatataaaaaacattagtagttgctcaaacataaaggaagacatacattcaacagattggatctctgttgattaaacatgtatcactctttcatttactcaacttcagaagatgaagacaagtttagtttctcttcacttattttagttgagaacttaaagcaaactcaatttccaacagaaaactattttgtaattcctacagatgtttgtcgagataatttccaaggtggaccaatcctattggctgtacaccagaaaactacaactactcttttcctgcaacggtgaacacatttagctgtttgatctagagaaaaataaacattagaagaaaagataaaggtgaactaaatatagaaaatgggttttcgtatttatcaggccatgtagcaaaagtggagatacaattattggtgcatagtgtttaagaaaaaatcacaaaaacaagtgcgggagtaatgcagtaagctcaaaagggcaaaagatagttgtgacgggaggttcatcacgtcgtttcctctggccccctggcgctgcatctcagccgccgaggcaacaatccacgtgggtggttgaggccgtctgcggttcccagatcccatcgcagcgcaacctccagtgaggcgaccgctgcggaggcggagaggggcgacgcaccgtcgcggaagaggcggccctggcggcggtgccgcagaggctacgcgcagtcgaggtggtgtgcgtgggtgccgacggagggtcgacagagccacattggggccggcgaagctgtgcactttgatggcaggagttgggagggaggggcagagcgaggagccgaggttggtcgggccattggcagaggaggcgagcggggcgatggcgacggtgtgggcttgtggaggtgaggaggccgacgatcaggtgtggaggcgcagagccaccgtgccaaatcaccgagagggcagatccggagggagcatgggagcaggcgagtagccaacggcgcacggtggatcctcgtcccccggagcgagttgggcgcgtgcagagagagggaagaggagagagtgggtggcggctgcggaa

SEQ ID NO: 22093 - DNA, 844 bp, Zea mays
agatcaaaagagtgatcggatctggcccattggatgcacgcttcagccaaaggtaaaccagtccagcaagtatcccaccaagatggccaagaaaggatgtcccgggattaaaacccgggtgggggatcaactccgcccaggcagcgtatttcgctggaataaccatcccgtgcagatacacgaaatcgtctgaccaggcgttcagcacaaccttcatggcaaacagaacaccagagaatccaacggcatgctgatcatagtacatggtatcgtcaccgagcaagagtaagcctctggacaggagcagcgtgataccctgcgacaggccaagcagcaccgcgaccatggaagcaaactcggcactacccattgatgtctcgagatgaatgcccttccacagcagcgacgtcatgttgtagaagaggtgactttcactcaagtggtagaagggtgacaggaaaaagcgcgtcaagtcgccatactcgatgatgagctgagggttgaaggagacgcgcgcgagcgagggcaggaccccgtcgagcgcgccggggcggaggtagacgagtgagttggcggcgagcagcgcggccgtgacgggcgggcgggaggcccccgcgcggccgtactcgatgagcacctgcagagccagcaggggcagcatcccccgcgacgcctccaggccgaagcggcgccgccgggcgctgctcatgccggaccccatctccggaacggcggaaccgaagccgcggctgaactgccggcttcctatcgccttgcggggccggggcttgcggttgcggcaagggaagccggatggcgcccggccggccccgagggacccaat

SEQ ID NO: 22094 - DNA, 539 bp, Zea mays
ggaggtgccccaggaatgttccgactcttctcctcaagctcatagtattgtctcagcaatagtatgtctcagcaattgtactccccagtttgctggcttgaactcaaatttccatcagcatctgctgtgagcgttttagcctctgaaacatgtgtctctttgcctggatcagtttcctgaagagaagcttgctcaactgtctgcctgtcgtcagagggctgctgttgctcaactgtctgtgcgttgtcacagttgtcatcttcctctctgcactcatccactgctccagcagtaatgggctcttcttctgctgcaggagcagcagcgtgttccttcttcgcatccttacttggcgttgctcgcctgctcttgcaatgcatttcattgaacgtggaaatggcgcggtcgaaggcgacgaccagcgccgagtcgtcccacagttcgtcgcccatgcccatctccgaatcgcgctgacctctatcgccctctgcgggtttctcttccttcctcgggcggtcgggcctagtgtcctcagcagc

SEQ ID NO: 22095 - DNA, 383 bp, Zea mays
gtaaaaaccacggccagtccgtaatacgactcacttaaggccttgactagagggtcgatcgcggaccgctggcggcacggcgcagggacgcgcggctagggcgggttacaacaacggcggacggccctggcagcacaggtttctgctgggtgtcagcggggggaggcaggtccagcgttacaggtgtgtgctggcccagcactccggtagccatgggcgcgatgggacgggtggtgggcaggccttgctttagtgcctcctcgtacgagggaggctcatctatttgcgaattcgtggatccagatatcctgcagagaagcttggcgccagccggcttcaattgcacgggccccactagtgagtcgtattacgtagcttggcgt

SEQ ID NO: 22096 - DNA, 2268 bp, Zea mays
  misc_feature (2204)..(2243): n is a, c, g, or t
  misc_feature (2247)..(2252): n is a, c, g, or t
  misc_feature (2255)..(2256): n is a, c, g, or t
gattcagcaacaacacctgaaagtccgtacagaggccttattgacactgctgcaccctttgagtctgttagagaagctgtcaccaagtttggaggaattgtcgattggaaagctcacaaagctcagatgatggagaggcgcaagctcatacaagttgaattagaaaacattcgaacagaaattccactttgcaaggaggaactagaagccgctgagatgactaaatctcaagttgtcgatgagctagagcacactaagagacttattgaggagctgaagcatcaactggagaaagtacaggttgaagaagctcaggcaaagcaggactctgagcttgcacaactcagggcacaagaaattgagcacggagtagctgatgaagctagtgcgatagccaggacacaaatggaagtcgccaaagaaaggcacgaaaaggctgttgctgaacttaagtcagtaaaagaggagttggcgtcagtacatgaacagtatgctgccttggtagatgaaagagacacagcaatcaaaagagcagaagaggtcatatctgctgagaaggacattgagaagcgagtggaacaactgacattagaactgattgcgtctaaagggtctcttgaatcccccccccccccccctcatgaagcagaggaacgtaggatcggtgcagcattggcgaaagagcaggattgcaatgcttgggagagagagttgcgtcaggcacaagaggagctggaacgattagacagtaagcttgcgttcagtaacgatatgcagcacaatattgatgcaaatttgcacaagttgcttagcctcaattcggagctgtctgcctatgtggcgaacaaactgactgaagaagctgaaggtgttcccaaggatcatgagtccgaagattctagacacattagcaaggcagttaaggaagctctagcatcgaaacagaaagaacttcaggagctcaaagccgacattgagaaggcaaaggctgaggccagcgtgctaagatttgctgccatgacactcagatcagaactggacaacgagaacgcttcacttgtcgcgttgcagcagggagaggctatggcatccgttgctgtttcttcactagaagctgagctcaaccggacgaaacaagagatagaatctgtcaggtccaaggaggcagaggcccaagaaaagatggtggagcttcccatggttttacagcaagcgactcaggaggccgaggacgccagggtagcagctcacgcggcccacgaggagctgaggaaggcgaaggaggcattcgagcaaaccaaggctgccgcagctgcagcagagaccaggttatctgctgttgtgaaagaaacagaagcatccgtagcatcagagaggctagcacgcgaggcgcttcaagctttgcaagaaagcgaacaggcaagagaaactaaggattctcagcgaggagtggtgcttcctataagcgagtactacgaacttagcaagaggacacatgaagccgaagaacaggcgagcgagaaagcagaagcactggcacaggtagtgtcggcaaaggaatcagaagcaatgagcctggagagcctaaaggaagcgtccgatgaaatggacgagaagaaggaagctcttgagatcgccctggagagagccgggaaggcgaacgaagggaagcttggcgcggagcaggagctgaggaaatggagagccgaccacgagcagcgccgcagagctcacgaatccgcgaaacgcgcggtgaatcctttgaacggtccgtctagagtatttgtcgaacagaagggtccataccacaaggagcaggaatccaaggtacaggtgtcggggagtagtagctacgagggcctcgttccaaaccaaaagatgcagaggaagaaatcgctgttccctctgatgggctcggttctatccaggaagacccgggcacagacgtgaggtaaacgagatcctataggcacctggggctttgccattcacattgctgtacattggtgtaataagctgttttcttttctcggtcttctttggaaagagcctttttgttttgttttaaaggttggtatatcctgtggaaggtgtaatttaatttgtcggtataaacagcgtagaacacattggaatacttttatatgatttttttggctaaaaaaaaaaaaaaactcgcgggggggcccccggtacccaatcgnnnnnnnnnnnnnnnnnnnnnnnnnnnnnnnnnnnnnnnnggannnnnnaannaaaaaacctcgg

SEQ ID NO: 22097 - DNA, 1647 bp, Zea mays
  misc_feature (1628)..(1632): n is a, c, g, or t
gggccaccggtgctcgctccgcccaggaccagcgggggagcctccagatctcggcgcgccgcgcaggccagcatggcgtcgtcctccgacgagcagtccaagccgccggagtcgcccgccgccgccgccgtggtcaccgccgcagcaccgccacagacgcacgccgagtgggtcgcttcgcttcaggcctactacgctgccgcggggcacccctacgcctggccggcgcagcacctcatggcggcggctgcggcgggggcgcacttcggcacgccggtgccgttccccgtctaccacccaggcgccgccgcggcgtactacgcgcacgcgtccatggccgcgggcgtcccttacccgacgtgcgaagctgtccctgcggtggcgctgcccactgtgccggaagggaaagggaagggtaagggcggaggcgcgtcgcctgagaaaggcagctccggggcgccctccggcgaggacgcttctaggagcgatgacagcggcagcgatgagtcatcggagactagagatgatgacactgaccataaggattcatctgcgcccaagaagaggaaatctggtaacacatcggctgaaggtgagccgtctcaagctactgttgtgcgatatgctgcggttgagtcaccatatcccgcaaaaggaaggtctgcctcaaagcttccagtgtctgcacctgggcgtgcagcgcttcctagtgccaccccgaatctaaacattgggatggacatttggaatgcttctcctgccttggctgtgcctgcagtgcagggggaagtgagtcctgggttggcacttgcccgacgtgatggcgttactcaactggacgaacgtgaaataaagagggagaggcgaaaacaatctaacagggagtctgcaaggagatctagattacgcaagcagcaagagtgcgaggagttagcccggaaggtagctgacctaacgaccgagaacagcgctctcagagcagaacttgacaacctcaagaaggcttgtcaagacatggaagcagaaaattcacgtctgttgggtggggtggctgacgcccaggtaccaagtgtcacgaccacactgggaatgagcatcgagccgccgaagttgcagctgcagctgcagcagcatcatgatgaggagggccagctccacaagaaatctagtaataacagcaatgggaactgtgctggaggcagccacaaaccggaggctaacactactaggtgagatacagaggtggatgaggaagtgacaaagatgagatgagatgaggtgtttcttatctaaccacaacacccatcatcggtcagtgtgtgtgttttttcttagcgaagctgtcgttttagtcctcgcagcccgctggggccatgtagagtcgcccccactgcagccatgtattatttatggctcgtcgcggtgtgctttgtgtttttttgtgtgttgtgtaaaaactattgatgtaacaaaacctagagagcctagagtttttttttatgtctgctaactcctgacgagggatgtaatgtaaccggccaatttgttgcctgatcgttcgttagatgaaatgctagcaaatgtcactcgattagcctgcggtaaaaaaaaaaaaaaaaaaaaaaaannnnngatctttgcgggagt

SEQ ID NO: 22098 - DNA, 2103 bp, Zea mays
gggtaccgggccccccctcctgtttttttttttttttttttttgagcaccaaatcatggatggaatgatgtttactacaaattcttacctctgatgtgagctaattatgggcaatgctgtcaatctgaaactatggctaaaaataaactaatgatattgcaggcatgatatcatgccacttttctagcatcgagacaggtcaatatccaagagtatgtgaatccatcattaccgaatactagccaaaatgtaaagcattgctcttatcagtgcgccaaaacaacatatccatcaacaaacaaacgtaaagcattgctcttagcagcaactaagcatttgaacgtcaactccacgatcggccacccccataccccctatatctatcacggtaacctgaagatggaggaggtgcaccacgacccatagcagctaattcagagctgaccttttgtccagcttcttccagaatattaataagttccttggcaaatctggcattagctgcagtgaaaaaggtgtacgctgttccttttgcacctgctctgccagttcgacctatacgatgaacataatcctcgagtgaccccggaaagtcatagttaatgacatacttcacatccttgacatctaagcctcgagcagcaacatcagtggccgtcataataggacttttccctgacttaaattcagaaaggacccaatcccgttctgcttggctcttgtcaccatggatagacaaagcaggccaaccatccattcgaagctgtctagtagtctgatcgcatcccttcttggtgtccataaatattaaaattcggctaccatccattatatcctccagtagattaaccagcttgttatacttctgactctcagataatatctctacatgctgaacaatggcatgattagccttcaagtcttcagaaccaatagtgaccttgtatgggtcaaaaaggaaattccttgctagctgctcaacttccttcggccaggtagcactccagtaaagtgtttggcgatctggacgaatctgagaaacaattttcttaatctgaggttcaaatcccatgtctagcatccggtctgcttcatctaaaacaagatatgtgacccttcgcaagtttgtatgatgtgattcaatcatatcaattagtcgtcctggtgtagctataacaatttcaacacctttttgaagatcacgaacttgtggaccttttggcacaccaccatatatgcaagtactttttatctttgatgatgcaccaaacttggttgcttcttgctgtatctgaacagcaagttcacgtgtaggagctaacaccaagacaattggaccatcgccaggggaaagaataggctgcgcattcacatgaacaatggcaggtaaaaggtaagcaagagttttccctgatcctgtctctgcaatgccaataaggtcgcggcctctcaatgccatcggccaaccttgcgattggataggggtaggttccacaaaaccagcttttgtgatctcttgcaacacatattctgggaagcccacatcacggaactcaagcaccggcttgggcacgtcgcggccgtcgacggtgatctcccggcggcggcggtacgcctccacctcttcctccgtcatgccggccaccgcgggtgactccacgtagaagttcttctcgaagcgcggcagcccatccagctccgaggccgccgcggaagcgtccgccttgctcggcgccgagaacgccctcgacccgcctccgaacgccccctcgctgcggcggtcgcggtaggagcccgcgtccgcagcgcggccgtcgtagcggctcatggcggcggtcgccggcggcgaggaggatggctagggtttaggcgcgcgagagtactggactatggaggagccgcgaccggtagggtttggttcggtaattgggcggttggcgcggtggccttcggttccgaagattccaggagcaagcaaagcaacactccaggagatgaaatttgtgattcgaaatgaagccagtgaaatcggtggccacgagcggaggagaggcacgtcgaaggctcgaagagtttcagttgagacgaggcccagaaaacgtt

SEQ ID NO: 22099 - DNA, 1589 bp, Zea mays
ttttttttttttttttcggatcagctctctgatttattgcgcgcaaaccttttattactgtaacatgccagacacatacggacagacagcttgcttgcttgctcgctcgcttgctttcgttgctctctacgcttcgctagagccatggccaacacagattcactacccagcgcacgacacactaggagtccactcgttttttacagcagccaaggagcagcagccaaggagcgggggggtggggccggcgcctcgaggaggacgaagcgaagcgccggcgacgcttcaaaatgtggcgagcttctttcatttgaggtgtggccgccgccataatcatcgggtcaccgagctagtagccttctcgcttggttacgattcctgagcctcggaccggtctctactacgttatcgggagctgcagtggtctcgctgaatggtggtggcctcgtgttggaatggttcttgtagaacctgatggagatcagactgctgcgcgtccccctgatcgacgattccggtgatccatggaagctcaccgccggcccgtgtcccgagaagaaaccttgccagagaatgacgacgcagaagataacggtgacgatcagggggcacagattgccacccgagaacccttgcttggcgttcttcatcttcttcaaggccttcatccgctcgaccctcgcccgcttcagcacggcaagctcgctcagctcgttgaggagcttctggtcagagacgtccagcggcgtaggcgtcagcggcctcggcggccgcggcggcttcttcttcgaccgcttcttcttcgccttgtcccctcccgagctgtccagaaggcccaggcccagcttctcctccccctcggacttcctgtcgtctccacttctagcaacggcgtccgaagccggtgaagagcagtccatgtgctggttgttcctgtcatccctcggacatccgttggcgcacgcacacacgcaaccactctccaggtcgttgctatggttgatcactgcagtgccgttgccactctccaggtcgatcaaggtgtcctggtcgttcacacacttagactccatcggaaccacgaaatagctccagtacttggtcctaactcctaacacattgataagcaaaaccgtggccctctctgatatgatactggggggtcacgaaccagatttgccctctgtcgatcaggagaggagaaatcacctctggaatactagctacctacagagctgcagcggcgaggtcaggttaccacagctagccagcgacgccctcccatggcgatgcccgccgaatcaaggaactcccggggccgcaccgcagccgcgaagaggacggaggggttgtggtggtgtggtgtggggtcaccgtacgtcccgggactgggagcggtgggacgggttgaggtggaaacggaaggaagcatccagattttcccgcctcgggggtcacgcgctatttaattccgctcctcgcgcaggatccatcgccggccccggccgtcgtcggcccggcggaacagtttttcccctttttgcttgctttgctctgccgccccgcccccggccggcccctcgagggta

SEQ ID NO: 22100 - DNA, 3093 bp, Zea mays
caatacaagaagaaagccctcttttttttttgaagccgtaaaataaatgtcatgtttatcatgagaataagcctcagctattctggtttacatggcaatgttaagtaagcaaaaatgaaatacataaggttatctttgtattgtccagtcaaggggaatcaatgtatattgcctccacactattgactggtgcgtggtaataaaacaacacgcgataacaaaaagggcaggaataaattccttgggacggatcatatcgatcttacggtggtgagtggtcatcatcctctataactccttgctcgctgaaccatatccaaaatctgagccaccccccgatgatttactccctccagaagcacctgcagcagcactgccacttcctcctacacttcctccggcgccgccaccaaatttgacgcctccgaagacaccagcacctatgttagctccaataccaccgtcggcgccaccggatcctccaccagaaacgcctgcatcggcaccggttccagtatagacgttgccacttcctcctgcatttcctcctacgccaccaccaactttggcacctccggagacaccagcacccacggtagcactggtacctgcactggcgccaccggatcctccacctgaaacacttgtacctgcatcagctccagtatatgcatttccactccctcccgcttttcctccaatgttgccgtcaactttggcgcctccggagacaccagcatcgacgccaccggatcctccaccggaaacacccgcatcggcaccggttcctgtatacgccttgccacttcctcccgcgtttcctccaacgccaccaccaactttagcgcctcccgagacaccagcacctacggtagcgccagcgccagcatcggcgccaccggaggatcctccactagaaacgccggcaccggttccggtataggcattgccactccctcccacacttcctccggcgccaccaccaactttggcgtctttggagacaccagcacccacggtagcaccggtacccgcatcggcgccagcagatcctccgctcgaaacacttgtacctgcatcagctccggtatatgccttgccacttcctcccacgtttcctccgacgccaccaccaactttagcgtctcctgagacaccagcacctacggtagcgctagtgccagcattgccactccctcccacacttcctccagcgccaccaccaactttggcgtctttggagacaacagcatcagctccggtatatgccttcccactctctcctgcctttcctccaacaccagcatcgacaccagcttcagcgttgccactcccgccagcctttcctgcaacgccaccgccaatcgtgaaactcttggagatgcctacaccagcaccggtaccagcgctagcatctgctccagcatcaccaccagctttagcaccccccgaaatatcagccttagcatcacttccacctgccttattacccttagcaacagtatagacaccggcatcagcaccagctccagctccagctccagcattgacgtcagcacccccaccaacagtatcctcctacatcagagccaacctttgcacctccagacgcaccacctcctatctttgcgcctccagatacaccacctcctatctttgcgcctccagaaacgctcgcatcgccaccagctccagcaccggcatcgattttgccaccagaagcagttgcatcagcatcggttttgccacctgcatatcctccggcgtcgccaccagcgctgacaccgccgctcttgccttttttagcttctccttcagccccagcaacggcttcgccttcggctttgtctagagcttgagcttcagcgacagcttcagcttcaactttagccagagctcggctctccatgtcagtatggactttgacatcgacaccaactactacccgaccagacacgcctacaatgcaagcaagaatatcatgttacattccatcatgtgttaaaaaagccataaacctcaaagtgataattgacgaaaaaggcggtatcaatggagcattatcattactcattgccatctcagccatcgatgacatgctgatggctatgtttcctgcgacattgcagaggtcgtgcgccacgcccttgagcatctcatgcttcatcttctgtgccatggcaacgtcgctggagatggccttgcagcgttcggcggccttcttaaggatctcctgctggaacctgagcgccgccacgatgtcggcggccgcgacgctggcgtgctgctggctgacgacgaacatctggtccgcgacctctccggccatggccctcatgaactccgccgacttgatcaacagcaccagcttcaggtggatcgcgattttcgcgctggaggcgatggtctcgatgtgtttcaccatgcgcttcgtcatctcttgcttggccctgatcaagagtgcagcctcaccagccgccttcttaaactctggatcatacgggcctgttttcttctcattcttcaccctgattaaatttaaaccccgggaaaagaaatgaaaagaaaaaaaagattagttacttcgtcatatctggatgaagcatagcaggtcaaggtatgaacaatctacatgacaataatatagggattgatgggatttttttggtgtacataccggcctccgtagtccagctccggctcggctggtggcttgcccatcctgaaatgggacatcgccggcgtcgtcctccatgctgcgatgagcaacattaggagaactatggcactgttagaaaacttcgcccttgctgatctttctaactcccctctccgctctactgactcaaggacgtgatcgctgttgaatacgatccatcccgcgcttgcatttatataggagggactgccctcttgtgtttggttccctgcgagcaagatgggccgatggagtggtttggggacgagaacattgcccggagcaaaacgagagtggtcttgcgcgcactgcggagaagccatgccatgccatgcatcagttcatctcccttctttatgaatggacgataaaaactgaagctgcaggcatgcaag

SEQ ID NO: 22101 - DNA, 2598 bp, Zea mays
atcccgttcgccgacatcccccgcctccgtctcccccgcgtcggcgtactcagcagtcacatatatagaactgcgccccctcgcgggcccgcacaccgagagttcttcttcttcctcttcgtctccttctagtagtggacagagagagatcgagtgctagggaagaagcaaagcaagccagccaggcagcagcaaccgcgcctggtttcctcctcctcctcctcgtgggctcacacaaggcttccttcggttcgggggtgtgcgaagcggcgcaacggcggaggcggcgctagcatcaccggccgacggtcctcctccttctcacgaaaggcactagaggagcggcggcggcggcggcgcatcaagcaccgcaccgatgggcccactggagccgcgctaccgtccaggcggcgcccccgaggacacgactaagagaagggcctccaagagcaagagtttcaaagacgccgagaacttcgaagtcctcgtccttgagaagagctgcggttgcaagttcaagtctttgaggatcttgctcatagccatcatctccgcgacagtccttacccttgtaaccccgaccttatacgagcgccagttgcagtcagcctcccggtacgtggatgtcgggtggatgtgggacagagcgagttccgatccgcggtacgcatcttctgccgatgttgggtgggaggatgtgtacaaagcactgggaaacctaagaagcggtaaccgccagagtcatctcagagttgggctcttgaatttcaacagcaccgagtatggctcctggacgcagttgctcccagctgacagccacgttatctccactgtaaggctcgagcacgccaaggacagcgtcacctggcagacgctgtaccctgagtggatcgacgtggggtacctcgaggccggcccctcttgcccgtcgctgccggagccaaacgtgccaagaggtgcgcgctttgacgtcgtcgccgtgaagctcccatgcacccgtgtggcgggctggtcgagagacgtcgcgcggctccatctgcagctctcggcagccaaactggctgtggcgtcctcgaagcgcaaccacgacgtccatgttctcttcgtcactgactgcttcccgatcccgaacctcttcccttgcaagaaccttgtcacacgtgaaggcagcgcctggttgtacagtcctgactccaaagcgttgagggaaaagctcaggcttccagtcgggtcctgtgagcttgccgttccactcaaagccaaatcgaggcttttctcggtagatcgacgaagagaagcgtacgcgacgatactgcattcagcgagcgaatacgtctgcggcgcaatctcggcagcgcaaagcatccgccaggcaggatccaccagggacctggtcatccttgtggacgagaccataagcgaccaccaccggagaggcttggaggcggcggggtggaaggtcagagtgatccagaggatcaggaaccccaaggcggagcgcgacgcgtacaacgagtggaactacagcaagttcaggctgtggcagctgaccgactacgacaaggtcatcttcatagacgccgacctcctcatcctgaggaacgtcgacttcctgttcgccatgccggagatcgccgcgacgggcaacaacgccacgctcttcaactccggcgtcatggtcgtcgagccctccaactgcacgttccgcctgctcatggaccacatcgacgagatcacctcgtacaacggcggggaccaggggtacctcaacgagatattcacgtggtggcaccgcgtccccaggcacatgaacttcctcaagcacttctgggagggcgacagcgaggccatgaaggcgaagaagacccagctgttcggtgcggacccgccggtcctctacgtcctccactaccttggcctcaagccggcgccgtcatgcccggcctacgactgcaactggaacaacgccgggatgcgcgagttcgccagcgacgtcgcgcatgcccggtggtggaaggtgcacgacaggatgccccggaagctccagtcctactgcctgctgaggtcgcggcagaaggccaggctggagtgggaccggaggcaggccgagaaggccaactctcaagatggccactggcgcctcaacgtcacggacaccaggctcaagacgtgctttgagaagttctgcttctgggagagcatgctctggcattggggcgagaacagtaacaggaccaagagcgtccccatggcagccacgacggcaaggtcgtgatctgtagatatacgaacaccccatccccatatggcaaccatacatgcatagcaatagcttgtataggtagctatgctttagttcttcgctatatatacagaatacaccactcgatccctgttgttgtcaaggctgcagctctatgtcgctgccggcctgccaccatggctaacgattcttttgggttggctgctgtaataagtttcaggtacatgtaaatttccctgctgaaattacgtgaccgcgtgtgagaaatgaatttgtacagggcgccaaataataattggttggtgcattacaacatatgaccagtcttttgcagt

SEQ ID NO: 22102 - DNA, 1380 bp, Zea mays
gtctccccgcgtcggcgtactcttgtagtatcggcagtcacatatatagagcttcggcccccccggagcccggacaccgagttcttcttcttcctcttcgtctccttctagtagtggacggccaggcaggcagcagcaaccgcgcctggtttcctcctcctcctcctcctcctgggctcacacaaggcttccttcggttcgggggtgtgcgaagcggcgcaacggcggaggcggcgctagcatcaccggccgacggtcctcgtccttctcacgaaaggtactagaggagcgtgagcggcggcggcggcggcggcgcatcaagcaccgcaccgatgggcccactggagccgcgctaccgtccaggcggcgcccccgaggacacgactaagagaagggcctccaagagcaagagtttcaaagacgccgagaacttcgaagtcctcgtccttgagaagagctgcggttgcaagttcaagtctttgaggatcttgctcatagccatcatctccgcgacagtccttaccctggtaaccccgaccttatacgagcgccagttgcagtcagcctcccggtacgtggatgtcgggtggatgtgggacagagcgagttccgatccgcggtacgcatcttctgccgatgttgggtgggaggatgtgtacaaagcactgggaaacctaaggagcggtaaccgccagagtcatctcagagttgggctcttgaatttcaacagcaccgagtatggctcctggacgcagttgctcccagctgacagccacgttatctccactgtaaggctcgagcacgccaaggacagcgtcacctggcagacgctgtaccctgagtggatcgacgaggaggaagagacggagataccctcttgcccgtcgctgccggagcctaacgtgccaagaggtgcgcgctttgacgtcgtcgccgtgaagcttccctgcacccgtgtggcgggctggtcgagagacgtcgcgcggctccatctgcagctctcggcagccaaactggctgtggcgtcctcgaagcgcaaccacgacgacgtccatgttctcttcgtcactgactgcttcccgatcccgaacctcttcccttgcaagaaccttgtcacacgtgaaggcagcgcctggttgtacagtcctgactccaaggcgttgagggaaaagctcaggcttccagtcgggtcctgtgagcttgccgttccactcaaagccaaatcgaggctttcctcggtagatcgacgaagagaagcgtacgcgacgatactgcattcagcgagcgaatacgtctgcggcgcaatctcggcagcgcaaagcatccgccaggcaggatccaccagggacctggtcatccttgtggacgagaccataagcg

SEQ ID NO: 22103 - DNA, 1003 bp, Zea mays
ccgcgccgccgcccccctgcccacgtggcgggttgcccttaactgctgccaaaacaactatgcgcgtccagcgtctgctgaggctgaggatggcgtcccgctcgtgctcccgctgcgctgccttggcgccgcacgctgcgctcccgctctcctctctcctcgccccctcgccctctgccgcgcgccctcgatccgcgcccctctcgtgcgcagctcggccgtgcaggggccacgcggcggcgtcagcgttgcacggcgcggcagggcggaggcccccgagcgtggcggcgatgtcgtcgtcgacgccgccgccgggatccgtgcagaagtcggaagaggagtgggaggccatcctcacgccggagcagttcaacatcctacgcctcaagggcaccgagtaccctggaacgggtgagtacgacaagttctttgaggagggcatttataaatgtgctggatgtggaactcccttatacaaatcatcgacaaagttcaactcagggtgtggctggccggcattctatgaaggacttcctggggccataaggcagacgccggaccctgatgggaggcggacagagatcacatgtactgcttgtggaggacacttggggcacatattcaaaggggaggggtttaagacgcctaccaacgagcgacactgtgttaacagcatctcgcttaagttcaatccgtcccccgaggaagcctgacggcagatgaactcccaatctgtaactcaacaacagaataaatttggactttgtttgttgctttcacattgtgtagagagctatgagatcgagtttgtcattcctcggatcatttcgaatatgatgtaaaaaatccaatcacaagtgctggtctttgttgataaatcaatgtacctcagttttagatgaataggccatgtatatgctcatgctcatacaactagcctactagctgcaccctggcttcgttgccccaggtaaaaaaaaaaaaaaaaaaggcccctagggcc

SEQ ID NO: 22104 - DNA, 900 bp, Zea mays
ggcttgctaaatctatataacatattttggtccaactttcagcaatttttgcttatcaaaacctttgacatggcaaattttgatagcaagttatacactccaatgcattaaatgcgctgcggccttctaataaacgcagcaaaaaactgcatttacatcaaatgtgattcgtgccttgggcaacgtcagtttcaacagctgctacaaaattggatgcatgcatgcataagcaaaaccagattctcagctagattttcaggcttcaacagaaacacccttgccaagtccactcgaggcaagcttcatcaccttctcctttccctttttacttgatttgccagattttctcttcttgcttgacttctctggcacaggtgaagcaggccgaggctctgcaagttcaccgttctccacagacgaaccattcatttcgtctttgattgaccccgcatccacatctgggtctaccacggacattcgcgtcagcgtatagtccaacagaaacgtgcttcggactagtctgtccactctgctgaaatgcctctgcgaatacggaataaggccctcgaggagctcactgatgccctttatctccaggatatcagtgggagagaaactcctcaatacccgaaaaagcacaaactgcgcaacatgacagaacttgggcttcgtattccattcacgggcgtactctagaagcacacgaaggccatcctttggaagaccaagaagagccttttctattggatcctctgcgtcagctcgcctggcaagctgtgagaataaatctagaagcctgtgtggtcttctaagctcaaatgcaagttgtattgcctttgcgtagtcagaatctgacacagcattttccaattcctggcctcttaaaacttctccccgcgt

SEQ ID NO: 22105 - DNA, 4068 bp, Zea mays
  misc_feature (816)..(816): n is a, c, g, or t
  misc_feature (843)..(843): n is a, c, g, or t
  misc_feature (974)..(974): n is a, c, g, or t
  misc_feature (1080)..(1080): n is a, c, g, or t
  misc_feature (1116)..(1116): n is a, c, g, or t
  misc_feature (3957)..(3957): n is a, c, g, or t
attgtagtctattgtaaaggacataaatgtaattttacacaggctgcaccctgtacttataaataggtgaacagtaccccggcactgttcatgcaaccctgtaaccgctaacgcattacactggaattattttccgctagaggcgaaggtataaacgtacctgaaaaatcccttagccacttatcttcccagaatctaacgtttgtccctctattggtcacaaaccgcccatgtgagagaaaaagctcttttattttcataagacccgaccaaaaatgagagtctccaggtttcacctgcacctctccaatagtcttgttacgaaagtattttctctttaagatctgttgccacattccctcttcgttggctagcttgaacaaccacttaactaacaaacacttattctgggaatcaatattcttagtcccgatcccacctacctcttttggttggcagaggacgctccactttgccaacctatactttttcttttcatcctctgattgccagtaaaaacgagatctaagaaagtcaatcttttccagaaccttacggggtatttcaaagaaagataacatgtataccgggagactagaaagaaccgagttaataaggactaagcgtcctcccaccgagagatgctttcctttccagctattcagtttcttttctattctctctataacactattccactctgcattcctaagttttctgaagtgcataggaatccccaaatatctgaaggggtacgcccccgctttacaaccgaaaaggtctgaataggcctgctcatgttctttggcatccccnaaacagaagatctcgctcttatgaaantttatcttgagaccggacagttgctcaaacgcacataaaatgagtttgagatttcgagctttgtcaagatcatgatccataaagagtattgtatcgtctgcgtattggaggatggaaagaccatcgtccancaggtgagggataactccctcaatatgcccctctctcttggcacggttgataagagtaaccagcatgtcaacaatgacattaaacaggactggagataacgggtcnccttgtcttagacctttctttgtttgaaagttattngtgagctggtcattaatctttatgttcacgtgacctctttgggtgaaggcctcaatccaatcacaccacttgttcgagaaacctttcatcagcaaagtttgtctaacaaaagaccaccgtactttgtcgtaagctttctcaaaatcaatcttaaacactactccattttgcttcttacgatgtaattcgtgtaaggtctcatgaagaatcacaacacctatattagatagagatcatatttcgtgacctttctcggtcgaggtttcaattaaacttcttaatataataaggacgatctttcctcaccaccgaatgctcaaccaacaaaagctttgctggattgcaactgaggaagacaaactgtttgtaccgtaccaagcagccaatcgcagcatcgcgatttcgaacgcgcgcccacactgatcataccgcatgcagtggcagaagaatccgatgtgaaacaatagtagtaagaaaatactgaactactatcacagataactaaacgaaatgatatgttaatgaaacgagaagcgcggatggtccccctcaaaaagccgcagcattcggtacatccataaacaaaaaaaaaaggaagcttgtgccaaccgccaaacggcagggaatggaattatggagtgcatcgccgacatccagatcgcagatccaacagttaaggtggggttgattgctgggcgtggtactgcttccgaatcacacgctcaacacaaggcacacatgggacacaatcacaaagggaaaaccaacccgaacagcaagcaatcaaagactgtaaggccgtgtccggcaggtcacccaaaacaatgttttgcactgtaaattacattattggtcgagtgaagttcgaatatagggtttagcaatgtataagctgcttgagcctaaatataacttctgaaatctggtacgaaagttccctgcaataagctcccaagaaagtttcaaacagatagccgaagaatttcaaacagatagcctaaggcactgtgaccttgtatcaaataatgcatttacatctgtggttgtggccgcatctacatcagaaaatctattgccgacattctcactttgactgtgcccatgggtcgcatttgatcgtgatttacactgaaattagatttttcaaaatccaaatgcgaacaccaagttaacgaccaaatcattgttagtaaacgatcaaaatgaggttagtcaacgaccgaaacgtggttcgttaacgatcaaaatgtaattgccaaaaacttaggcaggcggcaggccgatgcttttgccagcccgtgggtttgtgtcctgttcttaccaatacctcatacttggcttaccaaatctatgtaaaaattattccatccaacttttggcaacttttgcttaccagaacatttggcatggcagattttgatagcacttcgccctcctaataaatcagcaaaaatgcatttacatcatatgggattcgtgtgttgggcaacgtcagttgcaacagcagctacaaaattggcggcatgcataaaaaaacagattctcagctatatatttagggttcaacagaaacatccttgctgagtagtccgcttgaggcaaccttcaccttcttctccttgccctttttacctgatttgccagattttctcttcttgcttgacttctgtggtacaggtgaagcaggccgaggctctgcaagttcaccgttctccacagacgaaccgttcatttcatctttgattgttcccgcatctacatctggatctaccacggacattcgcatcagcgtatagtccaacagaaacgtgcttcggactagtctatcgactcggctgaaatgcctctgcgaatacggaataaggccctcaaggagctcactgatgcccttgatctccaggatatcagtgggagagaaactcctcaataaccgaaaaagcacaaactgtgtcagaccatgaacacactcttaataaaagttgaaacgctctaaagaaggaagttaaaatgccttaggacaggaaaaagttattacctccaggatatcagtgggagagaaactcctcaataaccgaaaaagcacaaactgtgcaacatgacagaacttgggcttcgtattccattcacggacgtattcaagaagcacgcgaaggccatccgttggaagaccaagaagagccttttctattggatcctctgcatcagctctcctgcaaacccaatgatgcataacatcatgttaataattcaaagcggctgacttcattcgaatcaagaaatagtaccttgcaagctttgagaataaatctagaagtctgtgtggtcttctaagctcaaatgcaagttgtattgcctttgcgtagtcagaatctgacacagcattttccaattcctggcctcttaaaacttcttcctcctgcaacaatgatgagttttagagtgctgtggatgcctgacatagtgacatagacctgtatgaattcctaaacccatcaagcagaggcaaacacgaatatatcaaaaatatggcaaactgagagaggtatcatatcccaacgacatacgagctcactatattgatacaagatctaatgtcagaaatttcatagtttttcttccaaaagcaagcatcttgcttgcaattatatatgctcaaagtgtaacagtaacaggtttcacttgccttcttacgaaaatcttcctgcttatcttccatggtggaatcatgccacaggttgaggacagcatcggttccaccagtagcaaccatttcagttttcatgccaacagccaatgcccagacctacggaacaaataatagtgagattgagtcccctccancaccaccaacaacaacaaagtctcttagtcccaagcaagttggggtatgaaacacagttacagttgaaatgctaaaaagccagaaatcaaggttcaggcacgtagatagtg

SEQ ID NO: 22106 - DNA, 1602 bp, Zea mays
  misc_feature (7)..(11): n is a, c, g, or t
  misc_feature (15)..(56): n is a, c, g, or t
  misc_feature (81)..(85): n is a, c, g, or t
ccggatnnnnngggnnnnnnnnnnnnnnnnnnnnnnnnnnnnnnnnnnnnnnnnnnatacttggcttaccaaatctatgtnnnnnttattccatccaacttttggcaacttttgcttaccagaacatttggcatggcagatttggatagcacttcgccctcctaataaatcagcaaaaatgcatttacatcatatgggattcgtgtgttgggcaacgtccgttgcaacagcagctacaaaattggcggcatgcataaaaaaacagattctcagctagatatttagggttcaacagaaacatccttgctgagtagtccgctcgaggcaaccttcaccttcttctccttgccctttttacctgatttgccagattttctcttcttgcttgacttctgtggtacaggtgaagcaggccgaggctctgcaagttcaccgttctccgcagacgaaccgttcatttcatctttgattgttcccgcatctacatctggatctaccacggacattcgcatcagcgtatagtccaacagaaacgtgcttcggactagtctatcgactcggctgaaatgcctctgcgaatacggaataaggccctcaaggagctcactgatgcccttgatctccaggatatcagtgggagagaaactcctcaataaccgaaaaagcacaaactgtgcaacatgacagaacttgggcttcgtattccattcacggacgtattcaagaagcacgcgaaggccatccgttggaagaccaagaagagccttttctattggatcctctgcatcagctcttcttgcaagctttgagaataaatctagaagtctgtgtggtcttctaagctcaaatgcaagttgtattgcctttgcgtagtcagaatctgacacagcatttccccccgcccggcctcttaaaacttcttgctccttcttacggaaatcttcctgcttatcttccatggtgcaatcatgccacaggttgaggacagcatcggttccaccagtagcaaccatttcagttttcatgccaaacagccaatgcccagaccttcccatcatgcttatcataagtagcaatacattcatttgtccttgattgtccatagcttcactagaccatcaccttccgcaagaaataacttgagttccacgtgaaaggaaagaagctcgcagaacacttgatgtatgaccttcaaatgtcttcaagcatgagccatcagcaacggaccatattttgattgttctatcaccagaggacgtcattacacattgttcaacagaagaaaactcaactgaccagattcctcttttgtgtcccttaaggacaacagataacactaggttagggagcttccatatgcaagcagttcggtcctcagaaccactgcaaacaaggccatcattaggtgaaattgccagagaattaatatctttatcatgtgcagctacaacagcctttgctttaagagggacttcatcctcagcatcaccaagtgcatcgtcccaggtccataccttgatggttcgatcactgctgccacccacaaaaaagttatttgttttctttgagaaggcaacagaaccaacagctcccagatggcct

SEQ ID NO: 22107 - DNA, 2687 bp, Zea mays
acgtacgcggggggtcgagagacggccgtctgctcagccgtcgttggcgacggctcgtttcagggtcccccacctactaatcacgaccctggcctctctcgattctgttgccttgccattgccatcatccaccctcatgcatgtcggtgcaacgcccatgggcatccactggtgcttatagtgcggccctcccgggccgggccggggaggacatcctcggccttccagggcagcaaccacgaaagccttctgcgcggggtgctttcctcgcagcaaatattcctgccttttgcattccggcttgcaagttccttgctttgggcagatatattgtgaggtctctatatataggtggttcgaggtgatcggcagaaccacacaggcaaagatggcgagcgtgcacaaggccaccacccttgttctcatgttctgcctgctagcgctggggagagcggagtacctcaagtacaaggacccgaagcagcccgtcgctgttcgcatcaaggacctgctgggtcggatgactctcgccgaaaagatcggccagatgacgcagatcgagagggaaaacgccacggccgacgcgctggccaaatacttcataggtagcgtgctgagcggcggaggcagcgtgcctgctcctcaggcgtctgctcaggcttgggccgccatggtgaccgagatgcagaagggcgctctttctacgcgtctgggtataccgatcatctacggtatcgatgcagtgcatgggcacaacaacgtctacaaagctactattttccctcacaacgtcgggcttggagctaccagggaccctgacctcgttaagagaattggagaagcaactgctcttgaagttagagctactggaattccttacgcctttgctccctgtatagcggtctgtagagatccaagatggggacgttgctatgagagctacagtgaggatccaaaggttgtccagtcactgacttcactcatctctggcctgcaaggtgacgctcctgcggattccgcgggaaggccgtatgttgggggaagtaagaaggttgctgcatgcgcgaagcactatgtcggtgatggtggaacgcataacggaatcaacgagaacaacacgatcatcgacacacacgggctgctgagcatccatatgcctccttactacaactctatcatccgaggtgtctccacggtcatggtctcctactccagctggaacggagtgaagatgcacgcgaaccatttcctggtcacggattttctcaagaacaagctcaagtttaggggttttgtgatttccgactgggagggcattgatcggatcactactcctcctcacgccaactactcttactcaattgaggctggtgttggtgctggaattgacatgatcatggttccattcagatacacagaattcatcgacgatctgacgacacaagttcagaacaaggtcatccccatgagcagaatcgacgacgccgtctacaggatccttcgtgtcaagttcaccatgggtctgttcgagaacccttaccccgactctagcctcgccggcgagctcgggaagcaagaacaccgggaactggcgcgcgaagccgtcaggaaatccctggttctcctgaagaacggcaagtcctcctacgctccgttgctgcccctcccgaagaaggccggcaagatcctggtcgccggcagccacgccaacgacctgggcaaccagtgcggggggtggacgatcacgtggcaaggaagcagcggcaacaccactgccggcacgacgatcctctccgggatcgaggccaccgtggaccccagcacgcaggtggtgtactcggagagcccggacagcggcgtgctggccgacaagtacgactacgcgatcgtggtggtcggggagccgccatacgcggagacgttcggcgacaacctgaacctgacgatcccggcgcccgggccgagcgtgatccagtcggtgtgcggggccgccaagtgcgtggtggtcctcatctccggcaggccgctggtggtggagccgtacctgggcgacatggacgcgctggtggcggcgtggctgccggggtcggaggggcagggcgtggcggacgtgctgttcggcgactacgggttcacggggaagctgccgcggacgtggttcaagtcggtggaccagctgcccatgaacgtgggcgacgcgcactacgacccgctcttcccgttcggcttcggactcaccaccaagggcacgaagtgagtgagtgtgaggcgctctgatgggatgtggcctgtgagtgagctgtgtattcgtgggcgggcgtgaggctctttggctttcgaattggttgggggtgacgggcggcgagtcgtgtacgccgcacacattgcgcagcgtacgttgggttgggatgtttgcgtctgggtaataacagtgatgcattcttgagatggttgctgttagtgtgggttgtttggaatgaacaataagatcaggcgcgttacattggcacgctactacctctcctgctgagaccagagatggcgatgtgcatttacccatcggcccgtgctattccataccctatttagccgtgtactgataaaagaatttgtcaaaccgtgtacgggtaaaatcatgtatccatgtactgctcactataccgtatacgccagctacttctactacc

SEQ ID NO: 22108 - DNA, 2414 bp, Zea mays
gggtacctcgaggccggccgggataaagtccgggccccgcgcccccggcgggagccttccctgcccccggtgagctgccactgccagcttccccgtgcgcgagctgtgctgctgctcggcggcgcgcccactccccggccgctctctcgtcactccgcctgccggtaatcggtctctatatataggtggttcgaggtgatcggcagaaccacacaggcaaagatggcgagcgtgcacaaggccaccacccttgttctcatgttctgcctgctagcgctggggagagcggagtacctcaagtacaaggacccgaagcagcccgtcgctgttcgcatcaaggacctgctgggtcggatgactctcgccgaaaagatcggccagatgacgcagatcgagagggaaaacgccacggccgacgcgctggccaaatacttcataggtagcgtgctgagcggcggaggcagcgtgcctgctcctcaggcgtctgctcaggcttgggccgccatggtgaccgagatgcagaagggcgctctttctacgcgtctgggtataccgatcatctacggtatcgatgcagtgcatgggcacaacaacgtctacaaagctactatcttccctcacaacgtcgggcttggagctaccagggaccctgacctcgttaagagaattggagaagcaactgctcttgaagttagagctactggaattccttacgcctttgctccctgtatagcggtttgtagagatccaagatggggacgctgctatgagagctacagtgaggatccaaaggttgtccagtcactgacttcactcatctctggcctgcaaggtgacgctcctgcggattccgcgggaaggccgtatgttgggggaagtaagaaggtcgctgcgtgcgcgaagcactatgtcggtgatggtggaacgcataacggaatcaacgagaacaacacgatcatcgacacacacgggctgctgagcatccatatgcctccttactacaactctatcatccgaggtgtctccacggtcatggtctcctactccagctggaacggagtgaagatgcacgcgaaccatttcctagtcacggattttctcaagaacaagctcaagtttaggggttttgtgatttccgactgggagggcattgatcggatcactactcctcctcacgccaactactcttactcaattgaggctggtgttggtgctggaattgacatgatcatggttccattcaggtacacagaattcatcgacgacctgacgacacaagttcagaacaaggtcatccccatgagcagaatcgacgacgccgtctacaggatccttcgtgtcaagttcaccatgggcctgttcgagaacccttaccccgactctagcctcgccggcgagctcgggaagcaagaacaccgggaactggcgcgcgaagccgtcaggaaatccctggttctcctgaagaacggcaagtcctcctacgctccgttgctgcctctcccgaagaaggccggcaagatcctggtcgccggcagccacgccaacgacctgggcaaccagtgcggggggtggacgatcacgtggcaaggaagcagcggcaacaccactgccggcacgacgatcctctccgggatcgaggccaccgtggaccccagcacgcaggtggtgtactcggagagcccggacagcggcgtgctggccgacaagtacgactacgcgatcgtggtggtcggtgagccgccatacgcggagacgttcggcgacaacctgaacctgacgatcccggcgcccgggccgagcgtgatccagtcggtgtgcggagccgccaagtgcgtggtggtcctcatctccggcaggccgctggtggtggagccgtacctgggcgacatggacgcgctggtggcggcgtggctgccagggtcggaggggcagggcgtggcggacgtgctgttcggcgactacgggttcacggggaagctgccgcggacgtggttcaagtcggtggaccagctgcccatgaacgtgggcgacgcgcactacgacccgctcttcccgttcggcttcgggctcaccaccaagggcacgaagtgagtgagtttgaggcgctctgatgggatgtggatgtggcctgtgagtgagctgtgtattcgtgggcgggcgtgaggctttggctttcgaattggttgggggtgacgggcgagtcgtgtacgccgcacacattgcgcagcgtacgttgggttgggatgtttgcgtctgggtaataacagtgatgcattcttgagatggttgctgttagtgtgggttgtttggaatgaacaataagatgaggcgcgttacattggcacgctaaaaaaaaaaaaaaaaaaaccaaaaaaaaaaaaaaaaagggcggctgctcgcgatctagaactagt

SEQ ID NO: 22109 - DNA, 1678 bp, Zea mays
ctcgaggccggccgggccggggcgccgcgtctgacgtatctgccctttcccgcggcacgcggccgaaggcgtcgttcccccttccccaccgcctcttcgcccgccggacgcaagccgccgcagctagcccgacgcggactgaggaagccaacagggcgccaaccgctgccacagcaactcgccagccgagtcctgaaaccaccgaaggacctaggcttcccacctattcatggcccgctgcctcgtcgcccgccgcttcctcccgcacctccgcctctgtgcgccgcgtctcctgtctgttccaccgccgacgctgggcatgcttatccgcggtgtcggagtgtcgtttccttcggttcaggcgcctcaaggaacccgatcctttgctgacgatcgctcacactatgatctgtttggtaaaagaaggcctggggatgaagagttcagaaaagcctggcaggaggacgtagatgaagaggactgtctgtggacaggtagtgaagatgatgacggcgaagaagagagtgatacaaaaatggagagggaaattaagaaagtgaagaggcaagcgaaggaaaattcaaaccttattgatgctgatgacagtgacgagttaagaagtatatgccctgagagtgatgaagatgatatgactctctggagtggcagtgaagatgacgatgacggcgatattccctctgaggcacatcctagtgaacgcagtgactcatatcttgataaggtgtttgaatttgaggagtcaccaaagtaccacacaatctcagagctgttgaaagcagagaacgaaccacctgagctatctccgggaaagcaagcaaggaaacttgctgtagaaaatgctcttaagaagttaaagaaaggccctgatggacgctacattaacgtatttgatgttgttactgatatagatatcctgattggtgcatttgagaacattgtttcaggaccagaatacgcagaactgcgggagggtggaccaaaaaagctcaatatacagttcttcaaggatatacaggcacgcatgagggacccaaatttcaagttttctccagagttgaagctaaagccaaagagtaagttagtgtctaggaaaaaatggcagaaagccaaagctaggaagaggaaaaatgacagacgttgaggtgatcatacctcgtaatgtattcatctctctttcccacatcagaatgctttcttcagatggttcacgtattatctgtagtgtttattcacgatggatgggcttgatgtgatggcactagcacttcaagaaaagctaaaaaaaaaaaaaaaaatatcattcacatgtgatgtgtgttctatttggcgactgggagttctgaattgcctagtttatctgagtctagcaagaagcagggagtatgattctctccattcacactggagtgctgcgaagttagtgtacaactcaaagtcagacttgaagtttctctgttgacttcactcttcaacacatgcatgtcttgatattctcaactgtttacataactgaagtctggtgggaggaaatggtatgctcagaatgttgattctgcatagtttctcaatttctcttggattgctaatgttctttgtaaaactcacaagttatatgagctggaccaattacagtatcacagcaccagatttatgacta

SEQ ID NO: 22110 - DNA, 960 bp, Zea mays
cttttgcagaaaaactttgttcccaaacaccccctaaacactacagcaactgcggcatgcgttttgtttattgagcaaaagcactgctcagccctacagcaactgcggcatgcgttttgtttttctcacaaaagaaaaaggtcttacaacacccttatcaaagaacgggaagaaaataaaacacctcgaacatttatatgtaagtacagcaatattacagccacatgatagctgaggaagcatgaacagagcgaaaaatgatcggattacagatctccaactcaattcaacctactgattaggatgctgtcacgagtagggagaatctagtcaattataccaaatatttgtgggtcattatcagggcgcggaaacagtagtttcagccgaaatgcgtctacaccatttagatagtatctgtacaatctctttgctcggataaacccaaggcggccatagagagcaagggcacccttattagtaacttctgcttcaagtgtcacctcctcacagccagattccatcattgcccgaattgatctagtaactagctcagttgctattcccctccctcggtagggcttgaggacgacgagcatggcgatgtagcccctgaatgcacccctatgctcccccatcttgcacacgactgtccccacgcacttgccatccctggcatcgaacgccaggaaggtgagctgcggccagaggtagacgaagtagcggtaggtgaagatggaatagggctcgctgagctcctcgtccaccagcgacatcaccagcggcagatgctgctccccgccatagctcacgtaagtgatctccacgccctcctccgcacccccgcttccttcaccggcgttggcggcggcggaggaggaggccgacgacatcgccgccgttgtgtgaaaaactgaatacgtaaacgacgtatcgaaggcgcaaaactcgatacatctt

SEQ ID NO: 22111 - DNA, 1008 bp, Zea mays
  misc_feature (32)..(35): n is a, c, g, or t
ggccgcttttttttatttggagttagaggggnnnntttttttttttttttttttttttttttttcttttttttttttttttttttacagcaactgcggcatgcgttttgtttattgagcaaaagaactgcacggtcttattgtttgatctgaagttgattaatacatccttatcaaagaacaggaggaaataaaacacctcgaaaatttatatgttagtacaacaatatgcagttacatgctagctataaaagcatgaaacagagcaaaaaagaatgatcagggtctccaactcaattctacctactgattagggtactgtcacaagtagggagaatccatcttctggtcatccctgtcattgccaaccatcattggaggcaggccaggatcagggcgtggaaacagaagtttcagccgaaaagcgtctacaccattcaaatagtacctgtacagtctttttgctcggataaaccccaggcgaccatagagagcaagggcacccttgttagtaacttctgcttcaagtgtcacctcctcacagccagactccatcatcacccgaattgatctagtaactagctcagttgctattccccttcctcggtagggcttcaggacgacgagcatggcgatgtagcccctgaatgcaccccggtgctcccccatcttgcacacgaccgtccccacgcacttgccatccctggcatcgaacgccaggaaggtgagctgcggccagaggtacacgaagtagcggtatgtgaagatggagtagggctcgctgagctcctcgtcgaccagcgacattaccagcggcaggtgatgctcccctccgtagctcacgtacgcgatctcccgcccttccaccgcaccaccgcttccttcgctaccggcggcggcagaggaggcggcggcggccgacgacatcgccgcagtcccggtgatggatacccgtgtgaggccctgtttagagacttcacttcaaaaaaattgccggcctcgaggtacc

SEQ ID NO: 22112 - DNA, 882 bp, Zea mays
tttttttttttttttggcacaaaatcttttaaaatttatcaaaaagtatttttgggggagaccaatattcacaattaaacactacagcaactgcggcatgcgttttgtttttctcacaaaagaaaaaggtcttacaacacccttatcaaagaacgggaagaaaataaaacacctcgaacatttatatgtaagtacagcaatattacagtcacatgatagctaaggaagcatgaaacagagcgaaaaatgatcggattacaggtctccaactaaattcaacctactgattaggatgctgtcacgagtagggagaatctagtcaattataccaaatatttgtgggtcattatcagggcgcggaaacagtagtttcagccgaaatgcgtctacaccatttagatagtatctgtacaatctctttgctcggataaacccaaggcggccatagagagcaagggcacccttattagtaacttctgcttcaagtgtcacctattcccctccctcggtagggcttgaggacgacgagcatggcgatgtagcccctgaatgcacccctatgctcccccatcttgcacacgactgtccccacgcacttgccatccctggcatcgaacgccaggaaggtgagctgcggccagaggtagacgaagtagcggtaggtgaagatggaatagggctcgctgagctcctcgtccaccagcgacatcaccagcggcagatgctgctccccgccatagctcacgtaagtgatctccacgccctcctccgcacccccgcttccttcaccggcgttggcggcggcggaggaggaggccgacgacatcgccgccgttgtgtgaaaaactgaatacgtttttcgattaggatgttctaggtaat

SEQ ID NO: 22113 - DNA, 748 bp, Zea mays
gcagcagggcgaattgcacatgtataaagacgactacttttatcactcttagctggccgcccgttactcttcagtaccagctgttcagcaactgatttgctgcgcccataagcatcaacatggtcttcaatcggaaaataaggcaacgcctcatttccgtggacaatcggctttcctccgaataccacattgtatgtgcttacatacacaagccttctgacaccttgctcatggcaagcgtccagtacattgcaggtcccatttatattaacctcatcagatctcccagtctgcaccatctccttccctgacatgccataagaagcaaggtggaaaacacagtccactccacggaaagccttccgcacatcatccttctttcttatgtccccttggatgattcggacgccggcgtcgaggagctgctgggaccaggaggaggaggcgcggagatcgagggaccggacctcgcgggcaccgcggcggagcagctcgaggctgagggcagctccgacgaagccctgcccgcccgtcaccgcgaatcgcagaccctcgatcccctcgttcgcgctcagatgcatcttctcgccggggtacaggtcgccggcggccgacgataacctgggcggtcgccctggtgctactccgtgctgctgccgcctgacctcggacccgcgcgaagcgtcagcagttcagcacgatgcacgaccaaagaccaactcgatggagtctctcgaggtacccaatg

SEQ ID NO: 22114 - DNA, 5288 bp, Zea mays
  misc_feature (3326)..(3326): n is a, c, g, or t
ccaccttcgccgtatcaatatcaataatatcatacggttcatatacggcgttagatgtgcgacagccaccaaatttctgctggagcatccgttgcatttggatctaacaatggctagttacattacagctcatccaagaaagcgacctgttaaactttcaccagttcacagcatcaccacaaagtacatccgaccacaggcctctccgttgcatgtcaggagggatacgatctggggatgctcatacgcctgacgcctcctcaataaaaaccaagcatgaagcttggaagttggaaccactgttacaggatccgcagtgtacgtacacgtgaaccaaacacgaattcacgctctgcctctcttgagaaggtaccggagggagaagtaccccagagcgaaggtctgccagaaccacccggcagcgttcctcgggtcaacccttctcgccaagaaccaggcgtacacggcttcgccagcatgcagtgcgatcgctaccaccaagaccagccggatcacgagcatcgagcggaaaacaaacaggtgcacgtcgagcacccatttcaacgggccgactgccgggaggcaggcagcagaaaacacggccagcatcccgatcgttacggccagccaagtgaatatggtcgggccatccagctcccttctcttccgctcttgccagtacgagatcgttgcggctaagccttcgtggggcctcaccatgggcacgtagccgagctcctctctagctttcaagaacgaaaagtagtgtgtgacaccaaccttgtaaacttcagcggggagaattagaggctgaggcatccatttactatcaagccatgggtagaacagtgtagatatgaataaaaatattcttgaaacggcaagggcaacggaggtatccagcaccacttgaggaacggaataacccaaactttgaaaaaggggcttgatgataaattcaaaagtattgcatggtgatccatcgcatatgaaatacgcctgaccagctgctacaggagttcccttcctgtcaggaatgtcatctaaaagtcccatgcttgccaatatcagagcaagaactagattatctatataaacccaatctgtcttgacacctgggtccccaattttgaagaaagctaatcccaactttgcaagggacaggattcttggaaaatgacgctcttcacctggtccatatatagcagcagggcgaattgcacatgtataaagacgactacttttatcactcctgtaagctggccgcccggacgcctgggggacaggctgcatacaatcaaatgccacccgtggcttacaagctgaaatgaaattcttgttgttgtttaaagagcaattatggatgacaatttttttcagaagacaatatcacaatctaaaaaagtgtgcaaagggtagcatcagcctaaacaatttctttctaaccgtcggtttggaggacagcatggtccacaaaaaaaactgagcatatttgccatatttttcaatgtactggagcctagcaaaggagaagggtaaacttacttagctggccgcccgttactcttcagtaccagctgttcagcaactgatttgctgcgcccataagcatcaacatggtcttcaatcggaaaataaggcaacgcctcatttccgttgacaatcggctttcctccaaataccacattgtatgtgcttacatacacaagccttctgacaccttgctcatggcaagcgtccagtacattgcaggtcccatttatattaacctcatcagatctcgcagtctgcaccatctccttccctgacatgccataagaagcaaggtggaaaacacagtccactccacggaaagccctccgcacatcatccttctttcttatgtcccctgcaaaacagggccttaagaaactgatgtatcattccacaagctatatattggtaaccagttgcattaaacacagagaaacagaaggtaacacggtgattgcaggcaaaacaactatgcaagagccaccaactatttacctagatacatagatacacagatattaagatagtagtggtacagtgacgtcctccgtttggacacactaatttagtaatttgcatctcgtacgagaagccgaaactacaacatagaaggactacaagcactccaaaccgtcttattctaagaggaatccaattctgctgctcacagcgcagtaaatcgcatgaagtaagctatttacccacaggccacagcgacagcaaagtaaaaccgtggggattgcagcgatctgaactgaagatggtaaactggagggactgaccttggatgattcggacgccggcgtcgaggagctgctgggaccaggaggaggaggcgcggagatcgagggaccggacctcgcgggcaccgcggcggagcagctcgaggctgagggcagctccgacgaagccctgcccgcccgtcaccgcgaatcgcagaccctcgatcccctcgttcgcgctcagatgcatctcctcgccggggtacaggtcgccggcggccgacgataacctgggcggtcgccctggtgctactccgtgctgctgctgcctgacctcggacccgcgcgaagcgtcagcagttcagcacgatgcacgaccaaagaccaactcgatggagtctggactggactctctactgcaaatttgtgaagtggacgaggacgactacaaattctgaggcaaatttgcattttattcatcgttattatcagaatatgaattacctctaaaaaacataaaaacatgaaaaaaaaatcttaggcaaaatgtgaacaaaaaaggtcccaccgagatttgaactcgggttactggattcagagtccaatgtcctaaccactagaccatgggacctttgatgctgaggtcttagcaatatgatatataatgactcaaaacaacttgtgtctcgtaaatggttttagaagataaactgaactccacgaatccttcgttagcaatacttgattaacacctgccggtgagattgggaggctgggagcacgttgttccgattaactgaccatacttcggttaccgcttggccgcgcaatcgtatatcgccttccaagacagtcgtgcagatagatcacaatatatagttgttcctatcgtgctggagtgatgagtgcaacatggattttgtgaaatcaagtatgggatcttgacagcaatggtaaaaaaaaaggcattttgccatgtggatatatttaaaagaatagtttcgaacaaactcgttacaaaaatattaagcaccccagcgtgttgcatttttcacgggataggaggccatngtatagattccgcagacaccctccggcttcccggtgcccatctttatcctgacgtagccttgctccccccagttcttgccccacgagttcttcatggtgatgtagttctggccgtacgatgagccgtacccgacggccgtcagcgcatggtcgagctcgacgctgcaggccccgtcaaacaccccctgcagcagtgcagccagccagacgaggtatacacgcacatgttacttcccttctgtgacagctagtgatgacaccatctgaaaccaaccatactacaggcaagtcagttgatacttacccctctgtagaactggaagtccctgctccctgcagctatgccgacgctgacaggctgatgggccagcgctttcagcaggctgatctcgctgttctccgggacatcctcgaatccagttaggtcttgttcggttattcccaatacacatggattggatgggattggaaaaaattcttaagaagtttgacttgtttggaatttaaacccatccaatcccactcaatccacatggattgagagctaaccgaacaagcccttatagtgacgacgtcagcttggggctaaacacgcacgccagagcaaaggattagaaccctgcgtcctagtatcatccagttcacatgtgaagatttttgtgtgcgaacctgtttctctttgcagtagccttcttccatgaggtacgggtagtcgtcctcggcgtggatcccctggctccccatcatgtaagcgaacgccaagtccatggtccccccttcgcagccgtgatccagcgtggtgtcgcagtccaccagctcctgctccgagagcgacaccagcttgcccgtcacgatctggttgatcccttcgactgctgccaccgacgagaaggcccagcagctccctgcaagcattttttttttgttcgccttgtaatcgcatctcccaccgtctagtggcatctaatcggcacagcaacacgctgagaagaggatggcgttcgtgtattgtccagagacggaactcaccgcattttccctggttcttgaccggcgtcacggctcccttgtacctccagtcgactgaccagggcaagctgcctgcggctgcggccgcgtacctgaacgctgtcggggtgcgtgtctgtggcgcgcccgctcttggcagtgctcgcttcagtcccagataactggccttgaactcctcgtgggcgacgtcggcgaactggttcaggcccagccagtagctcccgttcttcctgttcgtttccgcgatgtgcatcaggttctgcttgaatatctcgtacctctccagcttctccgtcgggctggcgtagagcttgccgtgcttcacggaccaggatctgaagaggctgctgggcagtgcgaggtcttcctgggagtatccgacgacagaggggtctcggtggtggttcgcggaacaggctgcaaacgctaggaacaggacgaacaccgcgaccgcgagtttgggttccatgtcaaatgcctgctgctattttttgcccccttgttgtcatggcatgtgcaggatccaggaacacctttatactgcgaatatctatgtttcttgcaagtaaattccctgcaccagctatggctcttctggatgaagcttctcaagggcagagccttgctttagcaggaagctgttgctgcggccttgcagttgcacgtatgcttctgttccacaagtttcgtccaaggatgctttttcggtgcttctccaatgcctcagatgacgcttaaatcttggttttggtagtatgatgaattatagtaagggtatcttacacttgcagctctgctgcgcacctgttggaggtaacttgctcgaccatgcgaagcagctgcacgatggccttttttagaagatacccaagtatcttttgctcgcctgctccagtcatcactaggcctgcaaatgggggtgagtgtaaatgg

SEQ ID NO: 22115 - DNA, 2779 bp, Zea mays
ggatgtatctttctttttttgaaggatgcagttataaggctgtctccagcagcctattcatcttatctcacatctcatctcatattttaaaattcaccctgcaacattgcaggctacattgtgaaacggtgttttatgtgatcatatgcataatatgccggagataggttgagaaaaagaataaaccgaagctgcatctgtttatttgattaacgtttacttaaaaaaagttgggcagctgcgggcgcaccgaaggatccacatgagaacatggggaggaggcgctgggccaatgaaacttgtctgtccccgcctgctaccgaaacgttttgtcatgtttcggctccgcatcgtacggactagtaggctttaaggtagagctttttcagcaaatgcttctccacagccaatctaccttcacaacacatccgggtggtgcaagactgcaagctctctacataaaaacgtacagtacaagttataccgcacggtggttacacttcatgtctgcggctaccatcgtttttgcggtgatgttttcctacgagagatgttggccgagagaatgcagtcaggacgacccaggaggactgaagaagaaccgcataggcacaggcgctaactctgcagctcgtgcggctcatgtacatggctgcggttcgcaggtccatctccgaccctgacccagcactcggccctcacctatttccctctctccctttttcggttgcttccgctcgccgccgacactgatttttattgaatgcacggcaatggtaggttggggagggactggggggaggttggtggaagaatcagaagagtggtggagctcagcggtaccgtgctcctcattgttttcgtgggcagtattttaggtccggtttcggttactccgtccgtcgtcagcctaacatgcctattccaggacttccggttcagacgccaggggagcactgaccattggacttctctgtagacacaagaaagacacgtgcagatgaactggcatagcaggcaaggaaaacgagctgggtttttttttcagcttcgacgtatcaatatcaataatatcatacggttcgtatacggcgttagatgtgcgtctgcctccttttttctgctggagcatcagttgcatttggatctaacaatggctagttacattacagctcatccaagaaagcgacctgttaaactttcaccagttcacagtatcaccacaaagtacatccgatccgaccacaggcagatgtcaggagggatacgatctggggattgctcatacgcctgacgcctcctcctcaataaaaaccaagcatgaagcttggaagttggaaccactgttacaggatccgcagtgtacgtacatgtgaaccaaacacgaattcacgctctgcctctcttgagaaggtaccggagggagaagtaccccagagcgaaggtctgccagaaccacccggcagcgttcctcgggtcaacccttctcgccaagaaccaggcgtacacggcttcgccagcatgcagtgcgatcgctaccgccaagaccagccggatcacgagcatcgagcggaaaacaaacatgtggacgtcgagcacccatttcaacgggccgactggcgggaggcaggcggcagaaaacacggccagcatcccgatcgttacggccagccaagtaaatatggtcgggccatccagctccattctcttccgctcttgccagtacgagatcgttgcggccaagccttcgtggggcctcacaatgggcacgtagccgagctcctctctagctttcaagaacgaaaagtagtgtgtgacaccaacctgctagcctcatccggggattatttacagatgcctggatattggcattcgtaccttaacctttgtccaacatcaaacaaaaatgttatttgcaagtctgctggcctagtcaggagtagttcagtagagagatcccttgaaaagaactgttttttttttaaaaaaataaactagcaatgaaattgacatgactggtccacttgcatcttctggccattatatgcatatttcaaaactatgctggggtaggttaagtggcaacacaaaggagaacatcaaaattgcacatgacagatgctgaccttgtaaacttcagcggggagaattagaggctgaggcatccatttactatcaagccatgggtagaacagtgtagatatgaataaaaatattcttgaaacggcaagggcaacggaggtatccagcaccacttgaggaacggaataacccaaactttgaaaaaggggcttgatgataaattcaaaagtattgcatggtgatcctgcaaaacacttatagctaagtaaggcaatgaaatgtatagctgcatatataatcaccgtgttctatgtcacagagatctcgagacaccaatttttcaggggacatttctattataaggaagaaaaagtctaaattcttggccttctcaaaagttccgtatttactgggtgtaaaccttacccaaggaacactttgtacttgtattgcgaatagttctgttattcaagtaatggctattggaatcctgggacacctaattatggaaaaatgtactgtgtaaagtagctagtaattacatttttcctcaaacacacaggaggagctgtgtatccttacaaagtggtaaaatacccccccccccccacttccaaaaaaaaaaacaaggaaacacaaacaccaacactcagcctatgaaagtcagaattgcacctttattacaagataagcgacc

SEQ ID NO: 22116 - DNA, 1966 bp, Zea mays
ggcaaggaaaacgagctgggtttttttttatccagcttttacgtatcaataatatcatacggttcatatacggcgttagatgtgcgacagccaccaaatttctgctggaacatccgttgcatttggatctaacaatggctagttacattacagctcatccaagaaggcgacctgttaaactttcaccagttcacagcatcaccacaaagtacatccgaccacaggcctctccgttgcatgtcaggagggatacgatctggggatgctcatacgcctgacgcctcctcctcaataaaaaccaggcatgaagcttggaagttggaaccactgttacaggatccgcactgtacgtacatgtgaatcacacacgaattcacgctctgcctctcttgagaaggtaccggggggagaagtaccccagagcgaaggtctgccagaaccacccggcagcgttcctcgggtcaacccttctcgccaagaaccaggcgtacacggcttcgccagcatgcagtgcgatcgctaccgccaagaccagccggatcacgagcatcgagcggaaaacaaacaggtggacgtcgagcacccatttcaacgggccgacgggcgggaggcaggcggcagaaaacacggccagcatcccgatcgttacggccagccaagtgaatatggtcggaccatccagctcccttctcttccgttcttgccagtacgagatcgttgcggctaagccttcgtggggcctcaccatgggcacgtagccgagctcctccctagctttcaagaacgaaaagtagtgtgtgacaccaaccttgtaaacttcagcggggagaattagaggctggggcatccatttactatcaagccatgggtagaacagtgtagatatgaataaaaatattcttgaaacggcaagggcaacggaggtatccagcaccacttgaggaacggaataacccaaactttgaaaaaggggcttgatgataaattcaaaagtattgcatggtgatccatcgcatatgaaatacgcctgaccagctgctacaggagttcccttcctgtcaggaatgtcatctaaaagtcccatgcttgccaatatcagagcaagaactagattatctatataaacccaatctgtcttgacacctgggtccccaattttgaagaaagctaatcccaactttgcaagggacaggattcttggaaaatgacgctcttcacctggtccatatatagcagcagggcgaattgcacatgtataaagacgagtacttttatcactcttagctggccgcccgttactcttcagtaccagctgttcagcaactgatttgctgcgcccataagcatcaacatggtcttcaatcggaaaataaggcaacgcctcatttccgttgacaatcggctttcctccaaataccacattgtatgtgcttacatacacaagccttctgacaccttgctcatggcaagcgtccagtacattgcaggtcccatttatattaacctcatcagatctcccagtctgcaccatctccttccctgacatgccataagaagcaaggtggaaaacacagtccactccacggaaagcccttcgcacatcatccttctttcttatgtccccttggataattcggacgccggcgtcgaggagctgctgggaccaggaggaggaggcgcggagatcgagggaccggacctcgcgggcaccgcggcggagcagctcgaggctgagggcagctccgacgaagccctgcccgcccgtcaccgcgaatcgcagaccctcgatcccctcgttcgcgctcagatgcatcttctcgccggggtacaggtcgccgccggcggccgacgataacctgggcggtcgccctggtgctactccgtgctgctgccgcctgacctcggacccgcgcgaagcgtcagcacgaagcacgaccaaagaccaactcgatggagtctggactct

SEQ ID NO: 22117 - DNA, 5531 bp, Zea mays
  misc_feature (348)..(348): n is a, c, g, or t
  misc_feature (3793)..(3793): n is a, c, g, or t
gcttagaaaccgaacgccccctaactctgctgttgtttattatttttaagaattattgatagtttgtagcaatttaagtgtattatttatgagaattattgacggtttctagcaatttcaagatgcaaattctgcttgcgaagctgactcgtgtgctctgtatttgtggatcttctgcactgtacacacatttgtcaccatgctagatggcactgatgatagtacggaaatcagttcataaagtgttgtcgttgtctcaaaggggaaaatagaacccaagagaagatggcagatgaacacattttgggacatgtctgtgacagaaaatctgtcaaccagcctagctcnaatggccgacagcgtcccattaggtactgaggctaaaaatggaaaacaaatgccaaggaggggggagggcagcggctctcgtcctggaaatgtggcatggcggtgcggtggagcactggaggttgggcaatgtgacgctttgaagcctacttccctttcctccgtctctgtggtttggtttcaaccccttcgcttcttccgcagaagaacaaggagaaaagggaggtacgccatgagcgcatgaacgaaccaaggatcttcgcgttttaacgcctttttacatcgacttggttcctcgcgcctctgatctcggctctggcggcatttgcattgcaggggttcgtcacgaggaggaggaggaggaggaggtgcgtcgttccaatcgaaccccggcgcacaatctagaggccggggtggatcatcatcctcaccaagacagaactccatccccgttaaggtgttaaacattaatcatggccacaccgccagacggggcgcccgctggacctgatgacacgtcgccgccgccttcttccaactcgtcgacgccgcctccttccgactcatcgacgccgccacccaagtcctccggctcgggctcgccgtcgccatcgccacccgcaccgtcgttgtcgccgccaccaccggcgtcgccgcaggatagcacggcgccagcggccagaggctcgccggccgcgccgtcgagggactccccgtcaccaccggctccaaagcgcagcgacagtgactccgataatagtggcagcagcaagagcggaagcggaagcggaagcagaagcagaagcagcgggtcgacgcaggtggatgtcatcctggccggcgtggtgattggggtcctggcatttagcctgctgatgtgcatcgccgcgtgcgtgtgctgcgccaagaagaagaggaggaagaagcccccgcacatgaacatgccgtactacaccgacgagcacggtacacgctgctgacgacatgcgaatggcgagagtgtggagtaataactgacatggcgcgccgcggcgtgcgtgcgtgcgtgcagggaacgtcttctacgcgaacagcatgcccaagtggcagagcagcgcgatggaccacggctggcacgcgccgtactcgcccgcaagcggggacatgagcggctcgcacgggccggggctgggccagatgccgccctcgccgggcatgccgtcgctgggcttctccaagagctcgttctcgtacgaggagctagccgcggcgacgggcggcttctcatcgacgaacctgctggggcagggcgggttcgggtacgtgtacaagggcgtgctcgcgggcagcggcaaggaggtggccgtgaagcagctcaaggccgggagcgggcagggcgagcgcgagttccaggccgaggtggagatcatcagccgagtccaccaccgccacctcgtctccctcgtaggctactgtatcgccggctcctcccagcgcctgcttgtctacgagttcgtgcccaacaacaccctcgagcaccacctccacggtcagtaccagtatgcggagtttccgcgctggacaatctgagtactcgttatggtgtatcatgattcatgcatgcgtggtgggtgcagggaagggtgtgccggtgatggcctggccggcgaggcttgccatcgccctcggctccgccaagggcttggcttacctgcacgaagattgtaagctccaaattgaccccttaattagttccttgtgttttttatttgacgattttttttgttgtcaaagtatatgtataccccatgttcatctttgccggttttcttgctaatgtgcatggtgacaaattaaggccaccccaggatcatccaccgtgacatcaaggcagccaacatccttctggacgagaatttcgaggctaaggtcgcggatttcggacttgccaagctgaccacagacaccaacacgcacgtctccacgcgtgtcatgggaactttcgggtaagcatcatgcatgccacgcgcaacggcgggcgtgcaaccgtgcagcaaaagaaaggtgccgatcagccatttgcacgtttatgcacgcaggtatttggccccggagtacgcgtcgagcggcaagctcaccgacaagtcggacgtgttctccttcggcgtcatgctcctggagctcattaccggcaggagaccggttgatcccacgaactacatggaggacagcctggtcgactgggtaggctggccatggccgcccctctccgcgctgccttgcattgcattgcagctgcctccgtccgcgcatgctcagttagttctcacacgttcgcggcggtggtgtgcatgcaggccaggcccctcttggcgcgcgcgctgtccgaagacaacttcgacgagctgctcgacccgcggctggagaacagggtcgaccggctggagctggagcggatgtgctcctctgccgcggcggccgtccgccactcagccaagcggcggcccaagatgaaacaggtgaatcgtagcctctgcttccttcgaggcccctactagcctgcgaaacgacgtgacgcgttcgagattttaccctggaggcctggactgatttcgccccgtgcggtgcccccctgtgcggccgtgctttgtgcagatcgtccgtgctctggaaggggacgcgtcgctggacgacctgaacgagggggtgaagcagagcatgatgttcagctccggatcggagtacgactccggggccaactacgcggccaacatcagcaagttcaggaaggtggccttcgagagcagcgagttcagcaacgactacagcgggacaagcgagtacggcgccgactccggggacgcggcgacccagcggcagcaacatcgctgacctcctcgtccgagatgcgtgtgtggtgtacaatatttataccaaggggtcgatgtcgactgtcggatactatcagagatacccaaccctcgatcgtgacagctttagtacatgtaatgatgctcataaaatgtcatgtaacgtacgtatttgtgtgtgaaaaagagctgcttagctatgactggcgaatttcgctgcttagttgtgcaaattttgctggcgggtgtccaaatgcgccgagggattaggaactttccgactccattttactgctctctttgtcccaaattataagccgttctagctagaagagctataagcctataaccagttataatttgaaaatttggaagtagtaaacattcatttgccgttatagtactgataatgcctgtatctctatcatttggcttcctcacatactcctatttattaccctaaacttgttttctaccttccttaaaaacgttgtcctcgtgctatactatacgtcttggtgtgagctccgattggcgggtgatggaaatccaaatggaaaataggcaggctgtttaaacaagaattggtaagaatnagtttacccttagatgtcgtgtcgttgcccttcgaaggatcaagtatcgttcttgctctgaatcctagcagaagcagtgatacatacataatttgtaactaggtgagtacccgtgcgttacaacggtaacatataatatcataatgaattatgtacaaatgtgtgtttcattgttatagtactatgtccgtgcttttttttttttttttttagatacccataaaaatatatgttctatacacatttggatcttctatacacatttagatctcaagatgtcccattccctccaacgaaataagtccaagaaattctgtttgaggcctaaatgacctcagaacaaatgtttacattctgacaaatctttttaagatgctagaacatattcgatctttaaaaagaaccatagattccaatctgaaaaatcagcttgctgacattgccttggctccacggtatcgttgtcactgccacacaggaacatcggtccctcgtagccgccacaatacgccatccctacaaccgcgtgcacaacaacgcaacaaaacggcccgacatatagcaataaaaggcaacagtcaaagacatttactgaaaacaatgttgatgcactaaacacttctggaaaaaaaatgaaggtagtaaatgaaaggcataaacgttgagtaataaaatcaaattcccttggagttggcagtatatattaccactcaactcaataagtgcttttgtgcatatcctacacttctgtcatattgtaatggtgattaagtacgaaatttctagctcaaaacgggtgtagtaggagcaacaaagatgatttactgctataataatagacacctgtcatctccttcaatagaggtaacctcttgcctataataaaagaaataatttttaaaattaaaaatgtgaaacatcataccttttattcagtttaactattcagttaacaacattggttgtgcgagaaactctgggtcagaaacagaactatgaaattatgaagaactaaaaaacaaactaaaaagggtttgtgacagacttcaaaagcagagcaacacataccgccttccccttggttgtgcgaacatgggcgttttggccatcaattcgaaatacctcaccatcaacccaggacaaatctttatcttccacccatatatgagaacctgtgacaatgtttaacattgaagcctacaaaatatgacaagcggcaaatttaacctatgaaattgcattccatgtgggttagcagattaacatacatgcgtatcaaattattgcacctcaatggcctacaaaaagtaagtgggtttcaccgacgaaaacatgtatatcgactacacttcaggtttcttatataataattcaggtccggtcgcatgtaatgtgtagctgattacagcaatgtccatttctaccctgaaactaaaccaggaacaaattacggccttatacagttcatttaatcctcaggagtaattgaaatttacttcattcaactctagagcatattattctaccggattcactcctaagctgtggcaattactaatatgcatgctacatggaacaggtgcctagaacatgacgttggatgcttagtgttgctgctgttcctgccattgtacagttagtacctaaaagctatgctactgagagaaaatattaattgaagaatgcaataagaacatttcattagatttcttgtgtaaaagttcgctcgtttatgtta

SEQ ID NO: 22118 - DNA, 1228 bp, Zea mays
  misc_feature (8)..(8): n is a, c, g, or t
cggaattnttgggcttctggggccgggcgggttcgggtacgtgtacaagggcgtgctcgcggtcagcggcaaggaggtggccgtgaagcagctcaaggccgggagcgggcagggcgagcgcgagttccaggccgaggtggagatcatcagccgagtccaccaccgccacctcgtctccctcgtaggctactgtatcgccggctcctcccagcgcctgcttgtctacgagttcgtgcccaacaacaccctcgagcaccacctccacgggaagggtgtgccggtgatggcctggccggcgaggcttgccatcgccctcggctccgccaagggcttggcttacctgcacgaagattgccaccccaggatcatccaccgtgacatcaaggcagccaacatccttctggacgagaatttcgaggctaaggtcgcggatttcggacttgccaagctgaccacagacaccaacacgcacgtctccacgcgtgtcatgggaactttcgggtatttggccccggagtacgcgtcgagcggcaagctcaccgacaagtcggacgtgttctccttcggcgtcatgctcctggagctcatcaccggcaggagaccggttgatcccacgaactacatggaggacagcctggtcgactgggccaggcccctcttggcgcgcgcgctgtccgaagacaacttcgacgagctgctcgacccgcggctggagaacagggtcgaccggctggagctggagcggatgtgctcctctgccgcggcggccgtccgccactcagccaagcggcggcccaagatgaaacagatcgtccgtgctctggaaggggacgcgtcgctggacgacctgaacgagggggtgaagccagggcagagcatgatgttcagctccggatcggagtacgactccggggccaactacgcggccaacatcagcaagttcaggaaggtggccttcgagagcagcgagttcagcaacgactacagcgggacaagcgagtacggcgccgactccggggacgcggcgacccagcggcagcaacatcgctgacctcctcgtccgagatgcgtgtgtggtgtacaatatttataccaaggggtcgatgtcgactgtcggatactatcagagatacccaaccctcgatcgtgacagctttagtacatgtaaatgactccccctaaaatggcatgtaacgtacgtatttgtggggggcatgttgctgcttgc

SEQ ID NO: 22119 - DNA, 1307 bp, Zea mays
tttttttttttttttccttttttttttttttttttttttttttttttttttttttttagatcggtgcaaaactaaataaataaataaaccaagaggcgacatattccctccgttcttttttatttgtcgcgttttagtttacaaaataaactagtgggcgacaaatatttgagaacaaaggtagtattttggactttacctctatgagtttatgtacatcaaatatactataaactgaaggaaaataaagagggcagcctacaacaaacttcaaatcaactctgtactactttagaaggtaatcaatatagcatgcaggaccacatagaaaggggtgtcgcacttttgagctgcagaggaactgtgggggctaacagttgtgacattcttattgtagaactggatggagataagaccaccatgcattctgactgatgatatagatggcctatggaagcttatgctcgccccgtgccttgagaaaaaccagtgttttatttcatcagcaagccttgccaaagtatgaagaagcataagatgacggtaatgatcaaagccaccaagttcccaatggaagatgctggtttggaattcttcatcttcttcaatgccttcatacgctcaatcctagccttctttaacaccgcaagctccgatagtgcactgatgagcttctgatcagcagggtctaatggtgaagtagtctgtaatcttggaggtcgtggcggcttcttataccattttttattttccttatcaacagttgacttatccaaaatcccaaccttgatctccccttcagctttcataggctctccacttttaacagatgaatcttgacggtgtgaagagaaacaacatatgtggtgactcttatcatccttcagtgctacaagatcatcccatgagctgggccgcattgtacttgcatgcccaactattgaattaaccttcatcccactattgtcctctatgggtagcaagcacttgcctttctccagatcaaccaacatatcttggacacatacttcctttacctccattagaatgacagaaaaatctccaaatgatcaagatgtaggaaaacaacccctcctttctttctagaaatcaaggagctggtgggtgctcgtcgccggcgaagatactgacgaaggccttagcccttagcacctggcacaggacggcggcggcacaccagtcgtcggagagcgagacgggggcgagaccgcgagacaaacggagtcaaccgcggcgcagggacggagcttcgaggtaatggtctcgtgcagtttagtacgttgaat

SEQ ID NO: 22120 - DNA, 3945 bp, Zea mays
  misc_feature (102)..(102): n is a, c, g, or t
  misc_feature (3106)..(3106): n is a, c, g, or t
  misc_feature (3426)..(3426): n is a, c, g, or t
tggcggatcgagtgcgacgagctggccacaaaccttggactgcagccgttctgcatgacgtcggtgaagaggaaaaggaagctgcgctttgtcaacacagtnaaaggctagccatcgcatatgggttgctaaagacaagagcccctcatgtcattcgggtggtgaagaacttgaggttttgccttgattgtcatgaagtggccaaaataataagcaaggcatacaaccgagaaatcgtcgttagggatcgtgttcgtttccacaaatttatgggaggaagttgttcctgtaaggacttttggtgatctttttttcttttcttattaatataatagcaaactaggtgagtgcccgtgcgttgcaacggcaacatataatatcaagatggcttatttttttttttttttttcattgttatagtaccatgtccgtgcacaattatatttaatacccataaaaaaatatatgttctatacacatttggatcttctatacatatttagatctcgagatgtcccattcccttcatcaacaaaataagttcaagaaattttgtttgaggcctaaatgacctcagaacaaatgtttacgttctgacaaatattttttaagatcctagaacataaaagaaccacagattccaatctaaaaatcagcttgccggcattgacttggctccacgacgtcgttgtcactgccacacagaaacatcggtccttcgtagccgccacaatatgcactccatttgtgtgcaaaacaacgcaacaaaacggtccagcatatagcaataaaaggcaacaatcaaagacatttactaaaaacaatgttgatgcactaaacacttttgaaaaaaaaagaatgaaggtagtaaatgaaatgcataaacgttgaggaataaaatcaaattccctaggagttgatggtatatattaccactcaactcaataagtgcttttgtgcataacctacacatctgttgtttctaggcaaagtcaaattaataaagactaatggtattggttagcagagatgcagtagaccagtagaacattgaaggaattagtcaaagaccattttaaaaataactaacaagatattggttgcaaagtgaatgcaagtataactgtagtgaacacatgtcatattgtaatggtcatattgtaatatattaggatgttctagctcaaaacgggtgtagtaggagcaacaaagatgatttactgctataataatagacacctgtcatctccttcagtagaggtaacctctagcctataataatagaaataatttttaaaattaaaaatgtgaaacatcataccttttattcagtttaactattcagttaacaacattggttgtgcgagaaactctgggccagaaacagaactatgaaattatgaagaactaaaaaacaaactaaacaggggtgtgacagacttcaaaagcagagcaacacataccgccttccccttggttgtgcgaacatgggcgttttggccatcaattcgaaatacctcaccatcaaccctggacaaatctttatcttccacccatatatgagaacctgtgacaatgtttaacattgaagcctacaaaatatgacaagcggcaaatttaacctgtgaaattgcattccatgtgggttagcagattaacatacatgggtatcaaattattgcacctcaatggcctacaaaaagtaagtgggtttcaccgacgaaaacatgtatatcgactacacttcaggtttcttatataataattcaggtccggtcgcatgtaatgtgtagctgattacagcaatgtccatttctaccctgaaactaaaccaggaacaaattacggccttatacagttcatttaatcctcaggagtaactgaaatttacttcattcaactctagagcatattattctaccggattcactcctaagctgtggcaattactaatatgcatgctacatggaacaggtgcctagaacatgacgttggatgcttagtgttgctgctgttcctgccattgtacagttagtacctaaaagctatgctactgagagaaaatattaattgaagaatgcaataagaacatttcattagatttcttgtgtaaaagttcgctcgtttatgttaattattatctgtttgagaagatattagacttgtctagggtaaacaagaggggcctttatcaaatccgtcgatcttgcttcaactcacttgtttctgtcccagcattggtggcattaacctctacaacaagtgaacaactcaaaggaagtgatttcttaaaagtggtaggtacattaactattggatgtttacagttgaacctactaaaacatctagacaaatttattccagagtaggctttgtagctattcttattaaaacctgggagaaccttcactcgtgctttatagtgatgcttgctaaaacctgggaaaaccatttaaggaggtaatatggtggtatgaaaacagaaaaaaaaacacgtaaatcttcacatactttatttgataagaagttggactttagataagtatgtcggcaataggcaaataattttcactcttacatacgaggacgttggtgacgaagtagtctcggtcgagcctacaatccgcggcggcgccccgacctgccgcacctcgatccacagtggccgtctgaaccgtggacgaagcttgcgatcctcaggccgtctgaaccgtggacaaagcttgcgatcctcagcttggtggctttctgtgctcgagggggaaatgaaaaataaacagcaattcagatgacagagtaaatgaacgaacaaaacagccttgtgaaagctgctgatgaacacgcatgaagtatgatcctctcgatggcgttccctcaatctcaactgtttgcagctttgctagatcactgcgattctttgattttttttctctgtgtttgatgagggcgctgcaacgttgacaattgaacatcgattcagcgtggtagcataaacaaagagacgctgatagctaccttgatcgttggatgggatccctctgccatagggatgtcagtcctgccaacagcctccagctcaagcacacacatcagaagcaaatgtganccgcggtcggagtgggtggaacagacgagcagggtgggggagagagaggaaggaaggtaggcggcggcaccaggtggagcgcgttgcgcgtggcgagggcggtgtggacgttgccgaaggtagtggtgaggcccaacacctccagcttcggcgaccgcagcgccaggaagatggccatcgtgtcatctgctccgtcgaacagtggttcggttcggtcagtggactgcgatccgaacaccacaacaagaagaagcaccatggatggaagccggcgcggtcgggggaccagggcgcggctgccatggattggtcacggcagnccatggctggaagttttgtggacgagattcgcgacggatttggtagaccgacgagattcgcggccagcgcgtggagaaaggcagaaccgtgcaccaattttgagtgtggacgcctacgttaggtacataagtagtagtagagaagtagaagagatgggaactggatggctgaccatatttacttggttgagtgtaacaactggaatgttggctatgttttgtgccgctttgtcttgaaaaaacaagtaacaaaaaagcttagttttagagaaggcatgctacaatgtttttagaagttttgcgcccctgttcagcatacctgatgagatttagagggaaggataatatgtgcaatattttcctggtggtatgttttgggcggacatctgtaaatcagatattttctttatgatgttaaaattaacttctgatcaatttggataagtgcaacgtagtaaggtctcgttctgttccatcaaatgcaatatttagaacaagaataaaatcaatcccggacga

SEQ ID NO: 22121 - DNA, 902 bp, Zea mays
  misc_feature (876)..(876): n is a, c, g, or t
tttttggagttttttttttttttttttttttttttttttttttttttttttttttttttttttacacacaatcatttttgatccccataaaaaatatatgttctatacacatttagatcttgagatgtctcgttccctccaacgaaataagtccaagaaattttgtttgaggcttaaatgacctcaaaacaaatgtttacattctgacaaatcttttaaagatgctagaacatattcgatctttaaaaagaaccataggttccaatctgaaaaatcagcttgccgacattgacttggctccacggtgtcgttgtcaccaccacacaggaaaatcggtctctcgtagccgccacaatgtgccctccctacaacaaaaacatgttagtattattgttaatgaaaacgtggtctaattagttgcgccaacaaacaaattaactttatttctccacaactctctctactgaataatgctaatcgagggcaggtttttttatgttggtgttctggacatataataaactaaggcaaaagcgtatgagcacatgtgacagttggagaggaaatggagaagagctatatactaagaacacttgcaatcatgtttcaggcagtagtaaacctgtcaaatcactgctacttgtagcttcaaggtacttgatcaaactcggtttaatattgaggaattattgcacagctaaagtaagcattgaccccctaccgaaaacagtaagcagcagcatgataaattctttcagacaatcaaagtcagattagtgttgataccttaaacctctgaaaaagattatatgaatgtagtagcatgcatggttcttccttctagccctgcccacacccacacccacacaagagttnctacctgggtgctgtgtaaagtacag

SEQ ID NO: 22122 - DNA, 3459 bp, Zea mays
  misc_feature (1620)..(1620): n is a, c, g, or t
  misc_feature (3057)..(3057): n is a, c, g, or t
  misc_feature (3092)..(3092): n is a, c, g, or t
  misc_feature (3375)..(3375): n is a, c, g, or t
  misc_feature (3379)..(3379): n is a, c, g, or t
cctttttgtaggggtataaactataaagttcagagagcctagaggtgattgatgggatggaggcaaggagagtttgtgccagatgatgcaaacaaggaaatctattgactggttaagacgactgttgagatggcaagcaatggattctggtgggttatacctttcgacagagattccgcatggtgaagcttaaaattatgatgaagcttcctcagctgctgtttatcgaaaaagctacatgataaaaatatatcattttggcatatgtcttcgcttttcccaatcccatttgcttccggtctcatcacctctgacatgctcagtaaggatcactcctgcattctaaaaactaggatcacccttaaggagcaatattaagatgtgtcacttagcttaaagtattttgagataatttccttgaagcattcatgatttgtagtttcttttgtatggtaaaattatcttagaaacagttttgatgttcacattaacttcaagatgctactgaacatggtggggaaaaagtaagtggaggaggagaatccaaataatggcttgtcagctaactggggaacttagaaagtaagtagctgcatagttcaatacctgaattgtttttcgtgctcgcagaatggctgcctttggtagcatgataggcaaacttttgtcaatgccactattttcattgatttaaatgacttctttacataaaaggtttctgcaatttctgtctaccagttggatgtagcttctaaaactagtgaaaatgcagagaatcaaggaggtcaaggctgtaagcctgtaagaaattagtatagttgtatgaacgactcaattaacaacaaatagtacttttgtatgttgtagttttcgaaatctcggctgcgagtaccttcccatttccattaaaaaaaagagttgtggctatacttatgaaattcagaatggtatttatatttgtttcctgaatgtcacatagtccatgattatgagatgtctaaaccgaaggcacatatatataaatatggcgccggaattcgcttgcgtgctccgactaaatgcggcaatcaccggatgaatcaatggaatcgaagaacatctgtactctgggtataagaggaaccaacgctggaatcggcactggggataaataacggcaaacaggagcaccggcgaagtgtgattggcgagcggcaatcaagcggcaaacaggagcaccggtgatgtgcttgagacggggaaggaaatccttgggctgcaagcctgcaacaatgcaataggcgaagaaaacccacaaaatgtcgaagttgctagtggactctatcgcaaaaaaaaaaaaaaaaatatcgaagttgctgttgggctctatcgcaaaaaatagaaataaaaaaaaataaatgcggtgaacgtggatcgaacacgtgaccttcagatcttcagtctgacgctctcccaactgagctatccccgcaatggttatatttttcaaactatcatatataaattatataattctgcataaatagcataattatttgcttactttgttgtacatcaaagtgtgtttttattttattaactgtgattatcatttctcaatgtgctcccgctccaatgatnaaaacaaactcagtatacgtatcacgtctaattaaaaacaatccgttcacgctctcccaactgagctatcctcgcaatggttacattttttaaactatcatatatatatataattctgcataaatagcataattattggcttgctttgttgtacatcaaagtgtgtttttattttattgactgtgattatcatttctcaatgtgctcccgctccaatgatcaaaacaaactcagtatatgtatcatgtctaattaaaaacaatccgttcagatcttcagtctgacgctctcccaactgagctatccccgcaatggttatattttttaaactatcatatatatattatacaattctgcataaatagcataattatttgcttgctttgttgtacattaaagtgtgttttttattttattgactgtgattatcatttctcaatgtgctcccgctccaatgatcgaaacaaactcagtatacgtatcacgtctaattaaaaacaatccgttcagatcttcagtctgacgctctcccaactaagctatccccacaatggttatattttttaaactatcatatatatatatatatatatatatatatatatatatatatatatatatatatatataatacaattctgcataaatagcataattatttgatttttttgttgtacatcaaagtgtgtttttatattattgactataattatcatttctcaatgtgctcccgctccaatgatcgaaacaaactcagtatatgtattacgtctaattaaaagcaatccaatgtgtatcaagcttttcaatattttttcccacatatgtacactagaaaaacgatatactacttcgagcttgtacagtttagctaccatatattatactaggtgagtgtccgtgcgttgcaacggcaacatataataccatgatgaattatgtacaaatgtgtgttttattgttgtagtaaaatattcgtgcttggcacacaatcatgtttgatacccataaaaatatatgttctatacacatttggatcttctatacacatttagatctcgagatgtcccattccctccaacgaaataagtccaagaaattctgtttgaggcctaaatgacctcagaacaaatgtttacattctgacaaatctttttaagatgctagaacatattcgatctttaaaaagaaccatagattccaatctgaaaaatcagcttgctgacattgccttggctccacggtgtcgttgtcaccgccacacaggaacatcggtccctcgtagccgccacaatacgccatcccgccttccccttggttgtgcgaacatgggcgttttggccatcaattcgaaatacctcaccatcaaccctggacaaatctttatcttccacccatatatgagaacctttatcaaatctgtcgatcgtgctgcgnacgttggtgacgaagtagtctcggccgagcctacnatccgcggcgacgccccgacctgccgcacctcgatccacagtggccgtctgaaccgtggacgaagcttgcgatcctcaggccgtttgaaccgtggacaaagcttgcgatcctcagcttggtggctttctggagaaaaaagtagatgaagacagtgaaagggctattccctgccgtctcatccctaaaatattaggggggcattcatgtagtccccaagtggaatgtattaatgatgccagcatcacttaacttggacttgccaggtcacaaattttcaagggnaagncccactgggggttgctcgcttgggctcctttcaatcaacagcaggccttagtagcaataacagcaaccgaacattaaatc

SEQ ID NO: 22123 - DNA, 606 bp, Zea mays
actatgtacgtgctttacacacaattatatttgatacccataaaaaatatatgttctatacacatttagatctcgagatgtctcgctccctccaacgaaataagtccaagaaattttgtttgaggcttaaatgacctcaaaacaaatgtttacattctgacaaatcttttaaagatgctataacatattcgatctttaaaaagaaccataggttccaatctgaaaaatcagcttgccgacattgacttggctccacggtgtcgctgtcaccaccacacaggaaaatcggtctctcgtagccgccacaatgtgccctccaatcatgtttcaggcagtagtaaacctgtcaaatcactgctacttgtagcttcaaggtacttgatcaaactcggtttaatattgaggaattattgcacagctaaagtaagcattgaccccctaccgaaaacagtaagcagcagcatgataaattctttcagacaatcaaagtcagattagtgttgatatcttaaacctctgaaaaagattatatgaatgtagtagcatgcatggctcttccttctagccctgcccacacccacacccacacaagagttcctcctgggt
